United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 49

SEQ ID NO: 1749399 - RNA, 20 nt, Salmonella enterica enterica serovar Typhi Ty2
gucuggcagcggcaguaaau

SEQ ID NO: 1749400 - RNA, 13 nt, Salmonella enterica enterica serovar Typhi Ty2
gucugcuggccaa

SEQ ID NO: 1749401 - RNA, 15 nt, Salmonella enterica enterica serovar Typhi Ty2
gucugcuucgucugg

SEQ ID NO: 1749402 - RNA, 23 nt, Salmonella enterica enterica serovar Typhi Ty2
gucugcugggcgauuucacgaau

SEQ ID NO: 1749403 - RNA, 18 nt, Salmonella enterica enterica serovar Typhi Ty2
gucuggguuugcagcaga

SEQ ID NO: 1749404 - RNA, 19 nt, Salmonella enterica enterica serovar Typhi Ty2
gucugguacggccaccagg

SEQ ID NO: 1749405 - RNA, 20 nt, Salmonella enterica enterica serovar Typhi Ty2
gucugguaucugucaugcgg

SEQ ID NO: 1749406 - RNA, 13 nt, Salmonella enterica enterica serovar Typhi Ty2
gucugucaggacu

SEQ ID NO: 1749407 - RNA, 19 nt, Salmonella enterica enterica serovar Typhi Ty2
gucuccugaacuuuuugca

SEQ ID NO: 1749408 - RNA, 18 nt, Salmonella enterica enterica serovar Typhi Ty2
gucuccucgccagcuacc

SEQ ID NO: 1749409 - RNA, 23 nt, Salmonella enterica enterica serovar Typhi Ty2
gucucuuuagaaaaagaaaccuc

SEQ ID NO: 1749410 - RNA, 16 nt, Salmonella enterica enterica serovar Typhi Ty2
gucucuuuauugaaaa

SEQ ID NO: 1749411 - RNA, 19 nt, Salmonella enterica enterica serovar Typhi Ty2
gucugaagaaguucuucug

SEQ ID NO: 1749412 - RNA, 17 nt, Salmonella enterica enterica serovar Typhi Ty2
gucucugagaucaaaca

SEQ ID NO: 1749413 - RNA, 19 nt, Salmonella enterica enterica serovar Typhi Ty2
gucucucgugcaggccgga

SEQ ID NO: 1749414 - RNA, 16 nt, Salmonella enterica enterica serovar Typhi Ty2
gucugcaaaauuugug

SEQ ID NO: 1749415 - RNA, 22 nt, Salmonella enterica enterica serovar Typhi Ty2
gucugcaaaauuuguggugguc

SEQ ID NO: 1749416 - RNA, 23 nt, Salmonella enterica enterica serovar Typhi Ty2
gucugauugccggaugacgcuuc

SEQ ID NO: 1749417 - RNA, 22 nt, Salmonella enterica enterica serovar Typhi Ty2
gucugauaagcgcagcgccauc

SEQ ID NO: 1749418 - RNA, 15 nt, Salmonella enterica enterica serovar Typhi Ty2
gucugcaagagaaau

SEQ ID NO: 1749419 - RNA, 22 nt, Salmonella enterica enterica serovar Typhi Ty2
gucugaaggcguaugaaugaaa

SEQ ID NO: 1749420 - RNA, 20 nt, Salmonella enterica enterica serovar Typhi Ty2
gucugacaacuauugcugcc

SEQ ID NO: 1749421 - RNA, 14 nt, Salmonella enterica enterica serovar Typhi Ty2
gucugauaaacgca

SEQ ID NO: 1749422 - RNA, 16 nt, Salmonella enterica enterica serovar Typhi Ty2
gucugcgcgcuggugu

SEQ ID NO: 1749423 - RNA, 14 nt, Salmonella enterica enterica serovar Typhi Ty2
gucugcgcgcuggu

SEQ ID NO: 1749424 - RNA, 20 nt, Salmonella enterica enterica serovar Typhi Ty2
gucugcccggcaaccugagc

SEQ ID NO: 1749425 - RNA, 19 nt, Salmonella enterica enterica serovar Typhi Ty2
gucugccaugccuuugacu

SEQ ID NO: 1749426 - RNA, 14 nt, Salmonella enterica enterica serovar Typhi Ty2
uaaaucugccguca

SEQ ID NO: 1749427 - RNA, 19 nt, Salmonella enterica enterica serovar Typhi Ty2
uaaaucaauagauuauucg

SEQ ID NO: 1749428 - RNA, 16 nt, Salmonella enterica enterica serovar Typhi Ty2
uaaauaugaaagagaa

SEQ ID NO: 1749429 - RNA, 17 nt, Salmonella enterica enterica serovar Typhi Ty2
uaaaugcuugcuuuagc

SEQ ID NO: 1749430 - RNA, 13 nt, Salmonella enterica enterica serovar Typhi Ty2
uaaauaauuuugu

SEQ ID NO: 1749431 - RNA, 22 nt, Salmonella enterica enterica serovar Typhi Ty2
uaaauacaccaaacgaauuuaa

SEQ ID NO: 1749432 - RNA, 18 nt, Salmonella enterica enterica serovar Typhi Ty2
uaaauagacuguugaaag

SEQ ID NO: 1749433 - RNA, 14 nt, Salmonella enterica enterica serovar Typhi Ty2
uaaauagcaauuau

SEQ ID NO: 1749434 - RNA, 17 nt, Salmonella enterica enterica serovar Typhi Ty2
uaaauagcaauuauauu

SEQ ID NO: 1749435 - RNA, 14 nt, Salmonella enterica enterica serovar Typhi Ty2
uaaauagccagcau

SEQ ID NO: 1749436 - RNA, 12 nt, Salmonella enterica enterica serovar Typhi Ty2
uaaauaaacagc

SEQ ID NO: 1749437 - RNA, 15 nt, Salmonella enterica enterica serovar Typhi Ty2
uaaauaaaaauuccc

SEQ ID NO: 1749438 - RNA, 23 nt, Salmonella enterica enterica serovar Typhi Ty2
uaaaggucggcugcccugcggua

SEQ ID NO: 1749439 - RNA, 18 nt, Salmonella enterica enterica serovar Typhi Ty2
uaaagacgguaaucagac

SEQ ID NO: 1749440 - RNA, 19 nt, Salmonella enterica enterica serovar Typhi Ty2
uaaagaaugaaaaaaaaau

SEQ ID NO: 1749441 - RNA, 15 nt, Salmonella enterica enterica serovar Typhi Ty2
uaaagaccggcacaa

SEQ ID NO: 1749442 - RNA, 21 nt, Salmonella enterica enterica serovar Typhi Ty2
uaaacuucacgucgcucacau

SEQ ID NO: 1749443 - RNA, 20 nt, Salmonella enterica enterica serovar Typhi Ty2
uaaagccucucguaagagag

SEQ ID NO: 1749444 - RNA, 19 nt, Salmonella enterica enterica serovar Typhi Ty2
uaaagccgccgugcucacu

SEQ ID NO: 1749445 - RNA, 13 nt, Salmonella enterica enterica serovar Typhi Ty2
uaaagccuucaug

SEQ ID NO: 1749446 - RNA, 15 nt, Salmonella enterica enterica serovar Typhi Ty2
uaaagcgaauaacau

SEQ ID NO: 1749447 - RNA, 19 nt, Salmonella enterica enterica serovar Typhi Ty2
uaaagcgcucguuauaauu

SEQ ID NO: 1749448 - RNA, 21 nt, Salmonella enterica enterica serovar Typhi Ty2
uaaagcgcgggccugccuguu

SEQ ID NO: 1749449 - RNA, 23 nt, Salmonella enterica enterica serovar Typhi Ty2
uaaagcauagcgucaucaacaua

SEQ ID NO: 1749450 - RNA, 13 nt, Salmonella enterica enterica serovar Typhi Ty2
uaaagcagugcag

SEQ ID NO: 1749451 - RNA, 17 nt, Salmonella enterica enterica serovar Typhi Ty2
uaaagcacugguggaau

SEQ ID NO: 1749452 - RNA, 16 nt, Salmonella enterica enterica serovar Typhi Ty2
uaaagcacaagaacuu

SEQ ID NO: 1749453 - RNA, 22 nt, Salmonella enterica enterica serovar Typhi Ty2
uaaagcacaagaacuuaaauua

SEQ ID NO: 1749454 - RNA, 19 nt, Salmonella enterica enterica serovar Typhi Ty2
uaaagcccgguucaccguu

SEQ ID NO: 1749455 - RNA, 14 nt, Salmonella enterica enterica serovar Typhi Ty2
uaaagcccugacag

SEQ ID NO: 1749456 - RNA, 15 nt, Salmonella enterica enterica serovar Typhi Ty2
uaaagccaauccaga

SEQ ID NO: 1749457 - RNA, 21 nt, Salmonella enterica enterica serovar Typhi Ty2
uaaaccggucucuuaaugcca

SEQ ID NO: 1749458 - RNA, 15 nt, Salmonella enterica enterica serovar Typhi Ty2
uaaaccguuuuuccg

SEQ ID NO: 1749459 - RNA, 15 nt, Salmonella enterica enterica serovar Typhi Ty2
uaaaccguuaugaau

SEQ ID NO: 1749460 - RNA, 19 nt, Salmonella enterica enterica serovar Typhi Ty2
uaaaccgucauuuaccagu

SEQ ID NO: 1749461 - RNA, 17 nt, Salmonella enterica enterica serovar Typhi Ty2
uaaaccaaacuuaucuc

SEQ ID NO: 1749462 - RNA, 10 nt, Salmonella enterica enterica serovar Typhi Ty2
uaaaaugacc

SEQ ID NO: 1749463 - RNA, 12 nt, Salmonella enterica enterica serovar Typhi Ty2
uaaacgucccug

SEQ ID NO: 1749464 - RNA, 16 nt, Salmonella enterica enterica serovar Typhi Ty2
uaaacguaggccgggc

SEQ ID NO: 1749465 - RNA, 15 nt, Salmonella enterica enterica serovar Typhi Ty2
uaaacgugccacagu

SEQ ID NO: 1749466 - RNA, 14 nt, Salmonella enterica enterica serovar Typhi Ty2
uaaacggucaggau

SEQ ID NO: 1749467 - RNA, 15 nt, Salmonella enterica enterica serovar Typhi Ty2
uaaacgcaacaccau

SEQ ID NO: 1749468 - RNA, 13 nt, Salmonella enterica enterica serovar Typhi Ty2
uaaacguuccugc

SEQ ID NO: 1749469 - RNA, 14 nt, Salmonella enterica enterica serovar Typhi Ty2
uaaacguuccugcc

SEQ ID NO: 1749470 - RNA, 16 nt, Salmonella enterica enterica serovar Typhi Ty2
uaaacgugcuggaugg

SEQ ID NO: 1749471 - RNA, 20 nt, Salmonella enterica enterica serovar Typhi Ty2
uaaaccuguuuguuuauugu

SEQ ID NO: 1749472 - RNA, 19 nt, Salmonella enterica enterica serovar Typhi Ty2
uaaacgaucgguuaucacg

SEQ ID NO: 1749473 - RNA, 18 nt, Salmonella enterica enterica serovar Typhi Ty2
uaaacgagcgcaauaaca

SEQ ID NO: 1749474 - RNA, 12 nt, Salmonella enterica enterica serovar Typhi Ty2
uaaaccucuuug

SEQ ID NO: 1749475 - RNA, 22 nt, Salmonella enterica enterica serovar Typhi Ty2
uaaauuuaugguuccugaaaua

SEQ ID NO: 1749476 - RNA, 14 nt, Salmonella enterica enterica serovar Typhi Ty2
uaaauuuacucagu

SEQ ID NO: 1749477 - RNA, 22 nt, Salmonella enterica enterica serovar Typhi Ty2
uaaauuucaacccgaucgccau

SEQ ID NO: 1749478 - RNA, 21 nt, Salmonella enterica enterica serovar Typhi Ty2
uaaauuuccucuugucaggca

SEQ ID NO: 1749479 - RNA, 17 nt, Salmonella enterica enterica serovar Typhi Ty2
uaaauuuccgcagccag

SEQ ID NO: 1749480 - RNA, 18 nt, Salmonella enterica enterica serovar Typhi Ty2
uaaauuuccgcagccaga

SEQ ID NO: 1749481 - RNA, 12 nt, Salmonella enterica enterica serovar Typhi Ty2
uaacacaugcaa

SEQ ID NO: 1749482 - RNA, 19 nt, Salmonella enterica enterica serovar Typhi Ty2
uaacacacaguugccuucg

SEQ ID NO: 1749483 - RNA, 17 nt, Salmonella enterica enterica serovar Typhi Ty2
uaacacacuuucugcuu

SEQ ID NO: 1749484 - RNA, 17 nt, Salmonella enterica enterica serovar Typhi Ty2
uaacaaaucacaaggaa

SEQ ID NO: 1749485 - RNA, 11 nt, Salmonella enterica enterica serovar Typhi Ty2
uaacaaaucau

SEQ ID NO: 1749486 - RNA, 20 nt, Salmonella enterica enterica serovar Typhi Ty2
uaacaaauuaaauccugaaa

SEQ ID NO: 1749487 - RNA, 14 nt, Salmonella enterica enterica serovar Typhi Ty2
uaacaaugccucga

SEQ ID NO: 1749488 - RNA, 15 nt, Salmonella enterica enterica serovar Typhi Ty2
uaacaauuuaucaga

SEQ ID NO: 1749489 - RNA, 14 nt, Salmonella enterica enterica serovar Typhi Ty2
uaaauuacuuauga

SEQ ID NO: 1749490 - RNA, 14 nt, Salmonella enterica enterica serovar Typhi Ty2
uaaauuaacaccca

SEQ ID NO: 1749491 - RNA, 13 nt, Salmonella enterica enterica serovar Typhi Ty2
uaaauucgcuacg

SEQ ID NO: 1749492 - RNA, 20 nt, Salmonella enterica enterica serovar Typhi Ty2
uaaauuuaacucguccuguu

SEQ ID NO: 1749493 - RNA, 12 nt, Salmonella enterica enterica serovar Typhi Ty2
uaaauugguuau

SEQ ID NO: 1749494 - RNA, 22 nt, Salmonella enterica enterica serovar Typhi Ty2
uaaccggacgauuuaagcuuaa

SEQ ID NO: 1749495 - RNA, 12 nt, Salmonella enterica enterica serovar Typhi Ty2
uaaccgcuuuuu

SEQ ID NO: 1749496 - RNA, 20 nt, Salmonella enterica enterica serovar Typhi Ty2
uaaccgcgcaaucaaaacau

SEQ ID NO: 1749497 - RNA, 16 nt, Salmonella enterica enterica serovar Typhi Ty2
uaaccgccuccgacaa

SEQ ID NO: 1749498 - RNA, 23 nt, Salmonella enterica enterica serovar Typhi Ty2
uaaccgcuaaacagcaaaucggg

SEQ ID NO: 1749499 - RNA, 15 nt, Salmonella enterica enterica serovar Typhi Ty2
uaaccgcaaaugcca

SEQ ID NO: 1749500 - RNA, 18 nt, Salmonella enterica enterica serovar Typhi Ty2
uaaccgauaacgcggccc

SEQ ID NO: 1749501 - RNA, 17 nt, Salmonella enterica enterica serovar Typhi Ty2
uaaccguggcggcagug

SEQ ID NO: 1749502 - RNA, 22 nt, Salmonella enterica enterica serovar Typhi Ty2
uaacgaaaagggucauaaccgg

SEQ ID NO: 1749503 - RNA, 17 nt, Salmonella enterica enterica serovar Typhi Ty2
uaacgacgcuccagaau

SEQ ID NO: 1749504 - RNA, 17 nt, Salmonella enterica enterica serovar Typhi Ty2
uaacgacaaaaauacca

SEQ ID NO: 1749505 - RNA, 20 nt, Salmonella enterica enterica serovar Typhi Ty2
uaacgauuuccccuguacac

SEQ ID NO: 1749506 - RNA, 15 nt, Salmonella enterica enterica serovar Typhi Ty2
uaacgauuuccccug

SEQ ID NO: 1749507 - RNA, 23 nt, Salmonella enterica enterica serovar Typhi Ty2
uaacgcacuggucgggcaggcuu

SEQ ID NO: 1749508 - RNA, 17 nt, Salmonella enterica enterica serovar Typhi Ty2
uaacgcacuuuuccagc

SEQ ID NO: 1749509 - RNA, 22 nt, Salmonella enterica enterica serovar Typhi Ty2
uaacgcaacggaaggaaauaac

SEQ ID NO: 1749510 - RNA, 23 nt, Salmonella enterica enterica serovar Typhi Ty2
uaacgcaggcgauagccccagua

SEQ ID NO: 1749511 - RNA, 22 nt, Salmonella enterica enterica serovar Typhi Ty2
uaacgcagaauauuuuucucag

SEQ ID NO: 1749512 - RNA, 21 nt, Salmonella enterica enterica serovar Typhi Ty2
uaacgcuguaccggcagguga

SEQ ID NO: 1749513 - RNA, 14 nt, Salmonella enterica enterica serovar Typhi Ty2
uaacgcugcaaagu

SEQ ID NO: 1749514 - RNA, 20 nt, Salmonella enterica enterica serovar Typhi Ty2
uaacagagagggaaaaaaau

SEQ ID NO: 1749515 - RNA, 18 nt, Salmonella enterica enterica serovar Typhi Ty2
uaacagagagggaaaaaa

SEQ ID NO: 1749516 - RNA, 22 nt, Salmonella enterica enterica serovar Typhi Ty2
uaacagacgcaucuuuuucccg

SEQ ID NO: 1749517 - RNA, 23 nt, Salmonella enterica enterica serovar Typhi Ty2
uaacaccgcauggcuggcauauu

SEQ ID NO: 1749518 - RNA, 19 nt, Salmonella enterica enterica serovar Typhi Ty2
uaacagacgcaucuuuuuc

SEQ ID NO: 1749519 - RNA, 19 nt, Salmonella enterica enterica serovar Typhi Ty2
uaacagcgcgaccagcgug

SEQ ID NO: 1749520 - RNA, 19 nt, Salmonella enterica enterica serovar Typhi Ty2
uaacagccgcggaccuuuu

SEQ ID NO: 1749521 - RNA, 19 nt, Salmonella enterica enterica serovar Typhi Ty2
uaacaugcuggauucaguu

SEQ ID NO: 1749522 - RNA, 15 nt, Salmonella enterica enterica serovar Typhi Ty2
uaacauuucagucua

SEQ ID NO: 1749523 - RNA, 18 nt, Salmonella enterica enterica serovar Typhi Ty2
uaacauuuaagaaacaau

SEQ ID NO: 1749524 - RNA, 18 nt, Salmonella enterica enterica serovar Typhi Ty2
uaaccagcgcgccgccaa

SEQ ID NO: 1749525 - RNA, 18 nt, Salmonella enterica enterica serovar Typhi Ty2
uaaccccugcgcggccug

SEQ ID NO: 1749526 - RNA, 15 nt, Salmonella enterica enterica serovar Typhi Ty2
guuuuuauuuuucuu

SEQ ID NO: 1749527 - RNA, 15 nt, Salmonella enterica enterica serovar Typhi Ty2
guuuuuaucuuucuu

SEQ ID NO: 1749528 - RNA, 13 nt, Salmonella enterica enterica serovar Typhi Ty2
guuuuuauacauu

SEQ ID NO: 1749529 - RNA, 14 nt, Salmonella enterica enterica serovar Typhi Ty2
guuuuucucaucaa

SEQ ID NO: 1749530 - RNA, 14 nt, Salmonella enterica enterica serovar Typhi Ty2
guuuuucuuccugu

SEQ ID NO: 1749531 - RNA, 15 nt, Salmonella enterica enterica serovar Typhi Ty2
guuuuugaacauugc

SEQ ID NO: 1749532 - RNA, 16 nt, Salmonella enterica enterica serovar Typhi Ty2
guuuuucccgcuggcu

SEQ ID NO: 1749533 - RNA, 19 nt, Salmonella enterica enterica serovar Typhi Ty2
guuuuuccccguugcucau

SEQ ID NO: 1749534 - RNA, 14 nt, Salmonella enterica enterica serovar Typhi Ty2
guuuuucaucauca

SEQ ID NO: 1749535 - RNA, 15 nt, Salmonella enterica enterica serovar Typhi Ty2
guuuugucaucagau

SEQ ID NO: 1749536 - RNA, 16 nt, Salmonella enterica enterica serovar Typhi Ty2
guuuugcugucugggu

SEQ ID NO: 1749537 - RNA, 18 nt, Salmonella enterica enterica serovar Typhi Ty2
guuuuggguaaauaccag

SEQ ID NO: 1749538 - RNA, 20 nt, Salmonella enterica enterica serovar Typhi Ty2
guuuugguaucuucugacgg

SEQ ID NO: 1749539 - RNA, 18 nt, Salmonella enterica enterica serovar Typhi Ty2
guuuugcugauaugaaac

SEQ ID NO: 1749540 - RNA, 15 nt, Salmonella enterica enterica serovar Typhi Ty2
guuuugcuggaauuu

SEQ ID NO: 1749541 - RNA, 22 nt, Salmonella enterica enterica serovar Typhi Ty2
guuuugcaggaaaaacuguccc

SEQ ID NO: 1749542 - RNA, 18 nt, Salmonella enterica enterica serovar Typhi Ty2
guuuugccaguuucucaa

SEQ ID NO: 1749543 - RNA, 11 nt, Salmonella enterica enterica serovar Typhi Ty2
uaaaaaacagg

SEQ ID NO: 1749544 - RNA, 12 nt, Salmonella enterica enterica serovar Typhi Ty2
uaaaaaacauca

SEQ ID NO: 1749545 - RNA, 19 nt, Salmonella enterica enterica serovar Typhi Ty2
uaaaaaacaucauaauaau

SEQ ID NO: 1749546 - RNA, 17 nt, Salmonella enterica enterica serovar Typhi Ty2
uaaaaaauccugcacuu

SEQ ID NO: 1749547 - RNA, 21 nt, Salmonella enterica enterica serovar Typhi Ty2
uaaaaaaggggagucgguacu

SEQ ID NO: 1749548 - RNA, 15 nt, Salmonella enterica enterica serovar Typhi Ty2
uaaaaaagaggaaug

SEQ ID NO: 1749549 - RNA, 21 nt, Salmonella enterica enterica serovar Typhi Ty2
uaaaaaagccguauuuuauuu

SEQ ID NO: 1749550 - RNA, 18 nt, Salmonella enterica enterica serovar Typhi Ty2
uaaaaaagucacuuacuu

SEQ ID NO: 1749551 - RNA, 23 nt, Salmonella enterica enterica serovar Typhi Ty2
uaaaaaaggcagaagaaucugcc

SEQ ID NO: 1749552 - RNA, 19 nt, Salmonella enterica enterica serovar Typhi Ty2
uaaaaaaauaaaaaaggca

SEQ ID NO: 1749553 - RNA, 22 nt, Salmonella enterica enterica serovar Typhi Ty2
uaaaaaaaccucuaccuacaca

SEQ ID NO: 1749554 - RNA, 18 nt, Salmonella enterica enterica serovar Typhi Ty2
uaaaaaaaagccgaccug

SEQ ID NO: 1749555 - RNA, 14 nt, Salmonella enterica enterica serovar Typhi Ty2
guuuuuuccagcgc

SEQ ID NO: 1749556 - RNA, 13 nt, Salmonella enterica enterica serovar Typhi Ty2
guuuuuucaucuc

SEQ ID NO: 1749557 - RNA, 17 nt, Salmonella enterica enterica serovar Typhi Ty2
guuuuugucuccucaug

SEQ ID NO: 1749558 - RNA, 17 nt, Salmonella enterica enterica serovar Typhi Ty2
guuuuuuguugauuuua

SEQ ID NO: 1749559 - RNA, 21 nt, Salmonella enterica enterica serovar Typhi Ty2
uaaaauacgcucaauauacuu

SEQ ID NO: 1749560 - RNA, 21 nt, Salmonella enterica enterica serovar Typhi Ty2
uaaaagcgauaaagacagguu

SEQ ID NO: 1749561 - RNA, 17 nt, Salmonella enterica enterica serovar Typhi Ty2
uaaaagcccuuaucgcc

SEQ ID NO: 1749562 - RNA, 13 nt, Salmonella enterica enterica serovar Typhi Ty2
uaaaaguuagccc

SEQ ID NO: 1749563 - RNA, 17 nt, Salmonella enterica enterica serovar Typhi Ty2
uaaaaguuagccccuua

SEQ ID NO: 1749564 - RNA, 20 nt, Salmonella enterica enterica serovar Typhi Ty2
uaaaaauauggggguaaaca

SEQ ID NO: 1749565 - RNA, 21 nt, Salmonella enterica enterica serovar Typhi Ty2
uaaaaauauggcgggccugug

SEQ ID NO: 1749566 - RNA, 10 nt, Salmonella enterica enterica serovar Typhi Ty2
uaaaaaccag

SEQ ID NO: 1749567 - RNA, 15 nt, Salmonella enterica enterica serovar Typhi Ty2
uaaaaacaauaaaua

SEQ ID NO: 1749568 - RNA, 23 nt, Salmonella enterica enterica serovar Typhi Ty2
uaaaaccguagauuuucaucaua

SEQ ID NO: 1749569 - RNA, 22 nt, Salmonella enterica enterica serovar Typhi Ty2
uaaaaccggucuggcucacuga

SEQ ID NO: 1749570 - RNA, 17 nt, Salmonella enterica enterica serovar Typhi Ty2
guuuuauccccuucagg

SEQ ID NO: 1749571 - RNA, 22 nt, Salmonella enterica enterica serovar Typhi Ty2
guuuuauccguuuccgcaauaa

SEQ ID NO: 1749572 - RNA, 14 nt, Salmonella enterica enterica serovar Typhi Ty2
guuuuaaucuuuua

SEQ ID NO: 1749573 - RNA, 14 nt, Salmonella enterica enterica serovar Typhi Ty2
guuuuaaaaauaac

SEQ ID NO: 1749574 - RNA, 17 nt, Salmonella enterica enterica serovar Typhi Ty2
guuuuacgccgcuaaaa

SEQ ID NO: 1749575 - RNA, 22 nt, Salmonella enterica enterica serovar Typhi Ty2
guuuuccaggugcugccacauc

SEQ ID NO: 1749576 - RNA, 13 nt, Salmonella enterica enterica serovar Typhi Ty2
guuuucauuagcc

SEQ ID NO: 1749577 - RNA, 22 nt, Salmonella enterica enterica serovar Typhi Ty2
guuuucaggccgcguaauuuuu

SEQ ID NO: 1749578 - RNA, 14 nt, Salmonella enterica enterica serovar Typhi Ty2
guuuucaggucaua

SEQ ID NO: 1749579 - RNA, 13 nt, Salmonella enterica enterica serovar Typhi Ty2
guuugucucaggu

SEQ ID NO: 1749580 - RNA, 13 nt, Salmonella enterica enterica serovar Typhi Ty2
guuuuaaaaauaa

SEQ ID NO: 1749581 - RNA, 15 nt, Salmonella enterica enterica serovar Typhi Ty2
guuuguuuaauuuug

SEQ ID NO: 1749582 - RNA, 15 nt, Salmonella enterica enterica serovar Typhi Ty2
guuuggcaaucaaau

SEQ ID NO: 1749583 - RNA, 18 nt, Salmonella enterica enterica serovar Typhi Ty2
guuugcucgccauaaauc

SEQ ID NO: 1749584 - RNA, 23 nt, Salmonella enterica enterica serovar Typhi Ty2
guuucugccgguucggcaucgcc

SEQ ID NO: 1749585 - RNA, 18 nt, Salmonella enterica enterica serovar Typhi Ty2
guuugcugacaaucugcu

SEQ ID NO: 1749586 - RNA, 21 nt, Salmonella enterica enterica serovar Typhi Ty2
guuugccgcauacaucgcaga

SEQ ID NO: 1749587 - RNA, 15 nt, Salmonella enterica enterica serovar Typhi Ty2
guuugcgauccagua

SEQ ID NO: 1749588 - RNA, 18 nt, Salmonella enterica enterica serovar Typhi Ty2
guuugccagcaccagcag

SEQ ID NO: 1749589 - RNA, 19 nt, Salmonella enterica enterica serovar Typhi Ty2
guuguccggcgaccuuauu

SEQ ID NO: 1749590 - RNA, 20 nt, Salmonella enterica enterica serovar Typhi Ty2
guugucuucaccuugcugcg

SEQ ID NO: 1749591 - RNA, 16 nt, Salmonella enterica enterica serovar Typhi Ty2
guugucgagguuauaa

SEQ ID NO: 1749592 - RNA, 17 nt, Salmonella enterica enterica serovar Typhi Ty2
guugucggggcuuuaau

SEQ ID NO: 1749593 - RNA, 19 nt, Salmonella enterica enterica serovar Typhi Ty2
guucugcgccauuuccagc

SEQ ID NO: 1749594 - RNA, 23 nt, Salmonella enterica enterica serovar Typhi Ty2
guuuaaucucuucaucuguggca

SEQ ID NO: 1749595 - RNA, 15 nt, Salmonella enterica enterica serovar Typhi Ty2
guuuacgccgccauc

SEQ ID NO: 1749596 - RNA, 14 nt, Salmonella enterica enterica serovar Typhi Ty2
guuuacgcugcucc

SEQ ID NO: 1749597 - RNA, 18 nt, Salmonella enterica enterica serovar Typhi Ty2
guuuacgcccucaucggc

SEQ ID NO: 1749598 - RNA, 13 nt, Salmonella enterica enterica serovar Typhi Ty2
guuuacuccauuc

SEQ ID NO: 1749599 - RNA, 19 nt, Salmonella enterica enterica serovar Typhi Ty2
guuuacuccauucccagcu

SEQ ID NO: 1749600 - RNA, 20 nt, Salmonella enterica enterica serovar Typhi Ty2
guuuacuccauucccagcuc

SEQ ID NO: 1749601 - RNA, 17 nt, Salmonella enterica enterica serovar Typhi Ty2
guugugcauuccaggug

SEQ ID NO: 1749602 - RNA, 22 nt, Salmonella enterica enterica serovar Typhi Ty2
guuuaacguuucauggaaauca

SEQ ID NO: 1749603 - RNA, 13 nt, Salmonella enterica enterica serovar Typhi Ty2
guuuaagcggaua

SEQ ID NO: 1749604 - RNA, 23 nt, Salmonella enterica enterica serovar Typhi Ty2
guuuacguagcaaauagauaaag

SEQ ID NO: 1749605 - RNA, 18 nt, Salmonella enterica enterica serovar Typhi Ty2
guuuagaaaaaauuaaaa

SEQ ID NO: 1749606 - RNA, 13 nt, Salmonella enterica enterica serovar Typhi Ty2
guuuauucaucuc

SEQ ID NO: 1749607 - RNA, 15 nt, Salmonella enterica enterica serovar Typhi Ty2
guuuauucagaaaau

SEQ ID NO: 1749608 - RNA, 21 nt, Salmonella enterica enterica serovar Typhi Ty2
guuuauugccgcuucuuuauu

SEQ ID NO: 1749609 - RNA, 17 nt, Salmonella enterica enterica serovar Typhi Ty2
guuuauuuaagcuuacu

SEQ ID NO: 1749610 - RNA, 15 nt, Salmonella enterica enterica serovar Typhi Ty2
guuucaauccaugua

SEQ ID NO: 1749611 - RNA, 19 nt, Salmonella enterica enterica serovar Typhi Ty2
guuucaaugcccaggcgcc

SEQ ID NO: 1749612 - RNA, 20 nt, Salmonella enterica enterica serovar Typhi Ty2
guuuccacugagcuucaccg

SEQ ID NO: 1749613 - RNA, 22 nt, Salmonella enterica enterica serovar Typhi Ty2
guuuccacugagcuucaccgcc

SEQ ID NO: 1749614 - RNA, 21 nt, Salmonella enterica enterica serovar Typhi Ty2
guuuccagcaucgaccaggau

SEQ ID NO: 1749615 - RNA, 18 nt, Salmonella enterica enterica serovar Typhi Ty2
guuucguuuagcgccugc

SEQ ID NO: 1749616 - RNA, 16 nt, Salmonella enterica enterica serovar Typhi Ty2
guuucauggcuuuguu

SEQ ID NO: 1749617 - RNA, 22 nt, Salmonella enterica enterica serovar Typhi Ty2
guuucaggacggcauaagccag

SEQ ID NO: 1749618 - RNA, 14 nt, Salmonella enterica enterica serovar Typhi Ty2
ucaaaaauaaaaac

SEQ ID NO: 1749619 - RNA, 18 nt, Salmonella enterica enterica serovar Typhi Ty2
ucaaaaaguugucuuccu

SEQ ID NO: 1749620 - RNA, 19 nt, Salmonella enterica enterica serovar Typhi Ty2
ucaaaaauagcauuaagcu

SEQ ID NO: 1749621 - RNA, 13 nt, Salmonella enterica enterica serovar Typhi Ty2
ucaaaaaagagaa

SEQ ID NO: 1749622 - RNA, 14 nt, Salmonella enterica enterica serovar Typhi Ty2
ucaaaaaagagaag

SEQ ID NO: 1749623 - RNA, 13 nt, Salmonella enterica enterica serovar Typhi Ty2
ucaaaaaaaauag

SEQ ID NO: 1749624 - RNA, 19 nt, Salmonella enterica enterica serovar Typhi Ty2
uauuuuuuuuguuuucgau

SEQ ID NO: 1749625 - RNA, 17 nt, Salmonella enterica enterica serovar Typhi Ty2
ucaaaagugaucauggu

SEQ ID NO: 1749626 - RNA, 18 nt, Salmonella enterica enterica serovar Typhi Ty2
ucaaaauaacgcuucacc

SEQ ID NO: 1749627 - RNA, 14 nt, Salmonella enterica enterica serovar Typhi Ty2
ucaaaauaaaauua

SEQ ID NO: 1749628 - RNA, 19 nt, Salmonella enterica enterica serovar Typhi Ty2
ucaaaacuacgccaaugaa

SEQ ID NO: 1749629 - RNA, 23 nt, Salmonella enterica enterica serovar Typhi Ty2
ucaaaaccagcgcggauaaaaaa

SEQ ID NO: 1749630 - RNA, 21 nt, Salmonella enterica enterica serovar Typhi Ty2
ucaaaaccgggcagggaauac

SEQ ID NO: 1749631 - RNA, 20 nt, Salmonella enterica enterica serovar Typhi Ty2
uauuuugguguaacagcaac

SEQ ID NO: 1749632 - RNA, 18 nt, Salmonella enterica enterica serovar Typhi Ty2
uauuuuucagcuucuguc

SEQ ID NO: 1749633 - RNA, 12 nt, Salmonella enterica enterica serovar Typhi Ty2
uauuuuucagcu

SEQ ID NO: 1749634 - RNA, 14 nt, Salmonella enterica enterica serovar Typhi Ty2
uauuuuuucugcua

SEQ ID NO: 1749635 - RNA, 23 nt, Salmonella enterica enterica serovar Typhi Ty2
uauuuuggcucccgaacgauaau

SEQ ID NO: 1749636 - RNA, 16 nt, Salmonella enterica enterica serovar Typhi Ty2
uauuuuauucgccauu

SEQ ID NO: 1749637 - RNA, 12 nt, Salmonella enterica enterica serovar Typhi Ty2
uauuuuauuuuu

SEQ ID NO: 1749638 - RNA, 22 nt, Salmonella enterica enterica serovar Typhi Ty2
uauuuuccugaaaaaauucccg

SEQ ID NO: 1749639 - RNA, 20 nt, Salmonella enterica enterica serovar Typhi Ty2
uauuuucuccggcaguccau

SEQ ID NO: 1749640 - RNA, 15 nt, Salmonella enterica enterica serovar Typhi Ty2
ucaaaaucgcgcccc

SEQ ID NO: 1749641 - RNA, 17 nt, Salmonella enterica enterica serovar Typhi Ty2
ucaaaauggaaaauaau

SEQ ID NO: 1749642 - RNA, 16 nt, Salmonella enterica enterica serovar Typhi Ty2
ucaaaauggaaaauaa

SEQ ID NO: 1749643 - RNA, 21 nt, Salmonella enterica enterica serovar Typhi Ty2
ucaaaauggaaaauaauaauc

SEQ ID NO: 1749644 - RNA, 20 nt, Salmonella enterica enterica serovar Typhi Ty2
ucaaacacaaauuucgagca

SEQ ID NO: 1749645 - RNA, 14 nt, Salmonella enterica enterica serovar Typhi Ty2
ucaaaccagcuuuu

SEQ ID NO: 1749646 - RNA, 16 nt, Salmonella enterica enterica serovar Typhi Ty2
ucaaaccagcuuuuca

SEQ ID NO: 1749647 - RNA, 18 nt, Salmonella enterica enterica serovar Typhi Ty2
ucaaaccagcuuuucauu

SEQ ID NO: 1749648 - RNA, 16 nt, Salmonella enterica enterica serovar Typhi Ty2
ucaaacaggcugucug

SEQ ID NO: 1749649 - RNA, 19 nt, Salmonella enterica enterica serovar Typhi Ty2
ucaaacaggcgaaaacgua

SEQ ID NO: 1749650 - RNA, 12 nt, Salmonella enterica enterica serovar Typhi Ty2
ucaaacgcagca

SEQ ID NO: 1749651 - RNA, 14 nt, Salmonella enterica enterica serovar Typhi Ty2
ucaaacccuuccgc

SEQ ID NO: 1749652 - RNA, 22 nt, Salmonella enterica enterica serovar Typhi Ty2
ucaaacugacugaugcuggcgc

SEQ ID NO: 1749653 - RNA, 13 nt, Salmonella enterica enterica serovar Typhi Ty2
ucaaagaaaacau

SEQ ID NO: 1749654 - RNA, 18 nt, Salmonella enterica enterica serovar Typhi Ty2
ucaaagaaaacaucagcc

SEQ ID NO: 1749655 - RNA, 18 nt, Salmonella enterica enterica serovar Typhi Ty2
ucaaagaaaacuuucauu

SEQ ID NO: 1749656 - RNA, 20 nt, Salmonella enterica enterica serovar Typhi Ty2
ucaaacuuuuaaauugaaga

SEQ ID NO: 1749657 - RNA, 15 nt, Salmonella enterica enterica serovar Typhi Ty2
ucaaacuuuuaaauu

SEQ ID NO: 1749658 - RNA, 19 nt, Salmonella enterica enterica serovar Typhi Ty2
ucaaagccacacugcaucg

SEQ ID NO: 1749659 - RNA, 13 nt, Salmonella enterica enterica serovar Typhi Ty2
ucaaagaccuccg

SEQ ID NO: 1749660 - RNA, 20 nt, Salmonella enterica enterica serovar Typhi Ty2
ucaaagggcccguggaaaaa

SEQ ID NO: 1749661 - RNA, 17 nt, Salmonella enterica enterica serovar Typhi Ty2
ucaaaggccugcaucaa

SEQ ID NO: 1749662 - RNA, 19 nt, Salmonella enterica enterica serovar Typhi Ty2
ucaaaguugguucccagca

SEQ ID NO: 1749663 - RNA, 19 nt, Salmonella enterica enterica serovar Typhi Ty2
ucaaaguuauuuaccacgg

SEQ ID NO: 1749664 - RNA, 22 nt, Salmonella enterica enterica serovar Typhi Ty2
ucaaauaagacauggaguucca

SEQ ID NO: 1749665 - RNA, 23 nt, Salmonella enterica enterica serovar Typhi Ty2
ucaaauaagacauggaguuccag

SEQ ID NO: 1749666 - RNA, 17 nt, Salmonella enterica enterica serovar Typhi Ty2
ucaaauaccuuuucauu

SEQ ID NO: 1749667 - RNA, 22 nt, Salmonella enterica enterica serovar Typhi Ty2
ucaaauacgcgauaaaaaccca

SEQ ID NO: 1749668 - RNA, 14 nt, Salmonella enterica enterica serovar Typhi Ty2
ucaaauagagaaaa

SEQ ID NO: 1749669 - RNA, 15 nt, Salmonella enterica enterica serovar Typhi Ty2
ucaaauagagaaaau

SEQ ID NO: 1749670 - RNA, 16 nt, Salmonella enterica enterica serovar Typhi Ty2
ucaaauagagaaaaua

SEQ ID NO: 1749671 - RNA, 15 nt, Salmonella enterica enterica serovar Typhi Ty2
ucaacauuauuaaaa

SEQ ID NO: 1749672 - RNA, 16 nt, Salmonella enterica enterica serovar Typhi Ty2
ucaacauuauuaaaau

SEQ ID NO: 1749673 - RNA, 14 nt, Salmonella enterica enterica serovar Typhi Ty2
ucaacaucaucgga

SEQ ID NO: 1749674 - RNA, 21 nt, Salmonella enterica enterica serovar Typhi Ty2
ucaacauauuuuucacacaua

SEQ ID NO: 1749675 - RNA, 13 nt, Salmonella enterica enterica serovar Typhi Ty2
ucaacaucauuaa

SEQ ID NO: 1749676 - RNA, 20 nt, Salmonella enterica enterica serovar Typhi Ty2
ucaaccaucaaaaaaaauag

SEQ ID NO: 1749677 - RNA, 18 nt, Salmonella enterica enterica serovar Typhi Ty2
ucaaccaugaucaccauc

SEQ ID NO: 1749678 - RNA, 19 nt, Salmonella enterica enterica serovar Typhi Ty2
ucaacccaguuuuuauccu

SEQ ID NO: 1749679 - RNA, 16 nt, Salmonella enterica enterica serovar Typhi Ty2
ucaacacgcagaccca

SEQ ID NO: 1749680 - RNA, 16 nt, Salmonella enterica enterica serovar Typhi Ty2
ucaacacuuagaacgc

SEQ ID NO: 1749681 - RNA, 21 nt, Salmonella enterica enterica serovar Typhi Ty2
ucaacacuuagaacgcggaag

SEQ ID NO: 1749682 - RNA, 12 nt, Salmonella enterica enterica serovar Typhi Ty2
ucaacaauuacg

SEQ ID NO: 1749683 - RNA, 19 nt, Salmonella enterica enterica serovar Typhi Ty2
ucaacaaucguuaauucau

SEQ ID NO: 1749684 - RNA, 22 nt, Salmonella enterica enterica serovar Typhi Ty2
ucaacagcacccaggcacgggu

SEQ ID NO: 1749685 - RNA, 21 nt, Salmonella enterica enterica serovar Typhi Ty2
ucaaauucacccguuauucau

SEQ ID NO: 1749686 - RNA, 22 nt, Salmonella enterica enterica serovar Typhi Ty2
ucaaaucagacgcuucauuggu

SEQ ID NO: 1749687 - RNA, 12 nt, Salmonella enterica enterica serovar Typhi Ty2
ucaaauauauug

SEQ ID NO: 1749688 - RNA, 14 nt, Salmonella enterica enterica serovar Typhi Ty2
ucaaaugcgaaaaa

SEQ ID NO: 1749689 - RNA, 21 nt, Salmonella enterica enterica serovar Typhi Ty2
ucaaaugggaucuucaaugaa

SEQ ID NO: 1749690 - RNA, 22 nt, Salmonella enterica enterica serovar Typhi Ty2
ucaaaucuucauuucauugcgu

SEQ ID NO: 1749691 - RNA, 13 nt, Salmonella enterica enterica serovar Typhi Ty2
ucaacuauuaaag

SEQ ID NO: 1749692 - RNA, 14 nt, Salmonella enterica enterica serovar Typhi Ty2
ucaacucuccuuuc

SEQ ID NO: 1749693 - RNA, 21 nt, Salmonella enterica enterica serovar Typhi Ty2
ucaacuguaccugauccagcu

SEQ ID NO: 1749694 - RNA, 23 nt, Salmonella enterica enterica serovar Typhi Ty2
ucaacuguaccugauccagcucu

SEQ ID NO: 1749695 - RNA, 14 nt, Salmonella enterica enterica serovar Typhi Ty2
ucaacguuuuucag

SEQ ID NO: 1749696 - RNA, 15 nt, Salmonella enterica enterica serovar Typhi Ty2
ucaaccucuauaacu

SEQ ID NO: 1749697 - RNA, 20 nt, Salmonella enterica enterica serovar Typhi Ty2
ucaaccguuucuuuuucgau

SEQ ID NO: 1749698 - RNA, 18 nt, Salmonella enterica enterica serovar Typhi Ty2
ucaacgaaugccugcaua

SEQ ID NO: 1749699 - RNA, 19 nt, Salmonella enterica enterica serovar Typhi Ty2
ucaacgauagagugaaggc

SEQ ID NO: 1749700 - RNA, 18 nt, Salmonella enterica enterica serovar Typhi Ty2
ucaacgaggugaauaaau

SEQ ID NO: 1749701 - RNA, 15 nt, Salmonella enterica enterica serovar Typhi Ty2
ucaacgccaucuucc

SEQ ID NO: 1749702 - RNA, 18 nt, Salmonella enterica enterica serovar Typhi Ty2
ucaacgcaucaaauaccu

SEQ ID NO: 1749703 - RNA, 14 nt, Salmonella enterica enterica serovar Typhi Ty2
ucaacgcgccgcca

SEQ ID NO: 1749704 - RNA, 21 nt, Salmonella enterica enterica serovar Typhi Ty2
ucaagaucgcgcagcaggcca

SEQ ID NO: 1749705 - RNA, 16 nt, Salmonella enterica enterica serovar Typhi Ty2
ucaagaucgcgcagca

SEQ ID NO: 1749706 - RNA, 19 nt, Salmonella enterica enterica serovar Typhi Ty2
ucaagcauaucaaacugaa

SEQ ID NO: 1749707 - RNA, 21 nt, Salmonella enterica enterica serovar Typhi Ty2
ucaagccgggcggcugugucc

SEQ ID NO: 1749708 - RNA, 14 nt, Salmonella enterica enterica serovar Typhi Ty2
ucaagcaacuguag

SEQ ID NO: 1749709 - RNA, 14 nt, Salmonella enterica enterica serovar Typhi Ty2
ucaagcaguuccag

SEQ ID NO: 1749710 - RNA, 22 nt, Salmonella enterica enterica serovar Typhi Ty2
ucaacuuccaccaccuccugcu

SEQ ID NO: 1749711 - RNA, 21 nt, Salmonella enterica enterica serovar Typhi Ty2
ucaagaaucaauauaucaggc

SEQ ID NO: 1749712 - RNA, 16 nt, Salmonella enterica enterica serovar Typhi Ty2
ucaagaaugaccagcc

SEQ ID NO: 1749713 - RNA, 17 nt, Salmonella enterica enterica serovar Typhi Ty2
uauugacgaaaagauaa

SEQ ID NO: 1749714 - RNA, 15 nt, Salmonella enterica enterica serovar Typhi Ty2
uauugaccaucucuu

SEQ ID NO: 1749715 - RNA, 17 nt, Salmonella enterica enterica serovar Typhi Ty2
uauugaccgcuuuuucc

SEQ ID NO: 1749716 - RNA, 14 nt, Salmonella enterica enterica serovar Typhi Ty2
uauugagaauaaac

SEQ ID NO: 1749717 - RNA, 15 nt, Salmonella enterica enterica serovar Typhi Ty2
uauugagaauaaacu

SEQ ID NO: 1749718 - RNA, 15 nt, Salmonella enterica enterica serovar Typhi Ty2
uauugcaacuauuaa

SEQ ID NO: 1749719 - RNA, 16 nt, Salmonella enterica enterica serovar Typhi Ty2
uauugauuagcuuuuu

SEQ ID NO: 1749720 - RNA, 22 nt, Salmonella enterica enterica serovar Typhi Ty2
uauugccacagcgguauaucug

SEQ ID NO: 1749721 - RNA, 23 nt, Salmonella enterica enterica serovar Typhi Ty2
uauugcccguuuuaaugaacagc

SEQ ID NO: 1749722 - RNA, 15 nt, Salmonella enterica enterica serovar Typhi Ty2
uauugcccuuuuguu

SEQ ID NO: 1749723 - RNA, 17 nt, Salmonella enterica enterica serovar Typhi Ty2
uauugccugaagaacau

SEQ ID NO: 1749724 - RNA, 16 nt, Salmonella enterica enterica serovar Typhi Ty2
uauugccuaaauaacu

SEQ ID NO: 1749725 - RNA, 23 nt, Salmonella enterica enterica serovar Typhi Ty2
uauugcucuuccggcauaaaaag

SEQ ID NO: 1749726 - RNA, 20 nt, Salmonella enterica enterica serovar Typhi Ty2
uauugcugugcuaugauaag

SEQ ID NO: 1749727 - RNA, 16 nt, Salmonella enterica enterica serovar Typhi Ty2
uauugcuucagccaga

SEQ ID NO: 1749728 - RNA, 18 nt, Salmonella enterica enterica serovar Typhi Ty2
uauugggcguaagaaaag

SEQ ID NO: 1749729 - RNA, 15 nt, Salmonella enterica enterica serovar Typhi Ty2
uauuggcaggaugua

SEQ ID NO: 1749730 - RNA, 20 nt, Salmonella enterica enterica serovar Typhi Ty2
uauuuaaaauuccaauauuu

SEQ ID NO: 1749731 - RNA, 17 nt, Salmonella enterica enterica serovar Typhi Ty2
uauuguuuagacagaca

SEQ ID NO: 1749732 - RNA, 21 nt, Salmonella enterica enterica serovar Typhi Ty2
uauuguuuaacguuucaugga

SEQ ID NO: 1749733 - RNA, 22 nt, Salmonella enterica enterica serovar Typhi Ty2
uauuuaaauaucgguucaauac

SEQ ID NO: 1749734 - RNA, 12 nt, Salmonella enterica enterica serovar Typhi Ty2
uauuuaacccug

SEQ ID NO: 1749735 - RNA, 13 nt, Salmonella enterica enterica serovar Typhi Ty2
uauuguuaaaaag

SEQ ID NO: 1749736 - RNA, 22 nt, Salmonella enterica enterica serovar Typhi Ty2
uauugucgcccugcaauucaua

SEQ ID NO: 1749737 - RNA, 13 nt, Salmonella enterica enterica serovar Typhi Ty2
uauugucaugcua

SEQ ID NO: 1749738 - RNA, 22 nt, Salmonella enterica enterica serovar Typhi Ty2
uauugucgccaccgcuauucuu

SEQ ID NO: 1749739 - RNA, 23 nt, Salmonella enterica enterica serovar Typhi Ty2
uauugucgaauuccgccugcugu

SEQ ID NO: 1749740 - RNA, 15 nt, Salmonella enterica enterica serovar Typhi Ty2
uauuuaauacaucag

SEQ ID NO: 1749741 - RNA, 18 nt, Salmonella enterica enterica serovar Typhi Ty2
uauuuaauaagcauauau

SEQ ID NO: 1749742 - RNA, 19 nt, Salmonella enterica enterica serovar Typhi Ty2
uauuuaccgcuggcgucug

SEQ ID NO: 1749743 - RNA, 19 nt, Salmonella enterica enterica serovar Typhi Ty2
uauuuagccguucaugcac

SEQ ID NO: 1749744 - RNA, 20 nt, Salmonella enterica enterica serovar Typhi Ty2
uauuuagccguucaugcacu

SEQ ID NO: 1749745 - RNA, 21 nt, Salmonella enterica enterica serovar Typhi Ty2
uauuuacugaauaaauaguau

SEQ ID NO: 1749746 - RNA, 13 nt, Salmonella enterica enterica serovar Typhi Ty2
uauuugaauuuua

SEQ ID NO: 1749747 - RNA, 13 nt, Salmonella enterica enterica serovar Typhi Ty2
uauuugcccuguu

SEQ ID NO: 1749748 - RNA, 14 nt, Salmonella enterica enterica serovar Typhi Ty2
uauuuggagagcau

SEQ ID NO: 1749749 - RNA, 16 nt, Salmonella enterica enterica serovar Typhi Ty2
uauuuuacuugccauu

SEQ ID NO: 1749750 - RNA, 17 nt, Salmonella enterica enterica serovar Typhi Ty2
uauuuguguauuuuuuu

SEQ ID NO: 1749751 - RNA, 13 nt, Salmonella enterica enterica serovar Typhi Ty2
uauuugugaccaa

SEQ ID NO: 1749752 - RNA, 18 nt, Salmonella enterica enterica serovar Typhi Ty2
uauuucacguuucaucuc

SEQ ID NO: 1749753 - RNA, 13 nt, Salmonella enterica enterica serovar Typhi Ty2
uauuucagacuua

SEQ ID NO: 1749754 - RNA, 13 nt, Salmonella enterica enterica serovar Typhi Ty2
uauuucaguacag

SEQ ID NO: 1749755 - RNA, 14 nt, Salmonella enterica enterica serovar Typhi Ty2
uauuucauaaugug

SEQ ID NO: 1749756 - RNA, 17 nt, Salmonella enterica enterica serovar Typhi Ty2
uauuuccaccuucucuu

SEQ ID NO: 1749757 - RNA, 18 nt, Salmonella enterica enterica serovar Typhi Ty2
uauuucauuaaucuauuu

SEQ ID NO: 1749758 - RNA, 15 nt, Salmonella enterica enterica serovar Typhi Ty2
uauuucugaaaaacc

SEQ ID NO: 1749759 - RNA, 21 nt, Salmonella enterica enterica serovar Typhi Ty2
uauuucggcacugacucuucc

SEQ ID NO: 1749760 - RNA, 18 nt, Salmonella enterica enterica serovar Typhi Ty2
uauuucgacuuucuucgg

SEQ ID NO: 1749761 - RNA, 15 nt, Salmonella enterica enterica serovar Typhi Ty2
uauuuaucaaaaaga

SEQ ID NO: 1749762 - RNA, 14 nt, Salmonella enterica enterica serovar Typhi Ty2
uauuuauuuuuagu

SEQ ID NO: 1749763 - RNA, 14 nt, Salmonella enterica enterica serovar Typhi Ty2
uauuucaagcaaua

SEQ ID NO: 1749764 - RNA, 12 nt, Salmonella enterica enterica serovar Typhi Ty2
uauuuauuuaaa

SEQ ID NO: 1749765 - RNA, 12 nt, Salmonella enterica enterica serovar Typhi Ty2
uauuuauuuaau

SEQ ID NO: 1749766 - RNA, 12 nt, Salmonella enterica enterica serovar Typhi Ty2
uauuauaaaaua

SEQ ID NO: 1749767 - RNA, 18 nt, Salmonella enterica enterica serovar Typhi Ty2
uauuaggcacuaccaccu

SEQ ID NO: 1749768 - RNA, 21 nt, Salmonella enterica enterica serovar Typhi Ty2
uauuagcgguacucuuuuucc

SEQ ID NO: 1749769 - RNA, 16 nt, Salmonella enterica enterica serovar Typhi Ty2
uauuacuggaucauac

SEQ ID NO: 1749770 - RNA, 20 nt, Salmonella enterica enterica serovar Typhi Ty2
uauuaucugauucaauuaau

SEQ ID NO: 1749771 - RNA, 15 nt, Salmonella enterica enterica serovar Typhi Ty2
uauuaucggcgucau

SEQ ID NO: 1749772 - RNA, 20 nt, Salmonella enterica enterica serovar Typhi Ty2
uauuaugcguuuuuaucuuu

SEQ ID NO: 1749773 - RNA, 22 nt, Salmonella enterica enterica serovar Typhi Ty2
uauuaucaaaucuucauuucau

SEQ ID NO: 1749774 - RNA, 14 nt, Salmonella enterica enterica serovar Typhi Ty2
uauuaucaaaucuu

SEQ ID NO: 1749775 - RNA, 20 nt, Salmonella enterica enterica serovar Typhi Ty2
uauuauauagacuccgucaa

SEQ ID NO: 1749776 - RNA, 19 nt, Salmonella enterica enterica serovar Typhi Ty2
uauuauugcccuuuuguuu

SEQ ID NO: 1749777 - RNA, 13 nt, Salmonella enterica enterica serovar Typhi Ty2
uauuauuauuacg

SEQ ID NO: 1749778 - RNA, 13 nt, Salmonella enterica enterica serovar Typhi Ty2
uauuauuauauag

SEQ ID NO: 1749779 - RNA, 15 nt, Salmonella enterica enterica serovar Typhi Ty2
uauuaugcuggccug

SEQ ID NO: 1749780 - RNA, 18 nt, Salmonella enterica enterica serovar Typhi Ty2
uauuaacagcuucuucuu

SEQ ID NO: 1749781 - RNA, 12 nt, Salmonella enterica enterica serovar Typhi Ty2
uauuaacgcuuu

SEQ ID NO: 1749782 - RNA, 14 nt, Salmonella enterica enterica serovar Typhi Ty2
uauuacaagaaagu

SEQ ID NO: 1749783 - RNA, 20 nt, Salmonella enterica enterica serovar Typhi Ty2
uauuacaaguaauaaaauaa

SEQ ID NO: 1749784 - RNA, 13 nt, Salmonella enterica enterica serovar Typhi Ty2
uauuacaacguuc

SEQ ID NO: 1749785 - RNA, 18 nt, Salmonella enterica enterica serovar Typhi Ty2
uauuacuaauaaaauuca

SEQ ID NO: 1749786 - RNA, 15 nt, Salmonella enterica enterica serovar Typhi Ty2
uauuacugauaaagu

SEQ ID NO: 1749787 - RNA, 19 nt, Salmonella enterica enterica serovar Typhi Ty2
uauuacgcaucauauaacc

SEQ ID NO: 1749788 - RNA, 19 nt, Salmonella enterica enterica serovar Typhi Ty2
uauuacaugccguuaauaa

SEQ ID NO: 1749789 - RNA, 16 nt, Salmonella enterica enterica serovar Typhi Ty2
uauuacauagaaaaua

SEQ ID NO: 1749790 - RNA, 23 nt, Salmonella enterica enterica serovar Typhi Ty2
uauuacagacagucuggauauaa

SEQ ID NO: 1749791 - RNA, 15 nt, Salmonella enterica enterica serovar Typhi Ty2
uauuaccaaugagcu

SEQ ID NO: 1749792 - RNA, 18 nt, Salmonella enterica enterica serovar Typhi Ty2
uauuacccaacaccagac

SEQ ID NO: 1749793 - RNA, 16 nt, Salmonella enterica enterica serovar Typhi Ty2
uauuaccucgcgcuua

SEQ ID NO: 1749794 - RNA, 22 nt, Salmonella enterica enterica serovar Typhi Ty2
uauuaccugguauuauugucuu

SEQ ID NO: 1749795 - RNA, 17 nt, Salmonella enterica enterica serovar Typhi Ty2
uauucgcgcccucauuc

SEQ ID NO: 1749796 - RNA, 15 nt, Salmonella enterica enterica serovar Typhi Ty2
uauucgcuaucagaa

SEQ ID NO: 1749797 - RNA, 19 nt, Salmonella enterica enterica serovar Typhi Ty2
uauucgcgaugcucaacca

SEQ ID NO: 1749798 - RNA, 21 nt, Salmonella enterica enterica serovar Typhi Ty2
uauucgcaucgguaauuucaa

SEQ ID NO: 1749799 - RNA, 16 nt, Salmonella enterica enterica serovar Typhi Ty2
uauugaagauguagac

SEQ ID NO: 1749800 - RNA, 20 nt, Salmonella enterica enterica serovar Typhi Ty2
uauugaacggcucaaaauaa

SEQ ID NO: 1749801 - RNA, 21 nt, Salmonella enterica enterica serovar Typhi Ty2
uauucugggcuuacuuuccaa

SEQ ID NO: 1749802 - RNA, 23 nt, Salmonella enterica enterica serovar Typhi Ty2
uauucugcacgcacgacagugcu

SEQ ID NO: 1749803 - RNA, 17 nt, Salmonella enterica enterica serovar Typhi Ty2
uauucuuccccuucacu

SEQ ID NO: 1749804 - RNA, 22 nt, Salmonella enterica enterica serovar Typhi Ty2
uauucaacgccaucuuccucac

SEQ ID NO: 1749805 - RNA, 12 nt, Salmonella enterica enterica serovar Typhi Ty2
uauucaauaaua

SEQ ID NO: 1749806 - RNA, 16 nt, Salmonella enterica enterica serovar Typhi Ty2
uauuauuuugggaaug

SEQ ID NO: 1749807 - RNA, 22 nt, Salmonella enterica enterica serovar Typhi Ty2
uauuauuuugauacucaucaua

SEQ ID NO: 1749808 - RNA, 13 nt, Salmonella enterica enterica serovar Typhi Ty2
uauuauugucuua

SEQ ID NO: 1749809 - RNA, 17 nt, Salmonella enterica enterica serovar Typhi Ty2
uauucagggcuuuauuu

SEQ ID NO: 1749810 - RNA, 13 nt, Salmonella enterica enterica serovar Typhi Ty2
uauucaggccucc

SEQ ID NO: 1749811 - RNA, 17 nt, Salmonella enterica enterica serovar Typhi Ty2
uauucagcacaucagcc

SEQ ID NO: 1749812 - RNA, 16 nt, Salmonella enterica enterica serovar Typhi Ty2
uauucaccucccugca

SEQ ID NO: 1749813 - RNA, 18 nt, Salmonella enterica enterica serovar Typhi Ty2
uauucacgcgaauuccuu

SEQ ID NO: 1749814 - RNA, 17 nt, Salmonella enterica enterica serovar Typhi Ty2
uauucccauuccugcaa

SEQ ID NO: 1749815 - RNA, 20 nt, Salmonella enterica enterica serovar Typhi Ty2
uauuccgagucgaucucuuu

SEQ ID NO: 1749816 - RNA, 20 nt, Salmonella enterica enterica serovar Typhi Ty2
uauuccccccggcagcuuua

SEQ ID NO: 1749817 - RNA, 22 nt, Salmonella enterica enterica serovar Typhi Ty2
uauuccuguauaauuauuuguu

SEQ ID NO: 1749818 - RNA, 20 nt, Salmonella enterica enterica serovar Typhi Ty2
uauucgacuguuguucuuca

SEQ ID NO: 1749819 - RNA, 16 nt, Salmonella enterica enterica serovar Typhi Ty2
uauuccggcgcuggcg

SEQ ID NO: 1749820 - RNA, 22 nt, Salmonella enterica enterica serovar Typhi Ty2
uauuccucggaggccagauuca

SEQ ID NO: 1749821 - RNA, 21 nt, Salmonella enterica enterica serovar Typhi Ty2
uauuccagccaggaauggcua

SEQ ID NO: 1749822 - RNA, 22 nt, Salmonella enterica enterica serovar Typhi Ty2
uauucauuauuuuuaaauaacu

SEQ ID NO: 1749823 - RNA, 16 nt, Salmonella enterica enterica serovar Typhi Ty2
uauucaucaaaaugca

SEQ ID NO: 1749824 - RNA, 19 nt, Salmonella enterica enterica serovar Typhi Ty2
uauucaugccagaagcaaa

SEQ ID NO: 1749825 - RNA, 12 nt, Salmonella enterica enterica serovar Typhi Ty2
uauucaggugga

SEQ ID NO: 1749826 - RNA, 22 nt, Salmonella enterica enterica serovar Typhi Ty2
uauucauaacgccgaugccgcc

SEQ ID NO: 1749827 - RNA, 17 nt, Salmonella enterica enterica serovar Typhi Ty2
ucacaaucagccacggc

SEQ ID NO: 1749828 - RNA, 23 nt, Salmonella enterica enterica serovar Typhi Ty2
ucacaauguuuuuguaccaggcc

SEQ ID NO: 1749829 - RNA, 16 nt, Salmonella enterica enterica serovar Typhi Ty2
ucacaaugaccucuuu

SEQ ID NO: 1749830 - RNA, 14 nt, Salmonella enterica enterica serovar Typhi Ty2
ucacacauaucgcc

SEQ ID NO: 1749831 - RNA, 21 nt, Salmonella enterica enterica serovar Typhi Ty2
ucacaccaacgcuggcccggc

SEQ ID NO: 1749832 - RNA, 20 nt, Salmonella enterica enterica serovar Typhi Ty2
ucacaagcuguuucuccguu

SEQ ID NO: 1749833 - RNA, 13 nt, Salmonella enterica enterica serovar Typhi Ty2
ucacaaggaauga

SEQ ID NO: 1749834 - RNA, 16 nt, Salmonella enterica enterica serovar Typhi Ty2
ucacaaauuaaaaauc

SEQ ID NO: 1749835 - RNA, 16 nt, Salmonella enterica enterica serovar Typhi Ty2
ucacaacgucaucccg

SEQ ID NO: 1749836 - RNA, 22 nt, Salmonella enterica enterica serovar Typhi Ty2
ucacaccggcggagucgguaca

SEQ ID NO: 1749837 - RNA, 15 nt, Salmonella enterica enterica serovar Typhi Ty2
ucacacugcgccgcc

SEQ ID NO: 1749838 - RNA, 20 nt, Salmonella enterica enterica serovar Typhi Ty2
ucacacugcgccgccagcga

SEQ ID NO: 1749839 - RNA, 16 nt, Salmonella enterica enterica serovar Typhi Ty2
ucacacgcucacccag

SEQ ID NO: 1749840 - RNA, 22 nt, Salmonella enterica enterica serovar Typhi Ty2
ucacagacaucggagauuucau

SEQ ID NO: 1749841 - RNA, 19 nt, Salmonella enterica enterica serovar Typhi Ty2
ucacagccacacugcugug

SEQ ID NO: 1749842 - RNA, 20 nt, Salmonella enterica enterica serovar Typhi Ty2
ucacaggcuucgacaaacag

SEQ ID NO: 1749843 - RNA, 15 nt, Salmonella enterica enterica serovar Typhi Ty2
ucacaggcuucgaca

SEQ ID NO: 1749844 - RNA, 22 nt, Salmonella enterica enterica serovar Typhi Ty2
ucacagcgguuacgcuauagcu

SEQ ID NO: 1749845 - RNA, 17 nt, Salmonella enterica enterica serovar Typhi Ty2
ucacauaucccagaccg

SEQ ID NO: 1749846 - RNA, 18 nt, Salmonella enterica enterica serovar Typhi Ty2
ucacauauucaauaauau

SEQ ID NO: 1749847 - RNA, 17 nt, Salmonella enterica enterica serovar Typhi Ty2
ucacaucaaagccccau

SEQ ID NO: 1749848 - RNA, 17 nt, Salmonella enterica enterica serovar Typhi Ty2
ucacauacagcacuucc

SEQ ID NO: 1749849 - RNA, 15 nt, Salmonella enterica enterica serovar Typhi Ty2
ucacaucgcgcagca

SEQ ID NO: 1749850 - RNA, 20 nt, Salmonella enterica enterica serovar Typhi Ty2
ucacaucguaaaucagcgug

SEQ ID NO: 1749851 - RNA, 20 nt, Salmonella enterica enterica serovar Typhi Ty2
ucacaugcgggagcaaaaua

SEQ ID NO: 1749852 - RNA, 21 nt, Salmonella enterica enterica serovar Typhi Ty2
ucacauggcgaaaaucacuau

SEQ ID NO: 1749853 - RNA, 16 nt, Salmonella enterica enterica serovar Typhi Ty2
ucacauuggcaaaccc

SEQ ID NO: 1749854 - RNA, 14 nt, Salmonella enterica enterica serovar Typhi Ty2
ucaccacaaaggcg

SEQ ID NO: 1749855 - RNA, 15 nt, Salmonella enterica enterica serovar Typhi Ty2
ucaccauaaaucauu

SEQ ID NO: 1749856 - RNA, 18 nt, Salmonella enterica enterica serovar Typhi Ty2
ucaccagcugacgcagca

SEQ ID NO: 1749857 - RNA, 12 nt, Salmonella enterica enterica serovar Typhi Ty2
ucaccagcgcgc

SEQ ID NO: 1749858 - RNA, 22 nt, Salmonella enterica enterica serovar Typhi Ty2
ucaccaggcguaagaucccagg

SEQ ID NO: 1749859 - RNA, 21 nt, Salmonella enterica enterica serovar Typhi Ty2
ucaccagcccuuccaccaguu

SEQ ID NO: 1749860 - RNA, 22 nt, Salmonella enterica enterica serovar Typhi Ty2
ucaccacgggguuggcccuccc

SEQ ID NO: 1749861 - RNA, 16 nt, Salmonella enterica enterica serovar Typhi Ty2
ucaccaccgcaggcag

SEQ ID NO: 1749862 - RNA, 15 nt, Salmonella enterica enterica serovar Typhi Ty2
ucacccauuuuaucc

SEQ ID NO: 1749863 - RNA, 15 nt, Salmonella enterica enterica serovar Typhi Ty2
ucacccacuuguagc

SEQ ID NO: 1749864 - RNA, 16 nt, Salmonella enterica enterica serovar Typhi Ty2
ucacccagacugugau

SEQ ID NO: 1749865 - RNA, 23 nt, Salmonella enterica enterica serovar Typhi Ty2
ucacccagagauuaauuacgcac

SEQ ID NO: 1749866 - RNA, 15 nt, Salmonella enterica enterica serovar Typhi Ty2
ucaccauucauguuu

SEQ ID NO: 1749867 - RNA, 14 nt, Salmonella enterica enterica serovar Typhi Ty2
ucaccauucccagc

SEQ ID NO: 1749868 - RNA, 15 nt, Salmonella enterica enterica serovar Typhi Ty2
ucaccauucccagcg

SEQ ID NO: 1749869 - RNA, 18 nt, Salmonella enterica enterica serovar Typhi Ty2
ucacccacaggagccagu

SEQ ID NO: 1749870 - RNA, 16 nt, Salmonella enterica enterica serovar Typhi Ty2
ucacccaauaaauaau

SEQ ID NO: 1749871 - RNA, 18 nt, Salmonella enterica enterica serovar Typhi Ty2
ucacccaacauuuuuagc

SEQ ID NO: 1749872 - RNA, 13 nt, Salmonella enterica enterica serovar Typhi Ty2
ucaccaucuucac

SEQ ID NO: 1749873 - RNA, 17 nt, Salmonella enterica enterica serovar Typhi Ty2
ucaccauuaacaucaga

SEQ ID NO: 1749874 - RNA, 13 nt, Salmonella enterica enterica serovar Typhi Ty2
ucaccauuaauac

SEQ ID NO: 1749875 - RNA, 20 nt, Salmonella enterica enterica serovar Typhi Ty2
ucaccauaauuaccggcaca

SEQ ID NO: 1749876 - RNA, 18 nt, Salmonella enterica enterica serovar Typhi Ty2
ucaccguuuaaaaacauc

SEQ ID NO: 1749877 - RNA, 21 nt, Salmonella enterica enterica serovar Typhi Ty2
ucaccguauuaucaaaucuuc

SEQ ID NO: 1749878 - RNA, 19 nt, Salmonella enterica enterica serovar Typhi Ty2
ucaccguggcaucaucaaa

SEQ ID NO: 1749879 - RNA, 18 nt, Salmonella enterica enterica serovar Typhi Ty2
ucaccguggcaaaaucca

SEQ ID NO: 1749880 - RNA, 22 nt, Salmonella enterica enterica serovar Typhi Ty2
ucaccggcuguauacacuuucc

SEQ ID NO: 1749881 - RNA, 15 nt, Salmonella enterica enterica serovar Typhi Ty2
ucaccggcgugcgcu

SEQ ID NO: 1749882 - RNA, 17 nt, Salmonella enterica enterica serovar Typhi Ty2
ucaccgcugacugaacu

SEQ ID NO: 1749883 - RNA, 21 nt, Salmonella enterica enterica serovar Typhi Ty2
ucaccgcggcaaccagcccau

SEQ ID NO: 1749884 - RNA, 21 nt, Salmonella enterica enterica serovar Typhi Ty2
ucaccgcccaaugcccccauc

SEQ ID NO: 1749885 - RNA, 15 nt, Salmonella enterica enterica serovar Typhi Ty2
ucaccgaccugccuu

SEQ ID NO: 1749886 - RNA, 17 nt, Salmonella enterica enterica serovar Typhi Ty2
ucaccgaugacauuacc

SEQ ID NO: 1749887 - RNA, 14 nt, Salmonella enterica enterica serovar Typhi Ty2
ucaccgcaugacaa

SEQ ID NO: 1749888 - RNA, 18 nt, Salmonella enterica enterica serovar Typhi Ty2
ucacccgcgccagcaggu

SEQ ID NO: 1749889 - RNA, 17 nt, Salmonella enterica enterica serovar Typhi Ty2
ucacccgcgccagcagg

SEQ ID NO: 1749890 - RNA, 14 nt, Salmonella enterica enterica serovar Typhi Ty2
ucacccugaauuuc

SEQ ID NO: 1749891 - RNA, 16 nt, Salmonella enterica enterica serovar Typhi Ty2
ucacccugaauuucaa

SEQ ID NO: 1749892 - RNA, 20 nt, Salmonella enterica enterica serovar Typhi Ty2
ucacccugaauuucaauaau

SEQ ID NO: 1749893 - RNA, 17 nt, Salmonella enterica enterica serovar Typhi Ty2
ucacccuauaagcugcc

SEQ ID NO: 1749894 - RNA, 18 nt, Salmonella enterica enterica serovar Typhi Ty2
ucacccgccggcagcagc

SEQ ID NO: 1749895 - RNA, 14 nt, Salmonella enterica enterica serovar Typhi Ty2
ucacccgauaaaau

SEQ ID NO: 1749896 - RNA, 22 nt, Salmonella enterica enterica serovar Typhi Ty2
ucaccccagcgguaaaaucugu

SEQ ID NO: 1749897 - RNA, 21 nt, Salmonella enterica enterica serovar Typhi Ty2
ucaccccgucauauuacauag

SEQ ID NO: 1749898 - RNA, 19 nt, Salmonella enterica enterica serovar Typhi Ty2
ucaauugugugcacugcac

SEQ ID NO: 1749899 - RNA, 15 nt, Salmonella enterica enterica serovar Typhi Ty2
ucaauuucauauuau

SEQ ID NO: 1749900 - RNA, 15 nt, Salmonella enterica enterica serovar Typhi Ty2
ucacaaacaauuucc

SEQ ID NO: 1749901 - RNA, 22 nt, Salmonella enterica enterica serovar Typhi Ty2
ucacaaacaauuucccccacuu

SEQ ID NO: 1749902 - RNA, 13 nt, Salmonella enterica enterica serovar Typhi Ty2
ucacaaaaucauu

SEQ ID NO: 1749903 - RNA, 18 nt, Salmonella enterica enterica serovar Typhi Ty2
ucaauuuuucgcccggcu

SEQ ID NO: 1749904 - RNA, 23 nt, Salmonella enterica enterica serovar Typhi Ty2
ucacaaacaccaccaguaaccgc

SEQ ID NO: 1749905 - RNA, 14 nt, Salmonella enterica enterica serovar Typhi Ty2
ucacaaauuaaaaa

SEQ ID NO: 1749906 - RNA, 22 nt, Salmonella enterica enterica serovar Typhi Ty2
ucaaucacuugaagccuuucug

SEQ ID NO: 1749907 - RNA, 16 nt, Salmonella enterica enterica serovar Typhi Ty2
ucaaucaucagaagaa

SEQ ID NO: 1749908 - RNA, 17 nt, Salmonella enterica enterica serovar Typhi Ty2
ucaaucaucauaucccg

SEQ ID NO: 1749909 - RNA, 12 nt, Salmonella enterica enterica serovar Typhi Ty2
ucaaucaggcua

SEQ ID NO: 1749910 - RNA, 19 nt, Salmonella enterica enterica serovar Typhi Ty2
ucaauccaacgaaacucag

SEQ ID NO: 1749911 - RNA, 17 nt, Salmonella enterica enterica serovar Typhi Ty2
ucaaucggcgauagagu

SEQ ID NO: 1749912 - RNA, 18 nt, Salmonella enterica enterica serovar Typhi Ty2
ucaaucgucguuccgcca

SEQ ID NO: 1749913 - RNA, 16 nt, Salmonella enterica enterica serovar Typhi Ty2
ucaaucgccugcugua

SEQ ID NO: 1749914 - RNA, 14 nt, Salmonella enterica enterica serovar Typhi Ty2
ucaaucuucccgca

SEQ ID NO: 1749915 - RNA, 16 nt, Salmonella enterica enterica serovar Typhi Ty2
ucaaugcccagcgcaa

SEQ ID NO: 1749916 - RNA, 22 nt, Salmonella enterica enterica serovar Typhi Ty2
ucaaugcccuuaaauccggccu

SEQ ID NO: 1749917 - RNA, 17 nt, Salmonella enterica enterica serovar Typhi Ty2
ucaauggccuugccagc

SEQ ID NO: 1749918 - RNA, 15 nt, Salmonella enterica enterica serovar Typhi Ty2
ucaaugccuggcaga

SEQ ID NO: 1749919 - RNA, 19 nt, Salmonella enterica enterica serovar Typhi Ty2
ucaauguuagcauuauuuu

SEQ ID NO: 1749920 - RNA, 20 nt, Salmonella enterica enterica serovar Typhi Ty2
ucaaugggauagugccugcc

SEQ ID NO: 1749921 - RNA, 21 nt, Salmonella enterica enterica serovar Typhi Ty2
ucaaguuuagaaaaaauuaaa

SEQ ID NO: 1749922 - RNA, 22 nt, Salmonella enterica enterica serovar Typhi Ty2
ucaaguuuagaaaaaauuaaaa

SEQ ID NO: 1749923 - RNA, 15 nt, Salmonella enterica enterica serovar Typhi Ty2
ucaaguuuagaaaaa

SEQ ID NO: 1749924 - RNA, 16 nt, Salmonella enterica enterica serovar Typhi Ty2
ucaauaaacagcuccg

SEQ ID NO: 1749925 - RNA, 21 nt, Salmonella enterica enterica serovar Typhi Ty2
ucaauaaacauuuuuuuugca

SEQ ID NO: 1749926 - RNA, 16 nt, Salmonella enterica enterica serovar Typhi Ty2
ucaauaaaucaacaua

SEQ ID NO: 1749927 - RNA, 13 nt, Salmonella enterica enterica serovar Typhi Ty2
ucaaguacagcuu

SEQ ID NO: 1749928 - RNA, 23 nt, Salmonella enterica enterica serovar Typhi Ty2
ucaaggauggagauaucaccauc

SEQ ID NO: 1749929 - RNA, 16 nt, Salmonella enterica enterica serovar Typhi Ty2
ucaaggcauccagcag

SEQ ID NO: 1749930 - RNA, 19 nt, Salmonella enterica enterica serovar Typhi Ty2
ucaaggcauccagcagucg

SEQ ID NO: 1749931 - RNA, 15 nt, Salmonella enterica enterica serovar Typhi Ty2
ucaaggcgcaaaacc

SEQ ID NO: 1749932 - RNA, 19 nt, Salmonella enterica enterica serovar Typhi Ty2
ucaagguagcgugucuacc

SEQ ID NO: 1749933 - RNA, 22 nt, Salmonella enterica enterica serovar Typhi Ty2
ucaagcguuuccagaguacauu

SEQ ID NO: 1749934 - RNA, 22 nt, Salmonella enterica enterica serovar Typhi Ty2
ucaagcugauugauuuuguaau

SEQ ID NO: 1749935 - RNA, 16 nt, Salmonella enterica enterica serovar Typhi Ty2
ucaagcuggugcuuua

SEQ ID NO: 1749936 - RNA, 12 nt, Salmonella enterica enterica serovar Typhi Ty2
ucaauaacgaag

SEQ ID NO: 1749937 - RNA, 14 nt, Salmonella enterica enterica serovar Typhi Ty2
ucaauaagauaucc

SEQ ID NO: 1749938 - RNA, 22 nt, Salmonella enterica enterica serovar Typhi Ty2
ucaauaagaaacugcuguagca

SEQ ID NO: 1749939 - RNA, 13 nt, Salmonella enterica enterica serovar Typhi Ty2
ucaauaauauuau

SEQ ID NO: 1749940 - RNA, 15 nt, Salmonella enterica enterica serovar Typhi Ty2
ucaauaaucccuucu

SEQ ID NO: 1749941 - RNA, 20 nt, Salmonella enterica enterica serovar Typhi Ty2
ucaauacgagugacauuauu

SEQ ID NO: 1749942 - RNA, 22 nt, Salmonella enterica enterica serovar Typhi Ty2
ucaauacgagugacauuauuca

SEQ ID NO: 1749943 - RNA, 18 nt, Salmonella enterica enterica serovar Typhi Ty2
ucaauagagcgcagcaaa

SEQ ID NO: 1749944 - RNA, 21 nt, Salmonella enterica enterica serovar Typhi Ty2
ucaauaauggcgcgaaaacag

SEQ ID NO: 1749945 - RNA, 16 nt, Salmonella enterica enterica serovar Typhi Ty2
ucaauaguuaauuaaa

SEQ ID NO: 1749946 - RNA, 18 nt, Salmonella enterica enterica serovar Typhi Ty2
ucaauauugaacauuuuu

SEQ ID NO: 1749947 - RNA, 18 nt, Salmonella enterica enterica serovar Typhi Ty2
ucaaucacaaaauggcug

SEQ ID NO: 1749948 - RNA, 13 nt, Salmonella enterica enterica serovar Typhi Ty2
ucaaucaacucuu

SEQ ID NO: 1749949 - RNA, 18 nt, Salmonella enterica enterica serovar Typhi Ty2
ucacugccguacaaaccg

SEQ ID NO: 1749950 - RNA, 19 nt, Salmonella enterica enterica serovar Typhi Ty2
ucacugacuauccacagcg

SEQ ID NO: 1749951 - RNA, 14 nt, Salmonella enterica enterica serovar Typhi Ty2
ucacuguaaaaggg

SEQ ID NO: 1749952 - RNA, 19 nt, Salmonella enterica enterica serovar Typhi Ty2
ucacuggcggcaagcugcu

SEQ ID NO: 1749953 - RNA, 14 nt, Salmonella enterica enterica serovar Typhi Ty2
ucacuucaucauca

SEQ ID NO: 1749954 - RNA, 21 nt, Salmonella enterica enterica serovar Typhi Ty2
ucacuuccgccaccacgccca

SEQ ID NO: 1749955 - RNA, 17 nt, Salmonella enterica enterica serovar Typhi Ty2
ucacuuguucaauauuc

SEQ ID NO: 1749956 - RNA, 18 nt, Salmonella enterica enterica serovar Typhi Ty2
ucacuuuucuuuccugca

SEQ ID NO: 1749957 - RNA, 20 nt, Salmonella enterica enterica serovar Typhi Ty2
ucacuuucagauuuuuaaug

SEQ ID NO: 1749958 - RNA, 18 nt, Salmonella enterica enterica serovar Typhi Ty2
ucacuccuuagauuaauc

SEQ ID NO: 1749959 - RNA, 18 nt, Salmonella enterica enterica serovar Typhi Ty2
ucacuacccggaggcaau

SEQ ID NO: 1749960 - RNA, 19 nt, Salmonella enterica enterica serovar Typhi Ty2
ucacuacccggaggcaaua

SEQ ID NO: 1749961 - RNA, 12 nt, Salmonella enterica enterica serovar Typhi Ty2
ucacuaauuuga

SEQ ID NO: 1749962 - RNA, 18 nt, Salmonella enterica enterica serovar Typhi Ty2
ucacuaauccccauuuuu

SEQ ID NO: 1749963 - RNA, 19 nt, Salmonella enterica enterica serovar Typhi Ty2
ucacguagcguaucagacu

SEQ ID NO: 1749964 - RNA, 17 nt, Salmonella enterica enterica serovar Typhi Ty2
ucacgucgcccaccgca

SEQ ID NO: 1749965 - RNA, 22 nt, Salmonella enterica enterica serovar Typhi Ty2
ucacgucgcgaagcugugcguu

SEQ ID NO: 1749966 - RNA, 15 nt, Salmonella enterica enterica serovar Typhi Ty2
ucacguuccccagca

SEQ ID NO: 1749967 - RNA, 18 nt, Salmonella enterica enterica serovar Typhi Ty2
ucacguuuugcagcgcca

SEQ ID NO: 1749968 - RNA, 20 nt, Salmonella enterica enterica serovar Typhi Ty2
ucacguuuugcagcgccauc

SEQ ID NO: 1749969 - RNA, 15 nt, Salmonella enterica enterica serovar Typhi Ty2
ucacguuuacuaaaa

SEQ ID NO: 1749970 - RNA, 14 nt, Salmonella enterica enterica serovar Typhi Ty2
ucacuaaaccagcu

SEQ ID NO: 1749971 - RNA, 14 nt, Salmonella enterica enterica serovar Typhi Ty2
ucacgauaauguuu

SEQ ID NO: 1749972 - RNA, 19 nt, Salmonella enterica enterica serovar Typhi Ty2
ucacgauccgcaaauuacu

SEQ ID NO: 1749973 - RNA, 13 nt, Salmonella enterica enterica serovar Typhi Ty2
ucacgauagcgcc

SEQ ID NO: 1749974 - RNA, 17 nt, Salmonella enterica enterica serovar Typhi Ty2
ucaccuuucugccaggu

SEQ ID NO: 1749975 - RNA, 21 nt, Salmonella enterica enterica serovar Typhi Ty2
ucaccuuuacuuaauucugcu

SEQ ID NO: 1749976 - RNA, 21 nt, Salmonella enterica enterica serovar Typhi Ty2
ucaccuugcugcgcaggggcu

SEQ ID NO: 1749977 - RNA, 17 nt, Salmonella enterica enterica serovar Typhi Ty2
ucacgaaauaacgcacu

SEQ ID NO: 1749978 - RNA, 12 nt, Salmonella enterica enterica serovar Typhi Ty2
ucaccuuucugc

SEQ ID NO: 1749979 - RNA, 22 nt, Salmonella enterica enterica serovar Typhi Ty2
ucaccuucugugaaaguuucag

SEQ ID NO: 1749980 - RNA, 17 nt, Salmonella enterica enterica serovar Typhi Ty2
ucaccuucugcgcagga

SEQ ID NO: 1749981 - RNA, 20 nt, Salmonella enterica enterica serovar Typhi Ty2
ucaccuucggugaaaucacg

SEQ ID NO: 1749982 - RNA, 21 nt, Salmonella enterica enterica serovar Typhi Ty2
ucaccuucggugaaaucacga

SEQ ID NO: 1749983 - RNA, 21 nt, Salmonella enterica enterica serovar Typhi Ty2
ucaccuggauuccuccaauuc

SEQ ID NO: 1749984 - RNA, 18 nt, Salmonella enterica enterica serovar Typhi Ty2
ucaccuggaugcugccug

SEQ ID NO: 1749985 - RNA, 16 nt, Salmonella enterica enterica serovar Typhi Ty2
ucaccucuuccccggu

SEQ ID NO: 1749986 - RNA, 16 nt, Salmonella enterica enterica serovar Typhi Ty2
ucaccuccgcuuuuau

SEQ ID NO: 1749987 - RNA, 17 nt, Salmonella enterica enterica serovar Typhi Ty2
ucacgcaaaugcagcgg

SEQ ID NO: 1749988 - RNA, 20 nt, Salmonella enterica enterica serovar Typhi Ty2
ucacgcagcgugaagcugcc

SEQ ID NO: 1749989 - RNA, 15 nt, Salmonella enterica enterica serovar Typhi Ty2
ucacgccguccagca

SEQ ID NO: 1749990 - RNA, 21 nt, Salmonella enterica enterica serovar Typhi Ty2
ucacgccgugaauuucugcug

SEQ ID NO: 1749991 - RNA, 23 nt, Salmonella enterica enterica serovar Typhi Ty2
ucacgccgugaauuucugcugcc

SEQ ID NO: 1749992 - RNA, 18 nt, Salmonella enterica enterica serovar Typhi Ty2
ucacgcccagcgcggccc

SEQ ID NO: 1749993 - RNA, 20 nt, Salmonella enterica enterica serovar Typhi Ty2
ucacgccaucgacaaaggca

SEQ ID NO: 1749994 - RNA, 16 nt, Salmonella enterica enterica serovar Typhi Ty2
ucacgguucgcaauca

SEQ ID NO: 1749995 - RNA, 17 nt, Salmonella enterica enterica serovar Typhi Ty2
ucacgggcguagucagc

SEQ ID NO: 1749996 - RNA, 18 nt, Salmonella enterica enterica serovar Typhi Ty2
ucacgguagaccaaaugg

SEQ ID NO: 1749997 - RNA, 18 nt, Salmonella enterica enterica serovar Typhi Ty2
ucacggcacgcccuucgu

SEQ ID NO: 1749998 - RNA, 23 nt, Salmonella enterica enterica serovar Typhi Ty2
ucacggccuucgcagaucgccug

SEQ ID NO: 1749999 - RNA, 19 nt, Salmonella enterica enterica serovar Typhi Ty2
ucacggcaucugcggcaug

SEQ ID NO: 1750000 - RNA, 17 nt, Salmonella enterica enterica serovar Typhi Ty2
ucacggcgaaucgccug

SEQ ID NO: 1750001 - RNA, 21 nt, Salmonella enterica enterica serovar Typhi Ty2
ucacgcuuaucgccaaaccag

SEQ ID NO: 1750002 - RNA, 12 nt, Salmonella enterica enterica serovar Typhi Ty2
ucacgcggcgcg

SEQ ID NO: 1750003 - RNA, 17 nt, Salmonella enterica enterica serovar Typhi Ty2
ucacgcgccagcaccac

SEQ ID NO: 1750004 - RNA, 21 nt, Salmonella enterica enterica serovar Typhi Ty2
ucacgcuauguuugcugagaa

SEQ ID NO: 1750005 - RNA, 20 nt, Salmonella enterica enterica serovar Typhi Ty2
ucacgcucgaguucuucacg

SEQ ID NO: 1750006 - RNA, 15 nt, Salmonella enterica enterica serovar Typhi Ty2
ucagaaauaaaacca

SEQ ID NO: 1750007 - RNA, 19 nt, Salmonella enterica enterica serovar Typhi Ty2
ucagaaauauucaguacug

SEQ ID NO: 1750008 - RNA, 13 nt, Salmonella enterica enterica serovar Typhi Ty2
ucagaaauucgca

SEQ ID NO: 1750009 - RNA, 20 nt, Salmonella enterica enterica serovar Typhi Ty2
ucagaauaccgcguccuucu

SEQ ID NO: 1750010 - RNA, 11 nt, Salmonella enterica enterica serovar Typhi Ty2
ucagacaggcc

SEQ ID NO: 1750011 - RNA, 21 nt, Salmonella enterica enterica serovar Typhi Ty2
ucagacaugauaaguuucucu

SEQ ID NO: 1750012 - RNA, 19 nt, Salmonella enterica enterica serovar Typhi Ty2
ucagaauauccgguacacc

SEQ ID NO: 1750013 - RNA, 20 nt, Salmonella enterica enterica serovar Typhi Ty2
ucagaauuuuuaaccaucac

SEQ ID NO: 1750014 - RNA, 20 nt, Salmonella enterica enterica serovar Typhi Ty2
ucagacacauucugugaucc

SEQ ID NO: 1750015 - RNA, 19 nt, Salmonella enterica enterica serovar Typhi Ty2
ucagacaccagcccuggcu

SEQ ID NO: 1750016 - RNA, 16 nt, Salmonella enterica enterica serovar Typhi Ty2
ucagacgcucagccuu

SEQ ID NO: 1750017 - RNA, 16 nt, Salmonella enterica enterica serovar Typhi Ty2
ucagacgcgcagugug

SEQ ID NO: 1750018 - RNA, 12 nt, Salmonella enterica enterica serovar Typhi Ty2
ucagacgcauca

SEQ ID NO: 1750019 - RNA, 23 nt, Salmonella enterica enterica serovar Typhi Ty2
ucagacgaccauccaccagaacc

SEQ ID NO: 1750020 - RNA, 14 nt, Salmonella enterica enterica serovar Typhi Ty2
ucagacgaggcgcg

SEQ ID NO: 1750021 - RNA, 19 nt, Salmonella enterica enterica serovar Typhi Ty2
ucagacgcucagccuuaua

SEQ ID NO: 1750022 - RNA, 16 nt, Salmonella enterica enterica serovar Typhi Ty2
ucagacggacaucaga

SEQ ID NO: 1750023 - RNA, 20 nt, Salmonella enterica enterica serovar Typhi Ty2
ucagacucucaaugcccauc

SEQ ID NO: 1750024 - RNA, 17 nt, Salmonella enterica enterica serovar Typhi Ty2
ucagacguagcgccauc

SEQ ID NO: 1750025 - RNA, 22 nt, Salmonella enterica enterica serovar Typhi Ty2
ucagaggccuuuugcagcagcg

SEQ ID NO: 1750026 - RNA, 21 nt, Salmonella enterica enterica serovar Typhi Ty2
ucagaggccuuuugcagcagc

SEQ ID NO: 1750027 - RNA, 15 nt, Salmonella enterica enterica serovar Typhi Ty2
ucagauaacgaacca

SEQ ID NO: 1750028 - RNA, 21 nt, Salmonella enterica enterica serovar Typhi Ty2
ucagauaaacagguaaaacaa

SEQ ID NO: 1750029 - RNA, 18 nt, Salmonella enterica enterica serovar Typhi Ty2
ucagauacggcuccagca

SEQ ID NO: 1750030 - RNA, 15 nt, Salmonella enterica enterica serovar Typhi Ty2
ucagauaauucuaaa

SEQ ID NO: 1750031 - RNA, 14 nt, Salmonella enterica enterica serovar Typhi Ty2
ucagauauuccagc

SEQ ID NO: 1750032 - RNA, 23 nt, Salmonella enterica enterica serovar Typhi Ty2
ucagauaggcgcgaaaugucccg

SEQ ID NO: 1750033 - RNA, 13 nt, Salmonella enterica enterica serovar Typhi Ty2
ucagauuacccuc

SEQ ID NO: 1750034 - RNA, 18 nt, Salmonella enterica enterica serovar Typhi Ty2
ucagauucagcauuggca

SEQ ID NO: 1750035 - RNA, 11 nt, Salmonella enterica enterica serovar Typhi Ty2
ucagcaaaaac

SEQ ID NO: 1750036 - RNA, 20 nt, Salmonella enterica enterica serovar Typhi Ty2
ucagcaaacggcuggauaac

SEQ ID NO: 1750037 - RNA, 14 nt, Salmonella enterica enterica serovar Typhi Ty2
ucagcaaaaacauu

SEQ ID NO: 1750038 - RNA, 17 nt, Salmonella enterica enterica serovar Typhi Ty2
ucagaucuuauaugagc

SEQ ID NO: 1750039 - RNA, 16 nt, Salmonella enterica enterica serovar Typhi Ty2
ucagauccuucauuca

SEQ ID NO: 1750040 - RNA, 12 nt, Salmonella enterica enterica serovar Typhi Ty2
ucagauccuuuu

SEQ ID NO: 1750041 - RNA, 13 nt, Salmonella enterica enterica serovar Typhi Ty2
ucagauccuuuuu

SEQ ID NO: 1750042 - RNA, 15 nt, Salmonella enterica enterica serovar Typhi Ty2
ucagccagcgaucag

SEQ ID NO: 1750043 - RNA, 16 nt, Salmonella enterica enterica serovar Typhi Ty2
ucagccagcagcucaa

SEQ ID NO: 1750044 - RNA, 16 nt, Salmonella enterica enterica serovar Typhi Ty2
ucagccacgacgcuca

SEQ ID NO: 1750045 - RNA, 12 nt, Salmonella enterica enterica serovar Typhi Ty2
ucagcauggugu

SEQ ID NO: 1750046 - RNA, 13 nt, Salmonella enterica enterica serovar Typhi Ty2
ucagcauggugug

SEQ ID NO: 1750047 - RNA, 19 nt, Salmonella enterica enterica serovar Typhi Ty2
ucagcauguuucuccugcc

SEQ ID NO: 1750048 - RNA, 19 nt, Salmonella enterica enterica serovar Typhi Ty2
ucagcauccgcaagacacg

SEQ ID NO: 1750049 - RNA, 18 nt, Salmonella enterica enterica serovar Typhi Ty2
ucagccaaacuccucacu

SEQ ID NO: 1750050 - RNA, 16 nt, Salmonella enterica enterica serovar Typhi Ty2
ucagccgggcgggaac

SEQ ID NO: 1750051 - RNA, 16 nt, Salmonella enterica enterica serovar Typhi Ty2
ucagccuuaaucaacu

SEQ ID NO: 1750052 - RNA, 13 nt, Salmonella enterica enterica serovar Typhi Ty2
ucagccugcuaca

SEQ ID NO: 1750053 - RNA, 16 nt, Salmonella enterica enterica serovar Typhi Ty2
ucagccuuuucauaug

SEQ ID NO: 1750054 - RNA, 22 nt, Salmonella enterica enterica serovar Typhi Ty2
ucagccgcgcuaucaaaaugca

SEQ ID NO: 1750055 - RNA, 15 nt, Salmonella enterica enterica serovar Typhi Ty2
ucagccgccggugac

SEQ ID NO: 1750056 - RNA, 15 nt, Salmonella enterica enterica serovar Typhi Ty2
ucagcccuuauauca

SEQ ID NO: 1750057 - RNA, 15 nt, Salmonella enterica enterica serovar Typhi Ty2
ucagcccuacaaagg

SEQ ID NO: 1750058 - RNA, 17 nt, Salmonella enterica enterica serovar Typhi Ty2
ucagcccgcaaaggacc

SEQ ID NO: 1750059 - RNA, 17 nt, Salmonella enterica enterica serovar Typhi Ty2
ucagcaauuucucgccc

SEQ ID NO: 1750060 - RNA, 20 nt, Salmonella enterica enterica serovar Typhi Ty2
ucagcaauuucucgcccgcc

SEQ ID NO: 1750061 - RNA, 13 nt, Salmonella enterica enterica serovar Typhi Ty2
ucagcaccuccag

SEQ ID NO: 1750062 - RNA, 18 nt, Salmonella enterica enterica serovar Typhi Ty2
ucagcaccuccagcgccu

SEQ ID NO: 1750063 - RNA, 19 nt, Salmonella enterica enterica serovar Typhi Ty2
ucagcaacggaagcugacc

SEQ ID NO: 1750064 - RNA, 13 nt, Salmonella enterica enterica serovar Typhi Ty2
ucagcaacugcgu

SEQ ID NO: 1750065 - RNA, 15 nt, Salmonella enterica enterica serovar Typhi Ty2
ucagcaacugcugcg

SEQ ID NO: 1750066 - RNA, 18 nt, Salmonella enterica enterica serovar Typhi Ty2
ucagcaacccuuuuucaa

SEQ ID NO: 1750067 - RNA, 15 nt, Salmonella enterica enterica serovar Typhi Ty2
ucagcaaugauuuuu

SEQ ID NO: 1750068 - RNA, 18 nt, Salmonella enterica enterica serovar Typhi Ty2
ucagcagcaccgguuuuu

SEQ ID NO: 1750069 - RNA, 21 nt, Salmonella enterica enterica serovar Typhi Ty2
ucagcagcaccgguuuuuccg

SEQ ID NO: 1750070 - RNA, 14 nt, Salmonella enterica enterica serovar Typhi Ty2
ucagcagcaccacu

SEQ ID NO: 1750071 - RNA, 13 nt, Salmonella enterica enterica serovar Typhi Ty2
ucagcagaacaaa

SEQ ID NO: 1750072 - RNA, 15 nt, Salmonella enterica enterica serovar Typhi Ty2
ucagcagccgggcca

SEQ ID NO: 1750073 - RNA, 21 nt, Salmonella enterica enterica serovar Typhi Ty2
ucagcauaauauccugcaccg

SEQ ID NO: 1750074 - RNA, 12 nt, Salmonella enterica enterica serovar Typhi Ty2
ucagcaguucau

SEQ ID NO: 1750075 - RNA, 17 nt, Salmonella enterica enterica serovar Typhi Ty2
ucagcauaaagccucuc

SEQ ID NO: 1750076 - RNA, 20 nt, Salmonella enterica enterica serovar Typhi Ty2
uagaugaaacucgcuguggc

SEQ ID NO: 1750077 - RNA, 16 nt, Salmonella enterica enterica serovar Typhi Ty2
uagaaaaggucgucag

SEQ ID NO: 1750078 - RNA, 20 nt, Salmonella enterica enterica serovar Typhi Ty2
uagauguuaaaguuuuucau

SEQ ID NO: 1750079 - RNA, 15 nt, Salmonella enterica enterica serovar Typhi Ty2
uagccauuuaaugau

SEQ ID NO: 1750080 - RNA, 15 nt, Salmonella enterica enterica serovar Typhi Ty2
uagccauucauuaaa

SEQ ID NO: 1750081 - RNA, 21 nt, Salmonella enterica enterica serovar Typhi Ty2
uagccccagaccgauauuuug

SEQ ID NO: 1750082 - RNA, 22 nt, Salmonella enterica enterica serovar Typhi Ty2
uagcccgccagcaccagcagcg

SEQ ID NO: 1750083 - RNA, 14 nt, Salmonella enterica enterica serovar Typhi Ty2
uagcccggcaggcu

SEQ ID NO: 1750084 - RNA, 23 nt, Salmonella enterica enterica serovar Typhi Ty2
uagcccgcuuuaccgaaaucggu

SEQ ID NO: 1750085 - RNA, 23 nt, Salmonella enterica enterica serovar Typhi Ty2
uagcauuuccgcaucguuaucau

SEQ ID NO: 1750086 - RNA, 23 nt, Salmonella enterica enterica serovar Typhi Ty2
uagcauuaagcugauauuuuacu

SEQ ID NO: 1750087 - RNA, 20 nt, Salmonella enterica enterica serovar Typhi Ty2
uagcaaccucggcuugcuuc

SEQ ID NO: 1750088 - RNA, 13 nt, Salmonella enterica enterica serovar Typhi Ty2
uagcaacccacuu

SEQ ID NO: 1750089 - RNA, 18 nt, Salmonella enterica enterica serovar Typhi Ty2
uagcaaagcguacaugaa

SEQ ID NO: 1750090 - RNA, 15 nt, Salmonella enterica enterica serovar Typhi Ty2
uagcaacuuaauaau

SEQ ID NO: 1750091 - RNA, 14 nt, Salmonella enterica enterica serovar Typhi Ty2
uagcagacagccga

SEQ ID NO: 1750092 - RNA, 19 nt, Salmonella enterica enterica serovar Typhi Ty2
uagcagcgaugacagcagg

SEQ ID NO: 1750093 - RNA, 23 nt, Salmonella enterica enterica serovar Typhi Ty2
uagcaggauauuuugcucauauu

SEQ ID NO: 1750094 - RNA, 12 nt, Salmonella enterica enterica serovar Typhi Ty2
uagcuguucaau

SEQ ID NO: 1750095 - RNA, 20 nt, Salmonella enterica enterica serovar Typhi Ty2
uagcuuaucgccaaagauau

SEQ ID NO: 1750096 - RNA, 11 nt, Salmonella enterica enterica serovar Typhi Ty2
uagcuuccagc

SEQ ID NO: 1750097 - RNA, 12 nt, Salmonella enterica enterica serovar Typhi Ty2
uagcuaugguca

SEQ ID NO: 1750098 - RNA, 18 nt, Salmonella enterica enterica serovar Typhi Ty2
uagcuauuccaaaauaau

SEQ ID NO: 1750099 - RNA, 19 nt, Salmonella enterica enterica serovar Typhi Ty2
uagcuuaaaaaauccugca

SEQ ID NO: 1750100 - RNA, 16 nt, Salmonella enterica enterica serovar Typhi Ty2
uagcuuacuuucagau

SEQ ID NO: 1750101 - RNA, 21 nt, Salmonella enterica enterica serovar Typhi Ty2
uagcuuacuuuuagaauuauc

SEQ ID NO: 1750102 - RNA, 20 nt, Salmonella enterica enterica serovar Typhi Ty2
uaggccaaacuuacgcagcu

SEQ ID NO: 1750103 - RNA, 13 nt, Salmonella enterica enterica serovar Typhi Ty2
uaggccaaacuua

SEQ ID NO: 1750104 - RNA, 21 nt, Salmonella enterica enterica serovar Typhi Ty2
uaggccagccgacgcucuucc

SEQ ID NO: 1750105 - RNA, 19 nt, Salmonella enterica enterica serovar Typhi Ty2
uaggccgaauaagccaggc

SEQ ID NO: 1750106 - RNA, 13 nt, Salmonella enterica enterica serovar Typhi Ty2
uaggcgguuucau

SEQ ID NO: 1750107 - RNA, 16 nt, Salmonella enterica enterica serovar Typhi Ty2
uagcgcggcagcgcgc

SEQ ID NO: 1750108 - RNA, 21 nt, Salmonella enterica enterica serovar Typhi Ty2
uagcgcgcgcuaauuuucagg

SEQ ID NO: 1750109 - RNA, 16 nt, Salmonella enterica enterica serovar Typhi Ty2
uagcgcgauuuucucg

SEQ ID NO: 1750110 - RNA, 15 nt, Salmonella enterica enterica serovar Typhi Ty2
uagcgcgcuuccugc

SEQ ID NO: 1750111 - RNA, 23 nt, Salmonella enterica enterica serovar Typhi Ty2
uagcgccccggugcuuucuccug

SEQ ID NO: 1750112 - RNA, 14 nt, Salmonella enterica enterica serovar Typhi Ty2
uagcgccauauaaa

SEQ ID NO: 1750113 - RNA, 14 nt, Salmonella enterica enterica serovar Typhi Ty2
uagcgccagacaga

SEQ ID NO: 1750114 - RNA, 21 nt, Salmonella enterica enterica serovar Typhi Ty2
uagcgccuucaggcaucagau

SEQ ID NO: 1750115 - RNA, 16 nt, Salmonella enterica enterica serovar Typhi Ty2
uagcgccuaugcuguc

SEQ ID NO: 1750116 - RNA, 14 nt, Salmonella enterica enterica serovar Typhi Ty2
uagcgcccuuuuuu

SEQ ID NO: 1750117 - RNA, 18 nt, Salmonella enterica enterica serovar Typhi Ty2
uagcgcaaauauccuacc

SEQ ID NO: 1750118 - RNA, 19 nt, Salmonella enterica enterica serovar Typhi Ty2
uagcgcaggggggaaauga

SEQ ID NO: 1750119 - RNA, 20 nt, Salmonella enterica enterica serovar Typhi Ty2
uagcgcaggggggaaaugag

SEQ ID NO: 1750120 - RNA, 20 nt, Salmonella enterica enterica serovar Typhi Ty2
uagcccucgguggauaaauu

SEQ ID NO: 1750121 - RNA, 19 nt, Salmonella enterica enterica serovar Typhi Ty2
uagcccugagcccacagcg

SEQ ID NO: 1750122 - RNA, 14 nt, Salmonella enterica enterica serovar Typhi Ty2
uagcgucuucagua

SEQ ID NO: 1750123 - RNA, 22 nt, Salmonella enterica enterica serovar Typhi Ty2
uagcuacguagcgcauugcgcc

SEQ ID NO: 1750124 - RNA, 17 nt, Salmonella enterica enterica serovar Typhi Ty2
uagcgucuuauccggcc

SEQ ID NO: 1750125 - RNA, 18 nt, Salmonella enterica enterica serovar Typhi Ty2
uagcgucucaucaaaaag

SEQ ID NO: 1750126 - RNA, 19 nt, Salmonella enterica enterica serovar Typhi Ty2
uagcguaucagacuuauac

SEQ ID NO: 1750127 - RNA, 18 nt, Salmonella enterica enterica serovar Typhi Ty2
uagcgucaacgcuuuuau

SEQ ID NO: 1750128 - RNA, 22 nt, Salmonella enterica enterica serovar Typhi Ty2
uagcguacuuucaaauagcugg

SEQ ID NO: 1750129 - RNA, 19 nt, Salmonella enterica enterica serovar Typhi Ty2
uagcggcuaaucaccaccu

SEQ ID NO: 1750130 - RNA, 21 nt, Salmonella enterica enterica serovar Typhi Ty2
uagcggcguuuauauaaaaau

SEQ ID NO: 1750131 - RNA, 23 nt, Salmonella enterica enterica serovar Typhi Ty2
uagcgggcaaugccaccagcgcc

SEQ ID NO: 1750132 - RNA, 14 nt, Salmonella enterica enterica serovar Typhi Ty2
uagcgggggccggc

SEQ ID NO: 1750133 - RNA, 16 nt, Salmonella enterica enterica serovar Typhi Ty2
uagcggguaaacagau

SEQ ID NO: 1750134 - RNA, 18 nt, Salmonella enterica enterica serovar Typhi Ty2
uagcggcaugucugucua

SEQ ID NO: 1750135 - RNA, 13 nt, Salmonella enterica enterica serovar Typhi Ty2
uagcggaacugcg

SEQ ID NO: 1750136 - RNA, 15 nt, Salmonella enterica enterica serovar Typhi Ty2
uaguaaucauacgcg

SEQ ID NO: 1750137 - RNA, 15 nt, Salmonella enterica enterica serovar Typhi Ty2
uaguaaugcaugguc

SEQ ID NO: 1750138 - RNA, 16 nt, Salmonella enterica enterica serovar Typhi Ty2
uaguaauaaagcguag

SEQ ID NO: 1750139 - RNA, 19 nt, Salmonella enterica enterica serovar Typhi Ty2
uaguaccgaacagccaggc

SEQ ID NO: 1750140 - RNA, 13 nt, Salmonella enterica enterica serovar Typhi Ty2
uaguaaagaaauu

SEQ ID NO: 1750141 - RNA, 18 nt, Salmonella enterica enterica serovar Typhi Ty2
uaguaaagaaauuuugca

SEQ ID NO: 1750142 - RNA, 21 nt, Salmonella enterica enterica serovar Typhi Ty2
uaguaaaccgguugcuccguu

SEQ ID NO: 1750143 - RNA, 11 nt, Salmonella enterica enterica serovar Typhi Ty2
uaguaaauagg

SEQ ID NO: 1750144 - RNA, 16 nt, Salmonella enterica enterica serovar Typhi Ty2
uaguaaauagaaaaua

SEQ ID NO: 1750145 - RNA, 22 nt, Salmonella enterica enterica serovar Typhi Ty2
uagguucgguaugccuuccaga

SEQ ID NO: 1750146 - RNA, 18 nt, Salmonella enterica enterica serovar Typhi Ty2
uagguucugcgaggugau

SEQ ID NO: 1750147 - RNA, 23 nt, Salmonella enterica enterica serovar Typhi Ty2
uagguuaaauagcaggcaaugau

SEQ ID NO: 1750148 - RNA, 14 nt, Salmonella enterica enterica serovar Typhi Ty2
uagucgagggugau

SEQ ID NO: 1750149 - RNA, 23 nt, Salmonella enterica enterica serovar Typhi Ty2
uagucgauggucucguugccauu

SEQ ID NO: 1750150 - RNA, 21 nt, Salmonella enterica enterica serovar Typhi Ty2
uaguccucagcgaauaucucu

SEQ ID NO: 1750151 - RNA, 15 nt, Salmonella enterica enterica serovar Typhi Ty2
uaguccauuacgcag

SEQ ID NO: 1750152 - RNA, 19 nt, Salmonella enterica enterica serovar Typhi Ty2
uagucaucgccuucauccg

SEQ ID NO: 1750153 - RNA, 17 nt, Salmonella enterica enterica serovar Typhi Ty2
uagucauugacagcaag

SEQ ID NO: 1750154 - RNA, 14 nt, Salmonella enterica enterica serovar Typhi Ty2
uaguccagcagcca

SEQ ID NO: 1750155 - RNA, 15 nt, Salmonella enterica enterica serovar Typhi Ty2
uaguauccauaauuu

SEQ ID NO: 1750156 - RNA, 18 nt, Salmonella enterica enterica serovar Typhi Ty2
uaguauuuacaaaaaaga

SEQ ID NO: 1750157 - RNA, 16 nt, Salmonella enterica enterica serovar Typhi Ty2
uaguacgcgcgccggu

SEQ ID NO: 1750158 - RNA, 23 nt, Salmonella enterica enterica serovar Typhi Ty2
uaguacguuccagcguuuccgga

SEQ ID NO: 1750159 - RNA, 13 nt, Salmonella enterica enterica serovar Typhi Ty2
uauaaguaacugg

SEQ ID NO: 1750160 - RNA, 16 nt, Salmonella enterica enterica serovar Typhi Ty2
uauaagcgugcaaccc

SEQ ID NO: 1750161 - RNA, 19 nt, Salmonella enterica enterica serovar Typhi Ty2
uauaagcgguauucagguu

SEQ ID NO: 1750162 - RNA, 17 nt, Salmonella enterica enterica serovar Typhi Ty2
uauaagcugccucuuug

SEQ ID NO: 1750163 - RNA, 13 nt, Salmonella enterica enterica serovar Typhi Ty2
uauaacuugcaaa

SEQ ID NO: 1750164 - RNA, 12 nt, Salmonella enterica enterica serovar Typhi Ty2
uauaacauaaau

SEQ ID NO: 1750165 - RNA, 18 nt, Salmonella enterica enterica serovar Typhi Ty2
uauaacagaauaagccag

SEQ ID NO: 1750166 - RNA, 22 nt, Salmonella enterica enterica serovar Typhi Ty2
uauaaauuuauuuuuugcuggg

SEQ ID NO: 1750167 - RNA, 17 nt, Salmonella enterica enterica serovar Typhi Ty2
uauaaaguucccaugcu

SEQ ID NO: 1750168 - RNA, 15 nt, Salmonella enterica enterica serovar Typhi Ty2
uauaaccacgaaaau

SEQ ID NO: 1750169 - RNA, 20 nt, Salmonella enterica enterica serovar Typhi Ty2
uauaacucuuaauuauaaag

SEQ ID NO: 1750170 - RNA, 20 nt, Salmonella enterica enterica serovar Typhi Ty2
uauaacuaaacucaucuuua

SEQ ID NO: 1750171 - RNA, 23 nt, Salmonella enterica enterica serovar Typhi Ty2
uauaacuaaacucaucuuuauuc

SEQ ID NO: 1750172 - RNA, 21 nt, Salmonella enterica enterica serovar Typhi Ty2
uauaacgacagccuauuaauc

SEQ ID NO: 1750173 - RNA, 21 nt, Salmonella enterica enterica serovar Typhi Ty2
uaguuuagcgagcguucugca

SEQ ID NO: 1750174 - RNA, 12 nt, Salmonella enterica enterica serovar Typhi Ty2
uaguuguuuuau

SEQ ID NO: 1750175 - RNA, 20 nt, Salmonella enterica enterica serovar Typhi Ty2
uauaaaacgucacaauacuu

SEQ ID NO: 1750176 - RNA, 18 nt, Salmonella enterica enterica serovar Typhi Ty2
uauaaaaauagcuggcug

SEQ ID NO: 1750177 - RNA, 14 nt, Salmonella enterica enterica serovar Typhi Ty2
uauaaacucagcaa

SEQ ID NO: 1750178 - RNA, 22 nt, Salmonella enterica enterica serovar Typhi Ty2
uaguugacgccccauguggcca

SEQ ID NO: 1750179 - RNA, 19 nt, Salmonella enterica enterica serovar Typhi Ty2
uagugcaggcgcggucugg

SEQ ID NO: 1750180 - RNA, 22 nt, Salmonella enterica enterica serovar Typhi Ty2
uaucgcugcuaaacgagccguc

SEQ ID NO: 1750181 - RNA, 17 nt, Salmonella enterica enterica serovar Typhi Ty2
uaucgcuugauacgcca

SEQ ID NO: 1750182 - RNA, 13 nt, Salmonella enterica enterica serovar Typhi Ty2
uaucggccagcgc

SEQ ID NO: 1750183 - RNA, 14 nt, Salmonella enterica enterica serovar Typhi Ty2
uaucgccgaucaca

SEQ ID NO: 1750184 - RNA, 19 nt, Salmonella enterica enterica serovar Typhi Ty2
uaucgccguaaccgccugc

SEQ ID NO: 1750185 - RNA, 14 nt, Salmonella enterica enterica serovar Typhi Ty2
uaucgccucccugc

SEQ ID NO: 1750186 - RNA, 17 nt, Salmonella enterica enterica serovar Typhi Ty2
uaucgcgccagguauac

SEQ ID NO: 1750187 - RNA, 20 nt, Salmonella enterica enterica serovar Typhi Ty2
uaucgcgccggacagcagca

SEQ ID NO: 1750188 - RNA, 13 nt, Salmonella enterica enterica serovar Typhi Ty2
uaucgcgcuggca

SEQ ID NO: 1750189 - RNA, 23 nt, Salmonella enterica enterica serovar Typhi Ty2
uaucgcgccgccaauauccauuu

SEQ ID NO: 1750190 - RNA, 15 nt, Salmonella enterica enterica serovar Typhi Ty2
uaucgcgucaucaaa

SEQ ID NO: 1750191 - RNA, 15 nt, Salmonella enterica enterica serovar Typhi Ty2
uauccugcccuuuac

SEQ ID NO: 1750192 - RNA, 21 nt, Salmonella enterica enterica serovar Typhi Ty2
uauccucgcauccuccaucca

SEQ ID NO: 1750193 - RNA, 14 nt, Salmonella enterica enterica serovar Typhi Ty2
uaucgccaaaccag

SEQ ID NO: 1750194 - RNA, 17 nt, Salmonella enterica enterica serovar Typhi Ty2
uaucgccauauacgcca

SEQ ID NO: 1750195 - RNA, 19 nt, Salmonella enterica enterica serovar Typhi Ty2
uauccuggcgcguagaucu

SEQ ID NO: 1750196 - RNA, 14 nt, Salmonella enterica enterica serovar Typhi Ty2
uauccugcuugccu

SEQ ID NO: 1750197 - RNA, 18 nt, Salmonella enterica enterica serovar Typhi Ty2
uaucguugcgcgcaauca

SEQ ID NO: 1750198 - RNA, 23 nt, Salmonella enterica enterica serovar Typhi Ty2
uaucggcguguuucaucucauca

SEQ ID NO: 1750199 - RNA, 22 nt, Salmonella enterica enterica serovar Typhi Ty2
uaucuauuucuuagcgccagca

SEQ ID NO: 1750200 - RNA, 17 nt, Salmonella enterica enterica serovar Typhi Ty2
uaucucacggaaugacu

SEQ ID NO: 1750201 - RNA, 17 nt, Salmonella enterica enterica serovar Typhi Ty2
uaucugcauaggcuuua

SEQ ID NO: 1750202 - RNA, 14 nt, Salmonella enterica enterica serovar Typhi Ty2
uaucagaccgacaa

SEQ ID NO: 1750203 - RNA, 15 nt, Salmonella enterica enterica serovar Typhi Ty2
uaucagacaaucugu

SEQ ID NO: 1750204 - RNA, 23 nt, Salmonella enterica enterica serovar Typhi Ty2
uaucagacagaucgguuuauccc

SEQ ID NO: 1750205 - RNA, 17 nt, Salmonella enterica enterica serovar Typhi Ty2
uaucauuaugggcagca

SEQ ID NO: 1750206 - RNA, 12 nt, Salmonella enterica enterica serovar Typhi Ty2
uaucauuuccac

SEQ ID NO: 1750207 - RNA, 12 nt, Salmonella enterica enterica serovar Typhi Ty2
uauccacccggu

SEQ ID NO: 1750208 - RNA, 16 nt, Salmonella enterica enterica serovar Typhi Ty2
uauccauaauuuuccc

SEQ ID NO: 1750209 - RNA, 23 nt, Salmonella enterica enterica serovar Typhi Ty2
uauccaucagccaggguuuaauc

SEQ ID NO: 1750210 - RNA, 16 nt, Salmonella enterica enterica serovar Typhi Ty2
uauccguccucuuucc

SEQ ID NO: 1750211 - RNA, 21 nt, Salmonella enterica enterica serovar Typhi Ty2
uauccgugcgcaauuccagca

SEQ ID NO: 1750212 - RNA, 19 nt, Salmonella enterica enterica serovar Typhi Ty2
uauccguuauuuaauucuu

SEQ ID NO: 1750213 - RNA, 19 nt, Salmonella enterica enterica serovar Typhi Ty2
uauccuaaaucugccauca

SEQ ID NO: 1750214 - RNA, 19 nt, Salmonella enterica enterica serovar Typhi Ty2
uauccuaaugccacggcug

SEQ ID NO: 1750215 - RNA, 15 nt, Salmonella enterica enterica serovar Typhi Ty2
uauccuaaaucugcc

SEQ ID NO: 1750216 - RNA, 21 nt, Salmonella enterica enterica serovar Typhi Ty2
uauccgccaucgacagcgcca

SEQ ID NO: 1750217 - RNA, 16 nt, Salmonella enterica enterica serovar Typhi Ty2
uauccgccgcaaauuc

SEQ ID NO: 1750218 - RNA, 18 nt, Salmonella enterica enterica serovar Typhi Ty2
uauccgccugcugacaaa

SEQ ID NO: 1750219 - RNA, 15 nt, Salmonella enterica enterica serovar Typhi Ty2
uauaugcaaaacugu

SEQ ID NO: 1750220 - RNA, 22 nt, Salmonella enterica enterica serovar Typhi Ty2
uauaugcgacagaaauugaauu

SEQ ID NO: 1750221 - RNA, 20 nt, Salmonella enterica enterica serovar Typhi Ty2
uauaugcgacagaaauugaa

SEQ ID NO: 1750222 - RNA, 18 nt, Salmonella enterica enterica serovar Typhi Ty2
uauaucaugggaaaucac

SEQ ID NO: 1750223 - RNA, 21 nt, Salmonella enterica enterica serovar Typhi Ty2
uauauguccuuuacugcgcca

SEQ ID NO: 1750224 - RNA, 13 nt, Salmonella enterica enterica serovar Typhi Ty2
uaucaaaccagcu

SEQ ID NO: 1750225 - RNA, 22 nt, Salmonella enterica enterica serovar Typhi Ty2
uaucaaaaagacuccggcagca

SEQ ID NO: 1750226 - RNA, 11 nt, Salmonella enterica enterica serovar Typhi Ty2
uauauuuuuaa

SEQ ID NO: 1750227 - RNA, 18 nt, Salmonella enterica enterica serovar Typhi Ty2
uaucaagauaaaaagaca

SEQ ID NO: 1750228 - RNA, 14 nt, Salmonella enterica enterica serovar Typhi Ty2
uaucaaauacgcua

SEQ ID NO: 1750229 - RNA, 17 nt, Salmonella enterica enterica serovar Typhi Ty2
uaucaaacugaaaauca

SEQ ID NO: 1750230 - RNA, 12 nt, Salmonella enterica enterica serovar Typhi Ty2
uaucaccaucuu

SEQ ID NO: 1750231 - RNA, 20 nt, Salmonella enterica enterica serovar Typhi Ty2
uaucaccaucuuuuugcuca

SEQ ID NO: 1750232 - RNA, 12 nt, Salmonella enterica enterica serovar Typhi Ty2
uauauaauucau

SEQ ID NO: 1750233 - RNA, 21 nt, Salmonella enterica enterica serovar Typhi Ty2
uauaguuuuacgguuuauccc

SEQ ID NO: 1750234 - RNA, 21 nt, Salmonella enterica enterica serovar Typhi Ty2
uauaucaggcaaaaaucguca

SEQ ID NO: 1750235 - RNA, 13 nt, Salmonella enterica enterica serovar Typhi Ty2
uauaucaggcaaa

SEQ ID NO: 1750236 - RNA, 17 nt, Salmonella enterica enterica serovar Typhi Ty2
uauauaauuuauagcca

SEQ ID NO: 1750237 - RNA, 22 nt, Salmonella enterica enterica serovar Typhi Ty2
uauaguucgcauagaauuucag

SEQ ID NO: 1750238 - RNA, 14 nt, Salmonella enterica enterica serovar Typhi Ty2
uauagucuuaauuu

SEQ ID NO: 1750239 - RNA, 21 nt, Salmonella enterica enterica serovar Typhi Ty2
uauaguacgauagcaauuaau

SEQ ID NO: 1750240 - RNA, 19 nt, Salmonella enterica enterica serovar Typhi Ty2
uauaguccacuuucuguaa

SEQ ID NO: 1750241 - RNA, 16 nt, Salmonella enterica enterica serovar Typhi Ty2
uauaaucacagggguc

SEQ ID NO: 1750242 - RNA, 18 nt, Salmonella enterica enterica serovar Typhi Ty2
uaugccccgacaucagau

SEQ ID NO: 1750243 - RNA, 15 nt, Salmonella enterica enterica serovar Typhi Ty2
uaugccggagcgcuu

SEQ ID NO: 1750244 - RNA, 20 nt, Salmonella enterica enterica serovar Typhi Ty2
uaugccggaggauauuuauu

SEQ ID NO: 1750245 - RNA, 23 nt, Salmonella enterica enterica serovar Typhi Ty2
uaugccacucuuuuaaggcccuc

SEQ ID NO: 1750246 - RNA, 13 nt, Salmonella enterica enterica serovar Typhi Ty2
uaugcauugcuga

SEQ ID NO: 1750247 - RNA, 21 nt, Salmonella enterica enterica serovar Typhi Ty2
uaugccugccagcauuaaccc

SEQ ID NO: 1750248 - RNA, 19 nt, Salmonella enterica enterica serovar Typhi Ty2
uaugccugcacuaaaccag

SEQ ID NO: 1750249 - RNA, 19 nt, Salmonella enterica enterica serovar Typhi Ty2
uaugcgacugaaaaucaaa

SEQ ID NO: 1750250 - RNA, 14 nt, Salmonella enterica enterica serovar Typhi Ty2
uaugcgccuguuag

SEQ ID NO: 1750251 - RNA, 14 nt, Salmonella enterica enterica serovar Typhi Ty2
uaugcgcuuccagc

SEQ ID NO: 1750252 - RNA, 16 nt, Salmonella enterica enterica serovar Typhi Ty2
uaugcgcuuuuuucag

SEQ ID NO: 1750253 - RNA, 20 nt, Salmonella enterica enterica serovar Typhi Ty2
uaugcguuuuuaucuuucuu

SEQ ID NO: 1750254 - RNA, 17 nt, Salmonella enterica enterica serovar Typhi Ty2
uaugcucaacuuccaga

SEQ ID NO: 1750255 - RNA, 18 nt, Salmonella enterica enterica serovar Typhi Ty2
uaugcguugacccgucca

SEQ ID NO: 1750256 - RNA, 20 nt, Salmonella enterica enterica serovar Typhi Ty2
uaugcucccggggauuucuu

SEQ ID NO: 1750257 - RNA, 14 nt, Salmonella enterica enterica serovar Typhi Ty2
uaugcuguuuaugg

SEQ ID NO: 1750258 - RNA, 16 nt, Salmonella enterica enterica serovar Typhi Ty2
uauggaggauauaaaa

SEQ ID NO: 1750259 - RNA, 22 nt, Salmonella enterica enterica serovar Typhi Ty2
uauggcgcaaguguauggcugg

SEQ ID NO: 1750260 - RNA, 16 nt, Salmonella enterica enterica serovar Typhi Ty2
uauguuguugagacgg

SEQ ID NO: 1750261 - RNA, 19 nt, Salmonella enterica enterica serovar Typhi Ty2
uauguuccuggauagauuu

SEQ ID NO: 1750262 - RNA, 19 nt, Salmonella enterica enterica serovar Typhi Ty2
uaugugcaucggcacagcg

SEQ ID NO: 1750263 - RNA, 20 nt, Salmonella enterica enterica serovar Typhi Ty2
uaugugccgcccaggccuga

SEQ ID NO: 1750264 - RNA, 23 nt, Salmonella enterica enterica serovar Typhi Ty2
uaugugacaaucacucucuugua

SEQ ID NO: 1750265 - RNA, 18 nt, Salmonella enterica enterica serovar Typhi Ty2
uauguuaggguagaaaaa

SEQ ID NO: 1750266 - RNA, 14 nt, Salmonella enterica enterica serovar Typhi Ty2
uauguuauuuacaa

SEQ ID NO: 1750267 - RNA, 22 nt, Salmonella enterica enterica serovar Typhi Ty2
uauguaggccugauaagguaaa

SEQ ID NO: 1750268 - RNA, 18 nt, Salmonella enterica enterica serovar Typhi Ty2
uauguacgccaagcugca

SEQ ID NO: 1750269 - RNA, 17 nt, Salmonella enterica enterica serovar Typhi Ty2
uaugguacacauauggg

SEQ ID NO: 1750270 - RNA, 16 nt, Salmonella enterica enterica serovar Typhi Ty2
uauggguguagcucau

SEQ ID NO: 1750271 - RNA, 17 nt, Salmonella enterica enterica serovar Typhi Ty2
uauggugaguaauaaca

SEQ ID NO: 1750272 - RNA, 22 nt, Salmonella enterica enterica serovar Typhi Ty2
uaugggauaacgcagaagacag

SEQ ID NO: 1750273 - RNA, 12 nt, Salmonella enterica enterica serovar Typhi Ty2
uaugggcagcac

SEQ ID NO: 1750274 - RNA, 17 nt, Salmonella enterica enterica serovar Typhi Ty2
uauggguguagcucaua

SEQ ID NO: 1750275 - RNA, 17 nt, Salmonella enterica enterica serovar Typhi Ty2
uaugaagagaaacauac

SEQ ID NO: 1750276 - RNA, 14 nt, Salmonella enterica enterica serovar Typhi Ty2
uaugaagcuggagc

SEQ ID NO: 1750277 - RNA, 13 nt, Salmonella enterica enterica serovar Typhi Ty2
uaucuuuuuuagu

SEQ ID NO: 1750278 - RNA, 13 nt, Salmonella enterica enterica serovar Typhi Ty2
uaugaaagagaaa

SEQ ID NO: 1750279 - RNA, 17 nt, Salmonella enterica enterica serovar Typhi Ty2
uaugaaagagaaaucuc

SEQ ID NO: 1750280 - RNA, 20 nt, Salmonella enterica enterica serovar Typhi Ty2
uaugaaaccccaaaucagca

SEQ ID NO: 1750281 - RNA, 22 nt, Salmonella enterica enterica serovar Typhi Ty2
uaugaaaccccaaaucagcaaa

SEQ ID NO: 1750282 - RNA, 13 nt, Salmonella enterica enterica serovar Typhi Ty2
uaucuugcuuuau

SEQ ID NO: 1750283 - RNA, 20 nt, Salmonella enterica enterica serovar Typhi Ty2
uaucuugaugauucacccuc

SEQ ID NO: 1750284 - RNA, 13 nt, Salmonella enterica enterica serovar Typhi Ty2
uaucuugauauca

SEQ ID NO: 1750285 - RNA, 22 nt, Salmonella enterica enterica serovar Typhi Ty2
uaucuuuauugaaaagcagcca

SEQ ID NO: 1750286 - RNA, 15 nt, Salmonella enterica enterica serovar Typhi Ty2
uaucugcccuuucuu

SEQ ID NO: 1750287 - RNA, 18 nt, Salmonella enterica enterica serovar Typhi Ty2
uaucugcccuuucuuaug

SEQ ID NO: 1750288 - RNA, 12 nt, Salmonella enterica enterica serovar Typhi Ty2
uaucugcccuuu

SEQ ID NO: 1750289 - RNA, 21 nt, Salmonella enterica enterica serovar Typhi Ty2
uaucugccagccgauuuuucg

SEQ ID NO: 1750290 - RNA, 20 nt, Salmonella enterica enterica serovar Typhi Ty2
uaucuucugcugcucccuca

SEQ ID NO: 1750291 - RNA, 18 nt, Salmonella enterica enterica serovar Typhi Ty2
uaucugcugacacccucu

SEQ ID NO: 1750292 - RNA, 18 nt, Salmonella enterica enterica serovar Typhi Ty2
uaucuggauacccccuau

SEQ ID NO: 1750293 - RNA, 18 nt, Salmonella enterica enterica serovar Typhi Ty2
uaugacugcgaauuuccu

SEQ ID NO: 1750294 - RNA, 17 nt, Salmonella enterica enterica serovar Typhi Ty2
uaugaccgagucuacau

SEQ ID NO: 1750295 - RNA, 15 nt, Salmonella enterica enterica serovar Typhi Ty2
uaugaccaauggcgc

SEQ ID NO: 1750296 - RNA, 23 nt, Salmonella enterica enterica serovar Typhi Ty2
uaugaccccuccggccagcgcca

SEQ ID NO: 1750297 - RNA, 15 nt, Salmonella enterica enterica serovar Typhi Ty2
uaugacaacauaaag

SEQ ID NO: 1750298 - RNA, 19 nt, Salmonella enterica enterica serovar Typhi Ty2
uaugaauuauuuucuaaaa

SEQ ID NO: 1750299 - RNA, 23 nt, Salmonella enterica enterica serovar Typhi Ty2
uaugauagccguucuccagcguu

SEQ ID NO: 1750300 - RNA, 11 nt, Salmonella enterica enterica serovar Typhi Ty2
uaugcaaaaua

SEQ ID NO: 1750301 - RNA, 14 nt, Salmonella enterica enterica serovar Typhi Ty2
uaugcaaaagaaaa

SEQ ID NO: 1750302 - RNA, 20 nt, Salmonella enterica enterica serovar Typhi Ty2
uaugaucgacaaugaucaga

SEQ ID NO: 1750303 - RNA, 16 nt, Salmonella enterica enterica serovar Typhi Ty2
uaugaucugcacaaca

SEQ ID NO: 1750304 - RNA, 12 nt, Salmonella enterica enterica serovar Typhi Ty2
uaugauuuaaaa

SEQ ID NO: 1750305 - RNA, 15 nt, Salmonella enterica enterica serovar Typhi Ty2
uaugauuuaaaaaag

SEQ ID NO: 1750306 - RNA, 19 nt, Salmonella enterica enterica serovar Typhi Ty2
uacugucuuguggaacacc

SEQ ID NO: 1750307 - RNA, 21 nt, Salmonella enterica enterica serovar Typhi Ty2
uacugucaucccgauauacca

SEQ ID NO: 1750308 - RNA, 15 nt, Salmonella enterica enterica serovar Typhi Ty2
uacuggcuaucuuua

SEQ ID NO: 1750309 - RNA, 15 nt, Salmonella enterica enterica serovar Typhi Ty2
uacuggcgauuuuca

SEQ ID NO: 1750310 - RNA, 17 nt, Salmonella enterica enterica serovar Typhi Ty2
uacuggcgauuuucaua

SEQ ID NO: 1750311 - RNA, 22 nt, Salmonella enterica enterica serovar Typhi Ty2
uacuggcgauuuucauagcugg

SEQ ID NO: 1750312 - RNA, 19 nt, Salmonella enterica enterica serovar Typhi Ty2
uacuggauaaccgcuucga

SEQ ID NO: 1750313 - RNA, 17 nt, Salmonella enterica enterica serovar Typhi Ty2
uacuucgcuuuguuuuc

SEQ ID NO: 1750314 - RNA, 22 nt, Salmonella enterica enterica serovar Typhi Ty2
uacuuccgguugaccgcauaau

SEQ ID NO: 1750315 - RNA, 14 nt, Salmonella enterica enterica serovar Typhi Ty2
uacuuaaaauugaa

SEQ ID NO: 1750316 - RNA, 16 nt, Salmonella enterica enterica serovar Typhi Ty2
uacuuaaaauugaauu

SEQ ID NO: 1750317 - RNA, 18 nt, Salmonella enterica enterica serovar Typhi Ty2
uacuuaauucugcugccu

SEQ ID NO: 1750318 - RNA, 19 nt, Salmonella enterica enterica serovar Typhi Ty2
uacuuauagcuggcuuuau

SEQ ID NO: 1750319 - RNA, 14 nt, Salmonella enterica enterica serovar Typhi Ty2
uacuuauauuuauu

SEQ ID NO: 1750320 - RNA, 19 nt, Salmonella enterica enterica serovar Typhi Ty2
uacuuucagauaauucuaa

SEQ ID NO: 1750321 - RNA, 18 nt, Salmonella enterica enterica serovar Typhi Ty2
uacuuucuugccacuggc

SEQ ID NO: 1750322 - RNA, 19 nt, Salmonella enterica enterica serovar Typhi Ty2
uacuuugcgcccagauaau

SEQ ID NO: 1750323 - RNA, 17 nt, Salmonella enterica enterica serovar Typhi Ty2
uacuuuggccuaacagu

SEQ ID NO: 1750324 - RNA, 13 nt, Salmonella enterica enterica serovar Typhi Ty2
uagaaaaaauuaa

SEQ ID NO: 1750325 - RNA, 16 nt, Salmonella enterica enterica serovar Typhi Ty2
uagaaaaaauuaaaaa

SEQ ID NO: 1750326 - RNA, 18 nt, Salmonella enterica enterica serovar Typhi Ty2
uagaaaaaauuaaaaaua

SEQ ID NO: 1750327 - RNA, 17 nt, Salmonella enterica enterica serovar Typhi Ty2
uagaaaaagguaacuau

SEQ ID NO: 1750328 - RNA, 23 nt, Salmonella enterica enterica serovar Typhi Ty2
uacuucuucaguuccgccagacu

SEQ ID NO: 1750329 - RNA, 21 nt, Salmonella enterica enterica serovar Typhi Ty2
uacuuuauaaaucaggaaaaa

SEQ ID NO: 1750330 - RNA, 12 nt, Salmonella enterica enterica serovar Typhi Ty2
uacuuucaaaau

SEQ ID NO: 1750331 - RNA, 15 nt, Salmonella enterica enterica serovar Typhi Ty2
uacuuucaaaauacu

SEQ ID NO: 1750332 - RNA, 14 nt, Salmonella enterica enterica serovar Typhi Ty2
uacuuuaaaacaua

SEQ ID NO: 1750333 - RNA, 23 nt, Salmonella enterica enterica serovar Typhi Ty2
uacucuuucccggcaauuaccgc

SEQ ID NO: 1750334 - RNA, 13 nt, Salmonella enterica enterica serovar Typhi Ty2
uacugaccagaca

SEQ ID NO: 1750335 - RNA, 18 nt, Salmonella enterica enterica serovar Typhi Ty2
uacugaccaacaacagau

SEQ ID NO: 1750336 - RNA, 19 nt, Salmonella enterica enterica serovar Typhi Ty2
uacugaauaacagcaccau

SEQ ID NO: 1750337 - RNA, 19 nt, Salmonella enterica enterica serovar Typhi Ty2
uacucuuggagagcaucau

SEQ ID NO: 1750338 - RNA, 15 nt, Salmonella enterica enterica serovar Typhi Ty2
uacucuuccugcugc

SEQ ID NO: 1750339 - RNA, 12 nt, Salmonella enterica enterica serovar Typhi Ty2
uacucuuccucc

SEQ ID NO: 1750340 - RNA, 13 nt, Salmonella enterica enterica serovar Typhi Ty2
uacucuucacccu

SEQ ID NO: 1750341 - RNA, 17 nt, Salmonella enterica enterica serovar Typhi Ty2
uacugagcgccucugau

SEQ ID NO: 1750342 - RNA, 21 nt, Salmonella enterica enterica serovar Typhi Ty2
uacugauagcauuguauccag

SEQ ID NO: 1750343 - RNA, 20 nt, Salmonella enterica enterica serovar Typhi Ty2
uacugcaacgccagaugcgu

SEQ ID NO: 1750344 - RNA, 15 nt, Salmonella enterica enterica serovar Typhi Ty2
uacugccaaccauua

SEQ ID NO: 1750345 - RNA, 15 nt, Salmonella enterica enterica serovar Typhi Ty2
uacugcauuuucaau

SEQ ID NO: 1750346 - RNA, 22 nt, Salmonella enterica enterica serovar Typhi Ty2
uacugccgcccaucgccacagc

SEQ ID NO: 1750347 - RNA, 16 nt, Salmonella enterica enterica serovar Typhi Ty2
uacugcuggccuaucu

SEQ ID NO: 1750348 - RNA, 17 nt, Salmonella enterica enterica serovar Typhi Ty2
uacugcuggccuaucug

SEQ ID NO: 1750349 - RNA, 20 nt, Salmonella enterica enterica serovar Typhi Ty2
uacugcuggccuaucuguuc

SEQ ID NO: 1750350 - RNA, 18 nt, Salmonella enterica enterica serovar Typhi Ty2
uacugcgcguggcaaaua

SEQ ID NO: 1750351 - RNA, 21 nt, Salmonella enterica enterica serovar Typhi Ty2
uacugcggguguccguuccug

SEQ ID NO: 1750352 - RNA, 22 nt, Salmonella enterica enterica serovar Typhi Ty2
uacucagggcaaaaaugaucac

SEQ ID NO: 1750353 - RNA, 14 nt, Salmonella enterica enterica serovar Typhi Ty2
uacucaguuugccg

SEQ ID NO: 1750354 - RNA, 22 nt, Salmonella enterica enterica serovar Typhi Ty2
uacuccagcagaccggcaaaaa

SEQ ID NO: 1750355 - RNA, 13 nt, Salmonella enterica enterica serovar Typhi Ty2
uacuccagcagac

SEQ ID NO: 1750356 - RNA, 14 nt, Salmonella enterica enterica serovar Typhi Ty2
uacuccacaguuca

SEQ ID NO: 1750357 - RNA, 21 nt, Salmonella enterica enterica serovar Typhi Ty2
uacucguaaucuaaaauuauu

SEQ ID NO: 1750358 - RNA, 22 nt, Salmonella enterica enterica serovar Typhi Ty2
uacucgccaauauccccagccc

SEQ ID NO: 1750359 - RNA, 18 nt, Salmonella enterica enterica serovar Typhi Ty2
uacuccguuuuaaucuuu

SEQ ID NO: 1750360 - RNA, 15 nt, Salmonella enterica enterica serovar Typhi Ty2
uacuccguuuuaauc

SEQ ID NO: 1750361 - RNA, 20 nt, Salmonella enterica enterica serovar Typhi Ty2
uacucgacgcacuccagaug

SEQ ID NO: 1750362 - RNA, 16 nt, Salmonella enterica enterica serovar Typhi Ty2
uacgugaaacugauag

SEQ ID NO: 1750363 - RNA, 12 nt, Salmonella enterica enterica serovar Typhi Ty2
uacguuuauucu

SEQ ID NO: 1750364 - RNA, 13 nt, Salmonella enterica enterica serovar Typhi Ty2
uacuauuuuucac

SEQ ID NO: 1750365 - RNA, 20 nt, Salmonella enterica enterica serovar Typhi Ty2
uacucacauucauaaaagau

SEQ ID NO: 1750366 - RNA, 16 nt, Salmonella enterica enterica serovar Typhi Ty2
uacucacauucauaaa

SEQ ID NO: 1750367 - RNA, 13 nt, Salmonella enterica enterica serovar Typhi Ty2
uacucacugccgc

SEQ ID NO: 1750368 - RNA, 20 nt, Salmonella enterica enterica serovar Typhi Ty2
uacucacgacuuucaccaga

SEQ ID NO: 1750369 - RNA, 23 nt, Salmonella enterica enterica serovar Typhi Ty2
uaccccuguucaaaauagcuuuc

SEQ ID NO: 1750370 - RNA, 21 nt, Salmonella enterica enterica serovar Typhi Ty2
uaccccuuuuucaauuuccag

SEQ ID NO: 1750371 - RNA, 15 nt, Salmonella enterica enterica serovar Typhi Ty2
uacccgacucuuuuu

SEQ ID NO: 1750372 - RNA, 17 nt, Salmonella enterica enterica serovar Typhi Ty2
uaccccggcgcggcgcg

SEQ ID NO: 1750373 - RNA, 16 nt, Salmonella enterica enterica serovar Typhi Ty2
uaccccgccaccgccg

SEQ ID NO: 1750374 - RNA, 18 nt, Salmonella enterica enterica serovar Typhi Ty2
uaccccaggggcauauau

SEQ ID NO: 1750375 - RNA, 19 nt, Salmonella enterica enterica serovar Typhi Ty2
uacccgauaccgccagccc

SEQ ID NO: 1750376 - RNA, 20 nt, Salmonella enterica enterica serovar Typhi Ty2
uacccuauuuacagagcaau

SEQ ID NO: 1750377 - RNA, 12 nt, Salmonella enterica enterica serovar Typhi Ty2
uacccucugcac

SEQ ID NO: 1750378 - RNA, 13 nt, Salmonella enterica enterica serovar Typhi Ty2
uacccucugcguc

SEQ ID NO: 1750379 - RNA, 14 nt, Salmonella enterica enterica serovar Typhi Ty2
uacccuucagauau

SEQ ID NO: 1750380 - RNA, 19 nt, Salmonella enterica enterica serovar Typhi Ty2
uacccuuuucuuuaaacaa

SEQ ID NO: 1750381 - RNA, 15 nt, Salmonella enterica enterica serovar Typhi Ty2
uaccgccgcgaaccu

SEQ ID NO: 1750382 - RNA, 14 nt, Salmonella enterica enterica serovar Typhi Ty2
uaccgccgagcauu

SEQ ID NO: 1750383 - RNA, 16 nt, Salmonella enterica enterica serovar Typhi Ty2
uaccgccagcggcguu

SEQ ID NO: 1750384 - RNA, 23 nt, Salmonella enterica enterica serovar Typhi Ty2
uaccgauuguuuggugcugaaau

SEQ ID NO: 1750385 - RNA, 18 nt, Salmonella enterica enterica serovar Typhi Ty2
uaccgcaauaaacacgau

SEQ ID NO: 1750386 - RNA, 14 nt, Salmonella enterica enterica serovar Typhi Ty2
uaccgccguagaaa

SEQ ID NO: 1750387 - RNA, 17 nt, Salmonella enterica enterica serovar Typhi Ty2
uaccgccuucagcgcgc

SEQ ID NO: 1750388 - RNA, 15 nt, Salmonella enterica enterica serovar Typhi Ty2
uaccgcuaaaauacc

SEQ ID NO: 1750389 - RNA, 23 nt, Salmonella enterica enterica serovar Typhi Ty2
uaccgggccuccuuuccugugcu

SEQ ID NO: 1750390 - RNA, 15 nt, Salmonella enterica enterica serovar Typhi Ty2
uaccgggccuacgga

SEQ ID NO: 1750391 - RNA, 18 nt, Salmonella enterica enterica serovar Typhi Ty2
uaccggugcgauucagcg

SEQ ID NO: 1750392 - RNA, 14 nt, Salmonella enterica enterica serovar Typhi Ty2
uacauacauaccac

SEQ ID NO: 1750393 - RNA, 20 nt, Salmonella enterica enterica serovar Typhi Ty2
uacauaccccgcauuuaaca

SEQ ID NO: 1750394 - RNA, 21 nt, Salmonella enterica enterica serovar Typhi Ty2
uacauagaaaauauaugacaa

SEQ ID NO: 1750395 - RNA, 16 nt, Salmonella enterica enterica serovar Typhi Ty2
uacauagaaaauauau

SEQ ID NO: 1750396 - RNA, 20 nt, Salmonella enterica enterica serovar Typhi Ty2
uaccacgucugaagaaguuc

SEQ ID NO: 1750397 - RNA, 22 nt, Salmonella enterica enterica serovar Typhi Ty2
uaccacuucggcagaaaaagua

SEQ ID NO: 1750398 - RNA, 16 nt, Salmonella enterica enterica serovar Typhi Ty2
uaccacuucggcagaa

SEQ ID NO: 1750399 - RNA, 18 nt, Salmonella enterica enterica serovar Typhi Ty2
uaccacgccgcacacagc

SEQ ID NO: 1750400 - RNA, 17 nt, Salmonella enterica enterica serovar Typhi Ty2
uaccagauuaauaauag

SEQ ID NO: 1750401 - RNA, 14 nt, Salmonella enterica enterica serovar Typhi Ty2
uaccagcagcgcca

SEQ ID NO: 1750402 - RNA, 11 nt, Salmonella enterica enterica serovar Typhi Ty2
uaccagcaccu

SEQ ID NO: 1750403 - RNA, 14 nt, Salmonella enterica enterica serovar Typhi Ty2
uaccagaaccacuu

SEQ ID NO: 1750404 - RNA, 23 nt, Salmonella enterica enterica serovar Typhi Ty2
uaccagcgcgaacauuacauccu

SEQ ID NO: 1750405 - RNA, 17 nt, Salmonella enterica enterica serovar Typhi Ty2
uaccagcgauaguuguu

SEQ ID NO: 1750406 - RNA, 23 nt, Salmonella enterica enterica serovar Typhi Ty2
uaccagccuucggacugcuggua

SEQ ID NO: 1750407 - RNA, 22 nt, Salmonella enterica enterica serovar Typhi Ty2
uaccaggcagcgcgccagcgcu

SEQ ID NO: 1750408 - RNA, 15 nt, Salmonella enterica enterica serovar Typhi Ty2
uaccaggcagcgcgc

SEQ ID NO: 1750409 - RNA, 22 nt, Salmonella enterica enterica serovar Typhi Ty2
uaccagggaauaugauuuaaaa

SEQ ID NO: 1750410 - RNA, 23 nt, Salmonella enterica enterica serovar Typhi Ty2
uaccaggcggcuuuuucaucauc

SEQ ID NO: 1750411 - RNA, 18 nt, Salmonella enterica enterica serovar Typhi Ty2
uacccaaauuaauuuauu

SEQ ID NO: 1750412 - RNA, 13 nt, Salmonella enterica enterica serovar Typhi Ty2
uacccaaauuaau

SEQ ID NO: 1750413 - RNA, 12 nt, Salmonella enterica enterica serovar Typhi Ty2
uacguccauccg

SEQ ID NO: 1750414 - RNA, 23 nt, Salmonella enterica enterica serovar Typhi Ty2
uacgucgcacggaucaucuaccc

SEQ ID NO: 1750415 - RNA, 19 nt, Salmonella enterica enterica serovar Typhi Ty2
uacgucgcauacuuccuca

SEQ ID NO: 1750416 - RNA, 16 nt, Salmonella enterica enterica serovar Typhi Ty2
uacgucauaucaucca

SEQ ID NO: 1750417 - RNA, 20 nt, Salmonella enterica enterica serovar Typhi Ty2
uacggcuuucacaccguuau

SEQ ID NO: 1750418 - RNA, 18 nt, Salmonella enterica enterica serovar Typhi Ty2
uacgggcaugaagaaaau

SEQ ID NO: 1750419 - RNA, 23 nt, Salmonella enterica enterica serovar Typhi Ty2
uacggcaaacacaaucacgccca

SEQ ID NO: 1750420 - RNA, 20 nt, Salmonella enterica enterica serovar Typhi Ty2
uacggcaacgggacggcggc

SEQ ID NO: 1750421 - RNA, 20 nt, Salmonella enterica enterica serovar Typhi Ty2
uacggacugcggccugcaaa

SEQ ID NO: 1750422 - RNA, 23 nt, Salmonella enterica enterica serovar Typhi Ty2
uacggcugaaaaauccccccucc

SEQ ID NO: 1750423 - RNA, 16 nt, Salmonella enterica enterica serovar Typhi Ty2
uacggccauggaacau

SEQ ID NO: 1750424 - RNA, 14 nt, Salmonella enterica enterica serovar Typhi Ty2
uacgcaucaccagg

SEQ ID NO: 1750425 - RNA, 18 nt, Salmonella enterica enterica serovar Typhi Ty2
uacgcgccacgccauugc

SEQ ID NO: 1750426 - RNA, 18 nt, Salmonella enterica enterica serovar Typhi Ty2
uacgcagcgccuucgcuu

SEQ ID NO: 1750427 - RNA, 16 nt, Salmonella enterica enterica serovar Typhi Ty2
uacgcagcaggcagac

SEQ ID NO: 1750428 - RNA, 16 nt, Salmonella enterica enterica serovar Typhi Ty2
uacgcagccccauuug

SEQ ID NO: 1750429 - RNA, 23 nt, Salmonella enterica enterica serovar Typhi Ty2
uacgcagauaacuuccuuugccu

SEQ ID NO: 1750430 - RNA, 14 nt, Salmonella enterica enterica serovar Typhi Ty2
uacgcagcaggcag

SEQ ID NO: 1750431 - RNA, 18 nt, Salmonella enterica enterica serovar Typhi Ty2
uacgcagaucguauccag

SEQ ID NO: 1750432 - RNA, 15 nt, Salmonella enterica enterica serovar Typhi Ty2
uacgcuauuuaaaaa

SEQ ID NO: 1750433 - RNA, 16 nt, Salmonella enterica enterica serovar Typhi Ty2
uacgcuauuuaaaaac

SEQ ID NO: 1750434 - RNA, 17 nt, Salmonella enterica enterica serovar Typhi Ty2
uacgcgcugcaaauacu

SEQ ID NO: 1750435 - RNA, 14 nt, Salmonella enterica enterica serovar Typhi Ty2
uacgcgucaauuac

SEQ ID NO: 1750436 - RNA, 14 nt, Salmonella enterica enterica serovar Typhi Ty2
uacggaaaaaauac

SEQ ID NO: 1750437 - RNA, 12 nt, Salmonella enterica enterica serovar Typhi Ty2
uacggaaaaaug

SEQ ID NO: 1750438 - RNA, 20 nt, Salmonella enterica enterica serovar Typhi Ty2
uacggaaagcuguuguugcu

SEQ ID NO: 1750439 - RNA, 16 nt, Salmonella enterica enterica serovar Typhi Ty2
uacgcgggguaaaaug

SEQ ID NO: 1750440 - RNA, 17 nt, Salmonella enterica enterica serovar Typhi Ty2
uacgcgucaaagcacau

SEQ ID NO: 1750441 - RNA, 22 nt, Salmonella enterica enterica serovar Typhi Ty2
uacgcggcgcgcucuuuuucuu

SEQ ID NO: 1750442 - RNA, 23 nt, Salmonella enterica enterica serovar Typhi Ty2
uacgcggccaaaacccaccagca

SEQ ID NO: 1750443 - RNA, 20 nt, Salmonella enterica enterica serovar Typhi Ty2
uacgcggcgcgccguaaaca

SEQ ID NO: 1750444 - RNA, 22 nt, Salmonella enterica enterica serovar Typhi Ty2
uacgcggcgcgccguaaacaau

SEQ ID NO: 1750445 - RNA, 23 nt, Salmonella enterica enterica serovar Typhi Ty2
uaccuucggccuccgcuuccugc

SEQ ID NO: 1750446 - RNA, 13 nt, Salmonella enterica enterica serovar Typhi Ty2
uaccuucugccgc

SEQ ID NO: 1750447 - RNA, 13 nt, Salmonella enterica enterica serovar Typhi Ty2
uaccuauuuuaaa

SEQ ID NO: 1750448 - RNA, 15 nt, Salmonella enterica enterica serovar Typhi Ty2
uaccuuguucuucca

SEQ ID NO: 1750449 - RNA, 23 nt, Salmonella enterica enterica serovar Typhi Ty2
uaccuucuucacuaaaaacaggc

SEQ ID NO: 1750450 - RNA, 22 nt, Salmonella enterica enterica serovar Typhi Ty2
uaccguaaaaugcuggugcauc

SEQ ID NO: 1750451 - RNA, 19 nt, Salmonella enterica enterica serovar Typhi Ty2
uaccguaagcuuucugaau

SEQ ID NO: 1750452 - RNA, 18 nt, Salmonella enterica enterica serovar Typhi Ty2
uaccguaggccggauaag

SEQ ID NO: 1750453 - RNA, 18 nt, Salmonella enterica enterica serovar Typhi Ty2
uaccuacgcgauaaaaaa

SEQ ID NO: 1750454 - RNA, 15 nt, Salmonella enterica enterica serovar Typhi Ty2
uaccuuuaucuugac

SEQ ID NO: 1750455 - RNA, 13 nt, Salmonella enterica enterica serovar Typhi Ty2
uaccuuuacgcag

SEQ ID NO: 1750456 - RNA, 14 nt, Salmonella enterica enterica serovar Typhi Ty2
uacgauaccccauc

SEQ ID NO: 1750457 - RNA, 13 nt, Salmonella enterica enterica serovar Typhi Ty2
uacgauaucaucg

SEQ ID NO: 1750458 - RNA, 16 nt, Salmonella enterica enterica serovar Typhi Ty2
uacgaucgccaccgca

SEQ ID NO: 1750459 - RNA, 19 nt, Salmonella enterica enterica serovar Typhi Ty2
uacgagugcguucuuccac

SEQ ID NO: 1750460 - RNA, 19 nt, Salmonella enterica enterica serovar Typhi Ty2
uacgagugacauuauucac

SEQ ID NO: 1750461 - RNA, 20 nt, Salmonella enterica enterica serovar Typhi Ty2
uaauuuucccaguucaucca

SEQ ID NO: 1750462 - RNA, 13 nt, Salmonella enterica enterica serovar Typhi Ty2
uaauuuucaccuc

SEQ ID NO: 1750463 - RNA, 17 nt, Salmonella enterica enterica serovar Typhi Ty2
uaauuuucaccuccggg

SEQ ID NO: 1750464 - RNA, 22 nt, Salmonella enterica enterica serovar Typhi Ty2
uaauuuuauuauauuuaaaauu

SEQ ID NO: 1750465 - RNA, 11 nt, Salmonella enterica enterica serovar Typhi Ty2
uaauuuuagaa

SEQ ID NO: 1750466 - RNA, 16 nt, Salmonella enterica enterica serovar Typhi Ty2
uaauuuuacuuucauu

SEQ ID NO: 1750467 - RNA, 19 nt, Salmonella enterica enterica serovar Typhi Ty2
uaauuuuguuaaagugagu

SEQ ID NO: 1750468 - RNA, 23 nt, Salmonella enterica enterica serovar Typhi Ty2
uaauuuucuucuggccauuucau

SEQ ID NO: 1750469 - RNA, 20 nt, Salmonella enterica enterica serovar Typhi Ty2
uaauuuuuaugucauuuauu

SEQ ID NO: 1750470 - RNA, 15 nt, Salmonella enterica enterica serovar Typhi Ty2
uacaaaaaagauaac

SEQ ID NO: 1750471 - RNA, 23 nt, Salmonella enterica enterica serovar Typhi Ty2
uacaaaaaaugugagccauaaca

SEQ ID NO: 1750472 - RNA, 18 nt, Salmonella enterica enterica serovar Typhi Ty2
uacaaacaaauaaaucca

SEQ ID NO: 1750473 - RNA, 13 nt, Salmonella enterica enterica serovar Typhi Ty2
uacaaacaaauaa

SEQ ID NO: 1750474 - RNA, 17 nt, Salmonella enterica enterica serovar Typhi Ty2
uaauuugcaaaccauga

SEQ ID NO: 1750475 - RNA, 23 nt, Salmonella enterica enterica serovar Typhi Ty2
uaauuugcaaaccaugauaauaa

SEQ ID NO: 1750476 - RNA, 15 nt, Salmonella enterica enterica serovar Typhi Ty2
uaauuugcaaaccau

SEQ ID NO: 1750477 - RNA, 14 nt, Salmonella enterica enterica serovar Typhi Ty2
uaauuucagugaau

SEQ ID NO: 1750478 - RNA, 16 nt, Salmonella enterica enterica serovar Typhi Ty2
uaauuucaauuuugcc

SEQ ID NO: 1750479 - RNA, 12 nt, Salmonella enterica enterica serovar Typhi Ty2
uaauuucaauuu

SEQ ID NO: 1750480 - RNA, 15 nt, Salmonella enterica enterica serovar Typhi Ty2
uaauuuauccaguaa

SEQ ID NO: 1750481 - RNA, 17 nt, Salmonella enterica enterica serovar Typhi Ty2
uaauuuauauugugccu

SEQ ID NO: 1750482 - RNA, 17 nt, Salmonella enterica enterica serovar Typhi Ty2
uaauucucacagaauca

SEQ ID NO: 1750483 - RNA, 18 nt, Salmonella enterica enterica serovar Typhi Ty2
uaauucucacagaaucau

SEQ ID NO: 1750484 - RNA, 16 nt, Salmonella enterica enterica serovar Typhi Ty2
uacaguaguuuucauc

SEQ ID NO: 1750485 - RNA, 19 nt, Salmonella enterica enterica serovar Typhi Ty2
uacaguguaaaaauuuuug

SEQ ID NO: 1750486 - RNA, 14 nt, Salmonella enterica enterica serovar Typhi Ty2
uacaguggaaagua

SEQ ID NO: 1750487 - RNA, 22 nt, Salmonella enterica enterica serovar Typhi Ty2
uacagguugugcaucuccugac

SEQ ID NO: 1750488 - RNA, 14 nt, Salmonella enterica enterica serovar Typhi Ty2
uacaggacagaugu

SEQ ID NO: 1750489 - RNA, 20 nt, Salmonella enterica enterica serovar Typhi Ty2
uacaggaguuagcauguggg

SEQ ID NO: 1750490 - RNA, 19 nt, Salmonella enterica enterica serovar Typhi Ty2
uacagcuuaaucaccagcg

SEQ ID NO: 1750491 - RNA, 15 nt, Salmonella enterica enterica serovar Typhi Ty2
uacacgccuuccucc

SEQ ID NO: 1750492 - RNA, 23 nt, Salmonella enterica enterica serovar Typhi Ty2
uacacgcaucgggucgcgcgccg

SEQ ID NO: 1750493 - RNA, 18 nt, Salmonella enterica enterica serovar Typhi Ty2
uacaccuucacauuggca

SEQ ID NO: 1750494 - RNA, 12 nt, Salmonella enterica enterica serovar Typhi Ty2
uacaccuuugcc

SEQ ID NO: 1750495 - RNA, 16 nt, Salmonella enterica enterica serovar Typhi Ty2
uacacucaaccaucaa

SEQ ID NO: 1750496 - RNA, 20 nt, Salmonella enterica enterica serovar Typhi Ty2
uacacguauaaacgccgccg

SEQ ID NO: 1750497 - RNA, 13 nt, Salmonella enterica enterica serovar Typhi Ty2
uacagcacgccgg

SEQ ID NO: 1750498 - RNA, 18 nt, Salmonella enterica enterica serovar Typhi Ty2
uacagccaaaucagcagg

SEQ ID NO: 1750499 - RNA, 21 nt, Salmonella enterica enterica serovar Typhi Ty2
uacagccaaaucagcaggaca

SEQ ID NO: 1750500 - RNA, 20 nt, Salmonella enterica enterica serovar Typhi Ty2
uacacauaugggaagacauu

SEQ ID NO: 1750501 - RNA, 17 nt, Salmonella enterica enterica serovar Typhi Ty2
uacaaguaauaaaauaa

SEQ ID NO: 1750502 - RNA, 15 nt, Salmonella enterica enterica serovar Typhi Ty2
uacaaguaauaaaau

SEQ ID NO: 1750503 - RNA, 23 nt, Salmonella enterica enterica serovar Typhi Ty2
uacaagcguuuaauuccaucggc

SEQ ID NO: 1750504 - RNA, 14 nt, Salmonella enterica enterica serovar Typhi Ty2
uacaaguaauaaaa

SEQ ID NO: 1750505 - RNA, 23 nt, Salmonella enterica enterica serovar Typhi Ty2
uacaaagccaaaauuuucaauac

SEQ ID NO: 1750506 - RNA, 15 nt, Salmonella enterica enterica serovar Typhi Ty2
uacaaacgcaccgcc

SEQ ID NO: 1750507 - RNA, 19 nt, Salmonella enterica enterica serovar Typhi Ty2
uacaagaaaguaccugcac

SEQ ID NO: 1750508 - RNA, 23 nt, Salmonella enterica enterica serovar Typhi Ty2
uaaucccgcggcggacagcggca

SEQ ID NO: 1750509 - RNA, 17 nt, Salmonella enterica enterica serovar Typhi Ty2
uaaucccgccagccuua

SEQ ID NO: 1750510 - RNA, 18 nt, Salmonella enterica enterica serovar Typhi Ty2
uaaucccgaaucacuuac

SEQ ID NO: 1750511 - RNA, 13 nt, Salmonella enterica enterica serovar Typhi Ty2
uaauccgcuccac

SEQ ID NO: 1750512 - RNA, 18 nt, Salmonella enterica enterica serovar Typhi Ty2
uaauccgcugcaacuccc

SEQ ID NO: 1750513 - RNA, 11 nt, Salmonella enterica enterica serovar Typhi Ty2
uaaucccuugc

SEQ ID NO: 1750514 - RNA, 18 nt, Salmonella enterica enterica serovar Typhi Ty2
uaaucccuucuuuuacug

SEQ ID NO: 1750515 - RNA, 13 nt, Salmonella enterica enterica serovar Typhi Ty2
uaaucaucaugcu

SEQ ID NO: 1750516 - RNA, 22 nt, Salmonella enterica enterica serovar Typhi Ty2
uaauccuuguccauguaaacuc

SEQ ID NO: 1750517 - RNA, 18 nt, Salmonella enterica enterica serovar Typhi Ty2
uaauccgugaauguccug

SEQ ID NO: 1750518 - RNA, 20 nt, Salmonella enterica enterica serovar Typhi Ty2
uaauccggcaacugccgggg

SEQ ID NO: 1750519 - RNA, 21 nt, Salmonella enterica enterica serovar Typhi Ty2
uaauauugaccgcuuuuucca

SEQ ID NO: 1750520 - RNA, 13 nt, Salmonella enterica enterica serovar Typhi Ty2
uaauauuuauuau

SEQ ID NO: 1750521 - RNA, 13 nt, Salmonella enterica enterica serovar Typhi Ty2
uaauauuauugac

SEQ ID NO: 1750522 - RNA, 20 nt, Salmonella enterica enterica serovar Typhi Ty2
uaauauugaccgcuuuuucc

SEQ ID NO: 1750523 - RNA, 15 nt, Salmonella enterica enterica serovar Typhi Ty2
uaaucaccagcgcau

SEQ ID NO: 1750524 - RNA, 12 nt, Salmonella enterica enterica serovar Typhi Ty2
uaaucaccagcg

SEQ ID NO: 1750525 - RNA, 15 nt, Salmonella enterica enterica serovar Typhi Ty2
uaaucaccaccucaa

SEQ ID NO: 1750526 - RNA, 22 nt, Salmonella enterica enterica serovar Typhi Ty2
uaaucacuaacugaccauauau

SEQ ID NO: 1750527 - RNA, 14 nt, Salmonella enterica enterica serovar Typhi Ty2
uaaucacugcaccu

SEQ ID NO: 1750528 - RNA, 19 nt, Salmonella enterica enterica serovar Typhi Ty2
uaaucaucacgcuauggcc

SEQ ID NO: 1750529 - RNA, 19 nt, Salmonella enterica enterica serovar Typhi Ty2
uaacgucguaaauuccugc

SEQ ID NO: 1750530 - RNA, 15 nt, Salmonella enterica enterica serovar Typhi Ty2
uaacguuaaggaaac

SEQ ID NO: 1750531 - RNA, 16 nt, Salmonella enterica enterica serovar Typhi Ty2
uaacggaaaagcauug

SEQ ID NO: 1750532 - RNA, 17 nt, Salmonella enterica enterica serovar Typhi Ty2
uaacggaaaagcauugc

SEQ ID NO: 1750533 - RNA, 16 nt, Salmonella enterica enterica serovar Typhi Ty2
uaacggacucaggccu

SEQ ID NO: 1750534 - RNA, 20 nt, Salmonella enterica enterica serovar Typhi Ty2
uaauaguuucgacuuucauu

SEQ ID NO: 1750535 - RNA, 23 nt, Salmonella enterica enterica serovar Typhi Ty2
uaauagguacggggcaucuauuu

SEQ ID NO: 1750536 - RNA, 20 nt, Salmonella enterica enterica serovar Typhi Ty2
uaauauccaggagcauugga

SEQ ID NO: 1750537 - RNA, 20 nt, Salmonella enterica enterica serovar Typhi Ty2
uaauaucgcgcucuuccgcc

SEQ ID NO: 1750538 - RNA, 23 nt, Salmonella enterica enterica serovar Typhi Ty2
uaauaucguuaagccuucaauuu

SEQ ID NO: 1750539 - RNA, 12 nt, Salmonella enterica enterica serovar Typhi Ty2
uaauauacauuc

SEQ ID NO: 1750540 - RNA, 15 nt, Salmonella enterica enterica serovar Typhi Ty2
uaauauacauucauu

SEQ ID NO: 1750541 - RNA, 17 nt, Salmonella enterica enterica serovar Typhi Ty2
uaauauaaccaauuuaa

SEQ ID NO: 1750542 - RNA, 18 nt, Salmonella enterica enterica serovar Typhi Ty2
uaauucauaacaccaaua

SEQ ID NO: 1750543 - RNA, 16 nt, Salmonella enterica enterica serovar Typhi Ty2
uaauucauaacaccaa

SEQ ID NO: 1750544 - RNA, 14 nt, Salmonella enterica enterica serovar Typhi Ty2
uaauucagcucaac

SEQ ID NO: 1750545 - RNA, 19 nt, Salmonella enterica enterica serovar Typhi Ty2
uaauuauuuuucaaaugau

SEQ ID NO: 1750546 - RNA, 22 nt, Salmonella enterica enterica serovar Typhi Ty2
uaauuacuccguuuuaaucuuu

SEQ ID NO: 1750547 - RNA, 16 nt, Salmonella enterica enterica serovar Typhi Ty2
uaauuauuacagacag

SEQ ID NO: 1750548 - RNA, 22 nt, Salmonella enterica enterica serovar Typhi Ty2
uaauuauuacuggaucauacau

SEQ ID NO: 1750549 - RNA, 19 nt, Salmonella enterica enterica serovar Typhi Ty2
uaauuaucugccagccgau

SEQ ID NO: 1750550 - RNA, 22 nt, Salmonella enterica enterica serovar Typhi Ty2
uaauuaauucuaaauugggaug

SEQ ID NO: 1750551 - RNA, 18 nt, Salmonella enterica enterica serovar Typhi Ty2
uaauggcauaacgcugua

SEQ ID NO: 1750552 - RNA, 19 nt, Salmonella enterica enterica serovar Typhi Ty2
uaauggcagaauaaaacag

SEQ ID NO: 1750553 - RNA, 17 nt, Salmonella enterica enterica serovar Typhi Ty2
uaauggcgccgauaaca

SEQ ID NO: 1750554 - RNA, 12 nt, Salmonella enterica enterica serovar Typhi Ty2
uaauggcccagu

SEQ ID NO: 1750555 - RNA, 19 nt, Salmonella enterica enterica serovar Typhi Ty2
uaaugguggaaugccccag

SEQ ID NO: 1750556 - RNA, 20 nt, Salmonella enterica enterica serovar Typhi Ty2
uaaugguugugccaguaauc

SEQ ID NO: 1750557 - RNA, 18 nt, Salmonella enterica enterica serovar Typhi Ty2
uaauguuucacguagcaa

SEQ ID NO: 1750558 - RNA, 17 nt, Salmonella enterica enterica serovar Typhi Ty2
uaaugcaauaaacuaag

SEQ ID NO: 1750559 - RNA, 19 nt, Salmonella enterica enterica serovar Typhi Ty2
uaaugcaggcagcacugcu

SEQ ID NO: 1750560 - RNA, 21 nt, Salmonella enterica enterica serovar Typhi Ty2
uaaugcagcgucugcccuccu

SEQ ID NO: 1750561 - RNA, 15 nt, Salmonella enterica enterica serovar Typhi Ty2
uaaugcauuggccag

SEQ ID NO: 1750562 - RNA, 16 nt, Salmonella enterica enterica serovar Typhi Ty2
uaaugccuucugaaaa

SEQ ID NO: 1750563 - RNA, 22 nt, Salmonella enterica enterica serovar Typhi Ty2
uaaugcccggcccgucaucuuc

SEQ ID NO: 1750564 - RNA, 14 nt, Salmonella enterica enterica serovar Typhi Ty2
uaaugccaucauca

SEQ ID NO: 1750565 - RNA, 18 nt, Salmonella enterica enterica serovar Typhi Ty2
uaaugccuaucuugauau

SEQ ID NO: 1750566 - RNA, 20 nt, Salmonella enterica enterica serovar Typhi Ty2
uaaugccgccguacaaaccc

SEQ ID NO: 1750567 - RNA, 19 nt, Salmonella enterica enterica serovar Typhi Ty2
uaaugaguagaacguauua

SEQ ID NO: 1750568 - RNA, 19 nt, Salmonella enterica enterica serovar Typhi Ty2
uaaugagcgucgccagacc

SEQ ID NO: 1750569 - RNA, 18 nt, Salmonella enterica enterica serovar Typhi Ty2
uaaugacuuuuaaagacu

SEQ ID NO: 1750570 - RNA, 17 nt, Salmonella enterica enterica serovar Typhi Ty2
uaaugaacaccagcaac

SEQ ID NO: 1750571 - RNA, 17 nt, Salmonella enterica enterica serovar Typhi Ty2
uaaucgaaucgccucaa

SEQ ID NO: 1750572 - RNA, 14 nt, Salmonella enterica enterica serovar Typhi Ty2
uaaucgaaauaaag

SEQ ID NO: 1750573 - RNA, 20 nt, Salmonella enterica enterica serovar Typhi Ty2
uaaucgaaucgccucaacca

SEQ ID NO: 1750574 - RNA, 17 nt, Salmonella enterica enterica serovar Typhi Ty2
ggcauggcucgccgcug

SEQ ID NO: 1750575 - RNA, 22 nt, Salmonella enterica enterica serovar Typhi Ty2
ggcauggggucaggugggacca

SEQ ID NO: 1750576 - RNA, 20 nt, Salmonella enterica enterica serovar Typhi Ty2
ggcauggaugcaugagcacg

SEQ ID NO: 1750577 - RNA, 15 nt, Salmonella enterica enterica serovar Typhi Ty2
ggcauggcagcaggg

SEQ ID NO: 1750578 - RNA, 11 nt, Salmonella enterica enterica serovar Typhi Ty2
ggcaggcggaa

SEQ ID NO: 1750579 - RNA, 13 nt, Salmonella enterica enterica serovar Typhi Ty2
ggcaggcucacca

SEQ ID NO: 1750580 - RNA, 19 nt, Salmonella enterica enterica serovar Typhi Ty2
ggcaguaaagaucuggccg

SEQ ID NO: 1750581 - RNA, 22 nt, Salmonella enterica enterica serovar Typhi Ty2
ggcagucccaaugcggaaacca

SEQ ID NO: 1750582 - RNA, 18 nt, Salmonella enterica enterica serovar Typhi Ty2
ggcagucuggcggcagcc

SEQ ID NO: 1750583 - RNA, 13 nt, Salmonella enterica enterica serovar Typhi Ty2
ggcauagaaaaag

SEQ ID NO: 1750584 - RNA, 17 nt, Salmonella enterica enterica serovar Typhi Ty2
ggcauacucuccuccau

SEQ ID NO: 1750585 - RNA, 21 nt, Salmonella enterica enterica serovar Typhi Ty2
ggcagcgcaacgcuuaauccc

SEQ ID NO: 1750586 - RNA, 15 nt, Salmonella enterica enterica serovar Typhi Ty2
ggcagcgccagcggu

SEQ ID NO: 1750587 - RNA, 18 nt, Salmonella enterica enterica serovar Typhi Ty2
ggcagcgccagugacgcc

SEQ ID NO: 1750588 - RNA, 17 nt, Salmonella enterica enterica serovar Typhi Ty2
ggcagcgcgccagcgcu

SEQ ID NO: 1750589 - RNA, 16 nt, Salmonella enterica enterica serovar Typhi Ty2
ggcagcguggcgagcu

SEQ ID NO: 1750590 - RNA, 20 nt, Salmonella enterica enterica serovar Typhi Ty2
ggcagcuuccagcaaaccuu

SEQ ID NO: 1750591 - RNA, 15 nt, Salmonella enterica enterica serovar Typhi Ty2
ggcaggcagcgccag

SEQ ID NO: 1750592 - RNA, 16 nt, Salmonella enterica enterica serovar Typhi Ty2
ggcaggcauggccaau

SEQ ID NO: 1750593 - RNA, 14 nt, Salmonella enterica enterica serovar Typhi Ty2
ggcagccgccacca

SEQ ID NO: 1750594 - RNA, 19 nt, Salmonella enterica enterica serovar Typhi Ty2
ggcagcccggcguugaaau

SEQ ID NO: 1750595 - RNA, 18 nt, Salmonella enterica enterica serovar Typhi Ty2
ggcagccauucggcugcc

SEQ ID NO: 1750596 - RNA, 12 nt, Salmonella enterica enterica serovar Typhi Ty2
ggcagccaggca

SEQ ID NO: 1750597 - RNA, 17 nt, Salmonella enterica enterica serovar Typhi Ty2
ggcagcauuguauuuca

SEQ ID NO: 1750598 - RNA, 14 nt, Salmonella enterica enterica serovar Typhi Ty2
ggcagcagcuucau

SEQ ID NO: 1750599 - RNA, 17 nt, Salmonella enterica enterica serovar Typhi Ty2
ggcagcaggaucuccag

SEQ ID NO: 1750600 - RNA, 23 nt, Salmonella enterica enterica serovar Typhi Ty2
ggcagcaccggaacagaagccug

SEQ ID NO: 1750601 - RNA, 18 nt, Salmonella enterica enterica serovar Typhi Ty2
ggcacuacgguccaguug

SEQ ID NO: 1750602 - RNA, 14 nt, Salmonella enterica enterica serovar Typhi Ty2
ggcagacggcuggg

SEQ ID NO: 1750603 - RNA, 14 nt, Salmonella enterica enterica serovar Typhi Ty2
ggcagauaugcggg

SEQ ID NO: 1750604 - RNA, 14 nt, Salmonella enterica enterica serovar Typhi Ty2
ggcagagcgcgcuc

SEQ ID NO: 1750605 - RNA, 18 nt, Salmonella enterica enterica serovar Typhi Ty2
ggcaaacgguuaauacug

SEQ ID NO: 1750606 - RNA, 15 nt, Salmonella enterica enterica serovar Typhi Ty2
ggcaaaccccugcuc

SEQ ID NO: 1750607 - RNA, 12 nt, Salmonella enterica enterica serovar Typhi Ty2
ggcaaaccagca

SEQ ID NO: 1750608 - RNA, 13 nt, Salmonella enterica enterica serovar Typhi Ty2
ggcacgccaaaau

SEQ ID NO: 1750609 - RNA, 24 nt, Salmonella enterica enterica serovar Typhi Ty2
ggcacguuaaacaccucaccggcu

SEQ ID NO: 1750610 - RNA, 20 nt, Salmonella enterica enterica serovar Typhi Ty2
ggccgaauaagccaggcacc

SEQ ID NO: 1750611 - RNA, 22 nt, Salmonella enterica enterica serovar Typhi Ty2
ggcccugcgguacugcuggccu

SEQ ID NO: 1750612 - RNA, 17 nt, Salmonella enterica enterica serovar Typhi Ty2
ggccgacaggcggccgc

SEQ ID NO: 1750613 - RNA, 23 nt, Salmonella enterica enterica serovar Typhi Ty2
ggcccccuguuccagggcuucca

SEQ ID NO: 1750614 - RNA, 17 nt, Salmonella enterica enterica serovar Typhi Ty2
ggcccagcgcgguggcg

SEQ ID NO: 1750615 - RNA, 16 nt, Salmonella enterica enterica serovar Typhi Ty2
ggccaggcacguuaaa

SEQ ID NO: 1750616 - RNA, 14 nt, Salmonella enterica enterica serovar Typhi Ty2
ggccagcgcgcggc

SEQ ID NO: 1750617 - RNA, 17 nt, Salmonella enterica enterica serovar Typhi Ty2
ggccauuaacacacaau

SEQ ID NO: 1750618 - RNA, 14 nt, Salmonella enterica enterica serovar Typhi Ty2
ggccaguuuccuga

SEQ ID NO: 1750619 - RNA, 12 nt, Salmonella enterica enterica serovar Typhi Ty2
ggccacccacca

SEQ ID NO: 1750620 - RNA, 14 nt, Salmonella enterica enterica serovar Typhi Ty2
ggccaccagcgcca

SEQ ID NO: 1750621 - RNA, 17 nt, Salmonella enterica enterica serovar Typhi Ty2
ggccaccaggccugagc

SEQ ID NO: 1750622 - RNA, 17 nt, Salmonella enterica enterica serovar Typhi Ty2
ggcaugucugucuaugc

SEQ ID NO: 1750623 - RNA, 23 nt, Salmonella enterica enterica serovar Typhi Ty2
ggcauguucucccugacacugua

SEQ ID NO: 1750624 - RNA, 21 nt, Salmonella enterica enterica serovar Typhi Ty2
ggcauguccggcgacuccaga

SEQ ID NO: 1750625 - RNA, 18 nt, Salmonella enterica enterica serovar Typhi Ty2
ggcauuaagucauaccug

SEQ ID NO: 1750626 - RNA, 15 nt, Salmonella enterica enterica serovar Typhi Ty2
ggccagaugcggcga

SEQ ID NO: 1750627 - RNA, 17 nt, Salmonella enterica enterica serovar Typhi Ty2
ggccacggagugcgcgg

SEQ ID NO: 1750628 - RNA, 18 nt, Salmonella enterica enterica serovar Typhi Ty2
ggccagauaguggcugag

SEQ ID NO: 1750629 - RNA, 20 nt, Salmonella enterica enterica serovar Typhi Ty2
ggccagauaaguuugcagau

SEQ ID NO: 1750630 - RNA, 19 nt, Salmonella enterica enterica serovar Typhi Ty2
ggauucgccagcgugcuua

SEQ ID NO: 1750631 - RNA, 20 nt, Salmonella enterica enterica serovar Typhi Ty2
ggauuccgccgcggccagca

SEQ ID NO: 1750632 - RNA, 23 nt, Salmonella enterica enterica serovar Typhi Ty2
ggcaaacacaaucacgcccagcg

SEQ ID NO: 1750633 - RNA, 22 nt, Salmonella enterica enterica serovar Typhi Ty2
ggauugaaccuaaaaaccagaa

SEQ ID NO: 1750634 - RNA, 22 nt, Salmonella enterica enterica serovar Typhi Ty2
ggaugugaccuuugugcaggau

SEQ ID NO: 1750635 - RNA, 18 nt, Salmonella enterica enterica serovar Typhi Ty2
ggaugucggcuuacgccu

SEQ ID NO: 1750636 - RNA, 13 nt, Salmonella enterica enterica serovar Typhi Ty2
ggaugugcauuga

SEQ ID NO: 1750637 - RNA, 11 nt, Salmonella enterica enterica serovar Typhi Ty2
ggauggugguc

SEQ ID NO: 1750638 - RNA, 21 nt, Salmonella enterica enterica serovar Typhi Ty2
ggaucggucuggcgcauaaug

SEQ ID NO: 1750639 - RNA, 23 nt, Salmonella enterica enterica serovar Typhi Ty2
ggaucguucugcugauaauacug

SEQ ID NO: 1750640 - RNA, 15 nt, Salmonella enterica enterica serovar Typhi Ty2
ggaugacagaaagcg

SEQ ID NO: 1750641 - RNA, 22 nt, Salmonella enterica enterica serovar Typhi Ty2
ggaugcguaauccggccuggcg

SEQ ID NO: 1750642 - RNA, 19 nt, Salmonella enterica enterica serovar Typhi Ty2
ggaugcgccgcccaccgcc

SEQ ID NO: 1750643 - RNA, 16 nt, Salmonella enterica enterica serovar Typhi Ty2
ggaucaugguugaaaa

SEQ ID NO: 1750644 - RNA, 14 nt, Salmonella enterica enterica serovar Typhi Ty2
ggauaauuuaucca

SEQ ID NO: 1750645 - RNA, 21 nt, Salmonella enterica enterica serovar Typhi Ty2
ggauauaaaaaacauauaauu

SEQ ID NO: 1750646 - RNA, 20 nt, Salmonella enterica enterica serovar Typhi Ty2
ggauaguacugaccagacag

SEQ ID NO: 1750647 - RNA, 12 nt, Salmonella enterica enterica serovar Typhi Ty2
ggauagucuuca

SEQ ID NO: 1750648 - RNA, 18 nt, Salmonella enterica enterica serovar Typhi Ty2
ggauauuacccggccagu

SEQ ID NO: 1750649 - RNA, 18 nt, Salmonella enterica enterica serovar Typhi Ty2
ggauauugccgaagacca

SEQ ID NO: 1750650 - RNA, 22 nt, Salmonella enterica enterica serovar Typhi Ty2
ggaucagaaauucgcagcgcag

SEQ ID NO: 1750651 - RNA, 14 nt, Salmonella enterica enterica serovar Typhi Ty2
ggaucaucggccag

SEQ ID NO: 1750652 - RNA, 19 nt, Salmonella enterica enterica serovar Typhi Ty2
ggauaagcccggcggaggc

SEQ ID NO: 1750653 - RNA, 15 nt, Salmonella enterica enterica serovar Typhi Ty2
ggauaaaaucgccaa

SEQ ID NO: 1750654 - RNA, 14 nt, Salmonella enterica enterica serovar Typhi Ty2
ggauaaagaccggc

SEQ ID NO: 1750655 - RNA, 12 nt, Salmonella enterica enterica serovar Typhi Ty2
ggauaaaaaagc

SEQ ID NO: 1750656 - RNA, 19 nt, Salmonella enterica enterica serovar Typhi Ty2
ggagggguuuucgccagca

SEQ ID NO: 1750657 - RNA, 23 nt, Salmonella enterica enterica serovar Typhi Ty2
ggaggcgugagcgaacaggucgc

SEQ ID NO: 1750658 - RNA, 14 nt, Salmonella enterica enterica serovar Typhi Ty2
ggaggugcucuccc

SEQ ID NO: 1750659 - RNA, 23 nt, Salmonella enterica enterica serovar Typhi Ty2
ggaggugcugguggugggcggca

SEQ ID NO: 1750660 - RNA, 15 nt, Salmonella enterica enterica serovar Typhi Ty2
ggaggucauuauuca

SEQ ID NO: 1750661 - RNA, 23 nt, Salmonella enterica enterica serovar Typhi Ty2
ggaggucauuauucaggccuccu

SEQ ID NO: 1750662 - RNA, 23 nt, Salmonella enterica enterica serovar Typhi Ty2
ggagguauccuccugccaggcgc

SEQ ID NO: 1750663 - RNA, 19 nt, Salmonella enterica enterica serovar Typhi Ty2
ggagcagacuguaaaucug

SEQ ID NO: 1750664 - RNA, 21 nt, Salmonella enterica enterica serovar Typhi Ty2
ggagcagugauuaugcucccg

SEQ ID NO: 1750665 - RNA, 21 nt, Salmonella enterica enterica serovar Typhi Ty2
ggagccaguuuucgacauauu

SEQ ID NO: 1750666 - RNA, 16 nt, Salmonella enterica enterica serovar Typhi Ty2
ggagcguucaugcugg

SEQ ID NO: 1750667 - RNA, 19 nt, Salmonella enterica enterica serovar Typhi Ty2
ggagccucuucuggcuccc

SEQ ID NO: 1750668 - RNA, 18 nt, Salmonella enterica enterica serovar Typhi Ty2
ggagaggcguucaugccu

SEQ ID NO: 1750669 - RNA, 16 nt, Salmonella enterica enterica serovar Typhi Ty2
ggagagcaguccuaaa

SEQ ID NO: 1750670 - RNA, 13 nt, Salmonella enterica enterica serovar Typhi Ty2
ggagagcaguccu

SEQ ID NO: 1750671 - RNA, 15 nt, Salmonella enterica enterica serovar Typhi Ty2
ggacucccaggugug

SEQ ID NO: 1750672 - RNA, 15 nt, Salmonella enterica enterica serovar Typhi Ty2
ggagaacgccgggcc

SEQ ID NO: 1750673 - RNA, 15 nt, Salmonella enterica enterica serovar Typhi Ty2
ggagacagaacagga

SEQ ID NO: 1750674 - RNA, 21 nt, Salmonella enterica enterica serovar Typhi Ty2
ggagacggccacccaucccca

SEQ ID NO: 1750675 - RNA, 12 nt, Salmonella enterica enterica serovar Typhi Ty2
ggacaucgccau

SEQ ID NO: 1750676 - RNA, 14 nt, Salmonella enterica enterica serovar Typhi Ty2
ggacaucggccucg

SEQ ID NO: 1750677 - RNA, 23 nt, Salmonella enterica enterica serovar Typhi Ty2
ggacguugagcguuacgggaaca

SEQ ID NO: 1750678 - RNA, 17 nt, Salmonella enterica enterica serovar Typhi Ty2
ggacuaucgaaagagca

SEQ ID NO: 1750679 - RNA, 12 nt, Salmonella enterica enterica serovar Typhi Ty2
ggacguugaaaa

SEQ ID NO: 1750680 - RNA, 20 nt, Salmonella enterica enterica serovar Typhi Ty2
ggacacccggcuuuugcuuu

SEQ ID NO: 1750681 - RNA, 16 nt, Salmonella enterica enterica serovar Typhi Ty2
ggacaggcgaaauaag

SEQ ID NO: 1750682 - RNA, 17 nt, Salmonella enterica enterica serovar Typhi Ty2
ggaauuuaccggugcgg

SEQ ID NO: 1750683 - RNA, 18 nt, Salmonella enterica enterica serovar Typhi Ty2
ggaauuuaucaacaaauu

SEQ ID NO: 1750684 - RNA, 16 nt, Salmonella enterica enterica serovar Typhi Ty2
ggaauuuguugguuua

SEQ ID NO: 1750685 - RNA, 17 nt, Salmonella enterica enterica serovar Typhi Ty2
ggaauugguagacacgc

SEQ ID NO: 1750686 - RNA, 18 nt, Salmonella enterica enterica serovar Typhi Ty2
ggaaggauagccguauga

SEQ ID NO: 1750687 - RNA, 15 nt, Salmonella enterica enterica serovar Typhi Ty2
ggaaggcgugcagcg

SEQ ID NO: 1750688 - RNA, 12 nt, Salmonella enterica enterica serovar Typhi Ty2
ggaauauuggua

SEQ ID NO: 1750689 - RNA, 17 nt, Salmonella enterica enterica serovar Typhi Ty2
ggaauauugagaauaaa

SEQ ID NO: 1750690 - RNA, 15 nt, Salmonella enterica enterica serovar Typhi Ty2
ggaauggcgggcgca

SEQ ID NO: 1750691 - RNA, 20 nt, Salmonella enterica enterica serovar Typhi Ty2
ggaaugccccagguuauaga

SEQ ID NO: 1750692 - RNA, 14 nt, Salmonella enterica enterica serovar Typhi Ty2
ggaauccccgccgc

SEQ ID NO: 1750693 - RNA, 12 nt, Salmonella enterica enterica serovar Typhi Ty2
ggaaugcccagc

SEQ ID NO: 1750694 - RNA, 22 nt, Salmonella enterica enterica serovar Typhi Ty2
ggaaucacgcauaucccacugc

SEQ ID NO: 1750695 - RNA, 17 nt, Salmonella enterica enterica serovar Typhi Ty2
ggaacugacuccagcug

SEQ ID NO: 1750696 - RNA, 16 nt, Salmonella enterica enterica serovar Typhi Ty2
ggaacuggugaaacag

SEQ ID NO: 1750697 - RNA, 18 nt, Salmonella enterica enterica serovar Typhi Ty2
ggaagaaacgcuuaaagc

SEQ ID NO: 1750698 - RNA, 10 nt, Salmonella enterica enterica serovar Typhi Ty2
ggaacgcugu

SEQ ID NO: 1750699 - RNA, 19 nt, Salmonella enterica enterica serovar Typhi Ty2
ggaagacuggcgcagcaaa

SEQ ID NO: 1750700 - RNA, 14 nt, Salmonella enterica enterica serovar Typhi Ty2
ggaagacuggcgca

SEQ ID NO: 1750701 - RNA, 21 nt, Salmonella enterica enterica serovar Typhi Ty2
ggaagacauucacauauauuu

SEQ ID NO: 1750702 - RNA, 22 nt, Salmonella enterica enterica serovar Typhi Ty2
ggaagcugcgcagcacuucaga

SEQ ID NO: 1750703 - RNA, 15 nt, Salmonella enterica enterica serovar Typhi Ty2
ggaaggaaauaacgu

SEQ ID NO: 1750704 - RNA, 23 nt, Salmonella enterica enterica serovar Typhi Ty2
ggaagcccucggcgaacaggcgu

SEQ ID NO: 1750705 - RNA, 18 nt, Salmonella enterica enterica serovar Typhi Ty2
ggaagccguauaugaaua

SEQ ID NO: 1750706 - RNA, 17 nt, Salmonella enterica enterica serovar Typhi Ty2
ggaagcgauguuuacug

SEQ ID NO: 1750707 - RNA, 23 nt, Salmonella enterica enterica serovar Typhi Ty2
ggaacaaaccgacuuucaaaucg

SEQ ID NO: 1750708 - RNA, 19 nt, Salmonella enterica enterica serovar Typhi Ty2
ggaaauguagccccaggcc

SEQ ID NO: 1750709 - RNA, 21 nt, Salmonella enterica enterica serovar Typhi Ty2
ggaaaguaccaaaacagaaaa

SEQ ID NO: 1750710 - RNA, 14 nt, Salmonella enterica enterica serovar Typhi Ty2
ggaaauaaagguuc

SEQ ID NO: 1750711 - RNA, 20 nt, Salmonella enterica enterica serovar Typhi Ty2
ggaaaucaaaccaucccagg

SEQ ID NO: 1750712 - RNA, 19 nt, Salmonella enterica enterica serovar Typhi Ty2
ggaaaucaacaaucccuua

SEQ ID NO: 1750713 - RNA, 13 nt, Salmonella enterica enterica serovar Typhi Ty2
ggaaccaggcgcg

SEQ ID NO: 1750714 - RNA, 19 nt, Salmonella enterica enterica serovar Typhi Ty2
ggaaccggguugcggaagc

SEQ ID NO: 1750715 - RNA, 14 nt, Salmonella enterica enterica serovar Typhi Ty2
ggaacaccagcgcc

SEQ ID NO: 1750716 - RNA, 18 nt, Salmonella enterica enterica serovar Typhi Ty2
ggaaccaaaugcccagcu

SEQ ID NO: 1750717 - RNA, 16 nt, Salmonella enterica enterica serovar Typhi Ty2
ggaaccaaaugcccag

SEQ ID NO: 1750718 - RNA, 14 nt, Salmonella enterica enterica serovar Typhi Ty2
ggaacaucagccag

SEQ ID NO: 1750719 - RNA, 16 nt, Salmonella enterica enterica serovar Typhi Ty2
ggaacaucagccagca

SEQ ID NO: 1750720 - RNA, 16 nt, Salmonella enterica enterica serovar Typhi Ty2
ggaacaggccaaaccc

SEQ ID NO: 1750721 - RNA, 19 nt, Salmonella enterica enterica serovar Typhi Ty2
ggaacagcggagcgaagaa

SEQ ID NO: 1750722 - RNA, 19 nt, Salmonella enterica enterica serovar Typhi Ty2
gcuuuuuucucugcuuucg

SEQ ID NO: 1750723 - RNA, 22 nt, Salmonella enterica enterica serovar Typhi Ty2
gcuuuuuucucugcuuucggug

SEQ ID NO: 1750724 - RNA, 20 nt, Salmonella enterica enterica serovar Typhi Ty2
gcuuuuuuaacgauuucccc

SEQ ID NO: 1750725 - RNA, 14 nt, Salmonella enterica enterica serovar Typhi Ty2
gcuuuuuuaucuau

SEQ ID NO: 1750726 - RNA, 14 nt, Salmonella enterica enterica serovar Typhi Ty2
ggaaaaaaagaaua

SEQ ID NO: 1750727 - RNA, 20 nt, Salmonella enterica enterica serovar Typhi Ty2
ggaaaaaauacugauaaaaa

SEQ ID NO: 1750728 - RNA, 17 nt, Salmonella enterica enterica serovar Typhi Ty2
ggaaaacagcgccggca

SEQ ID NO: 1750729 - RNA, 15 nt, Salmonella enterica enterica serovar Typhi Ty2
ggaaaagcuguagca

SEQ ID NO: 1750730 - RNA, 22 nt, Salmonella enterica enterica serovar Typhi Ty2
ggaaaacggccagugaaauaaa

SEQ ID NO: 1750731 - RNA, 23 nt, Salmonella enterica enterica serovar Typhi Ty2
ggaaaacggccagugaaauaaau

SEQ ID NO: 1750732 - RNA, 13 nt, Salmonella enterica enterica serovar Typhi Ty2
ggaaaacgcuucu

SEQ ID NO: 1750733 - RNA, 15 nt, Salmonella enterica enterica serovar Typhi Ty2
ggaaacuguaguaau

SEQ ID NO: 1750734 - RNA, 14 nt, Salmonella enterica enterica serovar Typhi Ty2
ggaaagccccuacc

SEQ ID NO: 1750735 - RNA, 22 nt, Salmonella enterica enterica serovar Typhi Ty2
ggaaagccccuaccgaggcagg

SEQ ID NO: 1750736 - RNA, 21 nt, Salmonella enterica enterica serovar Typhi Ty2
ggaaagauuacuucaggcugc

SEQ ID NO: 1750737 - RNA, 16 nt, Salmonella enterica enterica serovar Typhi Ty2
ggaaacccgcucgccc

SEQ ID NO: 1750738 - RNA, 20 nt, Salmonella enterica enterica serovar Typhi Ty2
ggaaacgcuauuuaacccug

SEQ ID NO: 1750739 - RNA, 23 nt, Salmonella enterica enterica serovar Typhi Ty2
ggaaaccuuucuucucuucuuca

SEQ ID NO: 1750740 - RNA, 14 nt, Salmonella enterica enterica serovar Typhi Ty2
gcuuucuucuucac

SEQ ID NO: 1750741 - RNA, 19 nt, Salmonella enterica enterica serovar Typhi Ty2
gcuuugcaauguucaauau

SEQ ID NO: 1750742 - RNA, 14 nt, Salmonella enterica enterica serovar Typhi Ty2
gcuuucuguugaua

SEQ ID NO: 1750743 - RNA, 23 nt, Salmonella enterica enterica serovar Typhi Ty2
gcuuucuuccagguuaacccaca

SEQ ID NO: 1750744 - RNA, 19 nt, Salmonella enterica enterica serovar Typhi Ty2
gcuuucuguugauacagua

SEQ ID NO: 1750745 - RNA, 13 nt, Salmonella enterica enterica serovar Typhi Ty2
gcuuucuggauga

SEQ ID NO: 1750746 - RNA, 22 nt, Salmonella enterica enterica serovar Typhi Ty2
gcuuucggucguuugccgugca

SEQ ID NO: 1750747 - RNA, 17 nt, Salmonella enterica enterica serovar Typhi Ty2
gcuuuccagccaugcca

SEQ ID NO: 1750748 - RNA, 20 nt, Salmonella enterica enterica serovar Typhi Ty2
gcuuucaguaauaauauaaa

SEQ ID NO: 1750749 - RNA, 14 nt, Salmonella enterica enterica serovar Typhi Ty2
gcuuuccgggguga

SEQ ID NO: 1750750 - RNA, 19 nt, Salmonella enterica enterica serovar Typhi Ty2
gcuuuccggcgcuuccugc

SEQ ID NO: 1750751 - RNA, 20 nt, Salmonella enterica enterica serovar Typhi Ty2
gcuuuccgccaugaaaaaaa

SEQ ID NO: 1750752 - RNA, 21 nt, Salmonella enterica enterica serovar Typhi Ty2
gcuuuccgccaugaaaaaaac

SEQ ID NO: 1750753 - RNA, 14 nt, Salmonella enterica enterica serovar Typhi Ty2
gcuuuccgccgccg

SEQ ID NO: 1750754 - RNA, 21 nt, Salmonella enterica enterica serovar Typhi Ty2
gcuuuauucugucgccaccac

SEQ ID NO: 1750755 - RNA, 22 nt, Salmonella enterica enterica serovar Typhi Ty2
gcuuuauucugucgccaccacu

SEQ ID NO: 1750756 - RNA, 12 nt, Salmonella enterica enterica serovar Typhi Ty2
gcuuuauauaaa

SEQ ID NO: 1750757 - RNA, 16 nt, Salmonella enterica enterica serovar Typhi Ty2
gcuuucaauaaaucaa

SEQ ID NO: 1750758 - RNA, 18 nt, Salmonella enterica enterica serovar Typhi Ty2
gcuuuguaaaacauucaa

SEQ ID NO: 1750759 - RNA, 22 nt, Salmonella enterica enterica serovar Typhi Ty2
gcuuuguagcauaaucaggccc

SEQ ID NO: 1750760 - RNA, 17 nt, Salmonella enterica enterica serovar Typhi Ty2
gcuuugcuuauccggcc

SEQ ID NO: 1750761 - RNA, 16 nt, Salmonella enterica enterica serovar Typhi Ty2
gcuuugcgccaucggg

SEQ ID NO: 1750762 - RNA, 21 nt, Salmonella enterica enterica serovar Typhi Ty2
gcuuugcgauagcccggcaug

SEQ ID NO: 1750763 - RNA, 15 nt, Salmonella enterica enterica serovar Typhi Ty2
gcuuugcgccacuuc

SEQ ID NO: 1750764 - RNA, 22 nt, Salmonella enterica enterica serovar Typhi Ty2
gcuuuucaugacgcucuccucc

SEQ ID NO: 1750765 - RNA, 19 nt, Salmonella enterica enterica serovar Typhi Ty2
gcuuuucagcgucuuucuu

SEQ ID NO: 1750766 - RNA, 21 nt, Salmonella enterica enterica serovar Typhi Ty2
gcuuuuaguuguacaaacugu

SEQ ID NO: 1750767 - RNA, 14 nt, Salmonella enterica enterica serovar Typhi Ty2
gcuuuucauuuguu

SEQ ID NO: 1750768 - RNA, 18 nt, Salmonella enterica enterica serovar Typhi Ty2
gcuuuugcgcacugcucg

SEQ ID NO: 1750769 - RNA, 20 nt, Salmonella enterica enterica serovar Typhi Ty2
gcuuuugguuuuucaaccac

SEQ ID NO: 1750770 - RNA, 15 nt, Salmonella enterica enterica serovar Typhi Ty2
gcuuuuugccgggcg

SEQ ID NO: 1750771 - RNA, 22 nt, Salmonella enterica enterica serovar Typhi Ty2
gcuuuuucauucugcuuaccag

SEQ ID NO: 1750772 - RNA, 15 nt, Salmonella enterica enterica serovar Typhi Ty2
gcuuuuuaaauacug

SEQ ID NO: 1750773 - RNA, 12 nt, Salmonella enterica enterica serovar Typhi Ty2
gcuuuagcuuua

SEQ ID NO: 1750774 - RNA, 16 nt, Salmonella enterica enterica serovar Typhi Ty2
gcuuuaggguaucauu

SEQ ID NO: 1750775 - RNA, 21 nt, Salmonella enterica enterica serovar Typhi Ty2
gcuuuaaugcuuuaaaugccu

SEQ ID NO: 1750776 - RNA, 23 nt, Salmonella enterica enterica serovar Typhi Ty2
gcuuuaaucacccgcgccagcag

SEQ ID NO: 1750777 - RNA, 14 nt, Salmonella enterica enterica serovar Typhi Ty2
gcuuuaauauucau

SEQ ID NO: 1750778 - RNA, 15 nt, Salmonella enterica enterica serovar Typhi Ty2
gcuuuaaucaccaug

SEQ ID NO: 1750779 - RNA, 20 nt, Salmonella enterica enterica serovar Typhi Ty2
gcuuuaaucaguucauagcc

SEQ ID NO: 1750780 - RNA, 20 nt, Salmonella enterica enterica serovar Typhi Ty2
gcuuuacccggcgcaaacag

SEQ ID NO: 1750781 - RNA, 22 nt, Salmonella enterica enterica serovar Typhi Ty2
gcuuuacccgggccaucuuuuu

SEQ ID NO: 1750782 - RNA, 17 nt, Salmonella enterica enterica serovar Typhi Ty2
gcuuuaauaccgguggc

SEQ ID NO: 1750783 - RNA, 18 nt, Salmonella enterica enterica serovar Typhi Ty2
gcuuguuucacuguagcu

SEQ ID NO: 1750784 - RNA, 17 nt, Salmonella enterica enterica serovar Typhi Ty2
gcuuggcggcuuccugu

SEQ ID NO: 1750785 - RNA, 17 nt, Salmonella enterica enterica serovar Typhi Ty2
gcuugucgccaugcacc

SEQ ID NO: 1750786 - RNA, 19 nt, Salmonella enterica enterica serovar Typhi Ty2
gcuugucgcgagcuuccag

SEQ ID NO: 1750787 - RNA, 20 nt, Salmonella enterica enterica serovar Typhi Ty2
gcuugcguguuugggcgagg

SEQ ID NO: 1750788 - RNA, 14 nt, Salmonella enterica enterica serovar Typhi Ty2
gcuugcggguuuug

SEQ ID NO: 1750789 - RNA, 20 nt, Salmonella enterica enterica serovar Typhi Ty2
gcuuggccaguggggcugcu

SEQ ID NO: 1750790 - RNA, 21 nt, Salmonella enterica enterica serovar Typhi Ty2
gcuugccgucgucauaagcaa

SEQ ID NO: 1750791 - RNA, 16 nt, Salmonella enterica enterica serovar Typhi Ty2
gcuugcccagcauauu

SEQ ID NO: 1750792 - RNA, 20 nt, Salmonella enterica enterica serovar Typhi Ty2
gcuugauacgccaucuuucu

SEQ ID NO: 1750793 - RNA, 12 nt, Salmonella enterica enterica serovar Typhi Ty2
gcuugauaaaua

SEQ ID NO: 1750794 - RNA, 14 nt, Salmonella enterica enterica serovar Typhi Ty2
gcuugacucugaag

SEQ ID NO: 1750795 - RNA, 15 nt, Salmonella enterica enterica serovar Typhi Ty2
gcuugacucugaagc

SEQ ID NO: 1750796 - RNA, 15 nt, Salmonella enterica enterica serovar Typhi Ty2
gcuucccccggcgcc

SEQ ID NO: 1750797 - RNA, 19 nt, Salmonella enterica enterica serovar Typhi Ty2
gcuucccacagucggcgaa

SEQ ID NO: 1750798 - RNA, 14 nt, Salmonella enterica enterica serovar Typhi Ty2
gcuucccgaaagga

SEQ ID NO: 1750799 - RNA, 16 nt, Salmonella enterica enterica serovar Typhi Ty2
gcuucccgaaaggaag

SEQ ID NO: 1750800 - RNA, 15 nt, Salmonella enterica enterica serovar Typhi Ty2
gcuuccgccaugguu

SEQ ID NO: 1750801 - RNA, 15 nt, Salmonella enterica enterica serovar Typhi Ty2
gcuuccguccccagc

SEQ ID NO: 1750802 - RNA, 14 nt, Salmonella enterica enterica serovar Typhi Ty2
gcuuccugcagugg

SEQ ID NO: 1750803 - RNA, 13 nt, Salmonella enterica enterica serovar Typhi Ty2
gcuucgccaauaa

SEQ ID NO: 1750804 - RNA, 14 nt, Salmonella enterica enterica serovar Typhi Ty2
gcuucgcuuaccag

SEQ ID NO: 1750805 - RNA, 17 nt, Salmonella enterica enterica serovar Typhi Ty2
gcuucgcucucgugcca

SEQ ID NO: 1750806 - RNA, 19 nt, Salmonella enterica enterica serovar Typhi Ty2
gcuucgucaggcggcugcg

SEQ ID NO: 1750807 - RNA, 14 nt, Salmonella enterica enterica serovar Typhi Ty2
gcuucgucagcucc

SEQ ID NO: 1750808 - RNA, 14 nt, Salmonella enterica enterica serovar Typhi Ty2
gcuucucuuuccag

SEQ ID NO: 1750809 - RNA, 15 nt, Salmonella enterica enterica serovar Typhi Ty2
gcuucuggcguaaug

SEQ ID NO: 1750810 - RNA, 17 nt, Salmonella enterica enterica serovar Typhi Ty2
gcuucugauacugcucc

SEQ ID NO: 1750811 - RNA, 22 nt, Salmonella enterica enterica serovar Typhi Ty2
gcuucucacggauccagaacug

SEQ ID NO: 1750812 - RNA, 22 nt, Salmonella enterica enterica serovar Typhi Ty2
gcuucguuccgcgauuuccugu

SEQ ID NO: 1750813 - RNA, 20 nt, Salmonella enterica enterica serovar Typhi Ty2
gcuucguuaccgccuuuuuu

SEQ ID NO: 1750814 - RNA, 22 nt, Salmonella enterica enterica serovar Typhi Ty2
gcuucgucccugcauuauccac

SEQ ID NO: 1750815 - RNA, 16 nt, Salmonella enterica enterica serovar Typhi Ty2
gcuucugucagccuug

SEQ ID NO: 1750816 - RNA, 23 nt, Salmonella enterica enterica serovar Typhi Ty2
gcuucuucacuaauuugaugccu

SEQ ID NO: 1750817 - RNA, 19 nt, Salmonella enterica enterica serovar Typhi Ty2
gcuucaaccguuucuuuuu

SEQ ID NO: 1750818 - RNA, 21 nt, Salmonella enterica enterica serovar Typhi Ty2
gcuucaaucgucguuccgcca

SEQ ID NO: 1750819 - RNA, 14 nt, Salmonella enterica enterica serovar Typhi Ty2
gcuucaaccuccug

SEQ ID NO: 1750820 - RNA, 16 nt, Salmonella enterica enterica serovar Typhi Ty2
gcuucagccacuggcu

SEQ ID NO: 1750821 - RNA, 17 nt, Salmonella enterica enterica serovar Typhi Ty2
gcuucagcaucaucucc

SEQ ID NO: 1750822 - RNA, 21 nt, Salmonella enterica enterica serovar Typhi Ty2
gcuucagaaagcagguuuuga

SEQ ID NO: 1750823 - RNA, 19 nt, Salmonella enterica enterica serovar Typhi Ty2
gcuucacgaagcggguuuu

SEQ ID NO: 1750824 - RNA, 14 nt, Salmonella enterica enterica serovar Typhi Ty2
gcuucaccgccaga

SEQ ID NO: 1750825 - RNA, 16 nt, Salmonella enterica enterica serovar Typhi Ty2
gcuucaccgccagagc

SEQ ID NO: 1750826 - RNA, 20 nt, Salmonella enterica enterica serovar Typhi Ty2
gcuucauaucgcccagcagc

SEQ ID NO: 1750827 - RNA, 17 nt, Salmonella enterica enterica serovar Typhi Ty2
gcuucaucaccaucgcc

SEQ ID NO: 1750828 - RNA, 22 nt, Salmonella enterica enterica serovar Typhi Ty2
gcuucaggauuuacugagcgcc

SEQ ID NO: 1750829 - RNA, 12 nt, Salmonella enterica enterica serovar Typhi Ty2
gcuucagcgaca

SEQ ID NO: 1750830 - RNA, 16 nt, Salmonella enterica enterica serovar Typhi Ty2
gcuucagcggcgcguu

SEQ ID NO: 1750831 - RNA, 20 nt, Salmonella enterica enterica serovar Typhi Ty2
gcuuccacgcacgccggccc

SEQ ID NO: 1750832 - RNA, 17 nt, Salmonella enterica enterica serovar Typhi Ty2
gcuuccaccucuucugc

SEQ ID NO: 1750833 - RNA, 16 nt, Salmonella enterica enterica serovar Typhi Ty2
gcuuaaucgagagcgg

SEQ ID NO: 1750834 - RNA, 21 nt, Salmonella enterica enterica serovar Typhi Ty2
gcuuaauacgcagaucuuuuu

SEQ ID NO: 1750835 - RNA, 19 nt, Salmonella enterica enterica serovar Typhi Ty2
gcuuaagcuuugcaccacu

SEQ ID NO: 1750836 - RNA, 16 nt, Salmonella enterica enterica serovar Typhi Ty2
gcuuaacuucugcagg

SEQ ID NO: 1750837 - RNA, 19 nt, Salmonella enterica enterica serovar Typhi Ty2
gcuuaacgaugcggagaua

SEQ ID NO: 1750838 - RNA, 16 nt, Salmonella enterica enterica serovar Typhi Ty2
gcuuacacagacugcu

SEQ ID NO: 1750839 - RNA, 18 nt, Salmonella enterica enterica serovar Typhi Ty2
gcuuacaauuuaucugcg

SEQ ID NO: 1750840 - RNA, 15 nt, Salmonella enterica enterica serovar Typhi Ty2
gcuuacaauuuaucu

SEQ ID NO: 1750841 - RNA, 13 nt, Salmonella enterica enterica serovar Typhi Ty2
gcuuaccagaccg

SEQ ID NO: 1750842 - RNA, 14 nt, Salmonella enterica enterica serovar Typhi Ty2
gcuuacauuucagg

SEQ ID NO: 1750843 - RNA, 23 nt, Salmonella enterica enterica serovar Typhi Ty2
gcuuaccuuguucuuccauugcu

SEQ ID NO: 1750844 - RNA, 19 nt, Salmonella enterica enterica serovar Typhi Ty2
gcuuaccguaucccaccau

SEQ ID NO: 1750845 - RNA, 22 nt, Salmonella enterica enterica serovar Typhi Ty2
gcuuaccggguuuggucaggua

SEQ ID NO: 1750846 - RNA, 13 nt, Salmonella enterica enterica serovar Typhi Ty2
gcuuacccagucu

SEQ ID NO: 1750847 - RNA, 21 nt, Salmonella enterica enterica serovar Typhi Ty2
gcuuaucaguccccacauuac

SEQ ID NO: 1750848 - RNA, 22 nt, Salmonella enterica enterica serovar Typhi Ty2
gcuuaucaggccuacauuuuua

SEQ ID NO: 1750849 - RNA, 16 nt, Salmonella enterica enterica serovar Typhi Ty2
gcuuaucaggccuaca

SEQ ID NO: 1750850 - RNA, 16 nt, Salmonella enterica enterica serovar Typhi Ty2
gcuuaucgccaaagau

SEQ ID NO: 1750851 - RNA, 21 nt, Salmonella enterica enterica serovar Typhi Ty2
gcuuaucgccaaaccagaccc

SEQ ID NO: 1750852 - RNA, 16 nt, Salmonella enterica enterica serovar Typhi Ty2
gcuuauccggccuaca

SEQ ID NO: 1750853 - RNA, 18 nt, Salmonella enterica enterica serovar Typhi Ty2
gcuuaucugcugcugggu

SEQ ID NO: 1750854 - RNA, 21 nt, Salmonella enterica enterica serovar Typhi Ty2
gcuuaucugcugcuggguuga

SEQ ID NO: 1750855 - RNA, 14 nt, Salmonella enterica enterica serovar Typhi Ty2
gcuuaucugaccau

SEQ ID NO: 1750856 - RNA, 17 nt, Salmonella enterica enterica serovar Typhi Ty2
gcuuagcucaucagccu

SEQ ID NO: 1750857 - RNA, 12 nt, Salmonella enterica enterica serovar Typhi Ty2
gcuuagcuuccc

SEQ ID NO: 1750858 - RNA, 18 nt, Salmonella enterica enterica serovar Typhi Ty2
gcuuauaacccugucugc

SEQ ID NO: 1750859 - RNA, 21 nt, Salmonella enterica enterica serovar Typhi Ty2
gcuuagaucguaucggcuggc

SEQ ID NO: 1750860 - RNA, 22 nt, Salmonella enterica enterica serovar Typhi Ty2
gcuuagaacucacgcucaagau

SEQ ID NO: 1750861 - RNA, 16 nt, Salmonella enterica enterica serovar Typhi Ty2
gcuuacuuuuagaauu

SEQ ID NO: 1750862 - RNA, 21 nt, Salmonella enterica enterica serovar Typhi Ty2
gcuuacuuuccaaaauccagg

SEQ ID NO: 1750863 - RNA, 14 nt, Salmonella enterica enterica serovar Typhi Ty2
gcuggcagggggag

SEQ ID NO: 1750864 - RNA, 15 nt, Salmonella enterica enterica serovar Typhi Ty2
gcuggcacguucucg

SEQ ID NO: 1750865 - RNA, 21 nt, Salmonella enterica enterica serovar Typhi Ty2
gcuggccgaauagcugauaaa

SEQ ID NO: 1750866 - RNA, 14 nt, Salmonella enterica enterica serovar Typhi Ty2
gcuggccgcgugcu

SEQ ID NO: 1750867 - RNA, 17 nt, Salmonella enterica enterica serovar Typhi Ty2
gcuggcgaaccaccagc

SEQ ID NO: 1750868 - RNA, 16 nt, Salmonella enterica enterica serovar Typhi Ty2
gcuggccuucuccacu

SEQ ID NO: 1750869 - RNA, 20 nt, Salmonella enterica enterica serovar Typhi Ty2
gcuggccuaucuguucgcag

SEQ ID NO: 1750870 - RNA, 14 nt, Salmonella enterica enterica serovar Typhi Ty2
gcuggcggucggga

SEQ ID NO: 1750871 - RNA, 21 nt, Salmonella enterica enterica serovar Typhi Ty2
gcuggcguacaguuucgccgu

SEQ ID NO: 1750872 - RNA, 13 nt, Salmonella enterica enterica serovar Typhi Ty2
gcuggcguccagc

SEQ ID NO: 1750873 - RNA, 21 nt, Salmonella enterica enterica serovar Typhi Ty2
gcuggcgucuguccggcgcuc

SEQ ID NO: 1750874 - RNA, 14 nt, Salmonella enterica enterica serovar Typhi Ty2
gcuggcgcuguccu

SEQ ID NO: 1750875 - RNA, 22 nt, Salmonella enterica enterica serovar Typhi Ty2
gcuggcgcucacgauaacgcag

SEQ ID NO: 1750876 - RNA, 21 nt, Salmonella enterica enterica serovar Typhi Ty2
gcuggcgcgucacaacagccg

SEQ ID NO: 1750877 - RNA, 19 nt, Salmonella enterica enterica serovar Typhi Ty2
gcuggcgcggggaacacuc

SEQ ID NO: 1750878 - RNA, 18 nt, Salmonella enterica enterica serovar Typhi Ty2
gcuggcgcggggaacaca

SEQ ID NO: 1750879 - RNA, 23 nt, Salmonella enterica enterica serovar Typhi Ty2
gcuggcgauauccgugccgccgc

SEQ ID NO: 1750880 - RNA, 19 nt, Salmonella enterica enterica serovar Typhi Ty2
gcuggcgauaaugccguga

SEQ ID NO: 1750881 - RNA, 15 nt, Salmonella enterica enterica serovar Typhi Ty2
gcuggcgcaacuggc

SEQ ID NO: 1750882 - RNA, 18 nt, Salmonella enterica enterica serovar Typhi Ty2
gcugguagacaaacagcg

SEQ ID NO: 1750883 - RNA, 22 nt, Salmonella enterica enterica serovar Typhi Ty2
gcugguaguccucuaucuuuuc

SEQ ID NO: 1750884 - RNA, 21 nt, Salmonella enterica enterica serovar Typhi Ty2
gcuggucagcguacccgcggu

SEQ ID NO: 1750885 - RNA, 21 nt, Salmonella enterica enterica serovar Typhi Ty2
gcuggugcagcccgucggcgu

SEQ ID NO: 1750886 - RNA, 13 nt, Salmonella enterica enterica serovar Typhi Ty2
gcuggugcagccc

SEQ ID NO: 1750887 - RNA, 15 nt, Salmonella enterica enterica serovar Typhi Ty2
gcuggugaucuggcc

SEQ ID NO: 1750888 - RNA, 16 nt, Salmonella enterica enterica serovar Typhi Ty2
gcuggucgccagcgcc

SEQ ID NO: 1750889 - RNA, 23 nt, Salmonella enterica enterica serovar Typhi Ty2
gcuggggcgcguuucauuaagcc

SEQ ID NO: 1750890 - RNA, 17 nt, Salmonella enterica enterica serovar Typhi Ty2
gcugggucauuaugagu

SEQ ID NO: 1750891 - RNA, 16 nt, Salmonella enterica enterica serovar Typhi Ty2
gcuggguucauccagc

SEQ ID NO: 1750892 - RNA, 14 nt, Salmonella enterica enterica serovar Typhi Ty2
gcuggcuuaacuca

SEQ ID NO: 1750893 - RNA, 17 nt, Salmonella enterica enterica serovar Typhi Ty2
gcuggcuggccagggca

SEQ ID NO: 1750894 - RNA, 15 nt, Salmonella enterica enterica serovar Typhi Ty2
gcuggcuuaacucac

SEQ ID NO: 1750895 - RNA, 14 nt, Salmonella enterica enterica serovar Typhi Ty2
gcuggcuggcgguc

SEQ ID NO: 1750896 - RNA, 13 nt, Salmonella enterica enterica serovar Typhi Ty2
gcugugccaauaa

SEQ ID NO: 1750897 - RNA, 16 nt, Salmonella enterica enterica serovar Typhi Ty2
gcugugccaauaacgc

SEQ ID NO: 1750898 - RNA, 16 nt, Salmonella enterica enterica serovar Typhi Ty2
gcugucggucagauuc

SEQ ID NO: 1750899 - RNA, 12 nt, Salmonella enterica enterica serovar Typhi Ty2
gcugucgccaga

SEQ ID NO: 1750900 - RNA, 20 nt, Salmonella enterica enterica serovar Typhi Ty2
gcugucuaauugacggccac

SEQ ID NO: 1750901 - RNA, 19 nt, Salmonella enterica enterica serovar Typhi Ty2
gcuguuaaaaccggcugcc

SEQ ID NO: 1750902 - RNA, 15 nt, Salmonella enterica enterica serovar Typhi Ty2
gcuguggucgucugg

SEQ ID NO: 1750903 - RNA, 16 nt, Salmonella enterica enterica serovar Typhi Ty2
gcuguggaaacugugc

SEQ ID NO: 1750904 - RNA, 16 nt, Salmonella enterica enterica serovar Typhi Ty2
gcugugcuaucaggcc

SEQ ID NO: 1750905 - RNA, 13 nt, Salmonella enterica enterica serovar Typhi Ty2
gcuguuccuggug

SEQ ID NO: 1750906 - RNA, 18 nt, Salmonella enterica enterica serovar Typhi Ty2
gcuguugaggaaauucug

SEQ ID NO: 1750907 - RNA, 21 nt, Salmonella enterica enterica serovar Typhi Ty2
gcuguuccaccaacgaccauc

SEQ ID NO: 1750908 - RNA, 15 nt, Salmonella enterica enterica serovar Typhi Ty2
gcuguucagcagaau

SEQ ID NO: 1750909 - RNA, 23 nt, Salmonella enterica enterica serovar Typhi Ty2
gcuguuaccaaugccaaaaaaac

SEQ ID NO: 1750910 - RNA, 17 nt, Salmonella enterica enterica serovar Typhi Ty2
gcuguuaaccuugcgcc

SEQ ID NO: 1750911 - RNA, 15 nt, Salmonella enterica enterica serovar Typhi Ty2
gcuguuaguaagcug

SEQ ID NO: 1750912 - RNA, 17 nt, Salmonella enterica enterica serovar Typhi Ty2
gcuguuaguaagcuggg

SEQ ID NO: 1750913 - RNA, 16 nt, Salmonella enterica enterica serovar Typhi Ty2
gcuguuaccguaagcg

SEQ ID NO: 1750914 - RNA, 21 nt, Salmonella enterica enterica serovar Typhi Ty2
gcuguuuuucaucaucaucca

SEQ ID NO: 1750915 - RNA, 23 nt, Salmonella enterica enterica serovar Typhi Ty2
gcuguuuuucaucaucauccaga

SEQ ID NO: 1750916 - RNA, 13 nt, Salmonella enterica enterica serovar Typhi Ty2
gcuguuuuuuguu

SEQ ID NO: 1750917 - RNA, 15 nt, Salmonella enterica enterica serovar Typhi Ty2
gcuguuguuccagau

SEQ ID NO: 1750918 - RNA, 20 nt, Salmonella enterica enterica serovar Typhi Ty2
gcuguuucuggucauacugu

SEQ ID NO: 1750919 - RNA, 15 nt, Salmonella enterica enterica serovar Typhi Ty2
gcuguuucuggucau

SEQ ID NO: 1750920 - RNA, 21 nt, Salmonella enterica enterica serovar Typhi Ty2
gcuguuuagccgucucgguuc

SEQ ID NO: 1750921 - RNA, 23 nt, Salmonella enterica enterica serovar Typhi Ty2
gcuguugugucccggcccauacu

SEQ ID NO: 1750922 - RNA, 18 nt, Salmonella enterica enterica serovar Typhi Ty2
gcuguugucgauauuaaa

SEQ ID NO: 1750923 - RNA, 12 nt, Salmonella enterica enterica serovar Typhi Ty2
gcuggugguaaa

SEQ ID NO: 1750924 - RNA, 15 nt, Salmonella enterica enterica serovar Typhi Ty2
gcuggugcugugccu

SEQ ID NO: 1750925 - RNA, 22 nt, Salmonella enterica enterica serovar Typhi Ty2
gcuggugccaaucuccagcauc

SEQ ID NO: 1750926 - RNA, 13 nt, Salmonella enterica enterica serovar Typhi Ty2
gcugguggugggc

SEQ ID NO: 1750927 - RNA, 19 nt, Salmonella enterica enterica serovar Typhi Ty2
gcugguuaacgccgccauc

SEQ ID NO: 1750928 - RNA, 14 nt, Salmonella enterica enterica serovar Typhi Ty2
gcuggugucgccgu

SEQ ID NO: 1750929 - RNA, 18 nt, Salmonella enterica enterica serovar Typhi Ty2
gcuguaauagauaugaaa

SEQ ID NO: 1750930 - RNA, 15 nt, Salmonella enterica enterica serovar Typhi Ty2
gcuguaacccgccgc

SEQ ID NO: 1750931 - RNA, 16 nt, Salmonella enterica enterica serovar Typhi Ty2
gcuguacauauccagu

SEQ ID NO: 1750932 - RNA, 18 nt, Salmonella enterica enterica serovar Typhi Ty2
gcugucgaugauauccag

SEQ ID NO: 1750933 - RNA, 17 nt, Salmonella enterica enterica serovar Typhi Ty2
gcuguccuuaaccagcu

SEQ ID NO: 1750934 - RNA, 12 nt, Salmonella enterica enterica serovar Typhi Ty2
gcugucccagag

SEQ ID NO: 1750935 - RNA, 14 nt, Salmonella enterica enterica serovar Typhi Ty2
gcuguccagucaaa

SEQ ID NO: 1750936 - RNA, 21 nt, Salmonella enterica enterica serovar Typhi Ty2
gcuguccagauagggccaggc

SEQ ID NO: 1750937 - RNA, 22 nt, Salmonella enterica enterica serovar Typhi Ty2
gcuguccagauagggccaggcg

SEQ ID NO: 1750938 - RNA, 16 nt, Salmonella enterica enterica serovar Typhi Ty2
gcugucaucaaugagc

SEQ ID NO: 1750939 - RNA, 22 nt, Salmonella enterica enterica serovar Typhi Ty2
gcuguaggcacuuuccagacca

SEQ ID NO: 1750940 - RNA, 18 nt, Salmonella enterica enterica serovar Typhi Ty2
gcugcguucggaagacug

SEQ ID NO: 1750941 - RNA, 21 nt, Salmonella enterica enterica serovar Typhi Ty2
gcugcguucggaagacugcuc

SEQ ID NO: 1750942 - RNA, 11 nt, Salmonella enterica enterica serovar Typhi Ty2
gcugcugaugg

SEQ ID NO: 1750943 - RNA, 13 nt, Salmonella enterica enterica serovar Typhi Ty2
gcugcucuccuug

SEQ ID NO: 1750944 - RNA, 12 nt, Salmonella enterica enterica serovar Typhi Ty2
gcugcucccuca

SEQ ID NO: 1750945 - RNA, 21 nt, Salmonella enterica enterica serovar Typhi Ty2
gcugcucauuuaugcgcuggg

SEQ ID NO: 1750946 - RNA, 22 nt, Salmonella enterica enterica serovar Typhi Ty2
gcugcgccuggaaaaaagcgcc

SEQ ID NO: 1750947 - RNA, 13 nt, Salmonella enterica enterica serovar Typhi Ty2
gcugcgccguucc

SEQ ID NO: 1750948 - RNA, 22 nt, Salmonella enterica enterica serovar Typhi Ty2
gcugcgccugaaaggcacgcuc

SEQ ID NO: 1750949 - RNA, 14 nt, Salmonella enterica enterica serovar Typhi Ty2
gcugcgccagcgca

SEQ ID NO: 1750950 - RNA, 16 nt, Salmonella enterica enterica serovar Typhi Ty2
gcugcggaacaccagc

SEQ ID NO: 1750951 - RNA, 19 nt, Salmonella enterica enterica serovar Typhi Ty2
gcugcggaacaccagcgcc

SEQ ID NO: 1750952 - RNA, 14 nt, Salmonella enterica enterica serovar Typhi Ty2
gcugcgcugccagc

SEQ ID NO: 1750953 - RNA, 13 nt, Salmonella enterica enterica serovar Typhi Ty2
gcugcgcucagaa

SEQ ID NO: 1750954 - RNA, 11 nt, Salmonella enterica enterica serovar Typhi Ty2
gcugcggauga

SEQ ID NO: 1750955 - RNA, 20 nt, Salmonella enterica enterica serovar Typhi Ty2
gcuggcaaaacgcauccagc

SEQ ID NO: 1750956 - RNA, 14 nt, Salmonella enterica enterica serovar Typhi Ty2
gcuggcacuggcag

SEQ ID NO: 1750957 - RNA, 21 nt, Salmonella enterica enterica serovar Typhi Ty2
gcuggagcaggugcggcuggg

SEQ ID NO: 1750958 - RNA, 17 nt, Salmonella enterica enterica serovar Typhi Ty2
gcuggauagagcgcugc

SEQ ID NO: 1750959 - RNA, 22 nt, Salmonella enterica enterica serovar Typhi Ty2
gcugcuugcuuuucaucaccau

SEQ ID NO: 1750960 - RNA, 19 nt, Salmonella enterica enterica serovar Typhi Ty2
gcugcuuuuugagcggcac

SEQ ID NO: 1750961 - RNA, 17 nt, Salmonella enterica enterica serovar Typhi Ty2
gcuggaaugcccacucc

SEQ ID NO: 1750962 - RNA, 14 nt, Salmonella enterica enterica serovar Typhi Ty2
gcugcuguaacaga

SEQ ID NO: 1750963 - RNA, 16 nt, Salmonella enterica enterica serovar Typhi Ty2
gcugcuggugcgccug

SEQ ID NO: 1750964 - RNA, 21 nt, Salmonella enterica enterica serovar Typhi Ty2
gcugcuggcgagcaggaaaag

SEQ ID NO: 1750965 - RNA, 19 nt, Salmonella enterica enterica serovar Typhi Ty2
gcugcuggccuuccagaua

SEQ ID NO: 1750966 - RNA, 20 nt, Salmonella enterica enterica serovar Typhi Ty2
gcugcauccuguaccaccac

SEQ ID NO: 1750967 - RNA, 16 nt, Salmonella enterica enterica serovar Typhi Ty2
gcugcaucuuacugac

SEQ ID NO: 1750968 - RNA, 15 nt, Salmonella enterica enterica serovar Typhi Ty2
gcugcauccgcgcuu

SEQ ID NO: 1750969 - RNA, 14 nt, Salmonella enterica enterica serovar Typhi Ty2
gcugccacacucuc

SEQ ID NO: 1750970 - RNA, 13 nt, Salmonella enterica enterica serovar Typhi Ty2
gcugccagcugcg

SEQ ID NO: 1750971 - RNA, 21 nt, Salmonella enterica enterica serovar Typhi Ty2
gcugcagcuuaggauucgcca

SEQ ID NO: 1750972 - RNA, 17 nt, Salmonella enterica enterica serovar Typhi Ty2
gcugcacgccaucggcu

SEQ ID NO: 1750973 - RNA, 17 nt, Salmonella enterica enterica serovar Typhi Ty2
gcugccauuaucaccau

SEQ ID NO: 1750974 - RNA, 15 nt, Salmonella enterica enterica serovar Typhi Ty2
gcugccgaccuggcu

SEQ ID NO: 1750975 - RNA, 21 nt, Salmonella enterica enterica serovar Typhi Ty2
gcugcccugcgguagcuccag

SEQ ID NO: 1750976 - RNA, 22 nt, Salmonella enterica enterica serovar Typhi Ty2
gcugccgacaacgccuccugcc

SEQ ID NO: 1750977 - RNA, 19 nt, Salmonella enterica enterica serovar Typhi Ty2
gcugccgauacuccauugu

SEQ ID NO: 1750978 - RNA, 15 nt, Salmonella enterica enterica serovar Typhi Ty2
gcugccgcccuuucc

SEQ ID NO: 1750979 - RNA, 13 nt, Salmonella enterica enterica serovar Typhi Ty2
gcugcgacaacaa

SEQ ID NO: 1750980 - RNA, 9 nt, Salmonella enterica enterica serovar Typhi Ty2
gcugccgca

SEQ ID NO: 1750981 - RNA, 19 nt, Salmonella enterica enterica serovar Typhi Ty2
gcugccggaaagggaagag

SEQ ID NO: 1750982 - RNA, 12 nt, Salmonella enterica enterica serovar Typhi Ty2
gcgcaucaguac

SEQ ID NO: 1750983 - RNA, 15 nt, Salmonella enterica enterica serovar Typhi Ty2
gcgcaucauggucgu

SEQ ID NO: 1750984 - RNA, 21 nt, Salmonella enterica enterica serovar Typhi Ty2
gcgcaguuuacgcagcgccuu

SEQ ID NO: 1750985 - RNA, 19 nt, Salmonella enterica enterica serovar Typhi Ty2
gcgcaucaacgccaggcag

SEQ ID NO: 1750986 - RNA, 15 nt, Salmonella enterica enterica serovar Typhi Ty2
gcgcauacuuauaca

SEQ ID NO: 1750987 - RNA, 19 nt, Salmonella enterica enterica serovar Typhi Ty2
gcgcauagauauaacccag

SEQ ID NO: 1750988 - RNA, 17 nt, Salmonella enterica enterica serovar Typhi Ty2
gcgcauaggcuuugcug

SEQ ID NO: 1750989 - RNA, 14 nt, Salmonella enterica enterica serovar Typhi Ty2
gcgcaguggcgggu

SEQ ID NO: 1750990 - RNA, 19 nt, Salmonella enterica enterica serovar Typhi Ty2
gcgcaguucgccgccagga

SEQ ID NO: 1750991 - RNA, 20 nt, Salmonella enterica enterica serovar Typhi Ty2
gcgcaguaaacuccucuucc

SEQ ID NO: 1750992 - RNA, 13 nt, Salmonella enterica enterica serovar Typhi Ty2
gcgcagucacaga

SEQ ID NO: 1750993 - RNA, 17 nt, Salmonella enterica enterica serovar Typhi Ty2
gcgcagcgcccagcagc

SEQ ID NO: 1750994 - RNA, 18 nt, Salmonella enterica enterica serovar Typhi Ty2
gcgcagcgccaucaggcc

SEQ ID NO: 1750995 - RNA, 20 nt, Salmonella enterica enterica serovar Typhi Ty2
gcgcagcgccaucaggcaau

SEQ ID NO: 1750996 - RNA, 20 nt, Salmonella enterica enterica serovar Typhi Ty2
gcgcagcgaaacugcgcgcc

SEQ ID NO: 1750997 - RNA, 23 nt, Salmonella enterica enterica serovar Typhi Ty2
gcgcagauuuugcagauccgcga

SEQ ID NO: 1750998 - RNA, 23 nt, Salmonella enterica enterica serovar Typhi Ty2
gcgcagguaguugucggcggucg

SEQ ID NO: 1750999 - RNA, 14 nt, Salmonella enterica enterica serovar Typhi Ty2
gcgcaggggcauuu

SEQ ID NO: 1751000 - RNA, 15 nt, Salmonella enterica enterica serovar Typhi Ty2
gcgcaggcgggggcg

SEQ ID NO: 1751001 - RNA, 16 nt, Salmonella enterica enterica serovar Typhi Ty2
gcgcagagugagcagg

SEQ ID NO: 1751002 - RNA, 15 nt, Salmonella enterica enterica serovar Typhi Ty2
gcgcagaagcuacuu

SEQ ID NO: 1751003 - RNA, 20 nt, Salmonella enterica enterica serovar Typhi Ty2
gcgcacaauaccgagaaugu

SEQ ID NO: 1751004 - RNA, 19 nt, Salmonella enterica enterica serovar Typhi Ty2
gcgcacauuuacgccagcc

SEQ ID NO: 1751005 - RNA, 17 nt, Salmonella enterica enterica serovar Typhi Ty2
gcgccaggcccagccgc

SEQ ID NO: 1751006 - RNA, 16 nt, Salmonella enterica enterica serovar Typhi Ty2
gcgccaggccauugcu

SEQ ID NO: 1751007 - RNA, 21 nt, Salmonella enterica enterica serovar Typhi Ty2
gcgccaguuuuuccuguuccu

SEQ ID NO: 1751008 - RNA, 23 nt, Salmonella enterica enterica serovar Typhi Ty2
gcgccaguuggcguaccaucagc

SEQ ID NO: 1751009 - RNA, 14 nt, Salmonella enterica enterica serovar Typhi Ty2
gcgccaucaugcag

SEQ ID NO: 1751010 - RNA, 23 nt, Salmonella enterica enterica serovar Typhi Ty2
gcgccaucccaugcaccaguccc

SEQ ID NO: 1751011 - RNA, 17 nt, Salmonella enterica enterica serovar Typhi Ty2
gcgccauccggcgcuga

SEQ ID NO: 1751012 - RNA, 21 nt, Salmonella enterica enterica serovar Typhi Ty2
gcgccauauugcuguauuuua

SEQ ID NO: 1751013 - RNA, 18 nt, Salmonella enterica enterica serovar Typhi Ty2
gcgccaucagacucucaa

SEQ ID NO: 1751014 - RNA, 22 nt, Salmonella enterica enterica serovar Typhi Ty2
gcgccauauccucgcugggcca

SEQ ID NO: 1751015 - RNA, 16 nt, Salmonella enterica enterica serovar Typhi Ty2
gcgccauauccgcaga

SEQ ID NO: 1751016 - RNA, 14 nt, Salmonella enterica enterica serovar Typhi Ty2
gcgccaucuccucc

SEQ ID NO: 1751017 - RNA, 23 nt, Salmonella enterica enterica serovar Typhi Ty2
gcgccaugaucgauagcgacggc

SEQ ID NO: 1751018 - RNA, 11 nt, Salmonella enterica enterica serovar Typhi Ty2
gcgccaucggc

SEQ ID NO: 1751019 - RNA, 12 nt, Salmonella enterica enterica serovar Typhi Ty2
gcgccagcaggu

SEQ ID NO: 1751020 - RNA, 16 nt, Salmonella enterica enterica serovar Typhi Ty2
gcgccagccagucgcc

SEQ ID NO: 1751021 - RNA, 14 nt, Salmonella enterica enterica serovar Typhi Ty2
gcgccagccagcgc

SEQ ID NO: 1751022 - RNA, 19 nt, Salmonella enterica enterica serovar Typhi Ty2
gcgccagccagcgccacca

SEQ ID NO: 1751023 - RNA, 12 nt, Salmonella enterica enterica serovar Typhi Ty2
gcgccagccagc

SEQ ID NO: 1751024 - RNA, 22 nt, Salmonella enterica enterica serovar Typhi Ty2
gcgccagcuccauagaaaucag

SEQ ID NO: 1751025 - RNA, 21 nt, Salmonella enterica enterica serovar Typhi Ty2
gcgccagccgcgccaucuccu

SEQ ID NO: 1751026 - RNA, 15 nt, Salmonella enterica enterica serovar Typhi Ty2
gcgccaggaaacucg

SEQ ID NO: 1751027 - RNA, 16 nt, Salmonella enterica enterica serovar Typhi Ty2
gcgccacgcgccaggu

SEQ ID NO: 1751028 - RNA, 22 nt, Salmonella enterica enterica serovar Typhi Ty2
gcgccaccgggcaacacacgcu

SEQ ID NO: 1751029 - RNA, 13 nt, Salmonella enterica enterica serovar Typhi Ty2
gcgccacgccacc

SEQ ID NO: 1751030 - RNA, 19 nt, Salmonella enterica enterica serovar Typhi Ty2
gcgccacgccaccgggccg

SEQ ID NO: 1751031 - RNA, 21 nt, Salmonella enterica enterica serovar Typhi Ty2
gcgccacgcgaugcaaccccu

SEQ ID NO: 1751032 - RNA, 15 nt, Salmonella enterica enterica serovar Typhi Ty2
gcgccacgcccacgc

SEQ ID NO: 1751033 - RNA, 20 nt, Salmonella enterica enterica serovar Typhi Ty2
gcgcauuuuauuuaaaaagg

SEQ ID NO: 1751034 - RNA, 17 nt, Salmonella enterica enterica serovar Typhi Ty2
gcgcauuucguggcgga

SEQ ID NO: 1751035 - RNA, 19 nt, Salmonella enterica enterica serovar Typhi Ty2
gcgccaaaagaggcagcaa

SEQ ID NO: 1751036 - RNA, 19 nt, Salmonella enterica enterica serovar Typhi Ty2
gcgccaacggccucccagc

SEQ ID NO: 1751037 - RNA, 19 nt, Salmonella enterica enterica serovar Typhi Ty2
gcgccaaccgugagcgcgc

SEQ ID NO: 1751038 - RNA, 21 nt, Salmonella enterica enterica serovar Typhi Ty2
gcgccaaucaccgccagcaac

SEQ ID NO: 1751039 - RNA, 15 nt, Salmonella enterica enterica serovar Typhi Ty2
gcgccaagcggcaac

SEQ ID NO: 1751040 - RNA, 13 nt, Salmonella enterica enterica serovar Typhi Ty2
gcgccaccacuga

SEQ ID NO: 1751041 - RNA, 20 nt, Salmonella enterica enterica serovar Typhi Ty2
gcgccaauggcgaucuuuug

SEQ ID NO: 1751042 - RNA, 22 nt, Salmonella enterica enterica serovar Typhi Ty2
gcgccaaugcgaaaauacuccc

SEQ ID NO: 1751043 - RNA, 15 nt, Salmonella enterica enterica serovar Typhi Ty2
gcgcauuccagaccc

SEQ ID NO: 1751044 - RNA, 19 nt, Salmonella enterica enterica serovar Typhi Ty2
gcgcauugccugaaccggu

SEQ ID NO: 1751045 - RNA, 18 nt, Salmonella enterica enterica serovar Typhi Ty2
gcgcaucuggucauggcu

SEQ ID NO: 1751046 - RNA, 15 nt, Salmonella enterica enterica serovar Typhi Ty2
gcgcauggccauaga

SEQ ID NO: 1751047 - RNA, 23 nt, Salmonella enterica enterica serovar Typhi Ty2
gcgcaucucccugccagugaaag

SEQ ID NO: 1751048 - RNA, 20 nt, Salmonella enterica enterica serovar Typhi Ty2
gcgagcugccaguucauucc

SEQ ID NO: 1751049 - RNA, 18 nt, Salmonella enterica enterica serovar Typhi Ty2
gcgagucagacaccagcc

SEQ ID NO: 1751050 - RNA, 15 nt, Salmonella enterica enterica serovar Typhi Ty2
gcgagguucccgccg

SEQ ID NO: 1751051 - RNA, 17 nt, Salmonella enterica enterica serovar Typhi Ty2
gcgagguucccgccgcc

SEQ ID NO: 1751052 - RNA, 20 nt, Salmonella enterica enterica serovar Typhi Ty2
gcgauaaugaagcauaaaaa

SEQ ID NO: 1751053 - RNA, 17 nt, Salmonella enterica enterica serovar Typhi Ty2
gcgauaaggauaucuug

SEQ ID NO: 1751054 - RNA, 19 nt, Salmonella enterica enterica serovar Typhi Ty2
gcgauaaccgccgccgcgc

SEQ ID NO: 1751055 - RNA, 21 nt, Salmonella enterica enterica serovar Typhi Ty2
gcgauaaaaauauccgccauc

SEQ ID NO: 1751056 - RNA, 16 nt, Salmonella enterica enterica serovar Typhi Ty2
gcgauauucgggcgca

SEQ ID NO: 1751057 - RNA, 15 nt, Salmonella enterica enterica serovar Typhi Ty2
gcgaucagcgccacc

SEQ ID NO: 1751058 - RNA, 18 nt, Salmonella enterica enterica serovar Typhi Ty2
gcgaucacuaccgccauc

SEQ ID NO: 1751059 - RNA, 17 nt, Salmonella enterica enterica serovar Typhi Ty2
gcgaucagcgccaccac

SEQ ID NO: 1751060 - RNA, 13 nt, Salmonella enterica enterica serovar Typhi Ty2
gcgaucgcuucca

SEQ ID NO: 1751061 - RNA, 17 nt, Salmonella enterica enterica serovar Typhi Ty2
gcgaucucuuuggccag

SEQ ID NO: 1751062 - RNA, 14 nt, Salmonella enterica enterica serovar Typhi Ty2
gcgaugccugccgg

SEQ ID NO: 1751063 - RNA, 23 nt, Salmonella enterica enterica serovar Typhi Ty2
gcgacuacgguaaaccaggccag

SEQ ID NO: 1751064 - RNA, 21 nt, Salmonella enterica enterica serovar Typhi Ty2
gcgacuaugccggcugcagca

SEQ ID NO: 1751065 - RNA, 18 nt, Salmonella enterica enterica serovar Typhi Ty2
gcgacguugucuucaucu

SEQ ID NO: 1751066 - RNA, 17 nt, Salmonella enterica enterica serovar Typhi Ty2
gcgacguuaucucgcca

SEQ ID NO: 1751067 - RNA, 20 nt, Salmonella enterica enterica serovar Typhi Ty2
gcgacguuaucucgccagga

SEQ ID NO: 1751068 - RNA, 18 nt, Salmonella enterica enterica serovar Typhi Ty2
gcgacguccgccaacagc

SEQ ID NO: 1751069 - RNA, 18 nt, Salmonella enterica enterica serovar Typhi Ty2
gcgacguauuacgcaggc

SEQ ID NO: 1751070 - RNA, 13 nt, Salmonella enterica enterica serovar Typhi Ty2
gcgacggcggcgu

SEQ ID NO: 1751071 - RNA, 16 nt, Salmonella enterica enterica serovar Typhi Ty2
gcgacggcccaacagc

SEQ ID NO: 1751072 - RNA, 15 nt, Salmonella enterica enterica serovar Typhi Ty2
gcgacggggcgcaga

SEQ ID NO: 1751073 - RNA, 16 nt, Salmonella enterica enterica serovar Typhi Ty2
gcgacggacucgcgca

SEQ ID NO: 1751074 - RNA, 11 nt, Salmonella enterica enterica serovar Typhi Ty2
gcgagaaaaaa

SEQ ID NO: 1751075 - RNA, 23 nt, Salmonella enterica enterica serovar Typhi Ty2
gcgacucgccguuuuaucgcccg

SEQ ID NO: 1751076 - RNA, 14 nt, Salmonella enterica enterica serovar Typhi Ty2
gcgagacgccuggg

SEQ ID NO: 1751077 - RNA, 14 nt, Salmonella enterica enterica serovar Typhi Ty2
gcgagaaguucuca

SEQ ID NO: 1751078 - RNA, 15 nt, Salmonella enterica enterica serovar Typhi Ty2
gcgacgcgccagcca

SEQ ID NO: 1751079 - RNA, 16 nt, Salmonella enterica enterica serovar Typhi Ty2
gcgacgcgcgagcgca

SEQ ID NO: 1751080 - RNA, 17 nt, Salmonella enterica enterica serovar Typhi Ty2
gcgacgcgccagccagc

SEQ ID NO: 1751081 - RNA, 16 nt, Salmonella enterica enterica serovar Typhi Ty2
gcgacgcggcgaguua

SEQ ID NO: 1751082 - RNA, 22 nt, Salmonella enterica enterica serovar Typhi Ty2
gcgacgccagauuaucggccag

SEQ ID NO: 1751083 - RNA, 22 nt, Salmonella enterica enterica serovar Typhi Ty2
gcgaccgccaccauccggcgcu

SEQ ID NO: 1751084 - RNA, 21 nt, Salmonella enterica enterica serovar Typhi Ty2
gcgaccgcaucaaugcccagc

SEQ ID NO: 1751085 - RNA, 20 nt, Salmonella enterica enterica serovar Typhi Ty2
gcgaccgaucaucauuccga

SEQ ID NO: 1751086 - RNA, 16 nt, Salmonella enterica enterica serovar Typhi Ty2
gcgaccgccgcugguc

SEQ ID NO: 1751087 - RNA, 14 nt, Salmonella enterica enterica serovar Typhi Ty2
gcgaccacgccacc

SEQ ID NO: 1751088 - RNA, 18 nt, Salmonella enterica enterica serovar Typhi Ty2
gcgaccaccgucccagua

SEQ ID NO: 1751089 - RNA, 18 nt, Salmonella enterica enterica serovar Typhi Ty2
gcgaccagcagaugcagu

SEQ ID NO: 1751090 - RNA, 14 nt, Salmonella enterica enterica serovar Typhi Ty2
gcgacaucccagac

SEQ ID NO: 1751091 - RNA, 20 nt, Salmonella enterica enterica serovar Typhi Ty2
gcgaauuuccugccagaccu

SEQ ID NO: 1751092 - RNA, 21 nt, Salmonella enterica enterica serovar Typhi Ty2
gcgaauuucggcaaugacggu

SEQ ID NO: 1751093 - RNA, 20 nt, Salmonella enterica enterica serovar Typhi Ty2
gcgaaugcaaccggaacuca

SEQ ID NO: 1751094 - RNA, 15 nt, Salmonella enterica enterica serovar Typhi Ty2
gcgaauccggcggcu

SEQ ID NO: 1751095 - RNA, 13 nt, Salmonella enterica enterica serovar Typhi Ty2
gcgaaccggacca

SEQ ID NO: 1751096 - RNA, 22 nt, Salmonella enterica enterica serovar Typhi Ty2
gcgaagaucguuauccagcagc

SEQ ID NO: 1751097 - RNA, 20 nt, Salmonella enterica enterica serovar Typhi Ty2
gcgaacaguguaaacgccag

SEQ ID NO: 1751098 - RNA, 15 nt, Salmonella enterica enterica serovar Typhi Ty2
gcgaauaaucuguuu

SEQ ID NO: 1751099 - RNA, 15 nt, Salmonella enterica enterica serovar Typhi Ty2
gcgaauacgggaucg

SEQ ID NO: 1751100 - RNA, 15 nt, Salmonella enterica enterica serovar Typhi Ty2
gcgaauauacgcacc

SEQ ID NO: 1751101 - RNA, 15 nt, Salmonella enterica enterica serovar Typhi Ty2
gcgaauagcgcgcua

SEQ ID NO: 1751102 - RNA, 18 nt, Salmonella enterica enterica serovar Typhi Ty2
gcgaaucauguuuuucuc

SEQ ID NO: 1751103 - RNA, 16 nt, Salmonella enterica enterica serovar Typhi Ty2
gcgaauaaucccggcg

SEQ ID NO: 1751104 - RNA, 19 nt, Salmonella enterica enterica serovar Typhi Ty2
gccguuuuuaauuugcucc

SEQ ID NO: 1751105 - RNA, 22 nt, Salmonella enterica enterica serovar Typhi Ty2
gccguuuuuaauuugcuccaga

SEQ ID NO: 1751106 - RNA, 18 nt, Salmonella enterica enterica serovar Typhi Ty2
gccguuuuagguucuuca

SEQ ID NO: 1751107 - RNA, 14 nt, Salmonella enterica enterica serovar Typhi Ty2
gccuaaaucgcugc

SEQ ID NO: 1751108 - RNA, 15 nt, Salmonella enterica enterica serovar Typhi Ty2
gcgaaaaggccuggc

SEQ ID NO: 1751109 - RNA, 21 nt, Salmonella enterica enterica serovar Typhi Ty2
gccguuuuaacgucauuacca

SEQ ID NO: 1751110 - RNA, 17 nt, Salmonella enterica enterica serovar Typhi Ty2
gccguugugcugguuga

SEQ ID NO: 1751111 - RNA, 20 nt, Salmonella enterica enterica serovar Typhi Ty2
gcgaaagaagcgcuggagaa

SEQ ID NO: 1751112 - RNA, 17 nt, Salmonella enterica enterica serovar Typhi Ty2
gcgaaagagaaagcgcu

SEQ ID NO: 1751113 - RNA, 20 nt, Salmonella enterica enterica serovar Typhi Ty2
gcgaacagccccaccgccag

SEQ ID NO: 1751114 - RNA, 13 nt, Salmonella enterica enterica serovar Typhi Ty2
gccuaaauguucc

SEQ ID NO: 1751115 - RNA, 12 nt, Salmonella enterica enterica serovar Typhi Ty2
gcgaaaauaaac

SEQ ID NO: 1751116 - RNA, 23 nt, Salmonella enterica enterica serovar Typhi Ty2
gcgaaacaggucggcaugcaucu

SEQ ID NO: 1751117 - RNA, 19 nt, Salmonella enterica enterica serovar Typhi Ty2
gcggagguuucuuuuucua

SEQ ID NO: 1751118 - RNA, 16 nt, Salmonella enterica enterica serovar Typhi Ty2
gcggauaugcagcagc

SEQ ID NO: 1751119 - RNA, 17 nt, Salmonella enterica enterica serovar Typhi Ty2
gcggauaugcagcagcc

SEQ ID NO: 1751120 - RNA, 21 nt, Salmonella enterica enterica serovar Typhi Ty2
gcggauaaauagugacgccgc

SEQ ID NO: 1751121 - RNA, 20 nt, Salmonella enterica enterica serovar Typhi Ty2
gcggagagaucgacagcgcg

SEQ ID NO: 1751122 - RNA, 23 nt, Salmonella enterica enterica serovar Typhi Ty2
gcggagagaucgacagcgcgcgc

SEQ ID NO: 1751123 - RNA, 17 nt, Salmonella enterica enterica serovar Typhi Ty2
gcggagaagacgccgcc

SEQ ID NO: 1751124 - RNA, 19 nt, Salmonella enterica enterica serovar Typhi Ty2
gcggagaagacgccgccgc

SEQ ID NO: 1751125 - RNA, 16 nt, Salmonella enterica enterica serovar Typhi Ty2
gcggagaucgcucccg

SEQ ID NO: 1751126 - RNA, 17 nt, Salmonella enterica enterica serovar Typhi Ty2
gcggaccagcgugcgcu

SEQ ID NO: 1751127 - RNA, 12 nt, Salmonella enterica enterica serovar Typhi Ty2
gcggacagcggc

SEQ ID NO: 1751128 - RNA, 15 nt, Salmonella enterica enterica serovar Typhi Ty2
gcggacacccgcagc

SEQ ID NO: 1751129 - RNA, 22 nt, Salmonella enterica enterica serovar Typhi Ty2
gcggaaugcugguuaacgccgc

SEQ ID NO: 1751130 - RNA, 20 nt, Salmonella enterica enterica serovar Typhi Ty2
gcggaaucgucacagacccc

SEQ ID NO: 1751131 - RNA, 17 nt, Salmonella enterica enterica serovar Typhi Ty2
gcggaauccaucccccu

SEQ ID NO: 1751132 - RNA, 21 nt, Salmonella enterica enterica serovar Typhi Ty2
gcggaauccaucccccugccg

SEQ ID NO: 1751133 - RNA, 19 nt, Salmonella enterica enterica serovar Typhi Ty2
gcggaauugguagacgcgc

SEQ ID NO: 1751134 - RNA, 12 nt, Salmonella enterica enterica serovar Typhi Ty2
gcggauggcgcu

SEQ ID NO: 1751135 - RNA, 19 nt, Salmonella enterica enterica serovar Typhi Ty2
gcggaugguggcguaaaua

SEQ ID NO: 1751136 - RNA, 20 nt, Salmonella enterica enterica serovar Typhi Ty2
gcggauuccaguagcgcgcc

SEQ ID NO: 1751137 - RNA, 19 nt, Salmonella enterica enterica serovar Typhi Ty2
gcggauuccaguagcgcgc

SEQ ID NO: 1751138 - RNA, 21 nt, Salmonella enterica enterica serovar Typhi Ty2
gcggaugcgccauccaccagg

SEQ ID NO: 1751139 - RNA, 21 nt, Salmonella enterica enterica serovar Typhi Ty2
gcggcacacaacacggcggcu

SEQ ID NO: 1751140 - RNA, 23 nt, Salmonella enterica enterica serovar Typhi Ty2
gcggcaaugagcggccagcgggc

SEQ ID NO: 1751141 - RNA, 14 nt, Salmonella enterica enterica serovar Typhi Ty2
gcggcaauggccgc

SEQ ID NO: 1751142 - RNA, 13 nt, Salmonella enterica enterica serovar Typhi Ty2
gcggauugccgcg

SEQ ID NO: 1751143 - RNA, 17 nt, Salmonella enterica enterica serovar Typhi Ty2
gcggauugauuuuucug

SEQ ID NO: 1751144 - RNA, 13 nt, Salmonella enterica enterica serovar Typhi Ty2
gcggcaaaagagg

SEQ ID NO: 1751145 - RNA, 19 nt, Salmonella enterica enterica serovar Typhi Ty2
gcggcaaaaucuuuuucgc

SEQ ID NO: 1751146 - RNA, 16 nt, Salmonella enterica enterica serovar Typhi Ty2
gcggcaaaauugauuc

SEQ ID NO: 1751147 - RNA, 14 nt, Salmonella enterica enterica serovar Typhi Ty2
gcgcuuccagcaug

SEQ ID NO: 1751148 - RNA, 17 nt, Salmonella enterica enterica serovar Typhi Ty2
gcgcuuccugcagugga

SEQ ID NO: 1751149 - RNA, 16 nt, Salmonella enterica enterica serovar Typhi Ty2
gcgcuuccugcagugg

SEQ ID NO: 1751150 - RNA, 13 nt, Salmonella enterica enterica serovar Typhi Ty2
gcgcuucgccugc

SEQ ID NO: 1751151 - RNA, 15 nt, Salmonella enterica enterica serovar Typhi Ty2
gcgcuucgccugccg

SEQ ID NO: 1751152 - RNA, 17 nt, Salmonella enterica enterica serovar Typhi Ty2
gcgcugggccgggccug

SEQ ID NO: 1751153 - RNA, 19 nt, Salmonella enterica enterica serovar Typhi Ty2
gcgcuggcugaaucccugu

SEQ ID NO: 1751154 - RNA, 16 nt, Salmonella enterica enterica serovar Typhi Ty2
gcgcuuguaaauugcg

SEQ ID NO: 1751155 - RNA, 13 nt, Salmonella enterica enterica serovar Typhi Ty2
gcgcuugcggccg

SEQ ID NO: 1751156 - RNA, 16 nt, Salmonella enterica enterica serovar Typhi Ty2
gcgcuucgccugccgg

SEQ ID NO: 1751157 - RNA, 22 nt, Salmonella enterica enterica serovar Typhi Ty2
gcgcuugcauggcagccccggc

SEQ ID NO: 1751158 - RNA, 13 nt, Salmonella enterica enterica serovar Typhi Ty2
gcggaaccauuuu

SEQ ID NO: 1751159 - RNA, 14 nt, Salmonella enterica enterica serovar Typhi Ty2
gcggaaaaaagcag

SEQ ID NO: 1751160 - RNA, 18 nt, Salmonella enterica enterica serovar Typhi Ty2
gcggaacggcgagcuuua

SEQ ID NO: 1751161 - RNA, 23 nt, Salmonella enterica enterica serovar Typhi Ty2
gcggaagaggcgccuggcaccau

SEQ ID NO: 1751162 - RNA, 21 nt, Salmonella enterica enterica serovar Typhi Ty2
gcggaagccacguucuuccag

SEQ ID NO: 1751163 - RNA, 15 nt, Salmonella enterica enterica serovar Typhi Ty2
gcggaaguagagaac

SEQ ID NO: 1751164 - RNA, 12 nt, Salmonella enterica enterica serovar Typhi Ty2
gcgcuuuuucac

SEQ ID NO: 1751165 - RNA, 17 nt, Salmonella enterica enterica serovar Typhi Ty2
gcgcuuuugccgcgccc

SEQ ID NO: 1751166 - RNA, 12 nt, Salmonella enterica enterica serovar Typhi Ty2
gcgcuuuguuuc

SEQ ID NO: 1751167 - RNA, 16 nt, Salmonella enterica enterica serovar Typhi Ty2
gcgcuuuuccagcacg

SEQ ID NO: 1751168 - RNA, 15 nt, Salmonella enterica enterica serovar Typhi Ty2
gcgcuuucuucuuca

SEQ ID NO: 1751169 - RNA, 18 nt, Salmonella enterica enterica serovar Typhi Ty2
gcgcuuugccgcugcugc

SEQ ID NO: 1751170 - RNA, 21 nt, Salmonella enterica enterica serovar Typhi Ty2
gcggaaaggacguucuucucc

SEQ ID NO: 1751171 - RNA, 24 nt, Salmonella enterica enterica serovar Typhi Ty2
gcgcuuuuggcggccagcguguca

SEQ ID NO: 1751172 - RNA, 13 nt, Salmonella enterica enterica serovar Typhi Ty2
gcggaacaccagc

SEQ ID NO: 1751173 - RNA, 18 nt, Salmonella enterica enterica serovar Typhi Ty2
gcgcugaauagcgaccuu

SEQ ID NO: 1751174 - RNA, 14 nt, Salmonella enterica enterica serovar Typhi Ty2
gcgcucuuuuuuaa

SEQ ID NO: 1751175 - RNA, 17 nt, Salmonella enterica enterica serovar Typhi Ty2
gcgcugaggcgcuggcu

SEQ ID NO: 1751176 - RNA, 14 nt, Salmonella enterica enterica serovar Typhi Ty2
gcgcugaucgccac

SEQ ID NO: 1751177 - RNA, 15 nt, Salmonella enterica enterica serovar Typhi Ty2
gcgcugagucauccu

SEQ ID NO: 1751178 - RNA, 13 nt, Salmonella enterica enterica serovar Typhi Ty2
gcgcuggcggcga

SEQ ID NO: 1751179 - RNA, 20 nt, Salmonella enterica enterica serovar Typhi Ty2
gcgcuggcgccgcaaaccag

SEQ ID NO: 1751180 - RNA, 19 nt, Salmonella enterica enterica serovar Typhi Ty2
gcgcuggcaagcgccagca

SEQ ID NO: 1751181 - RNA, 21 nt, Salmonella enterica enterica serovar Typhi Ty2
gcgcucuuuuucuuuucuccg

SEQ ID NO: 1751182 - RNA, 16 nt, Salmonella enterica enterica serovar Typhi Ty2
gcgcucuuccgccagc

SEQ ID NO: 1751183 - RNA, 23 nt, Salmonella enterica enterica serovar Typhi Ty2
gcgcucgcuuuuacucuuccugc

SEQ ID NO: 1751184 - RNA, 15 nt, Salmonella enterica enterica serovar Typhi Ty2
gcgcgucagcgccuc

SEQ ID NO: 1751185 - RNA, 19 nt, Salmonella enterica enterica serovar Typhi Ty2
gcgcguccagccagcguuu

SEQ ID NO: 1751186 - RNA, 12 nt, Salmonella enterica enterica serovar Typhi Ty2
gcgcguccagac

SEQ ID NO: 1751187 - RNA, 21 nt, Salmonella enterica enterica serovar Typhi Ty2
gcgcguaaauccuccaucaug

SEQ ID NO: 1751188 - RNA, 21 nt, Salmonella enterica enterica serovar Typhi Ty2
gcgcgguggcuuuuuccugcc

SEQ ID NO: 1751189 - RNA, 17 nt, Salmonella enterica enterica serovar Typhi Ty2
gcgcgccuuccagcaau

SEQ ID NO: 1751190 - RNA, 22 nt, Salmonella enterica enterica serovar Typhi Ty2
gcgcgcggaacuuuaucaccag

SEQ ID NO: 1751191 - RNA, 21 nt, Salmonella enterica enterica serovar Typhi Ty2
gcgcgcggauauggcggcggc

SEQ ID NO: 1751192 - RNA, 14 nt, Salmonella enterica enterica serovar Typhi Ty2
gcgcgcgcaaagcg

SEQ ID NO: 1751193 - RNA, 16 nt, Salmonella enterica enterica serovar Typhi Ty2
gcgcgcccugcgggcc

SEQ ID NO: 1751194 - RNA, 20 nt, Salmonella enterica enterica serovar Typhi Ty2
gcgcgccggugaucccacca

SEQ ID NO: 1751195 - RNA, 15 nt, Salmonella enterica enterica serovar Typhi Ty2
gcgcgcccgacgcgc

SEQ ID NO: 1751196 - RNA, 18 nt, Salmonella enterica enterica serovar Typhi Ty2
gcgcgcccgccaccagca

SEQ ID NO: 1751197 - RNA, 16 nt, Salmonella enterica enterica serovar Typhi Ty2
gcgcgaucuguuggug

SEQ ID NO: 1751198 - RNA, 20 nt, Salmonella enterica enterica serovar Typhi Ty2
gcgcgaucucuuuggccagu

SEQ ID NO: 1751199 - RNA, 19 nt, Salmonella enterica enterica serovar Typhi Ty2
gcgccuuuaauuccgccgg

SEQ ID NO: 1751200 - RNA, 18 nt, Salmonella enterica enterica serovar Typhi Ty2
gcgccuuuuggcagcagc

SEQ ID NO: 1751201 - RNA, 19 nt, Salmonella enterica enterica serovar Typhi Ty2
gcgcgcagaccacgaauca

SEQ ID NO: 1751202 - RNA, 21 nt, Salmonella enterica enterica serovar Typhi Ty2
gcgcggccucauggcggugcu

SEQ ID NO: 1751203 - RNA, 14 nt, Salmonella enterica enterica serovar Typhi Ty2
gcgcggcguucugc

SEQ ID NO: 1751204 - RNA, 19 nt, Salmonella enterica enterica serovar Typhi Ty2
gcgccugaauguacgcaua

SEQ ID NO: 1751205 - RNA, 17 nt, Salmonella enterica enterica serovar Typhi Ty2
gcgccugaugccgccgu

SEQ ID NO: 1751206 - RNA, 16 nt, Salmonella enterica enterica serovar Typhi Ty2
gcgccugacgcggacg

SEQ ID NO: 1751207 - RNA, 14 nt, Salmonella enterica enterica serovar Typhi Ty2
gcgccucgcgcggc

SEQ ID NO: 1751208 - RNA, 23 nt, Salmonella enterica enterica serovar Typhi Ty2
gcgccuccgcguagcccagcgcc

SEQ ID NO: 1751209 - RNA, 17 nt, Salmonella enterica enterica serovar Typhi Ty2
gcgccuccccugccggc

SEQ ID NO: 1751210 - RNA, 19 nt, Salmonella enterica enterica serovar Typhi Ty2
gcgccggguuuggcgggcu

SEQ ID NO: 1751211 - RNA, 14 nt, Salmonella enterica enterica serovar Typhi Ty2
gcgccggggugcug

SEQ ID NO: 1751212 - RNA, 13 nt, Salmonella enterica enterica serovar Typhi Ty2
gcgccuuccagca

SEQ ID NO: 1751213 - RNA, 23 nt, Salmonella enterica enterica serovar Typhi Ty2
gcgccuguuagggcgcggcuggu

SEQ ID NO: 1751214 - RNA, 23 nt, Salmonella enterica enterica serovar Typhi Ty2
gcgccuguaaggcucucuuacca

SEQ ID NO: 1751215 - RNA, 14 nt, Salmonella enterica enterica serovar Typhi Ty2
gcgccugcucccgc

SEQ ID NO: 1751216 - RNA, 16 nt, Salmonella enterica enterica serovar Typhi Ty2
gcgccugcucagcauu

SEQ ID NO: 1751217 - RNA, 18 nt, Salmonella enterica enterica serovar Typhi Ty2
gcgccugcugccagccgc

SEQ ID NO: 1751218 - RNA, 14 nt, Salmonella enterica enterica serovar Typhi Ty2
gcgccugcugccug

SEQ ID NO: 1751219 - RNA, 21 nt, Salmonella enterica enterica serovar Typhi Ty2
gcgccgccucgcgauccgcca

SEQ ID NO: 1751220 - RNA, 13 nt, Salmonella enterica enterica serovar Typhi Ty2
gcgcccaggccaa

SEQ ID NO: 1751221 - RNA, 12 nt, Salmonella enterica enterica serovar Typhi Ty2
gcgcccagcgcc

SEQ ID NO: 1751222 - RNA, 23 nt, Salmonella enterica enterica serovar Typhi Ty2
gcgccggcugcgcugccagcugc

SEQ ID NO: 1751223 - RNA, 13 nt, Salmonella enterica enterica serovar Typhi Ty2
gcgccggggcagc

SEQ ID NO: 1751224 - RNA, 15 nt, Salmonella enterica enterica serovar Typhi Ty2
gcgccgcuuccggca

SEQ ID NO: 1751225 - RNA, 14 nt, Salmonella enterica enterica serovar Typhi Ty2
gcgccgcuccaggg

SEQ ID NO: 1751226 - RNA, 23 nt, Salmonella enterica enterica serovar Typhi Ty2
gcgccgcuggcgaccagccugcc

SEQ ID NO: 1751227 - RNA, 23 nt, Salmonella enterica enterica serovar Typhi Ty2
gcgggcugccccagacgcccuuc

SEQ ID NO: 1751228 - RNA, 23 nt, Salmonella enterica enterica serovar Typhi Ty2
gcgggcguugcugcacgucgcgc

SEQ ID NO: 1751229 - RNA, 13 nt, Salmonella enterica enterica serovar Typhi Ty2
gcgggccgucagg

SEQ ID NO: 1751230 - RNA, 14 nt, Salmonella enterica enterica serovar Typhi Ty2
gcgggacugcugcu

SEQ ID NO: 1751231 - RNA, 13 nt, Salmonella enterica enterica serovar Typhi Ty2
gcggugaaagaga

SEQ ID NO: 1751232 - RNA, 20 nt, Salmonella enterica enterica serovar Typhi Ty2
gcggugaaaggcuugcagga

SEQ ID NO: 1751233 - RNA, 13 nt, Salmonella enterica enterica serovar Typhi Ty2
gcgguaucaaugc

SEQ ID NO: 1751234 - RNA, 14 nt, Salmonella enterica enterica serovar Typhi Ty2
gcgggugaugacgc

SEQ ID NO: 1751235 - RNA, 19 nt, Salmonella enterica enterica serovar Typhi Ty2
gcgggugcgcagccccagc

SEQ ID NO: 1751236 - RNA, 16 nt, Salmonella enterica enterica serovar Typhi Ty2
gcgguaaggcaccggu

SEQ ID NO: 1751237 - RNA, 20 nt, Salmonella enterica enterica serovar Typhi Ty2
gcgguagaaaguacaucauu

SEQ ID NO: 1751238 - RNA, 21 nt, Salmonella enterica enterica serovar Typhi Ty2
gcggcuauugucugauggcgc

SEQ ID NO: 1751239 - RNA, 15 nt, Salmonella enterica enterica serovar Typhi Ty2
gcggcucaccagcug

SEQ ID NO: 1751240 - RNA, 23 nt, Salmonella enterica enterica serovar Typhi Ty2
gcggcucaccagcugacgcagca

SEQ ID NO: 1751241 - RNA, 19 nt, Salmonella enterica enterica serovar Typhi Ty2
gcggcuuuaaugccgccgu

SEQ ID NO: 1751242 - RNA, 22 nt, Salmonella enterica enterica serovar Typhi Ty2
gcggcuugucauccugcucauc

SEQ ID NO: 1751243 - RNA, 13 nt, Salmonella enterica enterica serovar Typhi Ty2
gcggcuuuuucau

SEQ ID NO: 1751244 - RNA, 20 nt, Salmonella enterica enterica serovar Typhi Ty2
gcggcguaucauagcggcua

SEQ ID NO: 1751245 - RNA, 16 nt, Salmonella enterica enterica serovar Typhi Ty2
gcggcguguggcugug

SEQ ID NO: 1751246 - RNA, 20 nt, Salmonella enterica enterica serovar Typhi Ty2
gcggcguggaaccgccggag

SEQ ID NO: 1751247 - RNA, 19 nt, Salmonella enterica enterica serovar Typhi Ty2
gcggcuacgccugauaagc

SEQ ID NO: 1751248 - RNA, 17 nt, Salmonella enterica enterica serovar Typhi Ty2
gcggcgcaaaucgccau

SEQ ID NO: 1751249 - RNA, 16 nt, Salmonella enterica enterica serovar Typhi Ty2
gcggcgccaucaccau

SEQ ID NO: 1751250 - RNA, 15 nt, Salmonella enterica enterica serovar Typhi Ty2
gcggcgguucauccu

SEQ ID NO: 1751251 - RNA, 19 nt, Salmonella enterica enterica serovar Typhi Ty2
gcggcguacacuucauccg

SEQ ID NO: 1751252 - RNA, 17 nt, Salmonella enterica enterica serovar Typhi Ty2
gcggcguaccgcgcgcc

SEQ ID NO: 1751253 - RNA, 18 nt, Salmonella enterica enterica serovar Typhi Ty2
gcggcguaccgcgcgccc

SEQ ID NO: 1751254 - RNA, 18 nt, Salmonella enterica enterica serovar Typhi Ty2
gcggcggucugcgccugc

SEQ ID NO: 1751255 - RNA, 15 nt, Salmonella enterica enterica serovar Typhi Ty2
gcgucagcgugcggu

SEQ ID NO: 1751256 - RNA, 12 nt, Salmonella enterica enterica serovar Typhi Ty2
gcgucaggcgau

SEQ ID NO: 1751257 - RNA, 15 nt, Salmonella enterica enterica serovar Typhi Ty2
gcgucauccugcagg

SEQ ID NO: 1751258 - RNA, 14 nt, Salmonella enterica enterica serovar Typhi Ty2
gcgucaucgcucca

SEQ ID NO: 1751259 - RNA, 15 nt, Salmonella enterica enterica serovar Typhi Ty2
gcgucauccaguguu

SEQ ID NO: 1751260 - RNA, 16 nt, Salmonella enterica enterica serovar Typhi Ty2
gcgucaggcuguuguu

SEQ ID NO: 1751261 - RNA, 19 nt, Salmonella enterica enterica serovar Typhi Ty2
gcgucaggcuguuguucuu

SEQ ID NO: 1751262 - RNA, 17 nt, Salmonella enterica enterica serovar Typhi Ty2
gcgucagccagaacgaa

SEQ ID NO: 1751263 - RNA, 16 nt, Salmonella enterica enterica serovar Typhi Ty2
gcgucagcccaagcug

SEQ ID NO: 1751264 - RNA, 14 nt, Salmonella enterica enterica serovar Typhi Ty2
gcgucagcccuucu

SEQ ID NO: 1751265 - RNA, 14 nt, Salmonella enterica enterica serovar Typhi Ty2
gcgucacccgccgg

SEQ ID NO: 1751266 - RNA, 18 nt, Salmonella enterica enterica serovar Typhi Ty2
gcgucacccgccggcagc

SEQ ID NO: 1751267 - RNA, 19 nt, Salmonella enterica enterica serovar Typhi Ty2
gcgucacgcgcaaagcugc

SEQ ID NO: 1751268 - RNA, 17 nt, Salmonella enterica enterica serovar Typhi Ty2
gcgucacaaaaacaccc

SEQ ID NO: 1751269 - RNA, 13 nt, Salmonella enterica enterica serovar Typhi Ty2
gcgucaauauuaa

SEQ ID NO: 1751270 - RNA, 15 nt, Salmonella enterica enterica serovar Typhi Ty2
gcgucaacguccagu

SEQ ID NO: 1751271 - RNA, 17 nt, Salmonella enterica enterica serovar Typhi Ty2
gcgucaacucagcaaua

SEQ ID NO: 1751272 - RNA, 20 nt, Salmonella enterica enterica serovar Typhi Ty2
gcggugaucccaggccggca

SEQ ID NO: 1751273 - RNA, 16 nt, Salmonella enterica enterica serovar Typhi Ty2
gcguagccaacacaua

SEQ ID NO: 1751274 - RNA, 22 nt, Salmonella enterica enterica serovar Typhi Ty2
gcggugcaugaauaucaaacca

SEQ ID NO: 1751275 - RNA, 21 nt, Salmonella enterica enterica serovar Typhi Ty2
gcguagcuggccuucuccacu

SEQ ID NO: 1751276 - RNA, 17 nt, Salmonella enterica enterica serovar Typhi Ty2
gcguagcucgcccagca

SEQ ID NO: 1751277 - RNA, 19 nt, Salmonella enterica enterica serovar Typhi Ty2
gcguagcguguauuccagu

SEQ ID NO: 1751278 - RNA, 14 nt, Salmonella enterica enterica serovar Typhi Ty2
gcguagcccagcgc

SEQ ID NO: 1751279 - RNA, 24 nt, Salmonella enterica enterica serovar Typhi Ty2
gcguaggguagaucacgccagcgc

SEQ ID NO: 1751280 - RNA, 14 nt, Salmonella enterica enterica serovar Typhi Ty2
gcguauugagcgca

SEQ ID NO: 1751281 - RNA, 13 nt, Salmonella enterica enterica serovar Typhi Ty2
gcgucaaaacagg

SEQ ID NO: 1751282 - RNA, 19 nt, Salmonella enterica enterica serovar Typhi Ty2
gcgucgccauaaagcugua

SEQ ID NO: 1751283 - RNA, 21 nt, Salmonella enterica enterica serovar Typhi Ty2
gcgucgccaaagcagcugcug

SEQ ID NO: 1751284 - RNA, 19 nt, Salmonella enterica enterica serovar Typhi Ty2
gcgucgccccaaucgccag

SEQ ID NO: 1751285 - RNA, 15 nt, Salmonella enterica enterica serovar Typhi Ty2
gcguccuucuuccgc

SEQ ID NO: 1751286 - RNA, 11 nt, Salmonella enterica enterica serovar Typhi Ty2
gcguccgccgc

SEQ ID NO: 1751287 - RNA, 19 nt, Salmonella enterica enterica serovar Typhi Ty2
gcgucaucggcgcgcuggc

SEQ ID NO: 1751288 - RNA, 22 nt, Salmonella enterica enterica serovar Typhi Ty2
gcgucaucggcgccagccuguu

SEQ ID NO: 1751289 - RNA, 14 nt, Salmonella enterica enterica serovar Typhi Ty2
gcguccagaugcaa

SEQ ID NO: 1751290 - RNA, 20 nt, Salmonella enterica enterica serovar Typhi Ty2
gcguccagcccguccagaua

SEQ ID NO: 1751291 - RNA, 23 nt, Salmonella enterica enterica serovar Typhi Ty2
gcguucauggcgcgacauggcga

SEQ ID NO: 1751292 - RNA, 21 nt, Salmonella enterica enterica serovar Typhi Ty2
gcguucacaccgccgccagcc

SEQ ID NO: 1751293 - RNA, 17 nt, Salmonella enterica enterica serovar Typhi Ty2
gcguugcgcccaggcca

SEQ ID NO: 1751294 - RNA, 19 nt, Salmonella enterica enterica serovar Typhi Ty2
gcguugcgccgccaggcau

SEQ ID NO: 1751295 - RNA, 16 nt, Salmonella enterica enterica serovar Typhi Ty2
gcguugccuggccucc

SEQ ID NO: 1751296 - RNA, 12 nt, Salmonella enterica enterica serovar Typhi Ty2
gcguuggcggcu

SEQ ID NO: 1751297 - RNA, 21 nt, Salmonella enterica enterica serovar Typhi Ty2
gcguuguaauaaugucggaug

SEQ ID NO: 1751298 - RNA, 17 nt, Salmonella enterica enterica serovar Typhi Ty2
gcguuguaaucgccuga

SEQ ID NO: 1751299 - RNA, 16 nt, Salmonella enterica enterica serovar Typhi Ty2
gcguugggcgugacgg

SEQ ID NO: 1751300 - RNA, 14 nt, Salmonella enterica enterica serovar Typhi Ty2
gcguuggcgggcug

SEQ ID NO: 1751301 - RNA, 22 nt, Salmonella enterica enterica serovar Typhi Ty2
gcguuaacccgcuuacaauuua

SEQ ID NO: 1751302 - RNA, 17 nt, Salmonella enterica enterica serovar Typhi Ty2
gcguguuuguaaaaaua

SEQ ID NO: 1751303 - RNA, 20 nt, Salmonella enterica enterica serovar Typhi Ty2
gcguguuucaucucaucaau

SEQ ID NO: 1751304 - RNA, 13 nt, Salmonella enterica enterica serovar Typhi Ty2
gcguguggugagg

SEQ ID NO: 1751305 - RNA, 16 nt, Salmonella enterica enterica serovar Typhi Ty2
gcgugucgcccggcgg

SEQ ID NO: 1751306 - RNA, 15 nt, Salmonella enterica enterica serovar Typhi Ty2
gcguggcauuaacaa

SEQ ID NO: 1751307 - RNA, 13 nt, Salmonella enterica enterica serovar Typhi Ty2
gcgugacccagac

SEQ ID NO: 1751308 - RNA, 17 nt, Salmonella enterica enterica serovar Typhi Ty2
gcgucucagcaggcggc

SEQ ID NO: 1751309 - RNA, 17 nt, Salmonella enterica enterica serovar Typhi Ty2
gcgucucaucaaaaagg

SEQ ID NO: 1751310 - RNA, 21 nt, Salmonella enterica enterica serovar Typhi Ty2
gcgucucagauggaaaaaaag

SEQ ID NO: 1751311 - RNA, 17 nt, Salmonella enterica enterica serovar Typhi Ty2
gcgucguuccgucagug

SEQ ID NO: 1751312 - RNA, 18 nt, Salmonella enterica enterica serovar Typhi Ty2
gcgucguucacgucgcga

SEQ ID NO: 1751313 - RNA, 15 nt, Salmonella enterica enterica serovar Typhi Ty2
gcgucgugcugggcg

SEQ ID NO: 1751314 - RNA, 20 nt, Salmonella enterica enterica serovar Typhi Ty2
gcgucguuggcauggucagc

SEQ ID NO: 1751315 - RNA, 15 nt, Salmonella enterica enterica serovar Typhi Ty2
gcgugccgggcuggc

SEQ ID NO: 1751316 - RNA, 12 nt, Salmonella enterica enterica serovar Typhi Ty2
gcgugccgagca

SEQ ID NO: 1751317 - RNA, 21 nt, Salmonella enterica enterica serovar Typhi Ty2
gcgugaugcgauccagcgggc

SEQ ID NO: 1751318 - RNA, 17 nt, Salmonella enterica enterica serovar Typhi Ty2
gcgugauaauuccccca

SEQ ID NO: 1751319 - RNA, 18 nt, Salmonella enterica enterica serovar Typhi Ty2
gcgugauaaaggccggca

SEQ ID NO: 1751320 - RNA, 17 nt, Salmonella enterica enterica serovar Typhi Ty2
gcgugagccacuaucca

SEQ ID NO: 1751321 - RNA, 14 nt, Salmonella enterica enterica serovar Typhi Ty2
gcgucgggccgcgc

SEQ ID NO: 1751322 - RNA, 17 nt, Salmonella enterica enterica serovar Typhi Ty2
gcgucgcguaccagcgc

SEQ ID NO: 1751323 - RNA, 18 nt, Salmonella enterica enterica serovar Typhi Ty2
gcgucgcggcaauagcga

SEQ ID NO: 1751324 - RNA, 16 nt, Salmonella enterica enterica serovar Typhi Ty2
gcgucgcuucguucug

SEQ ID NO: 1751325 - RNA, 17 nt, Salmonella enterica enterica serovar Typhi Ty2
gcgucggacauuuuguu

SEQ ID NO: 1751326 - RNA, 17 nt, Salmonella enterica enterica serovar Typhi Ty2
gcgucggcaccauuccc

SEQ ID NO: 1751327 - RNA, 20 nt, Salmonella enterica enterica serovar Typhi Ty2
gcucuucaauuuccaucugu

SEQ ID NO: 1751328 - RNA, 19 nt, Salmonella enterica enterica serovar Typhi Ty2
gcucuucuccgccugcggu

SEQ ID NO: 1751329 - RNA, 13 nt, Salmonella enterica enterica serovar Typhi Ty2
gcucuuucaacug

SEQ ID NO: 1751330 - RNA, 17 nt, Salmonella enterica enterica serovar Typhi Ty2
gcucuuucaacuuccgc

SEQ ID NO: 1751331 - RNA, 18 nt, Salmonella enterica enterica serovar Typhi Ty2
gcucuucaauuuccaucu

SEQ ID NO: 1751332 - RNA, 23 nt, Salmonella enterica enterica serovar Typhi Ty2
gcucguuuuuguuuaaaaaccag

SEQ ID NO: 1751333 - RNA, 19 nt, Salmonella enterica enterica serovar Typhi Ty2
gcucguaaagcaucagacu

SEQ ID NO: 1751334 - RNA, 20 nt, Salmonella enterica enterica serovar Typhi Ty2
gcucucucaaacuauuuuua

SEQ ID NO: 1751335 - RNA, 19 nt, Salmonella enterica enterica serovar Typhi Ty2
gcucucuuucaccagcgcc

SEQ ID NO: 1751336 - RNA, 19 nt, Salmonella enterica enterica serovar Typhi Ty2
gcucuccuggcauggcucg

SEQ ID NO: 1751337 - RNA, 16 nt, Salmonella enterica enterica serovar Typhi Ty2
gcucuccuggcauggc

SEQ ID NO: 1751338 - RNA, 22 nt, Salmonella enterica enterica serovar Typhi Ty2
gcucuccggcacauucaccacg

SEQ ID NO: 1751339 - RNA, 11 nt, Salmonella enterica enterica serovar Typhi Ty2
gcugaaccacc

SEQ ID NO: 1751340 - RNA, 19 nt, Salmonella enterica enterica serovar Typhi Ty2
gcugaauaaugccuuccug

SEQ ID NO: 1751341 - RNA, 15 nt, Salmonella enterica enterica serovar Typhi Ty2
gcugaagugcggaua

SEQ ID NO: 1751342 - RNA, 16 nt, Salmonella enterica enterica serovar Typhi Ty2
gcugacaaucugcugg

SEQ ID NO: 1751343 - RNA, 16 nt, Salmonella enterica enterica serovar Typhi Ty2
gcugacaaucagcaca

SEQ ID NO: 1751344 - RNA, 17 nt, Salmonella enterica enterica serovar Typhi Ty2
gcugacacucauccaga

SEQ ID NO: 1751345 - RNA, 22 nt, Salmonella enterica enterica serovar Typhi Ty2
gcugacaggauacccggcucgc

SEQ ID NO: 1751346 - RNA, 17 nt, Salmonella enterica enterica serovar Typhi Ty2
gcugacgacgccagccc

SEQ ID NO: 1751347 - RNA, 14 nt, Salmonella enterica enterica serovar Typhi Ty2
gcugacgaccccag

SEQ ID NO: 1751348 - RNA, 22 nt, Salmonella enterica enterica serovar Typhi Ty2
gcugacgauacucagccccagg

SEQ ID NO: 1751349 - RNA, 16 nt, Salmonella enterica enterica serovar Typhi Ty2
gcugacgcccaucagc

SEQ ID NO: 1751350 - RNA, 16 nt, Salmonella enterica enterica serovar Typhi Ty2
gcugacgacauucagc

SEQ ID NO: 1751351 - RNA, 15 nt, Salmonella enterica enterica serovar Typhi Ty2
gcugacgacauucag

SEQ ID NO: 1751352 - RNA, 20 nt, Salmonella enterica enterica serovar Typhi Ty2
gcugaccgcuuucccggcau

SEQ ID NO: 1751353 - RNA, 22 nt, Salmonella enterica enterica serovar Typhi Ty2
gcugaguuucucccgccagaug

SEQ ID NO: 1751354 - RNA, 15 nt, Salmonella enterica enterica serovar Typhi Ty2
gcugauaggccugga

SEQ ID NO: 1751355 - RNA, 16 nt, Salmonella enterica enterica serovar Typhi Ty2
gcugauaggccuggau

SEQ ID NO: 1751356 - RNA, 21 nt, Salmonella enterica enterica serovar Typhi Ty2
gcugauaagcuaguaaagaaa

SEQ ID NO: 1751357 - RNA, 13 nt, Salmonella enterica enterica serovar Typhi Ty2
gcugaugcagcuu

SEQ ID NO: 1751358 - RNA, 18 nt, Salmonella enterica enterica serovar Typhi Ty2
gcugaugcagcuugcagg

SEQ ID NO: 1751359 - RNA, 13 nt, Salmonella enterica enterica serovar Typhi Ty2
gcugaugcagaua

SEQ ID NO: 1751360 - RNA, 12 nt, Salmonella enterica enterica serovar Typhi Ty2
gcugaugguuuc

SEQ ID NO: 1751361 - RNA, 18 nt, Salmonella enterica enterica serovar Typhi Ty2
gcugauguuugcgcucuu

SEQ ID NO: 1751362 - RNA, 16 nt, Salmonella enterica enterica serovar Typhi Ty2
gcugaugugcggccug

SEQ ID NO: 1751363 - RNA, 16 nt, Salmonella enterica enterica serovar Typhi Ty2
gcugauguccgcagcc

SEQ ID NO: 1751364 - RNA, 16 nt, Salmonella enterica enterica serovar Typhi Ty2
gcugagcuaaucaccc

SEQ ID NO: 1751365 - RNA, 17 nt, Salmonella enterica enterica serovar Typhi Ty2
gcugagcuaaucaccca

SEQ ID NO: 1751366 - RNA, 20 nt, Salmonella enterica enterica serovar Typhi Ty2
gcugagucauccuuccccca

SEQ ID NO: 1751367 - RNA, 13 nt, Salmonella enterica enterica serovar Typhi Ty2
gcugaggcgcugg

SEQ ID NO: 1751368 - RNA, 13 nt, Salmonella enterica enterica serovar Typhi Ty2
gcugaggccgcuc

SEQ ID NO: 1751369 - RNA, 12 nt, Salmonella enterica enterica serovar Typhi Ty2
gcugagaaaaau

SEQ ID NO: 1751370 - RNA, 21 nt, Salmonella enterica enterica serovar Typhi Ty2
gcugacguucgacccgcaaug

SEQ ID NO: 1751371 - RNA, 18 nt, Salmonella enterica enterica serovar Typhi Ty2
gcugacguuacgcggcgc

SEQ ID NO: 1751372 - RNA, 18 nt, Salmonella enterica enterica serovar Typhi Ty2
gcucccagaaucguggcu

SEQ ID NO: 1751373 - RNA, 16 nt, Salmonella enterica enterica serovar Typhi Ty2
gcuccagcuggcuggc

SEQ ID NO: 1751374 - RNA, 22 nt, Salmonella enterica enterica serovar Typhi Ty2
gcuccagggauugauggccagc

SEQ ID NO: 1751375 - RNA, 23 nt, Salmonella enterica enterica serovar Typhi Ty2
gcuccagggauugauggccagcc

SEQ ID NO: 1751376 - RNA, 20 nt, Salmonella enterica enterica serovar Typhi Ty2
gcuccaugcugucgucgaca

SEQ ID NO: 1751377 - RNA, 19 nt, Salmonella enterica enterica serovar Typhi Ty2
gcuccagacaggacgccag

SEQ ID NO: 1751378 - RNA, 20 nt, Salmonella enterica enterica serovar Typhi Ty2
gcuccagacaggacgccagc

SEQ ID NO: 1751379 - RNA, 13 nt, Salmonella enterica enterica serovar Typhi Ty2
gcucaucggcggc

SEQ ID NO: 1751380 - RNA, 15 nt, Salmonella enterica enterica serovar Typhi Ty2
gcucaugacaucgcc

SEQ ID NO: 1751381 - RNA, 21 nt, Salmonella enterica enterica serovar Typhi Ty2
gcucaugauagggcagcaguu

SEQ ID NO: 1751382 - RNA, 19 nt, Salmonella enterica enterica serovar Typhi Ty2
gcucaugugcagcauccag

SEQ ID NO: 1751383 - RNA, 23 nt, Salmonella enterica enterica serovar Typhi Ty2
gcucacgguuucaacuuccacca

SEQ ID NO: 1751384 - RNA, 16 nt, Salmonella enterica enterica serovar Typhi Ty2
gcucagcgcggcagcc

SEQ ID NO: 1751385 - RNA, 13 nt, Salmonella enterica enterica serovar Typhi Ty2
gcucagcggcggc

SEQ ID NO: 1751386 - RNA, 14 nt, Salmonella enterica enterica serovar Typhi Ty2
gcucagcggcggcg

SEQ ID NO: 1751387 - RNA, 17 nt, Salmonella enterica enterica serovar Typhi Ty2
gcuccugucaggcgagc

SEQ ID NO: 1751388 - RNA, 22 nt, Salmonella enterica enterica serovar Typhi Ty2
gcuccugcgguacggccagcgc

SEQ ID NO: 1751389 - RNA, 18 nt, Salmonella enterica enterica serovar Typhi Ty2
gcuccuugauugcaagaa

SEQ ID NO: 1751390 - RNA, 20 nt, Salmonella enterica enterica serovar Typhi Ty2
gcucgccgaccggcgcgccg

SEQ ID NO: 1751391 - RNA, 16 nt, Salmonella enterica enterica serovar Typhi Ty2
gcucgaguucuucacg

SEQ ID NO: 1751392 - RNA, 20 nt, Salmonella enterica enterica serovar Typhi Ty2
gcucccgcagccacucccga

SEQ ID NO: 1751393 - RNA, 22 nt, Salmonella enterica enterica serovar Typhi Ty2
gcucccgccagcgagaugaaaa

SEQ ID NO: 1751394 - RNA, 18 nt, Salmonella enterica enterica serovar Typhi Ty2
gcucccgcagccacuccc

SEQ ID NO: 1751395 - RNA, 13 nt, Salmonella enterica enterica serovar Typhi Ty2
gcuccugccagau

SEQ ID NO: 1751396 - RNA, 15 nt, Salmonella enterica enterica serovar Typhi Ty2
gcuccugccagauuu

SEQ ID NO: 1751397 - RNA, 16 nt, Salmonella enterica enterica serovar Typhi Ty2
gcuccugcgccggacg

SEQ ID NO: 1751398 - RNA, 23 nt, Salmonella enterica enterica serovar Typhi Ty2
gcuccggcgcuggcgcuggcugc

SEQ ID NO: 1751399 - RNA, 23 nt, Salmonella enterica enterica serovar Typhi Ty2
gcucaaccaugauaaccagcccc

SEQ ID NO: 1751400 - RNA, 15 nt, Salmonella enterica enterica serovar Typhi Ty2
gcucaaccgcgcggc

SEQ ID NO: 1751401 - RNA, 21 nt, Salmonella enterica enterica serovar Typhi Ty2
gcucaaccgcgcggcguucug

SEQ ID NO: 1751402 - RNA, 14 nt, Salmonella enterica enterica serovar Typhi Ty2
gcucaacuggauga

SEQ ID NO: 1751403 - RNA, 12 nt, Salmonella enterica enterica serovar Typhi Ty2
gcucaaauauga

SEQ ID NO: 1751404 - RNA, 17 nt, Salmonella enterica enterica serovar Typhi Ty2
gcucaaaguuaccggca

SEQ ID NO: 1751405 - RNA, 20 nt, Salmonella enterica enterica serovar Typhi Ty2
gcucaaauaugauaugugua

SEQ ID NO: 1751406 - RNA, 15 nt, Salmonella enterica enterica serovar Typhi Ty2
gcucacggcacgccc

SEQ ID NO: 1751407 - RNA, 18 nt, Salmonella enterica enterica serovar Typhi Ty2
gcucaagaguaggccgga

SEQ ID NO: 1751408 - RNA, 16 nt, Salmonella enterica enterica serovar Typhi Ty2
gcucaagcgccgcgau

SEQ ID NO: 1751409 - RNA, 23 nt, Salmonella enterica enterica serovar Typhi Ty2
gcuauuaccggcuggaagcccaa

SEQ ID NO: 1751410 - RNA, 22 nt, Salmonella enterica enterica serovar Typhi Ty2
gcuauuaaucugugagcacagg

SEQ ID NO: 1751411 - RNA, 14 nt, Salmonella enterica enterica serovar Typhi Ty2
gcuaugccggagga

SEQ ID NO: 1751412 - RNA, 22 nt, Salmonella enterica enterica serovar Typhi Ty2
gcuaugccggaggauauuuauu

SEQ ID NO: 1751413 - RNA, 14 nt, Salmonella enterica enterica serovar Typhi Ty2
gcuaugcuuaccau

SEQ ID NO: 1751414 - RNA, 16 nt, Salmonella enterica enterica serovar Typhi Ty2
gcuauggcaacaaagc

SEQ ID NO: 1751415 - RNA, 22 nt, Salmonella enterica enterica serovar Typhi Ty2
gcuauucauuauuuuuaaauaa

SEQ ID NO: 1751416 - RNA, 20 nt, Salmonella enterica enterica serovar Typhi Ty2
gcuauuccaaaauaauaaaa

SEQ ID NO: 1751417 - RNA, 12 nt, Salmonella enterica enterica serovar Typhi Ty2
gcuauuuaaccc

SEQ ID NO: 1751418 - RNA, 18 nt, Salmonella enterica enterica serovar Typhi Ty2
gcuauuuaacccugguuu

SEQ ID NO: 1751419 - RNA, 15 nt, Salmonella enterica enterica serovar Typhi Ty2
gcucaaaaaagagua

SEQ ID NO: 1751420 - RNA, 22 nt, Salmonella enterica enterica serovar Typhi Ty2
gcuauaugauagaaguuaugca

SEQ ID NO: 1751421 - RNA, 14 nt, Salmonella enterica enterica serovar Typhi Ty2
gcuauauugcugcg

SEQ ID NO: 1751422 - RNA, 20 nt, Salmonella enterica enterica serovar Typhi Ty2
gcuaucaagauaaaaagaca

SEQ ID NO: 1751423 - RNA, 23 nt, Salmonella enterica enterica serovar Typhi Ty2
gcuaucaacgccuccaggcuacc

SEQ ID NO: 1751424 - RNA, 20 nt, Salmonella enterica enterica serovar Typhi Ty2
gcuaucaauaccgcuaauac

SEQ ID NO: 1751425 - RNA, 16 nt, Salmonella enterica enterica serovar Typhi Ty2
gcuaucaggcacugaa

SEQ ID NO: 1751426 - RNA, 20 nt, Salmonella enterica enterica serovar Typhi Ty2
gcuaucacacauaucgccag

SEQ ID NO: 1751427 - RNA, 14 nt, Salmonella enterica enterica serovar Typhi Ty2
gcuaucccaggcgg

SEQ ID NO: 1751428 - RNA, 19 nt, Salmonella enterica enterica serovar Typhi Ty2
gcuauccagcaguaaauaa

SEQ ID NO: 1751429 - RNA, 17 nt, Salmonella enterica enterica serovar Typhi Ty2
gcuauccagcaguaaau

SEQ ID NO: 1751430 - RNA, 20 nt, Salmonella enterica enterica serovar Typhi Ty2
gcuauccaucgccgcgccgu

SEQ ID NO: 1751431 - RNA, 12 nt, Salmonella enterica enterica serovar Typhi Ty2
gcuauccccauu

SEQ ID NO: 1751432 - RNA, 20 nt, Salmonella enterica enterica serovar Typhi Ty2
gcuaucccaggcggagaaau

SEQ ID NO: 1751433 - RNA, 16 nt, Salmonella enterica enterica serovar Typhi Ty2
gcuauccggcgcgcug

SEQ ID NO: 1751434 - RNA, 14 nt, Salmonella enterica enterica serovar Typhi Ty2
gcuauccgccgcca

SEQ ID NO: 1751435 - RNA, 19 nt, Salmonella enterica enterica serovar Typhi Ty2
gcuauccggcgcgcuggug

SEQ ID NO: 1751436 - RNA, 18 nt, Salmonella enterica enterica serovar Typhi Ty2
gcuaucuuuaugucagua

SEQ ID NO: 1751437 - RNA, 22 nt, Salmonella enterica enterica serovar Typhi Ty2
gcuaucugacagccaaacugcu

SEQ ID NO: 1751438 - RNA, 22 nt, Salmonella enterica enterica serovar Typhi Ty2
gcuaucucuuccagcgucucca

SEQ ID NO: 1751439 - RNA, 17 nt, Salmonella enterica enterica serovar Typhi Ty2
gcuaucgagaaugguuu

SEQ ID NO: 1751440 - RNA, 16 nt, Salmonella enterica enterica serovar Typhi Ty2
gcuauaccgcccgcgc

SEQ ID NO: 1751441 - RNA, 21 nt, Salmonella enterica enterica serovar Typhi Ty2
gcuauaccaggguucgcuggc

SEQ ID NO: 1751442 - RNA, 12 nt, Salmonella enterica enterica serovar Typhi Ty2
gcuauagcucag

SEQ ID NO: 1751443 - RNA, 22 nt, Salmonella enterica enterica serovar Typhi Ty2
gcuauagccgcguuugaguagc

SEQ ID NO: 1751444 - RNA, 13 nt, Salmonella enterica enterica serovar Typhi Ty2
gcuagcugcagcg

SEQ ID NO: 1751445 - RNA, 22 nt, Salmonella enterica enterica serovar Typhi Ty2
gcguuucacgcgcgccugccgc

SEQ ID NO: 1751446 - RNA, 19 nt, Salmonella enterica enterica serovar Typhi Ty2
gcguuuccacgcugacugc

SEQ ID NO: 1751447 - RNA, 23 nt, Salmonella enterica enterica serovar Typhi Ty2
gcccagauaaugccgcuggcgua

SEQ ID NO: 1751448 - RNA, 21 nt, Salmonella enterica enterica serovar Typhi Ty2
gcccagacaaagggcacaccg

SEQ ID NO: 1751449 - RNA, 21 nt, Salmonella enterica enterica serovar Typhi Ty2
gcccagcauauuaacagugag

SEQ ID NO: 1751450 - RNA, 16 nt, Salmonella enterica enterica serovar Typhi Ty2
gcccagccaaagcgcc

SEQ ID NO: 1751451 - RNA, 21 nt, Salmonella enterica enterica serovar Typhi Ty2
gcccagcgcgauacgcagcac

SEQ ID NO: 1751452 - RNA, 22 nt, Salmonella enterica enterica serovar Typhi Ty2
gcccaccggagcggcguccgcc

SEQ ID NO: 1751453 - RNA, 13 nt, Salmonella enterica enterica serovar Typhi Ty2
gcccacgcccaga

SEQ ID NO: 1751454 - RNA, 18 nt, Salmonella enterica enterica serovar Typhi Ty2
gcccaccugaaaaagggu

SEQ ID NO: 1751455 - RNA, 14 nt, Salmonella enterica enterica serovar Typhi Ty2
gcccagaacggcag

SEQ ID NO: 1751456 - RNA, 19 nt, Salmonella enterica enterica serovar Typhi Ty2
gcccacggaugaucuucau

SEQ ID NO: 1751457 - RNA, 19 nt, Salmonella enterica enterica serovar Typhi Ty2
gccauugcugucgacaaua

SEQ ID NO: 1751458 - RNA, 12 nt, Salmonella enterica enterica serovar Typhi Ty2
gccauugccgcg

SEQ ID NO: 1751459 - RNA, 20 nt, Salmonella enterica enterica serovar Typhi Ty2
gccauuucgccuauuuucuc

SEQ ID NO: 1751460 - RNA, 13 nt, Salmonella enterica enterica serovar Typhi Ty2
gccauuuuugcca

SEQ ID NO: 1751461 - RNA, 20 nt, Salmonella enterica enterica serovar Typhi Ty2
gcccaaauaaaagccgccgu

SEQ ID NO: 1751462 - RNA, 19 nt, Salmonella enterica enterica serovar Typhi Ty2
gcccaaauaguccagcagc

SEQ ID NO: 1751463 - RNA, 19 nt, Salmonella enterica enterica serovar Typhi Ty2
gcccaacagcaauguuuca

SEQ ID NO: 1751464 - RNA, 15 nt, Salmonella enterica enterica serovar Typhi Ty2
gcccaaugcccccau

SEQ ID NO: 1751465 - RNA, 19 nt, Salmonella enterica enterica serovar Typhi Ty2
gcccaauguuuuaccggca

SEQ ID NO: 1751466 - RNA, 19 nt, Salmonella enterica enterica serovar Typhi Ty2
gcccacaaugacagaaaug

SEQ ID NO: 1751467 - RNA, 15 nt, Salmonella enterica enterica serovar Typhi Ty2
gcccaauagcgcuga

SEQ ID NO: 1751468 - RNA, 13 nt, Salmonella enterica enterica serovar Typhi Ty2
gcccaauagcgcu

SEQ ID NO: 1751469 - RNA, 23 nt, Salmonella enterica enterica serovar Typhi Ty2
gccagucaauaagcuugcuuucc

SEQ ID NO: 1751470 - RNA, 13 nt, Salmonella enterica enterica serovar Typhi Ty2
gccagucaucgcc

SEQ ID NO: 1751471 - RNA, 13 nt, Salmonella enterica enterica serovar Typhi Ty2
gccaguccagguu

SEQ ID NO: 1751472 - RNA, 20 nt, Salmonella enterica enterica serovar Typhi Ty2
gccagguugcgcccggcgca

SEQ ID NO: 1751473 - RNA, 22 nt, Salmonella enterica enterica serovar Typhi Ty2
gccagguugcgcccggcgcauc

SEQ ID NO: 1751474 - RNA, 15 nt, Salmonella enterica enterica serovar Typhi Ty2
gccaguagcucgccg

SEQ ID NO: 1751475 - RNA, 14 nt, Salmonella enterica enterica serovar Typhi Ty2
gccaguagcugcuc

SEQ ID NO: 1751476 - RNA, 20 nt, Salmonella enterica enterica serovar Typhi Ty2
gccaucguaggcgcaaaccg

SEQ ID NO: 1751477 - RNA, 17 nt, Salmonella enterica enterica serovar Typhi Ty2
gccaucucauucgccag

SEQ ID NO: 1751478 - RNA, 14 nt, Salmonella enterica enterica serovar Typhi Ty2
gccaucucauucgc

SEQ ID NO: 1751479 - RNA, 13 nt, Salmonella enterica enterica serovar Typhi Ty2
gccaucuccugcg

SEQ ID NO: 1751480 - RNA, 23 nt, Salmonella enterica enterica serovar Typhi Ty2
gccauccugcgugccguugacca

SEQ ID NO: 1751481 - RNA, 22 nt, Salmonella enterica enterica serovar Typhi Ty2
gccauccuguucaagcaauaau

SEQ ID NO: 1751482 - RNA, 14 nt, Salmonella enterica enterica serovar Typhi Ty2
gccauccucacgca

SEQ ID NO: 1751483 - RNA, 14 nt, Salmonella enterica enterica serovar Typhi Ty2
gccauccugcaccg

SEQ ID NO: 1751484 - RNA, 19 nt, Salmonella enterica enterica serovar Typhi Ty2
gccauccugccgcaccagu

SEQ ID NO: 1751485 - RNA, 22 nt, Salmonella enterica enterica serovar Typhi Ty2
gccaucgacgcgcaucacaaug

SEQ ID NO: 1751486 - RNA, 15 nt, Salmonella enterica enterica serovar Typhi Ty2
gccaucgacagcgcc

SEQ ID NO: 1751487 - RNA, 18 nt, Salmonella enterica enterica serovar Typhi Ty2
gccaucaggcaucugaaa

SEQ ID NO: 1751488 - RNA, 19 nt, Salmonella enterica enterica serovar Typhi Ty2
gccaucaggcaugccaaac

SEQ ID NO: 1751489 - RNA, 19 nt, Salmonella enterica enterica serovar Typhi Ty2
gccaucaggccccccuugu

SEQ ID NO: 1751490 - RNA, 17 nt, Salmonella enterica enterica serovar Typhi Ty2
gccaucaggcaucugaa

SEQ ID NO: 1751491 - RNA, 15 nt, Salmonella enterica enterica serovar Typhi Ty2
gccaucaggaaauuc

SEQ ID NO: 1751492 - RNA, 15 nt, Salmonella enterica enterica serovar Typhi Ty2
gccaucuuuuuucac

SEQ ID NO: 1751493 - RNA, 20 nt, Salmonella enterica enterica serovar Typhi Ty2
gccaugagacgcguaaauca

SEQ ID NO: 1751494 - RNA, 22 nt, Salmonella enterica enterica serovar Typhi Ty2
gccaugaccauucacacuccag

SEQ ID NO: 1751495 - RNA, 12 nt, Salmonella enterica enterica serovar Typhi Ty2
gccaucuuccuc

SEQ ID NO: 1751496 - RNA, 18 nt, Salmonella enterica enterica serovar Typhi Ty2
gccaucuuccagcaucag

SEQ ID NO: 1751497 - RNA, 17 nt, Salmonella enterica enterica serovar Typhi Ty2
gccaucuuccagcauca

SEQ ID NO: 1751498 - RNA, 14 nt, Salmonella enterica enterica serovar Typhi Ty2
gccaucuuccagca

SEQ ID NO: 1751499 - RNA, 16 nt, Salmonella enterica enterica serovar Typhi Ty2
gccaucuucacgcagc

SEQ ID NO: 1751500 - RNA, 17 nt, Salmonella enterica enterica serovar Typhi Ty2
gccaucugugccagccc

SEQ ID NO: 1751501 - RNA, 12 nt, Salmonella enterica enterica serovar Typhi Ty2
gccauggagaaa

SEQ ID NO: 1751502 - RNA, 14 nt, Salmonella enterica enterica serovar Typhi Ty2
gccauggagaaaca

SEQ ID NO: 1751503 - RNA, 15 nt, Salmonella enterica enterica serovar Typhi Ty2
gccaugaucgccgcc

SEQ ID NO: 1751504 - RNA, 16 nt, Salmonella enterica enterica serovar Typhi Ty2
gccaugaucgccgcca

SEQ ID NO: 1751505 - RNA, 21 nt, Salmonella enterica enterica serovar Typhi Ty2
gccaugaucgccgccaucggc

SEQ ID NO: 1751506 - RNA, 18 nt, Salmonella enterica enterica serovar Typhi Ty2
gccaugagccuguauggg

SEQ ID NO: 1751507 - RNA, 14 nt, Salmonella enterica enterica serovar Typhi Ty2
gccaugauccuggu

SEQ ID NO: 1751508 - RNA, 19 nt, Salmonella enterica enterica serovar Typhi Ty2
gccauggcccuuuugcccg

SEQ ID NO: 1751509 - RNA, 13 nt, Salmonella enterica enterica serovar Typhi Ty2
gccauggcccuuu

SEQ ID NO: 1751510 - RNA, 21 nt, Salmonella enterica enterica serovar Typhi Ty2
gccaugguucacaauacagaa

SEQ ID NO: 1751511 - RNA, 23 nt, Salmonella enterica enterica serovar Typhi Ty2
gccauucucuucuaccacgcugc

SEQ ID NO: 1751512 - RNA, 19 nt, Salmonella enterica enterica serovar Typhi Ty2
gccauucgcccagucauca

SEQ ID NO: 1751513 - RNA, 18 nt, Salmonella enterica enterica serovar Typhi Ty2
gccauucgcuuccgccgg

SEQ ID NO: 1751514 - RNA, 18 nt, Salmonella enterica enterica serovar Typhi Ty2
gccauucccagccgagcg

SEQ ID NO: 1751515 - RNA, 19 nt, Salmonella enterica enterica serovar Typhi Ty2
gccauuaaugcaggcagca

SEQ ID NO: 1751516 - RNA, 18 nt, Salmonella enterica enterica serovar Typhi Ty2
gccauuauuguguucuca

SEQ ID NO: 1751517 - RNA, 13 nt, Salmonella enterica enterica serovar Typhi Ty2
gccauuauuuauu

SEQ ID NO: 1751518 - RNA, 17 nt, Salmonella enterica enterica serovar Typhi Ty2
gccauuauuguguucuc

SEQ ID NO: 1751519 - RNA, 14 nt, Salmonella enterica enterica serovar Typhi Ty2
gccauuaucaccau

SEQ ID NO: 1751520 - RNA, 22 nt, Salmonella enterica enterica serovar Typhi Ty2
gccauuaucaccauucccagcg

SEQ ID NO: 1751521 - RNA, 16 nt, Salmonella enterica enterica serovar Typhi Ty2
gccauguuaauaccag

SEQ ID NO: 1751522 - RNA, 16 nt, Salmonella enterica enterica serovar Typhi Ty2
gccaugucuucacucu

SEQ ID NO: 1751523 - RNA, 14 nt, Salmonella enterica enterica serovar Typhi Ty2
gccaugucuucacu

SEQ ID NO: 1751524 - RNA, 22 nt, Salmonella enterica enterica serovar Typhi Ty2
gccagcgcugcauuugcugccg

SEQ ID NO: 1751525 - RNA, 22 nt, Salmonella enterica enterica serovar Typhi Ty2
gccagcgcguuuuccauuuuac

SEQ ID NO: 1751526 - RNA, 23 nt, Salmonella enterica enterica serovar Typhi Ty2
gccagcgcuaauugugcgggggu

SEQ ID NO: 1751527 - RNA, 20 nt, Salmonella enterica enterica serovar Typhi Ty2
gccagcgcuaauugugcggg

SEQ ID NO: 1751528 - RNA, 17 nt, Salmonella enterica enterica serovar Typhi Ty2
gccagcgcuacccgcug

SEQ ID NO: 1751529 - RNA, 24 nt, Salmonella enterica enterica serovar Typhi Ty2
gccagcgcuacccgcugacgcugc

SEQ ID NO: 1751530 - RNA, 16 nt, Salmonella enterica enterica serovar Typhi Ty2
gccagcgugacccaga

SEQ ID NO: 1751531 - RNA, 20 nt, Salmonella enterica enterica serovar Typhi Ty2
gccagcgucucagcaggcgg

SEQ ID NO: 1751532 - RNA, 14 nt, Salmonella enterica enterica serovar Typhi Ty2
gccagcggccagcc

SEQ ID NO: 1751533 - RNA, 14 nt, Salmonella enterica enterica serovar Typhi Ty2
gccagcucuuuucu

SEQ ID NO: 1751534 - RNA, 16 nt, Salmonella enterica enterica serovar Typhi Ty2
gccagcucuuuucugg

SEQ ID NO: 1751535 - RNA, 23 nt, Salmonella enterica enterica serovar Typhi Ty2
gccagcugaaacagaauaaacgg

SEQ ID NO: 1751536 - RNA, 19 nt, Salmonella enterica enterica serovar Typhi Ty2
gccagcguggaugaacuca

SEQ ID NO: 1751537 - RNA, 16 nt, Salmonella enterica enterica serovar Typhi Ty2
gccagcguugaccagc

SEQ ID NO: 1751538 - RNA, 21 nt, Salmonella enterica enterica serovar Typhi Ty2
gccagcuaccgcucaggcgcg

SEQ ID NO: 1751539 - RNA, 15 nt, Salmonella enterica enterica serovar Typhi Ty2
gccagcucaaaugac

SEQ ID NO: 1751540 - RNA, 12 nt, Salmonella enterica enterica serovar Typhi Ty2
gccagcgccgcc

SEQ ID NO: 1751541 - RNA, 14 nt, Salmonella enterica enterica serovar Typhi Ty2
gccagcgacgcaug

SEQ ID NO: 1751542 - RNA, 20 nt, Salmonella enterica enterica serovar Typhi Ty2
gccagccgcgccaucuccuc

SEQ ID NO: 1751543 - RNA, 14 nt, Salmonella enterica enterica serovar Typhi Ty2
gccagccgccgccg

SEQ ID NO: 1751544 - RNA, 21 nt, Salmonella enterica enterica serovar Typhi Ty2
gccagccugaacaucuuccag

SEQ ID NO: 1751545 - RNA, 14 nt, Salmonella enterica enterica serovar Typhi Ty2
gccagcgagaaguc

SEQ ID NO: 1751546 - RNA, 21 nt, Salmonella enterica enterica serovar Typhi Ty2
gccagcgaccaccgucccagu

SEQ ID NO: 1751547 - RNA, 12 nt, Salmonella enterica enterica serovar Typhi Ty2
gccagccuuccc

SEQ ID NO: 1751548 - RNA, 23 nt, Salmonella enterica enterica serovar Typhi Ty2
gccagccugugaucggagaaaua

SEQ ID NO: 1751549 - RNA, 19 nt, Salmonella enterica enterica serovar Typhi Ty2
gccaggcaaagccccaguc

SEQ ID NO: 1751550 - RNA, 18 nt, Salmonella enterica enterica serovar Typhi Ty2
gccaggcaaucagcagcc

SEQ ID NO: 1751551 - RNA, 16 nt, Salmonella enterica enterica serovar Typhi Ty2
gccagcuucgcugcgc

SEQ ID NO: 1751552 - RNA, 21 nt, Salmonella enterica enterica serovar Typhi Ty2
gccaggacugacggaagagcu

SEQ ID NO: 1751553 - RNA, 18 nt, Salmonella enterica enterica serovar Typhi Ty2
gccaggcacguuaaacac

SEQ ID NO: 1751554 - RNA, 16 nt, Salmonella enterica enterica serovar Typhi Ty2
gccaggccgcggcugu

SEQ ID NO: 1751555 - RNA, 15 nt, Salmonella enterica enterica serovar Typhi Ty2
gccaggcgauuguca

SEQ ID NO: 1751556 - RNA, 19 nt, Salmonella enterica enterica serovar Typhi Ty2
gccaggcgcuaucuucaau

SEQ ID NO: 1751557 - RNA, 16 nt, Salmonella enterica enterica serovar Typhi Ty2
gccaggugccgagguu

SEQ ID NO: 1751558 - RNA, 18 nt, Salmonella enterica enterica serovar Typhi Ty2
gccaggugacuuugcccu

SEQ ID NO: 1751559 - RNA, 21 nt, Salmonella enterica enterica serovar Typhi Ty2
gccaggggaugauuuucaggc

SEQ ID NO: 1751560 - RNA, 17 nt, Salmonella enterica enterica serovar Typhi Ty2
gccaggggaugauuuuc

SEQ ID NO: 1751561 - RNA, 19 nt, Salmonella enterica enterica serovar Typhi Ty2
gccaggcggcaaagucuuc

SEQ ID NO: 1751562 - RNA, 23 nt, Salmonella enterica enterica serovar Typhi Ty2
gccagcaguuuuucaaucuuagc

SEQ ID NO: 1751563 - RNA, 11 nt, Salmonella enterica enterica serovar Typhi Ty2
gccagcaguug

SEQ ID NO: 1751564 - RNA, 19 nt, Salmonella enterica enterica serovar Typhi Ty2
gccagcagcucaacggcag

SEQ ID NO: 1751565 - RNA, 23 nt, Salmonella enterica enterica serovar Typhi Ty2
gccagcauaugcacacgcagcug

SEQ ID NO: 1751566 - RNA, 18 nt, Salmonella enterica enterica serovar Typhi Ty2
gccagcagcgcaucaucc

SEQ ID NO: 1751567 - RNA, 19 nt, Salmonella enterica enterica serovar Typhi Ty2
gccagcagcgcaccugccc

SEQ ID NO: 1751568 - RNA, 21 nt, Salmonella enterica enterica serovar Typhi Ty2
gccagcccucuucuucuuccg

SEQ ID NO: 1751569 - RNA, 20 nt, Salmonella enterica enterica serovar Typhi Ty2
gccagccccugcggauuacg

SEQ ID NO: 1751570 - RNA, 14 nt, Salmonella enterica enterica serovar Typhi Ty2
gccagccccagccc

SEQ ID NO: 1751571 - RNA, 14 nt, Salmonella enterica enterica serovar Typhi Ty2
gccagccccagaaa

SEQ ID NO: 1751572 - RNA, 16 nt, Salmonella enterica enterica serovar Typhi Ty2
gccagccauggcccuu

SEQ ID NO: 1751573 - RNA, 23 nt, Salmonella enterica enterica serovar Typhi Ty2
gccagccauggcccaaaagguag

SEQ ID NO: 1751574 - RNA, 17 nt, Salmonella enterica enterica serovar Typhi Ty2
gccagccagcgccacca

SEQ ID NO: 1751575 - RNA, 19 nt, Salmonella enterica enterica serovar Typhi Ty2
gccagccagucgccaggca

SEQ ID NO: 1751576 - RNA, 16 nt, Salmonella enterica enterica serovar Typhi Ty2
gccagccauccccaua

SEQ ID NO: 1751577 - RNA, 17 nt, Salmonella enterica enterica serovar Typhi Ty2
gccagcauuuccagcug

SEQ ID NO: 1751578 - RNA, 16 nt, Salmonella enterica enterica serovar Typhi Ty2
gccagcauuuccagcu

SEQ ID NO: 1751579 - RNA, 18 nt, Salmonella enterica enterica serovar Typhi Ty2
gccagccaaauagcgcca

SEQ ID NO: 1751580 - RNA, 23 nt, Salmonella enterica enterica serovar Typhi Ty2
gccagacgaugaauuccugcggc

SEQ ID NO: 1751581 - RNA, 14 nt, Salmonella enterica enterica serovar Typhi Ty2
gccagacgcgcagc

SEQ ID NO: 1751582 - RNA, 17 nt, Salmonella enterica enterica serovar Typhi Ty2
gccagacgggccaggcg

SEQ ID NO: 1751583 - RNA, 18 nt, Salmonella enterica enterica serovar Typhi Ty2
gccagacucgcucccuuc

SEQ ID NO: 1751584 - RNA, 19 nt, Salmonella enterica enterica serovar Typhi Ty2
gccagagagaugccgccgg

SEQ ID NO: 1751585 - RNA, 19 nt, Salmonella enterica enterica serovar Typhi Ty2
gccagaggcagcacaucaa

SEQ ID NO: 1751586 - RNA, 13 nt, Salmonella enterica enterica serovar Typhi Ty2
gccagcaaacugg

SEQ ID NO: 1751587 - RNA, 17 nt, Salmonella enterica enterica serovar Typhi Ty2
gccagcaaggcaagaaa

SEQ ID NO: 1751588 - RNA, 14 nt, Salmonella enterica enterica serovar Typhi Ty2
gccagcaacagcgu

SEQ ID NO: 1751589 - RNA, 18 nt, Salmonella enterica enterica serovar Typhi Ty2
gccagcaacgcccagaua

SEQ ID NO: 1751590 - RNA, 14 nt, Salmonella enterica enterica serovar Typhi Ty2
gccagcaccagcag

SEQ ID NO: 1751591 - RNA, 15 nt, Salmonella enterica enterica serovar Typhi Ty2
gccagcaccagcagc

SEQ ID NO: 1751592 - RNA, 16 nt, Salmonella enterica enterica serovar Typhi Ty2
gccagcaccagcauua

SEQ ID NO: 1751593 - RNA, 11 nt, Salmonella enterica enterica serovar Typhi Ty2
gccacuggccu

SEQ ID NO: 1751594 - RNA, 17 nt, Salmonella enterica enterica serovar Typhi Ty2
gccaccggauugccuuc

SEQ ID NO: 1751595 - RNA, 17 nt, Salmonella enterica enterica serovar Typhi Ty2
gccaccgcuauucuuca

SEQ ID NO: 1751596 - RNA, 17 nt, Salmonella enterica enterica serovar Typhi Ty2
gccaccgcuccgcgcau

SEQ ID NO: 1751597 - RNA, 14 nt, Salmonella enterica enterica serovar Typhi Ty2
gccacuucuuccag

SEQ ID NO: 1751598 - RNA, 20 nt, Salmonella enterica enterica serovar Typhi Ty2
gccacuucuuccagcggcag

SEQ ID NO: 1751599 - RNA, 22 nt, Salmonella enterica enterica serovar Typhi Ty2
gccacuucacuggcggcaagcu

SEQ ID NO: 1751600 - RNA, 19 nt, Salmonella enterica enterica serovar Typhi Ty2
gccaauguacguaaaacca

SEQ ID NO: 1751601 - RNA, 21 nt, Salmonella enterica enterica serovar Typhi Ty2
gccaauguacguaaaaccagc

SEQ ID NO: 1751602 - RNA, 22 nt, Salmonella enterica enterica serovar Typhi Ty2
gccaauggcucaacuccgccgg

SEQ ID NO: 1751603 - RNA, 11 nt, Salmonella enterica enterica serovar Typhi Ty2
gccaaugaacu

SEQ ID NO: 1751604 - RNA, 17 nt, Salmonella enterica enterica serovar Typhi Ty2
gccacaauggcaggcag

SEQ ID NO: 1751605 - RNA, 21 nt, Salmonella enterica enterica serovar Typhi Ty2
gccacaaugggggcauaauac

SEQ ID NO: 1751606 - RNA, 16 nt, Salmonella enterica enterica serovar Typhi Ty2
gccacaauugccagca

SEQ ID NO: 1751607 - RNA, 14 nt, Salmonella enterica enterica serovar Typhi Ty2
gccacaauugccag

SEQ ID NO: 1751608 - RNA, 23 nt, Salmonella enterica enterica serovar Typhi Ty2
gccacaacggcaauuuuuacaaa

SEQ ID NO: 1751609 - RNA, 21 nt, Salmonella enterica enterica serovar Typhi Ty2
gccacaaccgcccccaacuga

SEQ ID NO: 1751610 - RNA, 18 nt, Salmonella enterica enterica serovar Typhi Ty2
gccaauaaccaccuguuc

SEQ ID NO: 1751611 - RNA, 17 nt, Salmonella enterica enterica serovar Typhi Ty2
gccaaguaauaaagaga

SEQ ID NO: 1751612 - RNA, 21 nt, Salmonella enterica enterica serovar Typhi Ty2
gccaaguaauaaagagaacga

SEQ ID NO: 1751613 - RNA, 15 nt, Salmonella enterica enterica serovar Typhi Ty2
gccaauaggggcgga

SEQ ID NO: 1751614 - RNA, 20 nt, Salmonella enterica enterica serovar Typhi Ty2
gccaaucaccgccagcaacg

SEQ ID NO: 1751615 - RNA, 19 nt, Salmonella enterica enterica serovar Typhi Ty2
gccaauaauuaguuuuacc

SEQ ID NO: 1751616 - RNA, 14 nt, Salmonella enterica enterica serovar Typhi Ty2
gccaauccugcacc

SEQ ID NO: 1751617 - RNA, 21 nt, Salmonella enterica enterica serovar Typhi Ty2
gccaaucggcgucuugccgca

SEQ ID NO: 1751618 - RNA, 13 nt, Salmonella enterica enterica serovar Typhi Ty2
gccaccauaucuu

SEQ ID NO: 1751619 - RNA, 22 nt, Salmonella enterica enterica serovar Typhi Ty2
gccaccaucgucgccagaccca

SEQ ID NO: 1751620 - RNA, 18 nt, Salmonella enterica enterica serovar Typhi Ty2
gccaccaucuuuuuugcg

SEQ ID NO: 1751621 - RNA, 17 nt, Salmonella enterica enterica serovar Typhi Ty2
gccaccaugcugguugg

SEQ ID NO: 1751622 - RNA, 15 nt, Salmonella enterica enterica serovar Typhi Ty2
gccaccccaaaucuc

SEQ ID NO: 1751623 - RNA, 12 nt, Salmonella enterica enterica serovar Typhi Ty2
gccacagccgca

SEQ ID NO: 1751624 - RNA, 20 nt, Salmonella enterica enterica serovar Typhi Ty2
gccacagcgccagacacugg

SEQ ID NO: 1751625 - RNA, 23 nt, Salmonella enterica enterica serovar Typhi Ty2
gccaccaaagccaggccgccagc

SEQ ID NO: 1751626 - RNA, 20 nt, Salmonella enterica enterica serovar Typhi Ty2
gccaccaaagccaggccgcc

SEQ ID NO: 1751627 - RNA, 23 nt, Salmonella enterica enterica serovar Typhi Ty2
gccaccaaaaacgcccccagaua

SEQ ID NO: 1751628 - RNA, 21 nt, Salmonella enterica enterica serovar Typhi Ty2
gccacagauuaugcaguucuu

SEQ ID NO: 1751629 - RNA, 12 nt, Salmonella enterica enterica serovar Typhi Ty2
gccacagcaaau

SEQ ID NO: 1751630 - RNA, 14 nt, Salmonella enterica enterica serovar Typhi Ty2
gccacacccauagc

SEQ ID NO: 1751631 - RNA, 20 nt, Salmonella enterica enterica serovar Typhi Ty2
gcauuugucgcuguuaaucu

SEQ ID NO: 1751632 - RNA, 18 nt, Salmonella enterica enterica serovar Typhi Ty2
gcauuugcuuucaucaau

SEQ ID NO: 1751633 - RNA, 20 nt, Salmonella enterica enterica serovar Typhi Ty2
gcauuucgccaguuccauca

SEQ ID NO: 1751634 - RNA, 17 nt, Salmonella enterica enterica serovar Typhi Ty2
gcauuuuaucuuuuguu

SEQ ID NO: 1751635 - RNA, 14 nt, Salmonella enterica enterica serovar Typhi Ty2
gcauuucgccgcca

SEQ ID NO: 1751636 - RNA, 14 nt, Salmonella enterica enterica serovar Typhi Ty2
gcauuuuuucuuca

SEQ ID NO: 1751637 - RNA, 21 nt, Salmonella enterica enterica serovar Typhi Ty2
gccaaacucuuuuucaauaaa

SEQ ID NO: 1751638 - RNA, 13 nt, Salmonella enterica enterica serovar Typhi Ty2
gccaaacugcugg

SEQ ID NO: 1751639 - RNA, 15 nt, Salmonella enterica enterica serovar Typhi Ty2
gccaaaucagcagga

SEQ ID NO: 1751640 - RNA, 22 nt, Salmonella enterica enterica serovar Typhi Ty2
gccaaauagcgccagacagaua

SEQ ID NO: 1751641 - RNA, 17 nt, Salmonella enterica enterica serovar Typhi Ty2
gccaaagggagcagacu

SEQ ID NO: 1751642 - RNA, 15 nt, Salmonella enterica enterica serovar Typhi Ty2
gccaaacguggcggc

SEQ ID NO: 1751643 - RNA, 13 nt, Salmonella enterica enterica serovar Typhi Ty2
gccaaacuccuca

SEQ ID NO: 1751644 - RNA, 14 nt, Salmonella enterica enterica serovar Typhi Ty2
gccaaaccagaccc

SEQ ID NO: 1751645 - RNA, 14 nt, Salmonella enterica enterica serovar Typhi Ty2
gccaaaccacugau

SEQ ID NO: 1751646 - RNA, 16 nt, Salmonella enterica enterica serovar Typhi Ty2
gccaaaagaggcagca

SEQ ID NO: 1751647 - RNA, 18 nt, Salmonella enterica enterica serovar Typhi Ty2
gccaaaaccacagugacc

SEQ ID NO: 1751648 - RNA, 19 nt, Salmonella enterica enterica serovar Typhi Ty2
gccaaaacccaccagcagg

SEQ ID NO: 1751649 - RNA, 13 nt, Salmonella enterica enterica serovar Typhi Ty2
gccaaaaccgcuc

SEQ ID NO: 1751650 - RNA, 15 nt, Salmonella enterica enterica serovar Typhi Ty2
gccaacgccagcagc

SEQ ID NO: 1751651 - RNA, 14 nt, Salmonella enterica enterica serovar Typhi Ty2
gccaacuuuuucuu

SEQ ID NO: 1751652 - RNA, 18 nt, Salmonella enterica enterica serovar Typhi Ty2
gccaagcagcgccacgcc

SEQ ID NO: 1751653 - RNA, 12 nt, Salmonella enterica enterica serovar Typhi Ty2
gccaagcgcggc

SEQ ID NO: 1751654 - RNA, 17 nt, Salmonella enterica enterica serovar Typhi Ty2
gccaagcgcggcagcag

SEQ ID NO: 1751655 - RNA, 19 nt, Salmonella enterica enterica serovar Typhi Ty2
gccaagcgcggcagcagcu

SEQ ID NO: 1751656 - RNA, 16 nt, Salmonella enterica enterica serovar Typhi Ty2
gccaagcgcggcagca

SEQ ID NO: 1751657 - RNA, 20 nt, Salmonella enterica enterica serovar Typhi Ty2
gccaaccaccgcggagaucg

SEQ ID NO: 1751658 - RNA, 18 nt, Salmonella enterica enterica serovar Typhi Ty2
gccaaccgccacaauauc

SEQ ID NO: 1751659 - RNA, 21 nt, Salmonella enterica enterica serovar Typhi Ty2
gccaaccgugagcgcgccgca

SEQ ID NO: 1751660 - RNA, 19 nt, Salmonella enterica enterica serovar Typhi Ty2
gccaaauuuagugcucagc

SEQ ID NO: 1751661 - RNA, 11 nt, Salmonella enterica enterica serovar Typhi Ty2
gccaaauguau

SEQ ID NO: 1751662 - RNA, 14 nt, Salmonella enterica enterica serovar Typhi Ty2
gccaacaacaggcc

SEQ ID NO: 1751663 - RNA, 18 nt, Salmonella enterica enterica serovar Typhi Ty2
gccaaaucuguucugucc

SEQ ID NO: 1751664 - RNA, 19 nt, Salmonella enterica enterica serovar Typhi Ty2
gccaacaacaggccgccga

SEQ ID NO: 1751665 - RNA, 21 nt, Salmonella enterica enterica serovar Typhi Ty2
gccaacagccgcccacaaccg

SEQ ID NO: 1751666 - RNA, 21 nt, Salmonella enterica enterica serovar Typhi Ty2
gcauuggcguuaccggcaggc

SEQ ID NO: 1751667 - RNA, 19 nt, Salmonella enterica enterica serovar Typhi Ty2
gcauuggcguuaccggcag

SEQ ID NO: 1751668 - RNA, 16 nt, Salmonella enterica enterica serovar Typhi Ty2
gcauugcucaacugga

SEQ ID NO: 1751669 - RNA, 16 nt, Salmonella enterica enterica serovar Typhi Ty2
gcauugccggaaacca

SEQ ID NO: 1751670 - RNA, 19 nt, Salmonella enterica enterica serovar Typhi Ty2
gcauuuaacggcuuacugc

SEQ ID NO: 1751671 - RNA, 13 nt, Salmonella enterica enterica serovar Typhi Ty2
gcauuuaucaauc

SEQ ID NO: 1751672 - RNA, 13 nt, Salmonella enterica enterica serovar Typhi Ty2
gcauuuccagcug

SEQ ID NO: 1751673 - RNA, 24 nt, Salmonella enterica enterica serovar Typhi Ty2
gcauuucaaagcguucugaacugu

SEQ ID NO: 1751674 - RNA, 18 nt, Salmonella enterica enterica serovar Typhi Ty2
gcauuucaagcaggcgau

SEQ ID NO: 1751675 - RNA, 16 nt, Salmonella enterica enterica serovar Typhi Ty2
gcauuguuaauccaga

SEQ ID NO: 1751676 - RNA, 22 nt, Salmonella enterica enterica serovar Typhi Ty2
gcauugguggggcuaagugagc

SEQ ID NO: 1751677 - RNA, 18 nt, Salmonella enterica enterica serovar Typhi Ty2
gcauugugccggguagcg

SEQ ID NO: 1751678 - RNA, 14 nt, Salmonella enterica enterica serovar Typhi Ty2
gcauucuaaauccu

SEQ ID NO: 1751679 - RNA, 16 nt, Salmonella enterica enterica serovar Typhi Ty2
gcauucgcuccucagc

SEQ ID NO: 1751680 - RNA, 14 nt, Salmonella enterica enterica serovar Typhi Ty2
gcauucgcuccuca

SEQ ID NO: 1751681 - RNA, 20 nt, Salmonella enterica enterica serovar Typhi Ty2
gcauugagacaugccgccag

SEQ ID NO: 1751682 - RNA, 20 nt, Salmonella enterica enterica serovar Typhi Ty2
gcauuauacgccuauuuucu

SEQ ID NO: 1751683 - RNA, 14 nt, Salmonella enterica enterica serovar Typhi Ty2
gcauggcaauuaaa

SEQ ID NO: 1751684 - RNA, 23 nt, Salmonella enterica enterica serovar Typhi Ty2
gcauggcagccccggcauccagu

SEQ ID NO: 1751685 - RNA, 14 nt, Salmonella enterica enterica serovar Typhi Ty2
gcaugggaaauaac

SEQ ID NO: 1751686 - RNA, 22 nt, Salmonella enterica enterica serovar Typhi Ty2
gcauggggagaccccacacuac

SEQ ID NO: 1751687 - RNA, 19 nt, Salmonella enterica enterica serovar Typhi Ty2
gcauggguauaagcgugca

SEQ ID NO: 1751688 - RNA, 18 nt, Salmonella enterica enterica serovar Typhi Ty2
gcaugguguucagauggc

SEQ ID NO: 1751689 - RNA, 23 nt, Salmonella enterica enterica serovar Typhi Ty2
gcauggugacuccccacaauccc

SEQ ID NO: 1751690 - RNA, 20 nt, Salmonella enterica enterica serovar Typhi Ty2
gcauuagcgcgauaaaacca

SEQ ID NO: 1751691 - RNA, 15 nt, Salmonella enterica enterica serovar Typhi Ty2
gcauuaauuucuugc

SEQ ID NO: 1751692 - RNA, 15 nt, Salmonella enterica enterica serovar Typhi Ty2
gcauuaacguccaua

SEQ ID NO: 1751693 - RNA, 20 nt, Salmonella enterica enterica serovar Typhi Ty2
gcauuaaaucaucauaauca

SEQ ID NO: 1751694 - RNA, 19 nt, Salmonella enterica enterica serovar Typhi Ty2
gcauggugcagccgccauc

SEQ ID NO: 1751695 - RNA, 20 nt, Salmonella enterica enterica serovar Typhi Ty2
gcauguacaacuucaugagu

SEQ ID NO: 1751696 - RNA, 14 nt, Salmonella enterica enterica serovar Typhi Ty2
gcaugacccaggca

SEQ ID NO: 1751697 - RNA, 18 nt, Salmonella enterica enterica serovar Typhi Ty2
gcaugaauaaccucccgc

SEQ ID NO: 1751698 - RNA, 20 nt, Salmonella enterica enterica serovar Typhi Ty2
gcaugaauaaccucccgccg

SEQ ID NO: 1751699 - RNA, 20 nt, Salmonella enterica enterica serovar Typhi Ty2
gcaugaauaauuucuucuuu

SEQ ID NO: 1751700 - RNA, 17 nt, Salmonella enterica enterica serovar Typhi Ty2
gcaucuuuaaccgccug

SEQ ID NO: 1751701 - RNA, 14 nt, Salmonella enterica enterica serovar Typhi Ty2
gcaucuuuguucug

SEQ ID NO: 1751702 - RNA, 12 nt, Salmonella enterica enterica serovar Typhi Ty2
gcaucuuauauu

SEQ ID NO: 1751703 - RNA, 14 nt, Salmonella enterica enterica serovar Typhi Ty2
gcaugaugccacga

SEQ ID NO: 1751704 - RNA, 19 nt, Salmonella enterica enterica serovar Typhi Ty2
gcaugauggcgaacagccc

SEQ ID NO: 1751705 - RNA, 18 nt, Salmonella enterica enterica serovar Typhi Ty2
gcaugagguuaguaaugc

SEQ ID NO: 1751706 - RNA, 14 nt, Salmonella enterica enterica serovar Typhi Ty2
gcaugagccagccc

SEQ ID NO: 1751707 - RNA, 16 nt, Salmonella enterica enterica serovar Typhi Ty2
gcaugagccagcccuc

SEQ ID NO: 1751708 - RNA, 18 nt, Salmonella enterica enterica serovar Typhi Ty2
gcaugagcacgcggaaga

SEQ ID NO: 1751709 - RNA, 16 nt, Salmonella enterica enterica serovar Typhi Ty2
gcaugauuaagcuggg

SEQ ID NO: 1751710 - RNA, 13 nt, Salmonella enterica enterica serovar Typhi Ty2
gcaugauuacaga

SEQ ID NO: 1751711 - RNA, 22 nt, Salmonella enterica enterica serovar Typhi Ty2
gcaugcgccccguuuccgcgac

SEQ ID NO: 1751712 - RNA, 20 nt, Salmonella enterica enterica serovar Typhi Ty2
gcaugcccgccagcgggccg

SEQ ID NO: 1751713 - RNA, 12 nt, Salmonella enterica enterica serovar Typhi Ty2
gcaucugucauc

SEQ ID NO: 1751714 - RNA, 16 nt, Salmonella enterica enterica serovar Typhi Ty2
gcaucugucaucgccg

SEQ ID NO: 1751715 - RNA, 21 nt, Salmonella enterica enterica serovar Typhi Ty2
gcaucugggcugagaaaaauu

SEQ ID NO: 1751716 - RNA, 21 nt, Salmonella enterica enterica serovar Typhi Ty2
gcaucugaucuacaaucgucu

SEQ ID NO: 1751717 - RNA, 21 nt, Salmonella enterica enterica serovar Typhi Ty2
gcaucuccucgcacuggcgag

SEQ ID NO: 1751718 - RNA, 18 nt, Salmonella enterica enterica serovar Typhi Ty2
gcaucuaccgcauacuga

SEQ ID NO: 1751719 - RNA, 13 nt, Salmonella enterica enterica serovar Typhi Ty2
gcaucgcggucag

SEQ ID NO: 1751720 - RNA, 22 nt, Salmonella enterica enterica serovar Typhi Ty2
gcaucgguagaaugaauguagc

SEQ ID NO: 1751721 - RNA, 22 nt, Salmonella enterica enterica serovar Typhi Ty2
gcaucgguaaagguuuucacgc

SEQ ID NO: 1751722 - RNA, 21 nt, Salmonella enterica enterica serovar Typhi Ty2
gccgucagacaggccugguua

SEQ ID NO: 1751723 - RNA, 18 nt, Salmonella enterica enterica serovar Typhi Ty2
gccgucauaccgcccaug

SEQ ID NO: 1751724 - RNA, 17 nt, Salmonella enterica enterica serovar Typhi Ty2
gccgucagugagcccuc

SEQ ID NO: 1751725 - RNA, 18 nt, Salmonella enterica enterica serovar Typhi Ty2
gccgucaggcuugccgcg

SEQ ID NO: 1751726 - RNA, 18 nt, Salmonella enterica enterica serovar Typhi Ty2
gccguauucuuacccacc

SEQ ID NO: 1751727 - RNA, 22 nt, Salmonella enterica enterica serovar Typhi Ty2
gccguauuucacuuuugccggu

SEQ ID NO: 1751728 - RNA, 16 nt, Salmonella enterica enterica serovar Typhi Ty2
gccguauucuuaccca

SEQ ID NO: 1751729 - RNA, 15 nt, Salmonella enterica enterica serovar Typhi Ty2
gccgucacaggcggc

SEQ ID NO: 1751730 - RNA, 22 nt, Salmonella enterica enterica serovar Typhi Ty2
gccgucaacacgcagacccagg

SEQ ID NO: 1751731 - RNA, 18 nt, Salmonella enterica enterica serovar Typhi Ty2
gccguagcccgcuuuacc

SEQ ID NO: 1751732 - RNA, 19 nt, Salmonella enterica enterica serovar Typhi Ty2
gccguagcgcgcuuccugc

SEQ ID NO: 1751733 - RNA, 19 nt, Salmonella enterica enterica serovar Typhi Ty2
gccguagaaaaugcgcugg

SEQ ID NO: 1751734 - RNA, 16 nt, Salmonella enterica enterica serovar Typhi Ty2
gccguacuccagccca

SEQ ID NO: 1751735 - RNA, 16 nt, Salmonella enterica enterica serovar Typhi Ty2
gccgguguuaaccaga

SEQ ID NO: 1751736 - RNA, 16 nt, Salmonella enterica enterica serovar Typhi Ty2
gccgguugcgcugguu

SEQ ID NO: 1751737 - RNA, 21 nt, Salmonella enterica enterica serovar Typhi Ty2
gccgguucggccagucgcaga

SEQ ID NO: 1751738 - RNA, 17 nt, Salmonella enterica enterica serovar Typhi Ty2
gccguaaacaggcaggc

SEQ ID NO: 1751739 - RNA, 22 nt, Salmonella enterica enterica serovar Typhi Ty2
gccgguuuuagcguauccggca

SEQ ID NO: 1751740 - RNA, 18 nt, Salmonella enterica enterica serovar Typhi Ty2
gccguaaagggaagauca

SEQ ID NO: 1751741 - RNA, 19 nt, Salmonella enterica enterica serovar Typhi Ty2
gccgugcgccgacaucgcc

SEQ ID NO: 1751742 - RNA, 16 nt, Salmonella enterica enterica serovar Typhi Ty2
gccgugaaauauccuc

SEQ ID NO: 1751743 - RNA, 15 nt, Salmonella enterica enterica serovar Typhi Ty2
gccgugaacgccaaa

SEQ ID NO: 1751744 - RNA, 18 nt, Salmonella enterica enterica serovar Typhi Ty2
gccgucggcaauaaacuc

SEQ ID NO: 1751745 - RNA, 22 nt, Salmonella enterica enterica serovar Typhi Ty2
gccguucauucgccccagcaua

SEQ ID NO: 1751746 - RNA, 20 nt, Salmonella enterica enterica serovar Typhi Ty2
gccguucauucgccccagca

SEQ ID NO: 1751747 - RNA, 14 nt, Salmonella enterica enterica serovar Typhi Ty2
gccguuccauucca

SEQ ID NO: 1751748 - RNA, 15 nt, Salmonella enterica enterica serovar Typhi Ty2
gccguggaacgugcc

SEQ ID NO: 1751749 - RNA, 15 nt, Salmonella enterica enterica serovar Typhi Ty2
gccguuaccguggcg

SEQ ID NO: 1751750 - RNA, 15 nt, Salmonella enterica enterica serovar Typhi Ty2
gccguuaccgccgag

SEQ ID NO: 1751751 - RNA, 17 nt, Salmonella enterica enterica serovar Typhi Ty2
gccguuaccgccgagca

SEQ ID NO: 1751752 - RNA, 15 nt, Salmonella enterica enterica serovar Typhi Ty2
gccguuaauuuucac

SEQ ID NO: 1751753 - RNA, 15 nt, Salmonella enterica enterica serovar Typhi Ty2
gccgucggcgccagc

SEQ ID NO: 1751754 - RNA, 15 nt, Salmonella enterica enterica serovar Typhi Ty2
gccgucgacaaagcc

SEQ ID NO: 1751755 - RNA, 17 nt, Salmonella enterica enterica serovar Typhi Ty2
gccgguauccagcgcgu

SEQ ID NO: 1751756 - RNA, 17 nt, Salmonella enterica enterica serovar Typhi Ty2
gccgguacgcagcaggc

SEQ ID NO: 1751757 - RNA, 14 nt, Salmonella enterica enterica serovar Typhi Ty2
gccgguacguccac

SEQ ID NO: 1751758 - RNA, 16 nt, Salmonella enterica enterica serovar Typhi Ty2
gccgggcuucauaccg

SEQ ID NO: 1751759 - RNA, 14 nt, Salmonella enterica enterica serovar Typhi Ty2
gccgguagcgagaa

SEQ ID NO: 1751760 - RNA, 23 nt, Salmonella enterica enterica serovar Typhi Ty2
gccgggcggcuguguccgccaug

SEQ ID NO: 1751761 - RNA, 21 nt, Salmonella enterica enterica serovar Typhi Ty2
gccggugccgcaaucgguuuc

SEQ ID NO: 1751762 - RNA, 13 nt, Salmonella enterica enterica serovar Typhi Ty2
gccggugccgcaa

SEQ ID NO: 1751763 - RNA, 16 nt, Salmonella enterica enterica serovar Typhi Ty2
gccggucgccagcaua

SEQ ID NO: 1751764 - RNA, 17 nt, Salmonella enterica enterica serovar Typhi Ty2
gccgcgugcucgcggcg

SEQ ID NO: 1751765 - RNA, 13 nt, Salmonella enterica enterica serovar Typhi Ty2
gccgcgugcucgc

SEQ ID NO: 1751766 - RNA, 22 nt, Salmonella enterica enterica serovar Typhi Ty2
gccgcuaucgaccagcaccugc

SEQ ID NO: 1751767 - RNA, 20 nt, Salmonella enterica enterica serovar Typhi Ty2
gccgcuaucugcuccgccag

SEQ ID NO: 1751768 - RNA, 19 nt, Salmonella enterica enterica serovar Typhi Ty2
gccgcucaggguaaucacc

SEQ ID NO: 1751769 - RNA, 18 nt, Salmonella enterica enterica serovar Typhi Ty2
gccgcgucccgaccagga

SEQ ID NO: 1751770 - RNA, 14 nt, Salmonella enterica enterica serovar Typhi Ty2
gccgcuccacagca

SEQ ID NO: 1751771 - RNA, 20 nt, Salmonella enterica enterica serovar Typhi Ty2
gccgcugauguuuugcgccg

SEQ ID NO: 1751772 - RNA, 15 nt, Salmonella enterica enterica serovar Typhi Ty2
gccgcggcgcuggcc

SEQ ID NO: 1751773 - RNA, 18 nt, Salmonella enterica enterica serovar Typhi Ty2
gccgcgcuuucaguaaua

SEQ ID NO: 1751774 - RNA, 13 nt, Salmonella enterica enterica serovar Typhi Ty2
gccgcgcuggaua

SEQ ID NO: 1751775 - RNA, 16 nt, Salmonella enterica enterica serovar Typhi Ty2
gccggauggcggcgca

SEQ ID NO: 1751776 - RNA, 12 nt, Salmonella enterica enterica serovar Typhi Ty2
gccggauggcgc

SEQ ID NO: 1751777 - RNA, 13 nt, Salmonella enterica enterica serovar Typhi Ty2
gccggauggcggc

SEQ ID NO: 1751778 - RNA, 13 nt, Salmonella enterica enterica serovar Typhi Ty2
gccggaugguggu

SEQ ID NO: 1751779 - RNA, 12 nt, Salmonella enterica enterica serovar Typhi Ty2
gccggagagggg

SEQ ID NO: 1751780 - RNA, 13 nt, Salmonella enterica enterica serovar Typhi Ty2
gccggagaccggc

SEQ ID NO: 1751781 - RNA, 13 nt, Salmonella enterica enterica serovar Typhi Ty2
gccggcagcagcu

SEQ ID NO: 1751782 - RNA, 14 nt, Salmonella enterica enterica serovar Typhi Ty2
gccggcagcagcuu

SEQ ID NO: 1751783 - RNA, 17 nt, Salmonella enterica enterica serovar Typhi Ty2
gccggaugugagcgcau

SEQ ID NO: 1751784 - RNA, 15 nt, Salmonella enterica enterica serovar Typhi Ty2
gccgcuuauccggcc

SEQ ID NO: 1751785 - RNA, 19 nt, Salmonella enterica enterica serovar Typhi Ty2
gccgcuuacugugccgccg

SEQ ID NO: 1751786 - RNA, 16 nt, Salmonella enterica enterica serovar Typhi Ty2
gccgccgcgcggaccg

SEQ ID NO: 1751787 - RNA, 14 nt, Salmonella enterica enterica serovar Typhi Ty2
gccgccgccugcca

SEQ ID NO: 1751788 - RNA, 14 nt, Salmonella enterica enterica serovar Typhi Ty2
gccgccgagcgccg

SEQ ID NO: 1751789 - RNA, 18 nt, Salmonella enterica enterica serovar Typhi Ty2
gccgccgaggcuaagcca

SEQ ID NO: 1751790 - RNA, 16 nt, Salmonella enterica enterica serovar Typhi Ty2
gccgcacaaaauuuug

SEQ ID NO: 1751791 - RNA, 21 nt, Salmonella enterica enterica serovar Typhi Ty2
gccgcaaugaccacaaauucu

SEQ ID NO: 1751792 - RNA, 21 nt, Salmonella enterica enterica serovar Typhi Ty2
gccgcaaucacuucauacgaa

SEQ ID NO: 1751793 - RNA, 20 nt, Salmonella enterica enterica serovar Typhi Ty2
gccgcaaucacuucauacga

SEQ ID NO: 1751794 - RNA, 14 nt, Salmonella enterica enterica serovar Typhi Ty2
gccgcgcgccgccu

SEQ ID NO: 1751795 - RNA, 22 nt, Salmonella enterica enterica serovar Typhi Ty2
gccgcgcuaucaaaaugcaccg

SEQ ID NO: 1751796 - RNA, 20 nt, Salmonella enterica enterica serovar Typhi Ty2
gccgcgcgguauuucgcaac

SEQ ID NO: 1751797 - RNA, 17 nt, Salmonella enterica enterica serovar Typhi Ty2
gccgcgccggacuccag

SEQ ID NO: 1751798 - RNA, 21 nt, Salmonella enterica enterica serovar Typhi Ty2
gccgcgccggacuccagcaac

SEQ ID NO: 1751799 - RNA, 17 nt, Salmonella enterica enterica serovar Typhi Ty2
gccgcgccgacauagcu

SEQ ID NO: 1751800 - RNA, 14 nt, Salmonella enterica enterica serovar Typhi Ty2
gccgcgcccugcgg

SEQ ID NO: 1751801 - RNA, 18 nt, Salmonella enterica enterica serovar Typhi Ty2
gccgcgcccuaacaggcg

SEQ ID NO: 1751802 - RNA, 17 nt, Salmonella enterica enterica serovar Typhi Ty2
gccgcgcccuaacaggc

SEQ ID NO: 1751803 - RNA, 14 nt, Salmonella enterica enterica serovar Typhi Ty2
gccgcgaucgcggc

SEQ ID NO: 1751804 - RNA, 23 nt, Salmonella enterica enterica serovar Typhi Ty2
gccgcgauacauugucgcagcgc

SEQ ID NO: 1751805 - RNA, 16 nt, Salmonella enterica enterica serovar Typhi Ty2
gccgccuuggcgaccu

SEQ ID NO: 1751806 - RNA, 19 nt, Salmonella enterica enterica serovar Typhi Ty2
gccgcgagagucgccagga

SEQ ID NO: 1751807 - RNA, 18 nt, Salmonella enterica enterica serovar Typhi Ty2
gccgacgcauuucuccug

SEQ ID NO: 1751808 - RNA, 20 nt, Salmonella enterica enterica serovar Typhi Ty2
gccgacgccacccagcgaac

SEQ ID NO: 1751809 - RNA, 16 nt, Salmonella enterica enterica serovar Typhi Ty2
gccgacgauuugcgcu

SEQ ID NO: 1751810 - RNA, 14 nt, Salmonella enterica enterica serovar Typhi Ty2
gccgacucgcgcaa

SEQ ID NO: 1751811 - RNA, 16 nt, Salmonella enterica enterica serovar Typhi Ty2
gccgacgcucuuccuc

SEQ ID NO: 1751812 - RNA, 20 nt, Salmonella enterica enterica serovar Typhi Ty2
gccgagcauuuccgcagcca

SEQ ID NO: 1751813 - RNA, 12 nt, Salmonella enterica enterica serovar Typhi Ty2
gccgacuuuacg

SEQ ID NO: 1751814 - RNA, 16 nt, Salmonella enterica enterica serovar Typhi Ty2
gccgagcaacagaaac

SEQ ID NO: 1751815 - RNA, 16 nt, Salmonella enterica enterica serovar Typhi Ty2
gccgaggcauucagcc

SEQ ID NO: 1751816 - RNA, 19 nt, Salmonella enterica enterica serovar Typhi Ty2
gccgagggcauugaugguu

SEQ ID NO: 1751817 - RNA, 20 nt, Salmonella enterica enterica serovar Typhi Ty2
gccgaucaucccgcccagca

SEQ ID NO: 1751818 - RNA, 22 nt, Salmonella enterica enterica serovar Typhi Ty2
gccgauaaccagcgcgccgcca

SEQ ID NO: 1751819 - RNA, 17 nt, Salmonella enterica enterica serovar Typhi Ty2
gccgauaaccagcgcgc

SEQ ID NO: 1751820 - RNA, 21 nt, Salmonella enterica enterica serovar Typhi Ty2
gccgauaaccagcgcgccgcc

SEQ ID NO: 1751821 - RNA, 12 nt, Salmonella enterica enterica serovar Typhi Ty2
gccgcaaaagcc

SEQ ID NO: 1751822 - RNA, 23 nt, Salmonella enterica enterica serovar Typhi Ty2
gccgcaaaugaccagaucaacau

SEQ ID NO: 1751823 - RNA, 17 nt, Salmonella enterica enterica serovar Typhi Ty2
gccgcaaacagcacgcc

SEQ ID NO: 1751824 - RNA, 14 nt, Salmonella enterica enterica serovar Typhi Ty2
gccgcaaacgccga

SEQ ID NO: 1751825 - RNA, 21 nt, Salmonella enterica enterica serovar Typhi Ty2
gccgcaaacgccgaagccagc

SEQ ID NO: 1751826 - RNA, 19 nt, Salmonella enterica enterica serovar Typhi Ty2
gccgaaauccaccagcgga

SEQ ID NO: 1751827 - RNA, 18 nt, Salmonella enterica enterica serovar Typhi Ty2
gccgaaagcgaucacauu

SEQ ID NO: 1751828 - RNA, 12 nt, Salmonella enterica enterica serovar Typhi Ty2
gccgaacagacg

SEQ ID NO: 1751829 - RNA, 19 nt, Salmonella enterica enterica serovar Typhi Ty2
gccgaacaacacggcggcc

SEQ ID NO: 1751830 - RNA, 12 nt, Salmonella enterica enterica serovar Typhi Ty2
gcccuuugcccu

SEQ ID NO: 1751831 - RNA, 11 nt, Salmonella enterica enterica serovar Typhi Ty2
gcccuuucuua

SEQ ID NO: 1751832 - RNA, 13 nt, Salmonella enterica enterica serovar Typhi Ty2
gcccuuucuucaa

SEQ ID NO: 1751833 - RNA, 15 nt, Salmonella enterica enterica serovar Typhi Ty2
gcccuuccagcagcc

SEQ ID NO: 1751834 - RNA, 21 nt, Salmonella enterica enterica serovar Typhi Ty2
gcccuugaucggguuuuccug

SEQ ID NO: 1751835 - RNA, 14 nt, Salmonella enterica enterica serovar Typhi Ty2
gcccuucaucuucc

SEQ ID NO: 1751836 - RNA, 15 nt, Salmonella enterica enterica serovar Typhi Ty2
gcccuucaucuucca

SEQ ID NO: 1751837 - RNA, 16 nt, Salmonella enterica enterica serovar Typhi Ty2
gcccuucaucuuccag

SEQ ID NO: 1751838 - RNA, 14 nt, Salmonella enterica enterica serovar Typhi Ty2
gcccuuccagcagc

SEQ ID NO: 1751839 - RNA, 20 nt, Salmonella enterica enterica serovar Typhi Ty2
gcccuguuuuuucgccgcgc

SEQ ID NO: 1751840 - RNA, 14 nt, Salmonella enterica enterica serovar Typhi Ty2
gcccuuaucuggau

SEQ ID NO: 1751841 - RNA, 23 nt, Salmonella enterica enterica serovar Typhi Ty2
gccgaauuuacugugauccacca

SEQ ID NO: 1751842 - RNA, 20 nt, Salmonella enterica enterica serovar Typhi Ty2
gccgaaguucauaaauguac

SEQ ID NO: 1751843 - RNA, 20 nt, Salmonella enterica enterica serovar Typhi Ty2
gccgaagugugccagcagau

SEQ ID NO: 1751844 - RNA, 14 nt, Salmonella enterica enterica serovar Typhi Ty2
gccgaagugcgcgc

SEQ ID NO: 1751845 - RNA, 16 nt, Salmonella enterica enterica serovar Typhi Ty2
gccgaacucuuccacc

SEQ ID NO: 1751846 - RNA, 15 nt, Salmonella enterica enterica serovar Typhi Ty2
gccgaagcaggcgga

SEQ ID NO: 1751847 - RNA, 19 nt, Salmonella enterica enterica serovar Typhi Ty2
gccgacccccuccuuguaa

SEQ ID NO: 1751848 - RNA, 22 nt, Salmonella enterica enterica serovar Typhi Ty2
gccgaccauuggcaccaccagg

SEQ ID NO: 1751849 - RNA, 20 nt, Salmonella enterica enterica serovar Typhi Ty2
gccgacccgcaucgccgcgg

SEQ ID NO: 1751850 - RNA, 21 nt, Salmonella enterica enterica serovar Typhi Ty2
gccgacccgcaucgccgcggc

SEQ ID NO: 1751851 - RNA, 14 nt, Salmonella enterica enterica serovar Typhi Ty2
gccgaccggcgcgc

SEQ ID NO: 1751852 - RNA, 17 nt, Salmonella enterica enterica serovar Typhi Ty2
gccgaccgccagcagag

SEQ ID NO: 1751853 - RNA, 15 nt, Salmonella enterica enterica serovar Typhi Ty2
gccgaccaccagcuu

SEQ ID NO: 1751854 - RNA, 17 nt, Salmonella enterica enterica serovar Typhi Ty2
gccgaccaccauccggc

SEQ ID NO: 1751855 - RNA, 22 nt, Salmonella enterica enterica serovar Typhi Ty2
gccgaccacuucaacgccgcgc

SEQ ID NO: 1751856 - RNA, 17 nt, Salmonella enterica enterica serovar Typhi Ty2
gccgacaucgcucccgg

SEQ ID NO: 1751857 - RNA, 22 nt, Salmonella enterica enterica serovar Typhi Ty2
gccgacaugguuaaccaccagc

SEQ ID NO: 1751858 - RNA, 15 nt, Salmonella enterica enterica serovar Typhi Ty2
gccgacauucccugc

SEQ ID NO: 1751859 - RNA, 19 nt, Salmonella enterica enterica serovar Typhi Ty2
gccgaccaauugcaggcag

SEQ ID NO: 1751860 - RNA, 17 nt, Salmonella enterica enterica serovar Typhi Ty2
gccgacacaguaaaaaa

SEQ ID NO: 1751861 - RNA, 21 nt, Salmonella enterica enterica serovar Typhi Ty2
gccgacaucacgcaaaugcag

SEQ ID NO: 1751862 - RNA, 22 nt, Salmonella enterica enterica serovar Typhi Ty2
gccgacauaagugcaggcugag

SEQ ID NO: 1751863 - RNA, 18 nt, Salmonella enterica enterica serovar Typhi Ty2
gcccuguaacagaauuaa

SEQ ID NO: 1751864 - RNA, 13 nt, Salmonella enterica enterica serovar Typhi Ty2
gcccugcaaagca

SEQ ID NO: 1751865 - RNA, 15 nt, Salmonella enterica enterica serovar Typhi Ty2
gcccugacgccgcug

SEQ ID NO: 1751866 - RNA, 22 nt, Salmonella enterica enterica serovar Typhi Ty2
gcccugacgccgcuguuuucac

SEQ ID NO: 1751867 - RNA, 16 nt, Salmonella enterica enterica serovar Typhi Ty2
gcccugauggcgcgcc

SEQ ID NO: 1751868 - RNA, 14 nt, Salmonella enterica enterica serovar Typhi Ty2
gcccugcccgccag

SEQ ID NO: 1751869 - RNA, 14 nt, Salmonella enterica enterica serovar Typhi Ty2
gcccugcuggcgca

SEQ ID NO: 1751870 - RNA, 14 nt, Salmonella enterica enterica serovar Typhi Ty2
gcccuaucgcugcg

SEQ ID NO: 1751871 - RNA, 18 nt, Salmonella enterica enterica serovar Typhi Ty2
gcccgugguuuuacugca

SEQ ID NO: 1751872 - RNA, 15 nt, Salmonella enterica enterica serovar Typhi Ty2
gcccucgccagcaac

SEQ ID NO: 1751873 - RNA, 17 nt, Salmonella enterica enterica serovar Typhi Ty2
gcccggccacagcgcca

SEQ ID NO: 1751874 - RNA, 14 nt, Salmonella enterica enterica serovar Typhi Ty2
gcccggcaggcugg

SEQ ID NO: 1751875 - RNA, 14 nt, Salmonella enterica enterica serovar Typhi Ty2
gcccggcgccagcu

SEQ ID NO: 1751876 - RNA, 15 nt, Salmonella enterica enterica serovar Typhi Ty2
gcccggcuuucuguu

SEQ ID NO: 1751877 - RNA, 22 nt, Salmonella enterica enterica serovar Typhi Ty2
gcccgggagaacgccgggccug

SEQ ID NO: 1751878 - RNA, 19 nt, Salmonella enterica enterica serovar Typhi Ty2
gcccgggcacgauggccug

SEQ ID NO: 1751879 - RNA, 14 nt, Salmonella enterica enterica serovar Typhi Ty2
gcccggcuucccau

SEQ ID NO: 1751880 - RNA, 17 nt, Salmonella enterica enterica serovar Typhi Ty2
gcccggcgcgacaccuu

SEQ ID NO: 1751881 - RNA, 13 nt, Salmonella enterica enterica serovar Typhi Ty2
gcccggcgcggca

SEQ ID NO: 1751882 - RNA, 21 nt, Salmonella enterica enterica serovar Typhi Ty2
gcccgguaagaaugcgcguca

SEQ ID NO: 1751883 - RNA, 16 nt, Salmonella enterica enterica serovar Typhi Ty2
gcccgguaagcgcagc

SEQ ID NO: 1751884 - RNA, 23 nt, Salmonella enterica enterica serovar Typhi Ty2
gcccgguagcgcaaacuaccggg

SEQ ID NO: 1751885 - RNA, 14 nt, Salmonella enterica enterica serovar Typhi Ty2
gcccguaaacgggc

SEQ ID NO: 1751886 - RNA, 16 nt, Salmonella enterica enterica serovar Typhi Ty2
gcccgugacgccaggc

SEQ ID NO: 1751887 - RNA, 15 nt, Salmonella enterica enterica serovar Typhi Ty2
gcccguaaacaggcu

SEQ ID NO: 1751888 - RNA, 22 nt, Salmonella enterica enterica serovar Typhi Ty2
gcccgguggcggcuggcgccuu

SEQ ID NO: 1751889 - RNA, 15 nt, Salmonella enterica enterica serovar Typhi Ty2
gcccgguggcgcugc

SEQ ID NO: 1751890 - RNA, 20 nt, Salmonella enterica enterica serovar Typhi Ty2
gcccgguucgaacgacagaa

SEQ ID NO: 1751891 - RNA, 13 nt, Salmonella enterica enterica serovar Typhi Ty2
gcccgguucaccg

SEQ ID NO: 1751892 - RNA, 14 nt, Salmonella enterica enterica serovar Typhi Ty2
gccccugcgccagc

SEQ ID NO: 1751893 - RNA, 19 nt, Salmonella enterica enterica serovar Typhi Ty2
gccccugagcaaucaguuc

SEQ ID NO: 1751894 - RNA, 17 nt, Salmonella enterica enterica serovar Typhi Ty2
gcccagcuuaguaaccc

SEQ ID NO: 1751895 - RNA, 23 nt, Salmonella enterica enterica serovar Typhi Ty2
gcccaggccaaaaccacagugac

SEQ ID NO: 1751896 - RNA, 23 nt, Salmonella enterica enterica serovar Typhi Ty2
gccccguggcgggaugccccacu

SEQ ID NO: 1751897 - RNA, 14 nt, Salmonella enterica enterica serovar Typhi Ty2
gccccuaaggcagc

SEQ ID NO: 1751898 - RNA, 23 nt, Salmonella enterica enterica serovar Typhi Ty2
gccccguaucauuaggcggcgga

SEQ ID NO: 1751899 - RNA, 15 nt, Salmonella enterica enterica serovar Typhi Ty2
gccccguaucauuag

SEQ ID NO: 1751900 - RNA, 22 nt, Salmonella enterica enterica serovar Typhi Ty2
gccccggugcuuucuccugcgg

SEQ ID NO: 1751901 - RNA, 20 nt, Salmonella enterica enterica serovar Typhi Ty2
gccccucgcuaaugcccggc

SEQ ID NO: 1751902 - RNA, 20 nt, Salmonella enterica enterica serovar Typhi Ty2
gccccucaauuauguauuuc

SEQ ID NO: 1751903 - RNA, 11 nt, Salmonella enterica enterica serovar Typhi Ty2
gccccucccug

SEQ ID NO: 1751904 - RNA, 12 nt, Salmonella enterica enterica serovar Typhi Ty2
gccccucccuga

SEQ ID NO: 1751905 - RNA, 21 nt, Salmonella enterica enterica serovar Typhi Ty2
gcccggaugauuaucaucuau

SEQ ID NO: 1751906 - RNA, 21 nt, Salmonella enterica enterica serovar Typhi Ty2
gcccggagggguuuucgccag

SEQ ID NO: 1751907 - RNA, 22 nt, Salmonella enterica enterica serovar Typhi Ty2
gcccgccugagcgcgcaguggg

SEQ ID NO: 1751908 - RNA, 17 nt, Salmonella enterica enterica serovar Typhi Ty2
gcccgccugagcgcgca

SEQ ID NO: 1751909 - RNA, 22 nt, Salmonella enterica enterica serovar Typhi Ty2
gcccgccugcuguaaccccugc

SEQ ID NO: 1751910 - RNA, 12 nt, Salmonella enterica enterica serovar Typhi Ty2
gcccgccgggcg

SEQ ID NO: 1751911 - RNA, 16 nt, Salmonella enterica enterica serovar Typhi Ty2
gcccgccugagcgcgc

SEQ ID NO: 1751912 - RNA, 14 nt, Salmonella enterica enterica serovar Typhi Ty2
gcccgcccagcauu

SEQ ID NO: 1751913 - RNA, 14 nt, Salmonella enterica enterica serovar Typhi Ty2
gcccgauggcgcug

SEQ ID NO: 1751914 - RNA, 15 nt, Salmonella enterica enterica serovar Typhi Ty2
gcccgauggcgcugc

SEQ ID NO: 1751915 - RNA, 17 nt, Salmonella enterica enterica serovar Typhi Ty2
gcccgaugagcuugcac

SEQ ID NO: 1751916 - RNA, 17 nt, Salmonella enterica enterica serovar Typhi Ty2
gcccgauggcgcugcgu

SEQ ID NO: 1751917 - RNA, 13 nt, Salmonella enterica enterica serovar Typhi Ty2
gcccgccagcggg

SEQ ID NO: 1751918 - RNA, 21 nt, Salmonella enterica enterica serovar Typhi Ty2
gcccgcaaacagagcgccggc

SEQ ID NO: 1751919 - RNA, 17 nt, Salmonella enterica enterica serovar Typhi Ty2
gcacugcaccuggucga

SEQ ID NO: 1751920 - RNA, 16 nt, Salmonella enterica enterica serovar Typhi Ty2
gcacucgcgacauggc

SEQ ID NO: 1751921 - RNA, 17 nt, Salmonella enterica enterica serovar Typhi Ty2
gcacugauagccgccag

SEQ ID NO: 1751922 - RNA, 15 nt, Salmonella enterica enterica serovar Typhi Ty2
gcacguuuuccaggu

SEQ ID NO: 1751923 - RNA, 23 nt, Salmonella enterica enterica serovar Typhi Ty2
gcacguuaaagccgaccaucgcg

SEQ ID NO: 1751924 - RNA, 22 nt, Salmonella enterica enterica serovar Typhi Ty2
gcacucagaaaauuauuuuaaa

SEQ ID NO: 1751925 - RNA, 14 nt, Salmonella enterica enterica serovar Typhi Ty2
gcacucaccucuuc

SEQ ID NO: 1751926 - RNA, 19 nt, Salmonella enterica enterica serovar Typhi Ty2
gcacuaucgggcauuucag

SEQ ID NO: 1751927 - RNA, 19 nt, Salmonella enterica enterica serovar Typhi Ty2
gcacuacggauggcccugc

SEQ ID NO: 1751928 - RNA, 16 nt, Salmonella enterica enterica serovar Typhi Ty2
gcacuaacagcagcag

SEQ ID NO: 1751929 - RNA, 17 nt, Salmonella enterica enterica serovar Typhi Ty2
gcacggcaagcgcggcg

SEQ ID NO: 1751930 - RNA, 16 nt, Salmonella enterica enterica serovar Typhi Ty2
gcacggaugcaucaug

SEQ ID NO: 1751931 - RNA, 17 nt, Salmonella enterica enterica serovar Typhi Ty2
gcacgcuuuuuugcugg

SEQ ID NO: 1751932 - RNA, 14 nt, Salmonella enterica enterica serovar Typhi Ty2
gcacggauacugcu

SEQ ID NO: 1751933 - RNA, 22 nt, Salmonella enterica enterica serovar Typhi Ty2
gcacgcuauauuccagccagga

SEQ ID NO: 1751934 - RNA, 18 nt, Salmonella enterica enterica serovar Typhi Ty2
gcacgcuaaagcgcuggc

SEQ ID NO: 1751935 - RNA, 15 nt, Salmonella enterica enterica serovar Typhi Ty2
gcacgccgcccgccu

SEQ ID NO: 1751936 - RNA, 22 nt, Salmonella enterica enterica serovar Typhi Ty2
gcacgcuuuuuugcuggcuggc

SEQ ID NO: 1751937 - RNA, 17 nt, Salmonella enterica enterica serovar Typhi Ty2
gcacgcugguagccucg

SEQ ID NO: 1751938 - RNA, 22 nt, Salmonella enterica enterica serovar Typhi Ty2
gcacguagccccuaucuggugc

SEQ ID NO: 1751939 - RNA, 15 nt, Salmonella enterica enterica serovar Typhi Ty2
gcacgucgucccagg

SEQ ID NO: 1751940 - RNA, 17 nt, Salmonella enterica enterica serovar Typhi Ty2
gcacgggcaaagccgcc

SEQ ID NO: 1751941 - RNA, 16 nt, Salmonella enterica enterica serovar Typhi Ty2
gcaccagaaucauuaa

SEQ ID NO: 1751942 - RNA, 13 nt, Salmonella enterica enterica serovar Typhi Ty2
gcaccagcaacac

SEQ ID NO: 1751943 - RNA, 20 nt, Salmonella enterica enterica serovar Typhi Ty2
gcaccagcucuacaucgccg

SEQ ID NO: 1751944 - RNA, 14 nt, Salmonella enterica enterica serovar Typhi Ty2
gcaccuccagcgcc

SEQ ID NO: 1751945 - RNA, 15 nt, Salmonella enterica enterica serovar Typhi Ty2
gcaccguaaacggcu

SEQ ID NO: 1751946 - RNA, 15 nt, Salmonella enterica enterica serovar Typhi Ty2
gcacgaaaaauaaaa

SEQ ID NO: 1751947 - RNA, 22 nt, Salmonella enterica enterica serovar Typhi Ty2
gcaccuucaacagcucgccaug

SEQ ID NO: 1751948 - RNA, 15 nt, Salmonella enterica enterica serovar Typhi Ty2
gcacgccaucgccug

SEQ ID NO: 1751949 - RNA, 21 nt, Salmonella enterica enterica serovar Typhi Ty2
gcacgcccgcauucauaagca

SEQ ID NO: 1751950 - RNA, 18 nt, Salmonella enterica enterica serovar Typhi Ty2
gcacgcccuucgucagga

SEQ ID NO: 1751951 - RNA, 16 nt, Salmonella enterica enterica serovar Typhi Ty2
gcacgacguagcccau

SEQ ID NO: 1751952 - RNA, 23 nt, Salmonella enterica enterica serovar Typhi Ty2
gcaaugcugacgacauucagcac

SEQ ID NO: 1751953 - RNA, 21 nt, Salmonella enterica enterica serovar Typhi Ty2
gcaaugcgcuuuuuuugcccu

SEQ ID NO: 1751954 - RNA, 11 nt, Salmonella enterica enterica serovar Typhi Ty2
gcaaucuggcg

SEQ ID NO: 1751955 - RNA, 20 nt, Salmonella enterica enterica serovar Typhi Ty2
gcaaucucuuuauugcuggu

SEQ ID NO: 1751956 - RNA, 21 nt, Salmonella enterica enterica serovar Typhi Ty2
gcaaucaauacagagauauua

SEQ ID NO: 1751957 - RNA, 23 nt, Salmonella enterica enterica serovar Typhi Ty2
gcaauauucaugccagaagcaaa

SEQ ID NO: 1751958 - RNA, 18 nt, Salmonella enterica enterica serovar Typhi Ty2
gcaaucucuggccaggca

SEQ ID NO: 1751959 - RNA, 15 nt, Salmonella enterica enterica serovar Typhi Ty2
gcaaucucacugccc

SEQ ID NO: 1751960 - RNA, 16 nt, Salmonella enterica enterica serovar Typhi Ty2
gcaaucacauacagca

SEQ ID NO: 1751961 - RNA, 17 nt, Salmonella enterica enterica serovar Typhi Ty2
gcaaucacaagcuguuu

SEQ ID NO: 1751962 - RNA, 14 nt, Salmonella enterica enterica serovar Typhi Ty2
gcaauagaguaaug

SEQ ID NO: 1751963 - RNA, 17 nt, Salmonella enterica enterica serovar Typhi Ty2
gcaauagaguaaugaca

SEQ ID NO: 1751964 - RNA, 16 nt, Salmonella enterica enterica serovar Typhi Ty2
gcaaguauuggcugcc

SEQ ID NO: 1751965 - RNA, 14 nt, Salmonella enterica enterica serovar Typhi Ty2
gcaagucaccauca

SEQ ID NO: 1751966 - RNA, 17 nt, Salmonella enterica enterica serovar Typhi Ty2
gcaaggucugcgcccac

SEQ ID NO: 1751967 - RNA, 17 nt, Salmonella enterica enterica serovar Typhi Ty2
gcaagcauaaaaaacau

SEQ ID NO: 1751968 - RNA, 20 nt, Salmonella enterica enterica serovar Typhi Ty2
gcaagcauaaaaaacaucau

SEQ ID NO: 1751969 - RNA, 22 nt, Salmonella enterica enterica serovar Typhi Ty2
gcaagcaucugauauaucuuca

SEQ ID NO: 1751970 - RNA, 19 nt, Salmonella enterica enterica serovar Typhi Ty2
gcaagaaccgcuuuuccug

SEQ ID NO: 1751971 - RNA, 16 nt, Salmonella enterica enterica serovar Typhi Ty2
gcaagauuucaaaacc

SEQ ID NO: 1751972 - RNA, 15 nt, Salmonella enterica enterica serovar Typhi Ty2
gcaacuuagugucca

SEQ ID NO: 1751973 - RNA, 14 nt, Salmonella enterica enterica serovar Typhi Ty2
gcaacuuaauaaua

SEQ ID NO: 1751974 - RNA, 21 nt, Salmonella enterica enterica serovar Typhi Ty2
gcaacuuacgcccuauccggc

SEQ ID NO: 1751975 - RNA, 14 nt, Salmonella enterica enterica serovar Typhi Ty2
gcaaauucuuuuca

SEQ ID NO: 1751976 - RNA, 23 nt, Salmonella enterica enterica serovar Typhi Ty2
gcaaauucuguaucgcuuauuuu

SEQ ID NO: 1751977 - RNA, 23 nt, Salmonella enterica enterica serovar Typhi Ty2
gcacauuuuuaucaggccugccu

SEQ ID NO: 1751978 - RNA, 13 nt, Salmonella enterica enterica serovar Typhi Ty2
gcacaccauuuca

SEQ ID NO: 1751979 - RNA, 19 nt, Salmonella enterica enterica serovar Typhi Ty2
gcacacgcuggaagagaac

SEQ ID NO: 1751980 - RNA, 14 nt, Salmonella enterica enterica serovar Typhi Ty2
gcacacgucugagc

SEQ ID NO: 1751981 - RNA, 15 nt, Salmonella enterica enterica serovar Typhi Ty2
gcacacuuucaucag

SEQ ID NO: 1751982 - RNA, 21 nt, Salmonella enterica enterica serovar Typhi Ty2
gcacaucaugaugaucuucag

SEQ ID NO: 1751983 - RNA, 22 nt, Salmonella enterica enterica serovar Typhi Ty2
gcacaucaugaugaucuucagc

SEQ ID NO: 1751984 - RNA, 18 nt, Salmonella enterica enterica serovar Typhi Ty2
gcaauuuaccuauuucga

SEQ ID NO: 1751985 - RNA, 12 nt, Salmonella enterica enterica serovar Typhi Ty2
gcaauuucucgc

SEQ ID NO: 1751986 - RNA, 23 nt, Salmonella enterica enterica serovar Typhi Ty2
gcaauuugauagcgccacgcuuc

SEQ ID NO: 1751987 - RNA, 16 nt, Salmonella enterica enterica serovar Typhi Ty2
gcacaacggccagcaa

SEQ ID NO: 1751988 - RNA, 11 nt, Salmonella enterica enterica serovar Typhi Ty2
gcacaagccau

SEQ ID NO: 1751989 - RNA, 20 nt, Salmonella enterica enterica serovar Typhi Ty2
gcacaauaccaauaagaacu

SEQ ID NO: 1751990 - RNA, 12 nt, Salmonella enterica enterica serovar Typhi Ty2
gcacaauaccaa

SEQ ID NO: 1751991 - RNA, 13 nt, Salmonella enterica enterica serovar Typhi Ty2
gcacaauuccggc

SEQ ID NO: 1751992 - RNA, 23 nt, Salmonella enterica enterica serovar Typhi Ty2
gcacaauagcgcuaaacagcgcc

SEQ ID NO: 1751993 - RNA, 18 nt, Salmonella enterica enterica serovar Typhi Ty2
gcaaugggggcuugcgcc

SEQ ID NO: 1751994 - RNA, 21 nt, Salmonella enterica enterica serovar Typhi Ty2
gcaaugugcgccagaauugcc

SEQ ID NO: 1751995 - RNA, 20 nt, Salmonella enterica enterica serovar Typhi Ty2
gcaauguuccccugaugcgu

SEQ ID NO: 1751996 - RNA, 12 nt, Salmonella enterica enterica serovar Typhi Ty2
gcaauuaauauu

SEQ ID NO: 1751997 - RNA, 23 nt, Salmonella enterica enterica serovar Typhi Ty2
gcaauucgagauuuuucugcgcc

SEQ ID NO: 1751998 - RNA, 17 nt, Salmonella enterica enterica serovar Typhi Ty2
gcaauuccgcuuucuuc

SEQ ID NO: 1751999 - RNA, 17 nt, Salmonella enterica enterica serovar Typhi Ty2
gcaauugauacauuuuu

SEQ ID NO: 1752000 - RNA, 21 nt, Salmonella enterica enterica serovar Typhi Ty2
gcaauuccggcgaaaaaccga

SEQ ID NO: 1752001 - RNA, 15 nt, Salmonella enterica enterica serovar Typhi Ty2
gcauccaguuucuuc

SEQ ID NO: 1752002 - RNA, 21 nt, Salmonella enterica enterica serovar Typhi Ty2
gcauccagcacgagcgccagc

SEQ ID NO: 1752003 - RNA, 15 nt, Salmonella enterica enterica serovar Typhi Ty2
gcauccagcacgagc

SEQ ID NO: 1752004 - RNA, 15 nt, Salmonella enterica enterica serovar Typhi Ty2
gcaucauucaucucg

SEQ ID NO: 1752005 - RNA, 21 nt, Salmonella enterica enterica serovar Typhi Ty2
gcaucccgcuggcgccaccgc

SEQ ID NO: 1752006 - RNA, 11 nt, Salmonella enterica enterica serovar Typhi Ty2
gcaucccggca

SEQ ID NO: 1752007 - RNA, 15 nt, Salmonella enterica enterica serovar Typhi Ty2
gcaucccgcaggcgg

SEQ ID NO: 1752008 - RNA, 21 nt, Salmonella enterica enterica serovar Typhi Ty2
gcaucccggugucaaagcgcc

SEQ ID NO: 1752009 - RNA, 23 nt, Salmonella enterica enterica serovar Typhi Ty2
gcaucccggugucaaagcgccag

SEQ ID NO: 1752010 - RNA, 17 nt, Salmonella enterica enterica serovar Typhi Ty2
gcaucccgucccaccac

SEQ ID NO: 1752011 - RNA, 14 nt, Salmonella enterica enterica serovar Typhi Ty2
gcauccgccgccgc

SEQ ID NO: 1752012 - RNA, 23 nt, Salmonella enterica enterica serovar Typhi Ty2
gcauccgcggcgcuuugcuucuc

SEQ ID NO: 1752013 - RNA, 13 nt, Salmonella enterica enterica serovar Typhi Ty2
gcaucgacgccag

SEQ ID NO: 1752014 - RNA, 20 nt, Salmonella enterica enterica serovar Typhi Ty2
gcaucgacauccgauuucau

SEQ ID NO: 1752015 - RNA, 21 nt, Salmonella enterica enterica serovar Typhi Ty2
gcaucgauuuuucaucuucag

SEQ ID NO: 1752016 - RNA, 23 nt, Salmonella enterica enterica serovar Typhi Ty2
gcauccuuaugggucacauccag

SEQ ID NO: 1752017 - RNA, 23 nt, Salmonella enterica enterica serovar Typhi Ty2
gcauccugcggguucaucgccac

SEQ ID NO: 1752018 - RNA, 18 nt, Salmonella enterica enterica serovar Typhi Ty2
gcauccguagcuucagcu

SEQ ID NO: 1752019 - RNA, 18 nt, Salmonella enterica enterica serovar Typhi Ty2
gcauccuccauccaggua

SEQ ID NO: 1752020 - RNA, 18 nt, Salmonella enterica enterica serovar Typhi Ty2
gcauccgugaccugcuga

SEQ ID NO: 1752021 - RNA, 13 nt, Salmonella enterica enterica serovar Typhi Ty2
gcauccucuuucc

SEQ ID NO: 1752022 - RNA, 14 nt, Salmonella enterica enterica serovar Typhi Ty2
gcauccggcaucaa

SEQ ID NO: 1752023 - RNA, 16 nt, Salmonella enterica enterica serovar Typhi Ty2
gcauccggaaucgccg

SEQ ID NO: 1752024 - RNA, 15 nt, Salmonella enterica enterica serovar Typhi Ty2
gcauccggacgccag

SEQ ID NO: 1752025 - RNA, 16 nt, Salmonella enterica enterica serovar Typhi Ty2
gcauccggcaauucaa

SEQ ID NO: 1752026 - RNA, 22 nt, Salmonella enterica enterica serovar Typhi Ty2
gcaucagaaaaaccuccggcua

SEQ ID NO: 1752027 - RNA, 17 nt, Salmonella enterica enterica serovar Typhi Ty2
gcaucagacuacuuuua

SEQ ID NO: 1752028 - RNA, 14 nt, Salmonella enterica enterica serovar Typhi Ty2
gcaucagaaaaacc

SEQ ID NO: 1752029 - RNA, 15 nt, Salmonella enterica enterica serovar Typhi Ty2
gcaucagaaaaaccu

SEQ ID NO: 1752030 - RNA, 13 nt, Salmonella enterica enterica serovar Typhi Ty2
gcaucagaaaaac

SEQ ID NO: 1752031 - RNA, 16 nt, Salmonella enterica enterica serovar Typhi Ty2
gcaucagaacaaacuu

SEQ ID NO: 1752032 - RNA, 22 nt, Salmonella enterica enterica serovar Typhi Ty2
gcaucaggaaauccuggauacg

SEQ ID NO: 1752033 - RNA, 13 nt, Salmonella enterica enterica serovar Typhi Ty2
gcaucauaaaagg

SEQ ID NO: 1752034 - RNA, 22 nt, Salmonella enterica enterica serovar Typhi Ty2
gcaucaugggcucaucaaacag

SEQ ID NO: 1752035 - RNA, 17 nt, Salmonella enterica enterica serovar Typhi Ty2
gcaucaucucccaggcc

SEQ ID NO: 1752036 - RNA, 23 nt, Salmonella enterica enterica serovar Typhi Ty2
gcauaucuggcgaggcuuugucc

SEQ ID NO: 1752037 - RNA, 22 nt, Salmonella enterica enterica serovar Typhi Ty2
gcauauucauaucgaagcccag

SEQ ID NO: 1752038 - RNA, 17 nt, Salmonella enterica enterica serovar Typhi Ty2
gcaucaauaaaaucacc

SEQ ID NO: 1752039 - RNA, 23 nt, Salmonella enterica enterica serovar Typhi Ty2
gcaucaagcugcuggcgagcagg

SEQ ID NO: 1752040 - RNA, 22 nt, Salmonella enterica enterica serovar Typhi Ty2
gcaucaagcugcuggcgagcag

SEQ ID NO: 1752041 - RNA, 20 nt, Salmonella enterica enterica serovar Typhi Ty2
gcaucaauggcgucaaacag

SEQ ID NO: 1752042 - RNA, 14 nt, Salmonella enterica enterica serovar Typhi Ty2
gcaucacaugcggg

SEQ ID NO: 1752043 - RNA, 16 nt, Salmonella enterica enterica serovar Typhi Ty2
gcaucaaauaccuuuu

SEQ ID NO: 1752044 - RNA, 13 nt, Salmonella enterica enterica serovar Typhi Ty2
gcaucaacgccag

SEQ ID NO: 1752045 - RNA, 16 nt, Salmonella enterica enterica serovar Typhi Ty2
gcagguugagucugcu

SEQ ID NO: 1752046 - RNA, 20 nt, Salmonella enterica enterica serovar Typhi Ty2
gcagguugccgaugacuccc

SEQ ID NO: 1752047 - RNA, 19 nt, Salmonella enterica enterica serovar Typhi Ty2
gcaggugauggcggcuugg

SEQ ID NO: 1752048 - RNA, 17 nt, Salmonella enterica enterica serovar Typhi Ty2
gcagggaugacagaaag

SEQ ID NO: 1752049 - RNA, 18 nt, Salmonella enterica enterica serovar Typhi Ty2
gcagggaucguuuuucuu

SEQ ID NO: 1752050 - RNA, 20 nt, Salmonella enterica enterica serovar Typhi Ty2
gcaguauugcaccaggaaga

SEQ ID NO: 1752051 - RNA, 15 nt, Salmonella enterica enterica serovar Typhi Ty2
gcaguauuucagaac

SEQ ID NO: 1752052 - RNA, 17 nt, Salmonella enterica enterica serovar Typhi Ty2
gcaguauugcaccagga

SEQ ID NO: 1752053 - RNA, 18 nt, Salmonella enterica enterica serovar Typhi Ty2
gcaguaugaccccuccgg

SEQ ID NO: 1752054 - RNA, 22 nt, Salmonella enterica enterica serovar Typhi Ty2
gcaguauccgugccgagguggu

SEQ ID NO: 1752055 - RNA, 13 nt, Salmonella enterica enterica serovar Typhi Ty2
gcaguagccaugc

SEQ ID NO: 1752056 - RNA, 19 nt, Salmonella enterica enterica serovar Typhi Ty2
gcaguagauucuaucuguu

SEQ ID NO: 1752057 - RNA, 18 nt, Salmonella enterica enterica serovar Typhi Ty2
gcagugauucguaguaag

SEQ ID NO: 1752058 - RNA, 12 nt, Salmonella enterica enterica serovar Typhi Ty2
gcagugauuuua

SEQ ID NO: 1752059 - RNA, 15 nt, Salmonella enterica enterica serovar Typhi Ty2
gcagucccgccggga

SEQ ID NO: 1752060 - RNA, 22 nt, Salmonella enterica enterica serovar Typhi Ty2
gcagucaaaacgacauaaccgg

SEQ ID NO: 1752061 - RNA, 19 nt, Salmonella enterica enterica serovar Typhi Ty2
gcauacucacgaauaagaa

SEQ ID NO: 1752062 - RNA, 20 nt, Salmonella enterica enterica serovar Typhi Ty2
gcauacucuccuccauaccu

SEQ ID NO: 1752063 - RNA, 14 nt, Salmonella enterica enterica serovar Typhi Ty2
gcauagaaaaagaa

SEQ ID NO: 1752064 - RNA, 17 nt, Salmonella enterica enterica serovar Typhi Ty2
gcauagaauuucagggu

SEQ ID NO: 1752065 - RNA, 20 nt, Salmonella enterica enterica serovar Typhi Ty2
gcauaauuguggaaauaaga

SEQ ID NO: 1752066 - RNA, 17 nt, Salmonella enterica enterica serovar Typhi Ty2
gcauauacucacugaau

SEQ ID NO: 1752067 - RNA, 18 nt, Salmonella enterica enterica serovar Typhi Ty2
gcauauaagagacgccaa

SEQ ID NO: 1752068 - RNA, 19 nt, Salmonella enterica enterica serovar Typhi Ty2
gcauauccagcgccugcgc

SEQ ID NO: 1752069 - RNA, 14 nt, Salmonella enterica enterica serovar Typhi Ty2
gcauauccagcgcc

SEQ ID NO: 1752070 - RNA, 18 nt, Salmonella enterica enterica serovar Typhi Ty2
gcauaauaaagcagcggc

SEQ ID NO: 1752071 - RNA, 15 nt, Salmonella enterica enterica serovar Typhi Ty2
gcauaauauccagga

SEQ ID NO: 1752072 - RNA, 13 nt, Salmonella enterica enterica serovar Typhi Ty2
gcauaauaugcaa

SEQ ID NO: 1752073 - RNA, 23 nt, Salmonella enterica enterica serovar Typhi Ty2
gcauaauacggggccauuauuua

SEQ ID NO: 1752074 - RNA, 15 nt, Salmonella enterica enterica serovar Typhi Ty2
gcauaaaaaaugaga

SEQ ID NO: 1752075 - RNA, 19 nt, Salmonella enterica enterica serovar Typhi Ty2
gcauaaaaaaugagaaagg

SEQ ID NO: 1752076 - RNA, 14 nt, Salmonella enterica enterica serovar Typhi Ty2
gcauaaaaaaugag

SEQ ID NO: 1752077 - RNA, 14 nt, Salmonella enterica enterica serovar Typhi Ty2
gcauaaaaaagagg

SEQ ID NO: 1752078 - RNA, 17 nt, Salmonella enterica enterica serovar Typhi Ty2
gcagugcucgccaaaac

SEQ ID NO: 1752079 - RNA, 15 nt, Salmonella enterica enterica serovar Typhi Ty2
gcaguuuuuauccuc

SEQ ID NO: 1752080 - RNA, 15 nt, Salmonella enterica enterica serovar Typhi Ty2
gcagcuuggcggcuu

SEQ ID NO: 1752081 - RNA, 17 nt, Salmonella enterica enterica serovar Typhi Ty2
gcagcuugcaggcaaaa

SEQ ID NO: 1752082 - RNA, 13 nt, Salmonella enterica enterica serovar Typhi Ty2
gcaggcaaaucaa

SEQ ID NO: 1752083 - RNA, 22 nt, Salmonella enterica enterica serovar Typhi Ty2
gcaggcaaaucaacauuauuaa

SEQ ID NO: 1752084 - RNA, 19 nt, Salmonella enterica enterica serovar Typhi Ty2
gcaggcaaaacgggcggcg

SEQ ID NO: 1752085 - RNA, 18 nt, Salmonella enterica enterica serovar Typhi Ty2
gcaggcauuaaaaaaacg

SEQ ID NO: 1752086 - RNA, 17 nt, Salmonella enterica enterica serovar Typhi Ty2
gcaggcauuaaaaaaac

SEQ ID NO: 1752087 - RNA, 17 nt, Salmonella enterica enterica serovar Typhi Ty2
gcaggcaggucuccagc

SEQ ID NO: 1752088 - RNA, 18 nt, Salmonella enterica enterica serovar Typhi Ty2
gcaggcauaaaaaagagg

SEQ ID NO: 1752089 - RNA, 21 nt, Salmonella enterica enterica serovar Typhi Ty2
gcaggcacuguggugugccug

SEQ ID NO: 1752090 - RNA, 20 nt, Salmonella enterica enterica serovar Typhi Ty2
gcaggcuaacgcgccccagg

SEQ ID NO: 1752091 - RNA, 20 nt, Salmonella enterica enterica serovar Typhi Ty2
gcaggcgucauagccgcgcg

SEQ ID NO: 1752092 - RNA, 19 nt, Salmonella enterica enterica serovar Typhi Ty2
gcaggcgucauagccgcgc

SEQ ID NO: 1752093 - RNA, 18 nt, Salmonella enterica enterica serovar Typhi Ty2
gcaggcgucaaaacaggu

SEQ ID NO: 1752094 - RNA, 16 nt, Salmonella enterica enterica serovar Typhi Ty2
gcaggcggcuucgcau

SEQ ID NO: 1752095 - RNA, 18 nt, Salmonella enterica enterica serovar Typhi Ty2
gcaggcgauagccccagu

SEQ ID NO: 1752096 - RNA, 22 nt, Salmonella enterica enterica serovar Typhi Ty2
gcagcgucugcccuccugaaua

SEQ ID NO: 1752097 - RNA, 19 nt, Salmonella enterica enterica serovar Typhi Ty2
gcagcguaauacaggcgau

SEQ ID NO: 1752098 - RNA, 18 nt, Salmonella enterica enterica serovar Typhi Ty2
gcagcguaauagucugcu

SEQ ID NO: 1752099 - RNA, 20 nt, Salmonella enterica enterica serovar Typhi Ty2
gcagcgugaaacgcccuucc

SEQ ID NO: 1752100 - RNA, 22 nt, Salmonella enterica enterica serovar Typhi Ty2
gcagcucugccuguagcagcgc

SEQ ID NO: 1752101 - RNA, 13 nt, Salmonella enterica enterica serovar Typhi Ty2
gcagcucugccug

SEQ ID NO: 1752102 - RNA, 16 nt, Salmonella enterica enterica serovar Typhi Ty2
gcagcugccacaccac

SEQ ID NO: 1752103 - RNA, 22 nt, Salmonella enterica enterica serovar Typhi Ty2
gcagcugcuguaugauuucacc

SEQ ID NO: 1752104 - RNA, 15 nt, Salmonella enterica enterica serovar Typhi Ty2
gcagcgccuucgcuu

SEQ ID NO: 1752105 - RNA, 18 nt, Salmonella enterica enterica serovar Typhi Ty2
gcagcgcgcgacccagcg

SEQ ID NO: 1752106 - RNA, 14 nt, Salmonella enterica enterica serovar Typhi Ty2
gcagcgcggccugc

SEQ ID NO: 1752107 - RNA, 13 nt, Salmonella enterica enterica serovar Typhi Ty2
gcagcgcggccug

SEQ ID NO: 1752108 - RNA, 15 nt, Salmonella enterica enterica serovar Typhi Ty2
gcagcggcugcgccu

SEQ ID NO: 1752109 - RNA, 20 nt, Salmonella enterica enterica serovar Typhi Ty2
gcagcggcguaucuuccagc

SEQ ID NO: 1752110 - RNA, 21 nt, Salmonella enterica enterica serovar Typhi Ty2
gcagcggcguaucuuccagcg

SEQ ID NO: 1752111 - RNA, 14 nt, Salmonella enterica enterica serovar Typhi Ty2
gcagcgcuuucacc

SEQ ID NO: 1752112 - RNA, 21 nt, Salmonella enterica enterica serovar Typhi Ty2
gcacuggcuuacucgcccugc

SEQ ID NO: 1752113 - RNA, 21 nt, Salmonella enterica enterica serovar Typhi Ty2
gcacuuacucuacauucuguu

SEQ ID NO: 1752114 - RNA, 22 nt, Salmonella enterica enterica serovar Typhi Ty2
gcagcaaaucagcuacuuuaaa

SEQ ID NO: 1752115 - RNA, 18 nt, Salmonella enterica enterica serovar Typhi Ty2
gcagcaaaucagcuacuu

SEQ ID NO: 1752116 - RNA, 17 nt, Salmonella enterica enterica serovar Typhi Ty2
gcagcaaacgccauagc

SEQ ID NO: 1752117 - RNA, 13 nt, Salmonella enterica enterica serovar Typhi Ty2
gcagauuuuuauc

SEQ ID NO: 1752118 - RNA, 18 nt, Salmonella enterica enterica serovar Typhi Ty2
gcagcauaucgccguuca

SEQ ID NO: 1752119 - RNA, 22 nt, Salmonella enterica enterica serovar Typhi Ty2
gcagcaguuccccgccgcggcg

SEQ ID NO: 1752120 - RNA, 15 nt, Salmonella enterica enterica serovar Typhi Ty2
gcagcaucccggcaa

SEQ ID NO: 1752121 - RNA, 19 nt, Salmonella enterica enterica serovar Typhi Ty2
gcagcaucccggcaaaaau

SEQ ID NO: 1752122 - RNA, 20 nt, Salmonella enterica enterica serovar Typhi Ty2
gcagcaccagauauuuuucc

SEQ ID NO: 1752123 - RNA, 13 nt, Salmonella enterica enterica serovar Typhi Ty2
gcagcagcaggcu

SEQ ID NO: 1752124 - RNA, 14 nt, Salmonella enterica enterica serovar Typhi Ty2
gcagcgcaucaucc

SEQ ID NO: 1752125 - RNA, 15 nt, Salmonella enterica enterica serovar Typhi Ty2
gcagccgggccagac

SEQ ID NO: 1752126 - RNA, 15 nt, Salmonella enterica enterica serovar Typhi Ty2
gcagcgauauuucuc

SEQ ID NO: 1752127 - RNA, 21 nt, Salmonella enterica enterica serovar Typhi Ty2
gcagcgccauugagcauucua

SEQ ID NO: 1752128 - RNA, 15 nt, Salmonella enterica enterica serovar Typhi Ty2
gcagcgccaucaggc

SEQ ID NO: 1752129 - RNA, 22 nt, Salmonella enterica enterica serovar Typhi Ty2
gcagcauugggucaugcggaug

SEQ ID NO: 1752130 - RNA, 21 nt, Salmonella enterica enterica serovar Typhi Ty2
gcagcccuuugagaaaacugc

SEQ ID NO: 1752131 - RNA, 17 nt, Salmonella enterica enterica serovar Typhi Ty2
gcagccgcucaggguaa

SEQ ID NO: 1752132 - RNA, 21 nt, Salmonella enterica enterica serovar Typhi Ty2
gcagccccggcauccaguucc

SEQ ID NO: 1752133 - RNA, 18 nt, Salmonella enterica enterica serovar Typhi Ty2
gcagcccgcccacaggcu

SEQ ID NO: 1752134 - RNA, 22 nt, Salmonella enterica enterica serovar Typhi Ty2
gcaaagcccacgcccugcaaug

SEQ ID NO: 1752135 - RNA, 13 nt, Salmonella enterica enterica serovar Typhi Ty2
gcaaagccccagu

SEQ ID NO: 1752136 - RNA, 19 nt, Salmonella enterica enterica serovar Typhi Ty2
gcaaagcccacgcccugca

SEQ ID NO: 1752137 - RNA, 22 nt, Salmonella enterica enterica serovar Typhi Ty2
gcaaagcccaucagcgccagcc

SEQ ID NO: 1752138 - RNA, 16 nt, Salmonella enterica enterica serovar Typhi Ty2
gcaaagcguugcaacc

SEQ ID NO: 1752139 - RNA, 18 nt, Salmonella enterica enterica serovar Typhi Ty2
gcaaagcucaacgcaggc

SEQ ID NO: 1752140 - RNA, 15 nt, Salmonella enterica enterica serovar Typhi Ty2
gcaaagguugccgca

SEQ ID NO: 1752141 - RNA, 19 nt, Salmonella enterica enterica serovar Typhi Ty2
gcaaaguacgggugaagca

SEQ ID NO: 1752142 - RNA, 22 nt, Salmonella enterica enterica serovar Typhi Ty2
gcaaagucgaacgacugaguau

SEQ ID NO: 1752143 - RNA, 15 nt, Salmonella enterica enterica serovar Typhi Ty2
gcaaauuaugauuca

SEQ ID NO: 1752144 - RNA, 21 nt, Salmonella enterica enterica serovar Typhi Ty2
gcaaaugauuaucuccaucuu

SEQ ID NO: 1752145 - RNA, 20 nt, Salmonella enterica enterica serovar Typhi Ty2
gcaaaucccugaucggccag

SEQ ID NO: 1752146 - RNA, 22 nt, Salmonella enterica enterica serovar Typhi Ty2
gcaaaucugccgucaucgacuu

SEQ ID NO: 1752147 - RNA, 20 nt, Salmonella enterica enterica serovar Typhi Ty2
gcaaaucgcccaucacaugu

SEQ ID NO: 1752148 - RNA, 20 nt, Salmonella enterica enterica serovar Typhi Ty2
gcaaauacuggaaaaaacgg

SEQ ID NO: 1752149 - RNA, 19 nt, Salmonella enterica enterica serovar Typhi Ty2
gcaaauacugcuuuuccgg

SEQ ID NO: 1752150 - RNA, 19 nt, Salmonella enterica enterica serovar Typhi Ty2
gcaaauagguuuuaugcau

SEQ ID NO: 1752151 - RNA, 19 nt, Salmonella enterica enterica serovar Typhi Ty2
gcaaauaccggacagacuu

SEQ ID NO: 1752152 - RNA, 19 nt, Salmonella enterica enterica serovar Typhi Ty2
gcaaauaccacaucagacc

SEQ ID NO: 1752153 - RNA, 16 nt, Salmonella enterica enterica serovar Typhi Ty2
gcaaauacaucgccac

SEQ ID NO: 1752154 - RNA, 20 nt, Salmonella enterica enterica serovar Typhi Ty2
gcaaaucaacauuauuaaaa

SEQ ID NO: 1752155 - RNA, 13 nt, Salmonella enterica enterica serovar Typhi Ty2
gcaaaucaccaca

SEQ ID NO: 1752156 - RNA, 19 nt, Salmonella enterica enterica serovar Typhi Ty2
gcaaaucagcuacuuuaaa

SEQ ID NO: 1752157 - RNA, 18 nt, Salmonella enterica enterica serovar Typhi Ty2
gcaaaccggcaugaagac

SEQ ID NO: 1752158 - RNA, 13 nt, Salmonella enterica enterica serovar Typhi Ty2
gcaaaccucuccc

SEQ ID NO: 1752159 - RNA, 20 nt, Salmonella enterica enterica serovar Typhi Ty2
gcaaaccgggguaucuguuu

SEQ ID NO: 1752160 - RNA, 15 nt, Salmonella enterica enterica serovar Typhi Ty2
gcaaacgauaaaagc

SEQ ID NO: 1752161 - RNA, 18 nt, Salmonella enterica enterica serovar Typhi Ty2
gcaaacgauaaaagcucu

SEQ ID NO: 1752162 - RNA, 14 nt, Salmonella enterica enterica serovar Typhi Ty2
gcaaacgccauagc

SEQ ID NO: 1752163 - RNA, 19 nt, Salmonella enterica enterica serovar Typhi Ty2
gcaaacggaauagcgccuu

SEQ ID NO: 1752164 - RNA, 14 nt, Salmonella enterica enterica serovar Typhi Ty2
gcaaacgccgccug

SEQ ID NO: 1752165 - RNA, 20 nt, Salmonella enterica enterica serovar Typhi Ty2
gcaaacggcacuacagcccu

SEQ ID NO: 1752166 - RNA, 16 nt, Salmonella enterica enterica serovar Typhi Ty2
gcaaacguaaaacgcg

SEQ ID NO: 1752167 - RNA, 15 nt, Salmonella enterica enterica serovar Typhi Ty2
gcaaacucagcggcu

SEQ ID NO: 1752168 - RNA, 16 nt, Salmonella enterica enterica serovar Typhi Ty2
gcaaacgguuaauacu

SEQ ID NO: 1752169 - RNA, 18 nt, Salmonella enterica enterica serovar Typhi Ty2
gcaaacgguuaauacuga

SEQ ID NO: 1752170 - RNA, 23 nt, Salmonella enterica enterica serovar Typhi Ty2
gcaaacgguaaacgugccacagu

SEQ ID NO: 1752171 - RNA, 15 nt, Salmonella enterica enterica serovar Typhi Ty2
gcaaacugcgcgccc

SEQ ID NO: 1752172 - RNA, 15 nt, Salmonella enterica enterica serovar Typhi Ty2
gcaaacugaucgagg

SEQ ID NO: 1752173 - RNA, 15 nt, Salmonella enterica enterica serovar Typhi Ty2
gcaaacugccaggca

SEQ ID NO: 1752174 - RNA, 22 nt, Salmonella enterica enterica serovar Typhi Ty2
gcaaacuguauccguaauauga

SEQ ID NO: 1752175 - RNA, 16 nt, Salmonella enterica enterica serovar Typhi Ty2
gcaaagauaaucugaa

SEQ ID NO: 1752176 - RNA, 22 nt, Salmonella enterica enterica serovar Typhi Ty2
gcaaacuuugcgccauuucaau

SEQ ID NO: 1752177 - RNA, 17 nt, Salmonella enterica enterica serovar Typhi Ty2
gcaaagaagggcagggg

SEQ ID NO: 1752178 - RNA, 13 nt, Salmonella enterica enterica serovar Typhi Ty2
gcaaaauuacuuc

SEQ ID NO: 1752179 - RNA, 15 nt, Salmonella enterica enterica serovar Typhi Ty2
gcaaaauucacacca

SEQ ID NO: 1752180 - RNA, 18 nt, Salmonella enterica enterica serovar Typhi Ty2
gcaaacaccucagccacc

SEQ ID NO: 1752181 - RNA, 18 nt, Salmonella enterica enterica serovar Typhi Ty2
gcaaaagggccauggcug

SEQ ID NO: 1752182 - RNA, 14 nt, Salmonella enterica enterica serovar Typhi Ty2
gcaaaaaucagccc

SEQ ID NO: 1752183 - RNA, 23 nt, Salmonella enterica enterica serovar Typhi Ty2
gcaaaauaguucagcgcagagug

SEQ ID NO: 1752184 - RNA, 15 nt, Salmonella enterica enterica serovar Typhi Ty2
gcaaaauauauaauu

SEQ ID NO: 1752185 - RNA, 14 nt, Salmonella enterica enterica serovar Typhi Ty2
gcaaaaugcuucuu

SEQ ID NO: 1752186 - RNA, 19 nt, Salmonella enterica enterica serovar Typhi Ty2
gcaaaauggcaauugcgcc

SEQ ID NO: 1752187 - RNA, 21 nt, Salmonella enterica enterica serovar Typhi Ty2
gcaaaaucguuaaccagcggc

SEQ ID NO: 1752188 - RNA, 14 nt, Salmonella enterica enterica serovar Typhi Ty2
gcaaaaaaggccag

SEQ ID NO: 1752189 - RNA, 15 nt, Salmonella enterica enterica serovar Typhi Ty2
gcaaaaauaggcuuu

SEQ ID NO: 1752190 - RNA, 23 nt, Salmonella enterica enterica serovar Typhi Ty2
gauuuuuaccgccgguuuauccc

SEQ ID NO: 1752191 - RNA, 16 nt, Salmonella enterica enterica serovar Typhi Ty2
gauuuuuaaaauguuu

SEQ ID NO: 1752192 - RNA, 15 nt, Salmonella enterica enterica serovar Typhi Ty2
gauuuuucauugcaa

SEQ ID NO: 1752193 - RNA, 17 nt, Salmonella enterica enterica serovar Typhi Ty2
gauuuuaucaagucgcg

SEQ ID NO: 1752194 - RNA, 14 nt, Salmonella enterica enterica serovar Typhi Ty2
gauuucuucuggcu

SEQ ID NO: 1752195 - RNA, 16 nt, Salmonella enterica enterica serovar Typhi Ty2
gauuucaucaggcuga

SEQ ID NO: 1752196 - RNA, 16 nt, Salmonella enterica enterica serovar Typhi Ty2
gauuuauucuuugucu

SEQ ID NO: 1752197 - RNA, 19 nt, Salmonella enterica enterica serovar Typhi Ty2
gauuugcgaaucauguuuu

SEQ ID NO: 1752198 - RNA, 16 nt, Salmonella enterica enterica serovar Typhi Ty2
gauuugccgcgccuuc

SEQ ID NO: 1752199 - RNA, 14 nt, Salmonella enterica enterica serovar Typhi Ty2
gauuugcccuucca

SEQ ID NO: 1752200 - RNA, 17 nt, Salmonella enterica enterica serovar Typhi Ty2
gauuugcccuuccagca

SEQ ID NO: 1752201 - RNA, 21 nt, Salmonella enterica enterica serovar Typhi Ty2
gauugaggcggguaauuugcg

SEQ ID NO: 1752202 - RNA, 17 nt, Salmonella enterica enterica serovar Typhi Ty2
gauuauuucauuaaucu

SEQ ID NO: 1752203 - RNA, 15 nt, Salmonella enterica enterica serovar Typhi Ty2
gauuauuguuaaaaa

SEQ ID NO: 1752204 - RNA, 13 nt, Salmonella enterica enterica serovar Typhi Ty2
gauucuucugccu

SEQ ID NO: 1752205 - RNA, 18 nt, Salmonella enterica enterica serovar Typhi Ty2
gauucuggcgaguuucac

SEQ ID NO: 1752206 - RNA, 15 nt, Salmonella enterica enterica serovar Typhi Ty2
gauucugcaggccaa

SEQ ID NO: 1752207 - RNA, 16 nt, Salmonella enterica enterica serovar Typhi Ty2
gauuacugcgugcugg

SEQ ID NO: 1752208 - RNA, 18 nt, Salmonella enterica enterica serovar Typhi Ty2
gauuacucucuugccagc

SEQ ID NO: 1752209 - RNA, 20 nt, Salmonella enterica enterica serovar Typhi Ty2
gauuacucucuugccagcgc

SEQ ID NO: 1752210 - RNA, 16 nt, Salmonella enterica enterica serovar Typhi Ty2
gauuacggaacaaaac

SEQ ID NO: 1752211 - RNA, 16 nt, Salmonella enterica enterica serovar Typhi Ty2
gauuacgacccacaau

SEQ ID NO: 1752212 - RNA, 19 nt, Salmonella enterica enterica serovar Typhi Ty2
gauuaauaaaauuuuugcc

SEQ ID NO: 1752213 - RNA, 18 nt, Salmonella enterica enterica serovar Typhi Ty2
gauuaccgggauuuccau

SEQ ID NO: 1752214 - RNA, 22 nt, Salmonella enterica enterica serovar Typhi Ty2
gauuaccgggauuuccauauua

SEQ ID NO: 1752215 - RNA, 16 nt, Salmonella enterica enterica serovar Typhi Ty2
gauuaaucagcagaua

SEQ ID NO: 1752216 - RNA, 20 nt, Salmonella enterica enterica serovar Typhi Ty2
gauuaagcgaauccagcgcc

SEQ ID NO: 1752217 - RNA, 16 nt, Salmonella enterica enterica serovar Typhi Ty2
gauuaucggccagcgc

SEQ ID NO: 1752218 - RNA, 20 nt, Salmonella enterica enterica serovar Typhi Ty2
gauuacuucaggcugccaac

SEQ ID NO: 1752219 - RNA, 23 nt, Salmonella enterica enterica serovar Typhi Ty2
gauuaucagaaggcuugauacug

SEQ ID NO: 1752220 - RNA, 21 nt, Salmonella enterica enterica serovar Typhi Ty2
gauuaucaggaugaauaugaa

SEQ ID NO: 1752221 - RNA, 20 nt, Salmonella enterica enterica serovar Typhi Ty2
gauuaucaggaugaauauga

SEQ ID NO: 1752222 - RNA, 11 nt, Salmonella enterica enterica serovar Typhi Ty2
gauuauccagu

SEQ ID NO: 1752223 - RNA, 13 nt, Salmonella enterica enterica serovar Typhi Ty2
gauuaaccagcag

SEQ ID NO: 1752224 - RNA, 15 nt, Salmonella enterica enterica serovar Typhi Ty2
gauuaacggcaaaaa

SEQ ID NO: 1752225 - RNA, 16 nt, Salmonella enterica enterica serovar Typhi Ty2
gauuaacaagcagaua

SEQ ID NO: 1752226 - RNA, 23 nt, Salmonella enterica enterica serovar Typhi Ty2
gauuaaauggaucgacaucuuca

SEQ ID NO: 1752227 - RNA, 22 nt, Salmonella enterica enterica serovar Typhi Ty2
gaugucauccgguucacccacu

SEQ ID NO: 1752228 - RNA, 15 nt, Salmonella enterica enterica serovar Typhi Ty2
gaugucauaaucgcc

SEQ ID NO: 1752229 - RNA, 20 nt, Salmonella enterica enterica serovar Typhi Ty2
gauguccgucuuuucugucg

SEQ ID NO: 1752230 - RNA, 14 nt, Salmonella enterica enterica serovar Typhi Ty2
gaugucgccacgcc

SEQ ID NO: 1752231 - RNA, 13 nt, Salmonella enterica enterica serovar Typhi Ty2
gaugguuucuucg

SEQ ID NO: 1752232 - RNA, 13 nt, Salmonella enterica enterica serovar Typhi Ty2
gaugguuaagcag

SEQ ID NO: 1752233 - RNA, 17 nt, Salmonella enterica enterica serovar Typhi Ty2
gauguaaaaccuggcac

SEQ ID NO: 1752234 - RNA, 22 nt, Salmonella enterica enterica serovar Typhi Ty2
gauguacuguauucgguggaaa

SEQ ID NO: 1752235 - RNA, 18 nt, Salmonella enterica enterica serovar Typhi Ty2
gauggcggcgucgccugu

SEQ ID NO: 1752236 - RNA, 14 nt, Salmonella enterica enterica serovar Typhi Ty2
gauggcgcuccuga

SEQ ID NO: 1752237 - RNA, 15 nt, Salmonella enterica enterica serovar Typhi Ty2
gauggcgcuccugaa

SEQ ID NO: 1752238 - RNA, 17 nt, Salmonella enterica enterica serovar Typhi Ty2
gauggcgcuccugaauc

SEQ ID NO: 1752239 - RNA, 17 nt, Salmonella enterica enterica serovar Typhi Ty2
gauggcgcugcgcuuau

SEQ ID NO: 1752240 - RNA, 21 nt, Salmonella enterica enterica serovar Typhi Ty2
gauggcgauucauaugcgcca

SEQ ID NO: 1752241 - RNA, 16 nt, Salmonella enterica enterica serovar Typhi Ty2
gauggcgaucagcgcc

SEQ ID NO: 1752242 - RNA, 19 nt, Salmonella enterica enterica serovar Typhi Ty2
gauggcacgauaaccagau

SEQ ID NO: 1752243 - RNA, 15 nt, Salmonella enterica enterica serovar Typhi Ty2
gauggauaaccugcc

SEQ ID NO: 1752244 - RNA, 22 nt, Salmonella enterica enterica serovar Typhi Ty2
gaugcuugccauauugccgcac

SEQ ID NO: 1752245 - RNA, 19 nt, Salmonella enterica enterica serovar Typhi Ty2
gaugcugucuuagugaaag

SEQ ID NO: 1752246 - RNA, 22 nt, Salmonella enterica enterica serovar Typhi Ty2
gaugcuaaccucuauaguaaau

SEQ ID NO: 1752247 - RNA, 22 nt, Salmonella enterica enterica serovar Typhi Ty2
gaugcguucuagcuuaucgcca

SEQ ID NO: 1752248 - RNA, 17 nt, Salmonella enterica enterica serovar Typhi Ty2
gaugcguauccagcgcg

SEQ ID NO: 1752249 - RNA, 14 nt, Salmonella enterica enterica serovar Typhi Ty2
gaugcguucaaaga

SEQ ID NO: 1752250 - RNA, 15 nt, Salmonella enterica enterica serovar Typhi Ty2
gaugcgacucggugc

SEQ ID NO: 1752251 - RNA, 15 nt, Salmonella enterica enterica serovar Typhi Ty2
gaugcgaaucuucau

SEQ ID NO: 1752252 - RNA, 14 nt, Salmonella enterica enterica serovar Typhi Ty2
gaugcgccauccca

SEQ ID NO: 1752253 - RNA, 16 nt, Salmonella enterica enterica serovar Typhi Ty2
gaugcgccauccacca

SEQ ID NO: 1752254 - RNA, 20 nt, Salmonella enterica enterica serovar Typhi Ty2
gaugcgccagccagucgcca

SEQ ID NO: 1752255 - RNA, 18 nt, Salmonella enterica enterica serovar Typhi Ty2
gaugcgccaguucagcgu

SEQ ID NO: 1752256 - RNA, 20 nt, Salmonella enterica enterica serovar Typhi Ty2
gaugcaggccaagcagcgcc

SEQ ID NO: 1752257 - RNA, 14 nt, Salmonella enterica enterica serovar Typhi Ty2
gaugcaggcgccug

SEQ ID NO: 1752258 - RNA, 15 nt, Salmonella enterica enterica serovar Typhi Ty2
gaugcauaaaaaaac

SEQ ID NO: 1752259 - RNA, 15 nt, Salmonella enterica enterica serovar Typhi Ty2
gaugagcaggccagg

SEQ ID NO: 1752260 - RNA, 21 nt, Salmonella enterica enterica serovar Typhi Ty2
gaugagcgugacgaccggcac

SEQ ID NO: 1752261 - RNA, 15 nt, Salmonella enterica enterica serovar Typhi Ty2
gaugaucuucagccc

SEQ ID NO: 1752262 - RNA, 12 nt, Salmonella enterica enterica serovar Typhi Ty2
gaugaucuucau

SEQ ID NO: 1752263 - RNA, 13 nt, Salmonella enterica enterica serovar Typhi Ty2
gaugaucuucaua

SEQ ID NO: 1752264 - RNA, 19 nt, Salmonella enterica enterica serovar Typhi Ty2
gaugacucauuaaaaaaac

SEQ ID NO: 1752265 - RNA, 14 nt, Salmonella enterica enterica serovar Typhi Ty2
gaucguaugcgccu

SEQ ID NO: 1752266 - RNA, 15 nt, Salmonella enterica enterica serovar Typhi Ty2
gaucguaggcggcgg

SEQ ID NO: 1752267 - RNA, 18 nt, Salmonella enterica enterica serovar Typhi Ty2
gaucguaaaaugaaaaac

SEQ ID NO: 1752268 - RNA, 22 nt, Salmonella enterica enterica serovar Typhi Ty2
gaucgucgcgaucgcgccagcc

SEQ ID NO: 1752269 - RNA, 17 nt, Salmonella enterica enterica serovar Typhi Ty2
gaucguaugcgccuguu

SEQ ID NO: 1752270 - RNA, 13 nt, Salmonella enterica enterica serovar Typhi Ty2
gauccggcagcca

SEQ ID NO: 1752271 - RNA, 20 nt, Salmonella enterica enterica serovar Typhi Ty2
gauccguucgaucagcuggc

SEQ ID NO: 1752272 - RNA, 14 nt, Salmonella enterica enterica serovar Typhi Ty2
gauccguuucagaa

SEQ ID NO: 1752273 - RNA, 19 nt, Salmonella enterica enterica serovar Typhi Ty2
gaucgacaaaccacugcug

SEQ ID NO: 1752274 - RNA, 20 nt, Salmonella enterica enterica serovar Typhi Ty2
gauccuguaaaaaauccagc

SEQ ID NO: 1752275 - RNA, 22 nt, Salmonella enterica enterica serovar Typhi Ty2
gauccaccaaguauuugaguuc

SEQ ID NO: 1752276 - RNA, 23 nt, Salmonella enterica enterica serovar Typhi Ty2
gauccaacacaucgacaugcaga

SEQ ID NO: 1752277 - RNA, 16 nt, Salmonella enterica enterica serovar Typhi Ty2
gauccaccaccagcau

SEQ ID NO: 1752278 - RNA, 20 nt, Salmonella enterica enterica serovar Typhi Ty2
gauccaccaccagcaucacg

SEQ ID NO: 1752279 - RNA, 21 nt, Salmonella enterica enterica serovar Typhi Ty2
gauccagccccagcgccagcu

SEQ ID NO: 1752280 - RNA, 20 nt, Salmonella enterica enterica serovar Typhi Ty2
gauccagaacugcgaaauca

SEQ ID NO: 1752281 - RNA, 20 nt, Salmonella enterica enterica serovar Typhi Ty2
gauccgaugcgcuuuacugu

SEQ ID NO: 1752282 - RNA, 16 nt, Salmonella enterica enterica serovar Typhi Ty2
gaucccggccuucgaa

SEQ ID NO: 1752283 - RNA, 20 nt, Salmonella enterica enterica serovar Typhi Ty2
gaucccgggcgauaaaccag

SEQ ID NO: 1752284 - RNA, 19 nt, Salmonella enterica enterica serovar Typhi Ty2
gaucccuaauaaaauaacu

SEQ ID NO: 1752285 - RNA, 16 nt, Salmonella enterica enterica serovar Typhi Ty2
gaucggguuuuccuga

SEQ ID NO: 1752286 - RNA, 14 nt, Salmonella enterica enterica serovar Typhi Ty2
gaucggcuggcgca

SEQ ID NO: 1752287 - RNA, 15 nt, Salmonella enterica enterica serovar Typhi Ty2
gaucgggcuuccagc

SEQ ID NO: 1752288 - RNA, 20 nt, Salmonella enterica enterica serovar Typhi Ty2
gaucggcgcagguccauuuu

SEQ ID NO: 1752289 - RNA, 14 nt, Salmonella enterica enterica serovar Typhi Ty2
gaucggcgcaggga

SEQ ID NO: 1752290 - RNA, 13 nt, Salmonella enterica enterica serovar Typhi Ty2
gaucgcuccauuc

SEQ ID NO: 1752291 - RNA, 18 nt, Salmonella enterica enterica serovar Typhi Ty2
gaucggcaaacagcuuca

SEQ ID NO: 1752292 - RNA, 20 nt, Salmonella enterica enterica serovar Typhi Ty2
gaucggaaaucaaaccaucc

SEQ ID NO: 1752293 - RNA, 18 nt, Salmonella enterica enterica serovar Typhi Ty2
gaucgauauaucgcguca

SEQ ID NO: 1752294 - RNA, 20 nt, Salmonella enterica enterica serovar Typhi Ty2
gaucgcauuuaaucgccugc

SEQ ID NO: 1752295 - RNA, 14 nt, Salmonella enterica enterica serovar Typhi Ty2
gaucgcgcagcagg

SEQ ID NO: 1752296 - RNA, 10 nt, Salmonella enterica enterica serovar Typhi Ty2
gaucgccugg

SEQ ID NO: 1752297 - RNA, 22 nt, Salmonella enterica enterica serovar Typhi Ty2
gaucgccgguuuugguaucuuc

SEQ ID NO: 1752298 - RNA, 20 nt, Salmonella enterica enterica serovar Typhi Ty2
gauauuguguuuaccucaua

SEQ ID NO: 1752299 - RNA, 20 nt, Salmonella enterica enterica serovar Typhi Ty2
gauauugugcauacugauuu

SEQ ID NO: 1752300 - RNA, 16 nt, Salmonella enterica enterica serovar Typhi Ty2
gauauuacuaauaaaa

SEQ ID NO: 1752301 - RNA, 17 nt, Salmonella enterica enterica serovar Typhi Ty2
gauauuacuuuccagca

SEQ ID NO: 1752302 - RNA, 14 nt, Salmonella enterica enterica serovar Typhi Ty2
gauaugcagcagcc

SEQ ID NO: 1752303 - RNA, 23 nt, Salmonella enterica enterica serovar Typhi Ty2
gauaugaugcgccccgcuucccg

SEQ ID NO: 1752304 - RNA, 23 nt, Salmonella enterica enterica serovar Typhi Ty2
gauaugaauaauuucggcggcgc

SEQ ID NO: 1752305 - RNA, 19 nt, Salmonella enterica enterica serovar Typhi Ty2
gauaugcgacgaaagcggc

SEQ ID NO: 1752306 - RNA, 20 nt, Salmonella enterica enterica serovar Typhi Ty2
gauaugcgggggcaguaaau

SEQ ID NO: 1752307 - RNA, 18 nt, Salmonella enterica enterica serovar Typhi Ty2
gauaugcuugccggaugc

SEQ ID NO: 1752308 - RNA, 23 nt, Salmonella enterica enterica serovar Typhi Ty2
gauauggccguuuucaugcacga

SEQ ID NO: 1752309 - RNA, 14 nt, Salmonella enterica enterica serovar Typhi Ty2
gauaucgccccaga

SEQ ID NO: 1752310 - RNA, 23 nt, Salmonella enterica enterica serovar Typhi Ty2
gauaucgucauuaacgggaaacu

SEQ ID NO: 1752311 - RNA, 23 nt, Salmonella enterica enterica serovar Typhi Ty2
gauaucuuuauucgcuuguuuca

SEQ ID NO: 1752312 - RNA, 12 nt, Salmonella enterica enterica serovar Typhi Ty2
gauaucuuccag

SEQ ID NO: 1752313 - RNA, 21 nt, Salmonella enterica enterica serovar Typhi Ty2
gauauccagcaccucaucacc

SEQ ID NO: 1752314 - RNA, 14 nt, Salmonella enterica enterica serovar Typhi Ty2
gauagcaucuuccu

SEQ ID NO: 1752315 - RNA, 20 nt, Salmonella enterica enterica serovar Typhi Ty2
gauauccaccaccugauucu

SEQ ID NO: 1752316 - RNA, 17 nt, Salmonella enterica enterica serovar Typhi Ty2
gaucaggaaaucuucca

SEQ ID NO: 1752317 - RNA, 14 nt, Salmonella enterica enterica serovar Typhi Ty2
gaucaagcgggggc

SEQ ID NO: 1752318 - RNA, 18 nt, Salmonella enterica enterica serovar Typhi Ty2
gaucagcgcgcuccagac

SEQ ID NO: 1752319 - RNA, 22 nt, Salmonella enterica enterica serovar Typhi Ty2
gauauuuauuauuuccagguua

SEQ ID NO: 1752320 - RNA, 15 nt, Salmonella enterica enterica serovar Typhi Ty2
gauauuuaaaacugg

SEQ ID NO: 1752321 - RNA, 21 nt, Salmonella enterica enterica serovar Typhi Ty2
gauaaucacggcggaggccga

SEQ ID NO: 1752322 - RNA, 17 nt, Salmonella enterica enterica serovar Typhi Ty2
gauaauagccucauccc

SEQ ID NO: 1752323 - RNA, 17 nt, Salmonella enterica enterica serovar Typhi Ty2
gauaauaguggugcgca

SEQ ID NO: 1752324 - RNA, 14 nt, Salmonella enterica enterica serovar Typhi Ty2
gauaauaaucauau

SEQ ID NO: 1752325 - RNA, 18 nt, Salmonella enterica enterica serovar Typhi Ty2
gauaaccuguaaauaaua

SEQ ID NO: 1752326 - RNA, 17 nt, Salmonella enterica enterica serovar Typhi Ty2
gauaaccuauuuugcaa

SEQ ID NO: 1752327 - RNA, 22 nt, Salmonella enterica enterica serovar Typhi Ty2
gauaaaguuagcguuauggaag

SEQ ID NO: 1752328 - RNA, 14 nt, Salmonella enterica enterica serovar Typhi Ty2
gauaacgcgcuggc

SEQ ID NO: 1752329 - RNA, 15 nt, Salmonella enterica enterica serovar Typhi Ty2
gauaacgcgcuggcg

SEQ ID NO: 1752330 - RNA, 15 nt, Salmonella enterica enterica serovar Typhi Ty2
gauaacgcaacaaca

SEQ ID NO: 1752331 - RNA, 18 nt, Salmonella enterica enterica serovar Typhi Ty2
gauaacggcgcaaagaca

SEQ ID NO: 1752332 - RNA, 22 nt, Salmonella enterica enterica serovar Typhi Ty2
gauaacgcgauggccaaauaac

SEQ ID NO: 1752333 - RNA, 15 nt, Salmonella enterica enterica serovar Typhi Ty2
gauaacguauuucuu

SEQ ID NO: 1752334 - RNA, 20 nt, Salmonella enterica enterica serovar Typhi Ty2
gauaacggucgcucccuacc

SEQ ID NO: 1752335 - RNA, 16 nt, Salmonella enterica enterica serovar Typhi Ty2
gauaauucccccagua

SEQ ID NO: 1752336 - RNA, 19 nt, Salmonella enterica enterica serovar Typhi Ty2
gauaauucugacuugcugu

SEQ ID NO: 1752337 - RNA, 18 nt, Salmonella enterica enterica serovar Typhi Ty2
gauaaucgccgccagcuc

SEQ ID NO: 1752338 - RNA, 20 nt, Salmonella enterica enterica serovar Typhi Ty2
gauaauguuggauuauacau

SEQ ID NO: 1752339 - RNA, 18 nt, Salmonella enterica enterica serovar Typhi Ty2
gauaauguugguaaauuu

SEQ ID NO: 1752340 - RNA, 20 nt, Salmonella enterica enterica serovar Typhi Ty2
gauaauggcgccgauaacac

SEQ ID NO: 1752341 - RNA, 14 nt, Salmonella enterica enterica serovar Typhi Ty2
gauaccagauuaau

SEQ ID NO: 1752342 - RNA, 22 nt, Salmonella enterica enterica serovar Typhi Ty2
gauaccagccuucggacugcug

SEQ ID NO: 1752343 - RNA, 12 nt, Salmonella enterica enterica serovar Typhi Ty2
gauaccagauua

SEQ ID NO: 1752344 - RNA, 16 nt, Salmonella enterica enterica serovar Typhi Ty2
gauacccccuaucugg

SEQ ID NO: 1752345 - RNA, 20 nt, Salmonella enterica enterica serovar Typhi Ty2
gauacccagcgucccggcgu

SEQ ID NO: 1752346 - RNA, 20 nt, Salmonella enterica enterica serovar Typhi Ty2
gauacaggacugacugcugu

SEQ ID NO: 1752347 - RNA, 15 nt, Salmonella enterica enterica serovar Typhi Ty2
gauacaccuucacau

SEQ ID NO: 1752348 - RNA, 12 nt, Salmonella enterica enterica serovar Typhi Ty2
gauagaugaaga

SEQ ID NO: 1752349 - RNA, 23 nt, Salmonella enterica enterica serovar Typhi Ty2
gauagauuugauucguuuaagua

SEQ ID NO: 1752350 - RNA, 14 nt, Salmonella enterica enterica serovar Typhi Ty2
gauacuguuuuugc

SEQ ID NO: 1752351 - RNA, 21 nt, Salmonella enterica enterica serovar Typhi Ty2
gauacugccgcccaucgccac

SEQ ID NO: 1752352 - RNA, 14 nt, Salmonella enterica enterica serovar Typhi Ty2
gauacgccagcaga

SEQ ID NO: 1752353 - RNA, 15 nt, Salmonella enterica enterica serovar Typhi Ty2
gauacgccagcagac

SEQ ID NO: 1752354 - RNA, 14 nt, Salmonella enterica enterica serovar Typhi Ty2
gauacgccagguua

SEQ ID NO: 1752355 - RNA, 16 nt, Salmonella enterica enterica serovar Typhi Ty2
gauacgcuggcacagg

SEQ ID NO: 1752356 - RNA, 20 nt, Salmonella enterica enterica serovar Typhi Ty2
gauacgcgucaaagcacaug

SEQ ID NO: 1752357 - RNA, 18 nt, Salmonella enterica enterica serovar Typhi Ty2
gauacgcgucaaauagag

SEQ ID NO: 1752358 - RNA, 17 nt, Salmonella enterica enterica serovar Typhi Ty2
gauacgggaucgauaau

SEQ ID NO: 1752359 - RNA, 21 nt, Salmonella enterica enterica serovar Typhi Ty2
gauacuggaagugauccuuca

SEQ ID NO: 1752360 - RNA, 16 nt, Salmonella enterica enterica serovar Typhi Ty2
gauaaaggauaauagu

SEQ ID NO: 1752361 - RNA, 17 nt, Salmonella enterica enterica serovar Typhi Ty2
gauaaagcuuucaucuu

SEQ ID NO: 1752362 - RNA, 16 nt, Salmonella enterica enterica serovar Typhi Ty2
gauaaagugacgaggc

SEQ ID NO: 1752363 - RNA, 17 nt, Salmonella enterica enterica serovar Typhi Ty2
gauaaagcgaauaacau

SEQ ID NO: 1752364 - RNA, 22 nt, Salmonella enterica enterica serovar Typhi Ty2
gauaaagcgcucaugccacgcc

SEQ ID NO: 1752365 - RNA, 15 nt, Salmonella enterica enterica serovar Typhi Ty2
gauaaaauaaacacu

SEQ ID NO: 1752366 - RNA, 13 nt, Salmonella enterica enterica serovar Typhi Ty2
gauaaaauuguua

SEQ ID NO: 1752367 - RNA, 16 nt, Salmonella enterica enterica serovar Typhi Ty2
gauaaaaagcaaagag

SEQ ID NO: 1752368 - RNA, 14 nt, Salmonella enterica enterica serovar Typhi Ty2
gauaaaaaaaguau

SEQ ID NO: 1752369 - RNA, 22 nt, Salmonella enterica enterica serovar Typhi Ty2
gauaaaaacccaccagcgccag

SEQ ID NO: 1752370 - RNA, 18 nt, Salmonella enterica enterica serovar Typhi Ty2
gauaaaaacacccgcacc

SEQ ID NO: 1752371 - RNA, 13 nt, Salmonella enterica enterica serovar Typhi Ty2
gauaaaaaaagua

SEQ ID NO: 1752372 - RNA, 15 nt, Salmonella enterica enterica serovar Typhi Ty2
gaguucgguuaacug

SEQ ID NO: 1752373 - RNA, 18 nt, Salmonella enterica enterica serovar Typhi Ty2
gaguucguuaaucucaaa

SEQ ID NO: 1752374 - RNA, 17 nt, Salmonella enterica enterica serovar Typhi Ty2
gaguuaguggucauauu

SEQ ID NO: 1752375 - RNA, 12 nt, Salmonella enterica enterica serovar Typhi Ty2
gaguuccuccug

SEQ ID NO: 1752376 - RNA, 14 nt, Salmonella enterica enterica serovar Typhi Ty2
gaauuugccccaga

SEQ ID NO: 1752377 - RNA, 19 nt, Salmonella enterica enterica serovar Typhi Ty2
gaauuucgcgaauaaucug

SEQ ID NO: 1752378 - RNA, 17 nt, Salmonella enterica enterica serovar Typhi Ty2
gagucaaggcauccagc

SEQ ID NO: 1752379 - RNA, 18 nt, Salmonella enterica enterica serovar Typhi Ty2
gagucaaaagauugauuu

SEQ ID NO: 1752380 - RNA, 18 nt, Salmonella enterica enterica serovar Typhi Ty2
gagucagacaccagcccu

SEQ ID NO: 1752381 - RNA, 18 nt, Salmonella enterica enterica serovar Typhi Ty2
gagucagaaacggccugg

SEQ ID NO: 1752382 - RNA, 22 nt, Salmonella enterica enterica serovar Typhi Ty2
gaguauuuaccuacuguggugu

SEQ ID NO: 1752383 - RNA, 21 nt, Salmonella enterica enterica serovar Typhi Ty2
gaguaugcccgcgagagauua

SEQ ID NO: 1752384 - RNA, 18 nt, Salmonella enterica enterica serovar Typhi Ty2
gaguaugaacaggcagcg

SEQ ID NO: 1752385 - RNA, 19 nt, Salmonella enterica enterica serovar Typhi Ty2
gagucugaaaacucacgcc

SEQ ID NO: 1752386 - RNA, 21 nt, Salmonella enterica enterica serovar Typhi Ty2
gagugcgcggcgaaaaagccg

SEQ ID NO: 1752387 - RNA, 17 nt, Salmonella enterica enterica serovar Typhi Ty2
gaguggagcggucgaca

SEQ ID NO: 1752388 - RNA, 19 nt, Salmonella enterica enterica serovar Typhi Ty2
gagugcguucuuccacuuc

SEQ ID NO: 1752389 - RNA, 19 nt, Salmonella enterica enterica serovar Typhi Ty2
gagucuacaucaagagaaa

SEQ ID NO: 1752390 - RNA, 14 nt, Salmonella enterica enterica serovar Typhi Ty2
gagucuauuuccuc

SEQ ID NO: 1752391 - RNA, 19 nt, Salmonella enterica enterica serovar Typhi Ty2
gagucggaucaugaaaaau

SEQ ID NO: 1752392 - RNA, 14 nt, Salmonella enterica enterica serovar Typhi Ty2
gaguccagcggcag

SEQ ID NO: 1752393 - RNA, 12 nt, Salmonella enterica enterica serovar Typhi Ty2
cuuuuacugccc

SEQ ID NO: 1752394 - RNA, 14 nt, Salmonella enterica enterica serovar Typhi Ty2
cuuuuagcaccaga

SEQ ID NO: 1752395 - RNA, 14 nt, Salmonella enterica enterica serovar Typhi Ty2
cuuuuagcgcgccg

SEQ ID NO: 1752396 - RNA, 22 nt, Salmonella enterica enterica serovar Typhi Ty2
cuuuuacaagaauaugcagugc

SEQ ID NO: 1752397 - RNA, 19 nt, Salmonella enterica enterica serovar Typhi Ty2
cuuuuaccuuacggacugc

SEQ ID NO: 1752398 - RNA, 16 nt, Salmonella enterica enterica serovar Typhi Ty2
cuuuuacccuucaugu

SEQ ID NO: 1752399 - RNA, 16 nt, Salmonella enterica enterica serovar Typhi Ty2
cuuuuaguauuuacaa

SEQ ID NO: 1752400 - RNA, 21 nt, Salmonella enterica enterica serovar Typhi Ty2
cuuuucacccaacauuuuuag

SEQ ID NO: 1752401 - RNA, 18 nt, Salmonella enterica enterica serovar Typhi Ty2
cuuuucacgcauugccac

SEQ ID NO: 1752402 - RNA, 21 nt, Salmonella enterica enterica serovar Typhi Ty2
cuuuucagcccaggcuuuagu

SEQ ID NO: 1752403 - RNA, 19 nt, Salmonella enterica enterica serovar Typhi Ty2
cuuuucauccacagcgcca

SEQ ID NO: 1752404 - RNA, 17 nt, Salmonella enterica enterica serovar Typhi Ty2
cuuuucaggucuggauu

SEQ ID NO: 1752405 - RNA, 22 nt, Salmonella enterica enterica serovar Typhi Ty2
cuuuuauuauuuugauacucau

SEQ ID NO: 1752406 - RNA, 21 nt, Salmonella enterica enterica serovar Typhi Ty2
cuuuucaagaauuacaucaau

SEQ ID NO: 1752407 - RNA, 22 nt, Salmonella enterica enterica serovar Typhi Ty2
cuuuucccguaaugcccaggcg

SEQ ID NO: 1752408 - RNA, 18 nt, Salmonella enterica enterica serovar Typhi Ty2
cuuuucccgccagcugcg

SEQ ID NO: 1752409 - RNA, 17 nt, Salmonella enterica enterica serovar Typhi Ty2
cuuuuccagcacgccca

SEQ ID NO: 1752410 - RNA, 11 nt, Salmonella enterica enterica serovar Typhi Ty2
cuuuuccagcc

SEQ ID NO: 1752411 - RNA, 18 nt, Salmonella enterica enterica serovar Typhi Ty2
cuuuuaauuuuuauguca

SEQ ID NO: 1752412 - RNA, 22 nt, Salmonella enterica enterica serovar Typhi Ty2
cuuuuaauuuuuaugucauuua

SEQ ID NO: 1752413 - RNA, 15 nt, Salmonella enterica enterica serovar Typhi Ty2
cuuuuaauuuuuaug

SEQ ID NO: 1752414 - RNA, 21 nt, Salmonella enterica enterica serovar Typhi Ty2
cuuuuaaggcggcaaagauaa

SEQ ID NO: 1752415 - RNA, 21 nt, Salmonella enterica enterica serovar Typhi Ty2
cuuuuaauagcguagccugca

SEQ ID NO: 1752416 - RNA, 19 nt, Salmonella enterica enterica serovar Typhi Ty2
cuuuuaaggcggcaaagau

SEQ ID NO: 1752417 - RNA, 23 nt, Salmonella enterica enterica serovar Typhi Ty2
cuuuuaacaaaucgacagccagc

SEQ ID NO: 1752418 - RNA, 23 nt, Salmonella enterica enterica serovar Typhi Ty2
cuuuuaaccacgcaaucucuucc

SEQ ID NO: 1752419 - RNA, 18 nt, Salmonella enterica enterica serovar Typhi Ty2
cuuuuaaagacuuugaug

SEQ ID NO: 1752420 - RNA, 17 nt, Salmonella enterica enterica serovar Typhi Ty2
cuuuguugaucucauug

SEQ ID NO: 1752421 - RNA, 21 nt, Salmonella enterica enterica serovar Typhi Ty2
cuuuguucuguugaguucccu

SEQ ID NO: 1752422 - RNA, 19 nt, Salmonella enterica enterica serovar Typhi Ty2
cuuugugggacugcuucaa

SEQ ID NO: 1752423 - RNA, 16 nt, Salmonella enterica enterica serovar Typhi Ty2
cuuugugcaggaucaa

SEQ ID NO: 1752424 - RNA, 21 nt, Salmonella enterica enterica serovar Typhi Ty2
cuuugugaucugguuugguaa

SEQ ID NO: 1752425 - RNA, 14 nt, Salmonella enterica enterica serovar Typhi Ty2
cuuuguccugaagg

SEQ ID NO: 1752426 - RNA, 21 nt, Salmonella enterica enterica serovar Typhi Ty2
cuuugucgaaauugccgcccg

SEQ ID NO: 1752427 - RNA, 15 nt, Salmonella enterica enterica serovar Typhi Ty2
cuuugucgccaauaa

SEQ ID NO: 1752428 - RNA, 14 nt, Salmonella enterica enterica serovar Typhi Ty2
cuuucuuuuuuugu

SEQ ID NO: 1752429 - RNA, 22 nt, Salmonella enterica enterica serovar Typhi Ty2
cuuuugcccgguggcgcugcgc

SEQ ID NO: 1752430 - RNA, 19 nt, Salmonella enterica enterica serovar Typhi Ty2
cuuuugcgcguuccccaac

SEQ ID NO: 1752431 - RNA, 19 nt, Salmonella enterica enterica serovar Typhi Ty2
cuuuugcuaacagugaaau

SEQ ID NO: 1752432 - RNA, 12 nt, Salmonella enterica enterica serovar Typhi Ty2
cuuuugagcagc

SEQ ID NO: 1752433 - RNA, 18 nt, Salmonella enterica enterica serovar Typhi Ty2
cuuuugauacucugcuuu

SEQ ID NO: 1752434 - RNA, 21 nt, Salmonella enterica enterica serovar Typhi Ty2
cuuuugauacucugcuuuuuc

SEQ ID NO: 1752435 - RNA, 19 nt, Salmonella enterica enterica serovar Typhi Ty2
cuuuugucguccccuggac

SEQ ID NO: 1752436 - RNA, 20 nt, Salmonella enterica enterica serovar Typhi Ty2
cuuuugcuuccaguuucuca

SEQ ID NO: 1752437 - RNA, 18 nt, Salmonella enterica enterica serovar Typhi Ty2
cuuuugcuuucuggauga

SEQ ID NO: 1752438 - RNA, 18 nt, Salmonella enterica enterica serovar Typhi Ty2
cuuuucggcgcuuaucca

SEQ ID NO: 1752439 - RNA, 14 nt, Salmonella enterica enterica serovar Typhi Ty2
cuuuucgggcacug

SEQ ID NO: 1752440 - RNA, 17 nt, Salmonella enterica enterica serovar Typhi Ty2
cuuuucggguguccacu

SEQ ID NO: 1752441 - RNA, 14 nt, Salmonella enterica enterica serovar Typhi Ty2
cuuuuccugccagc

SEQ ID NO: 1752442 - RNA, 14 nt, Salmonella enterica enterica serovar Typhi Ty2
cuuuuccugcugcc

SEQ ID NO: 1752443 - RNA, 15 nt, Salmonella enterica enterica serovar Typhi Ty2
cuuuucuuuccugca

SEQ ID NO: 1752444 - RNA, 18 nt, Salmonella enterica enterica serovar Typhi Ty2
cuuuucuuucagcucuuc

SEQ ID NO: 1752445 - RNA, 14 nt, Salmonella enterica enterica serovar Typhi Ty2
cuuuucuuucagcu

SEQ ID NO: 1752446 - RNA, 15 nt, Salmonella enterica enterica serovar Typhi Ty2
cuuuuuauuuuucug

SEQ ID NO: 1752447 - RNA, 16 nt, Salmonella enterica enterica serovar Typhi Ty2
cuuuuuauuuguuccu

SEQ ID NO: 1752448 - RNA, 22 nt, Salmonella enterica enterica serovar Typhi Ty2
cuuuuucaacagcacccaggca

SEQ ID NO: 1752449 - RNA, 15 nt, Salmonella enterica enterica serovar Typhi Ty2
cuuuuuaaaaugacc

SEQ ID NO: 1752450 - RNA, 22 nt, Salmonella enterica enterica serovar Typhi Ty2
cuuuuuaaccauaaugucuucc

SEQ ID NO: 1752451 - RNA, 20 nt, Salmonella enterica enterica serovar Typhi Ty2
cuuuuugcgacacgcugcau

SEQ ID NO: 1752452 - RNA, 20 nt, Salmonella enterica enterica serovar Typhi Ty2
cuuuuugcauucgcuccuca

SEQ ID NO: 1752453 - RNA, 17 nt, Salmonella enterica enterica serovar Typhi Ty2
cuuuuucggcuggcagc

SEQ ID NO: 1752454 - RNA, 16 nt, Salmonella enterica enterica serovar Typhi Ty2
cuuuuucaauuuccag

SEQ ID NO: 1752455 - RNA, 17 nt, Salmonella enterica enterica serovar Typhi Ty2
cuuuuucauauuuuccu

SEQ ID NO: 1752456 - RNA, 24 nt, Salmonella enterica enterica serovar Typhi Ty2
cuuuuuccuccugcggagagagca

SEQ ID NO: 1752457 - RNA, 21 nt, Salmonella enterica enterica serovar Typhi Ty2
cuuuuuccgccugaucuuucu

SEQ ID NO: 1752458 - RNA, 15 nt, Salmonella enterica enterica serovar Typhi Ty2
cuuuuucccacugcg

SEQ ID NO: 1752459 - RNA, 21 nt, Salmonella enterica enterica serovar Typhi Ty2
gaaaaggccuggcugagaaaa

SEQ ID NO: 1752460 - RNA, 20 nt, Salmonella enterica enterica serovar Typhi Ty2
gaaaaggaagaauaaauaac

SEQ ID NO: 1752461 - RNA, 16 nt, Salmonella enterica enterica serovar Typhi Ty2
gaaaagaccaguggac

SEQ ID NO: 1752462 - RNA, 20 nt, Salmonella enterica enterica serovar Typhi Ty2
gaaaacuuuccaaccuguua

SEQ ID NO: 1752463 - RNA, 14 nt, Salmonella enterica enterica serovar Typhi Ty2
gaaaacuuuccaac

SEQ ID NO: 1752464 - RNA, 12 nt, Salmonella enterica enterica serovar Typhi Ty2
gaaaagaaccga

SEQ ID NO: 1752465 - RNA, 14 nt, Salmonella enterica enterica serovar Typhi Ty2
gaaaauagaggaaa

SEQ ID NO: 1752466 - RNA, 15 nt, Salmonella enterica enterica serovar Typhi Ty2
gaaaauaauucuuaa

SEQ ID NO: 1752467 - RNA, 14 nt, Salmonella enterica enterica serovar Typhi Ty2
gaaaauaacaauau

SEQ ID NO: 1752468 - RNA, 22 nt, Salmonella enterica enterica serovar Typhi Ty2
gaaaagguuucggcgaucacca

SEQ ID NO: 1752469 - RNA, 21 nt, Salmonella enterica enterica serovar Typhi Ty2
gaaaagguuucggcgaucacc

SEQ ID NO: 1752470 - RNA, 17 nt, Salmonella enterica enterica serovar Typhi Ty2
gaaaaggucgucaggcc

SEQ ID NO: 1752471 - RNA, 22 nt, Salmonella enterica enterica serovar Typhi Ty2
gaaaagggaugcugaagccgcu

SEQ ID NO: 1752472 - RNA, 22 nt, Salmonella enterica enterica serovar Typhi Ty2
gaaaaggccuggcugagaaaaa

SEQ ID NO: 1752473 - RNA, 22 nt, Salmonella enterica enterica serovar Typhi Ty2
gaaaaguuacaggcuccaagua

SEQ ID NO: 1752474 - RNA, 12 nt, Salmonella enterica enterica serovar Typhi Ty2
gaaaagugaacg

SEQ ID NO: 1752475 - RNA, 17 nt, Salmonella enterica enterica serovar Typhi Ty2
gaaaagucauuuucaug

SEQ ID NO: 1752476 - RNA, 16 nt, Salmonella enterica enterica serovar Typhi Ty2
gaaaauauaugacaac

SEQ ID NO: 1752477 - RNA, 13 nt, Salmonella enterica enterica serovar Typhi Ty2
gaaaauaucggcc

SEQ ID NO: 1752478 - RNA, 13 nt, Salmonella enterica enterica serovar Typhi Ty2
gaaaauauaaucu

SEQ ID NO: 1752479 - RNA, 15 nt, Salmonella enterica enterica serovar Typhi Ty2
gaaaauauaugacaa

SEQ ID NO: 1752480 - RNA, 22 nt, Salmonella enterica enterica serovar Typhi Ty2
gaaaaucagugaacacccugcc

SEQ ID NO: 1752481 - RNA, 14 nt, Salmonella enterica enterica serovar Typhi Ty2
gaaaaucgucucuc

SEQ ID NO: 1752482 - RNA, 14 nt, Salmonella enterica enterica serovar Typhi Ty2
gaaaaugcgcuggg

SEQ ID NO: 1752483 - RNA, 23 nt, Salmonella enterica enterica serovar Typhi Ty2
gaaaaugccagcgauuauuucau

SEQ ID NO: 1752484 - RNA, 20 nt, Salmonella enterica enterica serovar Typhi Ty2
gaaaaugagagacggagaaa

SEQ ID NO: 1752485 - RNA, 13 nt, Salmonella enterica enterica serovar Typhi Ty2
gaaaaucugguuu

SEQ ID NO: 1752486 - RNA, 16 nt, Salmonella enterica enterica serovar Typhi Ty2
gaaaaugguuuugccc

SEQ ID NO: 1752487 - RNA, 22 nt, Salmonella enterica enterica serovar Typhi Ty2
gaaacaacacgaucgaugcccu

SEQ ID NO: 1752488 - RNA, 12 nt, Salmonella enterica enterica serovar Typhi Ty2
gaaacaccagaa

SEQ ID NO: 1752489 - RNA, 16 nt, Salmonella enterica enterica serovar Typhi Ty2
gaaaaaugaauaccaa

SEQ ID NO: 1752490 - RNA, 21 nt, Salmonella enterica enterica serovar Typhi Ty2
gaaaaagcggcuguagccagc

SEQ ID NO: 1752491 - RNA, 22 nt, Salmonella enterica enterica serovar Typhi Ty2
gaaaaagcgcacuuuccauaau

SEQ ID NO: 1752492 - RNA, 20 nt, Salmonella enterica enterica serovar Typhi Ty2
gaaaaacucaccgcuaugaa

SEQ ID NO: 1752493 - RNA, 19 nt, Salmonella enterica enterica serovar Typhi Ty2
gaaaaagccaaaaggcgcc

SEQ ID NO: 1752494 - RNA, 20 nt, Salmonella enterica enterica serovar Typhi Ty2
gaaaaagaaguuagauauua

SEQ ID NO: 1752495 - RNA, 18 nt, Salmonella enterica enterica serovar Typhi Ty2
gaaaaagaaaccuccgca

SEQ ID NO: 1752496 - RNA, 17 nt, Salmonella enterica enterica serovar Typhi Ty2
gaaaaccuuugcugacg

SEQ ID NO: 1752497 - RNA, 23 nt, Salmonella enterica enterica serovar Typhi Ty2
gaaaaauuuaagccagauguaau

SEQ ID NO: 1752498 - RNA, 13 nt, Salmonella enterica enterica serovar Typhi Ty2
gaaaaauguguug

SEQ ID NO: 1752499 - RNA, 15 nt, Salmonella enterica enterica serovar Typhi Ty2
gaaaacagcgccggc

SEQ ID NO: 1752500 - RNA, 19 nt, Salmonella enterica enterica serovar Typhi Ty2
gaaaacagcgccggcagca

SEQ ID NO: 1752501 - RNA, 20 nt, Salmonella enterica enterica serovar Typhi Ty2
gaaaacagcgccggcagcag

SEQ ID NO: 1752502 - RNA, 21 nt, Salmonella enterica enterica serovar Typhi Ty2
gaaaacaccagggauuuugcu

SEQ ID NO: 1752503 - RNA, 13 nt, Salmonella enterica enterica serovar Typhi Ty2
gaaaaaauacuga

SEQ ID NO: 1752504 - RNA, 18 nt, Salmonella enterica enterica serovar Typhi Ty2
gaaaaaauuacagccgcg

SEQ ID NO: 1752505 - RNA, 13 nt, Salmonella enterica enterica serovar Typhi Ty2
gaaaaaauuacag

SEQ ID NO: 1752506 - RNA, 17 nt, Salmonella enterica enterica serovar Typhi Ty2
gaaaaaccaaaaaauau

SEQ ID NO: 1752507 - RNA, 21 nt, Salmonella enterica enterica serovar Typhi Ty2
gaaaaacgcuaccgucgccga

SEQ ID NO: 1752508 - RNA, 16 nt, Salmonella enterica enterica serovar Typhi Ty2
cuuuuuuuccagcguc

SEQ ID NO: 1752509 - RNA, 11 nt, Salmonella enterica enterica serovar Typhi Ty2
cuuuuuuucaa

SEQ ID NO: 1752510 - RNA, 22 nt, Salmonella enterica enterica serovar Typhi Ty2
gaaaaaacgggcccgcggcgac

SEQ ID NO: 1752511 - RNA, 18 nt, Salmonella enterica enterica serovar Typhi Ty2
cuuuuuuuuaugccucuu

SEQ ID NO: 1752512 - RNA, 20 nt, Salmonella enterica enterica serovar Typhi Ty2
gaaaaaaacgcauugcagca

SEQ ID NO: 1752513 - RNA, 17 nt, Salmonella enterica enterica serovar Typhi Ty2
cuuuuugugcaaucaca

SEQ ID NO: 1752514 - RNA, 21 nt, Salmonella enterica enterica serovar Typhi Ty2
cuuuuuuaccggaugggcaga

SEQ ID NO: 1752515 - RNA, 19 nt, Salmonella enterica enterica serovar Typhi Ty2
cuuuuuuagucuccugcca

SEQ ID NO: 1752516 - RNA, 16 nt, Salmonella enterica enterica serovar Typhi Ty2
cuuuuuuggucagaaa

SEQ ID NO: 1752517 - RNA, 14 nt, Salmonella enterica enterica serovar Typhi Ty2
cuuuuuuauuguuu

SEQ ID NO: 1752518 - RNA, 16 nt, Salmonella enterica enterica serovar Typhi Ty2
gaaacaggaaaaacau

SEQ ID NO: 1752519 - RNA, 14 nt, Salmonella enterica enterica serovar Typhi Ty2
gaaacauauauauc

SEQ ID NO: 1752520 - RNA, 14 nt, Salmonella enterica enterica serovar Typhi Ty2
gaaacaucaucguu

SEQ ID NO: 1752521 - RNA, 22 nt, Salmonella enterica enterica serovar Typhi Ty2
gaaaccccaaaucagcaaaaac

SEQ ID NO: 1752522 - RNA, 19 nt, Salmonella enterica enterica serovar Typhi Ty2
gaaaccagcauaauauuca

SEQ ID NO: 1752523 - RNA, 11 nt, Salmonella enterica enterica serovar Typhi Ty2
gaaaccagcau

SEQ ID NO: 1752524 - RNA, 19 nt, Salmonella enterica enterica serovar Typhi Ty2
gaaaccagauacccuuuau

SEQ ID NO: 1752525 - RNA, 18 nt, Salmonella enterica enterica serovar Typhi Ty2
gaaacgacugguaauguc

SEQ ID NO: 1752526 - RNA, 19 nt, Salmonella enterica enterica serovar Typhi Ty2
gaaacgccgaccacuucaa

SEQ ID NO: 1752527 - RNA, 21 nt, Salmonella enterica enterica serovar Typhi Ty2
gaaaccggcgucuuuugcugc

SEQ ID NO: 1752528 - RNA, 13 nt, Salmonella enterica enterica serovar Typhi Ty2
gaaaccggcggcg

SEQ ID NO: 1752529 - RNA, 19 nt, Salmonella enterica enterica serovar Typhi Ty2
gaaaccgcucgccgccucc

SEQ ID NO: 1752530 - RNA, 18 nt, Salmonella enterica enterica serovar Typhi Ty2
gaaaccgcucgccgccuc

SEQ ID NO: 1752531 - RNA, 16 nt, Salmonella enterica enterica serovar Typhi Ty2
gaaaccgcagaaaaag

SEQ ID NO: 1752532 - RNA, 21 nt, Salmonella enterica enterica serovar Typhi Ty2
gaaacccgccaccgccagcca

SEQ ID NO: 1752533 - RNA, 11 nt, Salmonella enterica enterica serovar Typhi Ty2
gaaagagaaag

SEQ ID NO: 1752534 - RNA, 17 nt, Salmonella enterica enterica serovar Typhi Ty2
gaaagaccugccgaccu

SEQ ID NO: 1752535 - RNA, 12 nt, Salmonella enterica enterica serovar Typhi Ty2
gaaagaagaggc

SEQ ID NO: 1752536 - RNA, 17 nt, Salmonella enterica enterica serovar Typhi Ty2
gaaacuggcgucauguu

SEQ ID NO: 1752537 - RNA, 18 nt, Salmonella enterica enterica serovar Typhi Ty2
gaaacugcugccgcagca

SEQ ID NO: 1752538 - RNA, 18 nt, Salmonella enterica enterica serovar Typhi Ty2
gaaacugcauaucgccgc

SEQ ID NO: 1752539 - RNA, 19 nt, Salmonella enterica enterica serovar Typhi Ty2
gaaacgugcauuauuuuag

SEQ ID NO: 1752540 - RNA, 16 nt, Salmonella enterica enterica serovar Typhi Ty2
gaaacguccccugcgg

SEQ ID NO: 1752541 - RNA, 16 nt, Salmonella enterica enterica serovar Typhi Ty2
gaaacguguuuauccc

SEQ ID NO: 1752542 - RNA, 20 nt, Salmonella enterica enterica serovar Typhi Ty2
gaaacgcuuuccggggugaa

SEQ ID NO: 1752543 - RNA, 22 nt, Salmonella enterica enterica serovar Typhi Ty2
gaaacucgccaugccaucggcc

SEQ ID NO: 1752544 - RNA, 21 nt, Salmonella enterica enterica serovar Typhi Ty2
gaaacucgacgggaaucuccg

SEQ ID NO: 1752545 - RNA, 12 nt, Salmonella enterica enterica serovar Typhi Ty2
gaaacugauauu

SEQ ID NO: 1752546 - RNA, 22 nt, Salmonella enterica enterica serovar Typhi Ty2
gaaacucgcuguggccaggcac

SEQ ID NO: 1752547 - RNA, 14 nt, Salmonella enterica enterica serovar Typhi Ty2
gaaagcagguuuug

SEQ ID NO: 1752548 - RNA, 16 nt, Salmonella enterica enterica serovar Typhi Ty2
gaaagauagcaggccc

SEQ ID NO: 1752549 - RNA, 13 nt, Salmonella enterica enterica serovar Typhi Ty2
gaaagauaaaaua

SEQ ID NO: 1752550 - RNA, 14 nt, Salmonella enterica enterica serovar Typhi Ty2
gaaagcaauacugu

SEQ ID NO: 1752551 - RNA, 14 nt, Salmonella enterica enterica serovar Typhi Ty2
gaaagcaacagcaa

SEQ ID NO: 1752552 - RNA, 21 nt, Salmonella enterica enterica serovar Typhi Ty2
gaaagauuucaucaggcugac

SEQ ID NO: 1752553 - RNA, 20 nt, Salmonella enterica enterica serovar Typhi Ty2
gaaagauuucaucaggcuga

SEQ ID NO: 1752554 - RNA, 21 nt, Salmonella enterica enterica serovar Typhi Ty2
gaaagauuacuucaggcugcc

SEQ ID NO: 1752555 - RNA, 17 nt, Salmonella enterica enterica serovar Typhi Ty2
gaaagccauaaaacugg

SEQ ID NO: 1752556 - RNA, 21 nt, Salmonella enterica enterica serovar Typhi Ty2
gaaagccauaaaacuggcgcu

SEQ ID NO: 1752557 - RNA, 22 nt, Salmonella enterica enterica serovar Typhi Ty2
gaaagcgacucauccacauacu

SEQ ID NO: 1752558 - RNA, 23 nt, Salmonella enterica enterica serovar Typhi Ty2
gaaaguaccaaaacagaaaagau

SEQ ID NO: 1752559 - RNA, 21 nt, Salmonella enterica enterica serovar Typhi Ty2
gaaaguaggcgguuucaucga

SEQ ID NO: 1752560 - RNA, 20 nt, Salmonella enterica enterica serovar Typhi Ty2
gaaagucaaaauaaaauuau

SEQ ID NO: 1752561 - RNA, 15 nt, Salmonella enterica enterica serovar Typhi Ty2
gaaagguaaaugcca

SEQ ID NO: 1752562 - RNA, 19 nt, Salmonella enterica enterica serovar Typhi Ty2
gaaaggcuugcaggauguc

SEQ ID NO: 1752563 - RNA, 15 nt, Salmonella enterica enterica serovar Typhi Ty2
gaaaggcuugcagga

SEQ ID NO: 1752564 - RNA, 13 nt, Salmonella enterica enterica serovar Typhi Ty2
gaaaggcuugcag

SEQ ID NO: 1752565 - RNA, 23 nt, Salmonella enterica enterica serovar Typhi Ty2
gaaaggggagggcaacaaacaua

SEQ ID NO: 1752566 - RNA, 14 nt, Salmonella enterica enterica serovar Typhi Ty2
gaaaggaagcgggc

SEQ ID NO: 1752567 - RNA, 13 nt, Salmonella enterica enterica serovar Typhi Ty2
gaaagcugccuuu

SEQ ID NO: 1752568 - RNA, 20 nt, Salmonella enterica enterica serovar Typhi Ty2
gaaauaucgcgcggcaugga

SEQ ID NO: 1752569 - RNA, 15 nt, Salmonella enterica enterica serovar Typhi Ty2
gaaauauucucagcc

SEQ ID NO: 1752570 - RNA, 19 nt, Salmonella enterica enterica serovar Typhi Ty2
gaaauagacgagcgaaaaa

SEQ ID NO: 1752571 - RNA, 15 nt, Salmonella enterica enterica serovar Typhi Ty2
gaaauaggggagacu

SEQ ID NO: 1752572 - RNA, 21 nt, Salmonella enterica enterica serovar Typhi Ty2
gaaauaccgguaaucaagccu

SEQ ID NO: 1752573 - RNA, 13 nt, Salmonella enterica enterica serovar Typhi Ty2
gaaaguggugggu

SEQ ID NO: 1752574 - RNA, 19 nt, Salmonella enterica enterica serovar Typhi Ty2
gaaaguugcgccgugccug

SEQ ID NO: 1752575 - RNA, 22 nt, Salmonella enterica enterica serovar Typhi Ty2
gaaagugaauccccaggagcau

SEQ ID NO: 1752576 - RNA, 20 nt, Salmonella enterica enterica serovar Typhi Ty2
gaaagucuuuuguuuuucuc

SEQ ID NO: 1752577 - RNA, 16 nt, Salmonella enterica enterica serovar Typhi Ty2
gaaaguggugggugau

SEQ ID NO: 1752578 - RNA, 21 nt, Salmonella enterica enterica serovar Typhi Ty2
gaaaguggugggugaugacgg

SEQ ID NO: 1752579 - RNA, 21 nt, Salmonella enterica enterica serovar Typhi Ty2
gaaagugggcgcuuuguuacu

SEQ ID NO: 1752580 - RNA, 14 nt, Salmonella enterica enterica serovar Typhi Ty2
gaaaguuugaagug

SEQ ID NO: 1752581 - RNA, 18 nt, Salmonella enterica enterica serovar Typhi Ty2
gaaauaacgcacuaccag

SEQ ID NO: 1752582 - RNA, 14 nt, Salmonella enterica enterica serovar Typhi Ty2
gaaauaaucuguag

SEQ ID NO: 1752583 - RNA, 18 nt, Salmonella enterica enterica serovar Typhi Ty2
gaacaggccaaacccugc

SEQ ID NO: 1752584 - RNA, 13 nt, Salmonella enterica enterica serovar Typhi Ty2
gaacagcggcagg

SEQ ID NO: 1752585 - RNA, 21 nt, Salmonella enterica enterica serovar Typhi Ty2
gaacagcgucauccaguguua

SEQ ID NO: 1752586 - RNA, 18 nt, Salmonella enterica enterica serovar Typhi Ty2
gaacaggcuucccaauac

SEQ ID NO: 1752587 - RNA, 15 nt, Salmonella enterica enterica serovar Typhi Ty2
gaacagggcgggcga

SEQ ID NO: 1752588 - RNA, 22 nt, Salmonella enterica enterica serovar Typhi Ty2
gaacagucccaccagcgcggca

SEQ ID NO: 1752589 - RNA, 14 nt, Salmonella enterica enterica serovar Typhi Ty2
gaacaguuucucgc

SEQ ID NO: 1752590 - RNA, 16 nt, Salmonella enterica enterica serovar Typhi Ty2
gaacaguuucgccagc

SEQ ID NO: 1752591 - RNA, 23 nt, Salmonella enterica enterica serovar Typhi Ty2
gaacaguguaaacgccagauaau

SEQ ID NO: 1752592 - RNA, 23 nt, Salmonella enterica enterica serovar Typhi Ty2
gaacauacuuucucuccuucacg

SEQ ID NO: 1752593 - RNA, 20 nt, Salmonella enterica enterica serovar Typhi Ty2
gaacaucagccagcagcuca

SEQ ID NO: 1752594 - RNA, 18 nt, Salmonella enterica enterica serovar Typhi Ty2
gaacaucagccagcagcu

SEQ ID NO: 1752595 - RNA, 23 nt, Salmonella enterica enterica serovar Typhi Ty2
gaacaucgacauucgauguuacu

SEQ ID NO: 1752596 - RNA, 16 nt, Salmonella enterica enterica serovar Typhi Ty2
gaacaucgacccccac

SEQ ID NO: 1752597 - RNA, 15 nt, Salmonella enterica enterica serovar Typhi Ty2
gaacaucuuccaggu

SEQ ID NO: 1752598 - RNA, 16 nt, Salmonella enterica enterica serovar Typhi Ty2
gaacauuucaucuauc

SEQ ID NO: 1752599 - RNA, 21 nt, Salmonella enterica enterica serovar Typhi Ty2
gaaccaaucgagaagccauca

SEQ ID NO: 1752600 - RNA, 12 nt, Salmonella enterica enterica serovar Typhi Ty2
gaacaugcauau

SEQ ID NO: 1752601 - RNA, 18 nt, Salmonella enterica enterica serovar Typhi Ty2
gaacauuggaauauccgc

SEQ ID NO: 1752602 - RNA, 14 nt, Salmonella enterica enterica serovar Typhi Ty2
gaacauuacauccu

SEQ ID NO: 1752603 - RNA, 17 nt, Salmonella enterica enterica serovar Typhi Ty2
gaacaauaacaccacaa

SEQ ID NO: 1752604 - RNA, 18 nt, Salmonella enterica enterica serovar Typhi Ty2
gaacacagcaugaauaac

SEQ ID NO: 1752605 - RNA, 16 nt, Salmonella enterica enterica serovar Typhi Ty2
gaacaccucauauuug

SEQ ID NO: 1752606 - RNA, 12 nt, Salmonella enterica enterica serovar Typhi Ty2
gaacagcaucac

SEQ ID NO: 1752607 - RNA, 19 nt, Salmonella enterica enterica serovar Typhi Ty2
gaacagcacguuaccggcg

SEQ ID NO: 1752608 - RNA, 21 nt, Salmonella enterica enterica serovar Typhi Ty2
gaacagaaaaaaugcaccgcc

SEQ ID NO: 1752609 - RNA, 15 nt, Salmonella enterica enterica serovar Typhi Ty2
gaacagacggcggcu

SEQ ID NO: 1752610 - RNA, 14 nt, Salmonella enterica enterica serovar Typhi Ty2
gaacagaagcgccg

SEQ ID NO: 1752611 - RNA, 21 nt, Salmonella enterica enterica serovar Typhi Ty2
gaacagaacagugaguuaaga

SEQ ID NO: 1752612 - RNA, 16 nt, Salmonella enterica enterica serovar Typhi Ty2
gaacacucuaaaucua

SEQ ID NO: 1752613 - RNA, 14 nt, Salmonella enterica enterica serovar Typhi Ty2
gaaauuuaaagaua

SEQ ID NO: 1752614 - RNA, 21 nt, Salmonella enterica enterica serovar Typhi Ty2
gaaauuuaaagauagcugcuu

SEQ ID NO: 1752615 - RNA, 13 nt, Salmonella enterica enterica serovar Typhi Ty2
gaaauuuauucau

SEQ ID NO: 1752616 - RNA, 22 nt, Salmonella enterica enterica serovar Typhi Ty2
gaaauugcagggugcagcaaau

SEQ ID NO: 1752617 - RNA, 18 nt, Salmonella enterica enterica serovar Typhi Ty2
gaaauugcagggugcagc

SEQ ID NO: 1752618 - RNA, 16 nt, Salmonella enterica enterica serovar Typhi Ty2
gaaauugaauuauaau

SEQ ID NO: 1752619 - RNA, 16 nt, Salmonella enterica enterica serovar Typhi Ty2
gaaauuucuuuuccag

SEQ ID NO: 1752620 - RNA, 20 nt, Salmonella enterica enterica serovar Typhi Ty2
gaacaaaagaaagcaauagc

SEQ ID NO: 1752621 - RNA, 17 nt, Salmonella enterica enterica serovar Typhi Ty2
gaaauucuaugccaggc

SEQ ID NO: 1752622 - RNA, 22 nt, Salmonella enterica enterica serovar Typhi Ty2
gaaauucugacgcagcuucuga

SEQ ID NO: 1752623 - RNA, 15 nt, Salmonella enterica enterica serovar Typhi Ty2
gaaauucgcagcgca

SEQ ID NO: 1752624 - RNA, 12 nt, Salmonella enterica enterica serovar Typhi Ty2
gaaauuauccac

SEQ ID NO: 1752625 - RNA, 15 nt, Salmonella enterica enterica serovar Typhi Ty2
gaaauguauucuccc

SEQ ID NO: 1752626 - RNA, 20 nt, Salmonella enterica enterica serovar Typhi Ty2
gaaaugcaggcguuuuauug

SEQ ID NO: 1752627 - RNA, 11 nt, Salmonella enterica enterica serovar Typhi Ty2
gaaaugagaaa

SEQ ID NO: 1752628 - RNA, 22 nt, Salmonella enterica enterica serovar Typhi Ty2
gaaaucuguuccagcgagcagg

SEQ ID NO: 1752629 - RNA, 23 nt, Salmonella enterica enterica serovar Typhi Ty2
gaaaucugcacguaccugcucca

SEQ ID NO: 1752630 - RNA, 15 nt, Salmonella enterica enterica serovar Typhi Ty2
gaaaucuguuccagc

SEQ ID NO: 1752631 - RNA, 20 nt, Salmonella enterica enterica serovar Typhi Ty2
gaaaucuguuccagcgagca

SEQ ID NO: 1752632 - RNA, 17 nt, Salmonella enterica enterica serovar Typhi Ty2
gaaaugcccauaaagaa

SEQ ID NO: 1752633 - RNA, 17 nt, Salmonella enterica enterica serovar Typhi Ty2
gaaaugccuuauccggc

SEQ ID NO: 1752634 - RNA, 17 nt, Salmonella enterica enterica serovar Typhi Ty2
gaaaugcgaauccggcg

SEQ ID NO: 1752635 - RNA, 19 nt, Salmonella enterica enterica serovar Typhi Ty2
gaaaugcgaauccggcggc

SEQ ID NO: 1752636 - RNA, 23 nt, Salmonella enterica enterica serovar Typhi Ty2
gaaaucacaaacaccaccaguaa

SEQ ID NO: 1752637 - RNA, 22 nt, Salmonella enterica enterica serovar Typhi Ty2
gaaaucacgcucaucggcggca

SEQ ID NO: 1752638 - RNA, 17 nt, Salmonella enterica enterica serovar Typhi Ty2
gaaauccucuauuuuuu

SEQ ID NO: 1752639 - RNA, 22 nt, Salmonella enterica enterica serovar Typhi Ty2
gaaaucgucagacggcuccagc

SEQ ID NO: 1752640 - RNA, 14 nt, Salmonella enterica enterica serovar Typhi Ty2
gaaaucuaucugua

SEQ ID NO: 1752641 - RNA, 17 nt, Salmonella enterica enterica serovar Typhi Ty2
gaacuuccgccaccacc

SEQ ID NO: 1752642 - RNA, 18 nt, Salmonella enterica enterica serovar Typhi Ty2
gaagaacacgccgccuau

SEQ ID NO: 1752643 - RNA, 16 nt, Salmonella enterica enterica serovar Typhi Ty2
gaagaccguuuaaacg

SEQ ID NO: 1752644 - RNA, 19 nt, Salmonella enterica enterica serovar Typhi Ty2
gaagacguuuacaccgcca

SEQ ID NO: 1752645 - RNA, 20 nt, Salmonella enterica enterica serovar Typhi Ty2
gaagaaucuguauaaaauau

SEQ ID NO: 1752646 - RNA, 22 nt, Salmonella enterica enterica serovar Typhi Ty2
gaagaauccagggaugaacagc

SEQ ID NO: 1752647 - RNA, 17 nt, Salmonella enterica enterica serovar Typhi Ty2
gaagacacaacgugcca

SEQ ID NO: 1752648 - RNA, 17 nt, Salmonella enterica enterica serovar Typhi Ty2
gaagaauucgcaaugug

SEQ ID NO: 1752649 - RNA, 16 nt, Salmonella enterica enterica serovar Typhi Ty2
gaagauaaagauauuc

SEQ ID NO: 1752650 - RNA, 17 nt, Salmonella enterica enterica serovar Typhi Ty2
gaagauaaacagcagcg

SEQ ID NO: 1752651 - RNA, 14 nt, Salmonella enterica enterica serovar Typhi Ty2
gaagauaagaaaaa

SEQ ID NO: 1752652 - RNA, 18 nt, Salmonella enterica enterica serovar Typhi Ty2
gaagauccgcucacgcca

SEQ ID NO: 1752653 - RNA, 21 nt, Salmonella enterica enterica serovar Typhi Ty2
gaagaguuaacuucuccgcca

SEQ ID NO: 1752654 - RNA, 16 nt, Salmonella enterica enterica serovar Typhi Ty2
gaagagugaauaacaa

SEQ ID NO: 1752655 - RNA, 18 nt, Salmonella enterica enterica serovar Typhi Ty2
gaagauuucuuaauuccu

SEQ ID NO: 1752656 - RNA, 17 nt, Salmonella enterica enterica serovar Typhi Ty2
gaagauuuuuauucccg

SEQ ID NO: 1752657 - RNA, 22 nt, Salmonella enterica enterica serovar Typhi Ty2
gaagauuaacccggucauccag

SEQ ID NO: 1752658 - RNA, 14 nt, Salmonella enterica enterica serovar Typhi Ty2
gaagauuagcagag

SEQ ID NO: 1752659 - RNA, 16 nt, Salmonella enterica enterica serovar Typhi Ty2
gaagauuagcagagcg

SEQ ID NO: 1752660 - RNA, 17 nt, Salmonella enterica enterica serovar Typhi Ty2
gaagcaggcggagaagg

SEQ ID NO: 1752661 - RNA, 17 nt, Salmonella enterica enterica serovar Typhi Ty2
gaagcacgacacaaaag

SEQ ID NO: 1752662 - RNA, 21 nt, Salmonella enterica enterica serovar Typhi Ty2
gaagccauccucacgcaacca

SEQ ID NO: 1752663 - RNA, 14 nt, Salmonella enterica enterica serovar Typhi Ty2
gaagccaucaaauu

SEQ ID NO: 1752664 - RNA, 18 nt, Salmonella enterica enterica serovar Typhi Ty2
gaagcccaugauggugaa

SEQ ID NO: 1752665 - RNA, 22 nt, Salmonella enterica enterica serovar Typhi Ty2
gaagcccaugauggugaacaga

SEQ ID NO: 1752666 - RNA, 21 nt, Salmonella enterica enterica serovar Typhi Ty2
gaagcccucggcgaacaggcg

SEQ ID NO: 1752667 - RNA, 19 nt, Salmonella enterica enterica serovar Typhi Ty2
gaagcgaccggcgucauca

SEQ ID NO: 1752668 - RNA, 17 nt, Salmonella enterica enterica serovar Typhi Ty2
gaagcgacgacacggcg

SEQ ID NO: 1752669 - RNA, 20 nt, Salmonella enterica enterica serovar Typhi Ty2
gaagcgauguauuuauccac

SEQ ID NO: 1752670 - RNA, 18 nt, Salmonella enterica enterica serovar Typhi Ty2
gaagccuggugcccaacc

SEQ ID NO: 1752671 - RNA, 14 nt, Salmonella enterica enterica serovar Typhi Ty2
gaagccuuucuguu

SEQ ID NO: 1752672 - RNA, 18 nt, Salmonella enterica enterica serovar Typhi Ty2
gaagcgcguucgucccac

SEQ ID NO: 1752673 - RNA, 20 nt, Salmonella enterica enterica serovar Typhi Ty2
gaagcgcguuggcguuaccu

SEQ ID NO: 1752674 - RNA, 21 nt, Salmonella enterica enterica serovar Typhi Ty2
gaagcgcgcgcacaacgugca

SEQ ID NO: 1752675 - RNA, 14 nt, Salmonella enterica enterica serovar Typhi Ty2
gaaggcaacugauc

SEQ ID NO: 1752676 - RNA, 17 nt, Salmonella enterica enterica serovar Typhi Ty2
gaaggcaggcuggguuu

SEQ ID NO: 1752677 - RNA, 13 nt, Salmonella enterica enterica serovar Typhi Ty2
gaaggcaucuuca

SEQ ID NO: 1752678 - RNA, 21 nt, Salmonella enterica enterica serovar Typhi Ty2
gaaggcaucuucagacaguuu

SEQ ID NO: 1752679 - RNA, 20 nt, Salmonella enterica enterica serovar Typhi Ty2
gaagcugcagggauaugcug

SEQ ID NO: 1752680 - RNA, 17 nt, Salmonella enterica enterica serovar Typhi Ty2
gaagcugccgucccagc

SEQ ID NO: 1752681 - RNA, 23 nt, Salmonella enterica enterica serovar Typhi Ty2
gaagcucaugugcagcauccagc

SEQ ID NO: 1752682 - RNA, 14 nt, Salmonella enterica enterica serovar Typhi Ty2
gaagcguaacagcg

SEQ ID NO: 1752683 - RNA, 16 nt, Salmonella enterica enterica serovar Typhi Ty2
gaagcgguaaaaccgg

SEQ ID NO: 1752684 - RNA, 19 nt, Salmonella enterica enterica serovar Typhi Ty2
gaagcggcgcuauccggca

SEQ ID NO: 1752685 - RNA, 20 nt, Salmonella enterica enterica serovar Typhi Ty2
gaacucugcgacgccaggcg

SEQ ID NO: 1752686 - RNA, 15 nt, Salmonella enterica enterica serovar Typhi Ty2
gaacucuuucagacc

SEQ ID NO: 1752687 - RNA, 13 nt, Salmonella enterica enterica serovar Typhi Ty2
gaacucuuucaga

SEQ ID NO: 1752688 - RNA, 16 nt, Salmonella enterica enterica serovar Typhi Ty2
gaacugauaaaagaga

SEQ ID NO: 1752689 - RNA, 20 nt, Salmonella enterica enterica serovar Typhi Ty2
gaacugauggcgcuaagcca

SEQ ID NO: 1752690 - RNA, 22 nt, Salmonella enterica enterica serovar Typhi Ty2
gaacugauggcgcuaagccagc

SEQ ID NO: 1752691 - RNA, 16 nt, Salmonella enterica enterica serovar Typhi Ty2
gaacuguucagccagc

SEQ ID NO: 1752692 - RNA, 14 nt, Salmonella enterica enterica serovar Typhi Ty2
gaacuuaaauuaau

SEQ ID NO: 1752693 - RNA, 17 nt, Salmonella enterica enterica serovar Typhi Ty2
gaacugggugccgugaa

SEQ ID NO: 1752694 - RNA, 19 nt, Salmonella enterica enterica serovar Typhi Ty2
gaacuggguaugcaguggg

SEQ ID NO: 1752695 - RNA, 15 nt, Salmonella enterica enterica serovar Typhi Ty2
gaacuuacccagcaa

SEQ ID NO: 1752696 - RNA, 17 nt, Salmonella enterica enterica serovar Typhi Ty2
gaacuguucagccagca

SEQ ID NO: 1752697 - RNA, 19 nt, Salmonella enterica enterica serovar Typhi Ty2
gaacugcagcgcgucgacc

SEQ ID NO: 1752698 - RNA, 11 nt, Salmonella enterica enterica serovar Typhi Ty2
gaacugcagcg

SEQ ID NO: 1752699 - RNA, 21 nt, Salmonella enterica enterica serovar Typhi Ty2
gaacugcaaauaccacaucag

SEQ ID NO: 1752700 - RNA, 20 nt, Salmonella enterica enterica serovar Typhi Ty2
gaacgcggcgccgaagcagg

SEQ ID NO: 1752701 - RNA, 15 nt, Salmonella enterica enterica serovar Typhi Ty2
gaacgcuuccgggcu

SEQ ID NO: 1752702 - RNA, 18 nt, Salmonella enterica enterica serovar Typhi Ty2
gaacgcuggcacuuuccg

SEQ ID NO: 1752703 - RNA, 18 nt, Salmonella enterica enterica serovar Typhi Ty2
gaacgcuggcggcaggcc

SEQ ID NO: 1752704 - RNA, 19 nt, Salmonella enterica enterica serovar Typhi Ty2
gaacggaucaugguugaaa

SEQ ID NO: 1752705 - RNA, 20 nt, Salmonella enterica enterica serovar Typhi Ty2
gaacggcaccggaaccggca

SEQ ID NO: 1752706 - RNA, 22 nt, Salmonella enterica enterica serovar Typhi Ty2
gaacggguaaaugcgcgcggcu

SEQ ID NO: 1752707 - RNA, 23 nt, Salmonella enterica enterica serovar Typhi Ty2
gaacuacccuucaaggagaaaau

SEQ ID NO: 1752708 - RNA, 14 nt, Salmonella enterica enterica serovar Typhi Ty2
gaacguaauggcau

SEQ ID NO: 1752709 - RNA, 17 nt, Salmonella enterica enterica serovar Typhi Ty2
gaacguucaaaaucaaa

SEQ ID NO: 1752710 - RNA, 22 nt, Salmonella enterica enterica serovar Typhi Ty2
gaacguuaucggcauaggcuau

SEQ ID NO: 1752711 - RNA, 22 nt, Salmonella enterica enterica serovar Typhi Ty2
gaaccuggcagaaaggugaaaa

SEQ ID NO: 1752712 - RNA, 19 nt, Salmonella enterica enterica serovar Typhi Ty2
gaaccuggcgguaaauacg

SEQ ID NO: 1752713 - RNA, 22 nt, Salmonella enterica enterica serovar Typhi Ty2
gaaccguugcgcccaucaucau

SEQ ID NO: 1752714 - RNA, 22 nt, Salmonella enterica enterica serovar Typhi Ty2
gaaccucaccguccgccaggcc

SEQ ID NO: 1752715 - RNA, 16 nt, Salmonella enterica enterica serovar Typhi Ty2
gaacgccuuauccggc

SEQ ID NO: 1752716 - RNA, 15 nt, Salmonella enterica enterica serovar Typhi Ty2
gaacgcgagaagccc

SEQ ID NO: 1752717 - RNA, 19 nt, Salmonella enterica enterica serovar Typhi Ty2
gaacgcacuuaaugcaaug

SEQ ID NO: 1752718 - RNA, 13 nt, Salmonella enterica enterica serovar Typhi Ty2
gaaccauaauaaa

SEQ ID NO: 1752719 - RNA, 21 nt, Salmonella enterica enterica serovar Typhi Ty2
gaaccagcggcaccagcacga

SEQ ID NO: 1752720 - RNA, 15 nt, Salmonella enterica enterica serovar Typhi Ty2
gaaccagcaucccac

SEQ ID NO: 1752721 - RNA, 12 nt, Salmonella enterica enterica serovar Typhi Ty2
gaaccaucggca

SEQ ID NO: 1752722 - RNA, 18 nt, Salmonella enterica enterica serovar Typhi Ty2
gaaccaucauuaauauaa

SEQ ID NO: 1752723 - RNA, 15 nt, Salmonella enterica enterica serovar Typhi Ty2
gaaccggcaucggca

SEQ ID NO: 1752724 - RNA, 14 nt, Salmonella enterica enterica serovar Typhi Ty2
gaaccggggcgcgc

SEQ ID NO: 1752725 - RNA, 16 nt, Salmonella enterica enterica serovar Typhi Ty2
gaacccgaccgucuuu

SEQ ID NO: 1752726 - RNA, 20 nt, Salmonella enterica enterica serovar Typhi Ty2
gaaccgcccaucaacaccag

SEQ ID NO: 1752727 - RNA, 16 nt, Salmonella enterica enterica serovar Typhi Ty2
gaauuaagcaauccau

SEQ ID NO: 1752728 - RNA, 19 nt, Salmonella enterica enterica serovar Typhi Ty2
gaauuauucguguuucgac

SEQ ID NO: 1752729 - RNA, 19 nt, Salmonella enterica enterica serovar Typhi Ty2
gaauuauuaaaucaauacu

SEQ ID NO: 1752730 - RNA, 13 nt, Salmonella enterica enterica serovar Typhi Ty2
gaauuauuaccaa

SEQ ID NO: 1752731 - RNA, 22 nt, Salmonella enterica enterica serovar Typhi Ty2
gaauucaaagaacagggggcgc

SEQ ID NO: 1752732 - RNA, 16 nt, Salmonella enterica enterica serovar Typhi Ty2
gaauuauuucaggaau

SEQ ID NO: 1752733 - RNA, 19 nt, Salmonella enterica enterica serovar Typhi Ty2
gaauucaccgcaugacaau

SEQ ID NO: 1752734 - RNA, 15 nt, Salmonella enterica enterica serovar Typhi Ty2
gaauuccaguccuuu

SEQ ID NO: 1752735 - RNA, 16 nt, Salmonella enterica enterica serovar Typhi Ty2
gaauuccaguccuuuc

SEQ ID NO: 1752736 - RNA, 19 nt, Salmonella enterica enterica serovar Typhi Ty2
gaauuuaucccgugguggg

SEQ ID NO: 1752737 - RNA, 16 nt, Salmonella enterica enterica serovar Typhi Ty2
gaauuuaucccguggu

SEQ ID NO: 1752738 - RNA, 22 nt, Salmonella enterica enterica serovar Typhi Ty2
gaauuucaggguagcauugccg

SEQ ID NO: 1752739 - RNA, 17 nt, Salmonella enterica enterica serovar Typhi Ty2
gaauuucaaucaucaua

SEQ ID NO: 1752740 - RNA, 13 nt, Salmonella enterica enterica serovar Typhi Ty2
gaauugguagacg

SEQ ID NO: 1752741 - RNA, 13 nt, Salmonella enterica enterica serovar Typhi Ty2
gaauugauaaaga

SEQ ID NO: 1752742 - RNA, 15 nt, Salmonella enterica enterica serovar Typhi Ty2
gaauugaacuaaaaa

SEQ ID NO: 1752743 - RNA, 17 nt, Salmonella enterica enterica serovar Typhi Ty2
gaauugcgguuuauccc

SEQ ID NO: 1752744 - RNA, 15 nt, Salmonella enterica enterica serovar Typhi Ty2
gaauucguacguuuu

SEQ ID NO: 1752745 - RNA, 12 nt, Salmonella enterica enterica serovar Typhi Ty2
gaauggagaagc

SEQ ID NO: 1752746 - RNA, 19 nt, Salmonella enterica enterica serovar Typhi Ty2
gaauggauaacgaaaaggg

SEQ ID NO: 1752747 - RNA, 23 nt, Salmonella enterica enterica serovar Typhi Ty2
gaaugcugacggauucuuccucu

SEQ ID NO: 1752748 - RNA, 23 nt, Salmonella enterica enterica serovar Typhi Ty2
gaaugcuucgccacgaccuacac

SEQ ID NO: 1752749 - RNA, 21 nt, Salmonella enterica enterica serovar Typhi Ty2
gaaugcuucuucgccagcuuc

SEQ ID NO: 1752750 - RNA, 23 nt, Salmonella enterica enterica serovar Typhi Ty2
gaaugcgcgcgugaccccaggca

SEQ ID NO: 1752751 - RNA, 18 nt, Salmonella enterica enterica serovar Typhi Ty2
gaaugccggauggcggcg

SEQ ID NO: 1752752 - RNA, 13 nt, Salmonella enterica enterica serovar Typhi Ty2
gaaugccagcgcc

SEQ ID NO: 1752753 - RNA, 17 nt, Salmonella enterica enterica serovar Typhi Ty2
gaaugcagaccucugcu

SEQ ID NO: 1752754 - RNA, 13 nt, Salmonella enterica enterica serovar Typhi Ty2
gaaugcaagcagc

SEQ ID NO: 1752755 - RNA, 22 nt, Salmonella enterica enterica serovar Typhi Ty2
gaaugccgcccauccagagcag

SEQ ID NO: 1752756 - RNA, 23 nt, Salmonella enterica enterica serovar Typhi Ty2
gaaugccgcccauccagagcagu

SEQ ID NO: 1752757 - RNA, 18 nt, Salmonella enterica enterica serovar Typhi Ty2
gaaugcccacuccggcgu

SEQ ID NO: 1752758 - RNA, 18 nt, Salmonella enterica enterica serovar Typhi Ty2
gaaugccgaauggcgggc

SEQ ID NO: 1752759 - RNA, 19 nt, Salmonella enterica enterica serovar Typhi Ty2
gaaugccuuuuacaauaac

SEQ ID NO: 1752760 - RNA, 13 nt, Salmonella enterica enterica serovar Typhi Ty2
gaauguguucuuu

SEQ ID NO: 1752761 - RNA, 14 nt, Salmonella enterica enterica serovar Typhi Ty2
gaaugugcaccuua

SEQ ID NO: 1752762 - RNA, 20 nt, Salmonella enterica enterica serovar Typhi Ty2
gaauguuccccguugagaau

SEQ ID NO: 1752763 - RNA, 19 nt, Salmonella enterica enterica serovar Typhi Ty2
gaauguccccauaucccgc

SEQ ID NO: 1752764 - RNA, 15 nt, Salmonella enterica enterica serovar Typhi Ty2
gaauguagcgcccuu

SEQ ID NO: 1752765 - RNA, 20 nt, Salmonella enterica enterica serovar Typhi Ty2
gaauguaggccggguaagcg

SEQ ID NO: 1752766 - RNA, 14 nt, Salmonella enterica enterica serovar Typhi Ty2
gaaugguucccuga

SEQ ID NO: 1752767 - RNA, 19 nt, Salmonella enterica enterica serovar Typhi Ty2
gaauggggaaauaaauaug

SEQ ID NO: 1752768 - RNA, 18 nt, Salmonella enterica enterica serovar Typhi Ty2
gaauggcgauuaacgcau

SEQ ID NO: 1752769 - RNA, 14 nt, Salmonella enterica enterica serovar Typhi Ty2
gaaugagcaucuac

SEQ ID NO: 1752770 - RNA, 23 nt, Salmonella enterica enterica serovar Typhi Ty2
gaaugauugccggauggcggcgu

SEQ ID NO: 1752771 - RNA, 23 nt, Salmonella enterica enterica serovar Typhi Ty2
gaaucuggucggugauauauuca

SEQ ID NO: 1752772 - RNA, 18 nt, Salmonella enterica enterica serovar Typhi Ty2
gaaugaaaaaaaaauuac

SEQ ID NO: 1752773 - RNA, 20 nt, Salmonella enterica enterica serovar Typhi Ty2
gaaucucgugaucgccaaag

SEQ ID NO: 1752774 - RNA, 22 nt, Salmonella enterica enterica serovar Typhi Ty2
gaaucucgaaacaauagcugug

SEQ ID NO: 1752775 - RNA, 22 nt, Salmonella enterica enterica serovar Typhi Ty2
gaaucgugcaagcccaacuauu

SEQ ID NO: 1752776 - RNA, 18 nt, Salmonella enterica enterica serovar Typhi Ty2
gaaucuauuauuaaucug

SEQ ID NO: 1752777 - RNA, 15 nt, Salmonella enterica enterica serovar Typhi Ty2
gaaucgccagucgca

SEQ ID NO: 1752778 - RNA, 16 nt, Salmonella enterica enterica serovar Typhi Ty2
gaaucgccagcaucgg

SEQ ID NO: 1752779 - RNA, 19 nt, Salmonella enterica enterica serovar Typhi Ty2
gaaucgccagucgcagcaa

SEQ ID NO: 1752780 - RNA, 23 nt, Salmonella enterica enterica serovar Typhi Ty2
gaaucgccagcaucggcagcgcc

SEQ ID NO: 1752781 - RNA, 15 nt, Salmonella enterica enterica serovar Typhi Ty2
gaaucgcgauccagc

SEQ ID NO: 1752782 - RNA, 14 nt, Salmonella enterica enterica serovar Typhi Ty2
gaaucgcuuccugg

SEQ ID NO: 1752783 - RNA, 14 nt, Salmonella enterica enterica serovar Typhi Ty2
gaaucagaugcuca

SEQ ID NO: 1752784 - RNA, 14 nt, Salmonella enterica enterica serovar Typhi Ty2
gaaucaucacaauu

SEQ ID NO: 1752785 - RNA, 14 nt, Salmonella enterica enterica serovar Typhi Ty2
gaaucaguauccac

SEQ ID NO: 1752786 - RNA, 11 nt, Salmonella enterica enterica serovar Typhi Ty2
gaauccaggua

SEQ ID NO: 1752787 - RNA, 12 nt, Salmonella enterica enterica serovar Typhi Ty2
gaauccagcagg

SEQ ID NO: 1752788 - RNA, 13 nt, Salmonella enterica enterica serovar Typhi Ty2
gaauccacuuuug

SEQ ID NO: 1752789 - RNA, 22 nt, Salmonella enterica enterica serovar Typhi Ty2
gaauccacuccguguugcugcc

SEQ ID NO: 1752790 - RNA, 18 nt, Salmonella enterica enterica serovar Typhi Ty2
gaauccccggcuuccagc

SEQ ID NO: 1752791 - RNA, 21 nt, Salmonella enterica enterica serovar Typhi Ty2
gaauccccggcuuccagcggc

SEQ ID NO: 1752792 - RNA, 21 nt, Salmonella enterica enterica serovar Typhi Ty2
gaaucccccugccacaaccgc

SEQ ID NO: 1752793 - RNA, 16 nt, Salmonella enterica enterica serovar Typhi Ty2
gaauccccaucuccag

SEQ ID NO: 1752794 - RNA, 19 nt, Salmonella enterica enterica serovar Typhi Ty2
gaauccguugaucguccau

SEQ ID NO: 1752795 - RNA, 14 nt, Salmonella enterica enterica serovar Typhi Ty2
gaauccggcggcuu

SEQ ID NO: 1752796 - RNA, 13 nt, Salmonella enterica enterica serovar Typhi Ty2
gaaguuauccagc

SEQ ID NO: 1752797 - RNA, 15 nt, Salmonella enterica enterica serovar Typhi Ty2
gaaguugcuuccagu

SEQ ID NO: 1752798 - RNA, 14 nt, Salmonella enterica enterica serovar Typhi Ty2
gaauaaaacugccg

SEQ ID NO: 1752799 - RNA, 11 nt, Salmonella enterica enterica serovar Typhi Ty2
gaauaaacaca

SEQ ID NO: 1752800 - RNA, 16 nt, Salmonella enterica enterica serovar Typhi Ty2
gaauaaagacacugcu

SEQ ID NO: 1752801 - RNA, 14 nt, Salmonella enterica enterica serovar Typhi Ty2
gaaguccuucacaa

SEQ ID NO: 1752802 - RNA, 17 nt, Salmonella enterica enterica serovar Typhi Ty2
gaagucgaaauuuucuu

SEQ ID NO: 1752803 - RNA, 15 nt, Salmonella enterica enterica serovar Typhi Ty2
gaagucauucgcagc

SEQ ID NO: 1752804 - RNA, 14 nt, Salmonella enterica enterica serovar Typhi Ty2
gaagucggaaaucu

SEQ ID NO: 1752805 - RNA, 14 nt, Salmonella enterica enterica serovar Typhi Ty2
gaagugccagguuu

SEQ ID NO: 1752806 - RNA, 20 nt, Salmonella enterica enterica serovar Typhi Ty2
gaagugauccuucaacgucu

SEQ ID NO: 1752807 - RNA, 19 nt, Salmonella enterica enterica serovar Typhi Ty2
gaagugcagcguuuccagc

SEQ ID NO: 1752808 - RNA, 23 nt, Salmonella enterica enterica serovar Typhi Ty2
gaaguaaucguuagcgagguucc

SEQ ID NO: 1752809 - RNA, 22 nt, Salmonella enterica enterica serovar Typhi Ty2
gaaguaaaggccguuaaaccaa

SEQ ID NO: 1752810 - RNA, 21 nt, Salmonella enterica enterica serovar Typhi Ty2
gaaguagcagagaaaagguug

SEQ ID NO: 1752811 - RNA, 20 nt, Salmonella enterica enterica serovar Typhi Ty2
gaagguuucgauagcaggca

SEQ ID NO: 1752812 - RNA, 14 nt, Salmonella enterica enterica serovar Typhi Ty2
gaagguuuuucccg

SEQ ID NO: 1752813 - RNA, 11 nt, Salmonella enterica enterica serovar Typhi Ty2
gaaggcggcgg

SEQ ID NO: 1752814 - RNA, 22 nt, Salmonella enterica enterica serovar Typhi Ty2
gaaggcucuacucgcggacgac

SEQ ID NO: 1752815 - RNA, 13 nt, Salmonella enterica enterica serovar Typhi Ty2
gaaggcuuuugcu

SEQ ID NO: 1752816 - RNA, 19 nt, Salmonella enterica enterica serovar Typhi Ty2
gaaggggcgggcagcagca

SEQ ID NO: 1752817 - RNA, 18 nt, Salmonella enterica enterica serovar Typhi Ty2
gaauaaucgccgggcggc

SEQ ID NO: 1752818 - RNA, 15 nt, Salmonella enterica enterica serovar Typhi Ty2
gaauaaucccggcgc

SEQ ID NO: 1752819 - RNA, 16 nt, Salmonella enterica enterica serovar Typhi Ty2
gaauaaagguggugcg

SEQ ID NO: 1752820 - RNA, 22 nt, Salmonella enterica enterica serovar Typhi Ty2
gaauaaaggauuguacuuauua

SEQ ID NO: 1752821 - RNA, 21 nt, Salmonella enterica enterica serovar Typhi Ty2
gaauaaauauaagaucuauuu

SEQ ID NO: 1752822 - RNA, 12 nt, Salmonella enterica enterica serovar Typhi Ty2
gaauaacagcac

SEQ ID NO: 1752823 - RNA, 19 nt, Salmonella enterica enterica serovar Typhi Ty2
gaauaacaucguaaaucaa

SEQ ID NO: 1752824 - RNA, 14 nt, Salmonella enterica enterica serovar Typhi Ty2
gaauaaccaucgga

SEQ ID NO: 1752825 - RNA, 23 nt, Salmonella enterica enterica serovar Typhi Ty2
gaauaacuccagugcagaaagug

SEQ ID NO: 1752826 - RNA, 17 nt, Salmonella enterica enterica serovar Typhi Ty2
gaauaccuugauaacug

SEQ ID NO: 1752827 - RNA, 19 nt, Salmonella enterica enterica serovar Typhi Ty2
gaauacccgcccgguuuug

SEQ ID NO: 1752828 - RNA, 23 nt, Salmonella enterica enterica serovar Typhi Ty2
gaauaccacuucggcagaaaaag

SEQ ID NO: 1752829 - RNA, 17 nt, Salmonella enterica enterica serovar Typhi Ty2
gaauaauguaaaaaaau

SEQ ID NO: 1752830 - RNA, 15 nt, Salmonella enterica enterica serovar Typhi Ty2
gaauaugauuuaaaa

SEQ ID NO: 1752831 - RNA, 23 nt, Salmonella enterica enterica serovar Typhi Ty2
gaauaugagauugugcuuuagcu

SEQ ID NO: 1752832 - RNA, 15 nt, Salmonella enterica enterica serovar Typhi Ty2
gaauaucuucccgac

SEQ ID NO: 1752833 - RNA, 17 nt, Salmonella enterica enterica serovar Typhi Ty2
gaauauccgguacacca

SEQ ID NO: 1752834 - RNA, 18 nt, Salmonella enterica enterica serovar Typhi Ty2
gaauauaguuagaaaaua

SEQ ID NO: 1752835 - RNA, 20 nt, Salmonella enterica enterica serovar Typhi Ty2
gaauaugccaggggaagccg

SEQ ID NO: 1752836 - RNA, 16 nt, Salmonella enterica enterica serovar Typhi Ty2
gaauaugauuuaaaaa

SEQ ID NO: 1752837 - RNA, 18 nt, Salmonella enterica enterica serovar Typhi Ty2
gaauaugauuuaaaaaag

SEQ ID NO: 1752838 - RNA, 16 nt, Salmonella enterica enterica serovar Typhi Ty2
gaauauucauuuccag

SEQ ID NO: 1752839 - RNA, 21 nt, Salmonella enterica enterica serovar Typhi Ty2
gaauauugacaguaauaaugu

SEQ ID NO: 1752840 - RNA, 13 nt, Salmonella enterica enterica serovar Typhi Ty2
gaauauuuugcug

SEQ ID NO: 1752841 - RNA, 13 nt, Salmonella enterica enterica serovar Typhi Ty2
gaauauaccauca

SEQ ID NO: 1752842 - RNA, 15 nt, Salmonella enterica enterica serovar Typhi Ty2
gaauaguuuugccca

SEQ ID NO: 1752843 - RNA, 15 nt, Salmonella enterica enterica serovar Typhi Ty2
gaauagacuggcgcc

SEQ ID NO: 1752844 - RNA, 22 nt, Salmonella enterica enterica serovar Typhi Ty2
gaauagacggccugcaaacgaa

SEQ ID NO: 1752845 - RNA, 17 nt, Salmonella enterica enterica serovar Typhi Ty2
gaauagaggcgcuggcg

SEQ ID NO: 1752846 - RNA, 17 nt, Salmonella enterica enterica serovar Typhi Ty2
gaauagcuuacuuucag

SEQ ID NO: 1752847 - RNA, 23 nt, Salmonella enterica enterica serovar Typhi Ty2
gaauagcccucgguggauaaauu

SEQ ID NO: 1752848 - RNA, 19 nt, Salmonella enterica enterica serovar Typhi Ty2
gaauagccugggcaaggcu

SEQ ID NO: 1752849 - RNA, 14 nt, Salmonella enterica enterica serovar Typhi Ty2
cuuaaaauugaauu

SEQ ID NO: 1752850 - RNA, 13 nt, Salmonella enterica enterica serovar Typhi Ty2
cuuaaaaaauccu

SEQ ID NO: 1752851 - RNA, 14 nt, Salmonella enterica enterica serovar Typhi Ty2
cuuaaaaaauccug

SEQ ID NO: 1752852 - RNA, 15 nt, Salmonella enterica enterica serovar Typhi Ty2
cuguuuuuugccaca

SEQ ID NO: 1752853 - RNA, 22 nt, Salmonella enterica enterica serovar Typhi Ty2
cuguuucuccguuguugcacca

SEQ ID NO: 1752854 - RNA, 23 nt, Salmonella enterica enterica serovar Typhi Ty2
cuguuucuccguuguugcaccac

SEQ ID NO: 1752855 - RNA, 15 nt, Salmonella enterica enterica serovar Typhi Ty2
cuguuugugguccaa

SEQ ID NO: 1752856 - RNA, 13 nt, Salmonella enterica enterica serovar Typhi Ty2
cuguuuuaauucc

SEQ ID NO: 1752857 - RNA, 22 nt, Salmonella enterica enterica serovar Typhi Ty2
cuguuugcugacaaucugcugg

SEQ ID NO: 1752858 - RNA, 22 nt, Salmonella enterica enterica serovar Typhi Ty2
cuguuucucgaucccgaauggc

SEQ ID NO: 1752859 - RNA, 12 nt, Salmonella enterica enterica serovar Typhi Ty2
cuguuuuccgcu

SEQ ID NO: 1752860 - RNA, 15 nt, Salmonella enterica enterica serovar Typhi Ty2
cuguuuucacucuuu

SEQ ID NO: 1752861 - RNA, 12 nt, Salmonella enterica enterica serovar Typhi Ty2
cuguucuggcuc

SEQ ID NO: 1752862 - RNA, 23 nt, Salmonella enterica enterica serovar Typhi Ty2
cuguucuggauagucuucaagcc

SEQ ID NO: 1752863 - RNA, 16 nt, Salmonella enterica enterica serovar Typhi Ty2
cuguugaaagccccgg

SEQ ID NO: 1752864 - RNA, 13 nt, Salmonella enterica enterica serovar Typhi Ty2
cuguucuuuuucg

SEQ ID NO: 1752865 - RNA, 11 nt, Salmonella enterica enterica serovar Typhi Ty2
cuguucugucc

SEQ ID NO: 1752866 - RNA, 17 nt, Salmonella enterica enterica serovar Typhi Ty2
cuguucuugcugcugcu

SEQ ID NO: 1752867 - RNA, 14 nt, Salmonella enterica enterica serovar Typhi Ty2
cugucugaaucagu

SEQ ID NO: 1752868 - RNA, 19 nt, Salmonella enterica enterica serovar Typhi Ty2
cuguugaguucccuucucc

SEQ ID NO: 1752869 - RNA, 21 nt, Salmonella enterica enterica serovar Typhi Ty2
cuguugaguucccuucuccuc

SEQ ID NO: 1752870 - RNA, 21 nt, Salmonella enterica enterica serovar Typhi Ty2
cuguugaugauaaccgccgcc

SEQ ID NO: 1752871 - RNA, 18 nt, Salmonella enterica enterica serovar Typhi Ty2
cuguugcgggccagcagc

SEQ ID NO: 1752872 - RNA, 19 nt, Salmonella enterica enterica serovar Typhi Ty2
cuguuggacugucuuguuu

SEQ ID NO: 1752873 - RNA, 20 nt, Salmonella enterica enterica serovar Typhi Ty2
cuguugccuuugcgcgcgau

SEQ ID NO: 1752874 - RNA, 19 nt, Salmonella enterica enterica serovar Typhi Ty2
cuguuuacccacuucuucc

SEQ ID NO: 1752875 - RNA, 17 nt, Salmonella enterica enterica serovar Typhi Ty2
cuguuuaagcgccucca

SEQ ID NO: 1752876 - RNA, 21 nt, Salmonella enterica enterica serovar Typhi Ty2
cuguuuaagcgccuccacaaa

SEQ ID NO: 1752877 - RNA, 17 nt, Salmonella enterica enterica serovar Typhi Ty2
cuguuuaagcuuuuucu

SEQ ID NO: 1752878 - RNA, 17 nt, Salmonella enterica enterica serovar Typhi Ty2
cuuacaggcuggaaaua

SEQ ID NO: 1752879 - RNA, 13 nt, Salmonella enterica enterica serovar Typhi Ty2
cuuacaggcgcau

SEQ ID NO: 1752880 - RNA, 19 nt, Salmonella enterica enterica serovar Typhi Ty2
cuuacaggcgcaucagaaa

SEQ ID NO: 1752881 - RNA, 13 nt, Salmonella enterica enterica serovar Typhi Ty2
cuuacaauuuauc

SEQ ID NO: 1752882 - RNA, 17 nt, Salmonella enterica enterica serovar Typhi Ty2
cuuacacacccggccua

SEQ ID NO: 1752883 - RNA, 20 nt, Salmonella enterica enterica serovar Typhi Ty2
cuuacaacauuguuauguuu

SEQ ID NO: 1752884 - RNA, 16 nt, Salmonella enterica enterica serovar Typhi Ty2
cuuacaaaaaauacau

SEQ ID NO: 1752885 - RNA, 24 nt, Salmonella enterica enterica serovar Typhi Ty2
cuuacgguaaagcguaucgcccag

SEQ ID NO: 1752886 - RNA, 18 nt, Salmonella enterica enterica serovar Typhi Ty2
cuuacguugcauuuauca

SEQ ID NO: 1752887 - RNA, 22 nt, Salmonella enterica enterica serovar Typhi Ty2
cuuacguuucucacuaauuuga

SEQ ID NO: 1752888 - RNA, 22 nt, Salmonella enterica enterica serovar Typhi Ty2
cuuacggacugcggccugcaaa

SEQ ID NO: 1752889 - RNA, 22 nt, Salmonella enterica enterica serovar Typhi Ty2
cuuacgcggcgcgcucuuuuuc

SEQ ID NO: 1752890 - RNA, 21 nt, Salmonella enterica enterica serovar Typhi Ty2
cuuacggacugcggccugcaa

SEQ ID NO: 1752891 - RNA, 19 nt, Salmonella enterica enterica serovar Typhi Ty2
cuuaccuuguucuuccauu

SEQ ID NO: 1752892 - RNA, 15 nt, Salmonella enterica enterica serovar Typhi Ty2
cuuaccuaagucagu

SEQ ID NO: 1752893 - RNA, 15 nt, Salmonella enterica enterica serovar Typhi Ty2
cuuacgcggcgcgcu

SEQ ID NO: 1752894 - RNA, 21 nt, Salmonella enterica enterica serovar Typhi Ty2
cuuacgcacaaaccgcgcggu

SEQ ID NO: 1752895 - RNA, 20 nt, Salmonella enterica enterica serovar Typhi Ty2
cuuacgaagaucgucgauca

SEQ ID NO: 1752896 - RNA, 13 nt, Salmonella enterica enterica serovar Typhi Ty2
cuuaaauaugaaa

SEQ ID NO: 1752897 - RNA, 14 nt, Salmonella enterica enterica serovar Typhi Ty2
cuuaauaucaauau

SEQ ID NO: 1752898 - RNA, 17 nt, Salmonella enterica enterica serovar Typhi Ty2
cuuaauaucaauauaau

SEQ ID NO: 1752899 - RNA, 20 nt, Salmonella enterica enterica serovar Typhi Ty2
cuuaaucaguucggcaucca

SEQ ID NO: 1752900 - RNA, 23 nt, Salmonella enterica enterica serovar Typhi Ty2
cuuaauaugcugccuacugcccu

SEQ ID NO: 1752901 - RNA, 22 nt, Salmonella enterica enterica serovar Typhi Ty2
cuuaauauccaguugcgccagc

SEQ ID NO: 1752902 - RNA, 13 nt, Salmonella enterica enterica serovar Typhi Ty2
cuuaaucaccagc

SEQ ID NO: 1752903 - RNA, 13 nt, Salmonella enterica enterica serovar Typhi Ty2
cuuaucaggccua

SEQ ID NO: 1752904 - RNA, 19 nt, Salmonella enterica enterica serovar Typhi Ty2
cuuaucaggccuaccagcc

SEQ ID NO: 1752905 - RNA, 11 nt, Salmonella enterica enterica serovar Typhi Ty2
cuuaucagaac

SEQ ID NO: 1752906 - RNA, 14 nt, Salmonella enterica enterica serovar Typhi Ty2
cuuaucaagcgaua

SEQ ID NO: 1752907 - RNA, 20 nt, Salmonella enterica enterica serovar Typhi Ty2
cuuauauuuauuuauugucu

SEQ ID NO: 1752908 - RNA, 20 nt, Salmonella enterica enterica serovar Typhi Ty2
cuuaucaaaccagcuuuuca

SEQ ID NO: 1752909 - RNA, 15 nt, Salmonella enterica enterica serovar Typhi Ty2
cuuauccggcugccg

SEQ ID NO: 1752910 - RNA, 20 nt, Salmonella enterica enterica serovar Typhi Ty2
cuuauccggcuuacggcuau

SEQ ID NO: 1752911 - RNA, 23 nt, Salmonella enterica enterica serovar Typhi Ty2
cuuauccggcuuauccggccugc

SEQ ID NO: 1752912 - RNA, 15 nt, Salmonella enterica enterica serovar Typhi Ty2
cuuaucgccccagcc

SEQ ID NO: 1752913 - RNA, 16 nt, Salmonella enterica enterica serovar Typhi Ty2
cuuaucgccaaagaua

SEQ ID NO: 1752914 - RNA, 22 nt, Salmonella enterica enterica serovar Typhi Ty2
cuuaucggcguguuucaucuca

SEQ ID NO: 1752915 - RNA, 14 nt, Salmonella enterica enterica serovar Typhi Ty2
cuuaucccauugcg

SEQ ID NO: 1752916 - RNA, 21 nt, Salmonella enterica enterica serovar Typhi Ty2
cuuauccggccuacagaacug

SEQ ID NO: 1752917 - RNA, 20 nt, Salmonella enterica enterica serovar Typhi Ty2
cuuauccggccuaccgucuc

SEQ ID NO: 1752918 - RNA, 19 nt, Salmonella enterica enterica serovar Typhi Ty2
cuuauccggccuauagcua

SEQ ID NO: 1752919 - RNA, 19 nt, Salmonella enterica enterica serovar Typhi Ty2
cuuauccgcuuuuaaacgg

SEQ ID NO: 1752920 - RNA, 19 nt, Salmonella enterica enterica serovar Typhi Ty2
cuuauacugauaaacuauc

SEQ ID NO: 1752921 - RNA, 16 nt, Salmonella enterica enterica serovar Typhi Ty2
cuuauacugauaaacu

SEQ ID NO: 1752922 - RNA, 18 nt, Salmonella enterica enterica serovar Typhi Ty2
cuuauacccuuguaaauu

SEQ ID NO: 1752923 - RNA, 16 nt, Salmonella enterica enterica serovar Typhi Ty2
cuuagcaguagugagc

SEQ ID NO: 1752924 - RNA, 18 nt, Salmonella enterica enterica serovar Typhi Ty2
cuuagcaguagugagcca

SEQ ID NO: 1752925 - RNA, 17 nt, Salmonella enterica enterica serovar Typhi Ty2
cuuagcaacugccggcu

SEQ ID NO: 1752926 - RNA, 13 nt, Salmonella enterica enterica serovar Typhi Ty2
cuuaucuggauga

SEQ ID NO: 1752927 - RNA, 18 nt, Salmonella enterica enterica serovar Typhi Ty2
cuuaucggugaugaaagc

SEQ ID NO: 1752928 - RNA, 21 nt, Salmonella enterica enterica serovar Typhi Ty2
cuuauuagaggcguaaguaaa

SEQ ID NO: 1752929 - RNA, 18 nt, Salmonella enterica enterica serovar Typhi Ty2
cuucacaaacaauuuccc

SEQ ID NO: 1752930 - RNA, 23 nt, Salmonella enterica enterica serovar Typhi Ty2
cuucacguugacgcaaacugcca

SEQ ID NO: 1752931 - RNA, 16 nt, Salmonella enterica enterica serovar Typhi Ty2
cuucacguuuuccagg

SEQ ID NO: 1752932 - RNA, 21 nt, Salmonella enterica enterica serovar Typhi Ty2
cuucacguugacgcaaacugc

SEQ ID NO: 1752933 - RNA, 18 nt, Salmonella enterica enterica serovar Typhi Ty2
cuucagaggccuuuugca

SEQ ID NO: 1752934 - RNA, 16 nt, Salmonella enterica enterica serovar Typhi Ty2
cuucacggaaggggcc

SEQ ID NO: 1752935 - RNA, 21 nt, Salmonella enterica enterica serovar Typhi Ty2
cuucacgccgugaauuucugc

SEQ ID NO: 1752936 - RNA, 15 nt, Salmonella enterica enterica serovar Typhi Ty2
cuucacgccauccag

SEQ ID NO: 1752937 - RNA, 14 nt, Salmonella enterica enterica serovar Typhi Ty2
cuucacgcuaaucc

SEQ ID NO: 1752938 - RNA, 19 nt, Salmonella enterica enterica serovar Typhi Ty2
cuucacgcagugcgcgacc

SEQ ID NO: 1752939 - RNA, 21 nt, Salmonella enterica enterica serovar Typhi Ty2
cuucacgagcggucaggccag

SEQ ID NO: 1752940 - RNA, 17 nt, Salmonella enterica enterica serovar Typhi Ty2
cuucagccagacguaaa

SEQ ID NO: 1752941 - RNA, 17 nt, Salmonella enterica enterica serovar Typhi Ty2
cuucagcgacaucguca

SEQ ID NO: 1752942 - RNA, 18 nt, Salmonella enterica enterica serovar Typhi Ty2
cuucagcauacaggucuu

SEQ ID NO: 1752943 - RNA, 14 nt, Salmonella enterica enterica serovar Typhi Ty2
cuucagcaucaucu

SEQ ID NO: 1752944 - RNA, 19 nt, Salmonella enterica enterica serovar Typhi Ty2
cuucaucaaagaaauaccc

SEQ ID NO: 1752945 - RNA, 19 nt, Salmonella enterica enterica serovar Typhi Ty2
cuucaucaguaacugacga

SEQ ID NO: 1752946 - RNA, 17 nt, Salmonella enterica enterica serovar Typhi Ty2
cuucaucaguaacugac

SEQ ID NO: 1752947 - RNA, 15 nt, Salmonella enterica enterica serovar Typhi Ty2
cuucaucccacucaa

SEQ ID NO: 1752948 - RNA, 14 nt, Salmonella enterica enterica serovar Typhi Ty2
cuucauccacgccg

SEQ ID NO: 1752949 - RNA, 22 nt, Salmonella enterica enterica serovar Typhi Ty2
cuucaugugguaggcuucaacc

SEQ ID NO: 1752950 - RNA, 13 nt, Salmonella enterica enterica serovar Typhi Ty2
cuucaugcacaaa

SEQ ID NO: 1752951 - RNA, 22 nt, Salmonella enterica enterica serovar Typhi Ty2
cuucagguuuuuaagcugccca

SEQ ID NO: 1752952 - RNA, 12 nt, Salmonella enterica enterica serovar Typhi Ty2
cuucaguaacca

SEQ ID NO: 1752953 - RNA, 19 nt, Salmonella enterica enterica serovar Typhi Ty2
cuucaguaaccagggagga

SEQ ID NO: 1752954 - RNA, 15 nt, Salmonella enterica enterica serovar Typhi Ty2
cuucaguaagcgagu

SEQ ID NO: 1752955 - RNA, 14 nt, Salmonella enterica enterica serovar Typhi Ty2
cuucagguuaagug

SEQ ID NO: 1752956 - RNA, 19 nt, Salmonella enterica enterica serovar Typhi Ty2
cuucagucuacuacacacu

SEQ ID NO: 1752957 - RNA, 16 nt, Salmonella enterica enterica serovar Typhi Ty2
cuucagcguugucccg

SEQ ID NO: 1752958 - RNA, 23 nt, Salmonella enterica enterica serovar Typhi Ty2
cuucagcguccggaaaauccuca

SEQ ID NO: 1752959 - RNA, 20 nt, Salmonella enterica enterica serovar Typhi Ty2
cuucagcggcgcguugccgc

SEQ ID NO: 1752960 - RNA, 20 nt, Salmonella enterica enterica serovar Typhi Ty2
cuucgccaucuccaucauuu

SEQ ID NO: 1752961 - RNA, 23 nt, Salmonella enterica enterica serovar Typhi Ty2
cuucgcccauugccacccauuua

SEQ ID NO: 1752962 - RNA, 15 nt, Salmonella enterica enterica serovar Typhi Ty2
cuucgcgggaccaaa

SEQ ID NO: 1752963 - RNA, 16 nt, Salmonella enterica enterica serovar Typhi Ty2
cuucgcggaauuucag

SEQ ID NO: 1752964 - RNA, 19 nt, Salmonella enterica enterica serovar Typhi Ty2
cuucgcgcagccagcgccc

SEQ ID NO: 1752965 - RNA, 18 nt, Salmonella enterica enterica serovar Typhi Ty2
cuuccggauuaaagacgc

SEQ ID NO: 1752966 - RNA, 20 nt, Salmonella enterica enterica serovar Typhi Ty2
cuuccggauaacgcgcuggc

SEQ ID NO: 1752967 - RNA, 21 nt, Salmonella enterica enterica serovar Typhi Ty2
cuuccggagacuaucuugccg

SEQ ID NO: 1752968 - RNA, 18 nt, Salmonella enterica enterica serovar Typhi Ty2
cuuccggcacucuucuuc

SEQ ID NO: 1752969 - RNA, 22 nt, Salmonella enterica enterica serovar Typhi Ty2
cuuccgggcgacgauacaacuc

SEQ ID NO: 1752970 - RNA, 15 nt, Salmonella enterica enterica serovar Typhi Ty2
cuuccgggcgggcgc

SEQ ID NO: 1752971 - RNA, 16 nt, Salmonella enterica enterica serovar Typhi Ty2
cuuccugagcagacau

SEQ ID NO: 1752972 - RNA, 19 nt, Salmonella enterica enterica serovar Typhi Ty2
cuuccugcacgccugcuuc

SEQ ID NO: 1752973 - RNA, 14 nt, Salmonella enterica enterica serovar Typhi Ty2
cuuccugcacgccu

SEQ ID NO: 1752974 - RNA, 13 nt, Salmonella enterica enterica serovar Typhi Ty2
cuucgcaaucucc

SEQ ID NO: 1752975 - RNA, 15 nt, Salmonella enterica enterica serovar Typhi Ty2
cuuccaucagccagg

SEQ ID NO: 1752976 - RNA, 17 nt, Salmonella enterica enterica serovar Typhi Ty2
cuuccaugccuucauaa

SEQ ID NO: 1752977 - RNA, 17 nt, Salmonella enterica enterica serovar Typhi Ty2
cuuccgccaccacgccc

SEQ ID NO: 1752978 - RNA, 22 nt, Salmonella enterica enterica serovar Typhi Ty2
cuuccgcaauacagcccgccag

SEQ ID NO: 1752979 - RNA, 21 nt, Salmonella enterica enterica serovar Typhi Ty2
cuuccgccaggcgggugguga

SEQ ID NO: 1752980 - RNA, 24 nt, Salmonella enterica enterica serovar Typhi Ty2
cuucauuuauggguuccaguugca

SEQ ID NO: 1752981 - RNA, 16 nt, Salmonella enterica enterica serovar Typhi Ty2
cuuccaguccagcgcg

SEQ ID NO: 1752982 - RNA, 10 nt, Salmonella enterica enterica serovar Typhi Ty2
cuuccaguac

SEQ ID NO: 1752983 - RNA, 14 nt, Salmonella enterica enterica serovar Typhi Ty2
cuuccaguugcguc

SEQ ID NO: 1752984 - RNA, 13 nt, Salmonella enterica enterica serovar Typhi Ty2
cuuccaguugcuu

SEQ ID NO: 1752985 - RNA, 14 nt, Salmonella enterica enterica serovar Typhi Ty2
cuuucauuccuuua

SEQ ID NO: 1752986 - RNA, 17 nt, Salmonella enterica enterica serovar Typhi Ty2
cuuucauuccuuuagcu

SEQ ID NO: 1752987 - RNA, 19 nt, Salmonella enterica enterica serovar Typhi Ty2
cuuuccgacccuuauguca

SEQ ID NO: 1752988 - RNA, 15 nt, Salmonella enterica enterica serovar Typhi Ty2
cuuuccgcaccgcuu

SEQ ID NO: 1752989 - RNA, 15 nt, Salmonella enterica enterica serovar Typhi Ty2
cuuucgccagcggcg

SEQ ID NO: 1752990 - RNA, 18 nt, Salmonella enterica enterica serovar Typhi Ty2
cuuuccuuuuucaggcac

SEQ ID NO: 1752991 - RNA, 18 nt, Salmonella enterica enterica serovar Typhi Ty2
cuuucggaauauugguac

SEQ ID NO: 1752992 - RNA, 16 nt, Salmonella enterica enterica serovar Typhi Ty2
cuuucggacuuccugu

SEQ ID NO: 1752993 - RNA, 19 nt, Salmonella enterica enterica serovar Typhi Ty2
cuuucucggcuuuccagcu

SEQ ID NO: 1752994 - RNA, 22 nt, Salmonella enterica enterica serovar Typhi Ty2
cuuucucgaauccacuuuuguc

SEQ ID NO: 1752995 - RNA, 23 nt, Salmonella enterica enterica serovar Typhi Ty2
cuuuacgcagauaacuuccuuug

SEQ ID NO: 1752996 - RNA, 20 nt, Salmonella enterica enterica serovar Typhi Ty2
cuuuaucaaacaaaccaaac

SEQ ID NO: 1752997 - RNA, 12 nt, Salmonella enterica enterica serovar Typhi Ty2
cuuuauauuuuu

SEQ ID NO: 1752998 - RNA, 17 nt, Salmonella enterica enterica serovar Typhi Ty2
cuuuauauaaaaaaugg

SEQ ID NO: 1752999 - RNA, 20 nt, Salmonella enterica enterica serovar Typhi Ty2
cuuuaaucacccgcgccagc

SEQ ID NO: 1753000 - RNA, 14 nt, Salmonella enterica enterica serovar Typhi Ty2
cuuuaccgugaaug

SEQ ID NO: 1753001 - RNA, 19 nt, Salmonella enterica enterica serovar Typhi Ty2
cuuuacccgggccaucuuu

SEQ ID NO: 1753002 - RNA, 14 nt, Salmonella enterica enterica serovar Typhi Ty2
cuuuacccagcggg

SEQ ID NO: 1753003 - RNA, 16 nt, Salmonella enterica enterica serovar Typhi Ty2
cuuuaccaaugugcaa

SEQ ID NO: 1753004 - RNA, 14 nt, Salmonella enterica enterica serovar Typhi Ty2
cuuuauucgcuugu

SEQ ID NO: 1753005 - RNA, 21 nt, Salmonella enterica enterica serovar Typhi Ty2
cuuuaugucaguaauauauua

SEQ ID NO: 1753006 - RNA, 14 nt, Salmonella enterica enterica serovar Typhi Ty2
cuuuaugucaguaa

SEQ ID NO: 1753007 - RNA, 14 nt, Salmonella enterica enterica serovar Typhi Ty2
cuuucacccauuga

SEQ ID NO: 1753008 - RNA, 18 nt, Salmonella enterica enterica serovar Typhi Ty2
cuuucaccggucgcaaga

SEQ ID NO: 1753009 - RNA, 16 nt, Salmonella enterica enterica serovar Typhi Ty2
cuuguccgaugcagac

SEQ ID NO: 1753010 - RNA, 15 nt, Salmonella enterica enterica serovar Typhi Ty2
cuugucauccugcuc

SEQ ID NO: 1753011 - RNA, 22 nt, Salmonella enterica enterica serovar Typhi Ty2
cuugugcuuccagcuccaucca

SEQ ID NO: 1753012 - RNA, 15 nt, Salmonella enterica enterica serovar Typhi Ty2
cuugugcuuccagcu

SEQ ID NO: 1753013 - RNA, 22 nt, Salmonella enterica enterica serovar Typhi Ty2
cuugugauaucugacuuauucg

SEQ ID NO: 1753014 - RNA, 24 nt, Salmonella enterica enterica serovar Typhi Ty2
cuuguuauccuaaaucugccauca

SEQ ID NO: 1753015 - RNA, 15 nt, Salmonella enterica enterica serovar Typhi Ty2
cuuguuguaaagaaa

SEQ ID NO: 1753016 - RNA, 15 nt, Salmonella enterica enterica serovar Typhi Ty2
cuuguucuuccauug

SEQ ID NO: 1753017 - RNA, 14 nt, Salmonella enterica enterica serovar Typhi Ty2
cuuguugcggauga

SEQ ID NO: 1753018 - RNA, 14 nt, Salmonella enterica enterica serovar Typhi Ty2
cuuuaaccgccugc

SEQ ID NO: 1753019 - RNA, 15 nt, Salmonella enterica enterica serovar Typhi Ty2
cuuuaaccgccugcu

SEQ ID NO: 1753020 - RNA, 13 nt, Salmonella enterica enterica serovar Typhi Ty2
cuuuaaccucuuu

SEQ ID NO: 1753021 - RNA, 14 nt, Salmonella enterica enterica serovar Typhi Ty2
cuuuaaccacagcc

SEQ ID NO: 1753022 - RNA, 15 nt, Salmonella enterica enterica serovar Typhi Ty2
cuugcggcgccagga

SEQ ID NO: 1753023 - RNA, 17 nt, Salmonella enterica enterica serovar Typhi Ty2
cuugcggggagaaugcg

SEQ ID NO: 1753024 - RNA, 16 nt, Salmonella enterica enterica serovar Typhi Ty2
cuugcggugagaaacg

SEQ ID NO: 1753025 - RNA, 22 nt, Salmonella enterica enterica serovar Typhi Ty2
cuugcucaaaaagcucaagcgc

SEQ ID NO: 1753026 - RNA, 17 nt, Salmonella enterica enterica serovar Typhi Ty2
cuugcuuuucaucacca

SEQ ID NO: 1753027 - RNA, 18 nt, Salmonella enterica enterica serovar Typhi Ty2
cuugccguuuuucucauc

SEQ ID NO: 1753028 - RNA, 15 nt, Salmonella enterica enterica serovar Typhi Ty2
cuugccguuuuucuc

SEQ ID NO: 1753029 - RNA, 15 nt, Salmonella enterica enterica serovar Typhi Ty2
cuugcgccaucaucc

SEQ ID NO: 1753030 - RNA, 23 nt, Salmonella enterica enterica serovar Typhi Ty2
cuugccgucaacacgcagaccca

SEQ ID NO: 1753031 - RNA, 15 nt, Salmonella enterica enterica serovar Typhi Ty2
cuugccggcgcagcg

SEQ ID NO: 1753032 - RNA, 15 nt, Salmonella enterica enterica serovar Typhi Ty2
cuugccgggggcgcu

SEQ ID NO: 1753033 - RNA, 22 nt, Salmonella enterica enterica serovar Typhi Ty2
cuugcagccagaacucaucuuc

SEQ ID NO: 1753034 - RNA, 19 nt, Salmonella enterica enterica serovar Typhi Ty2
cuucuuuauccugaagaug

SEQ ID NO: 1753035 - RNA, 17 nt, Salmonella enterica enterica serovar Typhi Ty2
cuucuuuaucuucugcu

SEQ ID NO: 1753036 - RNA, 21 nt, Salmonella enterica enterica serovar Typhi Ty2
cuucuuuaucuucugcugcuc

SEQ ID NO: 1753037 - RNA, 21 nt, Salmonella enterica enterica serovar Typhi Ty2
cuucuuuauucgcgaugcacc

SEQ ID NO: 1753038 - RNA, 23 nt, Salmonella enterica enterica serovar Typhi Ty2
cuugaugauucacccucgucuuu

SEQ ID NO: 1753039 - RNA, 18 nt, Salmonella enterica enterica serovar Typhi Ty2
cuugauggaaaacgcauc

SEQ ID NO: 1753040 - RNA, 13 nt, Salmonella enterica enterica serovar Typhi Ty2
cuugaugugucua

SEQ ID NO: 1753041 - RNA, 12 nt, Salmonella enterica enterica serovar Typhi Ty2
cuugauuccugg

SEQ ID NO: 1753042 - RNA, 19 nt, Salmonella enterica enterica serovar Typhi Ty2
cuugcacgccaaaaaguga

SEQ ID NO: 1753043 - RNA, 19 nt, Salmonella enterica enterica serovar Typhi Ty2
cuugauaaugucaacuuaa

SEQ ID NO: 1753044 - RNA, 16 nt, Salmonella enterica enterica serovar Typhi Ty2
cuugauacggcuuuca

SEQ ID NO: 1753045 - RNA, 23 nt, Salmonella enterica enterica serovar Typhi Ty2
cuucuccuucaaucacaaaaugg

SEQ ID NO: 1753046 - RNA, 17 nt, Salmonella enterica enterica serovar Typhi Ty2
cuucucuaucagcgccu

SEQ ID NO: 1753047 - RNA, 13 nt, Salmonella enterica enterica serovar Typhi Ty2
cuucuccgccauc

SEQ ID NO: 1753048 - RNA, 13 nt, Salmonella enterica enterica serovar Typhi Ty2
cuucuccccuuca

SEQ ID NO: 1753049 - RNA, 23 nt, Salmonella enterica enterica serovar Typhi Ty2
cuucuccccuucaucaguaacug

SEQ ID NO: 1753050 - RNA, 16 nt, Salmonella enterica enterica serovar Typhi Ty2
cuucuccucaacagac

SEQ ID NO: 1753051 - RNA, 18 nt, Salmonella enterica enterica serovar Typhi Ty2
cuucucgaaguucucaau

SEQ ID NO: 1753052 - RNA, 15 nt, Salmonella enterica enterica serovar Typhi Ty2
cuucgcgguuagaaa

SEQ ID NO: 1753053 - RNA, 13 nt, Salmonella enterica enterica serovar Typhi Ty2
cuucugcugugca

SEQ ID NO: 1753054 - RNA, 15 nt, Salmonella enterica enterica serovar Typhi Ty2
cuucugccgcgcggu

SEQ ID NO: 1753055 - RNA, 19 nt, Salmonella enterica enterica serovar Typhi Ty2
cuucugauggcuuugcugu

SEQ ID NO: 1753056 - RNA, 15 nt, Salmonella enterica enterica serovar Typhi Ty2
cuucugauggcuuug

SEQ ID NO: 1753057 - RNA, 23 nt, Salmonella enterica enterica serovar Typhi Ty2
cuucugacccaaucagacgccgg

SEQ ID NO: 1753058 - RNA, 17 nt, Salmonella enterica enterica serovar Typhi Ty2
cuucuucaguuccgcca

SEQ ID NO: 1753059 - RNA, 13 nt, Salmonella enterica enterica serovar Typhi Ty2
cuucuucaucuuc

SEQ ID NO: 1753060 - RNA, 13 nt, Salmonella enterica enterica serovar Typhi Ty2
cuucuucccccug

SEQ ID NO: 1753061 - RNA, 21 nt, Salmonella enterica enterica serovar Typhi Ty2
cuucuucggcagcuuccagca

SEQ ID NO: 1753062 - RNA, 15 nt, Salmonella enterica enterica serovar Typhi Ty2
cuucuucgcggccgc

SEQ ID NO: 1753063 - RNA, 15 nt, Salmonella enterica enterica serovar Typhi Ty2
cuucuucuaccaccu

SEQ ID NO: 1753064 - RNA, 13 nt, Salmonella enterica enterica serovar Typhi Ty2
cuucuggcucaga

SEQ ID NO: 1753065 - RNA, 16 nt, Salmonella enterica enterica serovar Typhi Ty2
cuucuggcgcaucaac

SEQ ID NO: 1753066 - RNA, 22 nt, Salmonella enterica enterica serovar Typhi Ty2
cuucugucagccuugcaucuca

SEQ ID NO: 1753067 - RNA, 20 nt, Salmonella enterica enterica serovar Typhi Ty2
cuucugucugcgugaagaca

SEQ ID NO: 1753068 - RNA, 21 nt, Salmonella enterica enterica serovar Typhi Ty2
cuggcgaugugcccgagugac

SEQ ID NO: 1753069 - RNA, 19 nt, Salmonella enterica enterica serovar Typhi Ty2
cuggcgauuuucauagcug

SEQ ID NO: 1753070 - RNA, 15 nt, Salmonella enterica enterica serovar Typhi Ty2
cuggcgcaaaugggc

SEQ ID NO: 1753071 - RNA, 14 nt, Salmonella enterica enterica serovar Typhi Ty2
cuggcgcaaccggc

SEQ ID NO: 1753072 - RNA, 23 nt, Salmonella enterica enterica serovar Typhi Ty2
cuggccugauaagcgcagcgcca

SEQ ID NO: 1753073 - RNA, 13 nt, Salmonella enterica enterica serovar Typhi Ty2
cuggccuucuuuc

SEQ ID NO: 1753074 - RNA, 15 nt, Salmonella enterica enterica serovar Typhi Ty2
cuggccuucuuucuc

SEQ ID NO: 1753075 - RNA, 20 nt, Salmonella enterica enterica serovar Typhi Ty2
cuggccguuuucccggcaau

SEQ ID NO: 1753076 - RNA, 17 nt, Salmonella enterica enterica serovar Typhi Ty2
cuggccguuuucccggc

SEQ ID NO: 1753077 - RNA, 20 nt, Salmonella enterica enterica serovar Typhi Ty2
cuggcggaauggcgggcgca

SEQ ID NO: 1753078 - RNA, 19 nt, Salmonella enterica enterica serovar Typhi Ty2
cuggcggaauggcgggcgc

SEQ ID NO: 1753079 - RNA, 23 nt, Salmonella enterica enterica serovar Typhi Ty2
cuggcgcuguaauagauaugaaa

SEQ ID NO: 1753080 - RNA, 17 nt, Salmonella enterica enterica serovar Typhi Ty2
cuggcgcugaccgcccc

SEQ ID NO: 1753081 - RNA, 19 nt, Salmonella enterica enterica serovar Typhi Ty2
cuggcgcuuuuccagcacg

SEQ ID NO: 1753082 - RNA, 19 nt, Salmonella enterica enterica serovar Typhi Ty2
cuggcgcggggaacacaga

SEQ ID NO: 1753083 - RNA, 18 nt, Salmonella enterica enterica serovar Typhi Ty2
cuggcgcggggaacacag

SEQ ID NO: 1753084 - RNA, 17 nt, Salmonella enterica enterica serovar Typhi Ty2
cuggcgcggggaacaca

SEQ ID NO: 1753085 - RNA, 17 nt, Salmonella enterica enterica serovar Typhi Ty2
cuggcgcggggaacacu

SEQ ID NO: 1753086 - RNA, 17 nt, Salmonella enterica enterica serovar Typhi Ty2
cuggcgcggggaacacg

SEQ ID NO: 1753087 - RNA, 15 nt, Salmonella enterica enterica serovar Typhi Ty2
cuggcgcuggcugcc

SEQ ID NO: 1753088 - RNA, 15 nt, Salmonella enterica enterica serovar Typhi Ty2
cuggcgcuggguaac

SEQ ID NO: 1753089 - RNA, 19 nt, Salmonella enterica enterica serovar Typhi Ty2
cuggcgcggggaacacacg

SEQ ID NO: 1753090 - RNA, 14 nt, Salmonella enterica enterica serovar Typhi Ty2
cuggcaguucaucu

SEQ ID NO: 1753091 - RNA, 19 nt, Salmonella enterica enterica serovar Typhi Ty2
cuggcauaaccgcagcgcg

SEQ ID NO: 1753092 - RNA, 20 nt, Salmonella enterica enterica serovar Typhi Ty2
cuggcaguccacguagcugc

SEQ ID NO: 1753093 - RNA, 23 nt, Salmonella enterica enterica serovar Typhi Ty2
cuggcaguucaucuucccgcaga

SEQ ID NO: 1753094 - RNA, 18 nt, Salmonella enterica enterica serovar Typhi Ty2
cuggcauggcucgccgcu

SEQ ID NO: 1753095 - RNA, 16 nt, Salmonella enterica enterica serovar Typhi Ty2
cuggcauggugcagcc

SEQ ID NO: 1753096 - RNA, 16 nt, Salmonella enterica enterica serovar Typhi Ty2
cuggcauuacgcuggc

SEQ ID NO: 1753097 - RNA, 19 nt, Salmonella enterica enterica serovar Typhi Ty2
cuggcauuacgcuggcccc

SEQ ID NO: 1753098 - RNA, 14 nt, Salmonella enterica enterica serovar Typhi Ty2
cuggccacagcaaa

SEQ ID NO: 1753099 - RNA, 23 nt, Salmonella enterica enterica serovar Typhi Ty2
cuggccacgccgaggcauucagc

SEQ ID NO: 1753100 - RNA, 22 nt, Salmonella enterica enterica serovar Typhi Ty2
cuggccccgcauuuuaccucac

SEQ ID NO: 1753101 - RNA, 22 nt, Salmonella enterica enterica serovar Typhi Ty2
cuggaguuuaaacacucuccac

SEQ ID NO: 1753102 - RNA, 14 nt, Salmonella enterica enterica serovar Typhi Ty2
cuggauaaaagguc

SEQ ID NO: 1753103 - RNA, 21 nt, Salmonella enterica enterica serovar Typhi Ty2
cuggaguuuaaacacucucca

SEQ ID NO: 1753104 - RNA, 20 nt, Salmonella enterica enterica serovar Typhi Ty2
cuggauaauaagacgccagu

SEQ ID NO: 1753105 - RNA, 16 nt, Salmonella enterica enterica serovar Typhi Ty2
cuggaggcggaagugc

SEQ ID NO: 1753106 - RNA, 19 nt, Salmonella enterica enterica serovar Typhi Ty2
cuggcaauaaagcagggcg

SEQ ID NO: 1753107 - RNA, 19 nt, Salmonella enterica enterica serovar Typhi Ty2
cuggauaccgcgccagcga

SEQ ID NO: 1753108 - RNA, 22 nt, Salmonella enterica enterica serovar Typhi Ty2
cuggcaagaccgauagagacug

SEQ ID NO: 1753109 - RNA, 14 nt, Salmonella enterica enterica serovar Typhi Ty2
cuggcaaucaugcg

SEQ ID NO: 1753110 - RNA, 16 nt, Salmonella enterica enterica serovar Typhi Ty2
cuggaacaaaccgacu

SEQ ID NO: 1753111 - RNA, 20 nt, Salmonella enterica enterica serovar Typhi Ty2
cuggaacaaaccgacuuuca

SEQ ID NO: 1753112 - RNA, 20 nt, Salmonella enterica enterica serovar Typhi Ty2
cuggacauauuccagaagcg

SEQ ID NO: 1753113 - RNA, 22 nt, Salmonella enterica enterica serovar Typhi Ty2
cuggaauuuuuccagcucagaa

SEQ ID NO: 1753114 - RNA, 16 nt, Salmonella enterica enterica serovar Typhi Ty2
cuggaauuuuuccagc

SEQ ID NO: 1753115 - RNA, 21 nt, Salmonella enterica enterica serovar Typhi Ty2
cuggaccccagauaauagcug

SEQ ID NO: 1753116 - RNA, 13 nt, Salmonella enterica enterica serovar Typhi Ty2
cuggagccacauc

SEQ ID NO: 1753117 - RNA, 20 nt, Salmonella enterica enterica serovar Typhi Ty2
cuggagcaggugcggcuggg

SEQ ID NO: 1753118 - RNA, 15 nt, Salmonella enterica enterica serovar Typhi Ty2
cuggagaucagcaug

SEQ ID NO: 1753119 - RNA, 19 nt, Salmonella enterica enterica serovar Typhi Ty2
cuggagagcagcgccagcg

SEQ ID NO: 1753120 - RNA, 15 nt, Salmonella enterica enterica serovar Typhi Ty2
cuggagaaugggauu

SEQ ID NO: 1753121 - RNA, 13 nt, Salmonella enterica enterica serovar Typhi Ty2
cugcuucuggcuu

SEQ ID NO: 1753122 - RNA, 20 nt, Salmonella enterica enterica serovar Typhi Ty2
cugcucagaaauauucagua

SEQ ID NO: 1753123 - RNA, 21 nt, Salmonella enterica enterica serovar Typhi Ty2
cugcucacgguuuagcucugu

SEQ ID NO: 1753124 - RNA, 23 nt, Salmonella enterica enterica serovar Typhi Ty2
cugcucaauacuuuccgggccgg

SEQ ID NO: 1753125 - RNA, 22 nt, Salmonella enterica enterica serovar Typhi Ty2
cugcucaagaauacccuuuaca

SEQ ID NO: 1753126 - RNA, 14 nt, Salmonella enterica enterica serovar Typhi Ty2
cugcuauccccauu

SEQ ID NO: 1753127 - RNA, 15 nt, Salmonella enterica enterica serovar Typhi Ty2
cugcuuuuugauaca

SEQ ID NO: 1753128 - RNA, 15 nt, Salmonella enterica enterica serovar Typhi Ty2
cugcuuucugucacc

SEQ ID NO: 1753129 - RNA, 20 nt, Salmonella enterica enterica serovar Typhi Ty2
cuggaaaauuucagugaaaa

SEQ ID NO: 1753130 - RNA, 15 nt, Salmonella enterica enterica serovar Typhi Ty2
cugcuuguucuuuuc

SEQ ID NO: 1753131 - RNA, 18 nt, Salmonella enterica enterica serovar Typhi Ty2
cugucgccgucugcaaaa

SEQ ID NO: 1753132 - RNA, 13 nt, Salmonella enterica enterica serovar Typhi Ty2
cugucgccgcgca

SEQ ID NO: 1753133 - RNA, 20 nt, Salmonella enterica enterica serovar Typhi Ty2
cugucgccgcguaaauccac

SEQ ID NO: 1753134 - RNA, 15 nt, Salmonella enterica enterica serovar Typhi Ty2
cugucgccgcccguc

SEQ ID NO: 1753135 - RNA, 17 nt, Salmonella enterica enterica serovar Typhi Ty2
cugucgcccgcaaccac

SEQ ID NO: 1753136 - RNA, 14 nt, Salmonella enterica enterica serovar Typhi Ty2
cugucgccaccacu

SEQ ID NO: 1753137 - RNA, 21 nt, Salmonella enterica enterica serovar Typhi Ty2
cugucgcaauuuaccuauuuc

SEQ ID NO: 1753138 - RNA, 21 nt, Salmonella enterica enterica serovar Typhi Ty2
cugucccuucgcccggcgcgc

SEQ ID NO: 1753139 - RNA, 16 nt, Salmonella enterica enterica serovar Typhi Ty2
cugucgucaccagcag

SEQ ID NO: 1753140 - RNA, 15 nt, Salmonella enterica enterica serovar Typhi Ty2
cugucgucaccugua

SEQ ID NO: 1753141 - RNA, 16 nt, Salmonella enterica enterica serovar Typhi Ty2
cugucguauuuauuuu

SEQ ID NO: 1753142 - RNA, 17 nt, Salmonella enterica enterica serovar Typhi Ty2
cugucggucagauucag

SEQ ID NO: 1753143 - RNA, 15 nt, Salmonella enterica enterica serovar Typhi Ty2
cugucggcagaaccu

SEQ ID NO: 1753144 - RNA, 18 nt, Salmonella enterica enterica serovar Typhi Ty2
cugucauaggcgacaggc

SEQ ID NO: 1753145 - RNA, 17 nt, Salmonella enterica enterica serovar Typhi Ty2
cugucagaaaucugaau

SEQ ID NO: 1753146 - RNA, 20 nt, Salmonella enterica enterica serovar Typhi Ty2
cugucacuccggcugcacca

SEQ ID NO: 1753147 - RNA, 14 nt, Salmonella enterica enterica serovar Typhi Ty2
cugucaaaaauaac

SEQ ID NO: 1753148 - RNA, 18 nt, Salmonella enterica enterica serovar Typhi Ty2
cugucaaaacccagccca

SEQ ID NO: 1753149 - RNA, 17 nt, Salmonella enterica enterica serovar Typhi Ty2
cuguauuuucguuugca

SEQ ID NO: 1753150 - RNA, 16 nt, Salmonella enterica enterica serovar Typhi Ty2
cuguauacacuuucca

SEQ ID NO: 1753151 - RNA, 20 nt, Salmonella enterica enterica serovar Typhi Ty2
cuguaaaccgccuccaggcc

SEQ ID NO: 1753152 - RNA, 12 nt, Salmonella enterica enterica serovar Typhi Ty2
cuguaaaaggga

SEQ ID NO: 1753153 - RNA, 23 nt, Salmonella enterica enterica serovar Typhi Ty2
cuguaaaagggauacgguuuuuu

SEQ ID NO: 1753154 - RNA, 18 nt, Salmonella enterica enterica serovar Typhi Ty2
cugguuuuagcuuauccc

SEQ ID NO: 1753155 - RNA, 15 nt, Salmonella enterica enterica serovar Typhi Ty2
cugguuuuuccauuc

SEQ ID NO: 1753156 - RNA, 22 nt, Salmonella enterica enterica serovar Typhi Ty2
cuggugcgacaccacgcaggcg

SEQ ID NO: 1753157 - RNA, 19 nt, Salmonella enterica enterica serovar Typhi Ty2
cuggugcgacaccacgcag

SEQ ID NO: 1753158 - RNA, 15 nt, Salmonella enterica enterica serovar Typhi Ty2
cuggugcgaauaagc

SEQ ID NO: 1753159 - RNA, 17 nt, Salmonella enterica enterica serovar Typhi Ty2
cuggugcgaauaagcuc

SEQ ID NO: 1753160 - RNA, 18 nt, Salmonella enterica enterica serovar Typhi Ty2
cuguaacaacuguuuuuc

SEQ ID NO: 1753161 - RNA, 14 nt, Salmonella enterica enterica serovar Typhi Ty2
cuguaaaucugccg

SEQ ID NO: 1753162 - RNA, 20 nt, Salmonella enterica enterica serovar Typhi Ty2
cuguaaacguuccugccagc

SEQ ID NO: 1753163 - RNA, 23 nt, Salmonella enterica enterica serovar Typhi Ty2
cuguaauucucccaaauuuuuuu

SEQ ID NO: 1753164 - RNA, 18 nt, Salmonella enterica enterica serovar Typhi Ty2
cuguaauuauaaauauua

SEQ ID NO: 1753165 - RNA, 17 nt, Salmonella enterica enterica serovar Typhi Ty2
cuguaaugucuggugca

SEQ ID NO: 1753166 - RNA, 23 nt, Salmonella enterica enterica serovar Typhi Ty2
cuguaaaucgcgcccgacauggc

SEQ ID NO: 1753167 - RNA, 14 nt, Salmonella enterica enterica serovar Typhi Ty2
cuguaacacugccg

SEQ ID NO: 1753168 - RNA, 14 nt, Salmonella enterica enterica serovar Typhi Ty2
cuguaaccccugcg

SEQ ID NO: 1753169 - RNA, 16 nt, Salmonella enterica enterica serovar Typhi Ty2
cuguacgcccagccgu

SEQ ID NO: 1753170 - RNA, 18 nt, Salmonella enterica enterica serovar Typhi Ty2
cuguaccugauccagcuc

SEQ ID NO: 1753171 - RNA, 14 nt, Salmonella enterica enterica serovar Typhi Ty2
cuguacgcccagcc

SEQ ID NO: 1753172 - RNA, 20 nt, Salmonella enterica enterica serovar Typhi Ty2
cuguagguucgguaugccuu

SEQ ID NO: 1753173 - RNA, 20 nt, Salmonella enterica enterica serovar Typhi Ty2
cuguacggagcuaauaugaa

SEQ ID NO: 1753174 - RNA, 16 nt, Salmonella enterica enterica serovar Typhi Ty2
cuguacggaauaagcg

SEQ ID NO: 1753175 - RNA, 14 nt, Salmonella enterica enterica serovar Typhi Ty2
cuguacgccucuuu

SEQ ID NO: 1753176 - RNA, 15 nt, Salmonella enterica enterica serovar Typhi Ty2
cuguauaaaauauuu

SEQ ID NO: 1753177 - RNA, 15 nt, Salmonella enterica enterica serovar Typhi Ty2
cuguauaaacucagc

SEQ ID NO: 1753178 - RNA, 16 nt, Salmonella enterica enterica serovar Typhi Ty2
cuguaccaccacgccc

SEQ ID NO: 1753179 - RNA, 12 nt, Salmonella enterica enterica serovar Typhi Ty2
cuguaccaccag

SEQ ID NO: 1753180 - RNA, 14 nt, Salmonella enterica enterica serovar Typhi Ty2
cuguaccaccacgc

SEQ ID NO: 1753181 - RNA, 12 nt, Salmonella enterica enterica serovar Typhi Ty2
cuguaccaggac

SEQ ID NO: 1753182 - RNA, 16 nt, Salmonella enterica enterica serovar Typhi Ty2
cuguaauuucgcuggc

SEQ ID NO: 1753183 - RNA, 19 nt, Salmonella enterica enterica serovar Typhi Ty2
cuguacaaaaucaucauca

SEQ ID NO: 1753184 - RNA, 13 nt, Salmonella enterica enterica serovar Typhi Ty2
cuguacauaucca

SEQ ID NO: 1753185 - RNA, 22 nt, Salmonella enterica enterica serovar Typhi Ty2
cugguaacggcacugcuuuucg

SEQ ID NO: 1753186 - RNA, 15 nt, Salmonella enterica enterica serovar Typhi Ty2
cugguaaggcaaaua

SEQ ID NO: 1753187 - RNA, 18 nt, Salmonella enterica enterica serovar Typhi Ty2
cuggcgucgccaaagcag

SEQ ID NO: 1753188 - RNA, 17 nt, Salmonella enterica enterica serovar Typhi Ty2
cugggcgacuucauuca

SEQ ID NO: 1753189 - RNA, 22 nt, Salmonella enterica enterica serovar Typhi Ty2
cugggcgagggaggcaaucgca

SEQ ID NO: 1753190 - RNA, 19 nt, Salmonella enterica enterica serovar Typhi Ty2
cugggcgcaugaggccugu

SEQ ID NO: 1753191 - RNA, 21 nt, Salmonella enterica enterica serovar Typhi Ty2
cuggcguaugcuuucagcaug

SEQ ID NO: 1753192 - RNA, 15 nt, Salmonella enterica enterica serovar Typhi Ty2
cuggugauaaagcag

SEQ ID NO: 1753193 - RNA, 17 nt, Salmonella enterica enterica serovar Typhi Ty2
cuggugacgaugauaac

SEQ ID NO: 1753194 - RNA, 20 nt, Salmonella enterica enterica serovar Typhi Ty2
cuggugagguuucagcaccu

SEQ ID NO: 1753195 - RNA, 18 nt, Salmonella enterica enterica serovar Typhi Ty2
cuggugaagacgcugcaa

SEQ ID NO: 1753196 - RNA, 14 nt, Salmonella enterica enterica serovar Typhi Ty2
cuggugaucuggcc

SEQ ID NO: 1753197 - RNA, 19 nt, Salmonella enterica enterica serovar Typhi Ty2
cuggugcccgcaaaaccuu

SEQ ID NO: 1753198 - RNA, 13 nt, Salmonella enterica enterica serovar Typhi Ty2
cuggucgggcagg

SEQ ID NO: 1753199 - RNA, 22 nt, Salmonella enterica enterica serovar Typhi Ty2
cuggucguaagaauuauuacca

SEQ ID NO: 1753200 - RNA, 18 nt, Salmonella enterica enterica serovar Typhi Ty2
cuggucggcgaccagcag

SEQ ID NO: 1753201 - RNA, 18 nt, Salmonella enterica enterica serovar Typhi Ty2
cuggucugaaucugcucc

SEQ ID NO: 1753202 - RNA, 18 nt, Salmonella enterica enterica serovar Typhi Ty2
cugguagagaucgacaaa

SEQ ID NO: 1753203 - RNA, 21 nt, Salmonella enterica enterica serovar Typhi Ty2
cugguacguccauccgccggg

SEQ ID NO: 1753204 - RNA, 21 nt, Salmonella enterica enterica serovar Typhi Ty2
cugguagcccucgcaaagcug

SEQ ID NO: 1753205 - RNA, 23 nt, Salmonella enterica enterica serovar Typhi Ty2
cugguaggucaacccuauugcca

SEQ ID NO: 1753206 - RNA, 18 nt, Salmonella enterica enterica serovar Typhi Ty2
cugguauaggccaggcua

SEQ ID NO: 1753207 - RNA, 15 nt, Salmonella enterica enterica serovar Typhi Ty2
cugguauugaauauu

SEQ ID NO: 1753208 - RNA, 17 nt, Salmonella enterica enterica serovar Typhi Ty2
cugcguaggggcgaccg

SEQ ID NO: 1753209 - RNA, 18 nt, Salmonella enterica enterica serovar Typhi Ty2
cugcgugaugcaucagaa

SEQ ID NO: 1753210 - RNA, 23 nt, Salmonella enterica enterica serovar Typhi Ty2
cugcgugccguugaccagcugac

SEQ ID NO: 1753211 - RNA, 23 nt, Salmonella enterica enterica serovar Typhi Ty2
cugcguaaaccauuucuccugca

SEQ ID NO: 1753212 - RNA, 20 nt, Salmonella enterica enterica serovar Typhi Ty2
cugcuaaacgagccgucauc

SEQ ID NO: 1753213 - RNA, 20 nt, Salmonella enterica enterica serovar Typhi Ty2
cugcuaaaacagcucacccc

SEQ ID NO: 1753214 - RNA, 20 nt, Salmonella enterica enterica serovar Typhi Ty2
cugcguugcucgccagccug

SEQ ID NO: 1753215 - RNA, 20 nt, Salmonella enterica enterica serovar Typhi Ty2
cugcguugcuauggcaacaa

SEQ ID NO: 1753216 - RNA, 15 nt, Salmonella enterica enterica serovar Typhi Ty2
cugcgguauauuccc

SEQ ID NO: 1753217 - RNA, 18 nt, Salmonella enterica enterica serovar Typhi Ty2
cugcgguaaucugccagc

SEQ ID NO: 1753218 - RNA, 16 nt, Salmonella enterica enterica serovar Typhi Ty2
cugcggucaggaauga

SEQ ID NO: 1753219 - RNA, 18 nt, Salmonella enterica enterica serovar Typhi Ty2
cugcgguacugcuggccu

SEQ ID NO: 1753220 - RNA, 14 nt, Salmonella enterica enterica serovar Typhi Ty2
cugcgcuucggcca

SEQ ID NO: 1753221 - RNA, 11 nt, Salmonella enterica enterica serovar Typhi Ty2
cugcgcuuuga

SEQ ID NO: 1753222 - RNA, 21 nt, Salmonella enterica enterica serovar Typhi Ty2
cugcgcuucgaugcguucaaa

SEQ ID NO: 1753223 - RNA, 16 nt, Salmonella enterica enterica serovar Typhi Ty2
cugcgcuuuggguuaa

SEQ ID NO: 1753224 - RNA, 23 nt, Salmonella enterica enterica serovar Typhi Ty2
cugcggaacuaacccgcagccgg

SEQ ID NO: 1753225 - RNA, 13 nt, Salmonella enterica enterica serovar Typhi Ty2
cugcggaauuuua

SEQ ID NO: 1753226 - RNA, 23 nt, Salmonella enterica enterica serovar Typhi Ty2
cugcgcaggucgccagaagccgu

SEQ ID NO: 1753227 - RNA, 16 nt, Salmonella enterica enterica serovar Typhi Ty2
cugcgcauccucuuuc

SEQ ID NO: 1753228 - RNA, 14 nt, Salmonella enterica enterica serovar Typhi Ty2
cugcgccaaaucgg

SEQ ID NO: 1753229 - RNA, 18 nt, Salmonella enterica enterica serovar Typhi Ty2
cugcgccauugcgggagc

SEQ ID NO: 1753230 - RNA, 16 nt, Salmonella enterica enterica serovar Typhi Ty2
cugcgcccgcaagcug

SEQ ID NO: 1753231 - RNA, 12 nt, Salmonella enterica enterica serovar Typhi Ty2
cugccugcagac

SEQ ID NO: 1753232 - RNA, 18 nt, Salmonella enterica enterica serovar Typhi Ty2
cugccuguuuacggcagg

SEQ ID NO: 1753233 - RNA, 22 nt, Salmonella enterica enterica serovar Typhi Ty2
cugccuggcucauucuccggga

SEQ ID NO: 1753234 - RNA, 12 nt, Salmonella enterica enterica serovar Typhi Ty2
cugccugcuuca

SEQ ID NO: 1753235 - RNA, 13 nt, Salmonella enterica enterica serovar Typhi Ty2
cugccugcuucag

SEQ ID NO: 1753236 - RNA, 12 nt, Salmonella enterica enterica serovar Typhi Ty2
cugcgcgccgga

SEQ ID NO: 1753237 - RNA, 17 nt, Salmonella enterica enterica serovar Typhi Ty2
cugcgcgucccucucca

SEQ ID NO: 1753238 - RNA, 20 nt, Salmonella enterica enterica serovar Typhi Ty2
cugcgcggcaaugagcggcc

SEQ ID NO: 1753239 - RNA, 18 nt, Salmonella enterica enterica serovar Typhi Ty2
cugccccagacgcccuuc

SEQ ID NO: 1753240 - RNA, 20 nt, Salmonella enterica enterica serovar Typhi Ty2
cugcccauguuuaccaucgc

SEQ ID NO: 1753241 - RNA, 16 nt, Salmonella enterica enterica serovar Typhi Ty2
cugcccggcaaccuga

SEQ ID NO: 1753242 - RNA, 17 nt, Salmonella enterica enterica serovar Typhi Ty2
cugcccgccgccaccau

SEQ ID NO: 1753243 - RNA, 16 nt, Salmonella enterica enterica serovar Typhi Ty2
cugcccgcguuuccac

SEQ ID NO: 1753244 - RNA, 20 nt, Salmonella enterica enterica serovar Typhi Ty2
cugccaucgcuucuacagcc

SEQ ID NO: 1753245 - RNA, 15 nt, Salmonella enterica enterica serovar Typhi Ty2
cugccaucauccagu

SEQ ID NO: 1753246 - RNA, 15 nt, Salmonella enterica enterica serovar Typhi Ty2
cugccaugccugaug

SEQ ID NO: 1753247 - RNA, 13 nt, Salmonella enterica enterica serovar Typhi Ty2
cugccaucaucca

SEQ ID NO: 1753248 - RNA, 18 nt, Salmonella enterica enterica serovar Typhi Ty2
cugccauagcaucaccag

SEQ ID NO: 1753249 - RNA, 19 nt, Salmonella enterica enterica serovar Typhi Ty2
cugccagggugcaaagaaa

SEQ ID NO: 1753250 - RNA, 23 nt, Salmonella enterica enterica serovar Typhi Ty2
cugccaggcguguggccagggca

SEQ ID NO: 1753251 - RNA, 16 nt, Salmonella enterica enterica serovar Typhi Ty2
cugccagucugcccgg

SEQ ID NO: 1753252 - RNA, 18 nt, Salmonella enterica enterica serovar Typhi Ty2
cugccaguagauggcgcu

SEQ ID NO: 1753253 - RNA, 19 nt, Salmonella enterica enterica serovar Typhi Ty2
cugccaguaguugaauaac

SEQ ID NO: 1753254 - RNA, 16 nt, Salmonella enterica enterica serovar Typhi Ty2
cugccaccgucgcggc

SEQ ID NO: 1753255 - RNA, 20 nt, Salmonella enterica enterica serovar Typhi Ty2
cugccacgcuuuuccuucca

SEQ ID NO: 1753256 - RNA, 12 nt, Salmonella enterica enterica serovar Typhi Ty2
cugccguaaaca

SEQ ID NO: 1753257 - RNA, 13 nt, Salmonella enterica enterica serovar Typhi Ty2
cugccgguucggc

SEQ ID NO: 1753258 - RNA, 14 nt, Salmonella enterica enterica serovar Typhi Ty2
cugccggucggcgu

SEQ ID NO: 1753259 - RNA, 13 nt, Salmonella enterica enterica serovar Typhi Ty2
cugccuaaagaaa

SEQ ID NO: 1753260 - RNA, 16 nt, Salmonella enterica enterica serovar Typhi Ty2
cugccuaaauugacgc

SEQ ID NO: 1753261 - RNA, 13 nt, Salmonella enterica enterica serovar Typhi Ty2
cugccuacugccc

SEQ ID NO: 1753262 - RNA, 23 nt, Salmonella enterica enterica serovar Typhi Ty2
cugccucaacaaguccuucuucc

SEQ ID NO: 1753263 - RNA, 19 nt, Salmonella enterica enterica serovar Typhi Ty2
cugccguuaaucuggccua

SEQ ID NO: 1753264 - RNA, 14 nt, Salmonella enterica enterica serovar Typhi Ty2
cugccgucccagcg

SEQ ID NO: 1753265 - RNA, 17 nt, Salmonella enterica enterica serovar Typhi Ty2
cugccgacaacgccucc

SEQ ID NO: 1753266 - RNA, 22 nt, Salmonella enterica enterica serovar Typhi Ty2
cugccgacgcccucaauaucuu

SEQ ID NO: 1753267 - RNA, 15 nt, Salmonella enterica enterica serovar Typhi Ty2
cugaucggccagcgu

SEQ ID NO: 1753268 - RNA, 22 nt, Salmonella enterica enterica serovar Typhi Ty2
cugaucuggcugcguaaaauca

SEQ ID NO: 1753269 - RNA, 16 nt, Salmonella enterica enterica serovar Typhi Ty2
cugauguccgcagccg

SEQ ID NO: 1753270 - RNA, 14 nt, Salmonella enterica enterica serovar Typhi Ty2
cugauguuccggca

SEQ ID NO: 1753271 - RNA, 17 nt, Salmonella enterica enterica serovar Typhi Ty2
cugauuaauaugaacca

SEQ ID NO: 1753272 - RNA, 14 nt, Salmonella enterica enterica serovar Typhi Ty2
cugauugucagcag

SEQ ID NO: 1753273 - RNA, 19 nt, Salmonella enterica enterica serovar Typhi Ty2
cugauugacuaucagccgc

SEQ ID NO: 1753274 - RNA, 17 nt, Salmonella enterica enterica serovar Typhi Ty2
cugauugccggaugucg

SEQ ID NO: 1753275 - RNA, 17 nt, Salmonella enterica enterica serovar Typhi Ty2
cugcaacgccugcggau

SEQ ID NO: 1753276 - RNA, 17 nt, Salmonella enterica enterica serovar Typhi Ty2
cugcaacuccugggcaa

SEQ ID NO: 1753277 - RNA, 19 nt, Salmonella enterica enterica serovar Typhi Ty2
cugauuucgacgauaaaaa

SEQ ID NO: 1753278 - RNA, 21 nt, Salmonella enterica enterica serovar Typhi Ty2
cugcacaacauuccgcuucca

SEQ ID NO: 1753279 - RNA, 17 nt, Salmonella enterica enterica serovar Typhi Ty2
cugcacaauaccaauaa

SEQ ID NO: 1753280 - RNA, 18 nt, Salmonella enterica enterica serovar Typhi Ty2
cugcaaucguucuugcac

SEQ ID NO: 1753281 - RNA, 21 nt, Salmonella enterica enterica serovar Typhi Ty2
cugcagaaucccgauaaucaa

SEQ ID NO: 1753282 - RNA, 20 nt, Salmonella enterica enterica serovar Typhi Ty2
cugcagacccacuuucagcu

SEQ ID NO: 1753283 - RNA, 16 nt, Salmonella enterica enterica serovar Typhi Ty2
cugcacguaccugcuc

SEQ ID NO: 1753284 - RNA, 23 nt, Salmonella enterica enterica serovar Typhi Ty2
cugcacgucgcgcucgcucauca

SEQ ID NO: 1753285 - RNA, 20 nt, Salmonella enterica enterica serovar Typhi Ty2
cugcagaccuauauggcgca

SEQ ID NO: 1753286 - RNA, 14 nt, Salmonella enterica enterica serovar Typhi Ty2
cugcaggucacgau

SEQ ID NO: 1753287 - RNA, 14 nt, Salmonella enterica enterica serovar Typhi Ty2
cugaggcgcuggcu

SEQ ID NO: 1753288 - RNA, 18 nt, Salmonella enterica enterica serovar Typhi Ty2
cugaggcuauugucauug

SEQ ID NO: 1753289 - RNA, 20 nt, Salmonella enterica enterica serovar Typhi Ty2
cugaguauaaaacucgccgc

SEQ ID NO: 1753290 - RNA, 12 nt, Salmonella enterica enterica serovar Typhi Ty2
cugaguauguua

SEQ ID NO: 1753291 - RNA, 22 nt, Salmonella enterica enterica serovar Typhi Ty2
cugaguuacgaucguuugccca

SEQ ID NO: 1753292 - RNA, 19 nt, Salmonella enterica enterica serovar Typhi Ty2
cugaguuucucccgccaga

SEQ ID NO: 1753293 - RNA, 13 nt, Salmonella enterica enterica serovar Typhi Ty2
cugagucuugccu

SEQ ID NO: 1753294 - RNA, 17 nt, Salmonella enterica enterica serovar Typhi Ty2
cugagugacgggcuggc

SEQ ID NO: 1753295 - RNA, 12 nt, Salmonella enterica enterica serovar Typhi Ty2
cugagucauccu

SEQ ID NO: 1753296 - RNA, 17 nt, Salmonella enterica enterica serovar Typhi Ty2
cugaggcguugcuccag

SEQ ID NO: 1753297 - RNA, 20 nt, Salmonella enterica enterica serovar Typhi Ty2
cugaggcguugcuccagcag

SEQ ID NO: 1753298 - RNA, 20 nt, Salmonella enterica enterica serovar Typhi Ty2
cucuaucuuuucaaucaggu

SEQ ID NO: 1753299 - RNA, 18 nt, Salmonella enterica enterica serovar Typhi Ty2
cucuaugaaugccggaug

SEQ ID NO: 1753300 - RNA, 18 nt, Salmonella enterica enterica serovar Typhi Ty2
cugagcuaaucacccacu

SEQ ID NO: 1753301 - RNA, 19 nt, Salmonella enterica enterica serovar Typhi Ty2
cucuauugauuggcaagaa

SEQ ID NO: 1753302 - RNA, 14 nt, Salmonella enterica enterica serovar Typhi Ty2
cugauaguuuaaau

SEQ ID NO: 1753303 - RNA, 15 nt, Salmonella enterica enterica serovar Typhi Ty2
cugauauaacccuca

SEQ ID NO: 1753304 - RNA, 20 nt, Salmonella enterica enterica serovar Typhi Ty2
cugauauuacuaauaaaauu

SEQ ID NO: 1753305 - RNA, 16 nt, Salmonella enterica enterica serovar Typhi Ty2
cugauauuuuuacuga

SEQ ID NO: 1753306 - RNA, 18 nt, Salmonella enterica enterica serovar Typhi Ty2
cugaucaucggcgcgucg

SEQ ID NO: 1753307 - RNA, 22 nt, Salmonella enterica enterica serovar Typhi Ty2
cugaucgccacgccuaaacuga

SEQ ID NO: 1753308 - RNA, 16 nt, Salmonella enterica enterica serovar Typhi Ty2
cugaucgcgcagacag

SEQ ID NO: 1753309 - RNA, 23 nt, Salmonella enterica enterica serovar Typhi Ty2
cugaucgaggacggccugacggu

SEQ ID NO: 1753310 - RNA, 18 nt, Salmonella enterica enterica serovar Typhi Ty2
cugaucgaggucgccaaa

SEQ ID NO: 1753311 - RNA, 17 nt, Salmonella enterica enterica serovar Typhi Ty2
cugauccagcucuucuu

SEQ ID NO: 1753312 - RNA, 17 nt, Salmonella enterica enterica serovar Typhi Ty2
cugaucccacuuaggca

SEQ ID NO: 1753313 - RNA, 15 nt, Salmonella enterica enterica serovar Typhi Ty2
cugaucccgcgcgcc

SEQ ID NO: 1753314 - RNA, 18 nt, Salmonella enterica enterica serovar Typhi Ty2
cugauaacgauaagugaa

SEQ ID NO: 1753315 - RNA, 14 nt, Salmonella enterica enterica serovar Typhi Ty2
cugauaagcacagg

SEQ ID NO: 1753316 - RNA, 13 nt, Salmonella enterica enterica serovar Typhi Ty2
cugauaaaagccc

SEQ ID NO: 1753317 - RNA, 11 nt, Salmonella enterica enterica serovar Typhi Ty2
cugauaaaauu

SEQ ID NO: 1753318 - RNA, 17 nt, Salmonella enterica enterica serovar Typhi Ty2
cugauaagcgcagcgcc

SEQ ID NO: 1753319 - RNA, 16 nt, Salmonella enterica enterica serovar Typhi Ty2
cugauaaucgagacug

SEQ ID NO: 1753320 - RNA, 20 nt, Salmonella enterica enterica serovar Typhi Ty2
cugauacgcaccagcucuac

SEQ ID NO: 1753321 - RNA, 16 nt, Salmonella enterica enterica serovar Typhi Ty2
cugauagcaaucaucc

SEQ ID NO: 1753322 - RNA, 17 nt, Salmonella enterica enterica serovar Typhi Ty2
cugauagcauuguaucc

SEQ ID NO: 1753323 - RNA, 21 nt, Salmonella enterica enterica serovar Typhi Ty2
cuaggccagugccaagcaaca

SEQ ID NO: 1753324 - RNA, 19 nt, Salmonella enterica enterica serovar Typhi Ty2
cuaggccagugccaagcaa

SEQ ID NO: 1753325 - RNA, 16 nt, Salmonella enterica enterica serovar Typhi Ty2
cuauaaaaaugaggua

SEQ ID NO: 1753326 - RNA, 23 nt, Salmonella enterica enterica serovar Typhi Ty2
cuauagaaugcaagcagcauaau

SEQ ID NO: 1753327 - RNA, 12 nt, Salmonella enterica enterica serovar Typhi Ty2
cuauaauaacaa

SEQ ID NO: 1753328 - RNA, 18 nt, Salmonella enterica enterica serovar Typhi Ty2
cuauaauaccuccugucu

SEQ ID NO: 1753329 - RNA, 23 nt, Salmonella enterica enterica serovar Typhi Ty2
cuauaauugcuuuuuuccacaga

SEQ ID NO: 1753330 - RNA, 16 nt, Salmonella enterica enterica serovar Typhi Ty2
cuauaauugcuuuuuu

SEQ ID NO: 1753331 - RNA, 14 nt, Salmonella enterica enterica serovar Typhi Ty2
cuaucuucgauaaa

SEQ ID NO: 1753332 - RNA, 13 nt, Salmonella enterica enterica serovar Typhi Ty2
cuaugauaagccu

SEQ ID NO: 1753333 - RNA, 12 nt, Salmonella enterica enterica serovar Typhi Ty2
cuaugguacaca

SEQ ID NO: 1753334 - RNA, 22 nt, Salmonella enterica enterica serovar Typhi Ty2
cuaugguacggcguguuuaacu

SEQ ID NO: 1753335 - RNA, 17 nt, Salmonella enterica enterica serovar Typhi Ty2
cuaucgaccagcaccug

SEQ ID NO: 1753336 - RNA, 16 nt, Salmonella enterica enterica serovar Typhi Ty2
cuaucgccaaacuggu

SEQ ID NO: 1753337 - RNA, 12 nt, Salmonella enterica enterica serovar Typhi Ty2
cuauccuggccu

SEQ ID NO: 1753338 - RNA, 22 nt, Salmonella enterica enterica serovar Typhi Ty2
cuauccguccucuuucccuuuu

SEQ ID NO: 1753339 - RNA, 17 nt, Salmonella enterica enterica serovar Typhi Ty2
cuauccguuuugacgac

SEQ ID NO: 1753340 - RNA, 14 nt, Salmonella enterica enterica serovar Typhi Ty2
cuacguuuaucugg

SEQ ID NO: 1753341 - RNA, 22 nt, Salmonella enterica enterica serovar Typhi Ty2
cuacgugauagaucacuuguuu

SEQ ID NO: 1753342 - RNA, 13 nt, Salmonella enterica enterica serovar Typhi Ty2
cuacguucaucag

SEQ ID NO: 1753343 - RNA, 13 nt, Salmonella enterica enterica serovar Typhi Ty2
cuacuacauaucu

SEQ ID NO: 1753344 - RNA, 13 nt, Salmonella enterica enterica serovar Typhi Ty2
cuagaacauuucc

SEQ ID NO: 1753345 - RNA, 16 nt, Salmonella enterica enterica serovar Typhi Ty2
cuaauaccgagaaugc

SEQ ID NO: 1753346 - RNA, 20 nt, Salmonella enterica enterica serovar Typhi Ty2
cuaccgcucaggcgcgcgcu

SEQ ID NO: 1753347 - RNA, 14 nt, Salmonella enterica enterica serovar Typhi Ty2
cuaccgggcaaaca

SEQ ID NO: 1753348 - RNA, 17 nt, Salmonella enterica enterica serovar Typhi Ty2
cuaccggggcgcucgcc

SEQ ID NO: 1753349 - RNA, 16 nt, Salmonella enterica enterica serovar Typhi Ty2
cuaccugcgagcugua

SEQ ID NO: 1753350 - RNA, 16 nt, Salmonella enterica enterica serovar Typhi Ty2
cuaccuucuucccaua

SEQ ID NO: 1753351 - RNA, 14 nt, Salmonella enterica enterica serovar Typhi Ty2
cuacgcuauuucca

SEQ ID NO: 1753352 - RNA, 15 nt, Salmonella enterica enterica serovar Typhi Ty2
cuacgguaaaccagg

SEQ ID NO: 1753353 - RNA, 20 nt, Salmonella enterica enterica serovar Typhi Ty2
cucaguccagccgccgcgcg

SEQ ID NO: 1753354 - RNA, 16 nt, Salmonella enterica enterica serovar Typhi Ty2
cucaguccagccgccg

SEQ ID NO: 1753355 - RNA, 14 nt, Salmonella enterica enterica serovar Typhi Ty2
cucagucagucccg

SEQ ID NO: 1753356 - RNA, 13 nt, Salmonella enterica enterica serovar Typhi Ty2
cucaucacagcca

SEQ ID NO: 1753357 - RNA, 17 nt, Salmonella enterica enterica serovar Typhi Ty2
cucaucacagccacacu

SEQ ID NO: 1753358 - RNA, 19 nt, Salmonella enterica enterica serovar Typhi Ty2
cucaucgguuaacacauau

SEQ ID NO: 1753359 - RNA, 17 nt, Salmonella enterica enterica serovar Typhi Ty2
cucaucggucgcaucca

SEQ ID NO: 1753360 - RNA, 21 nt, Salmonella enterica enterica serovar Typhi Ty2
cucaugugcagcauccagcuc

SEQ ID NO: 1753361 - RNA, 15 nt, Salmonella enterica enterica serovar Typhi Ty2
cucauguucgcuucu

SEQ ID NO: 1753362 - RNA, 22 nt, Salmonella enterica enterica serovar Typhi Ty2
cucaucuucggcgggaucucca

SEQ ID NO: 1753363 - RNA, 15 nt, Salmonella enterica enterica serovar Typhi Ty2
cucauggacaaaaaa

SEQ ID NO: 1753364 - RNA, 18 nt, Salmonella enterica enterica serovar Typhi Ty2
cucauguaaaggcgugug

SEQ ID NO: 1753365 - RNA, 13 nt, Salmonella enterica enterica serovar Typhi Ty2
cucacuguugaua

SEQ ID NO: 1753366 - RNA, 13 nt, Salmonella enterica enterica serovar Typhi Ty2
cucaccucccccg

SEQ ID NO: 1753367 - RNA, 14 nt, Salmonella enterica enterica serovar Typhi Ty2
cucaccugaugcga

SEQ ID NO: 1753368 - RNA, 19 nt, Salmonella enterica enterica serovar Typhi Ty2
cucaccguagcuccagacc

SEQ ID NO: 1753369 - RNA, 19 nt, Salmonella enterica enterica serovar Typhi Ty2
cucagaccauauucacgca

SEQ ID NO: 1753370 - RNA, 18 nt, Salmonella enterica enterica serovar Typhi Ty2
cucacuuuucuuuccugc

SEQ ID NO: 1753371 - RNA, 17 nt, Salmonella enterica enterica serovar Typhi Ty2
cucagaucggcagacag

SEQ ID NO: 1753372 - RNA, 23 nt, Salmonella enterica enterica serovar Typhi Ty2
cucagcauagcgcugaaacggga

SEQ ID NO: 1753373 - RNA, 24 nt, Salmonella enterica enterica serovar Typhi Ty2
cucagcaaaaucacgcacacgucu

SEQ ID NO: 1753374 - RNA, 18 nt, Salmonella enterica enterica serovar Typhi Ty2
cucaggcaagacacagcg

SEQ ID NO: 1753375 - RNA, 17 nt, Salmonella enterica enterica serovar Typhi Ty2
cucagggucagaauaca

SEQ ID NO: 1753376 - RNA, 15 nt, Salmonella enterica enterica serovar Typhi Ty2
cucaggacgccagug

SEQ ID NO: 1753377 - RNA, 13 nt, Salmonella enterica enterica serovar Typhi Ty2
cucaggacgccag

SEQ ID NO: 1753378 - RNA, 19 nt, Salmonella enterica enterica serovar Typhi Ty2
cucaggaaaacaaauugca

SEQ ID NO: 1753379 - RNA, 21 nt, Salmonella enterica enterica serovar Typhi Ty2
cucaggaagcguccagaugca

SEQ ID NO: 1753380 - RNA, 13 nt, Salmonella enterica enterica serovar Typhi Ty2
cucaggaaaacaa

SEQ ID NO: 1753381 - RNA, 19 nt, Salmonella enterica enterica serovar Typhi Ty2
cucagcuaaaaacagcgca

SEQ ID NO: 1753382 - RNA, 16 nt, Salmonella enterica enterica serovar Typhi Ty2
cucaccgccuaggcca

SEQ ID NO: 1753383 - RNA, 23 nt, Salmonella enterica enterica serovar Typhi Ty2
cucaccaguccggcagaaagcag

SEQ ID NO: 1753384 - RNA, 17 nt, Salmonella enterica enterica serovar Typhi Ty2
cucaccaccgccgcgag

SEQ ID NO: 1753385 - RNA, 13 nt, Salmonella enterica enterica serovar Typhi Ty2
cucaccaccgccg

SEQ ID NO: 1753386 - RNA, 14 nt, Salmonella enterica enterica serovar Typhi Ty2
cucaauuuuacagc

SEQ ID NO: 1753387 - RNA, 17 nt, Salmonella enterica enterica serovar Typhi Ty2
cucaauuuuacagccuc

SEQ ID NO: 1753388 - RNA, 15 nt, Salmonella enterica enterica serovar Typhi Ty2
cucacaaaacuauuu

SEQ ID NO: 1753389 - RNA, 19 nt, Salmonella enterica enterica serovar Typhi Ty2
cucacauucauaaaagauc

SEQ ID NO: 1753390 - RNA, 17 nt, Salmonella enterica enterica serovar Typhi Ty2
cucaaugguuucacgcu

SEQ ID NO: 1753391 - RNA, 15 nt, Salmonella enterica enterica serovar Typhi Ty2
cucaaugauuuccgc

SEQ ID NO: 1753392 - RNA, 15 nt, Salmonella enterica enterica serovar Typhi Ty2
cucaaucugaugaug

SEQ ID NO: 1753393 - RNA, 15 nt, Salmonella enterica enterica serovar Typhi Ty2
cucaauuuuacagcc

SEQ ID NO: 1753394 - RNA, 20 nt, Salmonella enterica enterica serovar Typhi Ty2
cucaagguagcgugucuacc

SEQ ID NO: 1753395 - RNA, 22 nt, Salmonella enterica enterica serovar Typhi Ty2
cucaagguagcgugucuaccaa

SEQ ID NO: 1753396 - RNA, 15 nt, Salmonella enterica enterica serovar Typhi Ty2
cucaaggucugucag

SEQ ID NO: 1753397 - RNA, 18 nt, Salmonella enterica enterica serovar Typhi Ty2
cucaaucauugucauuaa

SEQ ID NO: 1753398 - RNA, 21 nt, Salmonella enterica enterica serovar Typhi Ty2
cucaaccaccaccgauaaacg

SEQ ID NO: 1753399 - RNA, 14 nt, Salmonella enterica enterica serovar Typhi Ty2
cucaaccagcaaug

SEQ ID NO: 1753400 - RNA, 23 nt, Salmonella enterica enterica serovar Typhi Ty2
cucaaccaugauaaccagccccg

SEQ ID NO: 1753401 - RNA, 22 nt, Salmonella enterica enterica serovar Typhi Ty2
cucaaggcaauagaccagcggc

SEQ ID NO: 1753402 - RNA, 15 nt, Salmonella enterica enterica serovar Typhi Ty2
cucaaccgcgcggcg

SEQ ID NO: 1753403 - RNA, 16 nt, Salmonella enterica enterica serovar Typhi Ty2
cucaaccgguuuguca

SEQ ID NO: 1753404 - RNA, 18 nt, Salmonella enterica enterica serovar Typhi Ty2
cucaaccugaggaaaaag

SEQ ID NO: 1753405 - RNA, 16 nt, Salmonella enterica enterica serovar Typhi Ty2
cuauuucaacccggca

SEQ ID NO: 1753406 - RNA, 22 nt, Salmonella enterica enterica serovar Typhi Ty2
cuauuucaguacagccaaaaau

SEQ ID NO: 1753407 - RNA, 14 nt, Salmonella enterica enterica serovar Typhi Ty2
cuauuuccagaaau

SEQ ID NO: 1753408 - RNA, 13 nt, Salmonella enterica enterica serovar Typhi Ty2
cuauuugcagauu

SEQ ID NO: 1753409 - RNA, 19 nt, Salmonella enterica enterica serovar Typhi Ty2
cuauuuaaaaaccgccccc

SEQ ID NO: 1753410 - RNA, 17 nt, Salmonella enterica enterica serovar Typhi Ty2
cuauuuaacccugguuu

SEQ ID NO: 1753411 - RNA, 19 nt, Salmonella enterica enterica serovar Typhi Ty2
cuauuacaaaaaucaugcc

SEQ ID NO: 1753412 - RNA, 13 nt, Salmonella enterica enterica serovar Typhi Ty2
cuauuacaaaaau

SEQ ID NO: 1753413 - RNA, 13 nt, Salmonella enterica enterica serovar Typhi Ty2
cuauuaaucaccu

SEQ ID NO: 1753414 - RNA, 18 nt, Salmonella enterica enterica serovar Typhi Ty2
cuauuaaucugugagcac

SEQ ID NO: 1753415 - RNA, 16 nt, Salmonella enterica enterica serovar Typhi Ty2
cuauuuuuugcuggcg

SEQ ID NO: 1753416 - RNA, 11 nt, Salmonella enterica enterica serovar Typhi Ty2
cuauuuuucac

SEQ ID NO: 1753417 - RNA, 17 nt, Salmonella enterica enterica serovar Typhi Ty2
cuauuuucgccgacccc

SEQ ID NO: 1753418 - RNA, 23 nt, Salmonella enterica enterica serovar Typhi Ty2
cuauuuucuacucgggccagcuc

SEQ ID NO: 1753419 - RNA, 18 nt, Salmonella enterica enterica serovar Typhi Ty2
cuauuuuacuugccauuu

SEQ ID NO: 1753420 - RNA, 19 nt, Salmonella enterica enterica serovar Typhi Ty2
cuauuuuaaauucccagcg

SEQ ID NO: 1753421 - RNA, 19 nt, Salmonella enterica enterica serovar Typhi Ty2
cucgcgcagaaucagcgug

SEQ ID NO: 1753422 - RNA, 22 nt, Salmonella enterica enterica serovar Typhi Ty2
cucgcgcaucaggaucuucauc

SEQ ID NO: 1753423 - RNA, 12 nt, Salmonella enterica enterica serovar Typhi Ty2
cucgccagucag

SEQ ID NO: 1753424 - RNA, 13 nt, Salmonella enterica enterica serovar Typhi Ty2
cucgccauaaaga

SEQ ID NO: 1753425 - RNA, 11 nt, Salmonella enterica enterica serovar Typhi Ty2
cucgccagcgc

SEQ ID NO: 1753426 - RNA, 18 nt, Salmonella enterica enterica serovar Typhi Ty2
cucgccgguagccagcca

SEQ ID NO: 1753427 - RNA, 18 nt, Salmonella enterica enterica serovar Typhi Ty2
cucgcgguugacgcugcu

SEQ ID NO: 1753428 - RNA, 23 nt, Salmonella enterica enterica serovar Typhi Ty2
cucgcguccccagccgaugaccc

SEQ ID NO: 1753429 - RNA, 13 nt, Salmonella enterica enterica serovar Typhi Ty2
cucgcuaaugccc

SEQ ID NO: 1753430 - RNA, 16 nt, Salmonella enterica enterica serovar Typhi Ty2
cucgcuacgcucgccc

SEQ ID NO: 1753431 - RNA, 23 nt, Salmonella enterica enterica serovar Typhi Ty2
cucgcuaugaaaacgcagcccca

SEQ ID NO: 1753432 - RNA, 14 nt, Salmonella enterica enterica serovar Typhi Ty2
cucgcuacuggcaa

SEQ ID NO: 1753433 - RNA, 13 nt, Salmonella enterica enterica serovar Typhi Ty2
cucgcucccuucc

SEQ ID NO: 1753434 - RNA, 22 nt, Salmonella enterica enterica serovar Typhi Ty2
cucgcucauuugcgagaaaaag

SEQ ID NO: 1753435 - RNA, 23 nt, Salmonella enterica enterica serovar Typhi Ty2
cucgcucaucacaucgcgcagca

SEQ ID NO: 1753436 - RNA, 14 nt, Salmonella enterica enterica serovar Typhi Ty2
cucgcucccuuccc

SEQ ID NO: 1753437 - RNA, 17 nt, Salmonella enterica enterica serovar Typhi Ty2
cucgcucgcccaucacu

SEQ ID NO: 1753438 - RNA, 23 nt, Salmonella enterica enterica serovar Typhi Ty2
cucgcugauacgcuggcacagga

SEQ ID NO: 1753439 - RNA, 13 nt, Salmonella enterica enterica serovar Typhi Ty2
cucgauauauuuu

SEQ ID NO: 1753440 - RNA, 23 nt, Salmonella enterica enterica serovar Typhi Ty2
cucgauaucagggcuuuuuucuc

SEQ ID NO: 1753441 - RNA, 23 nt, Salmonella enterica enterica serovar Typhi Ty2
cucgauuugcccuuccagcagcc

SEQ ID NO: 1753442 - RNA, 18 nt, Salmonella enterica enterica serovar Typhi Ty2
cucgccaauauccccagc

SEQ ID NO: 1753443 - RNA, 20 nt, Salmonella enterica enterica serovar Typhi Ty2
cucgccacgguuggcccagc

SEQ ID NO: 1753444 - RNA, 11 nt, Salmonella enterica enterica serovar Typhi Ty2
cucgacggugc

SEQ ID NO: 1753445 - RNA, 21 nt, Salmonella enterica enterica serovar Typhi Ty2
cucgacguuuuccaucaccau

SEQ ID NO: 1753446 - RNA, 19 nt, Salmonella enterica enterica serovar Typhi Ty2
cucgacauagguucugcga

SEQ ID NO: 1753447 - RNA, 21 nt, Salmonella enterica enterica serovar Typhi Ty2
cuccugauaaccuauuuugca

SEQ ID NO: 1753448 - RNA, 20 nt, Salmonella enterica enterica serovar Typhi Ty2
cuccugcaucgauuccccac

SEQ ID NO: 1753449 - RNA, 17 nt, Salmonella enterica enterica serovar Typhi Ty2
cucgugaucgccaaagc

SEQ ID NO: 1753450 - RNA, 15 nt, Salmonella enterica enterica serovar Typhi Ty2
cucguccugcaauuu

SEQ ID NO: 1753451 - RNA, 24 nt, Salmonella enterica enterica serovar Typhi Ty2
cucguaagagaggcuuuaugcuga

SEQ ID NO: 1753452 - RNA, 21 nt, Salmonella enterica enterica serovar Typhi Ty2
cucgcuggugccaaucuccag

SEQ ID NO: 1753453 - RNA, 17 nt, Salmonella enterica enterica serovar Typhi Ty2
cucgcuuugccgccauc

SEQ ID NO: 1753454 - RNA, 16 nt, Salmonella enterica enterica serovar Typhi Ty2
cucggauagcuacgau

SEQ ID NO: 1753455 - RNA, 22 nt, Salmonella enterica enterica serovar Typhi Ty2
cucccgccagaugcagcggcag

SEQ ID NO: 1753456 - RNA, 21 nt, Salmonella enterica enterica serovar Typhi Ty2
cucccgcgucacgaccggcga

SEQ ID NO: 1753457 - RNA, 16 nt, Salmonella enterica enterica serovar Typhi Ty2
cucccgcagccacucc

SEQ ID NO: 1753458 - RNA, 18 nt, Salmonella enterica enterica serovar Typhi Ty2
cucccugccuaaagaaaa

SEQ ID NO: 1753459 - RNA, 12 nt, Salmonella enterica enterica serovar Typhi Ty2
cucccuggcagu

SEQ ID NO: 1753460 - RNA, 17 nt, Salmonella enterica enterica serovar Typhi Ty2
cucccugccuaaagaaa

SEQ ID NO: 1753461 - RNA, 13 nt, Salmonella enterica enterica serovar Typhi Ty2
cucccuuccccca

SEQ ID NO: 1753462 - RNA, 15 nt, Salmonella enterica enterica serovar Typhi Ty2
cuccgcaauuuccug

SEQ ID NO: 1753463 - RNA, 21 nt, Salmonella enterica enterica serovar Typhi Ty2
cuccgaaacaaucaccugaug

SEQ ID NO: 1753464 - RNA, 23 nt, Salmonella enterica enterica serovar Typhi Ty2
cucccaaacucgggaaaauagcc

SEQ ID NO: 1753465 - RNA, 19 nt, Salmonella enterica enterica serovar Typhi Ty2
cuccauuuuggggaaaaua

SEQ ID NO: 1753466 - RNA, 15 nt, Salmonella enterica enterica serovar Typhi Ty2
cucccaaauuuuuuu

SEQ ID NO: 1753467 - RNA, 22 nt, Salmonella enterica enterica serovar Typhi Ty2
cuccauggucagacgcucagcc

SEQ ID NO: 1753468 - RNA, 17 nt, Salmonella enterica enterica serovar Typhi Ty2
cuccauggucagacgcu

SEQ ID NO: 1753469 - RNA, 15 nt, Salmonella enterica enterica serovar Typhi Ty2
cucccauacccaggu

SEQ ID NO: 1753470 - RNA, 23 nt, Salmonella enterica enterica serovar Typhi Ty2
cuccccaggcgcuauucccaggc

SEQ ID NO: 1753471 - RNA, 12 nt, Salmonella enterica enterica serovar Typhi Ty2
cuccccagaaug

SEQ ID NO: 1753472 - RNA, 18 nt, Salmonella enterica enterica serovar Typhi Ty2
cuccccacgaaagucugu

SEQ ID NO: 1753473 - RNA, 14 nt, Salmonella enterica enterica serovar Typhi Ty2
cucccacucuucca

SEQ ID NO: 1753474 - RNA, 23 nt, Salmonella enterica enterica serovar Typhi Ty2
cucccaggccgccaccgccucgc

SEQ ID NO: 1753475 - RNA, 18 nt, Salmonella enterica enterica serovar Typhi Ty2
cucccaggccgccaccgc

SEQ ID NO: 1753476 - RNA, 21 nt, Salmonella enterica enterica serovar Typhi Ty2
cucccaggcgcgcagcugcca

SEQ ID NO: 1753477 - RNA, 13 nt, Salmonella enterica enterica serovar Typhi Ty2
cuccggcaggcaa

SEQ ID NO: 1753478 - RNA, 18 nt, Salmonella enterica enterica serovar Typhi Ty2
cuccggcaggcaaaucug

SEQ ID NO: 1753479 - RNA, 14 nt, Salmonella enterica enterica serovar Typhi Ty2
cuccggcaguccau

SEQ ID NO: 1753480 - RNA, 14 nt, Salmonella enterica enterica serovar Typhi Ty2
cuccggcagcgaau

SEQ ID NO: 1753481 - RNA, 17 nt, Salmonella enterica enterica serovar Typhi Ty2
cuccggcagaaaugacc

SEQ ID NO: 1753482 - RNA, 17 nt, Salmonella enterica enterica serovar Typhi Ty2
cuccggcuaugccggag

SEQ ID NO: 1753483 - RNA, 13 nt, Salmonella enterica enterica serovar Typhi Ty2
cuccggcggguaa

SEQ ID NO: 1753484 - RNA, 14 nt, Salmonella enterica enterica serovar Typhi Ty2
cuccggcgcgcgcg

SEQ ID NO: 1753485 - RNA, 21 nt, Salmonella enterica enterica serovar Typhi Ty2
cuccgguaucgccggcagacg

SEQ ID NO: 1753486 - RNA, 15 nt, Salmonella enterica enterica serovar Typhi Ty2
cuccuaagagaaaac

SEQ ID NO: 1753487 - RNA, 12 nt, Salmonella enterica enterica serovar Typhi Ty2
cuccagaagcau

SEQ ID NO: 1753488 - RNA, 17 nt, Salmonella enterica enterica serovar Typhi Ty2
cuccagacgaugauaau

SEQ ID NO: 1753489 - RNA, 22 nt, Salmonella enterica enterica serovar Typhi Ty2
cuccagaauauugacaucgccg

SEQ ID NO: 1753490 - RNA, 13 nt, Salmonella enterica enterica serovar Typhi Ty2
cuccagacaggac

SEQ ID NO: 1753491 - RNA, 22 nt, Salmonella enterica enterica serovar Typhi Ty2
cuccagacgaugauaauacauu

SEQ ID NO: 1753492 - RNA, 20 nt, Salmonella enterica enterica serovar Typhi Ty2
cuccagcagaccggcaaaaa

SEQ ID NO: 1753493 - RNA, 19 nt, Salmonella enterica enterica serovar Typhi Ty2
cuccagcagacgcugcuuc

SEQ ID NO: 1753494 - RNA, 20 nt, Salmonella enterica enterica serovar Typhi Ty2
cuccagcacgcgcugcgccg

SEQ ID NO: 1753495 - RNA, 17 nt, Salmonella enterica enterica serovar Typhi Ty2
cuccacgcccagcgccg

SEQ ID NO: 1753496 - RNA, 22 nt, Salmonella enterica enterica serovar Typhi Ty2
cuccagaagaucuaaagccagu

SEQ ID NO: 1753497 - RNA, 17 nt, Salmonella enterica enterica serovar Typhi Ty2
cuccacugucaaaaaua

SEQ ID NO: 1753498 - RNA, 23 nt, Salmonella enterica enterica serovar Typhi Ty2
cuccacugucaaaaauaacaggc

SEQ ID NO: 1753499 - RNA, 16 nt, Salmonella enterica enterica serovar Typhi Ty2
cucauuuuugcccagc

SEQ ID NO: 1753500 - RNA, 23 nt, Salmonella enterica enterica serovar Typhi Ty2
cucauuuuugaguuugucaucca

SEQ ID NO: 1753501 - RNA, 16 nt, Salmonella enterica enterica serovar Typhi Ty2
cucauuucacuauaaa

SEQ ID NO: 1753502 - RNA, 16 nt, Salmonella enterica enterica serovar Typhi Ty2
cucauuuuauccaaca

SEQ ID NO: 1753503 - RNA, 20 nt, Salmonella enterica enterica serovar Typhi Ty2
cucauuuuguugcuccagca

SEQ ID NO: 1753504 - RNA, 18 nt, Salmonella enterica enterica serovar Typhi Ty2
cuccaccgugucauagcc

SEQ ID NO: 1753505 - RNA, 14 nt, Salmonella enterica enterica serovar Typhi Ty2
cuccagcguggcag

SEQ ID NO: 1753506 - RNA, 16 nt, Salmonella enterica enterica serovar Typhi Ty2
cuccagcucagggucc

SEQ ID NO: 1753507 - RNA, 19 nt, Salmonella enterica enterica serovar Typhi Ty2
cuccaggcgaauccccauc

SEQ ID NO: 1753508 - RNA, 17 nt, Salmonella enterica enterica serovar Typhi Ty2
cuccagcccgccgcccu

SEQ ID NO: 1753509 - RNA, 18 nt, Salmonella enterica enterica serovar Typhi Ty2
cuccagcgccagcuccau

SEQ ID NO: 1753510 - RNA, 16 nt, Salmonella enterica enterica serovar Typhi Ty2
cuccagccucgcgcau

SEQ ID NO: 1753511 - RNA, 21 nt, Salmonella enterica enterica serovar Typhi Ty2
cuccagggcaacggccagcgc

SEQ ID NO: 1753512 - RNA, 17 nt, Salmonella enterica enterica serovar Typhi Ty2
cuccaguaauucccggc

SEQ ID NO: 1753513 - RNA, 22 nt, Salmonella enterica enterica serovar Typhi Ty2
cuccaguugauacaggaauaac

SEQ ID NO: 1753514 - RNA, 16 nt, Salmonella enterica enterica serovar Typhi Ty2
cuccaucauuuccggc

SEQ ID NO: 1753515 - RNA, 13 nt, Salmonella enterica enterica serovar Typhi Ty2
cuccaucgcuuua

SEQ ID NO: 1753516 - RNA, 18 nt, Salmonella enterica enterica serovar Typhi Ty2
cuccaucgccagcacguu

SEQ ID NO: 1753517 - RNA, 14 nt, Salmonella enterica enterica serovar Typhi Ty2
cuccaugcccacac

SEQ ID NO: 1753518 - RNA, 23 nt, Salmonella enterica enterica serovar Typhi Ty2
cuccauaauuugaaucgccuggc

SEQ ID NO: 1753519 - RNA, 19 nt, Salmonella enterica enterica serovar Typhi Ty2
cuccauaaauaacauuuca

SEQ ID NO: 1753520 - RNA, 13 nt, Salmonella enterica enterica serovar Typhi Ty2
cuccauaauuuga

SEQ ID NO: 1753521 - RNA, 23 nt, Salmonella enterica enterica serovar Typhi Ty2
cuccaucagacguuuauacccca

SEQ ID NO: 1753522 - RNA, 18 nt, Salmonella enterica enterica serovar Typhi Ty2
cuccaucacgguaaaccu

SEQ ID NO: 1753523 - RNA, 13 nt, Salmonella enterica enterica serovar Typhi Ty2
cguggccuccggc

SEQ ID NO: 1753524 - RNA, 13 nt, Salmonella enterica enterica serovar Typhi Ty2
cguggcgcaucuc

SEQ ID NO: 1753525 - RNA, 21 nt, Salmonella enterica enterica serovar Typhi Ty2
cguggccgauauugccuucac

SEQ ID NO: 1753526 - RNA, 21 nt, Salmonella enterica enterica serovar Typhi Ty2
cguggcauucgcuugcccggc

SEQ ID NO: 1753527 - RNA, 14 nt, Salmonella enterica enterica serovar Typhi Ty2
cguggccaaaaaau

SEQ ID NO: 1753528 - RNA, 16 nt, Salmonella enterica enterica serovar Typhi Ty2
cguggcgcuuuccggc

SEQ ID NO: 1753529 - RNA, 16 nt, Salmonella enterica enterica serovar Typhi Ty2
cguggcggcagagcca

SEQ ID NO: 1753530 - RNA, 16 nt, Salmonella enterica enterica serovar Typhi Ty2
cguggcgggaugcccc

SEQ ID NO: 1753531 - RNA, 14 nt, Salmonella enterica enterica serovar Typhi Ty2
cgugguaucgaaaa

SEQ ID NO: 1753532 - RNA, 21 nt, Salmonella enterica enterica serovar Typhi Ty2
cguggucauuaggcguaauua

SEQ ID NO: 1753533 - RNA, 21 nt, Salmonella enterica enterica serovar Typhi Ty2
cguggucguaaaacugcacca

SEQ ID NO: 1753534 - RNA, 13 nt, Salmonella enterica enterica serovar Typhi Ty2
cgugguauuacaa

SEQ ID NO: 1753535 - RNA, 20 nt, Salmonella enterica enterica serovar Typhi Ty2
cguggaccguauagcccaga

SEQ ID NO: 1753536 - RNA, 18 nt, Salmonella enterica enterica serovar Typhi Ty2
cgugcugacggagcuggc

SEQ ID NO: 1753537 - RNA, 18 nt, Salmonella enterica enterica serovar Typhi Ty2
cgugcucuucguggaacu

SEQ ID NO: 1753538 - RNA, 18 nt, Salmonella enterica enterica serovar Typhi Ty2
cgugcucucaccaucaua

SEQ ID NO: 1753539 - RNA, 16 nt, Salmonella enterica enterica serovar Typhi Ty2
cgugcugggcgcgccu

SEQ ID NO: 1753540 - RNA, 12 nt, Salmonella enterica enterica serovar Typhi Ty2
cgugcuggaugg

SEQ ID NO: 1753541 - RNA, 11 nt, Salmonella enterica enterica serovar Typhi Ty2
cguggcaucuu

SEQ ID NO: 1753542 - RNA, 17 nt, Salmonella enterica enterica serovar Typhi Ty2
cguggcauucgcuugcc

SEQ ID NO: 1753543 - RNA, 15 nt, Salmonella enterica enterica serovar Typhi Ty2
cguggcaaucagcaa

SEQ ID NO: 1753544 - RNA, 21 nt, Salmonella enterica enterica serovar Typhi Ty2
cguggauuuuuugucuguaua

SEQ ID NO: 1753545 - RNA, 15 nt, Salmonella enterica enterica serovar Typhi Ty2
cguggacgcuggguu

SEQ ID NO: 1753546 - RNA, 18 nt, Salmonella enterica enterica serovar Typhi Ty2
cgugcgauagcgucccgu

SEQ ID NO: 1753547 - RNA, 15 nt, Salmonella enterica enterica serovar Typhi Ty2
cgugcgccguccugc

SEQ ID NO: 1753548 - RNA, 19 nt, Salmonella enterica enterica serovar Typhi Ty2
cgugcgcucagggucagaa

SEQ ID NO: 1753549 - RNA, 21 nt, Salmonella enterica enterica serovar Typhi Ty2
cgugcggcgaagcaucuuucc

SEQ ID NO: 1753550 - RNA, 17 nt, Salmonella enterica enterica serovar Typhi Ty2
cgugcggcggacgccgg

SEQ ID NO: 1753551 - RNA, 20 nt, Salmonella enterica enterica serovar Typhi Ty2
cgugcgguauaucacgccau

SEQ ID NO: 1753552 - RNA, 17 nt, Salmonella enterica enterica serovar Typhi Ty2
cgugguuuccggcagcu

SEQ ID NO: 1753553 - RNA, 16 nt, Salmonella enterica enterica serovar Typhi Ty2
cguguaaacagaugcu

SEQ ID NO: 1753554 - RNA, 17 nt, Salmonella enterica enterica serovar Typhi Ty2
cguguaaacagaugcuc

SEQ ID NO: 1753555 - RNA, 17 nt, Salmonella enterica enterica serovar Typhi Ty2
cguguagccaguacgcg

SEQ ID NO: 1753556 - RNA, 21 nt, Salmonella enterica enterica serovar Typhi Ty2
cguguccaaacuggcugugcc

SEQ ID NO: 1753557 - RNA, 19 nt, Salmonella enterica enterica serovar Typhi Ty2
cgugucggauaucagacag

SEQ ID NO: 1753558 - RNA, 18 nt, Salmonella enterica enterica serovar Typhi Ty2
cguguggcggaaugaccu

SEQ ID NO: 1753559 - RNA, 11 nt, Salmonella enterica enterica serovar Typhi Ty2
cguguggcugu

SEQ ID NO: 1753560 - RNA, 21 nt, Salmonella enterica enterica serovar Typhi Ty2
cguguggucgcggcucaccag

SEQ ID NO: 1753561 - RNA, 16 nt, Salmonella enterica enterica serovar Typhi Ty2
cguguggccugcucua

SEQ ID NO: 1753562 - RNA, 18 nt, Salmonella enterica enterica serovar Typhi Ty2
cguuaaucgauuuucucc

SEQ ID NO: 1753563 - RNA, 21 nt, Salmonella enterica enterica serovar Typhi Ty2
cguuaaucgauuuucuccgga

SEQ ID NO: 1753564 - RNA, 14 nt, Salmonella enterica enterica serovar Typhi Ty2
cguuaacccggcau

SEQ ID NO: 1753565 - RNA, 20 nt, Salmonella enterica enterica serovar Typhi Ty2
cguuaaugcuguccugcaaa

SEQ ID NO: 1753566 - RNA, 13 nt, Salmonella enterica enterica serovar Typhi Ty2
cguuaaucggcac

SEQ ID NO: 1753567 - RNA, 12 nt, Salmonella enterica enterica serovar Typhi Ty2
cguuacccuccu

SEQ ID NO: 1753568 - RNA, 23 nt, Salmonella enterica enterica serovar Typhi Ty2
cguuaccggcuccggcaaauucu

SEQ ID NO: 1753569 - RNA, 16 nt, Salmonella enterica enterica serovar Typhi Ty2
cguuaccgccgagcau

SEQ ID NO: 1753570 - RNA, 18 nt, Salmonella enterica enterica serovar Typhi Ty2
cguuaccagcaucaauag

SEQ ID NO: 1753571 - RNA, 17 nt, Salmonella enterica enterica serovar Typhi Ty2
cguuacccagacagcaa

SEQ ID NO: 1753572 - RNA, 13 nt, Salmonella enterica enterica serovar Typhi Ty2
cguguuguccggc

SEQ ID NO: 1753573 - RNA, 23 nt, Salmonella enterica enterica serovar Typhi Ty2
cguguuacgccgcaaucacuuca

SEQ ID NO: 1753574 - RNA, 21 nt, Salmonella enterica enterica serovar Typhi Ty2
cguguuacugacgaccggcag

SEQ ID NO: 1753575 - RNA, 21 nt, Salmonella enterica enterica serovar Typhi Ty2
cguguuauuuucaaaaacaag

SEQ ID NO: 1753576 - RNA, 18 nt, Salmonella enterica enterica serovar Typhi Ty2
cguuccaucacuuccugu

SEQ ID NO: 1753577 - RNA, 13 nt, Salmonella enterica enterica serovar Typhi Ty2
cguuccagcagcg

SEQ ID NO: 1753578 - RNA, 18 nt, Salmonella enterica enterica serovar Typhi Ty2
cguucgcgcaauucuucu

SEQ ID NO: 1753579 - RNA, 16 nt, Salmonella enterica enterica serovar Typhi Ty2
cguucgcggaacggcg

SEQ ID NO: 1753580 - RNA, 19 nt, Salmonella enterica enterica serovar Typhi Ty2
cguucgcgaauuucacgca

SEQ ID NO: 1753581 - RNA, 21 nt, Salmonella enterica enterica serovar Typhi Ty2
cguucgcauauucugcgaaag

SEQ ID NO: 1753582 - RNA, 19 nt, Salmonella enterica enterica serovar Typhi Ty2
cguucagcccuuauaucau

SEQ ID NO: 1753583 - RNA, 17 nt, Salmonella enterica enterica serovar Typhi Ty2
cguucaccacaacccac

SEQ ID NO: 1753584 - RNA, 19 nt, Salmonella enterica enterica serovar Typhi Ty2
cguucacaccgccgccagc

SEQ ID NO: 1753585 - RNA, 11 nt, Salmonella enterica enterica serovar Typhi Ty2
cguucacgccg

SEQ ID NO: 1753586 - RNA, 15 nt, Salmonella enterica enterica serovar Typhi Ty2
cguucacgccgccau

SEQ ID NO: 1753587 - RNA, 21 nt, Salmonella enterica enterica serovar Typhi Ty2
cguuauuuuccugaaaaaauu

SEQ ID NO: 1753588 - RNA, 14 nt, Salmonella enterica enterica serovar Typhi Ty2
cguuauucgcuggc

SEQ ID NO: 1753589 - RNA, 19 nt, Salmonella enterica enterica serovar Typhi Ty2
cguuagucaacucgcacag

SEQ ID NO: 1753590 - RNA, 15 nt, Salmonella enterica enterica serovar Typhi Ty2
cguuauuuuccugaa

SEQ ID NO: 1753591 - RNA, 19 nt, Salmonella enterica enterica serovar Typhi Ty2
cguuagauauagcuuuuca

SEQ ID NO: 1753592 - RNA, 20 nt, Salmonella enterica enterica serovar Typhi Ty2
cguuagauauagcuuuucaa

SEQ ID NO: 1753593 - RNA, 21 nt, Salmonella enterica enterica serovar Typhi Ty2
cguuagcgagguucccgccgc

SEQ ID NO: 1753594 - RNA, 13 nt, Salmonella enterica enterica serovar Typhi Ty2
cguuagccgccau

SEQ ID NO: 1753595 - RNA, 15 nt, Salmonella enterica enterica serovar Typhi Ty2
cguuacgcgcugcaa

SEQ ID NO: 1753596 - RNA, 13 nt, Salmonella enterica enterica serovar Typhi Ty2
cguuacgcauuuc

SEQ ID NO: 1753597 - RNA, 20 nt, Salmonella enterica enterica serovar Typhi Ty2
cguuggcguaaaucaggcca

SEQ ID NO: 1753598 - RNA, 14 nt, Salmonella enterica enterica serovar Typhi Ty2
cguuggggaaaaua

SEQ ID NO: 1753599 - RNA, 13 nt, Salmonella enterica enterica serovar Typhi Ty2
cguuuaaaaugaa

SEQ ID NO: 1753600 - RNA, 19 nt, Salmonella enterica enterica serovar Typhi Ty2
cguuguuucugccuuuaac

SEQ ID NO: 1753601 - RNA, 15 nt, Salmonella enterica enterica serovar Typhi Ty2
cguuguuuggguaac

SEQ ID NO: 1753602 - RNA, 16 nt, Salmonella enterica enterica serovar Typhi Ty2
cguuucauguaaauga

SEQ ID NO: 1753603 - RNA, 22 nt, Salmonella enterica enterica serovar Typhi Ty2
cguuucauuuuucccaucaauc

SEQ ID NO: 1753604 - RNA, 13 nt, Salmonella enterica enterica serovar Typhi Ty2
cguuuccagugca

SEQ ID NO: 1753605 - RNA, 15 nt, Salmonella enterica enterica serovar Typhi Ty2
cguuuacgccgccau

SEQ ID NO: 1753606 - RNA, 14 nt, Salmonella enterica enterica serovar Typhi Ty2
cguuuacaccuauu

SEQ ID NO: 1753607 - RNA, 15 nt, Salmonella enterica enterica serovar Typhi Ty2
cguucuuccagaacg

SEQ ID NO: 1753608 - RNA, 22 nt, Salmonella enterica enterica serovar Typhi Ty2
cguucggaaucggacacuugca

SEQ ID NO: 1753609 - RNA, 21 nt, Salmonella enterica enterica serovar Typhi Ty2
cguugcuguaaccggaauaga

SEQ ID NO: 1753610 - RNA, 12 nt, Salmonella enterica enterica serovar Typhi Ty2
cguugcuuuaua

SEQ ID NO: 1753611 - RNA, 20 nt, Salmonella enterica enterica serovar Typhi Ty2
cguuggaagugcguuaaccc

SEQ ID NO: 1753612 - RNA, 15 nt, Salmonella enterica enterica serovar Typhi Ty2
cguuuuuguuuaaaa

SEQ ID NO: 1753613 - RNA, 15 nt, Salmonella enterica enterica serovar Typhi Ty2
cguuuuuuccagcgc

SEQ ID NO: 1753614 - RNA, 19 nt, Salmonella enterica enterica serovar Typhi Ty2
cguuuuuuuguuuuaccug

SEQ ID NO: 1753615 - RNA, 17 nt, Salmonella enterica enterica serovar Typhi Ty2
cguuugccccucuuccc

SEQ ID NO: 1753616 - RNA, 20 nt, Salmonella enterica enterica serovar Typhi Ty2
cguuuguuugucgauuuccg

SEQ ID NO: 1753617 - RNA, 20 nt, Salmonella enterica enterica serovar Typhi Ty2
cguuuuaacgucauuaccag

SEQ ID NO: 1753618 - RNA, 18 nt, Salmonella enterica enterica serovar Typhi Ty2
cguuucgauaaccaccag

SEQ ID NO: 1753619 - RNA, 16 nt, Salmonella enterica enterica serovar Typhi Ty2
cuaaaaaccugguccg

SEQ ID NO: 1753620 - RNA, 13 nt, Salmonella enterica enterica serovar Typhi Ty2
cuaaaccacggaa

SEQ ID NO: 1753621 - RNA, 23 nt, Salmonella enterica enterica serovar Typhi Ty2
cuaaaccgucauuuaccagugcu

SEQ ID NO: 1753622 - RNA, 20 nt, Salmonella enterica enterica serovar Typhi Ty2
cuaaaccagauguacagaau

SEQ ID NO: 1753623 - RNA, 17 nt, Salmonella enterica enterica serovar Typhi Ty2
cuaaaugcauagcccca

SEQ ID NO: 1753624 - RNA, 19 nt, Salmonella enterica enterica serovar Typhi Ty2
cuaacacaugcaagucgaa

SEQ ID NO: 1753625 - RNA, 11 nt, Salmonella enterica enterica serovar Typhi Ty2
cuaacaggaag

SEQ ID NO: 1753626 - RNA, 22 nt, Salmonella enterica enterica serovar Typhi Ty2
cuaacaucauucccguaucuuc

SEQ ID NO: 1753627 - RNA, 17 nt, Salmonella enterica enterica serovar Typhi Ty2
cuaaaugggcaggagau

SEQ ID NO: 1753628 - RNA, 23 nt, Salmonella enterica enterica serovar Typhi Ty2
cuaaaugacgcgcgagaacugcu

SEQ ID NO: 1753629 - RNA, 22 nt, Salmonella enterica enterica serovar Typhi Ty2
cuaaaugacgcgcgagaacugc

SEQ ID NO: 1753630 - RNA, 19 nt, Salmonella enterica enterica serovar Typhi Ty2
cuaaaugaccgccuuuuuu

SEQ ID NO: 1753631 - RNA, 19 nt, Salmonella enterica enterica serovar Typhi Ty2
cuaaaucuuuuugugcaau

SEQ ID NO: 1753632 - RNA, 15 nt, Salmonella enterica enterica serovar Typhi Ty2
cuaagugagcauuac

SEQ ID NO: 1753633 - RNA, 18 nt, Salmonella enterica enterica serovar Typhi Ty2
cuaaguauucacgugugu

SEQ ID NO: 1753634 - RNA, 18 nt, Salmonella enterica enterica serovar Typhi Ty2
cuaagcgcccguagcuca

SEQ ID NO: 1753635 - RNA, 18 nt, Salmonella enterica enterica serovar Typhi Ty2
cuaagaccagcaccaucu

SEQ ID NO: 1753636 - RNA, 14 nt, Salmonella enterica enterica serovar Typhi Ty2
cuaacgcucuucuc

SEQ ID NO: 1753637 - RNA, 22 nt, Salmonella enterica enterica serovar Typhi Ty2
cuaacgauguaaaaccuggcac

SEQ ID NO: 1753638 - RNA, 23 nt, Salmonella enterica enterica serovar Typhi Ty2
cuaacgcaacggaaggaaauaac

SEQ ID NO: 1753639 - RNA, 17 nt, Salmonella enterica enterica serovar Typhi Ty2
cuaacgccgugucgacc

SEQ ID NO: 1753640 - RNA, 19 nt, Salmonella enterica enterica serovar Typhi Ty2
cuaacgccugauccggccu

SEQ ID NO: 1753641 - RNA, 17 nt, Salmonella enterica enterica serovar Typhi Ty2
cuaacugguacguccau

SEQ ID NO: 1753642 - RNA, 12 nt, Salmonella enterica enterica serovar Typhi Ty2
cuaacuuauuga

SEQ ID NO: 1753643 - RNA, 21 nt, Salmonella enterica enterica serovar Typhi Ty2
cuaacgacccgaagugguggg

SEQ ID NO: 1753644 - RNA, 18 nt, Salmonella enterica enterica serovar Typhi Ty2
cuaacgaaaccggcggcg

SEQ ID NO: 1753645 - RNA, 17 nt, Salmonella enterica enterica serovar Typhi Ty2
cuaacgaaaccggcggc

SEQ ID NO: 1753646 - RNA, 20 nt, Salmonella enterica enterica serovar Typhi Ty2
cuaaccuguaucugcugaca

SEQ ID NO: 1753647 - RNA, 17 nt, Salmonella enterica enterica serovar Typhi Ty2
cuaaccuguaucugcug

SEQ ID NO: 1753648 - RNA, 19 nt, Salmonella enterica enterica serovar Typhi Ty2
cuaacccggcaaacguaaa

SEQ ID NO: 1753649 - RNA, 14 nt, Salmonella enterica enterica serovar Typhi Ty2
cgucucggccuggc

SEQ ID NO: 1753650 - RNA, 18 nt, Salmonella enterica enterica serovar Typhi Ty2
cgucucuuucauggaaau

SEQ ID NO: 1753651 - RNA, 15 nt, Salmonella enterica enterica serovar Typhi Ty2
cgucucucauuuucu

SEQ ID NO: 1753652 - RNA, 22 nt, Salmonella enterica enterica serovar Typhi Ty2
cgucugcacguuuugcucuucu

SEQ ID NO: 1753653 - RNA, 16 nt, Salmonella enterica enterica serovar Typhi Ty2
cgucugcccuccugaa

SEQ ID NO: 1753654 - RNA, 18 nt, Salmonella enterica enterica serovar Typhi Ty2
cgucugcugaaaugccug

SEQ ID NO: 1753655 - RNA, 21 nt, Salmonella enterica enterica serovar Typhi Ty2
cgucuuaaaauugcucagcca

SEQ ID NO: 1753656 - RNA, 20 nt, Salmonella enterica enterica serovar Typhi Ty2
cgucugguacggccaccagg

SEQ ID NO: 1753657 - RNA, 18 nt, Salmonella enterica enterica serovar Typhi Ty2
cgucuggcgaaaacggcg

SEQ ID NO: 1753658 - RNA, 17 nt, Salmonella enterica enterica serovar Typhi Ty2
cgucuuauccggccugc

SEQ ID NO: 1753659 - RNA, 16 nt, Salmonella enterica enterica serovar Typhi Ty2
cgucuuauccggccuc

SEQ ID NO: 1753660 - RNA, 23 nt, Salmonella enterica enterica serovar Typhi Ty2
cgucuuaaugguggucgcggcca

SEQ ID NO: 1753661 - RNA, 17 nt, Salmonella enterica enterica serovar Typhi Ty2
cgucuucaucagccagc

SEQ ID NO: 1753662 - RNA, 21 nt, Salmonella enterica enterica serovar Typhi Ty2
cgugaaccagcaucccacgaa

SEQ ID NO: 1753663 - RNA, 19 nt, Salmonella enterica enterica serovar Typhi Ty2
cgugaaccagcaucccacg

SEQ ID NO: 1753664 - RNA, 16 nt, Salmonella enterica enterica serovar Typhi Ty2
cgugaaccagcauccc

SEQ ID NO: 1753665 - RNA, 18 nt, Salmonella enterica enterica serovar Typhi Ty2
cgugaaauauccuccgcc

SEQ ID NO: 1753666 - RNA, 14 nt, Salmonella enterica enterica serovar Typhi Ty2
cgucuuuuagucac

SEQ ID NO: 1753667 - RNA, 22 nt, Salmonella enterica enterica serovar Typhi Ty2
cgucuuuuauccccaccaccgc

SEQ ID NO: 1753668 - RNA, 23 nt, Salmonella enterica enterica serovar Typhi Ty2
cgucuuuauucaucaucuugucc

SEQ ID NO: 1753669 - RNA, 23 nt, Salmonella enterica enterica serovar Typhi Ty2
cgucgucaaaggaauagccgcgc

SEQ ID NO: 1753670 - RNA, 18 nt, Salmonella enterica enterica serovar Typhi Ty2
cgucggcgucugcgcgcu

SEQ ID NO: 1753671 - RNA, 17 nt, Salmonella enterica enterica serovar Typhi Ty2
cgucgugcagcgccgcc

SEQ ID NO: 1753672 - RNA, 23 nt, Salmonella enterica enterica serovar Typhi Ty2
cgucguuaacaucaucaggccug

SEQ ID NO: 1753673 - RNA, 15 nt, Salmonella enterica enterica serovar Typhi Ty2
cgucguuccgccagg

SEQ ID NO: 1753674 - RNA, 16 nt, Salmonella enterica enterica serovar Typhi Ty2
cgucgucguuuguagg

SEQ ID NO: 1753675 - RNA, 15 nt, Salmonella enterica enterica serovar Typhi Ty2
cgucucccaaaugaa

SEQ ID NO: 1753676 - RNA, 21 nt, Salmonella enterica enterica serovar Typhi Ty2
cgucuccggcgcgccgcuggc

SEQ ID NO: 1753677 - RNA, 19 nt, Salmonella enterica enterica serovar Typhi Ty2
cgugauaaagcugacgcgc

SEQ ID NO: 1753678 - RNA, 22 nt, Salmonella enterica enterica serovar Typhi Ty2
cgugauaaacgguucagucagc

SEQ ID NO: 1753679 - RNA, 13 nt, Salmonella enterica enterica serovar Typhi Ty2
cgugaguuuuaac

SEQ ID NO: 1753680 - RNA, 19 nt, Salmonella enterica enterica serovar Typhi Ty2
cgugaguggcggcgcgcag

SEQ ID NO: 1753681 - RNA, 15 nt, Salmonella enterica enterica serovar Typhi Ty2
cgugaggcugaagcg

SEQ ID NO: 1753682 - RNA, 22 nt, Salmonella enterica enterica serovar Typhi Ty2
cgugagcugucgcucgcggcag

SEQ ID NO: 1753683 - RNA, 17 nt, Salmonella enterica enterica serovar Typhi Ty2
cgugagcgcauccggca

SEQ ID NO: 1753684 - RNA, 13 nt, Salmonella enterica enterica serovar Typhi Ty2
cgugagcgcgccg

SEQ ID NO: 1753685 - RNA, 21 nt, Salmonella enterica enterica serovar Typhi Ty2
cgugagccgaaauccaccagc

SEQ ID NO: 1753686 - RNA, 20 nt, Salmonella enterica enterica serovar Typhi Ty2
cgugaauuucugcugccagc

SEQ ID NO: 1753687 - RNA, 16 nt, Salmonella enterica enterica serovar Typhi Ty2
cgugacaguuaccccg

SEQ ID NO: 1753688 - RNA, 15 nt, Salmonella enterica enterica serovar Typhi Ty2
cgugaccaccgccau

SEQ ID NO: 1753689 - RNA, 14 nt, Salmonella enterica enterica serovar Typhi Ty2
cgugacccgccagc

SEQ ID NO: 1753690 - RNA, 20 nt, Salmonella enterica enterica serovar Typhi Ty2
cgugaccgauaaaaaagccu

SEQ ID NO: 1753691 - RNA, 23 nt, Salmonella enterica enterica serovar Typhi Ty2
cgugacgccuuccuccaguaauu

SEQ ID NO: 1753692 - RNA, 14 nt, Salmonella enterica enterica serovar Typhi Ty2
cgugacgcgccagc

SEQ ID NO: 1753693 - RNA, 22 nt, Salmonella enterica enterica serovar Typhi Ty2
cgugagaucguuauuaaacaga

SEQ ID NO: 1753694 - RNA, 13 nt, Salmonella enterica enterica serovar Typhi Ty2
cgugcacgcugcg

SEQ ID NO: 1753695 - RNA, 18 nt, Salmonella enterica enterica serovar Typhi Ty2
cgugcaaugucaugacug

SEQ ID NO: 1753696 - RNA, 14 nt, Salmonella enterica enterica serovar Typhi Ty2
cgugcaaugucaug

SEQ ID NO: 1753697 - RNA, 22 nt, Salmonella enterica enterica serovar Typhi Ty2
cgugauugagcagaucagcacg

SEQ ID NO: 1753698 - RNA, 19 nt, Salmonella enterica enterica serovar Typhi Ty2
cgugcaaaaucacgcggcg

SEQ ID NO: 1753699 - RNA, 16 nt, Salmonella enterica enterica serovar Typhi Ty2
cgugcagcgccgccug

SEQ ID NO: 1753700 - RNA, 13 nt, Salmonella enterica enterica serovar Typhi Ty2
cgugcagcgccgc

SEQ ID NO: 1753701 - RNA, 20 nt, Salmonella enterica enterica serovar Typhi Ty2
cgugcaugggauacgccagc

SEQ ID NO: 1753702 - RNA, 22 nt, Salmonella enterica enterica serovar Typhi Ty2
cgugcaugggauacgccagcag

SEQ ID NO: 1753703 - RNA, 21 nt, Salmonella enterica enterica serovar Typhi Ty2
cgugcaugggcagcuugccgc

SEQ ID NO: 1753704 - RNA, 20 nt, Salmonella enterica enterica serovar Typhi Ty2
cgugccaugaccauucacac

SEQ ID NO: 1753705 - RNA, 15 nt, Salmonella enterica enterica serovar Typhi Ty2
cgugccauuaacgca

SEQ ID NO: 1753706 - RNA, 14 nt, Salmonella enterica enterica serovar Typhi Ty2
cgugccgaccagcg

SEQ ID NO: 1753707 - RNA, 18 nt, Salmonella enterica enterica serovar Typhi Ty2
cgugccuuccaucggccc

SEQ ID NO: 1753708 - RNA, 22 nt, Salmonella enterica enterica serovar Typhi Ty2
cgugccguagaaaaugcgcugg

SEQ ID NO: 1753709 - RNA, 17 nt, Salmonella enterica enterica serovar Typhi Ty2
cgucgccggaaugcgaa

SEQ ID NO: 1753710 - RNA, 14 nt, Salmonella enterica enterica serovar Typhi Ty2
cgucgccagcaacg

SEQ ID NO: 1753711 - RNA, 16 nt, Salmonella enterica enterica serovar Typhi Ty2
cgucgccauccggcga

SEQ ID NO: 1753712 - RNA, 22 nt, Salmonella enterica enterica serovar Typhi Ty2
cgucgaggaagcugcgcagcac

SEQ ID NO: 1753713 - RNA, 21 nt, Salmonella enterica enterica serovar Typhi Ty2
cgucgauauguaaaucgguuu

SEQ ID NO: 1753714 - RNA, 14 nt, Salmonella enterica enterica serovar Typhi Ty2
cgucgaucagcgcg

SEQ ID NO: 1753715 - RNA, 14 nt, Salmonella enterica enterica serovar Typhi Ty2
cgucgagacggugu

SEQ ID NO: 1753716 - RNA, 14 nt, Salmonella enterica enterica serovar Typhi Ty2
cgucgcgcgcugug

SEQ ID NO: 1753717 - RNA, 17 nt, Salmonella enterica enterica serovar Typhi Ty2
cgucgcgaucgcgccag

SEQ ID NO: 1753718 - RNA, 16 nt, Salmonella enterica enterica serovar Typhi Ty2
cgucgcgcgccgccuc

SEQ ID NO: 1753719 - RNA, 18 nt, Salmonella enterica enterica serovar Typhi Ty2
cgucgcgaauaauuauuu

SEQ ID NO: 1753720 - RNA, 19 nt, Salmonella enterica enterica serovar Typhi Ty2
cgucgcgaauaauuauuuu

SEQ ID NO: 1753721 - RNA, 22 nt, Salmonella enterica enterica serovar Typhi Ty2
cgucgccuguuucugcgccgcu

SEQ ID NO: 1753722 - RNA, 21 nt, Salmonella enterica enterica serovar Typhi Ty2
cgucgccuguuucugcgccgc

SEQ ID NO: 1753723 - RNA, 18 nt, Salmonella enterica enterica serovar Typhi Ty2
cgucgccuguccggccug

SEQ ID NO: 1753724 - RNA, 23 nt, Salmonella enterica enterica serovar Typhi Ty2
cgucgccggugcuguagcugccc

SEQ ID NO: 1753725 - RNA, 17 nt, Salmonella enterica enterica serovar Typhi Ty2
cgucggcgccagccaca

SEQ ID NO: 1753726 - RNA, 14 nt, Salmonella enterica enterica serovar Typhi Ty2
cgucggcaccauuc

SEQ ID NO: 1753727 - RNA, 15 nt, Salmonella enterica enterica serovar Typhi Ty2
cgucgaaugacgcgc

SEQ ID NO: 1753728 - RNA, 21 nt, Salmonella enterica enterica serovar Typhi Ty2
cgucgacaaagccgacgccac

SEQ ID NO: 1753729 - RNA, 14 nt, Salmonella enterica enterica serovar Typhi Ty2
cgucgacagccccc

SEQ ID NO: 1753730 - RNA, 19 nt, Salmonella enterica enterica serovar Typhi Ty2
cguccuguagccgugccug

SEQ ID NO: 1753731 - RNA, 21 nt, Salmonella enterica enterica serovar Typhi Ty2
cguccugaaucgcuugcgcgu

SEQ ID NO: 1753732 - RNA, 17 nt, Salmonella enterica enterica serovar Typhi Ty2
cguccgguagagaacga

SEQ ID NO: 1753733 - RNA, 12 nt, Salmonella enterica enterica serovar Typhi Ty2
cguccgccuccg

SEQ ID NO: 1753734 - RNA, 12 nt, Salmonella enterica enterica serovar Typhi Ty2
cguccgccaggc

SEQ ID NO: 1753735 - RNA, 14 nt, Salmonella enterica enterica serovar Typhi Ty2
cguccgccaggccc

SEQ ID NO: 1753736 - RNA, 21 nt, Salmonella enterica enterica serovar Typhi Ty2
cgucccuuucccuuccagcga

SEQ ID NO: 1753737 - RNA, 14 nt, Salmonella enterica enterica serovar Typhi Ty2
cgucccuuucccuu

SEQ ID NO: 1753738 - RNA, 16 nt, Salmonella enterica enterica serovar Typhi Ty2
cgucccggcauuauaa

SEQ ID NO: 1753739 - RNA, 13 nt, Salmonella enterica enterica serovar Typhi Ty2
cgucccucgccgg

SEQ ID NO: 1753740 - RNA, 17 nt, Salmonella enterica enterica serovar Typhi Ty2
cgucccgauauaaaggu

SEQ ID NO: 1753741 - RNA, 18 nt, Salmonella enterica enterica serovar Typhi Ty2
cguccccuggacgcgagc

SEQ ID NO: 1753742 - RNA, 18 nt, Salmonella enterica enterica serovar Typhi Ty2
cguccccagccagagauc

SEQ ID NO: 1753743 - RNA, 20 nt, Salmonella enterica enterica serovar Typhi Ty2
cgucccaccacgcagccaug

SEQ ID NO: 1753744 - RNA, 16 nt, Salmonella enterica enterica serovar Typhi Ty2
cgucccagcggauguc

SEQ ID NO: 1753745 - RNA, 16 nt, Salmonella enterica enterica serovar Typhi Ty2
cguccauuacucucau

SEQ ID NO: 1753746 - RNA, 16 nt, Salmonella enterica enterica serovar Typhi Ty2
cguccauaagcgcggc

SEQ ID NO: 1753747 - RNA, 14 nt, Salmonella enterica enterica serovar Typhi Ty2
cguccauccgggua

SEQ ID NO: 1753748 - RNA, 19 nt, Salmonella enterica enterica serovar Typhi Ty2
cguccagcgcgugaaccgu

SEQ ID NO: 1753749 - RNA, 18 nt, Salmonella enterica enterica serovar Typhi Ty2
cguccagccgcucuguau

SEQ ID NO: 1753750 - RNA, 21 nt, Salmonella enterica enterica serovar Typhi Ty2
cguacugaaauaacucuggau

SEQ ID NO: 1753751 - RNA, 22 nt, Salmonella enterica enterica serovar Typhi Ty2
cguacucuaggcgcugcuggca

SEQ ID NO: 1753752 - RNA, 15 nt, Salmonella enterica enterica serovar Typhi Ty2
cguccagacuccuuu

SEQ ID NO: 1753753 - RNA, 22 nt, Salmonella enterica enterica serovar Typhi Ty2
cguccagauacgcgccggccgg

SEQ ID NO: 1753754 - RNA, 14 nt, Salmonella enterica enterica serovar Typhi Ty2
cguccacucuuccg

SEQ ID NO: 1753755 - RNA, 19 nt, Salmonella enterica enterica serovar Typhi Ty2
cguccacucuuccgggcga

SEQ ID NO: 1753756 - RNA, 22 nt, Salmonella enterica enterica serovar Typhi Ty2
cguccacggacaucggccucgc

SEQ ID NO: 1753757 - RNA, 21 nt, Salmonella enterica enterica serovar Typhi Ty2
cgcggcgaaaaagccggcgga

SEQ ID NO: 1753758 - RNA, 16 nt, Salmonella enterica enterica serovar Typhi Ty2
cgcggcgaaaaagccg

SEQ ID NO: 1753759 - RNA, 21 nt, Salmonella enterica enterica serovar Typhi Ty2
cgcggcgaaauaggccgcgau

SEQ ID NO: 1753760 - RNA, 16 nt, Salmonella enterica enterica serovar Typhi Ty2
cgcggccaccgccagu

SEQ ID NO: 1753761 - RNA, 18 nt, Salmonella enterica enterica serovar Typhi Ty2
cgcggcguaccgcgcgcc

SEQ ID NO: 1753762 - RNA, 14 nt, Salmonella enterica enterica serovar Typhi Ty2
cgcggcuacagaca

SEQ ID NO: 1753763 - RNA, 13 nt, Salmonella enterica enterica serovar Typhi Ty2
cgcggcgugcgcu

SEQ ID NO: 1753764 - RNA, 16 nt, Salmonella enterica enterica serovar Typhi Ty2
cgcgggauaucgcugg

SEQ ID NO: 1753765 - RNA, 15 nt, Salmonella enterica enterica serovar Typhi Ty2
cgcgggaaugcgcgc

SEQ ID NO: 1753766 - RNA, 14 nt, Salmonella enterica enterica serovar Typhi Ty2
cgcggcagcgcgca

SEQ ID NO: 1753767 - RNA, 13 nt, Salmonella enterica enterica serovar Typhi Ty2
cgcggcacacagc

SEQ ID NO: 1753768 - RNA, 18 nt, Salmonella enterica enterica serovar Typhi Ty2
cgcggauaugcagcagcc

SEQ ID NO: 1753769 - RNA, 19 nt, Salmonella enterica enterica serovar Typhi Ty2
cgcggauauggcggcggcu

SEQ ID NO: 1753770 - RNA, 20 nt, Salmonella enterica enterica serovar Typhi Ty2
cgcggaucagacggcugacc

SEQ ID NO: 1753771 - RNA, 22 nt, Salmonella enterica enterica serovar Typhi Ty2
cgcggcacacaacacggcggcu

SEQ ID NO: 1753772 - RNA, 22 nt, Salmonella enterica enterica serovar Typhi Ty2
cgcggagagaucgacagcgcgc

SEQ ID NO: 1753773 - RNA, 18 nt, Salmonella enterica enterica serovar Typhi Ty2
cgcggauaagcccggcgg

SEQ ID NO: 1753774 - RNA, 16 nt, Salmonella enterica enterica serovar Typhi Ty2
cgcggauaagcccggc

SEQ ID NO: 1753775 - RNA, 12 nt, Salmonella enterica enterica serovar Typhi Ty2
cgcgcuggcaag

SEQ ID NO: 1753776 - RNA, 23 nt, Salmonella enterica enterica serovar Typhi Ty2
cgcgcugcggcggcggaaaauag

SEQ ID NO: 1753777 - RNA, 19 nt, Salmonella enterica enterica serovar Typhi Ty2
cgcgcuggcaagcgccagc

SEQ ID NO: 1753778 - RNA, 16 nt, Salmonella enterica enterica serovar Typhi Ty2
cgcgcugucugccggc

SEQ ID NO: 1753779 - RNA, 20 nt, Salmonella enterica enterica serovar Typhi Ty2
cgcgcuggugggacuguuca

SEQ ID NO: 1753780 - RNA, 22 nt, Salmonella enterica enterica serovar Typhi Ty2
cgcgcuguuuauccacaggcga

SEQ ID NO: 1753781 - RNA, 20 nt, Salmonella enterica enterica serovar Typhi Ty2
cgcggaagcgaccggcguca

SEQ ID NO: 1753782 - RNA, 13 nt, Salmonella enterica enterica serovar Typhi Ty2
cgcggaaggcgcc

SEQ ID NO: 1753783 - RNA, 17 nt, Salmonella enterica enterica serovar Typhi Ty2
cgcgcuuucuggcgcag

SEQ ID NO: 1753784 - RNA, 21 nt, Salmonella enterica enterica serovar Typhi Ty2
cgcgcucauacgaucgcgcac

SEQ ID NO: 1753785 - RNA, 15 nt, Salmonella enterica enterica serovar Typhi Ty2
cgcgcucaagcuggg

SEQ ID NO: 1753786 - RNA, 23 nt, Salmonella enterica enterica serovar Typhi Ty2
cgcgcuagugccgccaggcaaau

SEQ ID NO: 1753787 - RNA, 19 nt, Salmonella enterica enterica serovar Typhi Ty2
cgcgcucaaauggucccug

SEQ ID NO: 1753788 - RNA, 13 nt, Salmonella enterica enterica serovar Typhi Ty2
cgcgcucgccagc

SEQ ID NO: 1753789 - RNA, 17 nt, Salmonella enterica enterica serovar Typhi Ty2
cgcgcucggucacuuca

SEQ ID NO: 1753790 - RNA, 16 nt, Salmonella enterica enterica serovar Typhi Ty2
cgcgcucuuccgccag

SEQ ID NO: 1753791 - RNA, 17 nt, Salmonella enterica enterica serovar Typhi Ty2
cgcgcucuuccgccagc

SEQ ID NO: 1753792 - RNA, 20 nt, Salmonella enterica enterica serovar Typhi Ty2
cgcgcggauauggcggcggc

SEQ ID NO: 1753793 - RNA, 19 nt, Salmonella enterica enterica serovar Typhi Ty2
cgcgcgcuuucaccgccuc

SEQ ID NO: 1753794 - RNA, 22 nt, Salmonella enterica enterica serovar Typhi Ty2
cgcgcgguugggcuuccgucgg

SEQ ID NO: 1753795 - RNA, 23 nt, Salmonella enterica enterica serovar Typhi Ty2
cgcgccugccauagcaucaccag

SEQ ID NO: 1753796 - RNA, 20 nt, Salmonella enterica enterica serovar Typhi Ty2
cgcgccuggaucugcgcauu

SEQ ID NO: 1753797 - RNA, 19 nt, Salmonella enterica enterica serovar Typhi Ty2
cgcgcgacuuaucuuccac

SEQ ID NO: 1753798 - RNA, 18 nt, Salmonella enterica enterica serovar Typhi Ty2
cgcgcgaaacgcacccgc

SEQ ID NO: 1753799 - RNA, 20 nt, Salmonella enterica enterica serovar Typhi Ty2
cgcgcgccugaugcgccgcc

SEQ ID NO: 1753800 - RNA, 12 nt, Salmonella enterica enterica serovar Typhi Ty2
cgcgcgccgccu

SEQ ID NO: 1753801 - RNA, 13 nt, Salmonella enterica enterica serovar Typhi Ty2
cgcgcgccgccuc

SEQ ID NO: 1753802 - RNA, 21 nt, Salmonella enterica enterica serovar Typhi Ty2
cgcgcgccgcuuccggcaggu

SEQ ID NO: 1753803 - RNA, 16 nt, Salmonella enterica enterica serovar Typhi Ty2
cgcgccggucgccagc

SEQ ID NO: 1753804 - RNA, 21 nt, Salmonella enterica enterica serovar Typhi Ty2
cgcgccggugaucccaccagc

SEQ ID NO: 1753805 - RNA, 23 nt, Salmonella enterica enterica serovar Typhi Ty2
cgcgccggggcggggaaaccguc

SEQ ID NO: 1753806 - RNA, 17 nt, Salmonella enterica enterica serovar Typhi Ty2
cgcgccgguagcgagaa

SEQ ID NO: 1753807 - RNA, 14 nt, Salmonella enterica enterica serovar Typhi Ty2
cgccagcaccacgu

SEQ ID NO: 1753808 - RNA, 15 nt, Salmonella enterica enterica serovar Typhi Ty2
cgcgccgugcccagc

SEQ ID NO: 1753809 - RNA, 11 nt, Salmonella enterica enterica serovar Typhi Ty2
cgcgccguucg

SEQ ID NO: 1753810 - RNA, 16 nt, Salmonella enterica enterica serovar Typhi Ty2
cgcgccugacgcggac

SEQ ID NO: 1753811 - RNA, 16 nt, Salmonella enterica enterica serovar Typhi Ty2
cgccagauacacgccu

SEQ ID NO: 1753812 - RNA, 20 nt, Salmonella enterica enterica serovar Typhi Ty2
cgccagauaaagcgaauaac

SEQ ID NO: 1753813 - RNA, 16 nt, Salmonella enterica enterica serovar Typhi Ty2
cgccagauaaaucagc

SEQ ID NO: 1753814 - RNA, 21 nt, Salmonella enterica enterica serovar Typhi Ty2
cgccagaggcgugcaugggca

SEQ ID NO: 1753815 - RNA, 22 nt, Salmonella enterica enterica serovar Typhi Ty2
cgccagaucgaacagcggcagg

SEQ ID NO: 1753816 - RNA, 14 nt, Salmonella enterica enterica serovar Typhi Ty2
cgccagaugcaccg

SEQ ID NO: 1753817 - RNA, 16 nt, Salmonella enterica enterica serovar Typhi Ty2
cgccagaugucggcgg

SEQ ID NO: 1753818 - RNA, 14 nt, Salmonella enterica enterica serovar Typhi Ty2
cgccagauuaucca

SEQ ID NO: 1753819 - RNA, 22 nt, Salmonella enterica enterica serovar Typhi Ty2
cgccagaugcuuaaacugcgcg

SEQ ID NO: 1753820 - RNA, 19 nt, Salmonella enterica enterica serovar Typhi Ty2
cgccagcaacagguacccc

SEQ ID NO: 1753821 - RNA, 19 nt, Salmonella enterica enterica serovar Typhi Ty2
cgccagauaaucgccgcca

SEQ ID NO: 1753822 - RNA, 20 nt, Salmonella enterica enterica serovar Typhi Ty2
cgccagcaaugccgccgcca

SEQ ID NO: 1753823 - RNA, 19 nt, Salmonella enterica enterica serovar Typhi Ty2
cgcuccccguuccaccgcc

SEQ ID NO: 1753824 - RNA, 14 nt, Salmonella enterica enterica serovar Typhi Ty2
cgcucccuuccccc

SEQ ID NO: 1753825 - RNA, 14 nt, Salmonella enterica enterica serovar Typhi Ty2
cgcuccagcuggcu

SEQ ID NO: 1753826 - RNA, 15 nt, Salmonella enterica enterica serovar Typhi Ty2
cgcuccagcuggcug

SEQ ID NO: 1753827 - RNA, 22 nt, Salmonella enterica enterica serovar Typhi Ty2
cgcuccagggauugauggccag

SEQ ID NO: 1753828 - RNA, 21 nt, Salmonella enterica enterica serovar Typhi Ty2
cgcuccaucauaucgcgcagc

SEQ ID NO: 1753829 - RNA, 17 nt, Salmonella enterica enterica serovar Typhi Ty2
cgcuccagaccaccagc

SEQ ID NO: 1753830 - RNA, 14 nt, Salmonella enterica enterica serovar Typhi Ty2
cgcuccaccgccgg

SEQ ID NO: 1753831 - RNA, 15 nt, Salmonella enterica enterica serovar Typhi Ty2
cgcucaugcgccugg

SEQ ID NO: 1753832 - RNA, 14 nt, Salmonella enterica enterica serovar Typhi Ty2
cgcuccugcuccca

SEQ ID NO: 1753833 - RNA, 21 nt, Salmonella enterica enterica serovar Typhi Ty2
cgcuccugcgguacggccagc

SEQ ID NO: 1753834 - RNA, 15 nt, Salmonella enterica enterica serovar Typhi Ty2
cgcuccgacaaacuu

SEQ ID NO: 1753835 - RNA, 20 nt, Salmonella enterica enterica serovar Typhi Ty2
cgcucccuucccccagaaug

SEQ ID NO: 1753836 - RNA, 24 nt, Salmonella enterica enterica serovar Typhi Ty2
cgcucgccagcauacgucugcgcu

SEQ ID NO: 1753837 - RNA, 15 nt, Salmonella enterica enterica serovar Typhi Ty2
cgcucgccauaucuu

SEQ ID NO: 1753838 - RNA, 13 nt, Salmonella enterica enterica serovar Typhi Ty2
cgcucgccgccuc

SEQ ID NO: 1753839 - RNA, 14 nt, Salmonella enterica enterica serovar Typhi Ty2
cgcucgcccgccgc

SEQ ID NO: 1753840 - RNA, 16 nt, Salmonella enterica enterica serovar Typhi Ty2
cgcucgccgccucccc

SEQ ID NO: 1753841 - RNA, 21 nt, Salmonella enterica enterica serovar Typhi Ty2
cgcucuucgccaaucgccgcc

SEQ ID NO: 1753842 - RNA, 15 nt, Salmonella enterica enterica serovar Typhi Ty2
cgcucuuccgccagc

SEQ ID NO: 1753843 - RNA, 19 nt, Salmonella enterica enterica serovar Typhi Ty2
cgcucuuccgccagcgcca

SEQ ID NO: 1753844 - RNA, 12 nt, Salmonella enterica enterica serovar Typhi Ty2
cgcucuuauugc

SEQ ID NO: 1753845 - RNA, 22 nt, Salmonella enterica enterica serovar Typhi Ty2
cgcucuuuaaugauguccagaa

SEQ ID NO: 1753846 - RNA, 21 nt, Salmonella enterica enterica serovar Typhi Ty2
cgcugacgaucaugccgccca

SEQ ID NO: 1753847 - RNA, 12 nt, Salmonella enterica enterica serovar Typhi Ty2
cgcugaccucaa

SEQ ID NO: 1753848 - RNA, 20 nt, Salmonella enterica enterica serovar Typhi Ty2
cgcucggcauacaccgccag

SEQ ID NO: 1753849 - RNA, 13 nt, Salmonella enterica enterica serovar Typhi Ty2
cgcucggccagau

SEQ ID NO: 1753850 - RNA, 16 nt, Salmonella enterica enterica serovar Typhi Ty2
cgcucggccagauaac

SEQ ID NO: 1753851 - RNA, 23 nt, Salmonella enterica enterica serovar Typhi Ty2
cgcucgcuggugccaaucuccag

SEQ ID NO: 1753852 - RNA, 20 nt, Salmonella enterica enterica serovar Typhi Ty2
cgcucgcuuacgcggcgcgc

SEQ ID NO: 1753853 - RNA, 14 nt, Salmonella enterica enterica serovar Typhi Ty2
cgcugauucguuuu

SEQ ID NO: 1753854 - RNA, 14 nt, Salmonella enterica enterica serovar Typhi Ty2
cgcugacugaacuc

SEQ ID NO: 1753855 - RNA, 19 nt, Salmonella enterica enterica serovar Typhi Ty2
cgcugauguuuugcgccgc

SEQ ID NO: 1753856 - RNA, 20 nt, Salmonella enterica enterica serovar Typhi Ty2
cgcugacgccgaccaccgcc

SEQ ID NO: 1753857 - RNA, 19 nt, Salmonella enterica enterica serovar Typhi Ty2
cgcugcauccuguaccacc

SEQ ID NO: 1753858 - RNA, 18 nt, Salmonella enterica enterica serovar Typhi Ty2
cgcugcacaaucgccagc

SEQ ID NO: 1753859 - RNA, 16 nt, Salmonella enterica enterica serovar Typhi Ty2
cgcugcagauuuugcu

SEQ ID NO: 1753860 - RNA, 21 nt, Salmonella enterica enterica serovar Typhi Ty2
cgcuaaucccgcucgccaggu

SEQ ID NO: 1753861 - RNA, 21 nt, Salmonella enterica enterica serovar Typhi Ty2
cgcuaaugcccggcgcggcau

SEQ ID NO: 1753862 - RNA, 22 nt, Salmonella enterica enterica serovar Typhi Ty2
cgcuaaugcccggcgcggcauc

SEQ ID NO: 1753863 - RNA, 17 nt, Salmonella enterica enterica serovar Typhi Ty2
cgcguuuagcgccagca

SEQ ID NO: 1753864 - RNA, 19 nt, Salmonella enterica enterica serovar Typhi Ty2
cgcuaccagcgcggcgcca

SEQ ID NO: 1753865 - RNA, 17 nt, Salmonella enterica enterica serovar Typhi Ty2
cgcuaccagcgcggcgc

SEQ ID NO: 1753866 - RNA, 17 nt, Salmonella enterica enterica serovar Typhi Ty2
cgcuaauuuuuaaauga

SEQ ID NO: 1753867 - RNA, 17 nt, Salmonella enterica enterica serovar Typhi Ty2
cgcuaauuuucagggug

SEQ ID NO: 1753868 - RNA, 23 nt, Salmonella enterica enterica serovar Typhi Ty2
cgcuaauguacgccuaaaaauga

SEQ ID NO: 1753869 - RNA, 18 nt, Salmonella enterica enterica serovar Typhi Ty2
cgcguucugaauaaauug

SEQ ID NO: 1753870 - RNA, 14 nt, Salmonella enterica enterica serovar Typhi Ty2
cgcguuggacaggg

SEQ ID NO: 1753871 - RNA, 20 nt, Salmonella enterica enterica serovar Typhi Ty2
cgcguguuuguaaaaauaga

SEQ ID NO: 1753872 - RNA, 18 nt, Salmonella enterica enterica serovar Typhi Ty2
cgcucaccaccgccgcga

SEQ ID NO: 1753873 - RNA, 23 nt, Salmonella enterica enterica serovar Typhi Ty2
cgcucacauucauugccgccagu

SEQ ID NO: 1753874 - RNA, 16 nt, Salmonella enterica enterica serovar Typhi Ty2
cgcucaccuccgccac

SEQ ID NO: 1753875 - RNA, 20 nt, Salmonella enterica enterica serovar Typhi Ty2
cgcucaucacaucgcgcagc

SEQ ID NO: 1753876 - RNA, 14 nt, Salmonella enterica enterica serovar Typhi Ty2
cgcuagccgcaucc

SEQ ID NO: 1753877 - RNA, 15 nt, Salmonella enterica enterica serovar Typhi Ty2
cgcuagcucaacgcc

SEQ ID NO: 1753878 - RNA, 15 nt, Salmonella enterica enterica serovar Typhi Ty2
cgcuagcuggcaggg

SEQ ID NO: 1753879 - RNA, 16 nt, Salmonella enterica enterica serovar Typhi Ty2
cgcuagggcaucagac

SEQ ID NO: 1753880 - RNA, 16 nt, Salmonella enterica enterica serovar Typhi Ty2
cgcucaagaugauagc

SEQ ID NO: 1753881 - RNA, 21 nt, Salmonella enterica enterica serovar Typhi Ty2
cgcucaagcgaaaaaauaauc

SEQ ID NO: 1753882 - RNA, 16 nt, Salmonella enterica enterica serovar Typhi Ty2
cgcucaauagccagaa

SEQ ID NO: 1753883 - RNA, 14 nt, Salmonella enterica enterica serovar Typhi Ty2
cgcuauccagcagu

SEQ ID NO: 1753884 - RNA, 17 nt, Salmonella enterica enterica serovar Typhi Ty2
cgcguaaccccugcccg

SEQ ID NO: 1753885 - RNA, 23 nt, Salmonella enterica enterica serovar Typhi Ty2
cgcguaaguuugcguacucagca

SEQ ID NO: 1753886 - RNA, 19 nt, Salmonella enterica enterica serovar Typhi Ty2
cgcguaaucuuccacccgc

SEQ ID NO: 1753887 - RNA, 20 nt, Salmonella enterica enterica serovar Typhi Ty2
cgcguaaucuuccacccgcg

SEQ ID NO: 1753888 - RNA, 14 nt, Salmonella enterica enterica serovar Typhi Ty2
cgcguaccucagca

SEQ ID NO: 1753889 - RNA, 14 nt, Salmonella enterica enterica serovar Typhi Ty2
cgcguagcccagcg

SEQ ID NO: 1753890 - RNA, 18 nt, Salmonella enterica enterica serovar Typhi Ty2
cgcguagcccacagguag

SEQ ID NO: 1753891 - RNA, 16 nt, Salmonella enterica enterica serovar Typhi Ty2
cgcguagcccagcgcc

SEQ ID NO: 1753892 - RNA, 12 nt, Salmonella enterica enterica serovar Typhi Ty2
cgcggggaacac

SEQ ID NO: 1753893 - RNA, 21 nt, Salmonella enterica enterica serovar Typhi Ty2
cgcgucguucacgucgcgaag

SEQ ID NO: 1753894 - RNA, 22 nt, Salmonella enterica enterica serovar Typhi Ty2
cgcgucguucacgucgcgaagc

SEQ ID NO: 1753895 - RNA, 12 nt, Salmonella enterica enterica serovar Typhi Ty2
cgcgucuucauc

SEQ ID NO: 1753896 - RNA, 21 nt, Salmonella enterica enterica serovar Typhi Ty2
cgcgucugaaugacgccgucu

SEQ ID NO: 1753897 - RNA, 14 nt, Salmonella enterica enterica serovar Typhi Ty2
cgcgucacaagcuc

SEQ ID NO: 1753898 - RNA, 17 nt, Salmonella enterica enterica serovar Typhi Ty2
cgcgucacaacagccgg

SEQ ID NO: 1753899 - RNA, 17 nt, Salmonella enterica enterica serovar Typhi Ty2
cgcguauucucaaccag

SEQ ID NO: 1753900 - RNA, 18 nt, Salmonella enterica enterica serovar Typhi Ty2
cgcgucagcgccuccgcg

SEQ ID NO: 1753901 - RNA, 17 nt, Salmonella enterica enterica serovar Typhi Ty2
cgcgucaaauagagaaa

SEQ ID NO: 1753902 - RNA, 15 nt, Salmonella enterica enterica serovar Typhi Ty2
cgcguauaacgccgc

SEQ ID NO: 1753903 - RNA, 19 nt, Salmonella enterica enterica serovar Typhi Ty2
cgcguauaacgccgccccc

SEQ ID NO: 1753904 - RNA, 13 nt, Salmonella enterica enterica serovar Typhi Ty2
cggccagcaaaau

SEQ ID NO: 1753905 - RNA, 14 nt, Salmonella enterica enterica serovar Typhi Ty2
cggccacuauuucg

SEQ ID NO: 1753906 - RNA, 21 nt, Salmonella enterica enterica serovar Typhi Ty2
cggccacgguguggcccagcg

SEQ ID NO: 1753907 - RNA, 20 nt, Salmonella enterica enterica serovar Typhi Ty2
cggccacgcgcgucaggacg

SEQ ID NO: 1753908 - RNA, 21 nt, Salmonella enterica enterica serovar Typhi Ty2
cggccaccauuacgcccccuc

SEQ ID NO: 1753909 - RNA, 14 nt, Salmonella enterica enterica serovar Typhi Ty2
cggccaccaggccu

SEQ ID NO: 1753910 - RNA, 23 nt, Salmonella enterica enterica serovar Typhi Ty2
cggccacccauccccauauucca

SEQ ID NO: 1753911 - RNA, 20 nt, Salmonella enterica enterica serovar Typhi Ty2
cggccaggcaaagauccacc

SEQ ID NO: 1753912 - RNA, 16 nt, Salmonella enterica enterica serovar Typhi Ty2
cggccacagcgccaga

SEQ ID NO: 1753913 - RNA, 14 nt, Salmonella enterica enterica serovar Typhi Ty2
cggccaccacauac

SEQ ID NO: 1753914 - RNA, 16 nt, Salmonella enterica enterica serovar Typhi Ty2
cggccaacgcgcccuc

SEQ ID NO: 1753915 - RNA, 21 nt, Salmonella enterica enterica serovar Typhi Ty2
cggcauuuuucucaggacgcc

SEQ ID NO: 1753916 - RNA, 22 nt, Salmonella enterica enterica serovar Typhi Ty2
cggccaaagcgcgacuggaacg

SEQ ID NO: 1753917 - RNA, 18 nt, Salmonella enterica enterica serovar Typhi Ty2
cggcagcuuccagcaaac

SEQ ID NO: 1753918 - RNA, 12 nt, Salmonella enterica enterica serovar Typhi Ty2
cggcagcuucca

SEQ ID NO: 1753919 - RNA, 11 nt, Salmonella enterica enterica serovar Typhi Ty2
cggcagcucug

SEQ ID NO: 1753920 - RNA, 23 nt, Salmonella enterica enterica serovar Typhi Ty2
cggcagcucugccuguagcagcg

SEQ ID NO: 1753921 - RNA, 16 nt, Salmonella enterica enterica serovar Typhi Ty2
cggcagcucuuccaga

SEQ ID NO: 1753922 - RNA, 17 nt, Salmonella enterica enterica serovar Typhi Ty2
cggcaucucaaggucug

SEQ ID NO: 1753923 - RNA, 14 nt, Salmonella enterica enterica serovar Typhi Ty2
cggcaucucaucuu

SEQ ID NO: 1753924 - RNA, 15 nt, Salmonella enterica enterica serovar Typhi Ty2
cggcaucucuucguu

SEQ ID NO: 1753925 - RNA, 20 nt, Salmonella enterica enterica serovar Typhi Ty2
cggcaucuuuaaccgccugc

SEQ ID NO: 1753926 - RNA, 16 nt, Salmonella enterica enterica serovar Typhi Ty2
cggcauuaauuucuug

SEQ ID NO: 1753927 - RNA, 16 nt, Salmonella enterica enterica serovar Typhi Ty2
cggcaugucgccagcc

SEQ ID NO: 1753928 - RNA, 18 nt, Salmonella enterica enterica serovar Typhi Ty2
cggcaugucgccagccag

SEQ ID NO: 1753929 - RNA, 18 nt, Salmonella enterica enterica serovar Typhi Ty2
cggcauguccggcgacuc

SEQ ID NO: 1753930 - RNA, 17 nt, Salmonella enterica enterica serovar Typhi Ty2
cggcauggaugcaugag

SEQ ID NO: 1753931 - RNA, 20 nt, Salmonella enterica enterica serovar Typhi Ty2
cggcauggguaaagcccauc

SEQ ID NO: 1753932 - RNA, 16 nt, Salmonella enterica enterica serovar Typhi Ty2
cggauaugcagcagcc

SEQ ID NO: 1753933 - RNA, 15 nt, Salmonella enterica enterica serovar Typhi Ty2
cggaucaccggcauu

SEQ ID NO: 1753934 - RNA, 22 nt, Salmonella enterica enterica serovar Typhi Ty2
cggauaccggcgcagcaucugc

SEQ ID NO: 1753935 - RNA, 12 nt, Salmonella enterica enterica serovar Typhi Ty2
cggcaacugcgc

SEQ ID NO: 1753936 - RNA, 12 nt, Salmonella enterica enterica serovar Typhi Ty2
cggcaauggcca

SEQ ID NO: 1753937 - RNA, 18 nt, Salmonella enterica enterica serovar Typhi Ty2
cggcaaugagcggccagc

SEQ ID NO: 1753938 - RNA, 15 nt, Salmonella enterica enterica serovar Typhi Ty2
cggcaaucaauacag

SEQ ID NO: 1753939 - RNA, 17 nt, Salmonella enterica enterica serovar Typhi Ty2
cggcaagucagaccagu

SEQ ID NO: 1753940 - RNA, 15 nt, Salmonella enterica enterica serovar Typhi Ty2
cggcaauaaacuccc

SEQ ID NO: 1753941 - RNA, 23 nt, Salmonella enterica enterica serovar Typhi Ty2
cggcaauaaacucccgcauauau

SEQ ID NO: 1753942 - RNA, 18 nt, Salmonella enterica enterica serovar Typhi Ty2
cggcaagcgggcguugcu

SEQ ID NO: 1753943 - RNA, 14 nt, Salmonella enterica enterica serovar Typhi Ty2
cggcaagcuggcga

SEQ ID NO: 1753944 - RNA, 17 nt, Salmonella enterica enterica serovar Typhi Ty2
cggcaaggaaaaccagu

SEQ ID NO: 1753945 - RNA, 14 nt, Salmonella enterica enterica serovar Typhi Ty2
cggcaccggacauc

SEQ ID NO: 1753946 - RNA, 18 nt, Salmonella enterica enterica serovar Typhi Ty2
cggcaccggaaccggcau

SEQ ID NO: 1753947 - RNA, 21 nt, Salmonella enterica enterica serovar Typhi Ty2
cggcacgucgucccaggccag

SEQ ID NO: 1753948 - RNA, 13 nt, Salmonella enterica enterica serovar Typhi Ty2
cggcacagccagu

SEQ ID NO: 1753949 - RNA, 19 nt, Salmonella enterica enterica serovar Typhi Ty2
cggcacauauuccggcgcu

SEQ ID NO: 1753950 - RNA, 22 nt, Salmonella enterica enterica serovar Typhi Ty2
cggcacauauuccggcgcuggc

SEQ ID NO: 1753951 - RNA, 15 nt, Salmonella enterica enterica serovar Typhi Ty2
cggcacaucaauaaa

SEQ ID NO: 1753952 - RNA, 15 nt, Salmonella enterica enterica serovar Typhi Ty2
cggcacaaccuggcu

SEQ ID NO: 1753953 - RNA, 14 nt, Salmonella enterica enterica serovar Typhi Ty2
cggcagcagcuuca

SEQ ID NO: 1753954 - RNA, 13 nt, Salmonella enterica enterica serovar Typhi Ty2
cggcagccgccac

SEQ ID NO: 1753955 - RNA, 16 nt, Salmonella enterica enterica serovar Typhi Ty2
cggcacucaccucuuc

SEQ ID NO: 1753956 - RNA, 12 nt, Salmonella enterica enterica serovar Typhi Ty2
cggcacuacagc

SEQ ID NO: 1753957 - RNA, 16 nt, Salmonella enterica enterica serovar Typhi Ty2
cggcacguuuuccagg

SEQ ID NO: 1753958 - RNA, 14 nt, Salmonella enterica enterica serovar Typhi Ty2
cggcagcacccggc

SEQ ID NO: 1753959 - RNA, 19 nt, Salmonella enterica enterica serovar Typhi Ty2
cgcuucgucagcuccucgc

SEQ ID NO: 1753960 - RNA, 16 nt, Salmonella enterica enterica serovar Typhi Ty2
cgcuucuacagccacc

SEQ ID NO: 1753961 - RNA, 23 nt, Salmonella enterica enterica serovar Typhi Ty2
cgcuucucuauacggcgcgcagu

SEQ ID NO: 1753962 - RNA, 12 nt, Salmonella enterica enterica serovar Typhi Ty2
cgcuucuucaug

SEQ ID NO: 1753963 - RNA, 15 nt, Salmonella enterica enterica serovar Typhi Ty2
cgcuucguauuucuu

SEQ ID NO: 1753964 - RNA, 19 nt, Salmonella enterica enterica serovar Typhi Ty2
cgcuucgcuugcccggccu

SEQ ID NO: 1753965 - RNA, 14 nt, Salmonella enterica enterica serovar Typhi Ty2
cgcuucgcgcgcca

SEQ ID NO: 1753966 - RNA, 21 nt, Salmonella enterica enterica serovar Typhi Ty2
cgcuucgccuguugcugacga

SEQ ID NO: 1753967 - RNA, 23 nt, Salmonella enterica enterica serovar Typhi Ty2
cgcuuggugcguaccucauggua

SEQ ID NO: 1753968 - RNA, 17 nt, Salmonella enterica enterica serovar Typhi Ty2
cgcuucuucuaccaccu

SEQ ID NO: 1753969 - RNA, 14 nt, Salmonella enterica enterica serovar Typhi Ty2
cgcuuccagcgcau

SEQ ID NO: 1753970 - RNA, 12 nt, Salmonella enterica enterica serovar Typhi Ty2
cgcuuccagaau

SEQ ID NO: 1753971 - RNA, 11 nt, Salmonella enterica enterica serovar Typhi Ty2
cgcuuccuggg

SEQ ID NO: 1753972 - RNA, 23 nt, Salmonella enterica enterica serovar Typhi Ty2
cgcuucgcagcgauauuucuccg

SEQ ID NO: 1753973 - RNA, 13 nt, Salmonella enterica enterica serovar Typhi Ty2
cgcuuccugcagu

SEQ ID NO: 1753974 - RNA, 16 nt, Salmonella enterica enterica serovar Typhi Ty2
cgcugccgcccuuucc

SEQ ID NO: 1753975 - RNA, 20 nt, Salmonella enterica enterica serovar Typhi Ty2
cgcugccacacucucuccag

SEQ ID NO: 1753976 - RNA, 21 nt, Salmonella enterica enterica serovar Typhi Ty2
cgcugccuuccgggcggcugu

SEQ ID NO: 1753977 - RNA, 14 nt, Salmonella enterica enterica serovar Typhi Ty2
cgcuuuguuuucca

SEQ ID NO: 1753978 - RNA, 19 nt, Salmonella enterica enterica serovar Typhi Ty2
cggaaauuagcccgcuuca

SEQ ID NO: 1753979 - RNA, 21 nt, Salmonella enterica enterica serovar Typhi Ty2
cgcuuugauguccggcgcguu

SEQ ID NO: 1753980 - RNA, 22 nt, Salmonella enterica enterica serovar Typhi Ty2
cgcuuugaggaucaauuuuucg

SEQ ID NO: 1753981 - RNA, 20 nt, Salmonella enterica enterica serovar Typhi Ty2
cgcuuucgccacgcucacuu

SEQ ID NO: 1753982 - RNA, 16 nt, Salmonella enterica enterica serovar Typhi Ty2
cggaacagggccgcau

SEQ ID NO: 1753983 - RNA, 19 nt, Salmonella enterica enterica serovar Typhi Ty2
cggaaccaaaauagauaau

SEQ ID NO: 1753984 - RNA, 13 nt, Salmonella enterica enterica serovar Typhi Ty2
cggaacaccagcg

SEQ ID NO: 1753985 - RNA, 16 nt, Salmonella enterica enterica serovar Typhi Ty2
cggaacaggcuuuuca

SEQ ID NO: 1753986 - RNA, 12 nt, Salmonella enterica enterica serovar Typhi Ty2
cggaacaccagc

SEQ ID NO: 1753987 - RNA, 16 nt, Salmonella enterica enterica serovar Typhi Ty2
cggaacccagcaaauc

SEQ ID NO: 1753988 - RNA, 18 nt, Salmonella enterica enterica serovar Typhi Ty2
cggaagacuggcgcagca

SEQ ID NO: 1753989 - RNA, 19 nt, Salmonella enterica enterica serovar Typhi Ty2
cggaagacuggcgcagcaa

SEQ ID NO: 1753990 - RNA, 21 nt, Salmonella enterica enterica serovar Typhi Ty2
cggaagacuggcgcagcaaac

SEQ ID NO: 1753991 - RNA, 16 nt, Salmonella enterica enterica serovar Typhi Ty2
cggaagagaaacucuu

SEQ ID NO: 1753992 - RNA, 20 nt, Salmonella enterica enterica serovar Typhi Ty2
cggaauagacggccugcaaa

SEQ ID NO: 1753993 - RNA, 16 nt, Salmonella enterica enterica serovar Typhi Ty2
cggaauaauguaaaaa

SEQ ID NO: 1753994 - RNA, 11 nt, Salmonella enterica enterica serovar Typhi Ty2
cggaauaacuc

SEQ ID NO: 1753995 - RNA, 19 nt, Salmonella enterica enterica serovar Typhi Ty2
cggaaucgcgauccagccc

SEQ ID NO: 1753996 - RNA, 20 nt, Salmonella enterica enterica serovar Typhi Ty2
cggaauaauguaaaaaaaua

SEQ ID NO: 1753997 - RNA, 15 nt, Salmonella enterica enterica serovar Typhi Ty2
cggaaguauccugga

SEQ ID NO: 1753998 - RNA, 16 nt, Salmonella enterica enterica serovar Typhi Ty2
cggaaggcgaaaacau

SEQ ID NO: 1753999 - RNA, 15 nt, Salmonella enterica enterica serovar Typhi Ty2
cggaagcugaccagg

SEQ ID NO: 1754000 - RNA, 21 nt, Salmonella enterica enterica serovar Typhi Ty2
cggaagcugaccagggcaaau

SEQ ID NO: 1754001 - RNA, 18 nt, Salmonella enterica enterica serovar Typhi Ty2
cggaagcagauaccagcc

SEQ ID NO: 1754002 - RNA, 15 nt, Salmonella enterica enterica serovar Typhi Ty2
cggaagcgaccggcg

SEQ ID NO: 1754003 - RNA, 22 nt, Salmonella enterica enterica serovar Typhi Ty2
cggaguggccgcaaaugauaau

SEQ ID NO: 1754004 - RNA, 14 nt, Salmonella enterica enterica serovar Typhi Ty2
cggaguccagcaac

SEQ ID NO: 1754005 - RNA, 21 nt, Salmonella enterica enterica serovar Typhi Ty2
cggagaguucauaacgcacaa

SEQ ID NO: 1754006 - RNA, 19 nt, Salmonella enterica enterica serovar Typhi Ty2
cggaggccagauucaccac

SEQ ID NO: 1754007 - RNA, 14 nt, Salmonella enterica enterica serovar Typhi Ty2
cggaggcacugccu

SEQ ID NO: 1754008 - RNA, 15 nt, Salmonella enterica enterica serovar Typhi Ty2
cggagauacuuucuu

SEQ ID NO: 1754009 - RNA, 19 nt, Salmonella enterica enterica serovar Typhi Ty2
cggagaaaagcgaaaauaa

SEQ ID NO: 1754010 - RNA, 17 nt, Salmonella enterica enterica serovar Typhi Ty2
cggagaagacgccgccg

SEQ ID NO: 1754011 - RNA, 22 nt, Salmonella enterica enterica serovar Typhi Ty2
cggagaacgguucauccagcag

SEQ ID NO: 1754012 - RNA, 23 nt, Salmonella enterica enterica serovar Typhi Ty2
cggagaaauagacgagcgaaaaa

SEQ ID NO: 1754013 - RNA, 15 nt, Salmonella enterica enterica serovar Typhi Ty2
cggacucgcuggaca

SEQ ID NO: 1754014 - RNA, 12 nt, Salmonella enterica enterica serovar Typhi Ty2
cggacucagggu

SEQ ID NO: 1754015 - RNA, 12 nt, Salmonella enterica enterica serovar Typhi Ty2
cggacuccagca

SEQ ID NO: 1754016 - RNA, 16 nt, Salmonella enterica enterica serovar Typhi Ty2
cggacucauacuugcc

SEQ ID NO: 1754017 - RNA, 23 nt, Salmonella enterica enterica serovar Typhi Ty2
cggaauggauaacgaaaaggguc

SEQ ID NO: 1754018 - RNA, 19 nt, Salmonella enterica enterica serovar Typhi Ty2
cggaauggcacagcgcagc

SEQ ID NO: 1754019 - RNA, 21 nt, Salmonella enterica enterica serovar Typhi Ty2
cggaauggcacagcgcagcaa

SEQ ID NO: 1754020 - RNA, 17 nt, Salmonella enterica enterica serovar Typhi Ty2
cggacaacgcuccagca

SEQ ID NO: 1754021 - RNA, 21 nt, Salmonella enterica enterica serovar Typhi Ty2
cggaaugugaaauacagccag

SEQ ID NO: 1754022 - RNA, 15 nt, Salmonella enterica enterica serovar Typhi Ty2
cggacacccgcagcc

SEQ ID NO: 1754023 - RNA, 18 nt, Salmonella enterica enterica serovar Typhi Ty2
cggacacccgcagccaga

SEQ ID NO: 1754024 - RNA, 12 nt, Salmonella enterica enterica serovar Typhi Ty2
cggacacuaauu

SEQ ID NO: 1754025 - RNA, 12 nt, Salmonella enterica enterica serovar Typhi Ty2
cggacagcagca

SEQ ID NO: 1754026 - RNA, 21 nt, Salmonella enterica enterica serovar Typhi Ty2
cggacauuuauuucacuggcc

SEQ ID NO: 1754027 - RNA, 19 nt, Salmonella enterica enterica serovar Typhi Ty2
cggacaucauccccggcag

SEQ ID NO: 1754028 - RNA, 15 nt, Salmonella enterica enterica serovar Typhi Ty2
cggaccccucuucuu

SEQ ID NO: 1754029 - RNA, 17 nt, Salmonella enterica enterica serovar Typhi Ty2
cggaccccucuucuuuu

SEQ ID NO: 1754030 - RNA, 19 nt, Salmonella enterica enterica serovar Typhi Ty2
cggaccgauaacaggaacg

SEQ ID NO: 1754031 - RNA, 15 nt, Salmonella enterica enterica serovar Typhi Ty2
cggacgccgggugau

SEQ ID NO: 1754032 - RNA, 19 nt, Salmonella enterica enterica serovar Typhi Ty2
cggacgcagaccaaaguca

SEQ ID NO: 1754033 - RNA, 16 nt, Salmonella enterica enterica serovar Typhi Ty2
cggacgccagugcgca

SEQ ID NO: 1754034 - RNA, 18 nt, Salmonella enterica enterica serovar Typhi Ty2
cggaccuccgcguaccuc

SEQ ID NO: 1754035 - RNA, 20 nt, Salmonella enterica enterica serovar Typhi Ty2
cggaccuaauagccagcccc

SEQ ID NO: 1754036 - RNA, 12 nt, Salmonella enterica enterica serovar Typhi Ty2
cggaccuccgcg

SEQ ID NO: 1754037 - RNA, 20 nt, Salmonella enterica enterica serovar Typhi Ty2
cggacgaaccuggcgguaaa

SEQ ID NO: 1754038 - RNA, 17 nt, Salmonella enterica enterica serovar Typhi Ty2
cggacgcaccagccagg

SEQ ID NO: 1754039 - RNA, 14 nt, Salmonella enterica enterica serovar Typhi Ty2
cguaccaggcagcg

SEQ ID NO: 1754040 - RNA, 20 nt, Salmonella enterica enterica serovar Typhi Ty2
cguaccgccuuguccggccu

SEQ ID NO: 1754041 - RNA, 21 nt, Salmonella enterica enterica serovar Typhi Ty2
cguacccggcuuacaacauug

SEQ ID NO: 1754042 - RNA, 15 nt, Salmonella enterica enterica serovar Typhi Ty2
cguacaugaauaaua

SEQ ID NO: 1754043 - RNA, 22 nt, Salmonella enterica enterica serovar Typhi Ty2
cguaccacgccgcacacagcag

SEQ ID NO: 1754044 - RNA, 21 nt, Salmonella enterica enterica serovar Typhi Ty2
cguacaggcggaaaucaacaa

SEQ ID NO: 1754045 - RNA, 20 nt, Salmonella enterica enterica serovar Typhi Ty2
cguacauguccagaucuuca

SEQ ID NO: 1754046 - RNA, 14 nt, Salmonella enterica enterica serovar Typhi Ty2
cguaccgcgcgccc

SEQ ID NO: 1754047 - RNA, 15 nt, Salmonella enterica enterica serovar Typhi Ty2
cguacucagcagacc

SEQ ID NO: 1754048 - RNA, 22 nt, Salmonella enterica enterica serovar Typhi Ty2
cguacucagaucggcagacagu

SEQ ID NO: 1754049 - RNA, 13 nt, Salmonella enterica enterica serovar Typhi Ty2
cguacggaaggua

SEQ ID NO: 1754050 - RNA, 17 nt, Salmonella enterica enterica serovar Typhi Ty2
cguacgccuaaaugaac

SEQ ID NO: 1754051 - RNA, 15 nt, Salmonella enterica enterica serovar Typhi Ty2
cguacggcugccuuu

SEQ ID NO: 1754052 - RNA, 12 nt, Salmonella enterica enterica serovar Typhi Ty2
cguaaugagcac

SEQ ID NO: 1754053 - RNA, 21 nt, Salmonella enterica enterica serovar Typhi Ty2
cguaaucuuuucauauuauuu

SEQ ID NO: 1754054 - RNA, 19 nt, Salmonella enterica enterica serovar Typhi Ty2
cguaauuaaccgcgccgcu

SEQ ID NO: 1754055 - RNA, 17 nt, Salmonella enterica enterica serovar Typhi Ty2
cguaauggguaaaaaua

SEQ ID NO: 1754056 - RNA, 14 nt, Salmonella enterica enterica serovar Typhi Ty2
cguaaucggccugu

SEQ ID NO: 1754057 - RNA, 15 nt, Salmonella enterica enterica serovar Typhi Ty2
cguaauacgaucuuc

SEQ ID NO: 1754058 - RNA, 19 nt, Salmonella enterica enterica serovar Typhi Ty2
cguaauuugcgacauggcg

SEQ ID NO: 1754059 - RNA, 21 nt, Salmonella enterica enterica serovar Typhi Ty2
cguacaaaggggccacaggcg

SEQ ID NO: 1754060 - RNA, 17 nt, Salmonella enterica enterica serovar Typhi Ty2
cguaauuguugccccgc

SEQ ID NO: 1754061 - RNA, 15 nt, Salmonella enterica enterica serovar Typhi Ty2
cguaauugcgccugg

SEQ ID NO: 1754062 - RNA, 14 nt, Salmonella enterica enterica serovar Typhi Ty2
cguaauuauuacag

SEQ ID NO: 1754063 - RNA, 22 nt, Salmonella enterica enterica serovar Typhi Ty2
cguaauuaaccgcgccgcuggc

SEQ ID NO: 1754064 - RNA, 19 nt, Salmonella enterica enterica serovar Typhi Ty2
cguacaggcggaaaucaac

SEQ ID NO: 1754065 - RNA, 18 nt, Salmonella enterica enterica serovar Typhi Ty2
cguaaaacaacagcggcg

SEQ ID NO: 1754066 - RNA, 18 nt, Salmonella enterica enterica serovar Typhi Ty2
cguaaaacugcaccaacg

SEQ ID NO: 1754067 - RNA, 23 nt, Salmonella enterica enterica serovar Typhi Ty2
cguaacagacgcaucuuuuuccc

SEQ ID NO: 1754068 - RNA, 18 nt, Salmonella enterica enterica serovar Typhi Ty2
cguaacagacgcaucuuu

SEQ ID NO: 1754069 - RNA, 23 nt, Salmonella enterica enterica serovar Typhi Ty2
cguaaauucucuauacugcugac

SEQ ID NO: 1754070 - RNA, 17 nt, Salmonella enterica enterica serovar Typhi Ty2
cguaaauucccuccaga

SEQ ID NO: 1754071 - RNA, 20 nt, Salmonella enterica enterica serovar Typhi Ty2
cguaaauuccuuguuuuaac

SEQ ID NO: 1754072 - RNA, 21 nt, Salmonella enterica enterica serovar Typhi Ty2
cguaacugcgguaaauaaugc

SEQ ID NO: 1754073 - RNA, 20 nt, Salmonella enterica enterica serovar Typhi Ty2
cguaagccaguucucuucuu

SEQ ID NO: 1754074 - RNA, 11 nt, Salmonella enterica enterica serovar Typhi Ty2
cguaagaaaag

SEQ ID NO: 1754075 - RNA, 17 nt, Salmonella enterica enterica serovar Typhi Ty2
cguaauaaaauuuccca

SEQ ID NO: 1754076 - RNA, 22 nt, Salmonella enterica enterica serovar Typhi Ty2
cguaagcgcccguccaugagua

SEQ ID NO: 1754077 - RNA, 14 nt, Salmonella enterica enterica serovar Typhi Ty2
cguaaaaacccuuu

SEQ ID NO: 1754078 - RNA, 22 nt, Salmonella enterica enterica serovar Typhi Ty2
cguaaaaauuguuccuguaaag

SEQ ID NO: 1754079 - RNA, 16 nt, Salmonella enterica enterica serovar Typhi Ty2
cguaaaaaacaucaua

SEQ ID NO: 1754080 - RNA, 15 nt, Salmonella enterica enterica serovar Typhi Ty2
cgguugcaauuccgc

SEQ ID NO: 1754081 - RNA, 16 nt, Salmonella enterica enterica serovar Typhi Ty2
cgguuuuuauggaagg

SEQ ID NO: 1754082 - RNA, 16 nt, Salmonella enterica enterica serovar Typhi Ty2
cgguucucccggcaua

SEQ ID NO: 1754083 - RNA, 15 nt, Salmonella enterica enterica serovar Typhi Ty2
cgguucuucccacuc

SEQ ID NO: 1754084 - RNA, 22 nt, Salmonella enterica enterica serovar Typhi Ty2
cgguucuucccacuccgcccag

SEQ ID NO: 1754085 - RNA, 16 nt, Salmonella enterica enterica serovar Typhi Ty2
cgguggcgcugcgcuu

SEQ ID NO: 1754086 - RNA, 21 nt, Salmonella enterica enterica serovar Typhi Ty2
cggugcuuucgauaaucugac

SEQ ID NO: 1754087 - RNA, 17 nt, Salmonella enterica enterica serovar Typhi Ty2
cggugcggcaagcgcgc

SEQ ID NO: 1754088 - RNA, 17 nt, Salmonella enterica enterica serovar Typhi Ty2
cggugcguuuaaagaga

SEQ ID NO: 1754089 - RNA, 19 nt, Salmonella enterica enterica serovar Typhi Ty2
cggugcggucacaggcaua

SEQ ID NO: 1754090 - RNA, 16 nt, Salmonella enterica enterica serovar Typhi Ty2
cggugcggucacaggc

SEQ ID NO: 1754091 - RNA, 19 nt, Salmonella enterica enterica serovar Typhi Ty2
cgguggugucaauggaugu

SEQ ID NO: 1754092 - RNA, 13 nt, Salmonella enterica enterica serovar Typhi Ty2
cgguucaggcuua

SEQ ID NO: 1754093 - RNA, 16 nt, Salmonella enterica enterica serovar Typhi Ty2
cgguguggcccagcgc

SEQ ID NO: 1754094 - RNA, 14 nt, Salmonella enterica enterica serovar Typhi Ty2
cggugauauugugu

SEQ ID NO: 1754095 - RNA, 23 nt, Salmonella enterica enterica serovar Typhi Ty2
cggugauauugccgaccgccagc

SEQ ID NO: 1754096 - RNA, 21 nt, Salmonella enterica enterica serovar Typhi Ty2
cggugaucccaggccggcaua

SEQ ID NO: 1754097 - RNA, 14 nt, Salmonella enterica enterica serovar Typhi Ty2
cggugaucccacca

SEQ ID NO: 1754098 - RNA, 17 nt, Salmonella enterica enterica serovar Typhi Ty2
cggugaauagguaugua

SEQ ID NO: 1754099 - RNA, 21 nt, Salmonella enterica enterica serovar Typhi Ty2
cggucucuuaaugccagcggc

SEQ ID NO: 1754100 - RNA, 15 nt, Salmonella enterica enterica serovar Typhi Ty2
cggucagcggcgcgc

SEQ ID NO: 1754101 - RNA, 12 nt, Salmonella enterica enterica serovar Typhi Ty2
cggucagccaca

SEQ ID NO: 1754102 - RNA, 12 nt, Salmonella enterica enterica serovar Typhi Ty2
cggucagccagc

SEQ ID NO: 1754103 - RNA, 15 nt, Salmonella enterica enterica serovar Typhi Ty2
cggucuuuuucgcag

SEQ ID NO: 1754104 - RNA, 19 nt, Salmonella enterica enterica serovar Typhi Ty2
cggucuggaugcguucaaa

SEQ ID NO: 1754105 - RNA, 22 nt, Salmonella enterica enterica serovar Typhi Ty2
cggucugcuucagccacuggcu

SEQ ID NO: 1754106 - RNA, 15 nt, Salmonella enterica enterica serovar Typhi Ty2
cggucuucacucacc

SEQ ID NO: 1754107 - RNA, 19 nt, Salmonella enterica enterica serovar Typhi Ty2
cggggaucguucugcugau

SEQ ID NO: 1754108 - RNA, 16 nt, Salmonella enterica enterica serovar Typhi Ty2
cggggauaaucagcag

SEQ ID NO: 1754109 - RNA, 18 nt, Salmonella enterica enterica serovar Typhi Ty2
cggggauaaucagcagcg

SEQ ID NO: 1754110 - RNA, 18 nt, Salmonella enterica enterica serovar Typhi Ty2
cggggcguuaaucaccgg

SEQ ID NO: 1754111 - RNA, 22 nt, Salmonella enterica enterica serovar Typhi Ty2
cggggcguuaaucaccggcgcg

SEQ ID NO: 1754112 - RNA, 22 nt, Salmonella enterica enterica serovar Typhi Ty2
cggggcucccacucuuccagca

SEQ ID NO: 1754113 - RNA, 23 nt, Salmonella enterica enterica serovar Typhi Ty2
cggggaacacggacagcaacccg

SEQ ID NO: 1754114 - RNA, 11 nt, Salmonella enterica enterica serovar Typhi Ty2
cggggaacacu

SEQ ID NO: 1754115 - RNA, 16 nt, Salmonella enterica enterica serovar Typhi Ty2
cggggaacacggacag

SEQ ID NO: 1754116 - RNA, 24 nt, Salmonella enterica enterica serovar Typhi Ty2
cggggaacacucuaaaucuaccca

SEQ ID NO: 1754117 - RNA, 18 nt, Salmonella enterica enterica serovar Typhi Ty2
cggguccagucgcgccgc

SEQ ID NO: 1754118 - RNA, 14 nt, Salmonella enterica enterica serovar Typhi Ty2
cgggucagcggggu

SEQ ID NO: 1754119 - RNA, 14 nt, Salmonella enterica enterica serovar Typhi Ty2
cgggguuugcagau

SEQ ID NO: 1754120 - RNA, 23 nt, Salmonella enterica enterica serovar Typhi Ty2
cggguaaacgucccugccacagu

SEQ ID NO: 1754121 - RNA, 21 nt, Salmonella enterica enterica serovar Typhi Ty2
cggguaaacaaacacagccau

SEQ ID NO: 1754122 - RNA, 21 nt, Salmonella enterica enterica serovar Typhi Ty2
cgggugcauuuucaccuggau

SEQ ID NO: 1754123 - RNA, 14 nt, Salmonella enterica enterica serovar Typhi Ty2
cgguacgccgccau

SEQ ID NO: 1754124 - RNA, 13 nt, Salmonella enterica enterica serovar Typhi Ty2
cgguaccggcauu

SEQ ID NO: 1754125 - RNA, 16 nt, Salmonella enterica enterica serovar Typhi Ty2
cgguacacgcagucca

SEQ ID NO: 1754126 - RNA, 15 nt, Salmonella enterica enterica serovar Typhi Ty2
cgguacuccccuuuu

SEQ ID NO: 1754127 - RNA, 14 nt, Salmonella enterica enterica serovar Typhi Ty2
cgguacucuuuuuc

SEQ ID NO: 1754128 - RNA, 15 nt, Salmonella enterica enterica serovar Typhi Ty2
cgguacggcauggcg

SEQ ID NO: 1754129 - RNA, 16 nt, Salmonella enterica enterica serovar Typhi Ty2
cgguagaggcgccgac

SEQ ID NO: 1754130 - RNA, 11 nt, Salmonella enterica enterica serovar Typhi Ty2
cgguacuucug

SEQ ID NO: 1754131 - RNA, 14 nt, Salmonella enterica enterica serovar Typhi Ty2
cgguacugcuggcc

SEQ ID NO: 1754132 - RNA, 16 nt, Salmonella enterica enterica serovar Typhi Ty2
cgguagcuuuuuaaau

SEQ ID NO: 1754133 - RNA, 16 nt, Salmonella enterica enterica serovar Typhi Ty2
cgguagcuccagacag

SEQ ID NO: 1754134 - RNA, 21 nt, Salmonella enterica enterica serovar Typhi Ty2
cgguauaaauuuccgcagcca

SEQ ID NO: 1754135 - RNA, 13 nt, Salmonella enterica enterica serovar Typhi Ty2
cgguagguuuaaa

SEQ ID NO: 1754136 - RNA, 14 nt, Salmonella enterica enterica serovar Typhi Ty2
cgguauaacugccu

SEQ ID NO: 1754137 - RNA, 16 nt, Salmonella enterica enterica serovar Typhi Ty2
cgguauccgcauucua

SEQ ID NO: 1754138 - RNA, 20 nt, Salmonella enterica enterica serovar Typhi Ty2
cgguaucgaucacgcgcagg

SEQ ID NO: 1754139 - RNA, 23 nt, Salmonella enterica enterica serovar Typhi Ty2
cgguauuaucaauaguuaauuaa

SEQ ID NO: 1754140 - RNA, 16 nt, Salmonella enterica enterica serovar Typhi Ty2
cgguaugcaccucuuu

SEQ ID NO: 1754141 - RNA, 15 nt, Salmonella enterica enterica serovar Typhi Ty2
cgguaugccuuccag

SEQ ID NO: 1754142 - RNA, 18 nt, Salmonella enterica enterica serovar Typhi Ty2
cgguauuuauccagcagg

SEQ ID NO: 1754143 - RNA, 23 nt, Salmonella enterica enterica serovar Typhi Ty2
cgguaacgacuuauuugcucagu

SEQ ID NO: 1754144 - RNA, 19 nt, Salmonella enterica enterica serovar Typhi Ty2
cgguaaaggucgccgcauc

SEQ ID NO: 1754145 - RNA, 21 nt, Salmonella enterica enterica serovar Typhi Ty2
cgguaaauuucuugaucaauc

SEQ ID NO: 1754146 - RNA, 19 nt, Salmonella enterica enterica serovar Typhi Ty2
cgguaaacgugcuggaugg

SEQ ID NO: 1754147 - RNA, 17 nt, Salmonella enterica enterica serovar Typhi Ty2
cgguaaaccaggccagc

SEQ ID NO: 1754148 - RNA, 15 nt, Salmonella enterica enterica serovar Typhi Ty2
cgguaaaccaggcca

SEQ ID NO: 1754149 - RNA, 13 nt, Salmonella enterica enterica serovar Typhi Ty2
cgguaaacaccac

SEQ ID NO: 1754150 - RNA, 23 nt, Salmonella enterica enterica serovar Typhi Ty2
cgguaagaaugcgcgucaggcca

SEQ ID NO: 1754151 - RNA, 19 nt, Salmonella enterica enterica serovar Typhi Ty2
cgguaagagcguuacccag

SEQ ID NO: 1754152 - RNA, 20 nt, Salmonella enterica enterica serovar Typhi Ty2
cgguaagcuguuccggcuuc

SEQ ID NO: 1754153 - RNA, 22 nt, Salmonella enterica enterica serovar Typhi Ty2
cgguaagcccauggcaggcagc

SEQ ID NO: 1754154 - RNA, 20 nt, Salmonella enterica enterica serovar Typhi Ty2
cgguaacgauacccaccagc

SEQ ID NO: 1754155 - RNA, 21 nt, Salmonella enterica enterica serovar Typhi Ty2
cgguaacguaacuugauuccu

SEQ ID NO: 1754156 - RNA, 14 nt, Salmonella enterica enterica serovar Typhi Ty2
cgguaaucacugcc

SEQ ID NO: 1754157 - RNA, 16 nt, Salmonella enterica enterica serovar Typhi Ty2
cgguaaucagacuggc

SEQ ID NO: 1754158 - RNA, 22 nt, Salmonella enterica enterica serovar Typhi Ty2
cgguaaucaccagaucggcauc

SEQ ID NO: 1754159 - RNA, 22 nt, Salmonella enterica enterica serovar Typhi Ty2
cgguaaucgaucccgccgcauc

SEQ ID NO: 1754160 - RNA, 23 nt, Salmonella enterica enterica serovar Typhi Ty2
cggguugcacauuguugcaggga

SEQ ID NO: 1754161 - RNA, 12 nt, Salmonella enterica enterica serovar Typhi Ty2
cggguugcugau

SEQ ID NO: 1754162 - RNA, 12 nt, Salmonella enterica enterica serovar Typhi Ty2
cggguuuuccug

SEQ ID NO: 1754163 - RNA, 20 nt, Salmonella enterica enterica serovar Typhi Ty2
cggguuuggucagguaagcu

SEQ ID NO: 1754164 - RNA, 14 nt, Salmonella enterica enterica serovar Typhi Ty2
cggguuaggcaagc

SEQ ID NO: 1754165 - RNA, 19 nt, Salmonella enterica enterica serovar Typhi Ty2
cgggcagcggcaagacaga

SEQ ID NO: 1754166 - RNA, 13 nt, Salmonella enterica enterica serovar Typhi Ty2
cgggcagcagcag

SEQ ID NO: 1754167 - RNA, 21 nt, Salmonella enterica enterica serovar Typhi Ty2
cgggcagauggucgcauggcu

SEQ ID NO: 1754168 - RNA, 22 nt, Salmonella enterica enterica serovar Typhi Ty2
cgggcagacaugaccgcacagc

SEQ ID NO: 1754169 - RNA, 14 nt, Salmonella enterica enterica serovar Typhi Ty2
cgggaucuccagaa

SEQ ID NO: 1754170 - RNA, 15 nt, Salmonella enterica enterica serovar Typhi Ty2
cgggaucgaaccgcc

SEQ ID NO: 1754171 - RNA, 17 nt, Salmonella enterica enterica serovar Typhi Ty2
cgggaugcauaaaaaaa

SEQ ID NO: 1754172 - RNA, 22 nt, Salmonella enterica enterica serovar Typhi Ty2
cgggaucugcgccauugagguc

SEQ ID NO: 1754173 - RNA, 22 nt, Salmonella enterica enterica serovar Typhi Ty2
cgggauggccgccgagcuguga

SEQ ID NO: 1754174 - RNA, 20 nt, Salmonella enterica enterica serovar Typhi Ty2
cgggaugguuaaauucauau

SEQ ID NO: 1754175 - RNA, 15 nt, Salmonella enterica enterica serovar Typhi Ty2
cgggaugguuaaauu

SEQ ID NO: 1754176 - RNA, 18 nt, Salmonella enterica enterica serovar Typhi Ty2
cgggagguucaccaccac

SEQ ID NO: 1754177 - RNA, 15 nt, Salmonella enterica enterica serovar Typhi Ty2
cgggaggggcuuucc

SEQ ID NO: 1754178 - RNA, 19 nt, Salmonella enterica enterica serovar Typhi Ty2
cgggauacggcgagaccau

SEQ ID NO: 1754179 - RNA, 17 nt, Salmonella enterica enterica serovar Typhi Ty2
cgggaucgcagaaauau

SEQ ID NO: 1754180 - RNA, 15 nt, Salmonella enterica enterica serovar Typhi Ty2
cgggaucgagcgcgg

SEQ ID NO: 1754181 - RNA, 17 nt, Salmonella enterica enterica serovar Typhi Ty2
cgggauccccugcuccu

SEQ ID NO: 1754182 - RNA, 14 nt, Salmonella enterica enterica serovar Typhi Ty2
cgggauauccucuu

SEQ ID NO: 1754183 - RNA, 22 nt, Salmonella enterica enterica serovar Typhi Ty2
cgggacuuuaaacgucaugcug

SEQ ID NO: 1754184 - RNA, 23 nt, Salmonella enterica enterica serovar Typhi Ty2
cgggagcucuaccagaccacgca

SEQ ID NO: 1754185 - RNA, 22 nt, Salmonella enterica enterica serovar Typhi Ty2
cgggaagaugugccacuccgcc

SEQ ID NO: 1754186 - RNA, 22 nt, Salmonella enterica enterica serovar Typhi Ty2
cggcugauggcguuccacccag

SEQ ID NO: 1754187 - RNA, 15 nt, Salmonella enterica enterica serovar Typhi Ty2
cggcugcgcugccag

SEQ ID NO: 1754188 - RNA, 16 nt, Salmonella enterica enterica serovar Typhi Ty2
cggcugcgcugccagc

SEQ ID NO: 1754189 - RNA, 22 nt, Salmonella enterica enterica serovar Typhi Ty2
cggcuggacgucaugccgccac

SEQ ID NO: 1754190 - RNA, 17 nt, Salmonella enterica enterica serovar Typhi Ty2
cggcuugucauccugcu

SEQ ID NO: 1754191 - RNA, 15 nt, Salmonella enterica enterica serovar Typhi Ty2
cgggaaauagagcag

SEQ ID NO: 1754192 - RNA, 20 nt, Salmonella enterica enterica serovar Typhi Ty2
cgggaaaagguuucggcgau

SEQ ID NO: 1754193 - RNA, 17 nt, Salmonella enterica enterica serovar Typhi Ty2
cgggaaaagcguccggg

SEQ ID NO: 1754194 - RNA, 21 nt, Salmonella enterica enterica serovar Typhi Ty2
cggcgucaccaccgcaggcag

SEQ ID NO: 1754195 - RNA, 12 nt, Salmonella enterica enterica serovar Typhi Ty2
cggcgucauccc

SEQ ID NO: 1754196 - RNA, 14 nt, Salmonella enterica enterica serovar Typhi Ty2
cggcguccgccagc

SEQ ID NO: 1754197 - RNA, 20 nt, Salmonella enterica enterica serovar Typhi Ty2
cggcgguuauccuccggguc

SEQ ID NO: 1754198 - RNA, 21 nt, Salmonella enterica enterica serovar Typhi Ty2
cggcggugcagguugccugau

SEQ ID NO: 1754199 - RNA, 13 nt, Salmonella enterica enterica serovar Typhi Ty2
cggcggcaguccc

SEQ ID NO: 1754200 - RNA, 17 nt, Salmonella enterica enterica serovar Typhi Ty2
cggcggguauggcaaug

SEQ ID NO: 1754201 - RNA, 16 nt, Salmonella enterica enterica serovar Typhi Ty2
cggcggaaaagcgccc

SEQ ID NO: 1754202 - RNA, 22 nt, Salmonella enterica enterica serovar Typhi Ty2
cggcgcugucacuccggcugca

SEQ ID NO: 1754203 - RNA, 16 nt, Salmonella enterica enterica serovar Typhi Ty2
cggcgcuuccugcagu

SEQ ID NO: 1754204 - RNA, 19 nt, Salmonella enterica enterica serovar Typhi Ty2
cggcggaaaauagccagaa

SEQ ID NO: 1754205 - RNA, 19 nt, Salmonella enterica enterica serovar Typhi Ty2
cggcguuggcgauuuccag

SEQ ID NO: 1754206 - RNA, 12 nt, Salmonella enterica enterica serovar Typhi Ty2
cggcguucugcg

SEQ ID NO: 1754207 - RNA, 16 nt, Salmonella enterica enterica serovar Typhi Ty2
cggcuccaauauuuca

SEQ ID NO: 1754208 - RNA, 16 nt, Salmonella enterica enterica serovar Typhi Ty2
cggcguuuauauaaaa

SEQ ID NO: 1754209 - RNA, 22 nt, Salmonella enterica enterica serovar Typhi Ty2
cggcguuuuaauauccuggcga

SEQ ID NO: 1754210 - RNA, 16 nt, Salmonella enterica enterica serovar Typhi Ty2
cggcgucugcgcgcug

SEQ ID NO: 1754211 - RNA, 14 nt, Salmonella enterica enterica serovar Typhi Ty2
cggcgucugaugaa

SEQ ID NO: 1754212 - RNA, 14 nt, Salmonella enterica enterica serovar Typhi Ty2
cggcgugaaagcgc

SEQ ID NO: 1754213 - RNA, 12 nt, Salmonella enterica enterica serovar Typhi Ty2
cggcucccauuu

SEQ ID NO: 1754214 - RNA, 16 nt, Salmonella enterica enterica serovar Typhi Ty2
cggcuccagcgccagc

SEQ ID NO: 1754215 - RNA, 22 nt, Salmonella enterica enterica serovar Typhi Ty2
cggcucgccuuugcgcccguac

SEQ ID NO: 1754216 - RNA, 14 nt, Salmonella enterica enterica serovar Typhi Ty2
cggcugaaccaccc

SEQ ID NO: 1754217 - RNA, 15 nt, Salmonella enterica enterica serovar Typhi Ty2
cggcgaaagaagcgc

SEQ ID NO: 1754218 - RNA, 21 nt, Salmonella enterica enterica serovar Typhi Ty2
cggcgaaagaagcgcuggaga

SEQ ID NO: 1754219 - RNA, 21 nt, Salmonella enterica enterica serovar Typhi Ty2
cggccuuuuuccgucagcaac

SEQ ID NO: 1754220 - RNA, 15 nt, Salmonella enterica enterica serovar Typhi Ty2
cggccccagccugga

SEQ ID NO: 1754221 - RNA, 13 nt, Salmonella enterica enterica serovar Typhi Ty2
cggcccaggcauc

SEQ ID NO: 1754222 - RNA, 18 nt, Salmonella enterica enterica serovar Typhi Ty2
cggcgaacguuggcuggg

SEQ ID NO: 1754223 - RNA, 19 nt, Salmonella enterica enterica serovar Typhi Ty2
cggcgaaccggcaucggca

SEQ ID NO: 1754224 - RNA, 21 nt, Salmonella enterica enterica serovar Typhi Ty2
cggcgaaccggcaucggcagc

SEQ ID NO: 1754225 - RNA, 20 nt, Salmonella enterica enterica serovar Typhi Ty2
cggcgaaaucgugcgcccca

SEQ ID NO: 1754226 - RNA, 18 nt, Salmonella enterica enterica serovar Typhi Ty2
cggcgaacucggucaggg

SEQ ID NO: 1754227 - RNA, 17 nt, Salmonella enterica enterica serovar Typhi Ty2
cggcgaagggggccggg

SEQ ID NO: 1754228 - RNA, 14 nt, Salmonella enterica enterica serovar Typhi Ty2
cggcgaccggcaaa

SEQ ID NO: 1754229 - RNA, 14 nt, Salmonella enterica enterica serovar Typhi Ty2
cggcgacagcgacc

SEQ ID NO: 1754230 - RNA, 16 nt, Salmonella enterica enterica serovar Typhi Ty2
cggcgacgugacgcgc

SEQ ID NO: 1754231 - RNA, 20 nt, Salmonella enterica enterica serovar Typhi Ty2
cggcgacggacucgcgcaga

SEQ ID NO: 1754232 - RNA, 15 nt, Salmonella enterica enterica serovar Typhi Ty2
cggcgacgcccgcca

SEQ ID NO: 1754233 - RNA, 20 nt, Salmonella enterica enterica serovar Typhi Ty2
cggcgaccuucacgccgcca

SEQ ID NO: 1754234 - RNA, 16 nt, Salmonella enterica enterica serovar Typhi Ty2
cggcgauagcgcccca

SEQ ID NO: 1754235 - RNA, 13 nt, Salmonella enterica enterica serovar Typhi Ty2
cggcgaucaccac

SEQ ID NO: 1754236 - RNA, 14 nt, Salmonella enterica enterica serovar Typhi Ty2
cggcgcgacgccgc

SEQ ID NO: 1754237 - RNA, 17 nt, Salmonella enterica enterica serovar Typhi Ty2
cggcgcgauauccacca

SEQ ID NO: 1754238 - RNA, 14 nt, Salmonella enterica enterica serovar Typhi Ty2
cggcgccuuccggc

SEQ ID NO: 1754239 - RNA, 17 nt, Salmonella enterica enterica serovar Typhi Ty2
cggcgcgaaagcgccuu

SEQ ID NO: 1754240 - RNA, 21 nt, Salmonella enterica enterica serovar Typhi Ty2
cggcgccuuuaauuccgccgg

SEQ ID NO: 1754241 - RNA, 13 nt, Salmonella enterica enterica serovar Typhi Ty2
cggcgccggcgcg

SEQ ID NO: 1754242 - RNA, 14 nt, Salmonella enterica enterica serovar Typhi Ty2
cggcgcgccuucca

SEQ ID NO: 1754243 - RNA, 12 nt, Salmonella enterica enterica serovar Typhi Ty2
cggcgcgcgcgc

SEQ ID NO: 1754244 - RNA, 13 nt, Salmonella enterica enterica serovar Typhi Ty2
cggcgcgccgcuc

SEQ ID NO: 1754245 - RNA, 24 nt, Salmonella enterica enterica serovar Typhi Ty2
cggcgcgccgcuggcgaccagccu

SEQ ID NO: 1754246 - RNA, 14 nt, Salmonella enterica enterica serovar Typhi Ty2
cggcgcgccggcaa

SEQ ID NO: 1754247 - RNA, 23 nt, Salmonella enterica enterica serovar Typhi Ty2
cggcgcgggugaugacgcgcagg

SEQ ID NO: 1754248 - RNA, 20 nt, Salmonella enterica enterica serovar Typhi Ty2
cggcgcgucuucccggcgcu

SEQ ID NO: 1754249 - RNA, 20 nt, Salmonella enterica enterica serovar Typhi Ty2
cggcgcgucgggcagggaug

SEQ ID NO: 1754250 - RNA, 22 nt, Salmonella enterica enterica serovar Typhi Ty2
cggcgcugcgcggcgugcagau

SEQ ID NO: 1754251 - RNA, 21 nt, Salmonella enterica enterica serovar Typhi Ty2
cggcgcccagcuuacgcgcag

SEQ ID NO: 1754252 - RNA, 15 nt, Salmonella enterica enterica serovar Typhi Ty2
cggcgccaucgccuc

SEQ ID NO: 1754253 - RNA, 14 nt, Salmonella enterica enterica serovar Typhi Ty2
cggcgcccggaggg

SEQ ID NO: 1754254 - RNA, 23 nt, Salmonella enterica enterica serovar Typhi Ty2
cggcgccgaucaucccgcccagc

SEQ ID NO: 1754255 - RNA, 15 nt, Salmonella enterica enterica serovar Typhi Ty2
cggcgccgaagcagg

SEQ ID NO: 1754256 - RNA, 17 nt, Salmonella enterica enterica serovar Typhi Ty2
cggcgauuuccagcgcc

SEQ ID NO: 1754257 - RNA, 15 nt, Salmonella enterica enterica serovar Typhi Ty2
cggcgcaaaucgcca

SEQ ID NO: 1754258 - RNA, 23 nt, Salmonella enterica enterica serovar Typhi Ty2
cggcgcaaaggccuuauccggcc

SEQ ID NO: 1754259 - RNA, 18 nt, Salmonella enterica enterica serovar Typhi Ty2
cggcgcacuuccucuccc

SEQ ID NO: 1754260 - RNA, 21 nt, Salmonella enterica enterica serovar Typhi Ty2
cggcgccaauuaacucuuccg

SEQ ID NO: 1754261 - RNA, 18 nt, Salmonella enterica enterica serovar Typhi Ty2
cggcgcauuuucggcagc

SEQ ID NO: 1754262 - RNA, 22 nt, Salmonella enterica enterica serovar Typhi Ty2
cggcgcaggggcauuuuccggc

SEQ ID NO: 1754263 - RNA, 17 nt, Salmonella enterica enterica serovar Typhi Ty2
cccugcugauacacaac

SEQ ID NO: 1754264 - RNA, 16 nt, Salmonella enterica enterica serovar Typhi Ty2
cccugcuguuccagug

SEQ ID NO: 1754265 - RNA, 13 nt, Salmonella enterica enterica serovar Typhi Ty2
cccugcuccugcc

SEQ ID NO: 1754266 - RNA, 22 nt, Salmonella enterica enterica serovar Typhi Ty2
cccugcgguagcuccagacagg

SEQ ID NO: 1754267 - RNA, 19 nt, Salmonella enterica enterica serovar Typhi Ty2
cccuggcgcaguggcgggu

SEQ ID NO: 1754268 - RNA, 22 nt, Salmonella enterica enterica serovar Typhi Ty2
cccuggauugugauuccaguug

SEQ ID NO: 1754269 - RNA, 18 nt, Salmonella enterica enterica serovar Typhi Ty2
cccugccauucccagccg

SEQ ID NO: 1754270 - RNA, 14 nt, Salmonella enterica enterica serovar Typhi Ty2
cccugcccgccagg

SEQ ID NO: 1754271 - RNA, 13 nt, Salmonella enterica enterica serovar Typhi Ty2
cccugcaucagcu

SEQ ID NO: 1754272 - RNA, 17 nt, Salmonella enterica enterica serovar Typhi Ty2
cccugcauuauccacga

SEQ ID NO: 1754273 - RNA, 17 nt, Salmonella enterica enterica serovar Typhi Ty2
cccugcgcuuucaacca

SEQ ID NO: 1754274 - RNA, 18 nt, Salmonella enterica enterica serovar Typhi Ty2
cccugcgcuuucaaccac

SEQ ID NO: 1754275 - RNA, 20 nt, Salmonella enterica enterica serovar Typhi Ty2
cccugcgcggccugcgccag

SEQ ID NO: 1754276 - RNA, 19 nt, Salmonella enterica enterica serovar Typhi Ty2
cccugcgaacagcgcucca

SEQ ID NO: 1754277 - RNA, 23 nt, Salmonella enterica enterica serovar Typhi Ty2
cccugcgaacagcgcuccacgcg

SEQ ID NO: 1754278 - RNA, 18 nt, Salmonella enterica enterica serovar Typhi Ty2
cccugcgaacagcgcucc

SEQ ID NO: 1754279 - RNA, 14 nt, Salmonella enterica enterica serovar Typhi Ty2
cccucuuccaucag

SEQ ID NO: 1754280 - RNA, 21 nt, Salmonella enterica enterica serovar Typhi Ty2
ccccuggacgcgagccacagg

SEQ ID NO: 1754281 - RNA, 15 nt, Salmonella enterica enterica serovar Typhi Ty2
ccccugcuccugcca

SEQ ID NO: 1754282 - RNA, 14 nt, Salmonella enterica enterica serovar Typhi Ty2
ccccugggccgggu

SEQ ID NO: 1754283 - RNA, 14 nt, Salmonella enterica enterica serovar Typhi Ty2
cccugcaacgccug

SEQ ID NO: 1754284 - RNA, 15 nt, Salmonella enterica enterica serovar Typhi Ty2
cccugcaacgccugc

SEQ ID NO: 1754285 - RNA, 21 nt, Salmonella enterica enterica serovar Typhi Ty2
cccugauauacaaaacccaua

SEQ ID NO: 1754286 - RNA, 22 nt, Salmonella enterica enterica serovar Typhi Ty2
cccugaugcguauccagcgcgg

SEQ ID NO: 1754287 - RNA, 14 nt, Salmonella enterica enterica serovar Typhi Ty2
cccugauggcgcgc

SEQ ID NO: 1754288 - RNA, 16 nt, Salmonella enterica enterica serovar Typhi Ty2
cccugaaaccguggaa

SEQ ID NO: 1754289 - RNA, 11 nt, Salmonella enterica enterica serovar Typhi Ty2
cccugaaacug

SEQ ID NO: 1754290 - RNA, 14 nt, Salmonella enterica enterica serovar Typhi Ty2
cccugaauauuaga

SEQ ID NO: 1754291 - RNA, 14 nt, Salmonella enterica enterica serovar Typhi Ty2
cccugacgccgcug

SEQ ID NO: 1754292 - RNA, 13 nt, Salmonella enterica enterica serovar Typhi Ty2
cccugagcccaca

SEQ ID NO: 1754293 - RNA, 15 nt, Salmonella enterica enterica serovar Typhi Ty2
cccugagucuugccu

SEQ ID NO: 1754294 - RNA, 12 nt, Salmonella enterica enterica serovar Typhi Ty2
cccuugcgcguu

SEQ ID NO: 1754295 - RNA, 16 nt, Salmonella enterica enterica serovar Typhi Ty2
cccuugccgcuuccag

SEQ ID NO: 1754296 - RNA, 23 nt, Salmonella enterica enterica serovar Typhi Ty2
cccuucuccgguaaucaccagau

SEQ ID NO: 1754297 - RNA, 17 nt, Salmonella enterica enterica serovar Typhi Ty2
cccuucucgcuaauauc

SEQ ID NO: 1754298 - RNA, 18 nt, Salmonella enterica enterica serovar Typhi Ty2
cccuucuucuggcucaga

SEQ ID NO: 1754299 - RNA, 19 nt, Salmonella enterica enterica serovar Typhi Ty2
cccuucuuuaucuucugcu

SEQ ID NO: 1754300 - RNA, 21 nt, Salmonella enterica enterica serovar Typhi Ty2
cccuucuuuuacugccccgcc

SEQ ID NO: 1754301 - RNA, 21 nt, Salmonella enterica enterica serovar Typhi Ty2
cccuuuuugcauucgcuccuc

SEQ ID NO: 1754302 - RNA, 18 nt, Salmonella enterica enterica serovar Typhi Ty2
ccgaagaacagauucauu

SEQ ID NO: 1754303 - RNA, 14 nt, Salmonella enterica enterica serovar Typhi Ty2
cccuucaucuucca

SEQ ID NO: 1754304 - RNA, 16 nt, Salmonella enterica enterica serovar Typhi Ty2
cccuuccagacagcuu

SEQ ID NO: 1754305 - RNA, 17 nt, Salmonella enterica enterica serovar Typhi Ty2
cccuuccccggcagccu

SEQ ID NO: 1754306 - RNA, 22 nt, Salmonella enterica enterica serovar Typhi Ty2
cccuucgacaaucagcaccauu

SEQ ID NO: 1754307 - RNA, 16 nt, Salmonella enterica enterica serovar Typhi Ty2
cccuucgaccgucagc

SEQ ID NO: 1754308 - RNA, 12 nt, Salmonella enterica enterica serovar Typhi Ty2
cccuucgcccuc

SEQ ID NO: 1754309 - RNA, 15 nt, Salmonella enterica enterica serovar Typhi Ty2
cccuuccucuccccc

SEQ ID NO: 1754310 - RNA, 23 nt, Salmonella enterica enterica serovar Typhi Ty2
cccuucgcuauccaucgccgcgc

SEQ ID NO: 1754311 - RNA, 19 nt, Salmonella enterica enterica serovar Typhi Ty2
cccuuaucuggaugaggac

SEQ ID NO: 1754312 - RNA, 21 nt, Salmonella enterica enterica serovar Typhi Ty2
cccuuaugucauucaggucua

SEQ ID NO: 1754313 - RNA, 16 nt, Salmonella enterica enterica serovar Typhi Ty2
cccuuaaauccggccu

SEQ ID NO: 1754314 - RNA, 18 nt, Salmonella enterica enterica serovar Typhi Ty2
cccuguuuuuucgccgcg

SEQ ID NO: 1754315 - RNA, 15 nt, Salmonella enterica enterica serovar Typhi Ty2
cccuuaaagccgccc

SEQ ID NO: 1754316 - RNA, 18 nt, Salmonella enterica enterica serovar Typhi Ty2
cccuguuccuguauuuga

SEQ ID NO: 1754317 - RNA, 22 nt, Salmonella enterica enterica serovar Typhi Ty2
cccuguuauucagggcuuuauu

SEQ ID NO: 1754318 - RNA, 21 nt, Salmonella enterica enterica serovar Typhi Ty2
cccuguaacagaauuaacgca

SEQ ID NO: 1754319 - RNA, 23 nt, Salmonella enterica enterica serovar Typhi Ty2
cccuguaacagaauuaacgcaga

SEQ ID NO: 1754320 - RNA, 15 nt, Salmonella enterica enterica serovar Typhi Ty2
cccuggcugguuaau

SEQ ID NO: 1754321 - RNA, 19 nt, Salmonella enterica enterica serovar Typhi Ty2
cccuggcucaauccaggug

SEQ ID NO: 1754322 - RNA, 16 nt, Salmonella enterica enterica serovar Typhi Ty2
cccuggggcgcucuuu

SEQ ID NO: 1754323 - RNA, 21 nt, Salmonella enterica enterica serovar Typhi Ty2
ccgaugagaaguagcccauau

SEQ ID NO: 1754324 - RNA, 21 nt, Salmonella enterica enterica serovar Typhi Ty2
ccgaucugguuauccaccagc

SEQ ID NO: 1754325 - RNA, 20 nt, Salmonella enterica enterica serovar Typhi Ty2
ccgaugucgccacgccgccc

SEQ ID NO: 1754326 - RNA, 13 nt, Salmonella enterica enterica serovar Typhi Ty2
ccgauucccaguc

SEQ ID NO: 1754327 - RNA, 15 nt, Salmonella enterica enterica serovar Typhi Ty2
ccgcaacggucgguc

SEQ ID NO: 1754328 - RNA, 18 nt, Salmonella enterica enterica serovar Typhi Ty2
ccgcaacggcuugugagc

SEQ ID NO: 1754329 - RNA, 23 nt, Salmonella enterica enterica serovar Typhi Ty2
ccgcaagaaacaggcugacaaag

SEQ ID NO: 1754330 - RNA, 18 nt, Salmonella enterica enterica serovar Typhi Ty2
ccgauuuuucggcacgcu

SEQ ID NO: 1754331 - RNA, 12 nt, Salmonella enterica enterica serovar Typhi Ty2
ccgauuuuucgg

SEQ ID NO: 1754332 - RNA, 13 nt, Salmonella enterica enterica serovar Typhi Ty2
ccgcaaaaaauac

SEQ ID NO: 1754333 - RNA, 22 nt, Salmonella enterica enterica serovar Typhi Ty2
ccgcaaacgccgugaacgccaa

SEQ ID NO: 1754334 - RNA, 16 nt, Salmonella enterica enterica serovar Typhi Ty2
ccgcaaacagcacgcc

SEQ ID NO: 1754335 - RNA, 16 nt, Salmonella enterica enterica serovar Typhi Ty2
ccgcaaacagagcgcc

SEQ ID NO: 1754336 - RNA, 20 nt, Salmonella enterica enterica serovar Typhi Ty2
ccgcaaaggaucaucggcca

SEQ ID NO: 1754337 - RNA, 18 nt, Salmonella enterica enterica serovar Typhi Ty2
ccgauucugccaguucac

SEQ ID NO: 1754338 - RNA, 16 nt, Salmonella enterica enterica serovar Typhi Ty2
ccgcacgguuagccgg

SEQ ID NO: 1754339 - RNA, 22 nt, Salmonella enterica enterica serovar Typhi Ty2
ccgcaauaccaauuaccggcuu

SEQ ID NO: 1754340 - RNA, 20 nt, Salmonella enterica enterica serovar Typhi Ty2
ccgcagugaagaauggcgcc

SEQ ID NO: 1754341 - RNA, 17 nt, Salmonella enterica enterica serovar Typhi Ty2
ccgcaggcucuuuuucu

SEQ ID NO: 1754342 - RNA, 16 nt, Salmonella enterica enterica serovar Typhi Ty2
ccgcaggagagccaga

SEQ ID NO: 1754343 - RNA, 11 nt, Salmonella enterica enterica serovar Typhi Ty2
ccgcaggacag

SEQ ID NO: 1754344 - RNA, 22 nt, Salmonella enterica enterica serovar Typhi Ty2
ccgcaggacagcgacauccucu

SEQ ID NO: 1754345 - RNA, 22 nt, Salmonella enterica enterica serovar Typhi Ty2
ccgcagccaacaacaggccgcc

SEQ ID NO: 1754346 - RNA, 11 nt, Salmonella enterica enterica serovar Typhi Ty2
ccgcagccacu

SEQ ID NO: 1754347 - RNA, 14 nt, Salmonella enterica enterica serovar Typhi Ty2
ccgcagccagaaca

SEQ ID NO: 1754348 - RNA, 17 nt, Salmonella enterica enterica serovar Typhi Ty2
ccgacgaaaaagccaaa

SEQ ID NO: 1754349 - RNA, 23 nt, Salmonella enterica enterica serovar Typhi Ty2
ccgacgauaaacagauaugaaau

SEQ ID NO: 1754350 - RNA, 19 nt, Salmonella enterica enterica serovar Typhi Ty2
ccgacgcauuucuccugau

SEQ ID NO: 1754351 - RNA, 14 nt, Salmonella enterica enterica serovar Typhi Ty2
ccgagaauccacuc

SEQ ID NO: 1754352 - RNA, 21 nt, Salmonella enterica enterica serovar Typhi Ty2
ccgacuaauuauuuuucaaau

SEQ ID NO: 1754353 - RNA, 12 nt, Salmonella enterica enterica serovar Typhi Ty2
ccgagcaacaga

SEQ ID NO: 1754354 - RNA, 19 nt, Salmonella enterica enterica serovar Typhi Ty2
ccgagcaacagaaaccaua

SEQ ID NO: 1754355 - RNA, 22 nt, Salmonella enterica enterica serovar Typhi Ty2
ccgaucaucccgcccagcaaca

SEQ ID NO: 1754356 - RNA, 22 nt, Salmonella enterica enterica serovar Typhi Ty2
ccgaucuacgcuauuuccagaa

SEQ ID NO: 1754357 - RNA, 13 nt, Salmonella enterica enterica serovar Typhi Ty2
ccgaucucccagc

SEQ ID NO: 1754358 - RNA, 19 nt, Salmonella enterica enterica serovar Typhi Ty2
ccgaucucaugcaacuggc

SEQ ID NO: 1754359 - RNA, 23 nt, Salmonella enterica enterica serovar Typhi Ty2
ccgaucagcaccacgcccggauc

SEQ ID NO: 1754360 - RNA, 12 nt, Salmonella enterica enterica serovar Typhi Ty2
ccgaucagauug

SEQ ID NO: 1754361 - RNA, 13 nt, Salmonella enterica enterica serovar Typhi Ty2
ccgaucagauuga

SEQ ID NO: 1754362 - RNA, 16 nt, Salmonella enterica enterica serovar Typhi Ty2
ccgaguuucugguaga

SEQ ID NO: 1754363 - RNA, 20 nt, Salmonella enterica enterica serovar Typhi Ty2
ccgaguggaaucagccagga

SEQ ID NO: 1754364 - RNA, 15 nt, Salmonella enterica enterica serovar Typhi Ty2
ccgagugucgcccgc

SEQ ID NO: 1754365 - RNA, 22 nt, Salmonella enterica enterica serovar Typhi Ty2
ccgagugcuuauguaggccuga

SEQ ID NO: 1754366 - RNA, 23 nt, Salmonella enterica enterica serovar Typhi Ty2
ccgagccgcccuucacaaccauc

SEQ ID NO: 1754367 - RNA, 14 nt, Salmonella enterica enterica serovar Typhi Ty2
ccggacaucauccc

SEQ ID NO: 1754368 - RNA, 18 nt, Salmonella enterica enterica serovar Typhi Ty2
ccggacaucauccccggc

SEQ ID NO: 1754369 - RNA, 21 nt, Salmonella enterica enterica serovar Typhi Ty2
ccggacaaggcgguacgccgc

SEQ ID NO: 1754370 - RNA, 14 nt, Salmonella enterica enterica serovar Typhi Ty2
ccggacaaggcggu

SEQ ID NO: 1754371 - RNA, 20 nt, Salmonella enterica enterica serovar Typhi Ty2
ccggacaacgcaaacuguau

SEQ ID NO: 1754372 - RNA, 16 nt, Salmonella enterica enterica serovar Typhi Ty2
ccggacaaggcgcgcc

SEQ ID NO: 1754373 - RNA, 20 nt, Salmonella enterica enterica serovar Typhi Ty2
ccggaaugguauaaaucccg

SEQ ID NO: 1754374 - RNA, 20 nt, Salmonella enterica enterica serovar Typhi Ty2
ccggaauggucgcgccaggg

SEQ ID NO: 1754375 - RNA, 22 nt, Salmonella enterica enterica serovar Typhi Ty2
ccggauaaggcgcuugcgccgc

SEQ ID NO: 1754376 - RNA, 21 nt, Salmonella enterica enterica serovar Typhi Ty2
ccggauaaggcgcuugcgccg

SEQ ID NO: 1754377 - RNA, 21 nt, Salmonella enterica enterica serovar Typhi Ty2
ccggauaaggccacgccgcca

SEQ ID NO: 1754378 - RNA, 16 nt, Salmonella enterica enterica serovar Typhi Ty2
ccggauaagcggcagc

SEQ ID NO: 1754379 - RNA, 22 nt, Salmonella enterica enterica serovar Typhi Ty2
ccggauaagcgcagcgccauca

SEQ ID NO: 1754380 - RNA, 16 nt, Salmonella enterica enterica serovar Typhi Ty2
ccggauaacggcgcga

SEQ ID NO: 1754381 - RNA, 17 nt, Salmonella enterica enterica serovar Typhi Ty2
ccggauaaccgcccgcg

SEQ ID NO: 1754382 - RNA, 20 nt, Salmonella enterica enterica serovar Typhi Ty2
ccggacuccaggcaacguug

SEQ ID NO: 1754383 - RNA, 15 nt, Salmonella enterica enterica serovar Typhi Ty2
ccggaacaaaagaaa

SEQ ID NO: 1754384 - RNA, 19 nt, Salmonella enterica enterica serovar Typhi Ty2
ccggaaauuugcagcgcug

SEQ ID NO: 1754385 - RNA, 22 nt, Salmonella enterica enterica serovar Typhi Ty2
ccggaaauggucgcuccggaac

SEQ ID NO: 1754386 - RNA, 17 nt, Salmonella enterica enterica serovar Typhi Ty2
ccggaacaaaagaaagc

SEQ ID NO: 1754387 - RNA, 20 nt, Salmonella enterica enterica serovar Typhi Ty2
ccggaacaggcuuuucaggc

SEQ ID NO: 1754388 - RNA, 21 nt, Salmonella enterica enterica serovar Typhi Ty2
ccggaacauacacguaauaca

SEQ ID NO: 1754389 - RNA, 17 nt, Salmonella enterica enterica serovar Typhi Ty2
ccggaaccuguccuuua

SEQ ID NO: 1754390 - RNA, 13 nt, Salmonella enterica enterica serovar Typhi Ty2
ccggaacgggcau

SEQ ID NO: 1754391 - RNA, 18 nt, Salmonella enterica enterica serovar Typhi Ty2
ccgcuuuaccgccuuccu

SEQ ID NO: 1754392 - RNA, 15 nt, Salmonella enterica enterica serovar Typhi Ty2
ccgcuuuaccgccuu

SEQ ID NO: 1754393 - RNA, 16 nt, Salmonella enterica enterica serovar Typhi Ty2
ccgcuuugccgcgcuc

SEQ ID NO: 1754394 - RNA, 16 nt, Salmonella enterica enterica serovar Typhi Ty2
ccgcuuugcgaacagc

SEQ ID NO: 1754395 - RNA, 13 nt, Salmonella enterica enterica serovar Typhi Ty2
ccgcuuugauuug

SEQ ID NO: 1754396 - RNA, 12 nt, Salmonella enterica enterica serovar Typhi Ty2
ccgcuuuuccug

SEQ ID NO: 1754397 - RNA, 22 nt, Salmonella enterica enterica serovar Typhi Ty2
ccggaaaucacaaacaccacca

SEQ ID NO: 1754398 - RNA, 12 nt, Salmonella enterica enterica serovar Typhi Ty2
ccggaaaucaca

SEQ ID NO: 1754399 - RNA, 22 nt, Salmonella enterica enterica serovar Typhi Ty2
ccggaaagaauaaucgccgccg

SEQ ID NO: 1754400 - RNA, 23 nt, Salmonella enterica enterica serovar Typhi Ty2
ccggaaagaauaaucgccgccgg

SEQ ID NO: 1754401 - RNA, 21 nt, Salmonella enterica enterica serovar Typhi Ty2
ccggaaaggauauaagcgcca

SEQ ID NO: 1754402 - RNA, 21 nt, Salmonella enterica enterica serovar Typhi Ty2
ccgcuuuugguuuuucaacca

SEQ ID NO: 1754403 - RNA, 14 nt, Salmonella enterica enterica serovar Typhi Ty2
ccggcacgcgcagc

SEQ ID NO: 1754404 - RNA, 21 nt, Salmonella enterica enterica serovar Typhi Ty2
ccggauaaggcgcuugugaua

SEQ ID NO: 1754405 - RNA, 22 nt, Salmonella enterica enterica serovar Typhi Ty2
ccggauaaggcggagccgccau

SEQ ID NO: 1754406 - RNA, 20 nt, Salmonella enterica enterica serovar Typhi Ty2
ccggauaauacgaaauugag

SEQ ID NO: 1754407 - RNA, 16 nt, Salmonella enterica enterica serovar Typhi Ty2
ccggauacaagguauc

SEQ ID NO: 1754408 - RNA, 19 nt, Salmonella enterica enterica serovar Typhi Ty2
ccggauagcggcuucgcca

SEQ ID NO: 1754409 - RNA, 13 nt, Salmonella enterica enterica serovar Typhi Ty2
ccggcaagcgcug

SEQ ID NO: 1754410 - RNA, 18 nt, Salmonella enterica enterica serovar Typhi Ty2
ccggcacggucaaucauc

SEQ ID NO: 1754411 - RNA, 18 nt, Salmonella enterica enterica serovar Typhi Ty2
ccggcacuguucggggau

SEQ ID NO: 1754412 - RNA, 23 nt, Salmonella enterica enterica serovar Typhi Ty2
ccggcagaaaugaccacguacug

SEQ ID NO: 1754413 - RNA, 18 nt, Salmonella enterica enterica serovar Typhi Ty2
ccggcaggagcggagaga

SEQ ID NO: 1754414 - RNA, 15 nt, Salmonella enterica enterica serovar Typhi Ty2
ccggcaggcagcgcc

SEQ ID NO: 1754415 - RNA, 16 nt, Salmonella enterica enterica serovar Typhi Ty2
ccggcagcuuuugcgc

SEQ ID NO: 1754416 - RNA, 13 nt, Salmonella enterica enterica serovar Typhi Ty2
ccggcauuucacu

SEQ ID NO: 1754417 - RNA, 12 nt, Salmonella enterica enterica serovar Typhi Ty2
ccgcgccgucgg

SEQ ID NO: 1754418 - RNA, 15 nt, Salmonella enterica enterica serovar Typhi Ty2
ccgcgccuaccagcg

SEQ ID NO: 1754419 - RNA, 21 nt, Salmonella enterica enterica serovar Typhi Ty2
ccgcggggaucgguuuauccc

SEQ ID NO: 1754420 - RNA, 21 nt, Salmonella enterica enterica serovar Typhi Ty2
ccgcgguacgaaucgccgcgc

SEQ ID NO: 1754421 - RNA, 13 nt, Salmonella enterica enterica serovar Typhi Ty2
ccgcguaaaaagu

SEQ ID NO: 1754422 - RNA, 20 nt, Salmonella enterica enterica serovar Typhi Ty2
ccgcguaccugugcagguac

SEQ ID NO: 1754423 - RNA, 17 nt, Salmonella enterica enterica serovar Typhi Ty2
ccgcguauugcccucgg

SEQ ID NO: 1754424 - RNA, 13 nt, Salmonella enterica enterica serovar Typhi Ty2
ccgcgucccgacc

SEQ ID NO: 1754425 - RNA, 19 nt, Salmonella enterica enterica serovar Typhi Ty2
ccgcguagcccagcgccgc

SEQ ID NO: 1754426 - RNA, 16 nt, Salmonella enterica enterica serovar Typhi Ty2
ccgcuaucgccaaacu

SEQ ID NO: 1754427 - RNA, 13 nt, Salmonella enterica enterica serovar Typhi Ty2
ccgcguuuuagca

SEQ ID NO: 1754428 - RNA, 14 nt, Salmonella enterica enterica serovar Typhi Ty2
ccgcguuggcggcu

SEQ ID NO: 1754429 - RNA, 19 nt, Salmonella enterica enterica serovar Typhi Ty2
ccgcguugguuaaggcggc

SEQ ID NO: 1754430 - RNA, 19 nt, Salmonella enterica enterica serovar Typhi Ty2
ccgcguuuaacgcagcgcg

SEQ ID NO: 1754431 - RNA, 12 nt, Salmonella enterica enterica serovar Typhi Ty2
ccgcuggcgucu

SEQ ID NO: 1754432 - RNA, 20 nt, Salmonella enterica enterica serovar Typhi Ty2
ccgcuggcuggccagggcau

SEQ ID NO: 1754433 - RNA, 22 nt, Salmonella enterica enterica serovar Typhi Ty2
ccgcuggcgcggggaacaccca

SEQ ID NO: 1754434 - RNA, 22 nt, Salmonella enterica enterica serovar Typhi Ty2
ccgcuggcgcggggaacacucu

SEQ ID NO: 1754435 - RNA, 22 nt, Salmonella enterica enterica serovar Typhi Ty2
ccgcuggcgcggggaucgguuu

SEQ ID NO: 1754436 - RNA, 13 nt, Salmonella enterica enterica serovar Typhi Ty2
ccgcuggccgguu

SEQ ID NO: 1754437 - RNA, 19 nt, Salmonella enterica enterica serovar Typhi Ty2
ccgcuggcgaccagccugc

SEQ ID NO: 1754438 - RNA, 19 nt, Salmonella enterica enterica serovar Typhi Ty2
ccgcuggcgccaccgcugc

SEQ ID NO: 1754439 - RNA, 19 nt, Salmonella enterica enterica serovar Typhi Ty2
ccgcuuaaauuaccgccgc

SEQ ID NO: 1754440 - RNA, 17 nt, Salmonella enterica enterica serovar Typhi Ty2
ccgcuucauuggcgucu

SEQ ID NO: 1754441 - RNA, 16 nt, Salmonella enterica enterica serovar Typhi Ty2
ccgcuucacgcgcggc

SEQ ID NO: 1754442 - RNA, 18 nt, Salmonella enterica enterica serovar Typhi Ty2
ccgcuguuuuucaucauc

SEQ ID NO: 1754443 - RNA, 13 nt, Salmonella enterica enterica serovar Typhi Ty2
ccgcuuccagaau

SEQ ID NO: 1754444 - RNA, 17 nt, Salmonella enterica enterica serovar Typhi Ty2
ccgcuuccagcgcgucg

SEQ ID NO: 1754445 - RNA, 18 nt, Salmonella enterica enterica serovar Typhi Ty2
ccgcuuccagcgcgucgg

SEQ ID NO: 1754446 - RNA, 20 nt, Salmonella enterica enterica serovar Typhi Ty2
ccgcucaccaccgccgcgag

SEQ ID NO: 1754447 - RNA, 13 nt, Salmonella enterica enterica serovar Typhi Ty2
ccgcucugcuguu

SEQ ID NO: 1754448 - RNA, 19 nt, Salmonella enterica enterica serovar Typhi Ty2
ccgcugaaauagccccguc

SEQ ID NO: 1754449 - RNA, 15 nt, Salmonella enterica enterica serovar Typhi Ty2
ccgccgggcaacacg

SEQ ID NO: 1754450 - RNA, 17 nt, Salmonella enterica enterica serovar Typhi Ty2
ccgccgggcgucacccg

SEQ ID NO: 1754451 - RNA, 23 nt, Salmonella enterica enterica serovar Typhi Ty2
ccgccggggcucccacucuucca

SEQ ID NO: 1754452 - RNA, 12 nt, Salmonella enterica enterica serovar Typhi Ty2
ccgccguccugg

SEQ ID NO: 1754453 - RNA, 19 nt, Salmonella enterica enterica serovar Typhi Ty2
ccgccgucgucaccgccgc

SEQ ID NO: 1754454 - RNA, 19 nt, Salmonella enterica enterica serovar Typhi Ty2
ccgccgguuuauccccgcu

SEQ ID NO: 1754455 - RNA, 12 nt, Salmonella enterica enterica serovar Typhi Ty2
ccgccucaaacg

SEQ ID NO: 1754456 - RNA, 20 nt, Salmonella enterica enterica serovar Typhi Ty2
ccgccucaauugccgccagc

SEQ ID NO: 1754457 - RNA, 12 nt, Salmonella enterica enterica serovar Typhi Ty2
ccgccuccagca

SEQ ID NO: 1754458 - RNA, 16 nt, Salmonella enterica enterica serovar Typhi Ty2
ccgccuaacagcgccg

SEQ ID NO: 1754459 - RNA, 21 nt, Salmonella enterica enterica serovar Typhi Ty2
ccgccuaacagcgccgcgccg

SEQ ID NO: 1754460 - RNA, 15 nt, Salmonella enterica enterica serovar Typhi Ty2
ccgccgugcucacua

SEQ ID NO: 1754461 - RNA, 20 nt, Salmonella enterica enterica serovar Typhi Ty2
ccgccucgcgauccgccagc

SEQ ID NO: 1754462 - RNA, 13 nt, Salmonella enterica enterica serovar Typhi Ty2
ccgccuccuccgg

SEQ ID NO: 1754463 - RNA, 14 nt, Salmonella enterica enterica serovar Typhi Ty2
ccgccuccaggccg

SEQ ID NO: 1754464 - RNA, 18 nt, Salmonella enterica enterica serovar Typhi Ty2
ccgccuuuaagcaccgcu

SEQ ID NO: 1754465 - RNA, 18 nt, Salmonella enterica enterica serovar Typhi Ty2
ccgcgaggaucugcuuau

SEQ ID NO: 1754466 - RNA, 15 nt, Salmonella enterica enterica serovar Typhi Ty2
ccgccugccgcgccc

SEQ ID NO: 1754467 - RNA, 19 nt, Salmonella enterica enterica serovar Typhi Ty2
ccgccugauuuaaugaacc

SEQ ID NO: 1754468 - RNA, 22 nt, Salmonella enterica enterica serovar Typhi Ty2
ccgccugccagauccaacacau

SEQ ID NO: 1754469 - RNA, 18 nt, Salmonella enterica enterica serovar Typhi Ty2
ccgccuugcggcgccagg

SEQ ID NO: 1754470 - RNA, 15 nt, Salmonella enterica enterica serovar Typhi Ty2
ccgccuugcggcggc

SEQ ID NO: 1754471 - RNA, 16 nt, Salmonella enterica enterica serovar Typhi Ty2
ccgccuuguccggccu

SEQ ID NO: 1754472 - RNA, 12 nt, Salmonella enterica enterica serovar Typhi Ty2
ccgcgccgccgc

SEQ ID NO: 1754473 - RNA, 16 nt, Salmonella enterica enterica serovar Typhi Ty2
ccgcgcagaaucacuu

SEQ ID NO: 1754474 - RNA, 16 nt, Salmonella enterica enterica serovar Typhi Ty2
ccgccgacaccggccu

SEQ ID NO: 1754475 - RNA, 14 nt, Salmonella enterica enterica serovar Typhi Ty2
ccgccgacaaccag

SEQ ID NO: 1754476 - RNA, 13 nt, Salmonella enterica enterica serovar Typhi Ty2
ccgcccguccgcu

SEQ ID NO: 1754477 - RNA, 23 nt, Salmonella enterica enterica serovar Typhi Ty2
ccgcccguacagacaucaucgaa

SEQ ID NO: 1754478 - RNA, 13 nt, Salmonella enterica enterica serovar Typhi Ty2
ccgccccugugga

SEQ ID NO: 1754479 - RNA, 22 nt, Salmonella enterica enterica serovar Typhi Ty2
ccgccccuguggaaucagucgg

SEQ ID NO: 1754480 - RNA, 20 nt, Salmonella enterica enterica serovar Typhi Ty2
ccgccaucucauucgccagc

SEQ ID NO: 1754481 - RNA, 14 nt, Salmonella enterica enterica serovar Typhi Ty2
ccgccaucgccucg

SEQ ID NO: 1754482 - RNA, 17 nt, Salmonella enterica enterica serovar Typhi Ty2
ccgccaucuccggcagc

SEQ ID NO: 1754483 - RNA, 22 nt, Salmonella enterica enterica serovar Typhi Ty2
ccgccauugccaguaccgacgc

SEQ ID NO: 1754484 - RNA, 20 nt, Salmonella enterica enterica serovar Typhi Ty2
ccgccauucgcuuccgccgg

SEQ ID NO: 1754485 - RNA, 15 nt, Salmonella enterica enterica serovar Typhi Ty2
ccgccauuauucuga

SEQ ID NO: 1754486 - RNA, 22 nt, Salmonella enterica enterica serovar Typhi Ty2
ccgccaucuuuacccugagccu

SEQ ID NO: 1754487 - RNA, 13 nt, Salmonella enterica enterica serovar Typhi Ty2
ccgcccauccaga

SEQ ID NO: 1754488 - RNA, 14 nt, Salmonella enterica enterica serovar Typhi Ty2
ccgcccccuccagu

SEQ ID NO: 1754489 - RNA, 16 nt, Salmonella enterica enterica serovar Typhi Ty2
ccgccgcgcggcccca

SEQ ID NO: 1754490 - RNA, 15 nt, Salmonella enterica enterica serovar Typhi Ty2
ccgccgcgcgucagc

SEQ ID NO: 1754491 - RNA, 20 nt, Salmonella enterica enterica serovar Typhi Ty2
ccgccgcguccuaccgccgc

SEQ ID NO: 1754492 - RNA, 14 nt, Salmonella enterica enterica serovar Typhi Ty2
ccgccgcggccagc

SEQ ID NO: 1754493 - RNA, 18 nt, Salmonella enterica enterica serovar Typhi Ty2
ccgccgcaauuccugacu

SEQ ID NO: 1754494 - RNA, 22 nt, Salmonella enterica enterica serovar Typhi Ty2
ccgccgcaauuccugacugcgc

SEQ ID NO: 1754495 - RNA, 14 nt, Salmonella enterica enterica serovar Typhi Ty2
ccgccgcacaggcg

SEQ ID NO: 1754496 - RNA, 17 nt, Salmonella enterica enterica serovar Typhi Ty2
ccgccgccaaacugcgc

SEQ ID NO: 1754497 - RNA, 23 nt, Salmonella enterica enterica serovar Typhi Ty2
ccgccggagaggggacucaccgu

SEQ ID NO: 1754498 - RNA, 23 nt, Salmonella enterica enterica serovar Typhi Ty2
ccgccgcuuuuuucagcggcagc

SEQ ID NO: 1754499 - RNA, 15 nt, Salmonella enterica enterica serovar Typhi Ty2
ccgccgcuggcuggc

SEQ ID NO: 1754500 - RNA, 23 nt, Salmonella enterica enterica serovar Typhi Ty2
ccugcgugccguugaccagcuga

SEQ ID NO: 1754501 - RNA, 18 nt, Salmonella enterica enterica serovar Typhi Ty2
ccugcguuaaacgcugug

SEQ ID NO: 1754502 - RNA, 21 nt, Salmonella enterica enterica serovar Typhi Ty2
ccugcugacuacgguugccuu

SEQ ID NO: 1754503 - RNA, 17 nt, Salmonella enterica enterica serovar Typhi Ty2
ccugcucuggacguuga

SEQ ID NO: 1754504 - RNA, 20 nt, Salmonella enterica enterica serovar Typhi Ty2
ccugcugccagccgccgccg

SEQ ID NO: 1754505 - RNA, 21 nt, Salmonella enterica enterica serovar Typhi Ty2
ccugcugccagccgccgccgg

SEQ ID NO: 1754506 - RNA, 15 nt, Salmonella enterica enterica serovar Typhi Ty2
ccuggaggaacagcg

SEQ ID NO: 1754507 - RNA, 17 nt, Salmonella enterica enterica serovar Typhi Ty2
ccuggagcguaagcgcg

SEQ ID NO: 1754508 - RNA, 14 nt, Salmonella enterica enterica serovar Typhi Ty2
ccuggaugcuuaaa

SEQ ID NO: 1754509 - RNA, 21 nt, Salmonella enterica enterica serovar Typhi Ty2
ccuggcguaguacgcgcgccg

SEQ ID NO: 1754510 - RNA, 19 nt, Salmonella enterica enterica serovar Typhi Ty2
ccugggcgaaaacgcccgc

SEQ ID NO: 1754511 - RNA, 13 nt, Salmonella enterica enterica serovar Typhi Ty2
ccugggccgggua

SEQ ID NO: 1754512 - RNA, 20 nt, Salmonella enterica enterica serovar Typhi Ty2
ccuggcguaugcuuucagca

SEQ ID NO: 1754513 - RNA, 16 nt, Salmonella enterica enterica serovar Typhi Ty2
ccuggcguaugcuuuc

SEQ ID NO: 1754514 - RNA, 14 nt, Salmonella enterica enterica serovar Typhi Ty2
ccuggcgggcagcc

SEQ ID NO: 1754515 - RNA, 19 nt, Salmonella enterica enterica serovar Typhi Ty2
ccuggcgguaagccaccag

SEQ ID NO: 1754516 - RNA, 13 nt, Salmonella enterica enterica serovar Typhi Ty2
ccuggcagaaagg

SEQ ID NO: 1754517 - RNA, 20 nt, Salmonella enterica enterica serovar Typhi Ty2
ccuggcagaaaggugaaaaa

SEQ ID NO: 1754518 - RNA, 16 nt, Salmonella enterica enterica serovar Typhi Ty2
ccuggcagguauuaau

SEQ ID NO: 1754519 - RNA, 21 nt, Salmonella enterica enterica serovar Typhi Ty2
ccuggcagguauuaauccugc

SEQ ID NO: 1754520 - RNA, 13 nt, Salmonella enterica enterica serovar Typhi Ty2
ccuggcauggcuc

SEQ ID NO: 1754521 - RNA, 18 nt, Salmonella enterica enterica serovar Typhi Ty2
ccugggucguugacguga

SEQ ID NO: 1754522 - RNA, 22 nt, Salmonella enterica enterica serovar Typhi Ty2
ccugggucguugacgugagaga

SEQ ID NO: 1754523 - RNA, 16 nt, Salmonella enterica enterica serovar Typhi Ty2
ccuggguuccaggcgg

SEQ ID NO: 1754524 - RNA, 20 nt, Salmonella enterica enterica serovar Typhi Ty2
ccugguaaggcaaauaugcu

SEQ ID NO: 1754525 - RNA, 19 nt, Salmonella enterica enterica serovar Typhi Ty2
ccuguaaacgcuucugcgc

SEQ ID NO: 1754526 - RNA, 19 nt, Salmonella enterica enterica serovar Typhi Ty2
ccuguaaugucuggugcag

SEQ ID NO: 1754527 - RNA, 17 nt, Salmonella enterica enterica serovar Typhi Ty2
ccuguacuugcgccgcc

SEQ ID NO: 1754528 - RNA, 14 nt, Salmonella enterica enterica serovar Typhi Ty2
ccuguaacacacug

SEQ ID NO: 1754529 - RNA, 18 nt, Salmonella enterica enterica serovar Typhi Ty2
ccuguaaacguuccugcc

SEQ ID NO: 1754530 - RNA, 16 nt, Salmonella enterica enterica serovar Typhi Ty2
ccuguaaccuuaaaag

SEQ ID NO: 1754531 - RNA, 18 nt, Salmonella enterica enterica serovar Typhi Ty2
ccuguaaccuuaaaaggc

SEQ ID NO: 1754532 - RNA, 15 nt, Salmonella enterica enterica serovar Typhi Ty2
ccuguaaccccagca

SEQ ID NO: 1754533 - RNA, 18 nt, Salmonella enterica enterica serovar Typhi Ty2
ccugucccuucgcccggc

SEQ ID NO: 1754534 - RNA, 16 nt, Salmonella enterica enterica serovar Typhi Ty2
ccugucguccucaggc

SEQ ID NO: 1754535 - RNA, 16 nt, Salmonella enterica enterica serovar Typhi Ty2
ccugucguacgccuaa

SEQ ID NO: 1754536 - RNA, 16 nt, Salmonella enterica enterica serovar Typhi Ty2
ccugucggucuuuuuc

SEQ ID NO: 1754537 - RNA, 23 nt, Salmonella enterica enterica serovar Typhi Ty2
ccugucgcgccauguugcguaaa

SEQ ID NO: 1754538 - RNA, 11 nt, Salmonella enterica enterica serovar Typhi Ty2
ccugugcuuug

SEQ ID NO: 1754539 - RNA, 14 nt, Salmonella enterica enterica serovar Typhi Ty2
ccuguauuaccuga

SEQ ID NO: 1754540 - RNA, 21 nt, Salmonella enterica enterica serovar Typhi Ty2
ccuguauuuucguuugcauuc

SEQ ID NO: 1754541 - RNA, 15 nt, Salmonella enterica enterica serovar Typhi Ty2
ccugucaggcgagcg

SEQ ID NO: 1754542 - RNA, 15 nt, Salmonella enterica enterica serovar Typhi Ty2
ccuguccauugcgag

SEQ ID NO: 1754543 - RNA, 23 nt, Salmonella enterica enterica serovar Typhi Ty2
ccugcacguuacccgccagucgg

SEQ ID NO: 1754544 - RNA, 12 nt, Salmonella enterica enterica serovar Typhi Ty2
ccugcacccgcc

SEQ ID NO: 1754545 - RNA, 15 nt, Salmonella enterica enterica serovar Typhi Ty2
ccugaaucgccgcac

SEQ ID NO: 1754546 - RNA, 19 nt, Salmonella enterica enterica serovar Typhi Ty2
ccugaaucgccgcacguaa

SEQ ID NO: 1754547 - RNA, 19 nt, Salmonella enterica enterica serovar Typhi Ty2
ccugaauaacccgcagccc

SEQ ID NO: 1754548 - RNA, 23 nt, Salmonella enterica enterica serovar Typhi Ty2
ccugcaauuccggcgaaaaaccg

SEQ ID NO: 1754549 - RNA, 22 nt, Salmonella enterica enterica serovar Typhi Ty2
ccugcaacuccugggcaaaaua

SEQ ID NO: 1754550 - RNA, 15 nt, Salmonella enterica enterica serovar Typhi Ty2
ccugccgcauguccc

SEQ ID NO: 1754551 - RNA, 15 nt, Salmonella enterica enterica serovar Typhi Ty2
ccugcccuuucuuca

SEQ ID NO: 1754552 - RNA, 23 nt, Salmonella enterica enterica serovar Typhi Ty2
ccugcauacucacauucauaaaa

SEQ ID NO: 1754553 - RNA, 14 nt, Salmonella enterica enterica serovar Typhi Ty2
ccugcaucaacagg

SEQ ID NO: 1754554 - RNA, 19 nt, Salmonella enterica enterica serovar Typhi Ty2
ccugcaucgauuccccacc

SEQ ID NO: 1754555 - RNA, 18 nt, Salmonella enterica enterica serovar Typhi Ty2
ccugcauguacauaaaau

SEQ ID NO: 1754556 - RNA, 16 nt, Salmonella enterica enterica serovar Typhi Ty2
ccugcggcguggaaaa

SEQ ID NO: 1754557 - RNA, 23 nt, Salmonella enterica enterica serovar Typhi Ty2
ccugcggccaugaucgccgccau

SEQ ID NO: 1754558 - RNA, 20 nt, Salmonella enterica enterica serovar Typhi Ty2
ccugcggccaugaucgccgc

SEQ ID NO: 1754559 - RNA, 15 nt, Salmonella enterica enterica serovar Typhi Ty2
ccugcggccucgccu

SEQ ID NO: 1754560 - RNA, 19 nt, Salmonella enterica enterica serovar Typhi Ty2
ccugcggccuugccgccag

SEQ ID NO: 1754561 - RNA, 14 nt, Salmonella enterica enterica serovar Typhi Ty2
ccugcggcugauug

SEQ ID NO: 1754562 - RNA, 17 nt, Salmonella enterica enterica serovar Typhi Ty2
ccugcgguaaucgccgc

SEQ ID NO: 1754563 - RNA, 19 nt, Salmonella enterica enterica serovar Typhi Ty2
ccugcgcucauauacccug

SEQ ID NO: 1754564 - RNA, 14 nt, Salmonella enterica enterica serovar Typhi Ty2
ccugcgcguaaauu

SEQ ID NO: 1754565 - RNA, 19 nt, Salmonella enterica enterica serovar Typhi Ty2
ccugcggacgcagcucaua

SEQ ID NO: 1754566 - RNA, 20 nt, Salmonella enterica enterica serovar Typhi Ty2
ccugcgagcuguagcgaagg

SEQ ID NO: 1754567 - RNA, 22 nt, Salmonella enterica enterica serovar Typhi Ty2
ccugcgauaccggacacccggc

SEQ ID NO: 1754568 - RNA, 23 nt, Salmonella enterica enterica serovar Typhi Ty2
ccugccugaagcgcaguguuaau

SEQ ID NO: 1754569 - RNA, 21 nt, Salmonella enterica enterica serovar Typhi Ty2
ccugccugacaaugacgcuuc

SEQ ID NO: 1754570 - RNA, 18 nt, Salmonella enterica enterica serovar Typhi Ty2
ccugccuuucccauccgc

SEQ ID NO: 1754571 - RNA, 10 nt, Salmonella enterica enterica serovar Typhi Ty2
ccugccuguu

SEQ ID NO: 1754572 - RNA, 21 nt, Salmonella enterica enterica serovar Typhi Ty2
ccugccuuaauccccggcccg

SEQ ID NO: 1754573 - RNA, 17 nt, Salmonella enterica enterica serovar Typhi Ty2
ccugccggaaaaugcgc

SEQ ID NO: 1754574 - RNA, 23 nt, Salmonella enterica enterica serovar Typhi Ty2
ccugccgucaaacuuaaugccug

SEQ ID NO: 1754575 - RNA, 17 nt, Salmonella enterica enterica serovar Typhi Ty2
ccugccguuuauuauuu

SEQ ID NO: 1754576 - RNA, 15 nt, Salmonella enterica enterica serovar Typhi Ty2
ccugccguuuuuaac

SEQ ID NO: 1754577 - RNA, 20 nt, Salmonella enterica enterica serovar Typhi Ty2
ccugccgucgcggcuuucag

SEQ ID NO: 1754578 - RNA, 18 nt, Salmonella enterica enterica serovar Typhi Ty2
ccugccuaagccggacgc

SEQ ID NO: 1754579 - RNA, 16 nt, Salmonella enterica enterica serovar Typhi Ty2
ccugaaggacaagcug

SEQ ID NO: 1754580 - RNA, 15 nt, Salmonella enterica enterica serovar Typhi Ty2
ccugaaggacaagcu

SEQ ID NO: 1754581 - RNA, 15 nt, Salmonella enterica enterica serovar Typhi Ty2
ccugaagccauccuc

SEQ ID NO: 1754582 - RNA, 20 nt, Salmonella enterica enterica serovar Typhi Ty2
ccugaagaccuuaucccgcu

SEQ ID NO: 1754583 - RNA, 17 nt, Salmonella enterica enterica serovar Typhi Ty2
ccugaacgccuaccgcu

SEQ ID NO: 1754584 - RNA, 19 nt, Salmonella enterica enterica serovar Typhi Ty2
ccugaaauaacagacuccg

SEQ ID NO: 1754585 - RNA, 11 nt, Salmonella enterica enterica serovar Typhi Ty2
ccugaacaggg

SEQ ID NO: 1754586 - RNA, 17 nt, Salmonella enterica enterica serovar Typhi Ty2
ccucuuucaugcggucu

SEQ ID NO: 1754587 - RNA, 13 nt, Salmonella enterica enterica serovar Typhi Ty2
ccugaaacgcggc

SEQ ID NO: 1754588 - RNA, 16 nt, Salmonella enterica enterica serovar Typhi Ty2
ccugaaaaaauucccg

SEQ ID NO: 1754589 - RNA, 19 nt, Salmonella enterica enterica serovar Typhi Ty2
ccucugauuggcuguuagu

SEQ ID NO: 1754590 - RNA, 21 nt, Salmonella enterica enterica serovar Typhi Ty2
ccucuccugaauugcaaggcg

SEQ ID NO: 1754591 - RNA, 22 nt, Salmonella enterica enterica serovar Typhi Ty2
ccucucccgaacugucugaauc

SEQ ID NO: 1754592 - RNA, 13 nt, Salmonella enterica enterica serovar Typhi Ty2
ccucgucuugauu

SEQ ID NO: 1754593 - RNA, 22 nt, Salmonella enterica enterica serovar Typhi Ty2
ccucgcuacuggcaaaugaagc

SEQ ID NO: 1754594 - RNA, 21 nt, Salmonella enterica enterica serovar Typhi Ty2
ccucgguggccuuguagcgcu

SEQ ID NO: 1754595 - RNA, 20 nt, Salmonella enterica enterica serovar Typhi Ty2
ccucgguauguccugccgca

SEQ ID NO: 1754596 - RNA, 13 nt, Salmonella enterica enterica serovar Typhi Ty2
ccucgaccccuuc

SEQ ID NO: 1754597 - RNA, 14 nt, Salmonella enterica enterica serovar Typhi Ty2
ccucgaaguauuac

SEQ ID NO: 1754598 - RNA, 20 nt, Salmonella enterica enterica serovar Typhi Ty2
ccuccuuguaagggaggugc

SEQ ID NO: 1754599 - RNA, 14 nt, Salmonella enterica enterica serovar Typhi Ty2
ccuccuuuccugug

SEQ ID NO: 1754600 - RNA, 16 nt, Salmonella enterica enterica serovar Typhi Ty2
ccucgcgauccgccag

SEQ ID NO: 1754601 - RNA, 19 nt, Salmonella enterica enterica serovar Typhi Ty2
ccucauauuuguaucuggu

SEQ ID NO: 1754602 - RNA, 22 nt, Salmonella enterica enterica serovar Typhi Ty2
ccucauccccagcaucaugucc

SEQ ID NO: 1754603 - RNA, 13 nt, Salmonella enterica enterica serovar Typhi Ty2
ccucauccccagc

SEQ ID NO: 1754604 - RNA, 12 nt, Salmonella enterica enterica serovar Typhi Ty2
ccucaucaugaa

SEQ ID NO: 1754605 - RNA, 16 nt, Salmonella enterica enterica serovar Typhi Ty2
ccucaucugcuucaac

SEQ ID NO: 1754606 - RNA, 14 nt, Salmonella enterica enterica serovar Typhi Ty2
ccucauucagcggc

SEQ ID NO: 1754607 - RNA, 18 nt, Salmonella enterica enterica serovar Typhi Ty2
ccucaucccguagcguca

SEQ ID NO: 1754608 - RNA, 15 nt, Salmonella enterica enterica serovar Typhi Ty2
ccucaucggcaaaca

SEQ ID NO: 1754609 - RNA, 16 nt, Salmonella enterica enterica serovar Typhi Ty2
ccuaccgaggcagggg

SEQ ID NO: 1754610 - RNA, 13 nt, Salmonella enterica enterica serovar Typhi Ty2
ccuaccgaggcag

SEQ ID NO: 1754611 - RNA, 11 nt, Salmonella enterica enterica serovar Typhi Ty2
ccuaccgccau

SEQ ID NO: 1754612 - RNA, 19 nt, Salmonella enterica enterica serovar Typhi Ty2
ccuacgauuucgcucgcuu

SEQ ID NO: 1754613 - RNA, 13 nt, Salmonella enterica enterica serovar Typhi Ty2
ccuacgcuauccg

SEQ ID NO: 1754614 - RNA, 21 nt, Salmonella enterica enterica serovar Typhi Ty2
ccuacggaaagcuguuguugc

SEQ ID NO: 1754615 - RNA, 18 nt, Salmonella enterica enterica serovar Typhi Ty2
ccuaccggcggcacccgu

SEQ ID NO: 1754616 - RNA, 17 nt, Salmonella enterica enterica serovar Typhi Ty2
ccuccagcgccuguuga

SEQ ID NO: 1754617 - RNA, 14 nt, Salmonella enterica enterica serovar Typhi Ty2
ccuccagcgacccu

SEQ ID NO: 1754618 - RNA, 14 nt, Salmonella enterica enterica serovar Typhi Ty2
ccuccauacacugc

SEQ ID NO: 1754619 - RNA, 16 nt, Salmonella enterica enterica serovar Typhi Ty2
ccucauuuuguugcuc

SEQ ID NO: 1754620 - RNA, 20 nt, Salmonella enterica enterica serovar Typhi Ty2
ccucauuuuguugcuccagc

SEQ ID NO: 1754621 - RNA, 13 nt, Salmonella enterica enterica serovar Typhi Ty2
ccuccaauucagg

SEQ ID NO: 1754622 - RNA, 22 nt, Salmonella enterica enterica serovar Typhi Ty2
ccuccacgcccagcgccgagaa

SEQ ID NO: 1754623 - RNA, 18 nt, Salmonella enterica enterica serovar Typhi Ty2
ccuccggcugaagcccca

SEQ ID NO: 1754624 - RNA, 16 nt, Salmonella enterica enterica serovar Typhi Ty2
ccuccggccagcgcca

SEQ ID NO: 1754625 - RNA, 16 nt, Salmonella enterica enterica serovar Typhi Ty2
ccuccgucaccuccgc

SEQ ID NO: 1754626 - RNA, 18 nt, Salmonella enterica enterica serovar Typhi Ty2
ccuccucgacguuuucca

SEQ ID NO: 1754627 - RNA, 18 nt, Salmonella enterica enterica serovar Typhi Ty2
ccuccugaauagcuuuca

SEQ ID NO: 1754628 - RNA, 19 nt, Salmonella enterica enterica serovar Typhi Ty2
ccuccugccgaugccgccg

SEQ ID NO: 1754629 - RNA, 16 nt, Salmonella enterica enterica serovar Typhi Ty2
ccuccuuguaagggag

SEQ ID NO: 1754630 - RNA, 17 nt, Salmonella enterica enterica serovar Typhi Ty2
ccuccuucgcgccugug

SEQ ID NO: 1754631 - RNA, 12 nt, Salmonella enterica enterica serovar Typhi Ty2
ccuccugcucca

SEQ ID NO: 1754632 - RNA, 17 nt, Salmonella enterica enterica serovar Typhi Ty2
ccuccgcgcagcaacag

SEQ ID NO: 1754633 - RNA, 11 nt, Salmonella enterica enterica serovar Typhi Ty2
ccuccgcccgg

SEQ ID NO: 1754634 - RNA, 18 nt, Salmonella enterica enterica serovar Typhi Ty2
ccuccgccacuagcgcuu

SEQ ID NO: 1754635 - RNA, 17 nt, Salmonella enterica enterica serovar Typhi Ty2
ccuccggaugacgccgc

SEQ ID NO: 1754636 - RNA, 19 nt, Salmonella enterica enterica serovar Typhi Ty2
ccuccgcuuccugcgccag

SEQ ID NO: 1754637 - RNA, 12 nt, Salmonella enterica enterica serovar Typhi Ty2
ccucccugccua

SEQ ID NO: 1754638 - RNA, 17 nt, Salmonella enterica enterica serovar Typhi Ty2
ccuccauggcuugucgc

SEQ ID NO: 1754639 - RNA, 13 nt, Salmonella enterica enterica serovar Typhi Ty2
ccuccccaggcgc

SEQ ID NO: 1754640 - RNA, 18 nt, Salmonella enterica enterica serovar Typhi Ty2
ccguguucaugcagccau

SEQ ID NO: 1754641 - RNA, 15 nt, Salmonella enterica enterica serovar Typhi Ty2
ccguguggucgcggc

SEQ ID NO: 1754642 - RNA, 14 nt, Salmonella enterica enterica serovar Typhi Ty2
ccguguccaaacug

SEQ ID NO: 1754643 - RNA, 17 nt, Salmonella enterica enterica serovar Typhi Ty2
ccguggugggguucccg

SEQ ID NO: 1754644 - RNA, 16 nt, Salmonella enterica enterica serovar Typhi Ty2
ccguggguggcaaggc

SEQ ID NO: 1754645 - RNA, 18 nt, Salmonella enterica enterica serovar Typhi Ty2
ccgugaaugccaagcgca

SEQ ID NO: 1754646 - RNA, 23 nt, Salmonella enterica enterica serovar Typhi Ty2
ccgugaaugcccggcggcgcgau

SEQ ID NO: 1754647 - RNA, 14 nt, Salmonella enterica enterica serovar Typhi Ty2
ccgugaccugcuga

SEQ ID NO: 1754648 - RNA, 14 nt, Salmonella enterica enterica serovar Typhi Ty2
ccgucuuuuuccug

SEQ ID NO: 1754649 - RNA, 14 nt, Salmonella enterica enterica serovar Typhi Ty2
ccgugccugcuccg

SEQ ID NO: 1754650 - RNA, 17 nt, Salmonella enterica enterica serovar Typhi Ty2
ccgugccggauggcggc

SEQ ID NO: 1754651 - RNA, 14 nt, Salmonella enterica enterica serovar Typhi Ty2
ccguugcgucacga

SEQ ID NO: 1754652 - RNA, 21 nt, Salmonella enterica enterica serovar Typhi Ty2
ccguuuucgcccccagcacga

SEQ ID NO: 1754653 - RNA, 19 nt, Salmonella enterica enterica serovar Typhi Ty2
ccguuuucuccuucaucca

SEQ ID NO: 1754654 - RNA, 19 nt, Salmonella enterica enterica serovar Typhi Ty2
ccguuuguaacauauuuuu

SEQ ID NO: 1754655 - RNA, 18 nt, Salmonella enterica enterica serovar Typhi Ty2
ccguuuuaccuucugccg

SEQ ID NO: 1754656 - RNA, 18 nt, Salmonella enterica enterica serovar Typhi Ty2
ccuaacuggaaaaagacc

SEQ ID NO: 1754657 - RNA, 22 nt, Salmonella enterica enterica serovar Typhi Ty2
ccuacagguugucgcaacgugu

SEQ ID NO: 1754658 - RNA, 18 nt, Salmonella enterica enterica serovar Typhi Ty2
ccuacagguugucgcaac

SEQ ID NO: 1754659 - RNA, 16 nt, Salmonella enterica enterica serovar Typhi Ty2
ccguaguagguaucca

SEQ ID NO: 1754660 - RNA, 16 nt, Salmonella enterica enterica serovar Typhi Ty2
ccguagcucagcugga

SEQ ID NO: 1754661 - RNA, 16 nt, Salmonella enterica enterica serovar Typhi Ty2
ccguagcuccagaccu

SEQ ID NO: 1754662 - RNA, 18 nt, Salmonella enterica enterica serovar Typhi Ty2
ccgucagaauggcgcguu

SEQ ID NO: 1754663 - RNA, 21 nt, Salmonella enterica enterica serovar Typhi Ty2
ccgucacugaaccugccuuug

SEQ ID NO: 1754664 - RNA, 15 nt, Salmonella enterica enterica serovar Typhi Ty2
ccguacgauguucga

SEQ ID NO: 1754665 - RNA, 14 nt, Salmonella enterica enterica serovar Typhi Ty2
ccguaaauuccuug

SEQ ID NO: 1754666 - RNA, 13 nt, Salmonella enterica enterica serovar Typhi Ty2
ccguaaaguuccc

SEQ ID NO: 1754667 - RNA, 16 nt, Salmonella enterica enterica serovar Typhi Ty2
ccgguuuuugcgcgcu

SEQ ID NO: 1754668 - RNA, 20 nt, Salmonella enterica enterica serovar Typhi Ty2
ccggugcagaccucugcaaa

SEQ ID NO: 1754669 - RNA, 20 nt, Salmonella enterica enterica serovar Typhi Ty2
ccggugauggugcagccccg

SEQ ID NO: 1754670 - RNA, 19 nt, Salmonella enterica enterica serovar Typhi Ty2
ccgucgucaccgccgcgcu

SEQ ID NO: 1754671 - RNA, 15 nt, Salmonella enterica enterica serovar Typhi Ty2
ccgucucaaccagca

SEQ ID NO: 1754672 - RNA, 19 nt, Salmonella enterica enterica serovar Typhi Ty2
ccgucucaaccagcaauga

SEQ ID NO: 1754673 - RNA, 18 nt, Salmonella enterica enterica serovar Typhi Ty2
ccgucuggcgugccgggc

SEQ ID NO: 1754674 - RNA, 18 nt, Salmonella enterica enterica serovar Typhi Ty2
ccgucuuacgaucccacg

SEQ ID NO: 1754675 - RNA, 18 nt, Salmonella enterica enterica serovar Typhi Ty2
ccgucggcaauuaacauu

SEQ ID NO: 1754676 - RNA, 14 nt, Salmonella enterica enterica serovar Typhi Ty2
ccgucggcaauaaa

SEQ ID NO: 1754677 - RNA, 17 nt, Salmonella enterica enterica serovar Typhi Ty2
ccgucggcgccagccac

SEQ ID NO: 1754678 - RNA, 16 nt, Salmonella enterica enterica serovar Typhi Ty2
ccgucggcgccagcca

SEQ ID NO: 1754679 - RNA, 15 nt, Salmonella enterica enterica serovar Typhi Ty2
ccgucgaugauggcg

SEQ ID NO: 1754680 - RNA, 17 nt, Salmonella enterica enterica serovar Typhi Ty2
ccgucgaugauggcggc

SEQ ID NO: 1754681 - RNA, 23 nt, Salmonella enterica enterica serovar Typhi Ty2
ccgucagcgguuguucagugcca

SEQ ID NO: 1754682 - RNA, 21 nt, Salmonella enterica enterica serovar Typhi Ty2
ccgucgagaaaccgcucgccg

SEQ ID NO: 1754683 - RNA, 21 nt, Salmonella enterica enterica serovar Typhi Ty2
ccggucgcgccagcgaccacc

SEQ ID NO: 1754684 - RNA, 14 nt, Salmonella enterica enterica serovar Typhi Ty2
ccggucgcgccagc

SEQ ID NO: 1754685 - RNA, 15 nt, Salmonella enterica enterica serovar Typhi Ty2
ccgguauagcgccuu

SEQ ID NO: 1754686 - RNA, 15 nt, Salmonella enterica enterica serovar Typhi Ty2
ccgguaacguaaaua

SEQ ID NO: 1754687 - RNA, 14 nt, Salmonella enterica enterica serovar Typhi Ty2
ccgguauuuuuucu

SEQ ID NO: 1754688 - RNA, 18 nt, Salmonella enterica enterica serovar Typhi Ty2
ccggguaucugggcggca

SEQ ID NO: 1754689 - RNA, 14 nt, Salmonella enterica enterica serovar Typhi Ty2
ccggguaauaaguu

SEQ ID NO: 1754690 - RNA, 17 nt, Salmonella enterica enterica serovar Typhi Ty2
ccggguaaacgcagcgu

SEQ ID NO: 1754691 - RNA, 14 nt, Salmonella enterica enterica serovar Typhi Ty2
ccggguuaaagccc

SEQ ID NO: 1754692 - RNA, 19 nt, Salmonella enterica enterica serovar Typhi Ty2
ccggguucgcccggcauga

SEQ ID NO: 1754693 - RNA, 19 nt, Salmonella enterica enterica serovar Typhi Ty2
ccgguaaagcagugcagua

SEQ ID NO: 1754694 - RNA, 18 nt, Salmonella enterica enterica serovar Typhi Ty2
ccgguaaagcagugcagu

SEQ ID NO: 1754695 - RNA, 16 nt, Salmonella enterica enterica serovar Typhi Ty2
ccgguaacgccguagg

SEQ ID NO: 1754696 - RNA, 17 nt, Salmonella enterica enterica serovar Typhi Ty2
ccgggagaacgccgggc

SEQ ID NO: 1754697 - RNA, 19 nt, Salmonella enterica enterica serovar Typhi Ty2
ccgggagaaaacgcggccu

SEQ ID NO: 1754698 - RNA, 13 nt, Salmonella enterica enterica serovar Typhi Ty2
ccgggauauaaaa

SEQ ID NO: 1754699 - RNA, 12 nt, Salmonella enterica enterica serovar Typhi Ty2
ccgggccacucu

SEQ ID NO: 1754700 - RNA, 20 nt, Salmonella enterica enterica serovar Typhi Ty2
ccgggaaaucuucuacuuca

SEQ ID NO: 1754701 - RNA, 16 nt, Salmonella enterica enterica serovar Typhi Ty2
ccggcuuuuuucaccu

SEQ ID NO: 1754702 - RNA, 21 nt, Salmonella enterica enterica serovar Typhi Ty2
ccgggaaaacaucacccggcg

SEQ ID NO: 1754703 - RNA, 22 nt, Salmonella enterica enterica serovar Typhi Ty2
ccggcuuuaugauggugagagc

SEQ ID NO: 1754704 - RNA, 15 nt, Salmonella enterica enterica serovar Typhi Ty2
ccggcuuuauuacuu

SEQ ID NO: 1754705 - RNA, 14 nt, Salmonella enterica enterica serovar Typhi Ty2
ccgggcggcgcagc

SEQ ID NO: 1754706 - RNA, 16 nt, Salmonella enterica enterica serovar Typhi Ty2
ccgggcgucacccgcc

SEQ ID NO: 1754707 - RNA, 18 nt, Salmonella enterica enterica serovar Typhi Ty2
ccggggaucguucugcug

SEQ ID NO: 1754708 - RNA, 13 nt, Salmonella enterica enterica serovar Typhi Ty2
ccgggcuucagga

SEQ ID NO: 1754709 - RNA, 14 nt, Salmonella enterica enterica serovar Typhi Ty2
ccggggaagcgcgc

SEQ ID NO: 1754710 - RNA, 16 nt, Salmonella enterica enterica serovar Typhi Ty2
ccggggaagcgcgcgc

SEQ ID NO: 1754711 - RNA, 17 nt, Salmonella enterica enterica serovar Typhi Ty2
ccggggaagcgcgcgca

SEQ ID NO: 1754712 - RNA, 17 nt, Salmonella enterica enterica serovar Typhi Ty2
ccggcguaauugcgccu

SEQ ID NO: 1754713 - RNA, 23 nt, Salmonella enterica enterica serovar Typhi Ty2
ccggcggucgauuuugccuucaa

SEQ ID NO: 1754714 - RNA, 20 nt, Salmonella enterica enterica serovar Typhi Ty2
ccggcggucgauuuugccuu

SEQ ID NO: 1754715 - RNA, 20 nt, Salmonella enterica enterica serovar Typhi Ty2
ccggcggucaugcuggcgau

SEQ ID NO: 1754716 - RNA, 11 nt, Salmonella enterica enterica serovar Typhi Ty2
ccggcggccua

SEQ ID NO: 1754717 - RNA, 15 nt, Salmonella enterica enterica serovar Typhi Ty2
ccggcggcaaggucu

SEQ ID NO: 1754718 - RNA, 15 nt, Salmonella enterica enterica serovar Typhi Ty2
ccggcuggcuauagu

SEQ ID NO: 1754719 - RNA, 11 nt, Salmonella enterica enterica serovar Typhi Ty2
ccggcuucagc

SEQ ID NO: 1754720 - RNA, 19 nt, Salmonella enterica enterica serovar Typhi Ty2
ccggcuuaaugcccggccc

SEQ ID NO: 1754721 - RNA, 20 nt, Salmonella enterica enterica serovar Typhi Ty2
ccggcuuaaugcccggcccg

SEQ ID NO: 1754722 - RNA, 20 nt, Salmonella enterica enterica serovar Typhi Ty2
ccggcugguuaaucacuuuu

SEQ ID NO: 1754723 - RNA, 23 nt, Salmonella enterica enterica serovar Typhi Ty2
ccggcuguucgacgaauggcggc

SEQ ID NO: 1754724 - RNA, 16 nt, Salmonella enterica enterica serovar Typhi Ty2
ccggcuuccagcggcg

SEQ ID NO: 1754725 - RNA, 13 nt, Salmonella enterica enterica serovar Typhi Ty2
ccggcgugauaaa

SEQ ID NO: 1754726 - RNA, 17 nt, Salmonella enterica enterica serovar Typhi Ty2
ccggcgugacucagcgg

SEQ ID NO: 1754727 - RNA, 14 nt, Salmonella enterica enterica serovar Typhi Ty2
ccggcguugcgccg

SEQ ID NO: 1754728 - RNA, 18 nt, Salmonella enterica enterica serovar Typhi Ty2
ccggcguucucccgggcc

SEQ ID NO: 1754729 - RNA, 22 nt, Salmonella enterica enterica serovar Typhi Ty2
ccggcguuucguuuagcgccug

SEQ ID NO: 1754730 - RNA, 11 nt, Salmonella enterica enterica serovar Typhi Ty2
ccggcucgccc

SEQ ID NO: 1754731 - RNA, 20 nt, Salmonella enterica enterica serovar Typhi Ty2
cgagggauuuccuggcaguu

SEQ ID NO: 1754732 - RNA, 18 nt, Salmonella enterica enterica serovar Typhi Ty2
cgaggcuuauaacccugu

SEQ ID NO: 1754733 - RNA, 20 nt, Salmonella enterica enterica serovar Typhi Ty2
cgaggcauaccgcccagaac

SEQ ID NO: 1754734 - RNA, 22 nt, Salmonella enterica enterica serovar Typhi Ty2
cgaggaguaguuaaaaaagguc

SEQ ID NO: 1754735 - RNA, 18 nt, Salmonella enterica enterica serovar Typhi Ty2
cgaggauaaaaucgccaa

SEQ ID NO: 1754736 - RNA, 21 nt, Salmonella enterica enterica serovar Typhi Ty2
cgaggaacaucagccagcagc

SEQ ID NO: 1754737 - RNA, 20 nt, Salmonella enterica enterica serovar Typhi Ty2
cgaggaacuguucagccagc

SEQ ID NO: 1754738 - RNA, 15 nt, Salmonella enterica enterica serovar Typhi Ty2
cgaggaacgcgcaga

SEQ ID NO: 1754739 - RNA, 19 nt, Salmonella enterica enterica serovar Typhi Ty2
cgaggaacgcgcagaccgu

SEQ ID NO: 1754740 - RNA, 14 nt, Salmonella enterica enterica serovar Typhi Ty2
cgagcuuuuuucuu

SEQ ID NO: 1754741 - RNA, 16 nt, Salmonella enterica enterica serovar Typhi Ty2
cgaggaaaaaugagac

SEQ ID NO: 1754742 - RNA, 18 nt, Salmonella enterica enterica serovar Typhi Ty2
cgaggaacaucagccagc

SEQ ID NO: 1754743 - RNA, 18 nt, Salmonella enterica enterica serovar Typhi Ty2
cgagcgcgucagcgccuc

SEQ ID NO: 1754744 - RNA, 19 nt, Salmonella enterica enterica serovar Typhi Ty2
cgagcggccaaagggagca

SEQ ID NO: 1754745 - RNA, 20 nt, Salmonella enterica enterica serovar Typhi Ty2
cgagcguucugcacgccggu

SEQ ID NO: 1754746 - RNA, 21 nt, Salmonella enterica enterica serovar Typhi Ty2
cgagcucaguccagccgccgc

SEQ ID NO: 1754747 - RNA, 19 nt, Salmonella enterica enterica serovar Typhi Ty2
cgagcgaucauaagggagc

SEQ ID NO: 1754748 - RNA, 23 nt, Salmonella enterica enterica serovar Typhi Ty2
cgagcgauagagaguuccuccug

SEQ ID NO: 1754749 - RNA, 13 nt, Salmonella enterica enterica serovar Typhi Ty2
cgagcgauagaga

SEQ ID NO: 1754750 - RNA, 21 nt, Salmonella enterica enterica serovar Typhi Ty2
cgagcgauagagaguuccucc

SEQ ID NO: 1754751 - RNA, 13 nt, Salmonella enterica enterica serovar Typhi Ty2
cgagcgccugaug

SEQ ID NO: 1754752 - RNA, 20 nt, Salmonella enterica enterica serovar Typhi Ty2
cgagcgaaggggcgggcagc

SEQ ID NO: 1754753 - RNA, 22 nt, Salmonella enterica enterica serovar Typhi Ty2
cgagcgaaggggcgggcagcag

SEQ ID NO: 1754754 - RNA, 20 nt, Salmonella enterica enterica serovar Typhi Ty2
cgauaaggucgcuauccagc

SEQ ID NO: 1754755 - RNA, 19 nt, Salmonella enterica enterica serovar Typhi Ty2
cgauaacguuaccgcagcg

SEQ ID NO: 1754756 - RNA, 21 nt, Salmonella enterica enterica serovar Typhi Ty2
cgauaauauccgacgccuguu

SEQ ID NO: 1754757 - RNA, 18 nt, Salmonella enterica enterica serovar Typhi Ty2
cgauaaugcgguucauuu

SEQ ID NO: 1754758 - RNA, 14 nt, Salmonella enterica enterica serovar Typhi Ty2
cgaguuaauagaau

SEQ ID NO: 1754759 - RNA, 23 nt, Salmonella enterica enterica serovar Typhi Ty2
cgaguuuuaacacuauauguccu

SEQ ID NO: 1754760 - RNA, 18 nt, Salmonella enterica enterica serovar Typhi Ty2
cgauaguccauuuuccua

SEQ ID NO: 1754761 - RNA, 17 nt, Salmonella enterica enterica serovar Typhi Ty2
cgauaggugacuuuccu

SEQ ID NO: 1754762 - RNA, 23 nt, Salmonella enterica enterica serovar Typhi Ty2
cgauaucgucauuaacgggaaac

SEQ ID NO: 1754763 - RNA, 16 nt, Salmonella enterica enterica serovar Typhi Ty2
cgauagcugcugacgu

SEQ ID NO: 1754764 - RNA, 19 nt, Salmonella enterica enterica serovar Typhi Ty2
cgauagcuaucacacauau

SEQ ID NO: 1754765 - RNA, 18 nt, Salmonella enterica enterica serovar Typhi Ty2
cgauauuacuccagcgua

SEQ ID NO: 1754766 - RNA, 23 nt, Salmonella enterica enterica serovar Typhi Ty2
cgauaugaauaauuucggcggcg

SEQ ID NO: 1754767 - RNA, 20 nt, Salmonella enterica enterica serovar Typhi Ty2
cgauagagaguuccuccugg

SEQ ID NO: 1754768 - RNA, 13 nt, Salmonella enterica enterica serovar Typhi Ty2
cgauaccggcaac

SEQ ID NO: 1754769 - RNA, 19 nt, Salmonella enterica enterica serovar Typhi Ty2
cgauacccgcccagaucag

SEQ ID NO: 1754770 - RNA, 15 nt, Salmonella enterica enterica serovar Typhi Ty2
cgauacccaccagcg

SEQ ID NO: 1754771 - RNA, 18 nt, Salmonella enterica enterica serovar Typhi Ty2
cgauacacgccgacgcau

SEQ ID NO: 1754772 - RNA, 21 nt, Salmonella enterica enterica serovar Typhi Ty2
cgauacaggacugacugcugu

SEQ ID NO: 1754773 - RNA, 13 nt, Salmonella enterica enterica serovar Typhi Ty2
cgauacaccuuca

SEQ ID NO: 1754774 - RNA, 15 nt, Salmonella enterica enterica serovar Typhi Ty2
cgauacaccuucaca

SEQ ID NO: 1754775 - RNA, 19 nt, Salmonella enterica enterica serovar Typhi Ty2
cgaggugauaaucagcgcu

SEQ ID NO: 1754776 - RNA, 22 nt, Salmonella enterica enterica serovar Typhi Ty2
cgagguucaccagcgcgccgcc

SEQ ID NO: 1754777 - RNA, 22 nt, Salmonella enterica enterica serovar Typhi Ty2
cgaggucaucuuucagaugcag

SEQ ID NO: 1754778 - RNA, 14 nt, Salmonella enterica enterica serovar Typhi Ty2
cgaggggcaggaag

SEQ ID NO: 1754779 - RNA, 14 nt, Salmonella enterica enterica serovar Typhi Ty2
cgaggggccaaaac

SEQ ID NO: 1754780 - RNA, 20 nt, Salmonella enterica enterica serovar Typhi Ty2
cgaguaauccauagccaaca

SEQ ID NO: 1754781 - RNA, 23 nt, Salmonella enterica enterica serovar Typhi Ty2
cgaguaacaccgcggcgcucgcc

SEQ ID NO: 1754782 - RNA, 14 nt, Salmonella enterica enterica serovar Typhi Ty2
cgagucacccugca

SEQ ID NO: 1754783 - RNA, 16 nt, Salmonella enterica enterica serovar Typhi Ty2
cgagucuuaccagguc

SEQ ID NO: 1754784 - RNA, 22 nt, Salmonella enterica enterica serovar Typhi Ty2
cgagugaggaccguacucagau

SEQ ID NO: 1754785 - RNA, 19 nt, Salmonella enterica enterica serovar Typhi Ty2
cgaguggaaucagccagga

SEQ ID NO: 1754786 - RNA, 19 nt, Salmonella enterica enterica serovar Typhi Ty2
cgagugcguucuuccacuu

SEQ ID NO: 1754787 - RNA, 13 nt, Salmonella enterica enterica serovar Typhi Ty2
cgacgucuuucuu

SEQ ID NO: 1754788 - RNA, 20 nt, Salmonella enterica enterica serovar Typhi Ty2
cgacguuguucgcuucuucu

SEQ ID NO: 1754789 - RNA, 21 nt, Salmonella enterica enterica serovar Typhi Ty2
cgacguuugcguaaagcuguu

SEQ ID NO: 1754790 - RNA, 19 nt, Salmonella enterica enterica serovar Typhi Ty2
cgacucccaggcgcgcagc

SEQ ID NO: 1754791 - RNA, 15 nt, Salmonella enterica enterica serovar Typhi Ty2
cgacuccggauagag

SEQ ID NO: 1754792 - RNA, 12 nt, Salmonella enterica enterica serovar Typhi Ty2
cgacucccaggc

SEQ ID NO: 1754793 - RNA, 13 nt, Salmonella enterica enterica serovar Typhi Ty2
cgacucucccggc

SEQ ID NO: 1754794 - RNA, 16 nt, Salmonella enterica enterica serovar Typhi Ty2
cgacucacgcagcgcu

SEQ ID NO: 1754795 - RNA, 16 nt, Salmonella enterica enterica serovar Typhi Ty2
cgacuuauuugcucag

SEQ ID NO: 1754796 - RNA, 14 nt, Salmonella enterica enterica serovar Typhi Ty2
cgacuucaagguuc

SEQ ID NO: 1754797 - RNA, 16 nt, Salmonella enterica enterica serovar Typhi Ty2
cgacuucauucaggca

SEQ ID NO: 1754798 - RNA, 22 nt, Salmonella enterica enterica serovar Typhi Ty2
cgacugcggucguauuuaccgc

SEQ ID NO: 1754799 - RNA, 21 nt, Salmonella enterica enterica serovar Typhi Ty2
cgacugccaccgucgcggcau

SEQ ID NO: 1754800 - RNA, 12 nt, Salmonella enterica enterica serovar Typhi Ty2
cgacugaacaua

SEQ ID NO: 1754801 - RNA, 16 nt, Salmonella enterica enterica serovar Typhi Ty2
cgacugaccagacaga

SEQ ID NO: 1754802 - RNA, 15 nt, Salmonella enterica enterica serovar Typhi Ty2
cgacucuuuuuucag

SEQ ID NO: 1754803 - RNA, 21 nt, Salmonella enterica enterica serovar Typhi Ty2
cgacugguaaugucauccagc

SEQ ID NO: 1754804 - RNA, 20 nt, Salmonella enterica enterica serovar Typhi Ty2
cgacuguuguucuucauaca

SEQ ID NO: 1754805 - RNA, 14 nt, Salmonella enterica enterica serovar Typhi Ty2
cgacgcuguuuaug

SEQ ID NO: 1754806 - RNA, 16 nt, Salmonella enterica enterica serovar Typhi Ty2
cgacgcuuaucagccc

SEQ ID NO: 1754807 - RNA, 13 nt, Salmonella enterica enterica serovar Typhi Ty2
cgacgcugccaca

SEQ ID NO: 1754808 - RNA, 12 nt, Salmonella enterica enterica serovar Typhi Ty2
cgacgcgggccg

SEQ ID NO: 1754809 - RNA, 21 nt, Salmonella enterica enterica serovar Typhi Ty2
cgacgcguuucacaucgccag

SEQ ID NO: 1754810 - RNA, 17 nt, Salmonella enterica enterica serovar Typhi Ty2
cgacgcguggcaucuua

SEQ ID NO: 1754811 - RNA, 12 nt, Salmonella enterica enterica serovar Typhi Ty2
cgacgcucauua

SEQ ID NO: 1754812 - RNA, 17 nt, Salmonella enterica enterica serovar Typhi Ty2
cgacgccuuuaccaccc

SEQ ID NO: 1754813 - RNA, 12 nt, Salmonella enterica enterica serovar Typhi Ty2
cgacgccugcau

SEQ ID NO: 1754814 - RNA, 21 nt, Salmonella enterica enterica serovar Typhi Ty2
cgacggucuuuuucgacggca

SEQ ID NO: 1754815 - RNA, 19 nt, Salmonella enterica enterica serovar Typhi Ty2
cgacgguaauaccaaccgc

SEQ ID NO: 1754816 - RNA, 20 nt, Salmonella enterica enterica serovar Typhi Ty2
cgacgggaaaaagcgcgccc

SEQ ID NO: 1754817 - RNA, 14 nt, Salmonella enterica enterica serovar Typhi Ty2
cgacggcgcagaca

SEQ ID NO: 1754818 - RNA, 21 nt, Salmonella enterica enterica serovar Typhi Ty2
cgagaaccaacugccaaacca

SEQ ID NO: 1754819 - RNA, 22 nt, Salmonella enterica enterica serovar Typhi Ty2
cgagaaagcguugccguaggca

SEQ ID NO: 1754820 - RNA, 18 nt, Salmonella enterica enterica serovar Typhi Ty2
cgagaauacugaagucga

SEQ ID NO: 1754821 - RNA, 18 nt, Salmonella enterica enterica serovar Typhi Ty2
cgagaaguucucacccau

SEQ ID NO: 1754822 - RNA, 17 nt, Salmonella enterica enterica serovar Typhi Ty2
cgagaccaucaacagcg

SEQ ID NO: 1754823 - RNA, 13 nt, Salmonella enterica enterica serovar Typhi Ty2
cgagaauuuuaug

SEQ ID NO: 1754824 - RNA, 17 nt, Salmonella enterica enterica serovar Typhi Ty2
cgagacugcccggcaua

SEQ ID NO: 1754825 - RNA, 21 nt, Salmonella enterica enterica serovar Typhi Ty2
cgagauuuaccgggaaauguc

SEQ ID NO: 1754826 - RNA, 23 nt, Salmonella enterica enterica serovar Typhi Ty2
cgagauuuuucugcgccaccagc

SEQ ID NO: 1754827 - RNA, 16 nt, Salmonella enterica enterica serovar Typhi Ty2
cgagauucaauaaugu

SEQ ID NO: 1754828 - RNA, 13 nt, Salmonella enterica enterica serovar Typhi Ty2
cgagaugaaaagu

SEQ ID NO: 1754829 - RNA, 15 nt, Salmonella enterica enterica serovar Typhi Ty2
cgagaucgccaccgc

SEQ ID NO: 1754830 - RNA, 14 nt, Salmonella enterica enterica serovar Typhi Ty2
cgagagaaaaaaau

SEQ ID NO: 1754831 - RNA, 13 nt, Salmonella enterica enterica serovar Typhi Ty2
cgagagaaaaaaa

SEQ ID NO: 1754832 - RNA, 18 nt, Salmonella enterica enterica serovar Typhi Ty2
cgagagaguauccacaga

SEQ ID NO: 1754833 - RNA, 22 nt, Salmonella enterica enterica serovar Typhi Ty2
cgagagaauuaacagcgcgacc

SEQ ID NO: 1754834 - RNA, 23 nt, Salmonella enterica enterica serovar Typhi Ty2
cgagagaauuaacagcgcgacca

SEQ ID NO: 1754835 - RNA, 20 nt, Salmonella enterica enterica serovar Typhi Ty2
cgagauacugcaacgccaga

SEQ ID NO: 1754836 - RNA, 16 nt, Salmonella enterica enterica serovar Typhi Ty2
cgagagucaaggcauc

SEQ ID NO: 1754837 - RNA, 22 nt, Salmonella enterica enterica serovar Typhi Ty2
cgagcaguucagcagcaccacu

SEQ ID NO: 1754838 - RNA, 21 nt, Salmonella enterica enterica serovar Typhi Ty2
cgagcaaaacccggugcggca

SEQ ID NO: 1754839 - RNA, 14 nt, Salmonella enterica enterica serovar Typhi Ty2
cgagcacuuuuucc

SEQ ID NO: 1754840 - RNA, 19 nt, Salmonella enterica enterica serovar Typhi Ty2
cgagcacuuuuuccuccug

SEQ ID NO: 1754841 - RNA, 14 nt, Salmonella enterica enterica serovar Typhi Ty2
cgagcaggacgcgc

SEQ ID NO: 1754842 - RNA, 16 nt, Salmonella enterica enterica serovar Typhi Ty2
cgagcaggaauagcuc

SEQ ID NO: 1754843 - RNA, 16 nt, Salmonella enterica enterica serovar Typhi Ty2
cgcaguucaauauuca

SEQ ID NO: 1754844 - RNA, 15 nt, Salmonella enterica enterica serovar Typhi Ty2
cgcaguucgccgcca

SEQ ID NO: 1754845 - RNA, 19 nt, Salmonella enterica enterica serovar Typhi Ty2
cgcauacucuuggagagca

SEQ ID NO: 1754846 - RNA, 20 nt, Salmonella enterica enterica serovar Typhi Ty2
cgcauagcggccagauggca

SEQ ID NO: 1754847 - RNA, 21 nt, Salmonella enterica enterica serovar Typhi Ty2
cgcauaggcuuugcugagcgc

SEQ ID NO: 1754848 - RNA, 22 nt, Salmonella enterica enterica serovar Typhi Ty2
cgcauagacgcccugcaaagca

SEQ ID NO: 1754849 - RNA, 21 nt, Salmonella enterica enterica serovar Typhi Ty2
cgcauagauauaaacgcccga

SEQ ID NO: 1754850 - RNA, 13 nt, Salmonella enterica enterica serovar Typhi Ty2
cgcauauuuuuua

SEQ ID NO: 1754851 - RNA, 14 nt, Salmonella enterica enterica serovar Typhi Ty2
cgcaucagaaaaac

SEQ ID NO: 1754852 - RNA, 22 nt, Salmonella enterica enterica serovar Typhi Ty2
cgcaucaaacuugcccagcgcc

SEQ ID NO: 1754853 - RNA, 22 nt, Salmonella enterica enterica serovar Typhi Ty2
cgcaucaggaucuucaucccau

SEQ ID NO: 1754854 - RNA, 14 nt, Salmonella enterica enterica serovar Typhi Ty2
cgcaucccgccaac

SEQ ID NO: 1754855 - RNA, 16 nt, Salmonella enterica enterica serovar Typhi Ty2
cgcauccaguuguuua

SEQ ID NO: 1754856 - RNA, 18 nt, Salmonella enterica enterica serovar Typhi Ty2
cgcauccggcaaaacgaa

SEQ ID NO: 1754857 - RNA, 17 nt, Salmonella enterica enterica serovar Typhi Ty2
cgcaucgccgcggcgcu

SEQ ID NO: 1754858 - RNA, 16 nt, Salmonella enterica enterica serovar Typhi Ty2
cgcaucgauaucuuua

SEQ ID NO: 1754859 - RNA, 16 nt, Salmonella enterica enterica serovar Typhi Ty2
cgcaucugggcugaga

SEQ ID NO: 1754860 - RNA, 21 nt, Salmonella enterica enterica serovar Typhi Ty2
cgcaucugggcugagaaaaau

SEQ ID NO: 1754861 - RNA, 20 nt, Salmonella enterica enterica serovar Typhi Ty2
cgcaucugacaucagaaaau

SEQ ID NO: 1754862 - RNA, 22 nt, Salmonella enterica enterica serovar Typhi Ty2
cgcaucguggccgauauugccu

SEQ ID NO: 1754863 - RNA, 12 nt, Salmonella enterica enterica serovar Typhi Ty2
cgcaucgguaau

SEQ ID NO: 1754864 - RNA, 16 nt, Salmonella enterica enterica serovar Typhi Ty2
cgcaggggggaaauga

SEQ ID NO: 1754865 - RNA, 15 nt, Salmonella enterica enterica serovar Typhi Ty2
cgcagguaaaaucca

SEQ ID NO: 1754866 - RNA, 14 nt, Salmonella enterica enterica serovar Typhi Ty2
cgcagugaccagca

SEQ ID NO: 1754867 - RNA, 12 nt, Salmonella enterica enterica serovar Typhi Ty2
cgcagggcugcu

SEQ ID NO: 1754868 - RNA, 12 nt, Salmonella enterica enterica serovar Typhi Ty2
cgcaggcgagcg

SEQ ID NO: 1754869 - RNA, 12 nt, Salmonella enterica enterica serovar Typhi Ty2
cgcaggccaaac

SEQ ID NO: 1754870 - RNA, 14 nt, Salmonella enterica enterica serovar Typhi Ty2
cgcagaucgccugg

SEQ ID NO: 1754871 - RNA, 14 nt, Salmonella enterica enterica serovar Typhi Ty2
cgcagcaacgguuu

SEQ ID NO: 1754872 - RNA, 16 nt, Salmonella enterica enterica serovar Typhi Ty2
cgcagcuccagcucag

SEQ ID NO: 1754873 - RNA, 22 nt, Salmonella enterica enterica serovar Typhi Ty2
cgcagcugccacaccacaugcg

SEQ ID NO: 1754874 - RNA, 19 nt, Salmonella enterica enterica serovar Typhi Ty2
cgcauuuuuucuucaguuc

SEQ ID NO: 1754875 - RNA, 15 nt, Salmonella enterica enterica serovar Typhi Ty2
cgcauuugcuuucau

SEQ ID NO: 1754876 - RNA, 20 nt, Salmonella enterica enterica serovar Typhi Ty2
cgcauucuucagcgcguccu

SEQ ID NO: 1754877 - RNA, 13 nt, Salmonella enterica enterica serovar Typhi Ty2
cgcauguuugccu

SEQ ID NO: 1754878 - RNA, 22 nt, Salmonella enterica enterica serovar Typhi Ty2
cgcauuaauauuucacgagcga

SEQ ID NO: 1754879 - RNA, 21 nt, Salmonella enterica enterica serovar Typhi Ty2
cgccaacuuuuugcgcaauac

SEQ ID NO: 1754880 - RNA, 16 nt, Salmonella enterica enterica serovar Typhi Ty2
cgccaacuuuuugcgc

SEQ ID NO: 1754881 - RNA, 14 nt, Salmonella enterica enterica serovar Typhi Ty2
cgccaaccucccaa

SEQ ID NO: 1754882 - RNA, 15 nt, Salmonella enterica enterica serovar Typhi Ty2
cgccaaccugcuggu

SEQ ID NO: 1754883 - RNA, 17 nt, Salmonella enterica enterica serovar Typhi Ty2
cgccaaaguuaaucagc

SEQ ID NO: 1754884 - RNA, 20 nt, Salmonella enterica enterica serovar Typhi Ty2
cgccaaagggauaagaaaga

SEQ ID NO: 1754885 - RNA, 18 nt, Salmonella enterica enterica serovar Typhi Ty2
cgccaaagcagcugcugg

SEQ ID NO: 1754886 - RNA, 16 nt, Salmonella enterica enterica serovar Typhi Ty2
cgccaaaagaggcagc

SEQ ID NO: 1754887 - RNA, 14 nt, Salmonella enterica enterica serovar Typhi Ty2
cgccaaaccacacc

SEQ ID NO: 1754888 - RNA, 19 nt, Salmonella enterica enterica serovar Typhi Ty2
cgccaaaccugccacaggc

SEQ ID NO: 1754889 - RNA, 19 nt, Salmonella enterica enterica serovar Typhi Ty2
cgccaaacugcgcgccgcc

SEQ ID NO: 1754890 - RNA, 22 nt, Salmonella enterica enterica serovar Typhi Ty2
cgccaaaccugccacaggccaa

SEQ ID NO: 1754891 - RNA, 12 nt, Salmonella enterica enterica serovar Typhi Ty2
cgccaaucggcg

SEQ ID NO: 1754892 - RNA, 22 nt, Salmonella enterica enterica serovar Typhi Ty2
cgccaaucggcgucuugccgca

SEQ ID NO: 1754893 - RNA, 15 nt, Salmonella enterica enterica serovar Typhi Ty2
cgccaaguacgccuu

SEQ ID NO: 1754894 - RNA, 16 nt, Salmonella enterica enterica serovar Typhi Ty2
cgccaaguucggugac

SEQ ID NO: 1754895 - RNA, 17 nt, Salmonella enterica enterica serovar Typhi Ty2
cgccaagcggcaacucu

SEQ ID NO: 1754896 - RNA, 13 nt, Salmonella enterica enterica serovar Typhi Ty2
cgccaagcgcgga

SEQ ID NO: 1754897 - RNA, 13 nt, Salmonella enterica enterica serovar Typhi Ty2
cgccaccgccgcu

SEQ ID NO: 1754898 - RNA, 19 nt, Salmonella enterica enterica serovar Typhi Ty2
cgccacgcccaacauaaac

SEQ ID NO: 1754899 - RNA, 20 nt, Salmonella enterica enterica serovar Typhi Ty2
cgccacgcgacgccagccga

SEQ ID NO: 1754900 - RNA, 15 nt, Salmonella enterica enterica serovar Typhi Ty2
cgccacgccgcccgc

SEQ ID NO: 1754901 - RNA, 15 nt, Salmonella enterica enterica serovar Typhi Ty2
cgccacgcuccuucu

SEQ ID NO: 1754902 - RNA, 19 nt, Salmonella enterica enterica serovar Typhi Ty2
cgccacuuccagcgcgccg

SEQ ID NO: 1754903 - RNA, 20 nt, Salmonella enterica enterica serovar Typhi Ty2
cgccacuuccagcgcgccgu

SEQ ID NO: 1754904 - RNA, 15 nt, Salmonella enterica enterica serovar Typhi Ty2
cgccacuuccagcgc

SEQ ID NO: 1754905 - RNA, 14 nt, Salmonella enterica enterica serovar Typhi Ty2
cgccacuuccagcg

SEQ ID NO: 1754906 - RNA, 16 nt, Salmonella enterica enterica serovar Typhi Ty2
cgccacggccagcagc

SEQ ID NO: 1754907 - RNA, 21 nt, Salmonella enterica enterica serovar Typhi Ty2
cgccagacucagccaggucug

SEQ ID NO: 1754908 - RNA, 18 nt, Salmonella enterica enterica serovar Typhi Ty2
cgccagacccgcaauaac

SEQ ID NO: 1754909 - RNA, 18 nt, Salmonella enterica enterica serovar Typhi Ty2
cgccagaccgacgccaac

SEQ ID NO: 1754910 - RNA, 14 nt, Salmonella enterica enterica serovar Typhi Ty2
cgccagacccagcg

SEQ ID NO: 1754911 - RNA, 23 nt, Salmonella enterica enterica serovar Typhi Ty2
cgccagacacuggaaacagccaa

SEQ ID NO: 1754912 - RNA, 11 nt, Salmonella enterica enterica serovar Typhi Ty2
cgcaaggaaau

SEQ ID NO: 1754913 - RNA, 22 nt, Salmonella enterica enterica serovar Typhi Ty2
cgcaaucacauacagcacuucc

SEQ ID NO: 1754914 - RNA, 22 nt, Salmonella enterica enterica serovar Typhi Ty2
cgcaagcucaccaucuucauga

SEQ ID NO: 1754915 - RNA, 19 nt, Salmonella enterica enterica serovar Typhi Ty2
cgcaacuuaguguccacuc

SEQ ID NO: 1754916 - RNA, 18 nt, Salmonella enterica enterica serovar Typhi Ty2
cgcaagauuccagauagc

SEQ ID NO: 1754917 - RNA, 21 nt, Salmonella enterica enterica serovar Typhi Ty2
cgcaacauucugcuuccagaa

SEQ ID NO: 1754918 - RNA, 22 nt, Salmonella enterica enterica serovar Typhi Ty2
cgcacaaucgccgugaucccaa

SEQ ID NO: 1754919 - RNA, 23 nt, Salmonella enterica enterica serovar Typhi Ty2
cgcaauugguaauuaaaggcagc

SEQ ID NO: 1754920 - RNA, 13 nt, Salmonella enterica enterica serovar Typhi Ty2
cgcaauucuucua

SEQ ID NO: 1754921 - RNA, 15 nt, Salmonella enterica enterica serovar Typhi Ty2
cgcacaaaccgcgcg

SEQ ID NO: 1754922 - RNA, 22 nt, Salmonella enterica enterica serovar Typhi Ty2
cgcaauuccugacugcgcgccu

SEQ ID NO: 1754923 - RNA, 13 nt, Salmonella enterica enterica serovar Typhi Ty2
cgcaauuaauuua

SEQ ID NO: 1754924 - RNA, 21 nt, Salmonella enterica enterica serovar Typhi Ty2
cgcaaucucuuuauugcuggu

SEQ ID NO: 1754925 - RNA, 16 nt, Salmonella enterica enterica serovar Typhi Ty2
cgcaaugccaccacac

SEQ ID NO: 1754926 - RNA, 18 nt, Salmonella enterica enterica serovar Typhi Ty2
cgcaaucuccgccgcuuu

SEQ ID NO: 1754927 - RNA, 19 nt, Salmonella enterica enterica serovar Typhi Ty2
cgcaaucucgcaagauucc

SEQ ID NO: 1754928 - RNA, 15 nt, Salmonella enterica enterica serovar Typhi Ty2
cgcaaucaugacaga

SEQ ID NO: 1754929 - RNA, 21 nt, Salmonella enterica enterica serovar Typhi Ty2
cgcaaucacgcguuauacgca

SEQ ID NO: 1754930 - RNA, 21 nt, Salmonella enterica enterica serovar Typhi Ty2
cgcacuaccagaaacaacacg

SEQ ID NO: 1754931 - RNA, 12 nt, Salmonella enterica enterica serovar Typhi Ty2
cgcagacccuuu

SEQ ID NO: 1754932 - RNA, 14 nt, Salmonella enterica enterica serovar Typhi Ty2
cgcagacaguggcc

SEQ ID NO: 1754933 - RNA, 18 nt, Salmonella enterica enterica serovar Typhi Ty2
cgcagaguguaggccuga

SEQ ID NO: 1754934 - RNA, 16 nt, Salmonella enterica enterica serovar Typhi Ty2
cgcagagcccagcgcg

SEQ ID NO: 1754935 - RNA, 15 nt, Salmonella enterica enterica serovar Typhi Ty2
cgcagagucgcagcg

SEQ ID NO: 1754936 - RNA, 21 nt, Salmonella enterica enterica serovar Typhi Ty2
cgcagaguaaaaaaaccggcg

SEQ ID NO: 1754937 - RNA, 19 nt, Salmonella enterica enterica serovar Typhi Ty2
cgcacgccagauaaaucag

SEQ ID NO: 1754938 - RNA, 21 nt, Salmonella enterica enterica serovar Typhi Ty2
cgauuuauucuuugucugucg

SEQ ID NO: 1754939 - RNA, 18 nt, Salmonella enterica enterica serovar Typhi Ty2
cgauuucauuacgccugu

SEQ ID NO: 1754940 - RNA, 12 nt, Salmonella enterica enterica serovar Typhi Ty2
cgauuuccccug

SEQ ID NO: 1754941 - RNA, 20 nt, Salmonella enterica enterica serovar Typhi Ty2
cgauuuccuguguuacgcca

SEQ ID NO: 1754942 - RNA, 19 nt, Salmonella enterica enterica serovar Typhi Ty2
cgauuuuugaucucuuuag

SEQ ID NO: 1754943 - RNA, 15 nt, Salmonella enterica enterica serovar Typhi Ty2
cgauuuuuaggccaa

SEQ ID NO: 1754944 - RNA, 22 nt, Salmonella enterica enterica serovar Typhi Ty2
cgauuuugacaaugaugguuaa

SEQ ID NO: 1754945 - RNA, 21 nt, Salmonella enterica enterica serovar Typhi Ty2
cgauuuuuucgacauuaccca

SEQ ID NO: 1754946 - RNA, 15 nt, Salmonella enterica enterica serovar Typhi Ty2
cgauuuauccaccgc

SEQ ID NO: 1754947 - RNA, 21 nt, Salmonella enterica enterica serovar Typhi Ty2
cgauuuaccucucaccaguag

SEQ ID NO: 1754948 - RNA, 13 nt, Salmonella enterica enterica serovar Typhi Ty2
cgauugucaucau

SEQ ID NO: 1754949 - RNA, 21 nt, Salmonella enterica enterica serovar Typhi Ty2
cgauuggccgucucuuucaug

SEQ ID NO: 1754950 - RNA, 13 nt, Salmonella enterica enterica serovar Typhi Ty2
cgauuccccacca

SEQ ID NO: 1754951 - RNA, 16 nt, Salmonella enterica enterica serovar Typhi Ty2
cgauucccgaucuuca

SEQ ID NO: 1754952 - RNA, 17 nt, Salmonella enterica enterica serovar Typhi Ty2
cgauuccgugucugaau

SEQ ID NO: 1754953 - RNA, 23 nt, Salmonella enterica enterica serovar Typhi Ty2
cgauauuucgccuaucaugcugc

SEQ ID NO: 1754954 - RNA, 14 nt, Salmonella enterica enterica serovar Typhi Ty2
cgaugccucacccc

SEQ ID NO: 1754955 - RNA, 17 nt, Salmonella enterica enterica serovar Typhi Ty2
cgaugcugcuccaucuc

SEQ ID NO: 1754956 - RNA, 21 nt, Salmonella enterica enterica serovar Typhi Ty2
cgaugcugaauagccagcccc

SEQ ID NO: 1754957 - RNA, 14 nt, Salmonella enterica enterica serovar Typhi Ty2
cgaugucgccgccg

SEQ ID NO: 1754958 - RNA, 18 nt, Salmonella enterica enterica serovar Typhi Ty2
cgaugcuguuucaguaaa

SEQ ID NO: 1754959 - RNA, 14 nt, Salmonella enterica enterica serovar Typhi Ty2
cgauggcaaauaau

SEQ ID NO: 1754960 - RNA, 16 nt, Salmonella enterica enterica serovar Typhi Ty2
cgaaaucaucaauggc

SEQ ID NO: 1754961 - RNA, 18 nt, Salmonella enterica enterica serovar Typhi Ty2
cgaaaucagagacaaaua

SEQ ID NO: 1754962 - RNA, 15 nt, Salmonella enterica enterica serovar Typhi Ty2
cgaaaugaccaccgc

SEQ ID NO: 1754963 - RNA, 17 nt, Salmonella enterica enterica serovar Typhi Ty2
cgaaauguccauccauu

SEQ ID NO: 1754964 - RNA, 18 nt, Salmonella enterica enterica serovar Typhi Ty2
cgaaauuggaguuaucau

SEQ ID NO: 1754965 - RNA, 17 nt, Salmonella enterica enterica serovar Typhi Ty2
cgaaauuuucuucuucg

SEQ ID NO: 1754966 - RNA, 19 nt, Salmonella enterica enterica serovar Typhi Ty2
cgaacaaguaguuguuaua

SEQ ID NO: 1754967 - RNA, 14 nt, Salmonella enterica enterica serovar Typhi Ty2
cgaacaacacggcg

SEQ ID NO: 1754968 - RNA, 17 nt, Salmonella enterica enterica serovar Typhi Ty2
cgaaagaaacgccgacc

SEQ ID NO: 1754969 - RNA, 15 nt, Salmonella enterica enterica serovar Typhi Ty2
cgaaagcugccuuuu

SEQ ID NO: 1754970 - RNA, 17 nt, Salmonella enterica enterica serovar Typhi Ty2
cgaaacucagcggccca

SEQ ID NO: 1754971 - RNA, 11 nt, Salmonella enterica enterica serovar Typhi Ty2
cgaaacucagc

SEQ ID NO: 1754972 - RNA, 19 nt, Salmonella enterica enterica serovar Typhi Ty2
cgaaacguccccugcgguu

SEQ ID NO: 1754973 - RNA, 19 nt, Salmonella enterica enterica serovar Typhi Ty2
cgaacgcccggugaucggu

SEQ ID NO: 1754974 - RNA, 15 nt, Salmonella enterica enterica serovar Typhi Ty2
cgaaccguggccucc

SEQ ID NO: 1754975 - RNA, 13 nt, Salmonella enterica enterica serovar Typhi Ty2
cgaaccaccagcc

SEQ ID NO: 1754976 - RNA, 21 nt, Salmonella enterica enterica serovar Typhi Ty2
cgaaccacggcuucagcggcg

SEQ ID NO: 1754977 - RNA, 19 nt, Salmonella enterica enterica serovar Typhi Ty2
cgaacaguguaaacgccag

SEQ ID NO: 1754978 - RNA, 17 nt, Salmonella enterica enterica serovar Typhi Ty2
cgaacauuucagcgcca

SEQ ID NO: 1754979 - RNA, 13 nt, Salmonella enterica enterica serovar Typhi Ty2
cgaacauuucagc

SEQ ID NO: 1754980 - RNA, 12 nt, Salmonella enterica enterica serovar Typhi Ty2
cgaacagccagg

SEQ ID NO: 1754981 - RNA, 17 nt, Salmonella enterica enterica serovar Typhi Ty2
cgaacagcgcuccacgc

SEQ ID NO: 1754982 - RNA, 18 nt, Salmonella enterica enterica serovar Typhi Ty2
cgaacaggcucagcgcca

SEQ ID NO: 1754983 - RNA, 20 nt, Salmonella enterica enterica serovar Typhi Ty2
ccuuuuucaauuuccaguuu

SEQ ID NO: 1754984 - RNA, 16 nt, Salmonella enterica enterica serovar Typhi Ty2
ccuuuucguacauguc

SEQ ID NO: 1754985 - RNA, 15 nt, Salmonella enterica enterica serovar Typhi Ty2
ccuuuuugcagcgcg

SEQ ID NO: 1754986 - RNA, 22 nt, Salmonella enterica enterica serovar Typhi Ty2
ccuuuuugauccguuucagaaa

SEQ ID NO: 1754987 - RNA, 19 nt, Salmonella enterica enterica serovar Typhi Ty2
ccuuuuucauccucaacca

SEQ ID NO: 1754988 - RNA, 20 nt, Salmonella enterica enterica serovar Typhi Ty2
ccuuuuuugguuauccagca

SEQ ID NO: 1754989 - RNA, 18 nt, Salmonella enterica enterica serovar Typhi Ty2
cgaaacagauuaaaaagc

SEQ ID NO: 1754990 - RNA, 22 nt, Salmonella enterica enterica serovar Typhi Ty2
cgaaacaaccgucgauuuuaau

SEQ ID NO: 1754991 - RNA, 20 nt, Salmonella enterica enterica serovar Typhi Ty2
cgaaacaggaaaaacauggg

SEQ ID NO: 1754992 - RNA, 15 nt, Salmonella enterica enterica serovar Typhi Ty2
cgaaaauaucggccu

SEQ ID NO: 1754993 - RNA, 13 nt, Salmonella enterica enterica serovar Typhi Ty2
cgaaaaucgguaa

SEQ ID NO: 1754994 - RNA, 16 nt, Salmonella enterica enterica serovar Typhi Ty2
cgaaaaacccgcuuca

SEQ ID NO: 1754995 - RNA, 13 nt, Salmonella enterica enterica serovar Typhi Ty2
cgaaaaaagaugg

SEQ ID NO: 1754996 - RNA, 22 nt, Salmonella enterica enterica serovar Typhi Ty2
cgaaaacguugacuuaaaaagc

SEQ ID NO: 1754997 - RNA, 23 nt, Salmonella enterica enterica serovar Typhi Ty2
ccuuuggaggagagcgucaugaa

SEQ ID NO: 1754998 - RNA, 21 nt, Salmonella enterica enterica serovar Typhi Ty2
ccuuugcgcgcgauauccacc

SEQ ID NO: 1754999 - RNA, 24 nt, Salmonella enterica enterica serovar Typhi Ty2
ccuuugcgcgcgauauccaccuga

SEQ ID NO: 1755000 - RNA, 14 nt, Salmonella enterica enterica serovar Typhi Ty2
ccuuuggccaccag

SEQ ID NO: 1755001 - RNA, 22 nt, Salmonella enterica enterica serovar Typhi Ty2
ccuuuggccuggagaucagcau

SEQ ID NO: 1755002 - RNA, 16 nt, Salmonella enterica enterica serovar Typhi Ty2
ccuuuuagcacuuuaa

SEQ ID NO: 1755003 - RNA, 15 nt, Salmonella enterica enterica serovar Typhi Ty2
ccuuuuaagguuaca

SEQ ID NO: 1755004 - RNA, 19 nt, Salmonella enterica enterica serovar Typhi Ty2
ccuuucgugcacuucaugc

SEQ ID NO: 1755005 - RNA, 15 nt, Salmonella enterica enterica serovar Typhi Ty2
ccuuuacugcgccag

SEQ ID NO: 1755006 - RNA, 14 nt, Salmonella enterica enterica serovar Typhi Ty2
ccuuuaucugcccu

SEQ ID NO: 1755007 - RNA, 18 nt, Salmonella enterica enterica serovar Typhi Ty2
ccuuucaaaaaagagaag

SEQ ID NO: 1755008 - RNA, 12 nt, Salmonella enterica enterica serovar Typhi Ty2
ccuuucaacgga

SEQ ID NO: 1755009 - RNA, 17 nt, Salmonella enterica enterica serovar Typhi Ty2
ccuuucggacuuccugu

SEQ ID NO: 1755010 - RNA, 11 nt, Salmonella enterica enterica serovar Typhi Ty2
ccuuucauuuu

SEQ ID NO: 1755011 - RNA, 23 nt, Salmonella enterica enterica serovar Typhi Ty2
ccuuucagagcgucuuuuauccc

SEQ ID NO: 1755012 - RNA, 20 nt, Salmonella enterica enterica serovar Typhi Ty2
ccuugcccguauugaagcga

SEQ ID NO: 1755013 - RNA, 20 nt, Salmonella enterica enterica serovar Typhi Ty2
ccuugccgcuuccaguccag

SEQ ID NO: 1755014 - RNA, 14 nt, Salmonella enterica enterica serovar Typhi Ty2
ccuugcgcagccag

SEQ ID NO: 1755015 - RNA, 15 nt, Salmonella enterica enterica serovar Typhi Ty2
ccuugcggugcagca

SEQ ID NO: 1755016 - RNA, 18 nt, Salmonella enterica enterica serovar Typhi Ty2
ccuugcggugcagcagac

SEQ ID NO: 1755017 - RNA, 21 nt, Salmonella enterica enterica serovar Typhi Ty2
ccuugcuggccuguucaagug

SEQ ID NO: 1755018 - RNA, 15 nt, Salmonella enterica enterica serovar Typhi Ty2
ccuugcccgcgccag

SEQ ID NO: 1755019 - RNA, 18 nt, Salmonella enterica enterica serovar Typhi Ty2
ccuugccagugaaaaaaa

SEQ ID NO: 1755020 - RNA, 22 nt, Salmonella enterica enterica serovar Typhi Ty2
ccuuuacugaaucucagauaau

SEQ ID NO: 1755021 - RNA, 19 nt, Salmonella enterica enterica serovar Typhi Ty2
ccuuuaaccucuuuuucau

SEQ ID NO: 1755022 - RNA, 22 nt, Salmonella enterica enterica serovar Typhi Ty2
ccuuguugauaaaacgaauacu

SEQ ID NO: 1755023 - RNA, 13 nt, Salmonella enterica enterica serovar Typhi Ty2
ccuugugucacau

SEQ ID NO: 1755024 - RNA, 14 nt, Salmonella enterica enterica serovar Typhi Ty2
ccuuguaagggagg

SEQ ID NO: 1755025 - RNA, 20 nt, Salmonella enterica enterica serovar Typhi Ty2
ccuucgaugagcgcgaaauc

SEQ ID NO: 1755026 - RNA, 14 nt, Salmonella enterica enterica serovar Typhi Ty2
ccuucgaacagcuc

SEQ ID NO: 1755027 - RNA, 17 nt, Salmonella enterica enterica serovar Typhi Ty2
ccuucgaccgucagcag

SEQ ID NO: 1755028 - RNA, 14 nt, Salmonella enterica enterica serovar Typhi Ty2
ccuucgcccggcgc

SEQ ID NO: 1755029 - RNA, 14 nt, Salmonella enterica enterica serovar Typhi Ty2
ccuucgcccucgcc

SEQ ID NO: 1755030 - RNA, 20 nt, Salmonella enterica enterica serovar Typhi Ty2
ccuucgcggugaucccaggc

SEQ ID NO: 1755031 - RNA, 16 nt, Salmonella enterica enterica serovar Typhi Ty2
ccuucgcccggcgcgc

SEQ ID NO: 1755032 - RNA, 12 nt, Salmonella enterica enterica serovar Typhi Ty2
ccuucgccgccg

SEQ ID NO: 1755033 - RNA, 13 nt, Salmonella enterica enterica serovar Typhi Ty2
ccuucgccuucac

SEQ ID NO: 1755034 - RNA, 19 nt, Salmonella enterica enterica serovar Typhi Ty2
ccuucgcggugaucccagg

SEQ ID NO: 1755035 - RNA, 18 nt, Salmonella enterica enterica serovar Typhi Ty2
ccuucgggcgauuuuugc

SEQ ID NO: 1755036 - RNA, 12 nt, Salmonella enterica enterica serovar Typhi Ty2
ccuucgggcgau

SEQ ID NO: 1755037 - RNA, 20 nt, Salmonella enterica enterica serovar Typhi Ty2
ccuucggccuccgcuuccug

SEQ ID NO: 1755038 - RNA, 19 nt, Salmonella enterica enterica serovar Typhi Ty2
ccuguguuacgccaauaau

SEQ ID NO: 1755039 - RNA, 16 nt, Salmonella enterica enterica serovar Typhi Ty2
ccuuccuggucugcca

SEQ ID NO: 1755040 - RNA, 19 nt, Salmonella enterica enterica serovar Typhi Ty2
ccuuccgcaagcucaccau

SEQ ID NO: 1755041 - RNA, 23 nt, Salmonella enterica enterica serovar Typhi Ty2
ccuuccccggcagccucaggccu

SEQ ID NO: 1755042 - RNA, 15 nt, Salmonella enterica enterica serovar Typhi Ty2
ccuuccccggcagcc

SEQ ID NO: 1755043 - RNA, 17 nt, Salmonella enterica enterica serovar Typhi Ty2
ccuucuucgccgucaua

SEQ ID NO: 1755044 - RNA, 18 nt, Salmonella enterica enterica serovar Typhi Ty2
ccuucuugcucaaaaagc

SEQ ID NO: 1755045 - RNA, 21 nt, Salmonella enterica enterica serovar Typhi Ty2
ccuucuuuauucacuuuuucu

SEQ ID NO: 1755046 - RNA, 13 nt, Salmonella enterica enterica serovar Typhi Ty2
ccuucuuuggcuu

SEQ ID NO: 1755047 - RNA, 20 nt, Salmonella enterica enterica serovar Typhi Ty2
ccuugaaguuauccagcgcc

SEQ ID NO: 1755048 - RNA, 21 nt, Salmonella enterica enterica serovar Typhi Ty2
ccuucugcgcccgccugcugu

SEQ ID NO: 1755049 - RNA, 22 nt, Salmonella enterica enterica serovar Typhi Ty2
ccuucucuccuagaaacccauu

SEQ ID NO: 1755050 - RNA, 17 nt, Salmonella enterica enterica serovar Typhi Ty2
ccuucucugucgagcau

SEQ ID NO: 1755051 - RNA, 19 nt, Salmonella enterica enterica serovar Typhi Ty2
ccuucuuccgucaccguau

SEQ ID NO: 1755052 - RNA, 19 nt, Salmonella enterica enterica serovar Typhi Ty2
ccuucuguaagcaauuaau

SEQ ID NO: 1755053 - RNA, 19 nt, Salmonella enterica enterica serovar Typhi Ty2
ccuucugguagccagacau

SEQ ID NO: 1755054 - RNA, 14 nt, Salmonella enterica enterica serovar Typhi Ty2
ccuucuccacucau

SEQ ID NO: 1755055 - RNA, 11 nt, Salmonella enterica enterica serovar Typhi Ty2
ccuucuccuuc

SEQ ID NO: 1755056 - RNA, 17 nt, Salmonella enterica enterica serovar Typhi Ty2
ccuucgguuuuauauuc

SEQ ID NO: 1755057 - RNA, 21 nt, Salmonella enterica enterica serovar Typhi Ty2
ccuucggugaaaucacgaccg

SEQ ID NO: 1755058 - RNA, 16 nt, Salmonella enterica enterica serovar Typhi Ty2
ccuucgucaaaauggg

SEQ ID NO: 1755059 - RNA, 12 nt, Salmonella enterica enterica serovar Typhi Ty2
ccuucggcucca

SEQ ID NO: 1755060 - RNA, 15 nt, Salmonella enterica enterica serovar Typhi Ty2
ccuucgucaaaaugg

SEQ ID NO: 1755061 - RNA, 16 nt, Salmonella enterica enterica serovar Typhi Ty2
cgaaggucagauccuu

SEQ ID NO: 1755062 - RNA, 18 nt, Salmonella enterica enterica serovar Typhi Ty2
cgaagggggccgggaaag

SEQ ID NO: 1755063 - RNA, 18 nt, Salmonella enterica enterica serovar Typhi Ty2
cgaagguuaccuacgguu

SEQ ID NO: 1755064 - RNA, 16 nt, Salmonella enterica enterica serovar Typhi Ty2
cgaagggugaggagcu

SEQ ID NO: 1755065 - RNA, 14 nt, Salmonella enterica enterica serovar Typhi Ty2
cgaagucgccaccc

SEQ ID NO: 1755066 - RNA, 15 nt, Salmonella enterica enterica serovar Typhi Ty2
cgaagucgccacccg

SEQ ID NO: 1755067 - RNA, 22 nt, Salmonella enterica enterica serovar Typhi Ty2
cgaagugcagcguuuccagcca

SEQ ID NO: 1755068 - RNA, 13 nt, Salmonella enterica enterica serovar Typhi Ty2
cgaaguggugggu

SEQ ID NO: 1755069 - RNA, 23 nt, Salmonella enterica enterica serovar Typhi Ty2
cgaagccgcgggcgguauuacau

SEQ ID NO: 1755070 - RNA, 15 nt, Salmonella enterica enterica serovar Typhi Ty2
cgaaggaagauagcg

SEQ ID NO: 1755071 - RNA, 21 nt, Salmonella enterica enterica serovar Typhi Ty2
cgaaggcuacugcgucgcgcg

SEQ ID NO: 1755072 - RNA, 19 nt, Salmonella enterica enterica serovar Typhi Ty2
cgaagcgucauccggcaau

SEQ ID NO: 1755073 - RNA, 16 nt, Salmonella enterica enterica serovar Typhi Ty2
cgaacuucauccacgc

SEQ ID NO: 1755074 - RNA, 24 nt, Salmonella enterica enterica serovar Typhi Ty2
cgaacugucugaaucagugcaucu

SEQ ID NO: 1755075 - RNA, 19 nt, Salmonella enterica enterica serovar Typhi Ty2
cgaacuucauccacgccga

SEQ ID NO: 1755076 - RNA, 20 nt, Salmonella enterica enterica serovar Typhi Ty2
cgaacuucgcgguugcgccc

SEQ ID NO: 1755077 - RNA, 18 nt, Salmonella enterica enterica serovar Typhi Ty2
cgaacugauggcgcuaag

SEQ ID NO: 1755078 - RNA, 15 nt, Salmonella enterica enterica serovar Typhi Ty2
cgaacugauggcgcu

SEQ ID NO: 1755079 - RNA, 12 nt, Salmonella enterica enterica serovar Typhi Ty2
cgaacggccuga

SEQ ID NO: 1755080 - RNA, 18 nt, Salmonella enterica enterica serovar Typhi Ty2
cgaacggcuuuccagcag

SEQ ID NO: 1755081 - RNA, 14 nt, Salmonella enterica enterica serovar Typhi Ty2
cgaacuccagcgcg

SEQ ID NO: 1755082 - RNA, 20 nt, Salmonella enterica enterica serovar Typhi Ty2
cgaagccaccggauugccuu

SEQ ID NO: 1755083 - RNA, 18 nt, Salmonella enterica enterica serovar Typhi Ty2
cgacaacgccuccugccg

SEQ ID NO: 1755084 - RNA, 20 nt, Salmonella enterica enterica serovar Typhi Ty2
cgacaacgccuccugccgau

SEQ ID NO: 1755085 - RNA, 18 nt, Salmonella enterica enterica serovar Typhi Ty2
cgacaacgcguuuauuau

SEQ ID NO: 1755086 - RNA, 15 nt, Salmonella enterica enterica serovar Typhi Ty2
cgacaacaaguccaa

SEQ ID NO: 1755087 - RNA, 13 nt, Salmonella enterica enterica serovar Typhi Ty2
cgacaaagccgac

SEQ ID NO: 1755088 - RNA, 23 nt, Salmonella enterica enterica serovar Typhi Ty2
cgacaacuucuaauuuuuccagc

SEQ ID NO: 1755089 - RNA, 21 nt, Salmonella enterica enterica serovar Typhi Ty2
cgacaacuucuaauuuuucca

SEQ ID NO: 1755090 - RNA, 16 nt, Salmonella enterica enterica serovar Typhi Ty2
cgacaacguuuucagc

SEQ ID NO: 1755091 - RNA, 23 nt, Salmonella enterica enterica serovar Typhi Ty2
cgacaagaagauuucuuaauucc

SEQ ID NO: 1755092 - RNA, 18 nt, Salmonella enterica enterica serovar Typhi Ty2
cgaauuugaaaaaaacau

SEQ ID NO: 1755093 - RNA, 18 nt, Salmonella enterica enterica serovar Typhi Ty2
cgaauuuacugugaucca

SEQ ID NO: 1755094 - RNA, 17 nt, Salmonella enterica enterica serovar Typhi Ty2
cgaauuugccccagaua

SEQ ID NO: 1755095 - RNA, 23 nt, Salmonella enterica enterica serovar Typhi Ty2
cgacaaaacuuuuggugcccauc

SEQ ID NO: 1755096 - RNA, 16 nt, Salmonella enterica enterica serovar Typhi Ty2
cgacaaacuccagcuc

SEQ ID NO: 1755097 - RNA, 13 nt, Salmonella enterica enterica serovar Typhi Ty2
cgacacaucaucg

SEQ ID NO: 1755098 - RNA, 15 nt, Salmonella enterica enterica serovar Typhi Ty2
cgacacauccugcgg

SEQ ID NO: 1755099 - RNA, 14 nt, Salmonella enterica enterica serovar Typhi Ty2
cgacacaucaucgc

SEQ ID NO: 1755100 - RNA, 20 nt, Salmonella enterica enterica serovar Typhi Ty2
cgacaauggcuagggaaacg

SEQ ID NO: 1755101 - RNA, 15 nt, Salmonella enterica enterica serovar Typhi Ty2
cgacacaacggcaca

SEQ ID NO: 1755102 - RNA, 19 nt, Salmonella enterica enterica serovar Typhi Ty2
cgacacccgauacacgccg

SEQ ID NO: 1755103 - RNA, 15 nt, Salmonella enterica enterica serovar Typhi Ty2
cgacacuccgcgcau

SEQ ID NO: 1755104 - RNA, 21 nt, Salmonella enterica enterica serovar Typhi Ty2
cgacacgcgcgcugcgccugg

SEQ ID NO: 1755105 - RNA, 23 nt, Salmonella enterica enterica serovar Typhi Ty2
cgacagaauaugcauauucauau

SEQ ID NO: 1755106 - RNA, 21 nt, Salmonella enterica enterica serovar Typhi Ty2
cgacacugaaacuccgcagcc

SEQ ID NO: 1755107 - RNA, 13 nt, Salmonella enterica enterica serovar Typhi Ty2
cgaauccuccugu

SEQ ID NO: 1755108 - RNA, 21 nt, Salmonella enterica enterica serovar Typhi Ty2
cgaaucgacaauccgccacgc

SEQ ID NO: 1755109 - RNA, 13 nt, Salmonella enterica enterica serovar Typhi Ty2
cgaauccagcagg

SEQ ID NO: 1755110 - RNA, 18 nt, Salmonella enterica enterica serovar Typhi Ty2
cgaauccccaucuccaga

SEQ ID NO: 1755111 - RNA, 12 nt, Salmonella enterica enterica serovar Typhi Ty2
cgaauccggggg

SEQ ID NO: 1755112 - RNA, 15 nt, Salmonella enterica enterica serovar Typhi Ty2
cgaauaucuuugucc

SEQ ID NO: 1755113 - RNA, 21 nt, Salmonella enterica enterica serovar Typhi Ty2
cgaauagaguaauacauccau

SEQ ID NO: 1755114 - RNA, 17 nt, Salmonella enterica enterica serovar Typhi Ty2
cgaauacuguuccaggc

SEQ ID NO: 1755115 - RNA, 16 nt, Salmonella enterica enterica serovar Typhi Ty2
cgaauaauuauuuucg

SEQ ID NO: 1755116 - RNA, 18 nt, Salmonella enterica enterica serovar Typhi Ty2
cgaauaaucaaccauaca

SEQ ID NO: 1755117 - RNA, 16 nt, Salmonella enterica enterica serovar Typhi Ty2
cgaauaaggaauggua

SEQ ID NO: 1755118 - RNA, 19 nt, Salmonella enterica enterica serovar Typhi Ty2
cgaauggccuccagcagca

SEQ ID NO: 1755119 - RNA, 18 nt, Salmonella enterica enterica serovar Typhi Ty2
cgaaugcgccagcgagac

SEQ ID NO: 1755120 - RNA, 22 nt, Salmonella enterica enterica serovar Typhi Ty2
cgaauucguccacacgccuggc

SEQ ID NO: 1755121 - RNA, 13 nt, Salmonella enterica enterica serovar Typhi Ty2
cgacaguaacugc

SEQ ID NO: 1755122 - RNA, 18 nt, Salmonella enterica enterica serovar Typhi Ty2
cgacaguacgguaauucc

SEQ ID NO: 1755123 - RNA, 16 nt, Salmonella enterica enterica serovar Typhi Ty2
cgacaguaacugcaaa

SEQ ID NO: 1755124 - RNA, 17 nt, Salmonella enterica enterica serovar Typhi Ty2
cgacaguucccggcaac

SEQ ID NO: 1755125 - RNA, 16 nt, Salmonella enterica enterica serovar Typhi Ty2
cgacauaaccggcaac

SEQ ID NO: 1755126 - RNA, 22 nt, Salmonella enterica enterica serovar Typhi Ty2
cgacaggguuugccagcaccag

SEQ ID NO: 1755127 - RNA, 17 nt, Salmonella enterica enterica serovar Typhi Ty2
cgacagggcgugaacca

SEQ ID NO: 1755128 - RNA, 14 nt, Salmonella enterica enterica serovar Typhi Ty2
cgacagcgcgcgcg

SEQ ID NO: 1755129 - RNA, 15 nt, Salmonella enterica enterica serovar Typhi Ty2
cgacagcgcccaacg

SEQ ID NO: 1755130 - RNA, 15 nt, Salmonella enterica enterica serovar Typhi Ty2
cgacaucucaggcaa

SEQ ID NO: 1755131 - RNA, 21 nt, Salmonella enterica enterica serovar Typhi Ty2
cgacaucucaggcaagacaca

SEQ ID NO: 1755132 - RNA, 18 nt, Salmonella enterica enterica serovar Typhi Ty2
cgacaugcuccugcaucu

SEQ ID NO: 1755133 - RNA, 17 nt, Salmonella enterica enterica serovar Typhi Ty2
cgacauucgauguuacu

SEQ ID NO: 1755134 - RNA, 23 nt, Salmonella enterica enterica serovar Typhi Ty2
cgacauucgauguuacugagcaa

SEQ ID NO: 1755135 - RNA, 19 nt, Salmonella enterica enterica serovar Typhi Ty2
cgaccaaacaagaucgcag

SEQ ID NO: 1755136 - RNA, 15 nt, Salmonella enterica enterica serovar Typhi Ty2
cgacauagccuuugu

SEQ ID NO: 1755137 - RNA, 21 nt, Salmonella enterica enterica serovar Typhi Ty2
cgacauaagcugcgacaacaa

SEQ ID NO: 1755138 - RNA, 12 nt, Salmonella enterica enterica serovar Typhi Ty2
cgacaucagaug

SEQ ID NO: 1755139 - RNA, 15 nt, Salmonella enterica enterica serovar Typhi Ty2
cgacaucgccugcuu

SEQ ID NO: 1755140 - RNA, 12 nt, Salmonella enterica enterica serovar Typhi Ty2
cgacaucgccaa

SEQ ID NO: 1755141 - RNA, 13 nt, Salmonella enterica enterica serovar Typhi Ty2
cgacccacaaugg

SEQ ID NO: 1755142 - RNA, 15 nt, Salmonella enterica enterica serovar Typhi Ty2
cgacccaucaauaac

SEQ ID NO: 1755143 - RNA, 20 nt, Salmonella enterica enterica serovar Typhi Ty2
cgaccccuucgcccucgcca

SEQ ID NO: 1755144 - RNA, 20 nt, Salmonella enterica enterica serovar Typhi Ty2
cgaccaugguucccgccacu

SEQ ID NO: 1755145 - RNA, 21 nt, Salmonella enterica enterica serovar Typhi Ty2
cgaccauaaauagccgaccgc

SEQ ID NO: 1755146 - RNA, 12 nt, Salmonella enterica enterica serovar Typhi Ty2
cgaccaucgccg

SEQ ID NO: 1755147 - RNA, 15 nt, Salmonella enterica enterica serovar Typhi Ty2
cgaccacuccggcau

SEQ ID NO: 1755148 - RNA, 13 nt, Salmonella enterica enterica serovar Typhi Ty2
cgaccacggccac

SEQ ID NO: 1755149 - RNA, 13 nt, Salmonella enterica enterica serovar Typhi Ty2
cgaccacgccacc

SEQ ID NO: 1755150 - RNA, 15 nt, Salmonella enterica enterica serovar Typhi Ty2
cgaccacccgcgacc

SEQ ID NO: 1755151 - RNA, 15 nt, Salmonella enterica enterica serovar Typhi Ty2
cgaccagacacggug

SEQ ID NO: 1755152 - RNA, 17 nt, Salmonella enterica enterica serovar Typhi Ty2
cgaccagcagcgggcug

SEQ ID NO: 1755153 - RNA, 16 nt, Salmonella enterica enterica serovar Typhi Ty2
cgaccagcagaugcag

SEQ ID NO: 1755154 - RNA, 13 nt, Salmonella enterica enterica serovar Typhi Ty2
cgaccagcgcgcc

SEQ ID NO: 1755155 - RNA, 13 nt, Salmonella enterica enterica serovar Typhi Ty2
cgaccagccugcc

SEQ ID NO: 1755156 - RNA, 11 nt, Salmonella enterica enterica serovar Typhi Ty2
cgaccuucucc

SEQ ID NO: 1755157 - RNA, 14 nt, Salmonella enterica enterica serovar Typhi Ty2
cgaccuucacgccg

SEQ ID NO: 1755158 - RNA, 13 nt, Salmonella enterica enterica serovar Typhi Ty2
cgacgacuucacc

SEQ ID NO: 1755159 - RNA, 22 nt, Salmonella enterica enterica serovar Typhi Ty2
cgacgagguuuccggcgggagc

SEQ ID NO: 1755160 - RNA, 19 nt, Salmonella enterica enterica serovar Typhi Ty2
cgacgauaaaaaaaguauc

SEQ ID NO: 1755161 - RNA, 15 nt, Salmonella enterica enterica serovar Typhi Ty2
cgacgaucagcgcca

SEQ ID NO: 1755162 - RNA, 17 nt, Salmonella enterica enterica serovar Typhi Ty2
cgacgcauuucuccuga

SEQ ID NO: 1755163 - RNA, 14 nt, Salmonella enterica enterica serovar Typhi Ty2
cgacgccaaaccug

SEQ ID NO: 1755164 - RNA, 15 nt, Salmonella enterica enterica serovar Typhi Ty2
cgacgcacuccagau

SEQ ID NO: 1755165 - RNA, 20 nt, Salmonella enterica enterica serovar Typhi Ty2
cgacgccaaucggcgucuug

SEQ ID NO: 1755166 - RNA, 13 nt, Salmonella enterica enterica serovar Typhi Ty2
cgacgccaaccgc

SEQ ID NO: 1755167 - RNA, 22 nt, Salmonella enterica enterica serovar Typhi Ty2
cgacgccgccgacacaguaaaa

SEQ ID NO: 1755168 - RNA, 16 nt, Salmonella enterica enterica serovar Typhi Ty2
cgaccuggcgcucaau

SEQ ID NO: 1755169 - RNA, 22 nt, Salmonella enterica enterica serovar Typhi Ty2
cgaccguuagcgacggcgcgcc

SEQ ID NO: 1755170 - RNA, 22 nt, Salmonella enterica enterica serovar Typhi Ty2
cgaccgugauuuuuaccgccgg

SEQ ID NO: 1755171 - RNA, 15 nt, Salmonella enterica enterica serovar Typhi Ty2
cgaccgucagcagca

SEQ ID NO: 1755172 - RNA, 18 nt, Salmonella enterica enterica serovar Typhi Ty2
cgaccgguccaccggggg

SEQ ID NO: 1755173 - RNA, 11 nt, Salmonella enterica enterica serovar Typhi Ty2
cgaccggcucg

SEQ ID NO: 1755174 - RNA, 14 nt, Salmonella enterica enterica serovar Typhi Ty2
cgaccggauugguc

SEQ ID NO: 1755175 - RNA, 21 nt, Salmonella enterica enterica serovar Typhi Ty2
cgaccgcgccacggccaacgc

SEQ ID NO: 1755176 - RNA, 15 nt, Salmonella enterica enterica serovar Typhi Ty2
cgaccgccagcagag

SEQ ID NO: 1755177 - RNA, 19 nt, Salmonella enterica enterica serovar Typhi Ty2
cgaccgcaggcucuuuuuc

SEQ ID NO: 1755178 - RNA, 20 nt, Salmonella enterica enterica serovar Typhi Ty2
cgacccgcugcgugaaaagg

SEQ ID NO: 1755179 - RNA, 20 nt, Salmonella enterica enterica serovar Typhi Ty2
cccagauaucagucugcaag

SEQ ID NO: 1755180 - RNA, 19 nt, Salmonella enterica enterica serovar Typhi Ty2
cccagauauccgcgcucaa

SEQ ID NO: 1755181 - RNA, 20 nt, Salmonella enterica enterica serovar Typhi Ty2
cccagauaauagcugaaaag

SEQ ID NO: 1755182 - RNA, 14 nt, Salmonella enterica enterica serovar Typhi Ty2
cccagcaaaccggc

SEQ ID NO: 1755183 - RNA, 16 nt, Salmonella enterica enterica serovar Typhi Ty2
cccagcaucccgcugg

SEQ ID NO: 1755184 - RNA, 21 nt, Salmonella enterica enterica serovar Typhi Ty2
cccagcaucccgcuggcgcca

SEQ ID NO: 1755185 - RNA, 20 nt, Salmonella enterica enterica serovar Typhi Ty2
cccagcaaugcacuacgaaa

SEQ ID NO: 1755186 - RNA, 16 nt, Salmonella enterica enterica serovar Typhi Ty2
cccagaauccgcgcau

SEQ ID NO: 1755187 - RNA, 14 nt, Salmonella enterica enterica serovar Typhi Ty2
cccagaaucacccc

SEQ ID NO: 1755188 - RNA, 16 nt, Salmonella enterica enterica serovar Typhi Ty2
cccagaaugccgccca

SEQ ID NO: 1755189 - RNA, 17 nt, Salmonella enterica enterica serovar Typhi Ty2
cccagacugugauggcg

SEQ ID NO: 1755190 - RNA, 19 nt, Salmonella enterica enterica serovar Typhi Ty2
cccagaaagaucagcagaa

SEQ ID NO: 1755191 - RNA, 13 nt, Salmonella enterica enterica serovar Typhi Ty2
cccacuguucaau

SEQ ID NO: 1755192 - RNA, 17 nt, Salmonella enterica enterica serovar Typhi Ty2
cccacgcauaguccugc

SEQ ID NO: 1755193 - RNA, 18 nt, Salmonella enterica enterica serovar Typhi Ty2
cccacgcauaguccugcc

SEQ ID NO: 1755194 - RNA, 14 nt, Salmonella enterica enterica serovar Typhi Ty2
cccacgccagcagc

SEQ ID NO: 1755195 - RNA, 24 nt, Salmonella enterica enterica serovar Typhi Ty2
cccacgccagcagcucgccgaccg

SEQ ID NO: 1755196 - RNA, 15 nt, Salmonella enterica enterica serovar Typhi Ty2
cccacugauaaaauu

SEQ ID NO: 1755197 - RNA, 14 nt, Salmonella enterica enterica serovar Typhi Ty2
cccacgcccgccau

SEQ ID NO: 1755198 - RNA, 19 nt, Salmonella enterica enterica serovar Typhi Ty2
cccacgacgcgguacccac

SEQ ID NO: 1755199 - RNA, 17 nt, Salmonella enterica enterica serovar Typhi Ty2
cccacgauacgccccug

SEQ ID NO: 1755200 - RNA, 18 nt, Salmonella enterica enterica serovar Typhi Ty2
cccaccuuuugcagcgcg

SEQ ID NO: 1755201 - RNA, 15 nt, Salmonella enterica enterica serovar Typhi Ty2
cccaacgaccauaaa

SEQ ID NO: 1755202 - RNA, 20 nt, Salmonella enterica enterica serovar Typhi Ty2
cccaacgacagcacuacgcu

SEQ ID NO: 1755203 - RNA, 22 nt, Salmonella enterica enterica serovar Typhi Ty2
cccaacggaugcgccaucccau

SEQ ID NO: 1755204 - RNA, 14 nt, Salmonella enterica enterica serovar Typhi Ty2
cccaagaacaugac

SEQ ID NO: 1755205 - RNA, 15 nt, Salmonella enterica enterica serovar Typhi Ty2
cccaacuacacucuu

SEQ ID NO: 1755206 - RNA, 15 nt, Salmonella enterica enterica serovar Typhi Ty2
cccaauaccacaacc

SEQ ID NO: 1755207 - RNA, 13 nt, Salmonella enterica enterica serovar Typhi Ty2
cccaauaccggcg

SEQ ID NO: 1755208 - RNA, 16 nt, Salmonella enterica enterica serovar Typhi Ty2
cccaccauaggccagc

SEQ ID NO: 1755209 - RNA, 14 nt, Salmonella enterica enterica serovar Typhi Ty2
cccacauuggcccc

SEQ ID NO: 1755210 - RNA, 15 nt, Salmonella enterica enterica serovar Typhi Ty2
cccacauguuggcau

SEQ ID NO: 1755211 - RNA, 15 nt, Salmonella enterica enterica serovar Typhi Ty2
cccacaucaccugug

SEQ ID NO: 1755212 - RNA, 22 nt, Salmonella enterica enterica serovar Typhi Ty2
cccaaucuugcguaccacguua

SEQ ID NO: 1755213 - RNA, 14 nt, Salmonella enterica enterica serovar Typhi Ty2
ccauucccguaaaa

SEQ ID NO: 1755214 - RNA, 21 nt, Salmonella enterica enterica serovar Typhi Ty2
ccauucccagcgcccccagca

SEQ ID NO: 1755215 - RNA, 14 nt, Salmonella enterica enterica serovar Typhi Ty2
ccauuccaggucau

SEQ ID NO: 1755216 - RNA, 22 nt, Salmonella enterica enterica serovar Typhi Ty2
ccauucgccagcccgaucaucu

SEQ ID NO: 1755217 - RNA, 16 nt, Salmonella enterica enterica serovar Typhi Ty2
ccauugcuaggaacag

SEQ ID NO: 1755218 - RNA, 20 nt, Salmonella enterica enterica serovar Typhi Ty2
ccauugcuaggaacagugac

SEQ ID NO: 1755219 - RNA, 13 nt, Salmonella enterica enterica serovar Typhi Ty2
ccauucuucaaca

SEQ ID NO: 1755220 - RNA, 16 nt, Salmonella enterica enterica serovar Typhi Ty2
ccauugcuuuuuugau

SEQ ID NO: 1755221 - RNA, 18 nt, Salmonella enterica enterica serovar Typhi Ty2
ccauugcugaggaucacc

SEQ ID NO: 1755222 - RNA, 21 nt, Salmonella enterica enterica serovar Typhi Ty2
ccauugggggguuagugcugu

SEQ ID NO: 1755223 - RNA, 17 nt, Salmonella enterica enterica serovar Typhi Ty2
ccauuaggcuauuuuau

SEQ ID NO: 1755224 - RNA, 12 nt, Salmonella enterica enterica serovar Typhi Ty2
ccauuauucgga

SEQ ID NO: 1755225 - RNA, 17 nt, Salmonella enterica enterica serovar Typhi Ty2
ccauuaugcucaccgcg

SEQ ID NO: 1755226 - RNA, 16 nt, Salmonella enterica enterica serovar Typhi Ty2
ccauuauuuauuuuca

SEQ ID NO: 1755227 - RNA, 17 nt, Salmonella enterica enterica serovar Typhi Ty2
ccauuauuguguucuca

SEQ ID NO: 1755228 - RNA, 24 nt, Salmonella enterica enterica serovar Typhi Ty2
ccauuauuuauuuucauacuauuu

SEQ ID NO: 1755229 - RNA, 14 nt, Salmonella enterica enterica serovar Typhi Ty2
ccauguuuguuuaa

SEQ ID NO: 1755230 - RNA, 15 nt, Salmonella enterica enterica serovar Typhi Ty2
ccauuaauacccaua

SEQ ID NO: 1755231 - RNA, 14 nt, Salmonella enterica enterica serovar Typhi Ty2
ccauguugagcgcu

SEQ ID NO: 1755232 - RNA, 22 nt, Salmonella enterica enterica serovar Typhi Ty2
ccauguugaucguaaaaugaaa

SEQ ID NO: 1755233 - RNA, 13 nt, Salmonella enterica enterica serovar Typhi Ty2
ccauguucaguuc

SEQ ID NO: 1755234 - RNA, 19 nt, Salmonella enterica enterica serovar Typhi Ty2
ccaugguucccgccacuga

SEQ ID NO: 1755235 - RNA, 14 nt, Salmonella enterica enterica serovar Typhi Ty2
ccauguacuccuga

SEQ ID NO: 1755236 - RNA, 18 nt, Salmonella enterica enterica serovar Typhi Ty2
ccauggccgcagcccgcc

SEQ ID NO: 1755237 - RNA, 21 nt, Salmonella enterica enterica serovar Typhi Ty2
ccaugcggcugaguucaggca

SEQ ID NO: 1755238 - RNA, 19 nt, Salmonella enterica enterica serovar Typhi Ty2
ccaugcgacuaaccugauc

SEQ ID NO: 1755239 - RNA, 11 nt, Salmonella enterica enterica serovar Typhi Ty2
ccaugccuuug

SEQ ID NO: 1755240 - RNA, 15 nt, Salmonella enterica enterica serovar Typhi Ty2
ccaugcuauucagca

SEQ ID NO: 1755241 - RNA, 16 nt, Salmonella enterica enterica serovar Typhi Ty2
ccauggcaggcagcac

SEQ ID NO: 1755242 - RNA, 15 nt, Salmonella enterica enterica serovar Typhi Ty2
ccauggccgcagccc

SEQ ID NO: 1755243 - RNA, 21 nt, Salmonella enterica enterica serovar Typhi Ty2
ccauggaacauccucuccuga

SEQ ID NO: 1755244 - RNA, 20 nt, Salmonella enterica enterica serovar Typhi Ty2
ccauggaacauccucuccug

SEQ ID NO: 1755245 - RNA, 15 nt, Salmonella enterica enterica serovar Typhi Ty2
ccaugcuuucaauaa

SEQ ID NO: 1755246 - RNA, 13 nt, Salmonella enterica enterica serovar Typhi Ty2
ccaugcuuucaau

SEQ ID NO: 1755247 - RNA, 13 nt, Salmonella enterica enterica serovar Typhi Ty2
ccaugcugguugg

SEQ ID NO: 1755248 - RNA, 23 nt, Salmonella enterica enterica serovar Typhi Ty2
ccaugcugucgucgacagcgccc

SEQ ID NO: 1755249 - RNA, 18 nt, Salmonella enterica enterica serovar Typhi Ty2
cccaguaauccggcaacu

SEQ ID NO: 1755250 - RNA, 16 nt, Salmonella enterica enterica serovar Typhi Ty2
cccaguaauccggcaa

SEQ ID NO: 1755251 - RNA, 19 nt, Salmonella enterica enterica serovar Typhi Ty2
cccaguaaauuaacgcgaa

SEQ ID NO: 1755252 - RNA, 19 nt, Salmonella enterica enterica serovar Typhi Ty2
cccagguuauucaggugga

SEQ ID NO: 1755253 - RNA, 22 nt, Salmonella enterica enterica serovar Typhi Ty2
cccagucauucucuuucugcgc

SEQ ID NO: 1755254 - RNA, 12 nt, Salmonella enterica enterica serovar Typhi Ty2
cccaguagccau

SEQ ID NO: 1755255 - RNA, 18 nt, Salmonella enterica enterica serovar Typhi Ty2
cccaguauugcaccuggg

SEQ ID NO: 1755256 - RNA, 14 nt, Salmonella enterica enterica serovar Typhi Ty2
cccagucacggcuc

SEQ ID NO: 1755257 - RNA, 18 nt, Salmonella enterica enterica serovar Typhi Ty2
cccagugccaccagccgg

SEQ ID NO: 1755258 - RNA, 12 nt, Salmonella enterica enterica serovar Typhi Ty2
cccaggcgcgca

SEQ ID NO: 1755259 - RNA, 23 nt, Salmonella enterica enterica serovar Typhi Ty2
cccaggcgcguuguccaacuguc

SEQ ID NO: 1755260 - RNA, 22 nt, Salmonella enterica enterica serovar Typhi Ty2
cccagcugagcuaaucacccac

SEQ ID NO: 1755261 - RNA, 14 nt, Salmonella enterica enterica serovar Typhi Ty2
cccagccagacgcc

SEQ ID NO: 1755262 - RNA, 17 nt, Salmonella enterica enterica serovar Typhi Ty2
cccagcaugagccagcc

SEQ ID NO: 1755263 - RNA, 22 nt, Salmonella enterica enterica serovar Typhi Ty2
cccagcaugggcauccccaugu

SEQ ID NO: 1755264 - RNA, 22 nt, Salmonella enterica enterica serovar Typhi Ty2
cccauacugacggcgcucuuua

SEQ ID NO: 1755265 - RNA, 11 nt, Salmonella enterica enterica serovar Typhi Ty2
cccauaaucac

SEQ ID NO: 1755266 - RNA, 19 nt, Salmonella enterica enterica serovar Typhi Ty2
cccauaaccgaugcacaug

SEQ ID NO: 1755267 - RNA, 23 nt, Salmonella enterica enterica serovar Typhi Ty2
cccauaauaaugacuaauuauua

SEQ ID NO: 1755268 - RNA, 13 nt, Salmonella enterica enterica serovar Typhi Ty2
cccauaaacaggu

SEQ ID NO: 1755269 - RNA, 14 nt, Salmonella enterica enterica serovar Typhi Ty2
cccauaaagauggc

SEQ ID NO: 1755270 - RNA, 19 nt, Salmonella enterica enterica serovar Typhi Ty2
cccauauuccagaaaggau

SEQ ID NO: 1755271 - RNA, 13 nt, Salmonella enterica enterica serovar Typhi Ty2
cccauauuccugc

SEQ ID NO: 1755272 - RNA, 13 nt, Salmonella enterica enterica serovar Typhi Ty2
cccauacguuuuu

SEQ ID NO: 1755273 - RNA, 15 nt, Salmonella enterica enterica serovar Typhi Ty2
cccauacugcccagc

SEQ ID NO: 1755274 - RNA, 18 nt, Salmonella enterica enterica serovar Typhi Ty2
cccaguuuuuuucugcca

SEQ ID NO: 1755275 - RNA, 22 nt, Salmonella enterica enterica serovar Typhi Ty2
cccaguugaucggccagcaagc

SEQ ID NO: 1755276 - RNA, 15 nt, Salmonella enterica enterica serovar Typhi Ty2
cccaguggcaaaauc

SEQ ID NO: 1755277 - RNA, 15 nt, Salmonella enterica enterica serovar Typhi Ty2
cccaguguacugcca

SEQ ID NO: 1755278 - RNA, 20 nt, Salmonella enterica enterica serovar Typhi Ty2
cccaucgcuuugcagaaaau

SEQ ID NO: 1755279 - RNA, 21 nt, Salmonella enterica enterica serovar Typhi Ty2
cccaucgggccgcucagcauc

SEQ ID NO: 1755280 - RNA, 14 nt, Salmonella enterica enterica serovar Typhi Ty2
cccaucgccguagg

SEQ ID NO: 1755281 - RNA, 22 nt, Salmonella enterica enterica serovar Typhi Ty2
cccaucaauaacgauaauuuua

SEQ ID NO: 1755282 - RNA, 13 nt, Salmonella enterica enterica serovar Typhi Ty2
cccaucaccugac

SEQ ID NO: 1755283 - RNA, 14 nt, Salmonella enterica enterica serovar Typhi Ty2
cccaucagcgccag

SEQ ID NO: 1755284 - RNA, 17 nt, Salmonella enterica enterica serovar Typhi Ty2
cccaucagcgccagccc

SEQ ID NO: 1755285 - RNA, 14 nt, Salmonella enterica enterica serovar Typhi Ty2
cccaucgagccaac

SEQ ID NO: 1755286 - RNA, 21 nt, Salmonella enterica enterica serovar Typhi Ty2
cccauccgggccacucuccag

SEQ ID NO: 1755287 - RNA, 16 nt, Salmonella enterica enterica serovar Typhi Ty2
cccauccgcccaccca

SEQ ID NO: 1755288 - RNA, 17 nt, Salmonella enterica enterica serovar Typhi Ty2
cccccuccauacccuau

SEQ ID NO: 1755289 - RNA, 13 nt, Salmonella enterica enterica serovar Typhi Ty2
cccccucggcagc

SEQ ID NO: 1755290 - RNA, 19 nt, Salmonella enterica enterica serovar Typhi Ty2
cccccgguagccacaccca

SEQ ID NO: 1755291 - RNA, 13 nt, Salmonella enterica enterica serovar Typhi Ty2
ccccaucuccaga

SEQ ID NO: 1755292 - RNA, 15 nt, Salmonella enterica enterica serovar Typhi Ty2
ccccaugacggccug

SEQ ID NO: 1755293 - RNA, 18 nt, Salmonella enterica enterica serovar Typhi Ty2
ccccaucaugcgccaggu

SEQ ID NO: 1755294 - RNA, 13 nt, Salmonella enterica enterica serovar Typhi Ty2
ccccagucuuccu

SEQ ID NO: 1755295 - RNA, 21 nt, Salmonella enterica enterica serovar Typhi Ty2
ccccagggagacggccaccca

SEQ ID NO: 1755296 - RNA, 11 nt, Salmonella enterica enterica serovar Typhi Ty2
ccccagcgcca

SEQ ID NO: 1755297 - RNA, 15 nt, Salmonella enterica enterica serovar Typhi Ty2
cccauucugcugaug

SEQ ID NO: 1755298 - RNA, 21 nt, Salmonella enterica enterica serovar Typhi Ty2
cccauugucaucaguaugagc

SEQ ID NO: 1755299 - RNA, 15 nt, Salmonella enterica enterica serovar Typhi Ty2
cccauugggccagca

SEQ ID NO: 1755300 - RNA, 22 nt, Salmonella enterica enterica serovar Typhi Ty2
cccauuuaacagauaauuaaua

SEQ ID NO: 1755301 - RNA, 12 nt, Salmonella enterica enterica serovar Typhi Ty2
ccccgucagucg

SEQ ID NO: 1755302 - RNA, 20 nt, Salmonella enterica enterica serovar Typhi Ty2
ccccggugcuuucuccugcg

SEQ ID NO: 1755303 - RNA, 18 nt, Salmonella enterica enterica serovar Typhi Ty2
ccccggucaacgcgccgc

SEQ ID NO: 1755304 - RNA, 14 nt, Salmonella enterica enterica serovar Typhi Ty2
ccccuaucuggugc

SEQ ID NO: 1755305 - RNA, 16 nt, Salmonella enterica enterica serovar Typhi Ty2
ccccuaccgaggcagg

SEQ ID NO: 1755306 - RNA, 15 nt, Salmonella enterica enterica serovar Typhi Ty2
ccccggccucgcccg

SEQ ID NO: 1755307 - RNA, 20 nt, Salmonella enterica enterica serovar Typhi Ty2
ccccggcgagugccugcugg

SEQ ID NO: 1755308 - RNA, 17 nt, Salmonella enterica enterica serovar Typhi Ty2
ccccggcgcccggaggg

SEQ ID NO: 1755309 - RNA, 13 nt, Salmonella enterica enterica serovar Typhi Ty2
ccccggcuuccag

SEQ ID NO: 1755310 - RNA, 20 nt, Salmonella enterica enterica serovar Typhi Ty2
ccccggcuuuaugaugguga

SEQ ID NO: 1755311 - RNA, 13 nt, Salmonella enterica enterica serovar Typhi Ty2
ccccggcaccacg

SEQ ID NO: 1755312 - RNA, 17 nt, Salmonella enterica enterica serovar Typhi Ty2
ccccgacauucccaguc

SEQ ID NO: 1755313 - RNA, 17 nt, Salmonella enterica enterica serovar Typhi Ty2
ccaugacgaccacagcc

SEQ ID NO: 1755314 - RNA, 14 nt, Salmonella enterica enterica serovar Typhi Ty2
ccaugacgacaggu

SEQ ID NO: 1755315 - RNA, 19 nt, Salmonella enterica enterica serovar Typhi Ty2
ccaugacgcagggcaauau

SEQ ID NO: 1755316 - RNA, 13 nt, Salmonella enterica enterica serovar Typhi Ty2
ccaugaguucaau

SEQ ID NO: 1755317 - RNA, 15 nt, Salmonella enterica enterica serovar Typhi Ty2
ccaugaucgccgcca

SEQ ID NO: 1755318 - RNA, 22 nt, Salmonella enterica enterica serovar Typhi Ty2
ccaugaucgauagcgacggcgc

SEQ ID NO: 1755319 - RNA, 18 nt, Salmonella enterica enterica serovar Typhi Ty2
ccaugauccguucgauca

SEQ ID NO: 1755320 - RNA, 14 nt, Salmonella enterica enterica serovar Typhi Ty2
ccaugauaauaauc

SEQ ID NO: 1755321 - RNA, 15 nt, Salmonella enterica enterica serovar Typhi Ty2
ccaucuuccagcauc

SEQ ID NO: 1755322 - RNA, 21 nt, Salmonella enterica enterica serovar Typhi Ty2
ccaucuggcguugccugcuau

SEQ ID NO: 1755323 - RNA, 22 nt, Salmonella enterica enterica serovar Typhi Ty2
ccaugcaccagucccagcccca

SEQ ID NO: 1755324 - RNA, 16 nt, Salmonella enterica enterica serovar Typhi Ty2
ccaugcauaaugcagc

SEQ ID NO: 1755325 - RNA, 17 nt, Salmonella enterica enterica serovar Typhi Ty2
ccaugcauaaugcagcc

SEQ ID NO: 1755326 - RNA, 18 nt, Salmonella enterica enterica serovar Typhi Ty2
ccaugcauaaugcagcca

SEQ ID NO: 1755327 - RNA, 13 nt, Salmonella enterica enterica serovar Typhi Ty2
ccaugccagcagu

SEQ ID NO: 1755328 - RNA, 17 nt, Salmonella enterica enterica serovar Typhi Ty2
ccaugcaaaaugcuucu

SEQ ID NO: 1755329 - RNA, 14 nt, Salmonella enterica enterica serovar Typhi Ty2
ccaugauucauccc

SEQ ID NO: 1755330 - RNA, 18 nt, Salmonella enterica enterica serovar Typhi Ty2
ccaucgcgccaucggcuu

SEQ ID NO: 1755331 - RNA, 14 nt, Salmonella enterica enterica serovar Typhi Ty2
ccaucgcgccgcug

SEQ ID NO: 1755332 - RNA, 23 nt, Salmonella enterica enterica serovar Typhi Ty2
ccaucgcgaauuucaaucgccag

SEQ ID NO: 1755333 - RNA, 21 nt, Salmonella enterica enterica serovar Typhi Ty2
ccaucgccugaugaccgccgu

SEQ ID NO: 1755334 - RNA, 20 nt, Salmonella enterica enterica serovar Typhi Ty2
ccaucgccugaugaccgccg

SEQ ID NO: 1755335 - RNA, 22 nt, Salmonella enterica enterica serovar Typhi Ty2
ccaucugaacucuuccagauac

SEQ ID NO: 1755336 - RNA, 15 nt, Salmonella enterica enterica serovar Typhi Ty2
ccauccggcaucucu

SEQ ID NO: 1755337 - RNA, 19 nt, Salmonella enterica enterica serovar Typhi Ty2
ccauccgggccacucucca

SEQ ID NO: 1755338 - RNA, 23 nt, Salmonella enterica enterica serovar Typhi Ty2
ccauccggcacggucaaucauca

SEQ ID NO: 1755339 - RNA, 14 nt, Salmonella enterica enterica serovar Typhi Ty2
ccauccggcacugu

SEQ ID NO: 1755340 - RNA, 22 nt, Salmonella enterica enterica serovar Typhi Ty2
ccauccucauuuuguugcucca

SEQ ID NO: 1755341 - RNA, 16 nt, Salmonella enterica enterica serovar Typhi Ty2
ccauccaccagaaccu

SEQ ID NO: 1755342 - RNA, 19 nt, Salmonella enterica enterica serovar Typhi Ty2
ccauccagacaugcacaug

SEQ ID NO: 1755343 - RNA, 15 nt, Salmonella enterica enterica serovar Typhi Ty2
ccaucaccgccaguc

SEQ ID NO: 1755344 - RNA, 21 nt, Salmonella enterica enterica serovar Typhi Ty2
ccauagcguuuaaaaagcugc

SEQ ID NO: 1755345 - RNA, 22 nt, Salmonella enterica enterica serovar Typhi Ty2
ccauagcguuuaaaaagcugca

SEQ ID NO: 1755346 - RNA, 20 nt, Salmonella enterica enterica serovar Typhi Ty2
ccauagcgcuaugcgcucca

SEQ ID NO: 1755347 - RNA, 17 nt, Salmonella enterica enterica serovar Typhi Ty2
ccauaaucgauauaauu

SEQ ID NO: 1755348 - RNA, 18 nt, Salmonella enterica enterica serovar Typhi Ty2
ccauaaucgauauaauuu

SEQ ID NO: 1755349 - RNA, 14 nt, Salmonella enterica enterica serovar Typhi Ty2
ccauaaugcaauca

SEQ ID NO: 1755350 - RNA, 12 nt, Salmonella enterica enterica serovar Typhi Ty2
ccauaaugacgc

SEQ ID NO: 1755351 - RNA, 17 nt, Salmonella enterica enterica serovar Typhi Ty2
ccauaaugauccacacc

SEQ ID NO: 1755352 - RNA, 20 nt, Salmonella enterica enterica serovar Typhi Ty2
ccauacuauccaacagaagg

SEQ ID NO: 1755353 - RNA, 19 nt, Salmonella enterica enterica serovar Typhi Ty2
ccauaccggacuccaggca

SEQ ID NO: 1755354 - RNA, 19 nt, Salmonella enterica enterica serovar Typhi Ty2
ccauaccuaaugcccgcuu

SEQ ID NO: 1755355 - RNA, 23 nt, Salmonella enterica enterica serovar Typhi Ty2
ccauaauuaccggcacaccggcc

SEQ ID NO: 1755356 - RNA, 20 nt, Salmonella enterica enterica serovar Typhi Ty2
ccauauagacauacaggaau

SEQ ID NO: 1755357 - RNA, 19 nt, Salmonella enterica enterica serovar Typhi Ty2
ccauauaacagaauaagcc

SEQ ID NO: 1755358 - RNA, 12 nt, Salmonella enterica enterica serovar Typhi Ty2
ccauauugcugu

SEQ ID NO: 1755359 - RNA, 14 nt, Salmonella enterica enterica serovar Typhi Ty2
ccauauaugaaauc

SEQ ID NO: 1755360 - RNA, 14 nt, Salmonella enterica enterica serovar Typhi Ty2
ccauaguccaugcc

SEQ ID NO: 1755361 - RNA, 18 nt, Salmonella enterica enterica serovar Typhi Ty2
ccauauuuaugcagcgcg

SEQ ID NO: 1755362 - RNA, 17 nt, Salmonella enterica enterica serovar Typhi Ty2
ccauauuuuuccagcgc

SEQ ID NO: 1755363 - RNA, 16 nt, Salmonella enterica enterica serovar Typhi Ty2
ccaucaaacgcagcaa

SEQ ID NO: 1755364 - RNA, 14 nt, Salmonella enterica enterica serovar Typhi Ty2
ccaguaauuuuucu

SEQ ID NO: 1755365 - RNA, 15 nt, Salmonella enterica enterica serovar Typhi Ty2
ccaguaauuuuuccg

SEQ ID NO: 1755366 - RNA, 17 nt, Salmonella enterica enterica serovar Typhi Ty2
ccaguacaaacaaauaa

SEQ ID NO: 1755367 - RNA, 23 nt, Salmonella enterica enterica serovar Typhi Ty2
ccaguaauuuuucucccagcaga

SEQ ID NO: 1755368 - RNA, 22 nt, Salmonella enterica enterica serovar Typhi Ty2
ccaguacaauuucuggccccug

SEQ ID NO: 1755369 - RNA, 13 nt, Salmonella enterica enterica serovar Typhi Ty2
ccaguaccagcac

SEQ ID NO: 1755370 - RNA, 21 nt, Salmonella enterica enterica serovar Typhi Ty2
ccaguacgucaacaaugcuuu

SEQ ID NO: 1755371 - RNA, 15 nt, Salmonella enterica enterica serovar Typhi Ty2
ccaguaccgccgccg

SEQ ID NO: 1755372 - RNA, 19 nt, Salmonella enterica enterica serovar Typhi Ty2
ccaguuagcgaucgcgccg

SEQ ID NO: 1755373 - RNA, 22 nt, Salmonella enterica enterica serovar Typhi Ty2
ccaguuaucaggacauaaaaca

SEQ ID NO: 1755374 - RNA, 19 nt, Salmonella enterica enterica serovar Typhi Ty2
ccaguuaacagaaugcuga

SEQ ID NO: 1755375 - RNA, 15 nt, Salmonella enterica enterica serovar Typhi Ty2
ccaguguuguucucu

SEQ ID NO: 1755376 - RNA, 21 nt, Salmonella enterica enterica serovar Typhi Ty2
ccaguacuuuggccuaacagu

SEQ ID NO: 1755377 - RNA, 20 nt, Salmonella enterica enterica serovar Typhi Ty2
ccagugguuccauuccagaa

SEQ ID NO: 1755378 - RNA, 16 nt, Salmonella enterica enterica serovar Typhi Ty2
ccaguucauuaacauc

SEQ ID NO: 1755379 - RNA, 22 nt, Salmonella enterica enterica serovar Typhi Ty2
ccaguucacuccuaagagaaaa

SEQ ID NO: 1755380 - RNA, 22 nt, Salmonella enterica enterica serovar Typhi Ty2
ccaguuucugacguaacuuauc

SEQ ID NO: 1755381 - RNA, 16 nt, Salmonella enterica enterica serovar Typhi Ty2
ccaguucccacagcuu

SEQ ID NO: 1755382 - RNA, 21 nt, Salmonella enterica enterica serovar Typhi Ty2
ccaguuucucaaacacuucua

SEQ ID NO: 1755383 - RNA, 13 nt, Salmonella enterica enterica serovar Typhi Ty2
ccauaaacaaaac

SEQ ID NO: 1755384 - RNA, 20 nt, Salmonella enterica enterica serovar Typhi Ty2
ccauaagcuuaggauaagaa

SEQ ID NO: 1755385 - RNA, 21 nt, Salmonella enterica enterica serovar Typhi Ty2
ccaguuuuugcauuauauuuu

SEQ ID NO: 1755386 - RNA, 13 nt, Salmonella enterica enterica serovar Typhi Ty2
ccaguuuuuucca

SEQ ID NO: 1755387 - RNA, 19 nt, Salmonella enterica enterica serovar Typhi Ty2
ccaggaagaguaucucucu

SEQ ID NO: 1755388 - RNA, 19 nt, Salmonella enterica enterica serovar Typhi Ty2
ccagcuuguuauccaucag

SEQ ID NO: 1755389 - RNA, 19 nt, Salmonella enterica enterica serovar Typhi Ty2
ccaggaguuaaaccuggua

SEQ ID NO: 1755390 - RNA, 15 nt, Salmonella enterica enterica serovar Typhi Ty2
ccaggagcauuggaa

SEQ ID NO: 1755391 - RNA, 15 nt, Salmonella enterica enterica serovar Typhi Ty2
ccaggauaauaauga

SEQ ID NO: 1755392 - RNA, 22 nt, Salmonella enterica enterica serovar Typhi Ty2
ccaggauaguacugaccagaca

SEQ ID NO: 1755393 - RNA, 13 nt, Salmonella enterica enterica serovar Typhi Ty2
ccaggaucgccgc

SEQ ID NO: 1755394 - RNA, 17 nt, Salmonella enterica enterica serovar Typhi Ty2
ccaggcaaucagcagcc

SEQ ID NO: 1755395 - RNA, 14 nt, Salmonella enterica enterica serovar Typhi Ty2
ccagcucuuucaau

SEQ ID NO: 1755396 - RNA, 21 nt, Salmonella enterica enterica serovar Typhi Ty2
ccagcugacgacgccagcccu

SEQ ID NO: 1755397 - RNA, 23 nt, Salmonella enterica enterica serovar Typhi Ty2
ccagcucugccgguugaccggcc

SEQ ID NO: 1755398 - RNA, 23 nt, Salmonella enterica enterica serovar Typhi Ty2
ccagcugguuaaccaccucauua

SEQ ID NO: 1755399 - RNA, 18 nt, Salmonella enterica enterica serovar Typhi Ty2
ccagcuguuuaagcgccu

SEQ ID NO: 1755400 - RNA, 11 nt, Salmonella enterica enterica serovar Typhi Ty2
ccagcuugaau

SEQ ID NO: 1755401 - RNA, 18 nt, Salmonella enterica enterica serovar Typhi Ty2
ccagcuugccgucacagg

SEQ ID NO: 1755402 - RNA, 13 nt, Salmonella enterica enterica serovar Typhi Ty2
ccagcuuaucuga

SEQ ID NO: 1755403 - RNA, 14 nt, Salmonella enterica enterica serovar Typhi Ty2
ccagcuucgccccg

SEQ ID NO: 1755404 - RNA, 21 nt, Salmonella enterica enterica serovar Typhi Ty2
ccagccccuucgcuguccauu

SEQ ID NO: 1755405 - RNA, 13 nt, Salmonella enterica enterica serovar Typhi Ty2
ccagcggccagcc

SEQ ID NO: 1755406 - RNA, 14 nt, Salmonella enterica enterica serovar Typhi Ty2
ccagcggccagcca

SEQ ID NO: 1755407 - RNA, 14 nt, Salmonella enterica enterica serovar Typhi Ty2
ccagcccgccgccc

SEQ ID NO: 1755408 - RNA, 15 nt, Salmonella enterica enterica serovar Typhi Ty2
ccagcccgccgcccu

SEQ ID NO: 1755409 - RNA, 22 nt, Salmonella enterica enterica serovar Typhi Ty2
ccagcccggaaauaaacgccag

SEQ ID NO: 1755410 - RNA, 23 nt, Salmonella enterica enterica serovar Typhi Ty2
ccagcccggaaauaaacgccagu

SEQ ID NO: 1755411 - RNA, 19 nt, Salmonella enterica enterica serovar Typhi Ty2
ccagcggcgccaucaccau

SEQ ID NO: 1755412 - RNA, 18 nt, Salmonella enterica enterica serovar Typhi Ty2
ccagcggcggcuugccuu

SEQ ID NO: 1755413 - RNA, 20 nt, Salmonella enterica enterica serovar Typhi Ty2
ccagcggcgcgcgguuaugc

SEQ ID NO: 1755414 - RNA, 19 nt, Salmonella enterica enterica serovar Typhi Ty2
ccagcguagauucacugug

SEQ ID NO: 1755415 - RNA, 21 nt, Salmonella enterica enterica serovar Typhi Ty2
ccagcguacguaacuucuugg

SEQ ID NO: 1755416 - RNA, 18 nt, Salmonella enterica enterica serovar Typhi Ty2
ccagcguacaucuuccau

SEQ ID NO: 1755417 - RNA, 15 nt, Salmonella enterica enterica serovar Typhi Ty2
ccagcgucacaggcu

SEQ ID NO: 1755418 - RNA, 16 nt, Salmonella enterica enterica serovar Typhi Ty2
ccagcgugacccagac

SEQ ID NO: 1755419 - RNA, 17 nt, Salmonella enterica enterica serovar Typhi Ty2
ccagcgugacccagaca

SEQ ID NO: 1755420 - RNA, 15 nt, Salmonella enterica enterica serovar Typhi Ty2
ccagcguaagcgccc

SEQ ID NO: 1755421 - RNA, 20 nt, Salmonella enterica enterica serovar Typhi Ty2
ccagcguaugauagcgagca

SEQ ID NO: 1755422 - RNA, 21 nt, Salmonella enterica enterica serovar Typhi Ty2
ccagcguauaauuaagcugcg

SEQ ID NO: 1755423 - RNA, 15 nt, Salmonella enterica enterica serovar Typhi Ty2
ccagcgugccgagca

SEQ ID NO: 1755424 - RNA, 19 nt, Salmonella enterica enterica serovar Typhi Ty2
ccagcgugccgagcaacag

SEQ ID NO: 1755425 - RNA, 23 nt, Salmonella enterica enterica serovar Typhi Ty2
ccagcgugccgagcaacagaaac

SEQ ID NO: 1755426 - RNA, 15 nt, Salmonella enterica enterica serovar Typhi Ty2
ccagcgugcgcagcg

SEQ ID NO: 1755427 - RNA, 15 nt, Salmonella enterica enterica serovar Typhi Ty2
ccagcucguuauuuc

SEQ ID NO: 1755428 - RNA, 16 nt, Salmonella enterica enterica serovar Typhi Ty2
ccagcucuacaucgcc

SEQ ID NO: 1755429 - RNA, 16 nt, Salmonella enterica enterica serovar Typhi Ty2
ccagcucgucuugugu

SEQ ID NO: 1755430 - RNA, 13 nt, Salmonella enterica enterica serovar Typhi Ty2
ccagcucauagga

SEQ ID NO: 1755431 - RNA, 23 nt, Salmonella enterica enterica serovar Typhi Ty2
ccagcucaccgagacugcccggc

SEQ ID NO: 1755432 - RNA, 14 nt, Salmonella enterica enterica serovar Typhi Ty2
ccagcucauuuuua

SEQ ID NO: 1755433 - RNA, 15 nt, Salmonella enterica enterica serovar Typhi Ty2
ccagcucauuuuuac

SEQ ID NO: 1755434 - RNA, 18 nt, Salmonella enterica enterica serovar Typhi Ty2
ccagcuccauccaccagc

SEQ ID NO: 1755435 - RNA, 21 nt, Salmonella enterica enterica serovar Typhi Ty2
ccagggauuuugcuuuuucgg

SEQ ID NO: 1755436 - RNA, 22 nt, Salmonella enterica enterica serovar Typhi Ty2
ccagggcaaauuaucccuuccu

SEQ ID NO: 1755437 - RNA, 23 nt, Salmonella enterica enterica serovar Typhi Ty2
ccagggauugauggccagccccu

SEQ ID NO: 1755438 - RNA, 20 nt, Salmonella enterica enterica serovar Typhi Ty2
ccaggcgcuauucccaggca

SEQ ID NO: 1755439 - RNA, 22 nt, Salmonella enterica enterica serovar Typhi Ty2
ccaggcuuccugcgcugucacc

SEQ ID NO: 1755440 - RNA, 20 nt, Salmonella enterica enterica serovar Typhi Ty2
ccagggcaugauuaaagcca

SEQ ID NO: 1755441 - RNA, 18 nt, Salmonella enterica enterica serovar Typhi Ty2
ccagggcaucaugauguu

SEQ ID NO: 1755442 - RNA, 13 nt, Salmonella enterica enterica serovar Typhi Ty2
ccagggcaggcag

SEQ ID NO: 1755443 - RNA, 17 nt, Salmonella enterica enterica serovar Typhi Ty2
ccagggcaggcagugaa

SEQ ID NO: 1755444 - RNA, 19 nt, Salmonella enterica enterica serovar Typhi Ty2
ccagggcaggcagugaacu

SEQ ID NO: 1755445 - RNA, 16 nt, Salmonella enterica enterica serovar Typhi Ty2
ccaggcgauaccgcgc

SEQ ID NO: 1755446 - RNA, 19 nt, Salmonella enterica enterica serovar Typhi Ty2
ccaggcgaaccccaugccg

SEQ ID NO: 1755447 - RNA, 16 nt, Salmonella enterica enterica serovar Typhi Ty2
ccaggcacuugagaaa

SEQ ID NO: 1755448 - RNA, 20 nt, Salmonella enterica enterica serovar Typhi Ty2
ccaggcagcaccucaauaug

SEQ ID NO: 1755449 - RNA, 21 nt, Salmonella enterica enterica serovar Typhi Ty2
ccaggccgucggcgccagcca

SEQ ID NO: 1755450 - RNA, 15 nt, Salmonella enterica enterica serovar Typhi Ty2
ccaggccguggcgca

SEQ ID NO: 1755451 - RNA, 21 nt, Salmonella enterica enterica serovar Typhi Ty2
ccaggccugaugagcgcagcg

SEQ ID NO: 1755452 - RNA, 21 nt, Salmonella enterica enterica serovar Typhi Ty2
ccaggccguggcgcaucuccu

SEQ ID NO: 1755453 - RNA, 20 nt, Salmonella enterica enterica serovar Typhi Ty2
ccaggugacuuugcccuuuu

SEQ ID NO: 1755454 - RNA, 14 nt, Salmonella enterica enterica serovar Typhi Ty2
ccaggugccgaggu

SEQ ID NO: 1755455 - RNA, 20 nt, Salmonella enterica enterica serovar Typhi Ty2
ccagggcgggauccccugcu

SEQ ID NO: 1755456 - RNA, 14 nt, Salmonella enterica enterica serovar Typhi Ty2
ccagggcgauuccc

SEQ ID NO: 1755457 - RNA, 21 nt, Salmonella enterica enterica serovar Typhi Ty2
ccaggggaugauuuucaggca

SEQ ID NO: 1755458 - RNA, 17 nt, Salmonella enterica enterica serovar Typhi Ty2
ccaggguucgcuggcca

SEQ ID NO: 1755459 - RNA, 19 nt, Salmonella enterica enterica serovar Typhi Ty2
ccagguuccccaaugauca

SEQ ID NO: 1755460 - RNA, 12 nt, Salmonella enterica enterica serovar Typhi Ty2
ccagguucagca

SEQ ID NO: 1755461 - RNA, 17 nt, Salmonella enterica enterica serovar Typhi Ty2
ccagguucaagcuggaa

SEQ ID NO: 1755462 - RNA, 23 nt, Salmonella enterica enterica serovar Typhi Ty2
ccagguugcucagguuauacugu

SEQ ID NO: 1755463 - RNA, 20 nt, Salmonella enterica enterica serovar Typhi Ty2
ccaguaacgcguccaacugg

SEQ ID NO: 1755464 - RNA, 17 nt, Salmonella enterica enterica serovar Typhi Ty2
ccaguaaugccgugccg

SEQ ID NO: 1755465 - RNA, 19 nt, Salmonella enterica enterica serovar Typhi Ty2
ccaguaauaucgccucccu

SEQ ID NO: 1755466 - RNA, 16 nt, Salmonella enterica enterica serovar Typhi Ty2
ccagguuuugcucuga

SEQ ID NO: 1755467 - RNA, 19 nt, Salmonella enterica enterica serovar Typhi Ty2
ccagguuuucaggccgcgu

SEQ ID NO: 1755468 - RNA, 20 nt, Salmonella enterica enterica serovar Typhi Ty2
ccaguaaaaucggaccuccg

SEQ ID NO: 1755469 - RNA, 21 nt, Salmonella enterica enterica serovar Typhi Ty2
ccagaaugcccugcuguucca

SEQ ID NO: 1755470 - RNA, 18 nt, Salmonella enterica enterica serovar Typhi Ty2
ccagaaugcccagcaagg

SEQ ID NO: 1755471 - RNA, 17 nt, Salmonella enterica enterica serovar Typhi Ty2
ccagaaugccagcgccg

SEQ ID NO: 1755472 - RNA, 13 nt, Salmonella enterica enterica serovar Typhi Ty2
ccagaaucuggcc

SEQ ID NO: 1755473 - RNA, 19 nt, Salmonella enterica enterica serovar Typhi Ty2
ccagaaucccacggagaaa

SEQ ID NO: 1755474 - RNA, 20 nt, Salmonella enterica enterica serovar Typhi Ty2
ccagaagcgcuuugccaaug

SEQ ID NO: 1755475 - RNA, 18 nt, Salmonella enterica enterica serovar Typhi Ty2
ccagaagcgcuuugccaa

SEQ ID NO: 1755476 - RNA, 16 nt, Salmonella enterica enterica serovar Typhi Ty2
ccagacaagcacauaa

SEQ ID NO: 1755477 - RNA, 17 nt, Salmonella enterica enterica serovar Typhi Ty2
ccagacacggugugccg

SEQ ID NO: 1755478 - RNA, 13 nt, Salmonella enterica enterica serovar Typhi Ty2
ccagacacuggaa

SEQ ID NO: 1755479 - RNA, 15 nt, Salmonella enterica enterica serovar Typhi Ty2
ccagacagauaacac

SEQ ID NO: 1755480 - RNA, 23 nt, Salmonella enterica enterica serovar Typhi Ty2
ccagacaaaaucuuuccagcucc

SEQ ID NO: 1755481 - RNA, 13 nt, Salmonella enterica enterica serovar Typhi Ty2
ccagaacggcagc

SEQ ID NO: 1755482 - RNA, 15 nt, Salmonella enterica enterica serovar Typhi Ty2
ccagaaagaucagca

SEQ ID NO: 1755483 - RNA, 19 nt, Salmonella enterica enterica serovar Typhi Ty2
ccagaacugcgaaaucacc

SEQ ID NO: 1755484 - RNA, 14 nt, Salmonella enterica enterica serovar Typhi Ty2
ccagaacucaucuu

SEQ ID NO: 1755485 - RNA, 14 nt, Salmonella enterica enterica serovar Typhi Ty2
ccagaacggcagcg

SEQ ID NO: 1755486 - RNA, 18 nt, Salmonella enterica enterica serovar Typhi Ty2
ccagaacgagaggaggag

SEQ ID NO: 1755487 - RNA, 17 nt, Salmonella enterica enterica serovar Typhi Ty2
ccagaagcacuucucca

SEQ ID NO: 1755488 - RNA, 12 nt, Salmonella enterica enterica serovar Typhi Ty2
ccagaagaaaau

SEQ ID NO: 1755489 - RNA, 16 nt, Salmonella enterica enterica serovar Typhi Ty2
ccacuuugcgcuccug

SEQ ID NO: 1755490 - RNA, 13 nt, Salmonella enterica enterica serovar Typhi Ty2
ccacuuugcgcuc

SEQ ID NO: 1755491 - RNA, 15 nt, Salmonella enterica enterica serovar Typhi Ty2
ccacuuugggccgaa

SEQ ID NO: 1755492 - RNA, 21 nt, Salmonella enterica enterica serovar Typhi Ty2
ccacuuucucggcuuuccagc

SEQ ID NO: 1755493 - RNA, 16 nt, Salmonella enterica enterica serovar Typhi Ty2
ccagaaaaagggaaaa

SEQ ID NO: 1755494 - RNA, 12 nt, Salmonella enterica enterica serovar Typhi Ty2
ccacuuugcgcu

SEQ ID NO: 1755495 - RNA, 14 nt, Salmonella enterica enterica serovar Typhi Ty2
ccacuuucagcucc

SEQ ID NO: 1755496 - RNA, 14 nt, Salmonella enterica enterica serovar Typhi Ty2
ccacguucuuccag

SEQ ID NO: 1755497 - RNA, 18 nt, Salmonella enterica enterica serovar Typhi Ty2
ccacgugcggacguagcg

SEQ ID NO: 1755498 - RNA, 18 nt, Salmonella enterica enterica serovar Typhi Ty2
ccagacuuuccagcacga

SEQ ID NO: 1755499 - RNA, 16 nt, Salmonella enterica enterica serovar Typhi Ty2
ccagacugugauggcg

SEQ ID NO: 1755500 - RNA, 14 nt, Salmonella enterica enterica serovar Typhi Ty2
ccagacuuuccagc

SEQ ID NO: 1755501 - RNA, 21 nt, Salmonella enterica enterica serovar Typhi Ty2
ccagagagcguuucuacgcca

SEQ ID NO: 1755502 - RNA, 16 nt, Salmonella enterica enterica serovar Typhi Ty2
ccagacucagccaggu

SEQ ID NO: 1755503 - RNA, 22 nt, Salmonella enterica enterica serovar Typhi Ty2
ccagacguuggauaacagcgcg

SEQ ID NO: 1755504 - RNA, 16 nt, Salmonella enterica enterica serovar Typhi Ty2
ccagagccccaaugcu

SEQ ID NO: 1755505 - RNA, 17 nt, Salmonella enterica enterica serovar Typhi Ty2
ccagagcgcgcuggcaa

SEQ ID NO: 1755506 - RNA, 20 nt, Salmonella enterica enterica serovar Typhi Ty2
ccagacgcugauagccacgg

SEQ ID NO: 1755507 - RNA, 19 nt, Salmonella enterica enterica serovar Typhi Ty2
ccagaccggcaucucaucu

SEQ ID NO: 1755508 - RNA, 12 nt, Salmonella enterica enterica serovar Typhi Ty2
ccagaccgugcg

SEQ ID NO: 1755509 - RNA, 19 nt, Salmonella enterica enterica serovar Typhi Ty2
ccagacagauuuggucagu

SEQ ID NO: 1755510 - RNA, 14 nt, Salmonella enterica enterica serovar Typhi Ty2
ccagacagcccaac

SEQ ID NO: 1755511 - RNA, 19 nt, Salmonella enterica enterica serovar Typhi Ty2
ccagacagauaacaccagc

SEQ ID NO: 1755512 - RNA, 19 nt, Salmonella enterica enterica serovar Typhi Ty2
ccagacaggacgccagcgc

SEQ ID NO: 1755513 - RNA, 15 nt, Salmonella enterica enterica serovar Typhi Ty2
ccagaccaauagaga

SEQ ID NO: 1755514 - RNA, 14 nt, Salmonella enterica enterica serovar Typhi Ty2
ccagaccaauagag

SEQ ID NO: 1755515 - RNA, 15 nt, Salmonella enterica enterica serovar Typhi Ty2
ccagacaugcacaug

SEQ ID NO: 1755516 - RNA, 15 nt, Salmonella enterica enterica serovar Typhi Ty2
ccagaugaaacugca

SEQ ID NO: 1755517 - RNA, 19 nt, Salmonella enterica enterica serovar Typhi Ty2
ccagaucggcaugauggcg

SEQ ID NO: 1755518 - RNA, 22 nt, Salmonella enterica enterica serovar Typhi Ty2
ccagaucguagccauguuccuc

SEQ ID NO: 1755519 - RNA, 19 nt, Salmonella enterica enterica serovar Typhi Ty2
ccagcaagcggcgauugau

SEQ ID NO: 1755520 - RNA, 21 nt, Salmonella enterica enterica serovar Typhi Ty2
ccagcaauaacaccggcggcg

SEQ ID NO: 1755521 - RNA, 19 nt, Salmonella enterica enterica serovar Typhi Ty2
ccagcaaggcugccgccag

SEQ ID NO: 1755522 - RNA, 16 nt, Salmonella enterica enterica serovar Typhi Ty2
ccagcacuaacagcag

SEQ ID NO: 1755523 - RNA, 17 nt, Salmonella enterica enterica serovar Typhi Ty2
ccagcacuaacagcagc

SEQ ID NO: 1755524 - RNA, 18 nt, Salmonella enterica enterica serovar Typhi Ty2
ccagcacggccuugaagu

SEQ ID NO: 1755525 - RNA, 17 nt, Salmonella enterica enterica serovar Typhi Ty2
ccagcagacgcugcuuc

SEQ ID NO: 1755526 - RNA, 20 nt, Salmonella enterica enterica serovar Typhi Ty2
ccagcagacgcugcuucacg

SEQ ID NO: 1755527 - RNA, 16 nt, Salmonella enterica enterica serovar Typhi Ty2
ccagcaccaucuuuuc

SEQ ID NO: 1755528 - RNA, 18 nt, Salmonella enterica enterica serovar Typhi Ty2
ccagcaaugagccgucgc

SEQ ID NO: 1755529 - RNA, 16 nt, Salmonella enterica enterica serovar Typhi Ty2
ccagccagacgccagc

SEQ ID NO: 1755530 - RNA, 17 nt, Salmonella enterica enterica serovar Typhi Ty2
ccagccagacgccagcc

SEQ ID NO: 1755531 - RNA, 18 nt, Salmonella enterica enterica serovar Typhi Ty2
ccagccacaagagcagca

SEQ ID NO: 1755532 - RNA, 16 nt, Salmonella enterica enterica serovar Typhi Ty2
ccagcauuucuucaag

SEQ ID NO: 1755533 - RNA, 20 nt, Salmonella enterica enterica serovar Typhi Ty2
ccagcauuuccagcugguua

SEQ ID NO: 1755534 - RNA, 18 nt, Salmonella enterica enterica serovar Typhi Ty2
ccagcauuucaaucgcgc

SEQ ID NO: 1755535 - RNA, 12 nt, Salmonella enterica enterica serovar Typhi Ty2
ccagccaaacaa

SEQ ID NO: 1755536 - RNA, 17 nt, Salmonella enterica enterica serovar Typhi Ty2
ccagcauuagcgccacc

SEQ ID NO: 1755537 - RNA, 18 nt, Salmonella enterica enterica serovar Typhi Ty2
ccagccaggaaccgccga

SEQ ID NO: 1755538 - RNA, 17 nt, Salmonella enterica enterica serovar Typhi Ty2
ccagccauagcagcaaa

SEQ ID NO: 1755539 - RNA, 17 nt, Salmonella enterica enterica serovar Typhi Ty2
ccagccauaaaugcuga

SEQ ID NO: 1755540 - RNA, 14 nt, Salmonella enterica enterica serovar Typhi Ty2
ccagccauaaauau

SEQ ID NO: 1755541 - RNA, 14 nt, Salmonella enterica enterica serovar Typhi Ty2
ccagccccagcccu

SEQ ID NO: 1755542 - RNA, 15 nt, Salmonella enterica enterica serovar Typhi Ty2
ccagccauagcagca

SEQ ID NO: 1755543 - RNA, 13 nt, Salmonella enterica enterica serovar Typhi Ty2
ccagccccagccc

SEQ ID NO: 1755544 - RNA, 16 nt, Salmonella enterica enterica serovar Typhi Ty2
ccagcaucgcccgggc

SEQ ID NO: 1755545 - RNA, 20 nt, Salmonella enterica enterica serovar Typhi Ty2
ccagcaucaugggcucauca

SEQ ID NO: 1755546 - RNA, 13 nt, Salmonella enterica enterica serovar Typhi Ty2
ccagcaucgacca

SEQ ID NO: 1755547 - RNA, 16 nt, Salmonella enterica enterica serovar Typhi Ty2
ccagcaugagccagcc

SEQ ID NO: 1755548 - RNA, 11 nt, Salmonella enterica enterica serovar Typhi Ty2
ccagcauggcg

SEQ ID NO: 1755549 - RNA, 15 nt, Salmonella enterica enterica serovar Typhi Ty2
ccagcaugcccgcca

SEQ ID NO: 1755550 - RNA, 21 nt, Salmonella enterica enterica serovar Typhi Ty2
ccagcaugaucauacugccgc

SEQ ID NO: 1755551 - RNA, 11 nt, Salmonella enterica enterica serovar Typhi Ty2
ccagcagcgcc

SEQ ID NO: 1755552 - RNA, 22 nt, Salmonella enterica enterica serovar Typhi Ty2
ccagcagcgccaguuuuucccg

SEQ ID NO: 1755553 - RNA, 14 nt, Salmonella enterica enterica serovar Typhi Ty2
ccagcaucaggugg

SEQ ID NO: 1755554 - RNA, 12 nt, Salmonella enterica enterica serovar Typhi Ty2
ccagcagccaca

SEQ ID NO: 1755555 - RNA, 20 nt, Salmonella enterica enterica serovar Typhi Ty2
ccagcagccagccguugugc

SEQ ID NO: 1755556 - RNA, 14 nt, Salmonella enterica enterica serovar Typhi Ty2
ccagcagccagccg

SEQ ID NO: 1755557 - RNA, 21 nt, Salmonella enterica enterica serovar Typhi Ty2
ccagcagccaugccagcgcgg

SEQ ID NO: 1755558 - RNA, 21 nt, Salmonella enterica enterica serovar Typhi Ty2
ccacggccaacgcgcccucug

SEQ ID NO: 1755559 - RNA, 12 nt, Salmonella enterica enterica serovar Typhi Ty2
ccacggccagca

SEQ ID NO: 1755560 - RNA, 17 nt, Salmonella enterica enterica serovar Typhi Ty2
ccacgggguuggcccuc

SEQ ID NO: 1755561 - RNA, 15 nt, Salmonella enterica enterica serovar Typhi Ty2
ccacggcuucagcgg

SEQ ID NO: 1755562 - RNA, 18 nt, Salmonella enterica enterica serovar Typhi Ty2
ccacggcuucagcggcgc

SEQ ID NO: 1755563 - RNA, 15 nt, Salmonella enterica enterica serovar Typhi Ty2
ccacgguguaccccg

SEQ ID NO: 1755564 - RNA, 13 nt, Salmonella enterica enterica serovar Typhi Ty2
ccacgcccgccgc

SEQ ID NO: 1755565 - RNA, 13 nt, Salmonella enterica enterica serovar Typhi Ty2
ccacgcccagcua

SEQ ID NO: 1755566 - RNA, 17 nt, Salmonella enterica enterica serovar Typhi Ty2
ccacgccaucgcggcgc

SEQ ID NO: 1755567 - RNA, 17 nt, Salmonella enterica enterica serovar Typhi Ty2
ccacgccauggccgcag

SEQ ID NO: 1755568 - RNA, 20 nt, Salmonella enterica enterica serovar Typhi Ty2
ccacgccaccgggccgucag

SEQ ID NO: 1755569 - RNA, 18 nt, Salmonella enterica enterica serovar Typhi Ty2
ccacgccaccgccgccac

SEQ ID NO: 1755570 - RNA, 15 nt, Salmonella enterica enterica serovar Typhi Ty2
ccacgccaccgccgc

SEQ ID NO: 1755571 - RNA, 11 nt, Salmonella enterica enterica serovar Typhi Ty2
ccacgccaccg

SEQ ID NO: 1755572 - RNA, 21 nt, Salmonella enterica enterica serovar Typhi Ty2
ccacgauguaugccgaccgug

SEQ ID NO: 1755573 - RNA, 15 nt, Salmonella enterica enterica serovar Typhi Ty2
ccacgcugccgccgc

SEQ ID NO: 1755574 - RNA, 14 nt, Salmonella enterica enterica serovar Typhi Ty2
ccacgcuuuuccuu

SEQ ID NO: 1755575 - RNA, 14 nt, Salmonella enterica enterica serovar Typhi Ty2
ccacgcugccgccg

SEQ ID NO: 1755576 - RNA, 19 nt, Salmonella enterica enterica serovar Typhi Ty2
ccacggauggccucugcca

SEQ ID NO: 1755577 - RNA, 19 nt, Salmonella enterica enterica serovar Typhi Ty2
ccacggauaagccagcccu

SEQ ID NO: 1755578 - RNA, 20 nt, Salmonella enterica enterica serovar Typhi Ty2
ccacggauauuuaccgccgc

SEQ ID NO: 1755579 - RNA, 22 nt, Salmonella enterica enterica serovar Typhi Ty2
ccaccguaugugcgccgugcag

SEQ ID NO: 1755580 - RNA, 21 nt, Salmonella enterica enterica serovar Typhi Ty2
ccaccguaugugcgccgugca

SEQ ID NO: 1755581 - RNA, 11 nt, Salmonella enterica enterica serovar Typhi Ty2
ccaccgaauuc

SEQ ID NO: 1755582 - RNA, 21 nt, Salmonella enterica enterica serovar Typhi Ty2
ccaccuuaaucgacuucaugc

SEQ ID NO: 1755583 - RNA, 14 nt, Salmonella enterica enterica serovar Typhi Ty2
ccaccucaaucacc

SEQ ID NO: 1755584 - RNA, 23 nt, Salmonella enterica enterica serovar Typhi Ty2
ccaccuuugaaaaucacaucgcc

SEQ ID NO: 1755585 - RNA, 15 nt, Salmonella enterica enterica serovar Typhi Ty2
ccaccuuucugcucc

SEQ ID NO: 1755586 - RNA, 16 nt, Salmonella enterica enterica serovar Typhi Ty2
ccacgaaagucuguuc

SEQ ID NO: 1755587 - RNA, 17 nt, Salmonella enterica enterica serovar Typhi Ty2
ccacgaucugauucaau

SEQ ID NO: 1755588 - RNA, 13 nt, Salmonella enterica enterica serovar Typhi Ty2
ccaccaccgccac

SEQ ID NO: 1755589 - RNA, 14 nt, Salmonella enterica enterica serovar Typhi Ty2
ccaccaccuccugc

SEQ ID NO: 1755590 - RNA, 11 nt, Salmonella enterica enterica serovar Typhi Ty2
ccaccacaaac

SEQ ID NO: 1755591 - RNA, 21 nt, Salmonella enterica enterica serovar Typhi Ty2
ccaccacccagugccaccagc

SEQ ID NO: 1755592 - RNA, 15 nt, Salmonella enterica enterica serovar Typhi Ty2
ccacauugaccccau

SEQ ID NO: 1755593 - RNA, 19 nt, Salmonella enterica enterica serovar Typhi Ty2
ccaccaaagccaggccgcc

SEQ ID NO: 1755594 - RNA, 17 nt, Salmonella enterica enterica serovar Typhi Ty2
ccaccaaagccaggccg

SEQ ID NO: 1755595 - RNA, 17 nt, Salmonella enterica enterica serovar Typhi Ty2
ccacauagcauccagac

SEQ ID NO: 1755596 - RNA, 23 nt, Salmonella enterica enterica serovar Typhi Ty2
ccacauccagcgccagcgccacc

SEQ ID NO: 1755597 - RNA, 17 nt, Salmonella enterica enterica serovar Typhi Ty2
ccacauccaccccgguu

SEQ ID NO: 1755598 - RNA, 22 nt, Salmonella enterica enterica serovar Typhi Ty2
ccacagugacccgccgccagca

SEQ ID NO: 1755599 - RNA, 17 nt, Salmonella enterica enterica serovar Typhi Ty2
ccacaugaccagcgccg

SEQ ID NO: 1755600 - RNA, 14 nt, Salmonella enterica enterica serovar Typhi Ty2
ccacaugaccagcg

SEQ ID NO: 1755601 - RNA, 21 nt, Salmonella enterica enterica serovar Typhi Ty2
ccacaucggauuauuuucacg

SEQ ID NO: 1755602 - RNA, 15 nt, Salmonella enterica enterica serovar Typhi Ty2
ccacauuaaagagcg

SEQ ID NO: 1755603 - RNA, 13 nt, Salmonella enterica enterica serovar Typhi Ty2
ccaccacgcccaa

SEQ ID NO: 1755604 - RNA, 17 nt, Salmonella enterica enterica serovar Typhi Ty2
ccaccagcgccaggcca

SEQ ID NO: 1755605 - RNA, 23 nt, Salmonella enterica enterica serovar Typhi Ty2
ccaccagcgccauaauccagaau

SEQ ID NO: 1755606 - RNA, 21 nt, Salmonella enterica enterica serovar Typhi Ty2
ccaccaggaaugcggccaucc

SEQ ID NO: 1755607 - RNA, 16 nt, Salmonella enterica enterica serovar Typhi Ty2
ccaccagcgccagcgg

SEQ ID NO: 1755608 - RNA, 15 nt, Salmonella enterica enterica serovar Typhi Ty2
ccaccagguucagca

SEQ ID NO: 1755609 - RNA, 15 nt, Salmonella enterica enterica serovar Typhi Ty2
ccaccauaggccagc

SEQ ID NO: 1755610 - RNA, 19 nt, Salmonella enterica enterica serovar Typhi Ty2
ccaccauauucgccaccgc

SEQ ID NO: 1755611 - RNA, 21 nt, Salmonella enterica enterica serovar Typhi Ty2
ccaccauauucgccaccgcgc

SEQ ID NO: 1755612 - RNA, 17 nt, Salmonella enterica enterica serovar Typhi Ty2
ccaccaucagacccgau

SEQ ID NO: 1755613 - RNA, 18 nt, Salmonella enterica enterica serovar Typhi Ty2
ccaccaucgucgccagac

SEQ ID NO: 1755614 - RNA, 16 nt, Salmonella enterica enterica serovar Typhi Ty2
ccaccaugcugguugg

SEQ ID NO: 1755615 - RNA, 21 nt, Salmonella enterica enterica serovar Typhi Ty2
ccaauugccacauagcaucca

SEQ ID NO: 1755616 - RNA, 18 nt, Salmonella enterica enterica serovar Typhi Ty2
ccacaauugccagcaggu

SEQ ID NO: 1755617 - RNA, 19 nt, Salmonella enterica enterica serovar Typhi Ty2
ccacaauggcaggcagcag

SEQ ID NO: 1755618 - RNA, 19 nt, Salmonella enterica enterica serovar Typhi Ty2
ccacaagaaaugcaggcgu

SEQ ID NO: 1755619 - RNA, 22 nt, Salmonella enterica enterica serovar Typhi Ty2
ccacaagagcagcaacccugcc

SEQ ID NO: 1755620 - RNA, 23 nt, Salmonella enterica enterica serovar Typhi Ty2
ccacaagagcagcaacccugccg

SEQ ID NO: 1755621 - RNA, 17 nt, Salmonella enterica enterica serovar Typhi Ty2
ccacaacgccugaugcu

SEQ ID NO: 1755622 - RNA, 12 nt, Salmonella enterica enterica serovar Typhi Ty2
ccacaaccggcu

SEQ ID NO: 1755623 - RNA, 23 nt, Salmonella enterica enterica serovar Typhi Ty2
ccacaaccgcccccaacugagcg

SEQ ID NO: 1755624 - RNA, 20 nt, Salmonella enterica enterica serovar Typhi Ty2
ccaauucguguuuuugaaca

SEQ ID NO: 1755625 - RNA, 22 nt, Salmonella enterica enterica serovar Typhi Ty2
ccaaugcuuagucagccuuaau

SEQ ID NO: 1755626 - RNA, 13 nt, Salmonella enterica enterica serovar Typhi Ty2
ccaaugcagcgcg

SEQ ID NO: 1755627 - RNA, 16 nt, Salmonella enterica enterica serovar Typhi Ty2
ccaaugccaaaaaaac

SEQ ID NO: 1755628 - RNA, 21 nt, Salmonella enterica enterica serovar Typhi Ty2
ccaauggcgcgucuuaaaauu

SEQ ID NO: 1755629 - RNA, 18 nt, Salmonella enterica enterica serovar Typhi Ty2
ccaaugucauauuuguga

SEQ ID NO: 1755630 - RNA, 18 nt, Salmonella enterica enterica serovar Typhi Ty2
ccaauguacguaaaacca

SEQ ID NO: 1755631 - RNA, 23 nt, Salmonella enterica enterica serovar Typhi Ty2
ccacaggaaccgguagccaggcg

SEQ ID NO: 1755632 - RNA, 9 nt, Salmonella enterica enterica serovar Typhi Ty2
ccacaggcu

SEQ ID NO: 1755633 - RNA, 17 nt, Salmonella enterica enterica serovar Typhi Ty2
ccacagguuaucgccgc

SEQ ID NO: 1755634 - RNA, 18 nt, Salmonella enterica enterica serovar Typhi Ty2
ccacagucgucuggcgcu

SEQ ID NO: 1755635 - RNA, 23 nt, Salmonella enterica enterica serovar Typhi Ty2
ccacaggaccacguucccgauuc

SEQ ID NO: 1755636 - RNA, 20 nt, Salmonella enterica enterica serovar Typhi Ty2
ccacagcgaauuccggccau

SEQ ID NO: 1755637 - RNA, 17 nt, Salmonella enterica enterica serovar Typhi Ty2
ccacagccgcauuuuuu

SEQ ID NO: 1755638 - RNA, 18 nt, Salmonella enterica enterica serovar Typhi Ty2
ccacagccaccgccagca

SEQ ID NO: 1755639 - RNA, 22 nt, Salmonella enterica enterica serovar Typhi Ty2
ccacagcauaccgugugcagug

SEQ ID NO: 1755640 - RNA, 17 nt, Salmonella enterica enterica serovar Typhi Ty2
ccacacccauagcagcu

SEQ ID NO: 1755641 - RNA, 14 nt, Salmonella enterica enterica serovar Typhi Ty2
ccacaccggcgcau

SEQ ID NO: 1755642 - RNA, 21 nt, Salmonella enterica enterica serovar Typhi Ty2
ccacacgcuuauccugccacu

SEQ ID NO: 1755643 - RNA, 15 nt, Salmonella enterica enterica serovar Typhi Ty2
ccacacugcaucgaa

SEQ ID NO: 1755644 - RNA, 13 nt, Salmonella enterica enterica serovar Typhi Ty2
ccacacugcugug

SEQ ID NO: 1755645 - RNA, 14 nt, Salmonella enterica enterica serovar Typhi Ty2
ccaauauccccagc

SEQ ID NO: 1755646 - RNA, 12 nt, Salmonella enterica enterica serovar Typhi Ty2
ccaauacccagc

SEQ ID NO: 1755647 - RNA, 19 nt, Salmonella enterica enterica serovar Typhi Ty2
ccaauaaugccgccgucgc

SEQ ID NO: 1755648 - RNA, 14 nt, Salmonella enterica enterica serovar Typhi Ty2
ccaauaauuuuaga

SEQ ID NO: 1755649 - RNA, 14 nt, Salmonella enterica enterica serovar Typhi Ty2
ccaauaaacgccag

SEQ ID NO: 1755650 - RNA, 12 nt, Salmonella enterica enterica serovar Typhi Ty2
ccaauaagaacu

SEQ ID NO: 1755651 - RNA, 17 nt, Salmonella enterica enterica serovar Typhi Ty2
ccaaucaacgccgccag

SEQ ID NO: 1755652 - RNA, 17 nt, Salmonella enterica enterica serovar Typhi Ty2
ccaaucagcggguauug

SEQ ID NO: 1755653 - RNA, 16 nt, Salmonella enterica enterica serovar Typhi Ty2
ccaauccugcacccgc

SEQ ID NO: 1755654 - RNA, 15 nt, Salmonella enterica enterica serovar Typhi Ty2
ccaaugacaauaauc

SEQ ID NO: 1755655 - RNA, 13 nt, Salmonella enterica enterica serovar Typhi Ty2
ccaaucuccagca

SEQ ID NO: 1755656 - RNA, 17 nt, Salmonella enterica enterica serovar Typhi Ty2
ccaaucgccgccgcgug

SEQ ID NO: 1755657 - RNA, 14 nt, Salmonella enterica enterica serovar Typhi Ty2
ccaagauccagcgg

SEQ ID NO: 1755658 - RNA, 21 nt, Salmonella enterica enterica serovar Typhi Ty2
ccaagauaagaaguaaacaga

SEQ ID NO: 1755659 - RNA, 12 nt, Salmonella enterica enterica serovar Typhi Ty2
ccaagaaugaaa

SEQ ID NO: 1755660 - RNA, 15 nt, Salmonella enterica enterica serovar Typhi Ty2
ccaagcguaguacgu

SEQ ID NO: 1755661 - RNA, 17 nt, Salmonella enterica enterica serovar Typhi Ty2
ccaagcgucagcauggu

SEQ ID NO: 1755662 - RNA, 19 nt, Salmonella enterica enterica serovar Typhi Ty2
ccaagcggcaucucgccaa

SEQ ID NO: 1755663 - RNA, 13 nt, Salmonella enterica enterica serovar Typhi Ty2
ccaagcagcgcca

SEQ ID NO: 1755664 - RNA, 15 nt, Salmonella enterica enterica serovar Typhi Ty2
ccaagauuuuucaga

SEQ ID NO: 1755665 - RNA, 18 nt, Salmonella enterica enterica serovar Typhi Ty2
ccaagcaacacggcgaca

SEQ ID NO: 1755666 - RNA, 17 nt, Salmonella enterica enterica serovar Typhi Ty2
ccaagucuccgcccagc

SEQ ID NO: 1755667 - RNA, 18 nt, Salmonella enterica enterica serovar Typhi Ty2
ccaaguaauaaagagaac

SEQ ID NO: 1755668 - RNA, 12 nt, Salmonella enterica enterica serovar Typhi Ty2
ccaaccaaccca

SEQ ID NO: 1755669 - RNA, 13 nt, Salmonella enterica enterica serovar Typhi Ty2
ccaacaggaacau

SEQ ID NO: 1755670 - RNA, 13 nt, Salmonella enterica enterica serovar Typhi Ty2
ccaacagcugggu

SEQ ID NO: 1755671 - RNA, 23 nt, Salmonella enterica enterica serovar Typhi Ty2
ccaacauagcuaaauaaaaauaa

SEQ ID NO: 1755672 - RNA, 23 nt, Salmonella enterica enterica serovar Typhi Ty2
ccaaccgcgacggggcgcagaaa

SEQ ID NO: 1755673 - RNA, 18 nt, Salmonella enterica enterica serovar Typhi Ty2
ccaacccacgcgccacgu

SEQ ID NO: 1755674 - RNA, 20 nt, Salmonella enterica enterica serovar Typhi Ty2
ccaacaaugccacgccccua

SEQ ID NO: 1755675 - RNA, 15 nt, Salmonella enterica enterica serovar Typhi Ty2
ccaacaaugccacgc

SEQ ID NO: 1755676 - RNA, 19 nt, Salmonella enterica enterica serovar Typhi Ty2
ccaacaaucagaagaaaua

SEQ ID NO: 1755677 - RNA, 13 nt, Salmonella enterica enterica serovar Typhi Ty2
ccaacaacccauu

SEQ ID NO: 1755678 - RNA, 14 nt, Salmonella enterica enterica serovar Typhi Ty2
ccaacaacccauuc

SEQ ID NO: 1755679 - RNA, 17 nt, Salmonella enterica enterica serovar Typhi Ty2
ccaacaacaggccgccg

SEQ ID NO: 1755680 - RNA, 17 nt, Salmonella enterica enterica serovar Typhi Ty2
ccaacugcgccugaaga

SEQ ID NO: 1755681 - RNA, 17 nt, Salmonella enterica enterica serovar Typhi Ty2
ccaacugucgccauccu

SEQ ID NO: 1755682 - RNA, 21 nt, Salmonella enterica enterica serovar Typhi Ty2
ccaacuguauuuugaaaacac

SEQ ID NO: 1755683 - RNA, 14 nt, Salmonella enterica enterica serovar Typhi Ty2
ccaacguauaaaau

SEQ ID NO: 1755684 - RNA, 15 nt, Salmonella enterica enterica serovar Typhi Ty2
ccaacgucagcaucu

SEQ ID NO: 1755685 - RNA, 22 nt, Salmonella enterica enterica serovar Typhi Ty2
ccaacggcgacgcccgccaucu

SEQ ID NO: 1755686 - RNA, 20 nt, Salmonella enterica enterica serovar Typhi Ty2
ccaacgaaacucagcggccc

SEQ ID NO: 1755687 - RNA, 14 nt, Salmonella enterica enterica serovar Typhi Ty2
ccaacgccaacaua

SEQ ID NO: 1755688 - RNA, 20 nt, Salmonella enterica enterica serovar Typhi Ty2
ccaaauaguccagcagccau

SEQ ID NO: 1755689 - RNA, 16 nt, Salmonella enterica enterica serovar Typhi Ty2
ccaaaucuguucuguc

SEQ ID NO: 1755690 - RNA, 18 nt, Salmonella enterica enterica serovar Typhi Ty2
ccaaaucuguucugucca

SEQ ID NO: 1755691 - RNA, 15 nt, Salmonella enterica enterica serovar Typhi Ty2
ccaaaguccaacugu

SEQ ID NO: 1755692 - RNA, 15 nt, Salmonella enterica enterica serovar Typhi Ty2
ccaaacuggcugugc

SEQ ID NO: 1755693 - RNA, 19 nt, Salmonella enterica enterica serovar Typhi Ty2
ccaaacuccucacugcgua

SEQ ID NO: 1755694 - RNA, 18 nt, Salmonella enterica enterica serovar Typhi Ty2
ccaaacugcgcgccgccc

SEQ ID NO: 1755695 - RNA, 12 nt, Salmonella enterica enterica serovar Typhi Ty2
ccaaacugcgga

SEQ ID NO: 1755696 - RNA, 13 nt, Salmonella enterica enterica serovar Typhi Ty2
ccaaacuccucac

SEQ ID NO: 1755697 - RNA, 23 nt, Salmonella enterica enterica serovar Typhi Ty2
ccaaacgaugaccauaaaugaaa

SEQ ID NO: 1755698 - RNA, 12 nt, Salmonella enterica enterica serovar Typhi Ty2
ccaaacggcagc

SEQ ID NO: 1755699 - RNA, 13 nt, Salmonella enterica enterica serovar Typhi Ty2
ccaaacggcagcu

SEQ ID NO: 1755700 - RNA, 23 nt, Salmonella enterica enterica serovar Typhi Ty2
ccaaagcaccauucuucaacaau

SEQ ID NO: 1755701 - RNA, 14 nt, Salmonella enterica enterica serovar Typhi Ty2
ccaaagcagcugcu

SEQ ID NO: 1755702 - RNA, 19 nt, Salmonella enterica enterica serovar Typhi Ty2
ccaaagcagcggaaaauau

SEQ ID NO: 1755703 - RNA, 16 nt, Salmonella enterica enterica serovar Typhi Ty2
ccaaagggagcagacu

SEQ ID NO: 1755704 - RNA, 17 nt, Salmonella enterica enterica serovar Typhi Ty2
ccaaagcgcugcugcuc

SEQ ID NO: 1755705 - RNA, 18 nt, Salmonella enterica enterica serovar Typhi Ty2
ccaaagccaggccgccag

SEQ ID NO: 1755706 - RNA, 18 nt, Salmonella enterica enterica serovar Typhi Ty2
ccaaagcccgcaaacaga

SEQ ID NO: 1755707 - RNA, 16 nt, Salmonella enterica enterica serovar Typhi Ty2
cauuucugccugcuuc

SEQ ID NO: 1755708 - RNA, 22 nt, Salmonella enterica enterica serovar Typhi Ty2
ccaaaaaccguagcguugccaa

SEQ ID NO: 1755709 - RNA, 16 nt, Salmonella enterica enterica serovar Typhi Ty2
ccaaaaccacagugac

SEQ ID NO: 1755710 - RNA, 19 nt, Salmonella enterica enterica serovar Typhi Ty2
ccaaacaucgcucgcgcca

SEQ ID NO: 1755711 - RNA, 13 nt, Salmonella enterica enterica serovar Typhi Ty2
ccaaacagcggcu

SEQ ID NO: 1755712 - RNA, 15 nt, Salmonella enterica enterica serovar Typhi Ty2
ccaaacacuuccccu

SEQ ID NO: 1755713 - RNA, 16 nt, Salmonella enterica enterica serovar Typhi Ty2
ccaaacgaauuuaaau

SEQ ID NO: 1755714 - RNA, 17 nt, Salmonella enterica enterica serovar Typhi Ty2
ccaaacgaauuuaaaua

SEQ ID NO: 1755715 - RNA, 20 nt, Salmonella enterica enterica serovar Typhi Ty2
ccaaacgacgcguuucacau

SEQ ID NO: 1755716 - RNA, 22 nt, Salmonella enterica enterica serovar Typhi Ty2
ccaaaccacugauggaguuuca

SEQ ID NO: 1755717 - RNA, 22 nt, Salmonella enterica enterica serovar Typhi Ty2
ccaaaccagacucaccccuucu

SEQ ID NO: 1755718 - RNA, 19 nt, Salmonella enterica enterica serovar Typhi Ty2
ccaaaaugcgcaaagcaua

SEQ ID NO: 1755719 - RNA, 19 nt, Salmonella enterica enterica serovar Typhi Ty2
ccaaaauaauaaaaaucgg

SEQ ID NO: 1755720 - RNA, 20 nt, Salmonella enterica enterica serovar Typhi Ty2
ccaaaauccagggaaaccau

SEQ ID NO: 1755721 - RNA, 17 nt, Salmonella enterica enterica serovar Typhi Ty2
cagggauauacaaauau

SEQ ID NO: 1755722 - RNA, 17 nt, Salmonella enterica enterica serovar Typhi Ty2
cagggauaugcugaucu

SEQ ID NO: 1755723 - RNA, 22 nt, Salmonella enterica enterica serovar Typhi Ty2
cagggauauuccauacaguggc

SEQ ID NO: 1755724 - RNA, 19 nt, Salmonella enterica enterica serovar Typhi Ty2
cagguaauacaggguuugu

SEQ ID NO: 1755725 - RNA, 15 nt, Salmonella enterica enterica serovar Typhi Ty2
cagguaaucaucacc

SEQ ID NO: 1755726 - RNA, 22 nt, Salmonella enterica enterica serovar Typhi Ty2
cagguaacauaucgacauaagu

SEQ ID NO: 1755727 - RNA, 20 nt, Salmonella enterica enterica serovar Typhi Ty2
cagguaacgacuacuuccag

SEQ ID NO: 1755728 - RNA, 22 nt, Salmonella enterica enterica serovar Typhi Ty2
cagguacgcguuucacaaccuc

SEQ ID NO: 1755729 - RNA, 15 nt, Salmonella enterica enterica serovar Typhi Ty2
cagguaccccgccac

SEQ ID NO: 1755730 - RNA, 14 nt, Salmonella enterica enterica serovar Typhi Ty2
cagguagcagaccg

SEQ ID NO: 1755731 - RNA, 18 nt, Salmonella enterica enterica serovar Typhi Ty2
cagguauuaaauacagag

SEQ ID NO: 1755732 - RNA, 16 nt, Salmonella enterica enterica serovar Typhi Ty2
cagguauuaaauacag

SEQ ID NO: 1755733 - RNA, 13 nt, Salmonella enterica enterica serovar Typhi Ty2
cagguauuaaaua

SEQ ID NO: 1755734 - RNA, 17 nt, Salmonella enterica enterica serovar Typhi Ty2
cagguaguugucggcgg

SEQ ID NO: 1755735 - RNA, 19 nt, Salmonella enterica enterica serovar Typhi Ty2
cagguagcgccuuuacugg

SEQ ID NO: 1755736 - RNA, 20 nt, Salmonella enterica enterica serovar Typhi Ty2
cagguauucuaacugaucag

SEQ ID NO: 1755737 - RNA, 15 nt, Salmonella enterica enterica serovar Typhi Ty2
caggugacgaagauc

SEQ ID NO: 1755738 - RNA, 14 nt, Salmonella enterica enterica serovar Typhi Ty2
caggugaacauuac

SEQ ID NO: 1755739 - RNA, 21 nt, Salmonella enterica enterica serovar Typhi Ty2
caggucuauugccuaaauaac

SEQ ID NO: 1755740 - RNA, 14 nt, Salmonella enterica enterica serovar Typhi Ty2
caggucugagauaa

SEQ ID NO: 1755741 - RNA, 15 nt, Salmonella enterica enterica serovar Typhi Ty2
caggucgaugauuuu

SEQ ID NO: 1755742 - RNA, 18 nt, Salmonella enterica enterica serovar Typhi Ty2
caggucgcccagccauaa

SEQ ID NO: 1755743 - RNA, 17 nt, Salmonella enterica enterica serovar Typhi Ty2
cagguuuacccugauuu

SEQ ID NO: 1755744 - RNA, 19 nt, Salmonella enterica enterica serovar Typhi Ty2
cagguuuaaacgaacgaga

SEQ ID NO: 1755745 - RNA, 20 nt, Salmonella enterica enterica serovar Typhi Ty2
cagguuguccugauagcaau

SEQ ID NO: 1755746 - RNA, 14 nt, Salmonella enterica enterica serovar Typhi Ty2
cagguugugcaucu

SEQ ID NO: 1755747 - RNA, 23 nt, Salmonella enterica enterica serovar Typhi Ty2
cagguuucaucgccgauuccugc

SEQ ID NO: 1755748 - RNA, 13 nt, Salmonella enterica enterica serovar Typhi Ty2
cagguuucaucgc

SEQ ID NO: 1755749 - RNA, 20 nt, Salmonella enterica enterica serovar Typhi Ty2
cagguuuacguagcagcgcg

SEQ ID NO: 1755750 - RNA, 20 nt, Salmonella enterica enterica serovar Typhi Ty2
caguaaauuaaacagcugua

SEQ ID NO: 1755751 - RNA, 12 nt, Salmonella enterica enterica serovar Typhi Ty2
caguaacacccg

SEQ ID NO: 1755752 - RNA, 16 nt, Salmonella enterica enterica serovar Typhi Ty2
caguaacacccgcgcc

SEQ ID NO: 1755753 - RNA, 19 nt, Salmonella enterica enterica serovar Typhi Ty2
caguaacaucgaaugucga

SEQ ID NO: 1755754 - RNA, 20 nt, Salmonella enterica enterica serovar Typhi Ty2
caguaaaucccgcaucaccc

SEQ ID NO: 1755755 - RNA, 17 nt, Salmonella enterica enterica serovar Typhi Ty2
caguaaccgccacagca

SEQ ID NO: 1755756 - RNA, 16 nt, Salmonella enterica enterica serovar Typhi Ty2
caguaaccgccacagc

SEQ ID NO: 1755757 - RNA, 15 nt, Salmonella enterica enterica serovar Typhi Ty2
caguaacgcacuuuu

SEQ ID NO: 1755758 - RNA, 22 nt, Salmonella enterica enterica serovar Typhi Ty2
caguaaucaccgucuccggcgc

SEQ ID NO: 1755759 - RNA, 22 nt, Salmonella enterica enterica serovar Typhi Ty2
caguaaucccggucgcgccagc

SEQ ID NO: 1755760 - RNA, 17 nt, Salmonella enterica enterica serovar Typhi Ty2
caguaauaugaauugau

SEQ ID NO: 1755761 - RNA, 15 nt, Salmonella enterica enterica serovar Typhi Ty2
caguaauccggcaac

SEQ ID NO: 1755762 - RNA, 12 nt, Salmonella enterica enterica serovar Typhi Ty2
cagguuaaccca

SEQ ID NO: 1755763 - RNA, 15 nt, Salmonella enterica enterica serovar Typhi Ty2
cagguuacucuucca

SEQ ID NO: 1755764 - RNA, 15 nt, Salmonella enterica enterica serovar Typhi Ty2
cagguuauacuguga

SEQ ID NO: 1755765 - RNA, 15 nt, Salmonella enterica enterica serovar Typhi Ty2
cagguucgaaucccg

SEQ ID NO: 1755766 - RNA, 19 nt, Salmonella enterica enterica serovar Typhi Ty2
caguacguaacggaaaagc

SEQ ID NO: 1755767 - RNA, 20 nt, Salmonella enterica enterica serovar Typhi Ty2
caguagccgccgcaggacag

SEQ ID NO: 1755768 - RNA, 16 nt, Salmonella enterica enterica serovar Typhi Ty2
caguagcgcgacgcca

SEQ ID NO: 1755769 - RNA, 17 nt, Salmonella enterica enterica serovar Typhi Ty2
caguaucguguuauuuu

SEQ ID NO: 1755770 - RNA, 19 nt, Salmonella enterica enterica serovar Typhi Ty2
caguacggaugauguacag

SEQ ID NO: 1755771 - RNA, 17 nt, Salmonella enterica enterica serovar Typhi Ty2
caguacgcgcgcggcgu

SEQ ID NO: 1755772 - RNA, 17 nt, Salmonella enterica enterica serovar Typhi Ty2
caguacgaucaugaguc

SEQ ID NO: 1755773 - RNA, 17 nt, Salmonella enterica enterica serovar Typhi Ty2
caguacgcgaccgccgc

SEQ ID NO: 1755774 - RNA, 17 nt, Salmonella enterica enterica serovar Typhi Ty2
caguacaaacaaauaaa

SEQ ID NO: 1755775 - RNA, 15 nt, Salmonella enterica enterica serovar Typhi Ty2
caguacaaacaaaua

SEQ ID NO: 1755776 - RNA, 16 nt, Salmonella enterica enterica serovar Typhi Ty2
caguacaaacaaauaa

SEQ ID NO: 1755777 - RNA, 23 nt, Salmonella enterica enterica serovar Typhi Ty2
caguaauuuuucucccagcagac

SEQ ID NO: 1755778 - RNA, 21 nt, Salmonella enterica enterica serovar Typhi Ty2
caguacaaacaaauaaaucca

SEQ ID NO: 1755779 - RNA, 15 nt, Salmonella enterica enterica serovar Typhi Ty2
caguaccuucaacgc

SEQ ID NO: 1755780 - RNA, 14 nt, Salmonella enterica enterica serovar Typhi Ty2
caguccccuuuuca

SEQ ID NO: 1755781 - RNA, 23 nt, Salmonella enterica enterica serovar Typhi Ty2
caguccccagcguaccacgccgc

SEQ ID NO: 1755782 - RNA, 19 nt, Salmonella enterica enterica serovar Typhi Ty2
cagucccaaugcggaaacc

SEQ ID NO: 1755783 - RNA, 23 nt, Salmonella enterica enterica serovar Typhi Ty2
caguccagcgcggguucuuucca

SEQ ID NO: 1755784 - RNA, 17 nt, Salmonella enterica enterica serovar Typhi Ty2
cagucauucucuuucug

SEQ ID NO: 1755785 - RNA, 22 nt, Salmonella enterica enterica serovar Typhi Ty2
caguaugaucaugcccggcaaa

SEQ ID NO: 1755786 - RNA, 14 nt, Salmonella enterica enterica serovar Typhi Ty2
caguuucaucaucg

SEQ ID NO: 1755787 - RNA, 16 nt, Salmonella enterica enterica serovar Typhi Ty2
caguucuaacaggaag

SEQ ID NO: 1755788 - RNA, 14 nt, Salmonella enterica enterica serovar Typhi Ty2
caguucguucugcg

SEQ ID NO: 1755789 - RNA, 15 nt, Salmonella enterica enterica serovar Typhi Ty2
caguuucgccagcgc

SEQ ID NO: 1755790 - RNA, 14 nt, Salmonella enterica enterica serovar Typhi Ty2
caguuugcgaaaag

SEQ ID NO: 1755791 - RNA, 15 nt, Salmonella enterica enterica serovar Typhi Ty2
caguuugcgaaaagc

SEQ ID NO: 1755792 - RNA, 16 nt, Salmonella enterica enterica serovar Typhi Ty2
caguuugguaauacua

SEQ ID NO: 1755793 - RNA, 18 nt, Salmonella enterica enterica serovar Typhi Ty2
caguuuguaaccaacaaa

SEQ ID NO: 1755794 - RNA, 16 nt, Salmonella enterica enterica serovar Typhi Ty2
cauaaagcgucuuaga

SEQ ID NO: 1755795 - RNA, 15 nt, Salmonella enterica enterica serovar Typhi Ty2
caguuuuuauaacua

SEQ ID NO: 1755796 - RNA, 15 nt, Salmonella enterica enterica serovar Typhi Ty2
caguuuuuccuuucu

SEQ ID NO: 1755797 - RNA, 19 nt, Salmonella enterica enterica serovar Typhi Ty2
caguuuugaucgaaucucc

SEQ ID NO: 1755798 - RNA, 17 nt, Salmonella enterica enterica serovar Typhi Ty2
caguuuuugcauuauau

SEQ ID NO: 1755799 - RNA, 12 nt, Salmonella enterica enterica serovar Typhi Ty2
caguuuuuccuu

SEQ ID NO: 1755800 - RNA, 15 nt, Salmonella enterica enterica serovar Typhi Ty2
caguuuuugaacaua

SEQ ID NO: 1755801 - RNA, 12 nt, Salmonella enterica enterica serovar Typhi Ty2
cauaaaaccauu

SEQ ID NO: 1755802 - RNA, 19 nt, Salmonella enterica enterica serovar Typhi Ty2
caguuuuuugaccauucca

SEQ ID NO: 1755803 - RNA, 22 nt, Salmonella enterica enterica serovar Typhi Ty2
cauaagugauacaugcuacagg

SEQ ID NO: 1755804 - RNA, 15 nt, Salmonella enterica enterica serovar Typhi Ty2
cauaaguaaauaaca

SEQ ID NO: 1755805 - RNA, 17 nt, Salmonella enterica enterica serovar Typhi Ty2
cauaauaaugacuaauu

SEQ ID NO: 1755806 - RNA, 23 nt, Salmonella enterica enterica serovar Typhi Ty2
cauaauaagcgcucaggcagcca

SEQ ID NO: 1755807 - RNA, 17 nt, Salmonella enterica enterica serovar Typhi Ty2
cauaauaaacugcaucc

SEQ ID NO: 1755808 - RNA, 20 nt, Salmonella enterica enterica serovar Typhi Ty2
cauaaauacaauucaacuca

SEQ ID NO: 1755809 - RNA, 18 nt, Salmonella enterica enterica serovar Typhi Ty2
cauaaagucagacaagua

SEQ ID NO: 1755810 - RNA, 15 nt, Salmonella enterica enterica serovar Typhi Ty2
cauaagcaaauccuc

SEQ ID NO: 1755811 - RNA, 14 nt, Salmonella enterica enterica serovar Typhi Ty2
cauaagcaauaggu

SEQ ID NO: 1755812 - RNA, 15 nt, Salmonella enterica enterica serovar Typhi Ty2
cauaagcaaacagug

SEQ ID NO: 1755813 - RNA, 21 nt, Salmonella enterica enterica serovar Typhi Ty2
cauaagcacaccauuucacaa

SEQ ID NO: 1755814 - RNA, 23 nt, Salmonella enterica enterica serovar Typhi Ty2
cauaagcaaauccucgucaaggu

SEQ ID NO: 1755815 - RNA, 14 nt, Salmonella enterica enterica serovar Typhi Ty2
cauaagccaguccu

SEQ ID NO: 1755816 - RNA, 19 nt, Salmonella enterica enterica serovar Typhi Ty2
cauaaggguaagcaauaug

SEQ ID NO: 1755817 - RNA, 14 nt, Salmonella enterica enterica serovar Typhi Ty2
cauaagcgcggcgg

SEQ ID NO: 1755818 - RNA, 15 nt, Salmonella enterica enterica serovar Typhi Ty2
cauaagcgcggcgga

SEQ ID NO: 1755819 - RNA, 21 nt, Salmonella enterica enterica serovar Typhi Ty2
cauaagcuuaggauaagaaua

SEQ ID NO: 1755820 - RNA, 22 nt, Salmonella enterica enterica serovar Typhi Ty2
cauaagccgcguucugucgaua

SEQ ID NO: 1755821 - RNA, 15 nt, Salmonella enterica enterica serovar Typhi Ty2
caguccgcccgccuc

SEQ ID NO: 1755822 - RNA, 20 nt, Salmonella enterica enterica serovar Typhi Ty2
cagucccugaagaaaaggaa

SEQ ID NO: 1755823 - RNA, 24 nt, Salmonella enterica enterica serovar Typhi Ty2
cagucccugaagaaaaggaaugcc

SEQ ID NO: 1755824 - RNA, 23 nt, Salmonella enterica enterica serovar Typhi Ty2
caguccgguacgacgacccuuuu

SEQ ID NO: 1755825 - RNA, 18 nt, Salmonella enterica enterica serovar Typhi Ty2
caguccuccggcugaagc

SEQ ID NO: 1755826 - RNA, 22 nt, Salmonella enterica enterica serovar Typhi Ty2
caguccuccggcugaagcccca

SEQ ID NO: 1755827 - RNA, 23 nt, Salmonella enterica enterica serovar Typhi Ty2
caguccgggccgugacacauuug

SEQ ID NO: 1755828 - RNA, 22 nt, Salmonella enterica enterica serovar Typhi Ty2
caguccggaugucucagcgcau

SEQ ID NO: 1755829 - RNA, 24 nt, Salmonella enterica enterica serovar Typhi Ty2
cagugauuacaaaaugugcaauca

SEQ ID NO: 1755830 - RNA, 21 nt, Salmonella enterica enterica serovar Typhi Ty2
cagugccaguccgguauaaaa

SEQ ID NO: 1755831 - RNA, 17 nt, Salmonella enterica enterica serovar Typhi Ty2
cagugauuaugcucccg

SEQ ID NO: 1755832 - RNA, 15 nt, Salmonella enterica enterica serovar Typhi Ty2
cagugauuacaaaau

SEQ ID NO: 1755833 - RNA, 22 nt, Salmonella enterica enterica serovar Typhi Ty2
cagugauccaucgguucucugc

SEQ ID NO: 1755834 - RNA, 20 nt, Salmonella enterica enterica serovar Typhi Ty2
cagugggcgucaaaaucccg

SEQ ID NO: 1755835 - RNA, 18 nt, Salmonella enterica enterica serovar Typhi Ty2
caguggcuuuaacgucag

SEQ ID NO: 1755836 - RNA, 22 nt, Salmonella enterica enterica serovar Typhi Ty2
caguggucguuagccagauggc

SEQ ID NO: 1755837 - RNA, 23 nt, Salmonella enterica enterica serovar Typhi Ty2
caguggcuuaccguaugcaaaag

SEQ ID NO: 1755838 - RNA, 20 nt, Salmonella enterica enterica serovar Typhi Ty2
caguggcuuuaacgucagca

SEQ ID NO: 1755839 - RNA, 18 nt, Salmonella enterica enterica serovar Typhi Ty2
cagugcuaaaauuauaca

SEQ ID NO: 1755840 - RNA, 16 nt, Salmonella enterica enterica serovar Typhi Ty2
cagugcgauaccggcc

SEQ ID NO: 1755841 - RNA, 18 nt, Salmonella enterica enterica serovar Typhi Ty2
caguucauccacgucaua

SEQ ID NO: 1755842 - RNA, 20 nt, Salmonella enterica enterica serovar Typhi Ty2
caguucacgacugauagguu

SEQ ID NO: 1755843 - RNA, 23 nt, Salmonella enterica enterica serovar Typhi Ty2
caguucagcagcaccacucccca

SEQ ID NO: 1755844 - RNA, 18 nt, Salmonella enterica enterica serovar Typhi Ty2
caguucauaagucaucca

SEQ ID NO: 1755845 - RNA, 14 nt, Salmonella enterica enterica serovar Typhi Ty2
caguucagccgcca

SEQ ID NO: 1755846 - RNA, 18 nt, Salmonella enterica enterica serovar Typhi Ty2
caguuauuuuacgggcgu

SEQ ID NO: 1755847 - RNA, 14 nt, Salmonella enterica enterica serovar Typhi Ty2
caguuauuuuuuuu

SEQ ID NO: 1755848 - RNA, 20 nt, Salmonella enterica enterica serovar Typhi Ty2
caguucaaacggcccggcgu

SEQ ID NO: 1755849 - RNA, 16 nt, Salmonella enterica enterica serovar Typhi Ty2
caguucaccggcggcc

SEQ ID NO: 1755850 - RNA, 20 nt, Salmonella enterica enterica serovar Typhi Ty2
caguucacuccuaagagaaa

SEQ ID NO: 1755851 - RNA, 21 nt, Salmonella enterica enterica serovar Typhi Ty2
caguucacuccuaagagaaaa

SEQ ID NO: 1755852 - RNA, 24 nt, Salmonella enterica enterica serovar Typhi Ty2
caguuauuaaucaagcccagcuca

SEQ ID NO: 1755853 - RNA, 22 nt, Salmonella enterica enterica serovar Typhi Ty2
caguuauuaaucaagcccagcu

SEQ ID NO: 1755854 - RNA, 16 nt, Salmonella enterica enterica serovar Typhi Ty2
caguuagcgaaacagu

SEQ ID NO: 1755855 - RNA, 19 nt, Salmonella enterica enterica serovar Typhi Ty2
cagugguggcuauagcuca

SEQ ID NO: 1755856 - RNA, 21 nt, Salmonella enterica enterica serovar Typhi Ty2
caguuaacgcguaaucuucca

SEQ ID NO: 1755857 - RNA, 18 nt, Salmonella enterica enterica serovar Typhi Ty2
caguucgccuucuucauc

SEQ ID NO: 1755858 - RNA, 14 nt, Salmonella enterica enterica serovar Typhi Ty2
caguucggcaaagc

SEQ ID NO: 1755859 - RNA, 21 nt, Salmonella enterica enterica serovar Typhi Ty2
caguucggcgauuuccagcgc

SEQ ID NO: 1755860 - RNA, 23 nt, Salmonella enterica enterica serovar Typhi Ty2
caguucggcgauuuccagcgccg

SEQ ID NO: 1755861 - RNA, 14 nt, Salmonella enterica enterica serovar Typhi Ty2
caguuccccgccgc

SEQ ID NO: 1755862 - RNA, 15 nt, Salmonella enterica enterica serovar Typhi Ty2
caguuccccgccgcg

SEQ ID NO: 1755863 - RNA, 20 nt, Salmonella enterica enterica serovar Typhi Ty2
caguuccaccguaugugcgc

SEQ ID NO: 1755864 - RNA, 16 nt, Salmonella enterica enterica serovar Typhi Ty2
caggccuguaaaccgc

SEQ ID NO: 1755865 - RNA, 16 nt, Salmonella enterica enterica serovar Typhi Ty2
caggccugagccgaac

SEQ ID NO: 1755866 - RNA, 20 nt, Salmonella enterica enterica serovar Typhi Ty2
caggccugauaagcacaggc

SEQ ID NO: 1755867 - RNA, 22 nt, Salmonella enterica enterica serovar Typhi Ty2
caggccugauaagcacaggcca

SEQ ID NO: 1755868 - RNA, 23 nt, Salmonella enterica enterica serovar Typhi Ty2
caggccugacuccggguaacgga

SEQ ID NO: 1755869 - RNA, 19 nt, Salmonella enterica enterica serovar Typhi Ty2
caggccugccugaucgcca

SEQ ID NO: 1755870 - RNA, 16 nt, Salmonella enterica enterica serovar Typhi Ty2
caggcgaccgggcaga

SEQ ID NO: 1755871 - RNA, 13 nt, Salmonella enterica enterica serovar Typhi Ty2
caggcgacgccgc

SEQ ID NO: 1755872 - RNA, 17 nt, Salmonella enterica enterica serovar Typhi Ty2
caggcgaccagaugcag

SEQ ID NO: 1755873 - RNA, 16 nt, Salmonella enterica enterica serovar Typhi Ty2
caggccuuucggcagc

SEQ ID NO: 1755874 - RNA, 19 nt, Salmonella enterica enterica serovar Typhi Ty2
caggcgacggaaacgcugu

SEQ ID NO: 1755875 - RNA, 17 nt, Salmonella enterica enterica serovar Typhi Ty2
caggcgacgccgccauc

SEQ ID NO: 1755876 - RNA, 18 nt, Salmonella enterica enterica serovar Typhi Ty2
caggcgauccuguucaaa

SEQ ID NO: 1755877 - RNA, 20 nt, Salmonella enterica enterica serovar Typhi Ty2
caggcgauagccguccaugu

SEQ ID NO: 1755878 - RNA, 24 nt, Salmonella enterica enterica serovar Typhi Ty2
caggcgcagagugagcaggcuaug

SEQ ID NO: 1755879 - RNA, 19 nt, Salmonella enterica enterica serovar Typhi Ty2
caggcgauucggacucaua

SEQ ID NO: 1755880 - RNA, 19 nt, Salmonella enterica enterica serovar Typhi Ty2
caggcggaugaaacagucc

SEQ ID NO: 1755881 - RNA, 18 nt, Salmonella enterica enterica serovar Typhi Ty2
caggcguaagaucccagg

SEQ ID NO: 1755882 - RNA, 18 nt, Salmonella enterica enterica serovar Typhi Ty2
caggcgucauagccgcgc

SEQ ID NO: 1755883 - RNA, 22 nt, Salmonella enterica enterica serovar Typhi Ty2
caggcugccgacaacgccuccu

SEQ ID NO: 1755884 - RNA, 18 nt, Salmonella enterica enterica serovar Typhi Ty2
caggcugaacccugccug

SEQ ID NO: 1755885 - RNA, 14 nt, Salmonella enterica enterica serovar Typhi Ty2
caggcugugcaaca

SEQ ID NO: 1755886 - RNA, 23 nt, Salmonella enterica enterica serovar Typhi Ty2
caggcuguugaggaaauucugac

SEQ ID NO: 1755887 - RNA, 14 nt, Salmonella enterica enterica serovar Typhi Ty2
caggcugucgcggc

SEQ ID NO: 1755888 - RNA, 16 nt, Salmonella enterica enterica serovar Typhi Ty2
caggcugucgcggcgg

SEQ ID NO: 1755889 - RNA, 15 nt, Salmonella enterica enterica serovar Typhi Ty2
caggcuuuucaggcu

SEQ ID NO: 1755890 - RNA, 15 nt, Salmonella enterica enterica serovar Typhi Ty2
caggcuugccgcgcc

SEQ ID NO: 1755891 - RNA, 21 nt, Salmonella enterica enterica serovar Typhi Ty2
caggcuugccgcgccagacgc

SEQ ID NO: 1755892 - RNA, 19 nt, Salmonella enterica enterica serovar Typhi Ty2
caggcuuuaaauucagcac

SEQ ID NO: 1755893 - RNA, 15 nt, Salmonella enterica enterica serovar Typhi Ty2
caggaugccaaccac

SEQ ID NO: 1755894 - RNA, 13 nt, Salmonella enterica enterica serovar Typhi Ty2
caggaucuuuuuc

SEQ ID NO: 1755895 - RNA, 14 nt, Salmonella enterica enterica serovar Typhi Ty2
caggaucuuuuuca

SEQ ID NO: 1755896 - RNA, 19 nt, Salmonella enterica enterica serovar Typhi Ty2
caggaucaaaaucgcgccc

SEQ ID NO: 1755897 - RNA, 18 nt, Salmonella enterica enterica serovar Typhi Ty2
caggauauacuucaucag

SEQ ID NO: 1755898 - RNA, 16 nt, Salmonella enterica enterica serovar Typhi Ty2
caggaucaauucugau

SEQ ID NO: 1755899 - RNA, 15 nt, Salmonella enterica enterica serovar Typhi Ty2
caggauacagccgac

SEQ ID NO: 1755900 - RNA, 15 nt, Salmonella enterica enterica serovar Typhi Ty2
caggaaccgccgaug

SEQ ID NO: 1755901 - RNA, 15 nt, Salmonella enterica enterica serovar Typhi Ty2
caggauaauaaugau

SEQ ID NO: 1755902 - RNA, 14 nt, Salmonella enterica enterica serovar Typhi Ty2
caggaaaucuucca

SEQ ID NO: 1755903 - RNA, 14 nt, Salmonella enterica enterica serovar Typhi Ty2
caggaacagauacu

SEQ ID NO: 1755904 - RNA, 20 nt, Salmonella enterica enterica serovar Typhi Ty2
caggaaauccagcagaauaa

SEQ ID NO: 1755905 - RNA, 18 nt, Salmonella enterica enterica serovar Typhi Ty2
caggcauaaaaaagagga

SEQ ID NO: 1755906 - RNA, 16 nt, Salmonella enterica enterica serovar Typhi Ty2
caggcauaauggaacu

SEQ ID NO: 1755907 - RNA, 20 nt, Salmonella enterica enterica serovar Typhi Ty2
caggcacgggugccuguucu

SEQ ID NO: 1755908 - RNA, 16 nt, Salmonella enterica enterica serovar Typhi Ty2
caggcacgccugugcu

SEQ ID NO: 1755909 - RNA, 19 nt, Salmonella enterica enterica serovar Typhi Ty2
caggcacagaagcgccugu

SEQ ID NO: 1755910 - RNA, 18 nt, Salmonella enterica enterica serovar Typhi Ty2
caggcacagaagcgccug

SEQ ID NO: 1755911 - RNA, 11 nt, Salmonella enterica enterica serovar Typhi Ty2
caggaugcuga

SEQ ID NO: 1755912 - RNA, 22 nt, Salmonella enterica enterica serovar Typhi Ty2
caggcaagacacagcgucgcgc

SEQ ID NO: 1755913 - RNA, 17 nt, Salmonella enterica enterica serovar Typhi Ty2
caggcaagacgcaugac

SEQ ID NO: 1755914 - RNA, 18 nt, Salmonella enterica enterica serovar Typhi Ty2
caggcaaaaggccuuuuu

SEQ ID NO: 1755915 - RNA, 16 nt, Salmonella enterica enterica serovar Typhi Ty2
caggcccaugaucagg

SEQ ID NO: 1755916 - RNA, 13 nt, Salmonella enterica enterica serovar Typhi Ty2
caggcccagccgc

SEQ ID NO: 1755917 - RNA, 15 nt, Salmonella enterica enterica serovar Typhi Ty2
caggcccagccgcuc

SEQ ID NO: 1755918 - RNA, 18 nt, Salmonella enterica enterica serovar Typhi Ty2
caggcccaguaccauuga

SEQ ID NO: 1755919 - RNA, 21 nt, Salmonella enterica enterica serovar Typhi Ty2
caggccaugcgccgcgucagc

SEQ ID NO: 1755920 - RNA, 16 nt, Salmonella enterica enterica serovar Typhi Ty2
caggccaugcgccgcg

SEQ ID NO: 1755921 - RNA, 19 nt, Salmonella enterica enterica serovar Typhi Ty2
caggccaucauugauacug

SEQ ID NO: 1755922 - RNA, 22 nt, Salmonella enterica enterica serovar Typhi Ty2
caggccaugcgccgcgucagca

SEQ ID NO: 1755923 - RNA, 12 nt, Salmonella enterica enterica serovar Typhi Ty2
caggcccagccg

SEQ ID NO: 1755924 - RNA, 15 nt, Salmonella enterica enterica serovar Typhi Ty2
caggcauuaaaaaaa

SEQ ID NO: 1755925 - RNA, 20 nt, Salmonella enterica enterica serovar Typhi Ty2
caggcauguugcgcaaucac

SEQ ID NO: 1755926 - RNA, 20 nt, Salmonella enterica enterica serovar Typhi Ty2
caggcaucuuccagcgucgg

SEQ ID NO: 1755927 - RNA, 20 nt, Salmonella enterica enterica serovar Typhi Ty2
caggcauugauaaagcgcuc

SEQ ID NO: 1755928 - RNA, 15 nt, Salmonella enterica enterica serovar Typhi Ty2
caggcauugucaccu

SEQ ID NO: 1755929 - RNA, 19 nt, Salmonella enterica enterica serovar Typhi Ty2
caggcauccgugaccugcu

SEQ ID NO: 1755930 - RNA, 17 nt, Salmonella enterica enterica serovar Typhi Ty2
caggcauccugcccugg

SEQ ID NO: 1755931 - RNA, 17 nt, Salmonella enterica enterica serovar Typhi Ty2
caggcauccgugaccug

SEQ ID NO: 1755932 - RNA, 23 nt, Salmonella enterica enterica serovar Typhi Ty2
caggcauagaaaaagaacugcaa

SEQ ID NO: 1755933 - RNA, 23 nt, Salmonella enterica enterica serovar Typhi Ty2
caggccaagcgccuguucaacau

SEQ ID NO: 1755934 - RNA, 18 nt, Salmonella enterica enterica serovar Typhi Ty2
caggccaauuccgccaua

SEQ ID NO: 1755935 - RNA, 20 nt, Salmonella enterica enterica serovar Typhi Ty2
caggccaacguaguuauugu

SEQ ID NO: 1755936 - RNA, 16 nt, Salmonella enterica enterica serovar Typhi Ty2
caggccaagcagcgcc

SEQ ID NO: 1755937 - RNA, 14 nt, Salmonella enterica enterica serovar Typhi Ty2
caggccaacauagc

SEQ ID NO: 1755938 - RNA, 21 nt, Salmonella enterica enterica serovar Typhi Ty2
caggccaaaaccacagugacc

SEQ ID NO: 1755939 - RNA, 21 nt, Salmonella enterica enterica serovar Typhi Ty2
caggccaaacccugcgccgca

SEQ ID NO: 1755940 - RNA, 13 nt, Salmonella enterica enterica serovar Typhi Ty2
caggaaaaacaug

SEQ ID NO: 1755941 - RNA, 17 nt, Salmonella enterica enterica serovar Typhi Ty2
caggaaaaacugucccu

SEQ ID NO: 1755942 - RNA, 19 nt, Salmonella enterica enterica serovar Typhi Ty2
cagcuuuucauuuguuccu

SEQ ID NO: 1755943 - RNA, 15 nt, Salmonella enterica enterica serovar Typhi Ty2
cagcuuuugcgcguu

SEQ ID NO: 1755944 - RNA, 22 nt, Salmonella enterica enterica serovar Typhi Ty2
caggaaagagccgcgcagcgca

SEQ ID NO: 1755945 - RNA, 16 nt, Salmonella enterica enterica serovar Typhi Ty2
caggaaagagccgcgc

SEQ ID NO: 1755946 - RNA, 21 nt, Salmonella enterica enterica serovar Typhi Ty2
caggaaaccgguaaaggcgac

SEQ ID NO: 1755947 - RNA, 14 nt, Salmonella enterica enterica serovar Typhi Ty2
caggaaaagaccau

SEQ ID NO: 1755948 - RNA, 19 nt, Salmonella enterica enterica serovar Typhi Ty2
cagcuuuaaugcuuuccag

SEQ ID NO: 1755949 - RNA, 18 nt, Salmonella enterica enterica serovar Typhi Ty2
cagcuuguuuacgcccuc

SEQ ID NO: 1755950 - RNA, 14 nt, Salmonella enterica enterica serovar Typhi Ty2
cagcuuguuuacgc

SEQ ID NO: 1755951 - RNA, 14 nt, Salmonella enterica enterica serovar Typhi Ty2
cagcuuggcggcuu

SEQ ID NO: 1755952 - RNA, 22 nt, Salmonella enterica enterica serovar Typhi Ty2
cagcugguuaaccaccucauua

SEQ ID NO: 1755953 - RNA, 17 nt, Salmonella enterica enterica serovar Typhi Ty2
cagcugguuaaccaccu

SEQ ID NO: 1755954 - RNA, 21 nt, Salmonella enterica enterica serovar Typhi Ty2
cagcuuccugcacgccugcuu

SEQ ID NO: 1755955 - RNA, 15 nt, Salmonella enterica enterica serovar Typhi Ty2
cagcugggccugcuc

SEQ ID NO: 1755956 - RNA, 17 nt, Salmonella enterica enterica serovar Typhi Ty2
cagcugggccugcuccg

SEQ ID NO: 1755957 - RNA, 20 nt, Salmonella enterica enterica serovar Typhi Ty2
cagcuucgcugcgcgggcgu

SEQ ID NO: 1755958 - RNA, 22 nt, Salmonella enterica enterica serovar Typhi Ty2
cagcuucgcugcgcgggcgucu

SEQ ID NO: 1755959 - RNA, 14 nt, Salmonella enterica enterica serovar Typhi Ty2
cagcuucugauacu

SEQ ID NO: 1755960 - RNA, 20 nt, Salmonella enterica enterica serovar Typhi Ty2
cagcucacgcgccagcacca

SEQ ID NO: 1755961 - RNA, 17 nt, Salmonella enterica enterica serovar Typhi Ty2
cagcucacgcgccagca

SEQ ID NO: 1755962 - RNA, 18 nt, Salmonella enterica enterica serovar Typhi Ty2
cagcuccuuuuaauaaag

SEQ ID NO: 1755963 - RNA, 16 nt, Salmonella enterica enterica serovar Typhi Ty2
cagcucguuauuuccg

SEQ ID NO: 1755964 - RNA, 13 nt, Salmonella enterica enterica serovar Typhi Ty2
cagcucuuuucug

SEQ ID NO: 1755965 - RNA, 18 nt, Salmonella enterica enterica serovar Typhi Ty2
cagcucuuuaggcaggaa

SEQ ID NO: 1755966 - RNA, 14 nt, Salmonella enterica enterica serovar Typhi Ty2
cagcucuucaggcg

SEQ ID NO: 1755967 - RNA, 22 nt, Salmonella enterica enterica serovar Typhi Ty2
cagcucugccgguugaccggcc

SEQ ID NO: 1755968 - RNA, 17 nt, Salmonella enterica enterica serovar Typhi Ty2
cagcugacgacgccagc

SEQ ID NO: 1755969 - RNA, 18 nt, Salmonella enterica enterica serovar Typhi Ty2
cagcugaaacagaauaaa

SEQ ID NO: 1755970 - RNA, 21 nt, Salmonella enterica enterica serovar Typhi Ty2
cagcgggugaucgcuugccac

SEQ ID NO: 1755971 - RNA, 15 nt, Salmonella enterica enterica serovar Typhi Ty2
cagcgguaugcaccu

SEQ ID NO: 1755972 - RNA, 23 nt, Salmonella enterica enterica serovar Typhi Ty2
cacugauauaccguccagacucc

SEQ ID NO: 1755973 - RNA, 17 nt, Salmonella enterica enterica serovar Typhi Ty2
cacugagcgcgccauga

SEQ ID NO: 1755974 - RNA, 18 nt, Salmonella enterica enterica serovar Typhi Ty2
cacugagcugugauaaaa

SEQ ID NO: 1755975 - RNA, 17 nt, Salmonella enterica enterica serovar Typhi Ty2
cacugagcuucaccgcc

SEQ ID NO: 1755976 - RNA, 16 nt, Salmonella enterica enterica serovar Typhi Ty2
cagcgucccggcgucu

SEQ ID NO: 1755977 - RNA, 16 nt, Salmonella enterica enterica serovar Typhi Ty2
cagcgucgacagcccc

SEQ ID NO: 1755978 - RNA, 13 nt, Salmonella enterica enterica serovar Typhi Ty2
cagcgucauuaaa

SEQ ID NO: 1755979 - RNA, 18 nt, Salmonella enterica enterica serovar Typhi Ty2
cagcgucagcagaguguc

SEQ ID NO: 1755980 - RNA, 16 nt, Salmonella enterica enterica serovar Typhi Ty2
cagcgucaccucuuuc

SEQ ID NO: 1755981 - RNA, 23 nt, Salmonella enterica enterica serovar Typhi Ty2
cagcgguuacuuuugaacauaaa

SEQ ID NO: 1755982 - RNA, 18 nt, Salmonella enterica enterica serovar Typhi Ty2
cagcguaaaacuuuucug

SEQ ID NO: 1755983 - RNA, 15 nt, Salmonella enterica enterica serovar Typhi Ty2
cagcgguuugccggu

SEQ ID NO: 1755984 - RNA, 18 nt, Salmonella enterica enterica serovar Typhi Ty2
cagcguacaauggcaggc

SEQ ID NO: 1755985 - RNA, 22 nt, Salmonella enterica enterica serovar Typhi Ty2
cagcguaaucggcaggccaacg

SEQ ID NO: 1755986 - RNA, 22 nt, Salmonella enterica enterica serovar Typhi Ty2
cagcguaaugcgccaggcagca

SEQ ID NO: 1755987 - RNA, 17 nt, Salmonella enterica enterica serovar Typhi Ty2
cagcguaccacgccgca

SEQ ID NO: 1755988 - RNA, 20 nt, Salmonella enterica enterica serovar Typhi Ty2
cagcguacaggcggaaauca

SEQ ID NO: 1755989 - RNA, 22 nt, Salmonella enterica enterica serovar Typhi Ty2
cagcguugcguguuguacagca

SEQ ID NO: 1755990 - RNA, 20 nt, Salmonella enterica enterica serovar Typhi Ty2
cagcguguucaugcgcggcg

SEQ ID NO: 1755991 - RNA, 13 nt, Salmonella enterica enterica serovar Typhi Ty2
cagcguuuccagc

SEQ ID NO: 1755992 - RNA, 15 nt, Salmonella enterica enterica serovar Typhi Ty2
cagcguuuugcgcuc

SEQ ID NO: 1755993 - RNA, 19 nt, Salmonella enterica enterica serovar Typhi Ty2
cagcuaaaaccguagauuu

SEQ ID NO: 1755994 - RNA, 15 nt, Salmonella enterica enterica serovar Typhi Ty2
cagcuaauuuuacuu

SEQ ID NO: 1755995 - RNA, 14 nt, Salmonella enterica enterica serovar Typhi Ty2
cagcgucgcuuugg

SEQ ID NO: 1755996 - RNA, 15 nt, Salmonella enterica enterica serovar Typhi Ty2
cagcgucggugaaga

SEQ ID NO: 1755997 - RNA, 16 nt, Salmonella enterica enterica serovar Typhi Ty2
cagcgucucagcaggc

SEQ ID NO: 1755998 - RNA, 17 nt, Salmonella enterica enterica serovar Typhi Ty2
cagcgucuauagaugau

SEQ ID NO: 1755999 - RNA, 18 nt, Salmonella enterica enterica serovar Typhi Ty2
cagcgucuauagaugaua

SEQ ID NO: 1756000 - RNA, 22 nt, Salmonella enterica enterica serovar Typhi Ty2
cagcgucugccccaaacgcuca

SEQ ID NO: 1756001 - RNA, 14 nt, Salmonella enterica enterica serovar Typhi Ty2
cagcgucuguuuca

SEQ ID NO: 1756002 - RNA, 22 nt, Salmonella enterica enterica serovar Typhi Ty2
cagcguggugacgguugagagg

SEQ ID NO: 1756003 - RNA, 22 nt, Salmonella enterica enterica serovar Typhi Ty2
cagcgugaaacgcccuucccag

SEQ ID NO: 1756004 - RNA, 15 nt, Salmonella enterica enterica serovar Typhi Ty2
cauguaccauuguca

SEQ ID NO: 1756005 - RNA, 17 nt, Salmonella enterica enterica serovar Typhi Ty2
cauguaaauaaggcugc

SEQ ID NO: 1756006 - RNA, 20 nt, Salmonella enterica enterica serovar Typhi Ty2
cauguaaccaaagcaccauu

SEQ ID NO: 1756007 - RNA, 19 nt, Salmonella enterica enterica serovar Typhi Ty2
cauguacaacuucaugagu

SEQ ID NO: 1756008 - RNA, 20 nt, Salmonella enterica enterica serovar Typhi Ty2
cauggcgucggcgacuuuca

SEQ ID NO: 1756009 - RNA, 19 nt, Salmonella enterica enterica serovar Typhi Ty2
cauguaaacuccauuaaau

SEQ ID NO: 1756010 - RNA, 14 nt, Salmonella enterica enterica serovar Typhi Ty2
cauguaaacuccau

SEQ ID NO: 1756011 - RNA, 14 nt, Salmonella enterica enterica serovar Typhi Ty2
cauggcuaaaagaa

SEQ ID NO: 1756012 - RNA, 19 nt, Salmonella enterica enterica serovar Typhi Ty2
caugguugacuuacaaaaa

SEQ ID NO: 1756013 - RNA, 22 nt, Salmonella enterica enterica serovar Typhi Ty2
caugguugacuuacaaaaaaua

SEQ ID NO: 1756014 - RNA, 14 nt, Salmonella enterica enterica serovar Typhi Ty2
cauguccccaggug

SEQ ID NO: 1756015 - RNA, 23 nt, Salmonella enterica enterica serovar Typhi Ty2
cauguccgauagcauuauugcca

SEQ ID NO: 1756016 - RNA, 23 nt, Salmonella enterica enterica serovar Typhi Ty2
cauguccggcgacuccagaauau

SEQ ID NO: 1756017 - RNA, 22 nt, Salmonella enterica enterica serovar Typhi Ty2
cauguggccagcggccagccau

SEQ ID NO: 1756018 - RNA, 16 nt, Salmonella enterica enterica serovar Typhi Ty2
caugugguaggcuuca

SEQ ID NO: 1756019 - RNA, 20 nt, Salmonella enterica enterica serovar Typhi Ty2
cauggcgcauuaucgauuug

SEQ ID NO: 1756020 - RNA, 15 nt, Salmonella enterica enterica serovar Typhi Ty2
caugcuucucaaaga

SEQ ID NO: 1756021 - RNA, 16 nt, Salmonella enterica enterica serovar Typhi Ty2
caugcugccauuuuau

SEQ ID NO: 1756022 - RNA, 21 nt, Salmonella enterica enterica serovar Typhi Ty2
caugcugcaccgcaucaaacu

SEQ ID NO: 1756023 - RNA, 22 nt, Salmonella enterica enterica serovar Typhi Ty2
caugcuguauaaacucagcaau

SEQ ID NO: 1756024 - RNA, 19 nt, Salmonella enterica enterica serovar Typhi Ty2
caugcucauccaacugcgc

SEQ ID NO: 1756025 - RNA, 16 nt, Salmonella enterica enterica serovar Typhi Ty2
caugcucaugaaggca

SEQ ID NO: 1756026 - RNA, 15 nt, Salmonella enterica enterica serovar Typhi Ty2
caugccgcugcuggc

SEQ ID NO: 1756027 - RNA, 14 nt, Salmonella enterica enterica serovar Typhi Ty2
caugccgcccaggc

SEQ ID NO: 1756028 - RNA, 15 nt, Salmonella enterica enterica serovar Typhi Ty2
caugccgccacuucg

SEQ ID NO: 1756029 - RNA, 15 nt, Salmonella enterica enterica serovar Typhi Ty2
caugcuauucagcag

SEQ ID NO: 1756030 - RNA, 21 nt, Salmonella enterica enterica serovar Typhi Ty2
caugcuacaggcaaguuuaau

SEQ ID NO: 1756031 - RNA, 19 nt, Salmonella enterica enterica serovar Typhi Ty2
caugcuacaggcaaguuua

SEQ ID NO: 1756032 - RNA, 17 nt, Salmonella enterica enterica serovar Typhi Ty2
caugcuacaggcaaguu

SEQ ID NO: 1756033 - RNA, 22 nt, Salmonella enterica enterica serovar Typhi Ty2
caugccacaacagaagcggccu

SEQ ID NO: 1756034 - RNA, 13 nt, Salmonella enterica enterica serovar Typhi Ty2
caugccagaagca

SEQ ID NO: 1756035 - RNA, 14 nt, Salmonella enterica enterica serovar Typhi Ty2
caugccgccaaacu

SEQ ID NO: 1756036 - RNA, 18 nt, Salmonella enterica enterica serovar Typhi Ty2
caugccgaccagggcauc

SEQ ID NO: 1756037 - RNA, 21 nt, Salmonella enterica enterica serovar Typhi Ty2
caugccauaaucgauauaauu

SEQ ID NO: 1756038 - RNA, 18 nt, Salmonella enterica enterica serovar Typhi Ty2
caugccauacuccugccu

SEQ ID NO: 1756039 - RNA, 19 nt, Salmonella enterica enterica serovar Typhi Ty2
caugauaguaucgcugcua

SEQ ID NO: 1756040 - RNA, 16 nt, Salmonella enterica enterica serovar Typhi Ty2
caugaucauacugccg

SEQ ID NO: 1756041 - RNA, 18 nt, Salmonella enterica enterica serovar Typhi Ty2
caugauacccagcguccc

SEQ ID NO: 1756042 - RNA, 21 nt, Salmonella enterica enterica serovar Typhi Ty2
caugaucauacugccgccgug

SEQ ID NO: 1756043 - RNA, 16 nt, Salmonella enterica enterica serovar Typhi Ty2
caugaucgccgccauc

SEQ ID NO: 1756044 - RNA, 19 nt, Salmonella enterica enterica serovar Typhi Ty2
caugaucucuugcauaaua

SEQ ID NO: 1756045 - RNA, 23 nt, Salmonella enterica enterica serovar Typhi Ty2
caugagucgcgcgcgccagucau

SEQ ID NO: 1756046 - RNA, 13 nt, Salmonella enterica enterica serovar Typhi Ty2
caugagaagaaaa

SEQ ID NO: 1756047 - RNA, 17 nt, Salmonella enterica enterica serovar Typhi Ty2
caugcauuaaugggcga

SEQ ID NO: 1756048 - RNA, 15 nt, Salmonella enterica enterica serovar Typhi Ty2
caugcagcucaagcg

SEQ ID NO: 1756049 - RNA, 15 nt, Salmonella enterica enterica serovar Typhi Ty2
caugaugaucuucag

SEQ ID NO: 1756050 - RNA, 13 nt, Salmonella enterica enterica serovar Typhi Ty2
caugaugaagaua

SEQ ID NO: 1756051 - RNA, 23 nt, Salmonella enterica enterica serovar Typhi Ty2
caugaugccacgagaaauccaca

SEQ ID NO: 1756052 - RNA, 20 nt, Salmonella enterica enterica serovar Typhi Ty2
caugauggcgaacagcccca

SEQ ID NO: 1756053 - RNA, 17 nt, Salmonella enterica enterica serovar Typhi Ty2
caugauggugaacagaa

SEQ ID NO: 1756054 - RNA, 22 nt, Salmonella enterica enterica serovar Typhi Ty2
caugauucuugcggauuaucgu

SEQ ID NO: 1756055 - RNA, 13 nt, Salmonella enterica enterica serovar Typhi Ty2
caugacauccaug

SEQ ID NO: 1756056 - RNA, 14 nt, Salmonella enterica enterica serovar Typhi Ty2
caugaccaccagcg

SEQ ID NO: 1756057 - RNA, 16 nt, Salmonella enterica enterica serovar Typhi Ty2
caugaccagcgccgcg

SEQ ID NO: 1756058 - RNA, 17 nt, Salmonella enterica enterica serovar Typhi Ty2
caugacaauaacggccu

SEQ ID NO: 1756059 - RNA, 14 nt, Salmonella enterica enterica serovar Typhi Ty2
caugaccauucaca

SEQ ID NO: 1756060 - RNA, 18 nt, Salmonella enterica enterica serovar Typhi Ty2
caugaccauccacgggcu

SEQ ID NO: 1756061 - RNA, 14 nt, Salmonella enterica enterica serovar Typhi Ty2
caugacucuuguuu

SEQ ID NO: 1756062 - RNA, 18 nt, Salmonella enterica enterica serovar Typhi Ty2
caugacuuuuuucaaccu

SEQ ID NO: 1756063 - RNA, 24 nt, Salmonella enterica enterica serovar Typhi Ty2
caugaagauggucuguaccaccag

SEQ ID NO: 1756064 - RNA, 13 nt, Salmonella enterica enterica serovar Typhi Ty2
caucucuccgcgu

SEQ ID NO: 1756065 - RNA, 15 nt, Salmonella enterica enterica serovar Typhi Ty2
caucucuggcggcgu

SEQ ID NO: 1756066 - RNA, 14 nt, Salmonella enterica enterica serovar Typhi Ty2
cauuuccgcagcca

SEQ ID NO: 1756067 - RNA, 14 nt, Salmonella enterica enterica serovar Typhi Ty2
cauuucagucuaau

SEQ ID NO: 1756068 - RNA, 12 nt, Salmonella enterica enterica serovar Typhi Ty2
cauuucaugacc

SEQ ID NO: 1756069 - RNA, 18 nt, Salmonella enterica enterica serovar Typhi Ty2
cauuucaggcaaaggaau

SEQ ID NO: 1756070 - RNA, 19 nt, Salmonella enterica enterica serovar Typhi Ty2
cauuucagcgcagaauuua

SEQ ID NO: 1756071 - RNA, 16 nt, Salmonella enterica enterica serovar Typhi Ty2
cauuucacuauaaaaa

SEQ ID NO: 1756072 - RNA, 15 nt, Salmonella enterica enterica serovar Typhi Ty2
cauuucacuuguucu

SEQ ID NO: 1756073 - RNA, 20 nt, Salmonella enterica enterica serovar Typhi Ty2
cauuucacgauacuguugca

SEQ ID NO: 1756074 - RNA, 15 nt, Salmonella enterica enterica serovar Typhi Ty2
cauuuaugccgccau

SEQ ID NO: 1756075 - RNA, 23 nt, Salmonella enterica enterica serovar Typhi Ty2
cauuucaaucgccaccacauuca

SEQ ID NO: 1756076 - RNA, 13 nt, Salmonella enterica enterica serovar Typhi Ty2
cauuucaaucgcc

SEQ ID NO: 1756077 - RNA, 19 nt, Salmonella enterica enterica serovar Typhi Ty2
cauuguauuucagggaaaa

SEQ ID NO: 1756078 - RNA, 12 nt, Salmonella enterica enterica serovar Typhi Ty2
cauugucaaaaa

SEQ ID NO: 1756079 - RNA, 17 nt, Salmonella enterica enterica serovar Typhi Ty2
cauuuacgccagccaga

SEQ ID NO: 1756080 - RNA, 16 nt, Salmonella enterica enterica serovar Typhi Ty2
cauuuaccuuucccca

SEQ ID NO: 1756081 - RNA, 22 nt, Salmonella enterica enterica serovar Typhi Ty2
cauugcgcucuaucgccgcccg

SEQ ID NO: 1756082 - RNA, 18 nt, Salmonella enterica enterica serovar Typhi Ty2
cauuggggaaccuggcag

SEQ ID NO: 1756083 - RNA, 18 nt, Salmonella enterica enterica serovar Typhi Ty2
cauuggcgucugcuggcc

SEQ ID NO: 1756084 - RNA, 14 nt, Salmonella enterica enterica serovar Typhi Ty2
cauuguaaaaccga

SEQ ID NO: 1756085 - RNA, 18 nt, Salmonella enterica enterica serovar Typhi Ty2
cauugccccagcccugcu

SEQ ID NO: 1756086 - RNA, 15 nt, Salmonella enterica enterica serovar Typhi Ty2
cauugccccucccug

SEQ ID NO: 1756087 - RNA, 19 nt, Salmonella enterica enterica serovar Typhi Ty2
cauugccauguuaauacca

SEQ ID NO: 1756088 - RNA, 13 nt, Salmonella enterica enterica serovar Typhi Ty2
cauugccacccau

SEQ ID NO: 1756089 - RNA, 23 nt, Salmonella enterica enterica serovar Typhi Ty2
cauucgggacaaacccccagcca

SEQ ID NO: 1756090 - RNA, 22 nt, Salmonella enterica enterica serovar Typhi Ty2
cauucgggacaaacccccagcc

SEQ ID NO: 1756091 - RNA, 16 nt, Salmonella enterica enterica serovar Typhi Ty2
cauucgcuugcccggc

SEQ ID NO: 1756092 - RNA, 14 nt, Salmonella enterica enterica serovar Typhi Ty2
cauucgcuccucag

SEQ ID NO: 1756093 - RNA, 15 nt, Salmonella enterica enterica serovar Typhi Ty2
cauucgguaguucca

SEQ ID NO: 1756094 - RNA, 19 nt, Salmonella enterica enterica serovar Typhi Ty2
cauucuuuaaaaugacuca

SEQ ID NO: 1756095 - RNA, 23 nt, Salmonella enterica enterica serovar Typhi Ty2
cauucuuugcuuuguaaagcgcc

SEQ ID NO: 1756096 - RNA, 15 nt, Salmonella enterica enterica serovar Typhi Ty2
cauuauaaauaucau

SEQ ID NO: 1756097 - RNA, 16 nt, Salmonella enterica enterica serovar Typhi Ty2
cauuaccuggcaacau

SEQ ID NO: 1756098 - RNA, 21 nt, Salmonella enterica enterica serovar Typhi Ty2
cauguucaugaaccacgccaa

SEQ ID NO: 1756099 - RNA, 19 nt, Salmonella enterica enterica serovar Typhi Ty2
cauguguggguaggguugc

SEQ ID NO: 1756100 - RNA, 22 nt, Salmonella enterica enterica serovar Typhi Ty2
cauguuaauaccagcgccaauc

SEQ ID NO: 1756101 - RNA, 22 nt, Salmonella enterica enterica serovar Typhi Ty2
cauguuaauugucagcucuuug

SEQ ID NO: 1756102 - RNA, 14 nt, Salmonella enterica enterica serovar Typhi Ty2
cauuaugcuggguu

SEQ ID NO: 1756103 - RNA, 20 nt, Salmonella enterica enterica serovar Typhi Ty2
cauuauuaaauuaacaccca

SEQ ID NO: 1756104 - RNA, 17 nt, Salmonella enterica enterica serovar Typhi Ty2
cauuauauagucuuaau

SEQ ID NO: 1756105 - RNA, 17 nt, Salmonella enterica enterica serovar Typhi Ty2
cauuauugaucucuuca

SEQ ID NO: 1756106 - RNA, 19 nt, Salmonella enterica enterica serovar Typhi Ty2
cauucaacgcaucaaauac

SEQ ID NO: 1756107 - RNA, 20 nt, Salmonella enterica enterica serovar Typhi Ty2
cauuauuuuagugaaaaaau

SEQ ID NO: 1756108 - RNA, 18 nt, Salmonella enterica enterica serovar Typhi Ty2
cauuauuuuuaaauaacu

SEQ ID NO: 1756109 - RNA, 16 nt, Salmonella enterica enterica serovar Typhi Ty2
cauuauuuuuaaauaa

SEQ ID NO: 1756110 - RNA, 17 nt, Salmonella enterica enterica serovar Typhi Ty2
cauuauuuuuaaauaac

SEQ ID NO: 1756111 - RNA, 18 nt, Salmonella enterica enterica serovar Typhi Ty2
cauuccuuuagcuuccag

SEQ ID NO: 1756112 - RNA, 16 nt, Salmonella enterica enterica serovar Typhi Ty2
cauucgaauccuccug

SEQ ID NO: 1756113 - RNA, 17 nt, Salmonella enterica enterica serovar Typhi Ty2
cauuccuuuagcuucca

SEQ ID NO: 1756114 - RNA, 23 nt, Salmonella enterica enterica serovar Typhi Ty2
cauucgcagcaaaaucuucuggc

SEQ ID NO: 1756115 - RNA, 18 nt, Salmonella enterica enterica serovar Typhi Ty2
cauucgcccgcaauguuu

SEQ ID NO: 1756116 - RNA, 16 nt, Salmonella enterica enterica serovar Typhi Ty2
cauucgcgcacggcgc

SEQ ID NO: 1756117 - RNA, 17 nt, Salmonella enterica enterica serovar Typhi Ty2
cauucccguaaaagaag

SEQ ID NO: 1756118 - RNA, 16 nt, Salmonella enterica enterica serovar Typhi Ty2
cauucccgccaauaac

SEQ ID NO: 1756119 - RNA, 22 nt, Salmonella enterica enterica serovar Typhi Ty2
cauuccgcgcaaauacugaaau

SEQ ID NO: 1756120 - RNA, 19 nt, Salmonella enterica enterica serovar Typhi Ty2
cauucauugucuuuuucuc

SEQ ID NO: 1756121 - RNA, 16 nt, Salmonella enterica enterica serovar Typhi Ty2
cauucauugccgccag

SEQ ID NO: 1756122 - RNA, 12 nt, Salmonella enterica enterica serovar Typhi Ty2
cauuccagaccu

SEQ ID NO: 1756123 - RNA, 12 nt, Salmonella enterica enterica serovar Typhi Ty2
cauuccagccgg

SEQ ID NO: 1756124 - RNA, 13 nt, Salmonella enterica enterica serovar Typhi Ty2
cauucacgccacc

SEQ ID NO: 1756125 - RNA, 20 nt, Salmonella enterica enterica serovar Typhi Ty2
cauucacccaauaaauaaua

SEQ ID NO: 1756126 - RNA, 20 nt, Salmonella enterica enterica serovar Typhi Ty2
cauucagcggcugcgccugc

SEQ ID NO: 1756127 - RNA, 17 nt, Salmonella enterica enterica serovar Typhi Ty2
cauucaggccucugcuu

SEQ ID NO: 1756128 - RNA, 18 nt, Salmonella enterica enterica serovar Typhi Ty2
cauucaggccucugcuuu

SEQ ID NO: 1756129 - RNA, 14 nt, Salmonella enterica enterica serovar Typhi Ty2
cauucaggcuuucc

SEQ ID NO: 1756130 - RNA, 14 nt, Salmonella enterica enterica serovar Typhi Ty2
cauucauaaaagau

SEQ ID NO: 1756131 - RNA, 17 nt, Salmonella enterica enterica serovar Typhi Ty2
cauagaguaucgccugu

SEQ ID NO: 1756132 - RNA, 13 nt, Salmonella enterica enterica serovar Typhi Ty2
cauagauaacuau

SEQ ID NO: 1756133 - RNA, 17 nt, Salmonella enterica enterica serovar Typhi Ty2
cauagauauaacccagu

SEQ ID NO: 1756134 - RNA, 19 nt, Salmonella enterica enterica serovar Typhi Ty2
cauagcagaguacuggaau

SEQ ID NO: 1756135 - RNA, 14 nt, Salmonella enterica enterica serovar Typhi Ty2
cauagccgccaccc

SEQ ID NO: 1756136 - RNA, 19 nt, Salmonella enterica enterica serovar Typhi Ty2
cauagcgcgaaugauuuua

SEQ ID NO: 1756137 - RNA, 14 nt, Salmonella enterica enterica serovar Typhi Ty2
cauagcgccuucag

SEQ ID NO: 1756138 - RNA, 15 nt, Salmonella enterica enterica serovar Typhi Ty2
cauagcgcgaaugau

SEQ ID NO: 1756139 - RNA, 20 nt, Salmonella enterica enterica serovar Typhi Ty2
cauagcggacuaaauuccug

SEQ ID NO: 1756140 - RNA, 22 nt, Salmonella enterica enterica serovar Typhi Ty2
cauagccguggcuggcgucccg

SEQ ID NO: 1756141 - RNA, 13 nt, Salmonella enterica enterica serovar Typhi Ty2
cauagccuaauga

SEQ ID NO: 1756142 - RNA, 22 nt, Salmonella enterica enterica serovar Typhi Ty2
cauagccggcgauagcgcccca

SEQ ID NO: 1756143 - RNA, 23 nt, Salmonella enterica enterica serovar Typhi Ty2
cauaauggcgacgccuucaguca

SEQ ID NO: 1756144 - RNA, 19 nt, Salmonella enterica enterica serovar Typhi Ty2
cauaauggaacugccuggc

SEQ ID NO: 1756145 - RNA, 16 nt, Salmonella enterica enterica serovar Typhi Ty2
cauacaaagagaaaau

SEQ ID NO: 1756146 - RNA, 16 nt, Salmonella enterica enterica serovar Typhi Ty2
cauaauuuuugccuuu

SEQ ID NO: 1756147 - RNA, 21 nt, Salmonella enterica enterica serovar Typhi Ty2
cauaauugcugcccgccgccg

SEQ ID NO: 1756148 - RNA, 17 nt, Salmonella enterica enterica serovar Typhi Ty2
cauaauuguucagcuac

SEQ ID NO: 1756149 - RNA, 20 nt, Salmonella enterica enterica serovar Typhi Ty2
cauagacgcccugcaaagca

SEQ ID NO: 1756150 - RNA, 17 nt, Salmonella enterica enterica serovar Typhi Ty2
cauagaaaucagcaggu

SEQ ID NO: 1756151 - RNA, 16 nt, Salmonella enterica enterica serovar Typhi Ty2
cauagaaauagccccg

SEQ ID NO: 1756152 - RNA, 17 nt, Salmonella enterica enterica serovar Typhi Ty2
cauagaaccacuuauuu

SEQ ID NO: 1756153 - RNA, 16 nt, Salmonella enterica enterica serovar Typhi Ty2
cauagaacgcuugucu

SEQ ID NO: 1756154 - RNA, 18 nt, Salmonella enterica enterica serovar Typhi Ty2
cauaguacccucugcacc

SEQ ID NO: 1756155 - RNA, 19 nt, Salmonella enterica enterica serovar Typhi Ty2
cauaggcuuugcugagcgc

SEQ ID NO: 1756156 - RNA, 18 nt, Salmonella enterica enterica serovar Typhi Ty2
cauagcguuaucuggucg

SEQ ID NO: 1756157 - RNA, 18 nt, Salmonella enterica enterica serovar Typhi Ty2
cauagcgucaucaacaua

SEQ ID NO: 1756158 - RNA, 16 nt, Salmonella enterica enterica serovar Typhi Ty2
cauagcguugauaugc

SEQ ID NO: 1756159 - RNA, 17 nt, Salmonella enterica enterica serovar Typhi Ty2
cauaggccggcgaagau

SEQ ID NO: 1756160 - RNA, 19 nt, Salmonella enterica enterica serovar Typhi Ty2
cauauagcagcagucucua

SEQ ID NO: 1756161 - RNA, 19 nt, Salmonella enterica enterica serovar Typhi Ty2
cauauaccgcaccugggua

SEQ ID NO: 1756162 - RNA, 16 nt, Salmonella enterica enterica serovar Typhi Ty2
cauaguuuuuccccau

SEQ ID NO: 1756163 - RNA, 15 nt, Salmonella enterica enterica serovar Typhi Ty2
cauaguuugcauaac

SEQ ID NO: 1756164 - RNA, 18 nt, Salmonella enterica enterica serovar Typhi Ty2
cauaguuugcucaggcuc

SEQ ID NO: 1756165 - RNA, 11 nt, Salmonella enterica enterica serovar Typhi Ty2
cauauuccugc

SEQ ID NO: 1756166 - RNA, 20 nt, Salmonella enterica enterica serovar Typhi Ty2
cauauuccagaagcgcuuug

SEQ ID NO: 1756167 - RNA, 22 nt, Salmonella enterica enterica serovar Typhi Ty2
cauauuccagccacacgacggu

SEQ ID NO: 1756168 - RNA, 13 nt, Salmonella enterica enterica serovar Typhi Ty2
cauauucaugguu

SEQ ID NO: 1756169 - RNA, 12 nt, Salmonella enterica enterica serovar Typhi Ty2
cauaucgaauga

SEQ ID NO: 1756170 - RNA, 20 nt, Salmonella enterica enterica serovar Typhi Ty2
cauaucgcagaccauccaug

SEQ ID NO: 1756171 - RNA, 17 nt, Salmonella enterica enterica serovar Typhi Ty2
cauauccgacagauagu

SEQ ID NO: 1756172 - RNA, 20 nt, Salmonella enterica enterica serovar Typhi Ty2
cauauucuuugcgccuuauu

SEQ ID NO: 1756173 - RNA, 23 nt, Salmonella enterica enterica serovar Typhi Ty2
cauauucgguagcuguaccagau

SEQ ID NO: 1756174 - RNA, 16 nt, Salmonella enterica enterica serovar Typhi Ty2
cauauucgucuucauc

SEQ ID NO: 1756175 - RNA, 20 nt, Salmonella enterica enterica serovar Typhi Ty2
cauauugcgacaacuagaau

SEQ ID NO: 1756176 - RNA, 14 nt, Salmonella enterica enterica serovar Typhi Ty2
cauauugcgccgca

SEQ ID NO: 1756177 - RNA, 16 nt, Salmonella enterica enterica serovar Typhi Ty2
cauauuguguuuuuua

SEQ ID NO: 1756178 - RNA, 17 nt, Salmonella enterica enterica serovar Typhi Ty2
caucaaaguuauuuacc

SEQ ID NO: 1756179 - RNA, 20 nt, Salmonella enterica enterica serovar Typhi Ty2
caucaaucgcuaucugacag

SEQ ID NO: 1756180 - RNA, 23 nt, Salmonella enterica enterica serovar Typhi Ty2
caucaaucacuacggguuuuugu

SEQ ID NO: 1756181 - RNA, 13 nt, Salmonella enterica enterica serovar Typhi Ty2
caucaaugcccag

SEQ ID NO: 1756182 - RNA, 13 nt, Salmonella enterica enterica serovar Typhi Ty2
caucaaucaccuu

SEQ ID NO: 1756183 - RNA, 18 nt, Salmonella enterica enterica serovar Typhi Ty2
caucaauacccggccccu

SEQ ID NO: 1756184 - RNA, 11 nt, Salmonella enterica enterica serovar Typhi Ty2
caucaauagca

SEQ ID NO: 1756185 - RNA, 19 nt, Salmonella enterica enterica serovar Typhi Ty2
caucacuaccauuuccggc

SEQ ID NO: 1756186 - RNA, 14 nt, Salmonella enterica enterica serovar Typhi Ty2
caucacguccuccc

SEQ ID NO: 1756187 - RNA, 22 nt, Salmonella enterica enterica serovar Typhi Ty2
caucaccaguugcgaagccacu

SEQ ID NO: 1756188 - RNA, 18 nt, Salmonella enterica enterica serovar Typhi Ty2
caucacaaugaccucuuu

SEQ ID NO: 1756189 - RNA, 16 nt, Salmonella enterica enterica serovar Typhi Ty2
caucaauuugaaaagg

SEQ ID NO: 1756190 - RNA, 20 nt, Salmonella enterica enterica serovar Typhi Ty2
caucaauucuuuaauuugug

SEQ ID NO: 1756191 - RNA, 22 nt, Salmonella enterica enterica serovar Typhi Ty2
caucaaugcccagcgcaaucac

SEQ ID NO: 1756192 - RNA, 15 nt, Salmonella enterica enterica serovar Typhi Ty2
caucacagccacacu

SEQ ID NO: 1756193 - RNA, 18 nt, Salmonella enterica enterica serovar Typhi Ty2
caucagcgcuaccagcgc

SEQ ID NO: 1756194 - RNA, 20 nt, Salmonella enterica enterica serovar Typhi Ty2
caucagacuacuuuuacccu

SEQ ID NO: 1756195 - RNA, 17 nt, Salmonella enterica enterica serovar Typhi Ty2
caucagaccgauaaaua

SEQ ID NO: 1756196 - RNA, 19 nt, Salmonella enterica enterica serovar Typhi Ty2
caucagcaaaauaccggca

SEQ ID NO: 1756197 - RNA, 23 nt, Salmonella enterica enterica serovar Typhi Ty2
caucagcaauuucucgcccgcca

SEQ ID NO: 1756198 - RNA, 22 nt, Salmonella enterica enterica serovar Typhi Ty2
caucagacuacuuuuacccuuc

SEQ ID NO: 1756199 - RNA, 17 nt, Salmonella enterica enterica serovar Typhi Ty2
caucagaccgccaagcg

SEQ ID NO: 1756200 - RNA, 18 nt, Salmonella enterica enterica serovar Typhi Ty2
caucagaccgauaaauac

SEQ ID NO: 1756201 - RNA, 17 nt, Salmonella enterica enterica serovar Typhi Ty2
caucagaaugcugguca

SEQ ID NO: 1756202 - RNA, 13 nt, Salmonella enterica enterica serovar Typhi Ty2
caucacuuccauc

SEQ ID NO: 1756203 - RNA, 21 nt, Salmonella enterica enterica serovar Typhi Ty2
caucagaaaaaagccaagcac

SEQ ID NO: 1756204 - RNA, 15 nt, Salmonella enterica enterica serovar Typhi Ty2
caucacuuuuggcga

SEQ ID NO: 1756205 - RNA, 21 nt, Salmonella enterica enterica serovar Typhi Ty2
caucacuuuaugaccauacug

SEQ ID NO: 1756206 - RNA, 18 nt, Salmonella enterica enterica serovar Typhi Ty2
caucucgguuaugaccaa

SEQ ID NO: 1756207 - RNA, 16 nt, Salmonella enterica enterica serovar Typhi Ty2
caucucaucuugcagg

SEQ ID NO: 1756208 - RNA, 15 nt, Salmonella enterica enterica serovar Typhi Ty2
caucucaucggcuuu

SEQ ID NO: 1756209 - RNA, 22 nt, Salmonella enterica enterica serovar Typhi Ty2
caucucaauaucguugccgccg

SEQ ID NO: 1756210 - RNA, 20 nt, Salmonella enterica enterica serovar Typhi Ty2
caucuaacacaaauucgcua

SEQ ID NO: 1756211 - RNA, 16 nt, Salmonella enterica enterica serovar Typhi Ty2
caucgugagcgcguca

SEQ ID NO: 1756212 - RNA, 14 nt, Salmonella enterica enterica serovar Typhi Ty2
caucgugauaaacg

SEQ ID NO: 1756213 - RNA, 23 nt, Salmonella enterica enterica serovar Typhi Ty2
caucgugauagacggcugaaugu

SEQ ID NO: 1756214 - RNA, 19 nt, Salmonella enterica enterica serovar Typhi Ty2
caucgugguuaauacauca

SEQ ID NO: 1756215 - RNA, 22 nt, Salmonella enterica enterica serovar Typhi Ty2
caucguguauaccaaaaauaau

SEQ ID NO: 1756216 - RNA, 21 nt, Salmonella enterica enterica serovar Typhi Ty2
caucguuacccauuaccuggc

SEQ ID NO: 1756217 - RNA, 22 nt, Salmonella enterica enterica serovar Typhi Ty2
caucggcacacuuucgcccggc

SEQ ID NO: 1756218 - RNA, 15 nt, Salmonella enterica enterica serovar Typhi Ty2
caucggcacagcgug

SEQ ID NO: 1756219 - RNA, 21 nt, Salmonella enterica enterica serovar Typhi Ty2
caucggcacguaguaaugcau

SEQ ID NO: 1756220 - RNA, 12 nt, Salmonella enterica enterica serovar Typhi Ty2
caucggccucgc

SEQ ID NO: 1756221 - RNA, 13 nt, Salmonella enterica enterica serovar Typhi Ty2
caucggcaucaaa

SEQ ID NO: 1756222 - RNA, 17 nt, Salmonella enterica enterica serovar Typhi Ty2
caucguaccaauaccca

SEQ ID NO: 1756223 - RNA, 18 nt, Salmonella enterica enterica serovar Typhi Ty2
cauccugcggguucaucg

SEQ ID NO: 1756224 - RNA, 16 nt, Salmonella enterica enterica serovar Typhi Ty2
cauccuguaccaccac

SEQ ID NO: 1756225 - RNA, 14 nt, Salmonella enterica enterica serovar Typhi Ty2
caucgauuuuucau

SEQ ID NO: 1756226 - RNA, 14 nt, Salmonella enterica enterica serovar Typhi Ty2
caucgcaaaauucc

SEQ ID NO: 1756227 - RNA, 20 nt, Salmonella enterica enterica serovar Typhi Ty2
caucgcaaugccaccacacg

SEQ ID NO: 1756228 - RNA, 16 nt, Salmonella enterica enterica serovar Typhi Ty2
caucgcaaugccacca

SEQ ID NO: 1756229 - RNA, 19 nt, Salmonella enterica enterica serovar Typhi Ty2
caucgccacaugcggcagg

SEQ ID NO: 1756230 - RNA, 15 nt, Salmonella enterica enterica serovar Typhi Ty2
caucgccgcggcgcu

SEQ ID NO: 1756231 - RNA, 14 nt, Salmonella enterica enterica serovar Typhi Ty2
caucgccgccgagu

SEQ ID NO: 1756232 - RNA, 20 nt, Salmonella enterica enterica serovar Typhi Ty2
caucgcuggcgcgcgcgccu

SEQ ID NO: 1756233 - RNA, 20 nt, Salmonella enterica enterica serovar Typhi Ty2
caucgcuggucgcuaccaca

SEQ ID NO: 1756234 - RNA, 16 nt, Salmonella enterica enterica serovar Typhi Ty2
caucgcuugcccagca

SEQ ID NO: 1756235 - RNA, 20 nt, Salmonella enterica enterica serovar Typhi Ty2
caucgcuucuauuaccgcag

SEQ ID NO: 1756236 - RNA, 16 nt, Salmonella enterica enterica serovar Typhi Ty2
caucgcuuagcggcuc

SEQ ID NO: 1756237 - RNA, 19 nt, Salmonella enterica enterica serovar Typhi Ty2
caucggcaaacgccgccug

SEQ ID NO: 1756238 - RNA, 14 nt, Salmonella enterica enterica serovar Typhi Ty2
caucggauuauuuu

SEQ ID NO: 1756239 - RNA, 15 nt, Salmonella enterica enterica serovar Typhi Ty2
caucggauagaugaa

SEQ ID NO: 1756240 - RNA, 14 nt, Salmonella enterica enterica serovar Typhi Ty2
caucccggcaacgu

SEQ ID NO: 1756241 - RNA, 21 nt, Salmonella enterica enterica serovar Typhi Ty2
caucccgauaauggcgccgau

SEQ ID NO: 1756242 - RNA, 15 nt, Salmonella enterica enterica serovar Typhi Ty2
caucccgcccagcaa

SEQ ID NO: 1756243 - RNA, 14 nt, Salmonella enterica enterica serovar Typhi Ty2
cauccccggcgccc

SEQ ID NO: 1756244 - RNA, 17 nt, Salmonella enterica enterica serovar Typhi Ty2
cauccauguacuccuga

SEQ ID NO: 1756245 - RNA, 16 nt, Salmonella enterica enterica serovar Typhi Ty2
caucccaugcaccagu

SEQ ID NO: 1756246 - RNA, 14 nt, Salmonella enterica enterica serovar Typhi Ty2
caucccugauuuau

SEQ ID NO: 1756247 - RNA, 20 nt, Salmonella enterica enterica serovar Typhi Ty2
caucccguuuucgucccagc

SEQ ID NO: 1756248 - RNA, 22 nt, Salmonella enterica enterica serovar Typhi Ty2
cauccgaccacggccacagcca

SEQ ID NO: 1756249 - RNA, 15 nt, Salmonella enterica enterica serovar Typhi Ty2
cauccgaccacggcc

SEQ ID NO: 1756250 - RNA, 21 nt, Salmonella enterica enterica serovar Typhi Ty2
cauccggcacgccaucgccug

SEQ ID NO: 1756251 - RNA, 16 nt, Salmonella enterica enterica serovar Typhi Ty2
cauccggcaaacucag

SEQ ID NO: 1756252 - RNA, 15 nt, Salmonella enterica enterica serovar Typhi Ty2
cauccggcaaacuca

SEQ ID NO: 1756253 - RNA, 22 nt, Salmonella enterica enterica serovar Typhi Ty2
cauccggcgauggugcggcgca

SEQ ID NO: 1756254 - RNA, 16 nt, Salmonella enterica enterica serovar Typhi Ty2
cauccggcgcugauga

SEQ ID NO: 1756255 - RNA, 18 nt, Salmonella enterica enterica serovar Typhi Ty2
cauccggcauuuaugcug

SEQ ID NO: 1756256 - RNA, 21 nt, Salmonella enterica enterica serovar Typhi Ty2
cauccugcgccauugcgggag

SEQ ID NO: 1756257 - RNA, 23 nt, Salmonella enterica enterica serovar Typhi Ty2
cauccggcgcugcgcggcgugca

SEQ ID NO: 1756258 - RNA, 17 nt, Salmonella enterica enterica serovar Typhi Ty2
cauccugcaacucaaaa

SEQ ID NO: 1756259 - RNA, 17 nt, Salmonella enterica enterica serovar Typhi Ty2
caucaugucacccacgc

SEQ ID NO: 1756260 - RNA, 14 nt, Salmonella enterica enterica serovar Typhi Ty2
caucauuaauauaa

SEQ ID NO: 1756261 - RNA, 19 nt, Salmonella enterica enterica serovar Typhi Ty2
caucaugcuaaaagcgacu

SEQ ID NO: 1756262 - RNA, 20 nt, Salmonella enterica enterica serovar Typhi Ty2
caucaggaucuucaucccau

SEQ ID NO: 1756263 - RNA, 13 nt, Salmonella enterica enterica serovar Typhi Ty2
caucaggaaugcc

SEQ ID NO: 1756264 - RNA, 18 nt, Salmonella enterica enterica serovar Typhi Ty2
caucauuaauauaauccu

SEQ ID NO: 1756265 - RNA, 16 nt, Salmonella enterica enterica serovar Typhi Ty2
caucauuauuccccuc

SEQ ID NO: 1756266 - RNA, 23 nt, Salmonella enterica enterica serovar Typhi Ty2
caucauuaccuuuuccggcggca

SEQ ID NO: 1756267 - RNA, 17 nt, Salmonella enterica enterica serovar Typhi Ty2
cauccaacugcgccuga

SEQ ID NO: 1756268 - RNA, 18 nt, Salmonella enterica enterica serovar Typhi Ty2
cauccagcagcagcaccg

SEQ ID NO: 1756269 - RNA, 22 nt, Salmonella enterica enterica serovar Typhi Ty2
cauccagcacagguacaggccg

SEQ ID NO: 1756270 - RNA, 14 nt, Salmonella enterica enterica serovar Typhi Ty2
cauccacagcgcca

SEQ ID NO: 1756271 - RNA, 17 nt, Salmonella enterica enterica serovar Typhi Ty2
cauccagcgaaccuucc

SEQ ID NO: 1756272 - RNA, 17 nt, Salmonella enterica enterica serovar Typhi Ty2
cauccagcgcucaauca

SEQ ID NO: 1756273 - RNA, 18 nt, Salmonella enterica enterica serovar Typhi Ty2
cauccagcgucacaggcu

SEQ ID NO: 1756274 - RNA, 16 nt, Salmonella enterica enterica serovar Typhi Ty2
cauccagucagcaauu

SEQ ID NO: 1756275 - RNA, 15 nt, Salmonella enterica enterica serovar Typhi Ty2
cauccagucagcaau

SEQ ID NO: 1756276 - RNA, 22 nt, Salmonella enterica enterica serovar Typhi Ty2
cauccaggguuuaaucacgcca

SEQ ID NO: 1756277 - RNA, 21 nt, Salmonella enterica enterica serovar Typhi Ty2
cauccaggaaguaaauuauuc

SEQ ID NO: 1756278 - RNA, 14 nt, Salmonella enterica enterica serovar Typhi Ty2
cauccagcucaugu

SEQ ID NO: 1756279 - RNA, 14 nt, Salmonella enterica enterica serovar Typhi Ty2
cauccaucaucuau

SEQ ID NO: 1756280 - RNA, 23 nt, Salmonella enterica enterica serovar Typhi Ty2
cauccaguuuauauucuucgccc

SEQ ID NO: 1756281 - RNA, 23 nt, Salmonella enterica enterica serovar Typhi Ty2
caaaauccgccaccgcgcgcaga

SEQ ID NO: 1756282 - RNA, 20 nt, Salmonella enterica enterica serovar Typhi Ty2
caaaaucgcgcuuuauguuu

SEQ ID NO: 1756283 - RNA, 23 nt, Salmonella enterica enterica serovar Typhi Ty2
caaaaucgcgcuuuauguuuaug

SEQ ID NO: 1756284 - RNA, 19 nt, Salmonella enterica enterica serovar Typhi Ty2
caaaaucccggcuggguuc

SEQ ID NO: 1756285 - RNA, 18 nt, Salmonella enterica enterica serovar Typhi Ty2
caaaaucggcuucuccca

SEQ ID NO: 1756286 - RNA, 16 nt, Salmonella enterica enterica serovar Typhi Ty2
caaaaucuuuuucgcu

SEQ ID NO: 1756287 - RNA, 18 nt, Salmonella enterica enterica serovar Typhi Ty2
caaaaugcccuucgaccg

SEQ ID NO: 1756288 - RNA, 16 nt, Salmonella enterica enterica serovar Typhi Ty2
caaaauggaaaauaau

SEQ ID NO: 1756289 - RNA, 19 nt, Salmonella enterica enterica serovar Typhi Ty2
caaaauggcaaguaaaaua

SEQ ID NO: 1756290 - RNA, 22 nt, Salmonella enterica enterica serovar Typhi Ty2
caaaaugugcaaucacacuaca

SEQ ID NO: 1756291 - RNA, 22 nt, Salmonella enterica enterica serovar Typhi Ty2
caaaauuugugguggucauccg

SEQ ID NO: 1756292 - RNA, 15 nt, Salmonella enterica enterica serovar Typhi Ty2
caaaauaagucauau

SEQ ID NO: 1756293 - RNA, 18 nt, Salmonella enterica enterica serovar Typhi Ty2
caaaauaacguuuaaacu

SEQ ID NO: 1756294 - RNA, 18 nt, Salmonella enterica enterica serovar Typhi Ty2
caaaauaacgcuucaccu

SEQ ID NO: 1756295 - RNA, 19 nt, Salmonella enterica enterica serovar Typhi Ty2
caaaauaauacguuuauuc

SEQ ID NO: 1756296 - RNA, 14 nt, Salmonella enterica enterica serovar Typhi Ty2
caaaauacuggccg

SEQ ID NO: 1756297 - RNA, 16 nt, Salmonella enterica enterica serovar Typhi Ty2
caaaaucaaacagaau

SEQ ID NO: 1756298 - RNA, 20 nt, Salmonella enterica enterica serovar Typhi Ty2
caaaaucacgcacacgucug

SEQ ID NO: 1756299 - RNA, 14 nt, Salmonella enterica enterica serovar Typhi Ty2
caaaaucacgcaca

SEQ ID NO: 1756300 - RNA, 17 nt, Salmonella enterica enterica serovar Typhi Ty2
auuuuuauucccgccgc

SEQ ID NO: 1756301 - RNA, 16 nt, Salmonella enterica enterica serovar Typhi Ty2
caaacuauuuuuagcc

SEQ ID NO: 1756302 - RNA, 15 nt, Salmonella enterica enterica serovar Typhi Ty2
caaacggcgccagcu

SEQ ID NO: 1756303 - RNA, 17 nt, Salmonella enterica enterica serovar Typhi Ty2
caaacgucguaaaaccu

SEQ ID NO: 1756304 - RNA, 22 nt, Salmonella enterica enterica serovar Typhi Ty2
caaacuccgcgcuggcaauaaa

SEQ ID NO: 1756305 - RNA, 18 nt, Salmonella enterica enterica serovar Typhi Ty2
caaacucacguuccccag

SEQ ID NO: 1756306 - RNA, 23 nt, Salmonella enterica enterica serovar Typhi Ty2
caaacucacguuccccagcaccg

SEQ ID NO: 1756307 - RNA, 12 nt, Salmonella enterica enterica serovar Typhi Ty2
caaacucagcgg

SEQ ID NO: 1756308 - RNA, 22 nt, Salmonella enterica enterica serovar Typhi Ty2
caaacucgcugccgaccuggcu

SEQ ID NO: 1756309 - RNA, 17 nt, Salmonella enterica enterica serovar Typhi Ty2
caaacucugaaaaaauu

SEQ ID NO: 1756310 - RNA, 19 nt, Salmonella enterica enterica serovar Typhi Ty2
caaacucuuuuucaauaaa

SEQ ID NO: 1756311 - RNA, 21 nt, Salmonella enterica enterica serovar Typhi Ty2
caaacugaaaacgggugaucu

SEQ ID NO: 1756312 - RNA, 19 nt, Salmonella enterica enterica serovar Typhi Ty2
caaacugaaaaucaaauaa

SEQ ID NO: 1756313 - RNA, 17 nt, Salmonella enterica enterica serovar Typhi Ty2
caaacugauaagggccu

SEQ ID NO: 1756314 - RNA, 15 nt, Salmonella enterica enterica serovar Typhi Ty2
caaacgcuggugcug

SEQ ID NO: 1756315 - RNA, 20 nt, Salmonella enterica enterica serovar Typhi Ty2
caaacgcgauacacuccggc

SEQ ID NO: 1756316 - RNA, 14 nt, Salmonella enterica enterica serovar Typhi Ty2
caaacgcgccgcua

SEQ ID NO: 1756317 - RNA, 11 nt, Salmonella enterica enterica serovar Typhi Ty2
caaacgccagc

SEQ ID NO: 1756318 - RNA, 13 nt, Salmonella enterica enterica serovar Typhi Ty2
caaacgccaccgc

SEQ ID NO: 1756319 - RNA, 17 nt, Salmonella enterica enterica serovar Typhi Ty2
caaacgccgauggcgcc

SEQ ID NO: 1756320 - RNA, 17 nt, Salmonella enterica enterica serovar Typhi Ty2
caaaccgcuuucaucau

SEQ ID NO: 1756321 - RNA, 23 nt, Salmonella enterica enterica serovar Typhi Ty2
caaaccgauagcuaucacacaua

SEQ ID NO: 1756322 - RNA, 22 nt, Salmonella enterica enterica serovar Typhi Ty2
caaaccgauagcuaucacacau

SEQ ID NO: 1756323 - RNA, 16 nt, Salmonella enterica enterica serovar Typhi Ty2
caaaccgacccaaaaa

SEQ ID NO: 1756324 - RNA, 14 nt, Salmonella enterica enterica serovar Typhi Ty2
caaacccuuuggca

SEQ ID NO: 1756325 - RNA, 16 nt, Salmonella enterica enterica serovar Typhi Ty2
caaacgauaaaagcuc

SEQ ID NO: 1756326 - RNA, 15 nt, Salmonella enterica enterica serovar Typhi Ty2
caaacgauaaaagcu

SEQ ID NO: 1756327 - RNA, 21 nt, Salmonella enterica enterica serovar Typhi Ty2
caaaccugagcauauaaauaa

SEQ ID NO: 1756328 - RNA, 19 nt, Salmonella enterica enterica serovar Typhi Ty2
caaaccugagcauauaaau

SEQ ID NO: 1756329 - RNA, 16 nt, Salmonella enterica enterica serovar Typhi Ty2
caaacauuagcggugc

SEQ ID NO: 1756330 - RNA, 14 nt, Salmonella enterica enterica serovar Typhi Ty2
caaacaugcggcuu

SEQ ID NO: 1756331 - RNA, 21 nt, Salmonella enterica enterica serovar Typhi Ty2
caaaccacagugaugacggca

SEQ ID NO: 1756332 - RNA, 22 nt, Salmonella enterica enterica serovar Typhi Ty2
caaaccaacaucgcugaauuuc

SEQ ID NO: 1756333 - RNA, 21 nt, Salmonella enterica enterica serovar Typhi Ty2
caaaccccagauuacugcccu

SEQ ID NO: 1756334 - RNA, 15 nt, Salmonella enterica enterica serovar Typhi Ty2
caaaccccggacaca

SEQ ID NO: 1756335 - RNA, 12 nt, Salmonella enterica enterica serovar Typhi Ty2
caaaccauguac

SEQ ID NO: 1756336 - RNA, 13 nt, Salmonella enterica enterica serovar Typhi Ty2
caaacaguuccug

SEQ ID NO: 1756337 - RNA, 16 nt, Salmonella enterica enterica serovar Typhi Ty2
caaacagugggaagca

SEQ ID NO: 1756338 - RNA, 23 nt, Salmonella enterica enterica serovar Typhi Ty2
caaacagugggaagcacauccau

SEQ ID NO: 1756339 - RNA, 16 nt, Salmonella enterica enterica serovar Typhi Ty2
caaacauagccucaag

SEQ ID NO: 1756340 - RNA, 21 nt, Salmonella enterica enterica serovar Typhi Ty2
caaacaggcggcuguugguuu

SEQ ID NO: 1756341 - RNA, 18 nt, Salmonella enterica enterica serovar Typhi Ty2
caaacagcgacucgcugg

SEQ ID NO: 1756342 - RNA, 19 nt, Salmonella enterica enterica serovar Typhi Ty2
caaacagcagaacaaccag

SEQ ID NO: 1756343 - RNA, 12 nt, Salmonella enterica enterica serovar Typhi Ty2
caaacagcagaa

SEQ ID NO: 1756344 - RNA, 19 nt, Salmonella enterica enterica serovar Typhi Ty2
caaacaccucagccaccca

SEQ ID NO: 1756345 - RNA, 21 nt, Salmonella enterica enterica serovar Typhi Ty2
caaacacagccaucuucugcg

SEQ ID NO: 1756346 - RNA, 18 nt, Salmonella enterica enterica serovar Typhi Ty2
caaacacaaucacgccca

SEQ ID NO: 1756347 - RNA, 13 nt, Salmonella enterica enterica serovar Typhi Ty2
caaacacagccau

SEQ ID NO: 1756348 - RNA, 16 nt, Salmonella enterica enterica serovar Typhi Ty2
caaagcgguaaaucgc

SEQ ID NO: 1756349 - RNA, 16 nt, Salmonella enterica enterica serovar Typhi Ty2
caaagcguaccgucug

SEQ ID NO: 1756350 - RNA, 22 nt, Salmonella enterica enterica serovar Typhi Ty2
caaagcguucugaacuguaacc

SEQ ID NO: 1756351 - RNA, 21 nt, Salmonella enterica enterica serovar Typhi Ty2
caaagcguugcaaccccagac

SEQ ID NO: 1756352 - RNA, 15 nt, Salmonella enterica enterica serovar Typhi Ty2
caaagcucaacgcag

SEQ ID NO: 1756353 - RNA, 17 nt, Salmonella enterica enterica serovar Typhi Ty2
caaagauaaucugaaua

SEQ ID NO: 1756354 - RNA, 13 nt, Salmonella enterica enterica serovar Typhi Ty2
caaacuuccacac

SEQ ID NO: 1756355 - RNA, 19 nt, Salmonella enterica enterica serovar Typhi Ty2
caaacugcgcgcccgccuc

SEQ ID NO: 1756356 - RNA, 14 nt, Salmonella enterica enterica serovar Typhi Ty2
caaacugcgcgccc

SEQ ID NO: 1756357 - RNA, 11 nt, Salmonella enterica enterica serovar Typhi Ty2
caaacugcugg

SEQ ID NO: 1756358 - RNA, 22 nt, Salmonella enterica enterica serovar Typhi Ty2
caaacugcucguaaagcaucag

SEQ ID NO: 1756359 - RNA, 16 nt, Salmonella enterica enterica serovar Typhi Ty2
caaacuggccacagca

SEQ ID NO: 1756360 - RNA, 18 nt, Salmonella enterica enterica serovar Typhi Ty2
caaacuggcaaauaaaau

SEQ ID NO: 1756361 - RNA, 23 nt, Salmonella enterica enterica serovar Typhi Ty2
caaagacgguuucagugauaaag

SEQ ID NO: 1756362 - RNA, 14 nt, Salmonella enterica enterica serovar Typhi Ty2
caaagacgaauaag

SEQ ID NO: 1756363 - RNA, 19 nt, Salmonella enterica enterica serovar Typhi Ty2
caaagagguugcugauuaa

SEQ ID NO: 1756364 - RNA, 21 nt, Salmonella enterica enterica serovar Typhi Ty2
caaauccacuggucgucugaa

SEQ ID NO: 1756365 - RNA, 17 nt, Salmonella enterica enterica serovar Typhi Ty2
caaaucccgguaaaggu

SEQ ID NO: 1756366 - RNA, 20 nt, Salmonella enterica enterica serovar Typhi Ty2
caaaucccugaucggccaga

SEQ ID NO: 1756367 - RNA, 19 nt, Salmonella enterica enterica serovar Typhi Ty2
caaauagagaaaauaacaa

SEQ ID NO: 1756368 - RNA, 17 nt, Salmonella enterica enterica serovar Typhi Ty2
caaauagagaaaauaac

SEQ ID NO: 1756369 - RNA, 22 nt, Salmonella enterica enterica serovar Typhi Ty2
caaauacugcuuuuccggcagc

SEQ ID NO: 1756370 - RNA, 18 nt, Salmonella enterica enterica serovar Typhi Ty2
caaauauauugaaaaggg

SEQ ID NO: 1756371 - RNA, 17 nt, Salmonella enterica enterica serovar Typhi Ty2
caaauaugauaugugua

SEQ ID NO: 1756372 - RNA, 14 nt, Salmonella enterica enterica serovar Typhi Ty2
caaauagagaaaau

SEQ ID NO: 1756373 - RNA, 15 nt, Salmonella enterica enterica serovar Typhi Ty2
caaagggcaccuggg

SEQ ID NO: 1756374 - RNA, 10 nt, Salmonella enterica enterica serovar Typhi Ty2
caaagggagc

SEQ ID NO: 1756375 - RNA, 17 nt, Salmonella enterica enterica serovar Typhi Ty2
caaauucagaccccugu

SEQ ID NO: 1756376 - RNA, 17 nt, Salmonella enterica enterica serovar Typhi Ty2
caaauuuugauaaaaac

SEQ ID NO: 1756377 - RNA, 17 nt, Salmonella enterica enterica serovar Typhi Ty2
caaauccuccauaaaua

SEQ ID NO: 1756378 - RNA, 22 nt, Salmonella enterica enterica serovar Typhi Ty2
caaaucuggugauaaagcagac

SEQ ID NO: 1756379 - RNA, 21 nt, Salmonella enterica enterica serovar Typhi Ty2
caaaucuguuaucuggaugua

SEQ ID NO: 1756380 - RNA, 19 nt, Salmonella enterica enterica serovar Typhi Ty2
caaaucuucauuucauugc

SEQ ID NO: 1756381 - RNA, 20 nt, Salmonella enterica enterica serovar Typhi Ty2
caaaugggaucuucaaugaa

SEQ ID NO: 1756382 - RNA, 20 nt, Salmonella enterica enterica serovar Typhi Ty2
caacaaguccuucuuccccc

SEQ ID NO: 1756383 - RNA, 15 nt, Salmonella enterica enterica serovar Typhi Ty2
caacacccacaccau

SEQ ID NO: 1756384 - RNA, 16 nt, Salmonella enterica enterica serovar Typhi Ty2
caacaccugcugguca

SEQ ID NO: 1756385 - RNA, 15 nt, Salmonella enterica enterica serovar Typhi Ty2
caacacgauccccau

SEQ ID NO: 1756386 - RNA, 16 nt, Salmonella enterica enterica serovar Typhi Ty2
caacaccguaaaagga

SEQ ID NO: 1756387 - RNA, 14 nt, Salmonella enterica enterica serovar Typhi Ty2
caacaacaguugca

SEQ ID NO: 1756388 - RNA, 20 nt, Salmonella enterica enterica serovar Typhi Ty2
caacaguaccugauaaaauu

SEQ ID NO: 1756389 - RNA, 16 nt, Salmonella enterica enterica serovar Typhi Ty2
caacauaaauaaacag

SEQ ID NO: 1756390 - RNA, 19 nt, Salmonella enterica enterica serovar Typhi Ty2
caacaguugcuggagcagg

SEQ ID NO: 1756391 - RNA, 12 nt, Salmonella enterica enterica serovar Typhi Ty2
caacagcaccag

SEQ ID NO: 1756392 - RNA, 14 nt, Salmonella enterica enterica serovar Typhi Ty2
caacagcaauguuu

SEQ ID NO: 1756393 - RNA, 12 nt, Salmonella enterica enterica serovar Typhi Ty2
caacagcaaugu

SEQ ID NO: 1756394 - RNA, 14 nt, Salmonella enterica enterica serovar Typhi Ty2
caacagccgccugu

SEQ ID NO: 1756395 - RNA, 20 nt, Salmonella enterica enterica serovar Typhi Ty2
caacagcggcggcaguugcc

SEQ ID NO: 1756396 - RNA, 15 nt, Salmonella enterica enterica serovar Typhi Ty2
caacagcgagcuaug

SEQ ID NO: 1756397 - RNA, 21 nt, Salmonella enterica enterica serovar Typhi Ty2
caacagguaccccgccaccgc

SEQ ID NO: 1756398 - RNA, 16 nt, Salmonella enterica enterica serovar Typhi Ty2
caacagcgugagcugu

SEQ ID NO: 1756399 - RNA, 13 nt, Salmonella enterica enterica serovar Typhi Ty2
caagcucauuucc

SEQ ID NO: 1756400 - RNA, 17 nt, Salmonella enterica enterica serovar Typhi Ty2
caagcucauuucccaau

SEQ ID NO: 1756401 - RNA, 22 nt, Salmonella enterica enterica serovar Typhi Ty2
caagcuguagcguuuccacgac

SEQ ID NO: 1756402 - RNA, 14 nt, Salmonella enterica enterica serovar Typhi Ty2
caagcugcuuuuug

SEQ ID NO: 1756403 - RNA, 15 nt, Salmonella enterica enterica serovar Typhi Ty2
caagcugguaaaugc

SEQ ID NO: 1756404 - RNA, 14 nt, Salmonella enterica enterica serovar Typhi Ty2
caagcuggaauacc

SEQ ID NO: 1756405 - RNA, 17 nt, Salmonella enterica enterica serovar Typhi Ty2
caagauuucaaaacccg

SEQ ID NO: 1756406 - RNA, 17 nt, Salmonella enterica enterica serovar Typhi Ty2
caagcgcggcagcagcu

SEQ ID NO: 1756407 - RNA, 14 nt, Salmonella enterica enterica serovar Typhi Ty2
caagcgcggcagca

SEQ ID NO: 1756408 - RNA, 16 nt, Salmonella enterica enterica serovar Typhi Ty2
caagcgcuaagcaaca

SEQ ID NO: 1756409 - RNA, 17 nt, Salmonella enterica enterica serovar Typhi Ty2
caagcgcggacagcaga

SEQ ID NO: 1756410 - RNA, 18 nt, Salmonella enterica enterica serovar Typhi Ty2
caagcgccuguucaacau

SEQ ID NO: 1756411 - RNA, 15 nt, Salmonella enterica enterica serovar Typhi Ty2
caagcgccaguaaug

SEQ ID NO: 1756412 - RNA, 16 nt, Salmonella enterica enterica serovar Typhi Ty2
caaguaauaaaauaau

SEQ ID NO: 1756413 - RNA, 13 nt, Salmonella enterica enterica serovar Typhi Ty2
caaguaauaaaau

SEQ ID NO: 1756414 - RNA, 14 nt, Salmonella enterica enterica serovar Typhi Ty2
caaguaauaaagag

SEQ ID NO: 1756415 - RNA, 17 nt, Salmonella enterica enterica serovar Typhi Ty2
caaguaauaaaauaaua

SEQ ID NO: 1756416 - RNA, 18 nt, Salmonella enterica enterica serovar Typhi Ty2
caaguaaaaugcccugcu

SEQ ID NO: 1756417 - RNA, 15 nt, Salmonella enterica enterica serovar Typhi Ty2
caaguccaaguaugu

SEQ ID NO: 1756418 - RNA, 19 nt, Salmonella enterica enterica serovar Typhi Ty2
caaggcuauuagccaaagc

SEQ ID NO: 1756419 - RNA, 14 nt, Salmonella enterica enterica serovar Typhi Ty2
caaggcguucacac

SEQ ID NO: 1756420 - RNA, 21 nt, Salmonella enterica enterica serovar Typhi Ty2
caaguccgccgcuauuacccc

SEQ ID NO: 1756421 - RNA, 17 nt, Salmonella enterica enterica serovar Typhi Ty2
caaguccuucuuccccc

SEQ ID NO: 1756422 - RNA, 13 nt, Salmonella enterica enterica serovar Typhi Ty2
caauaagccagac

SEQ ID NO: 1756423 - RNA, 14 nt, Salmonella enterica enterica serovar Typhi Ty2
caauaaccgccagc

SEQ ID NO: 1756424 - RNA, 23 nt, Salmonella enterica enterica serovar Typhi Ty2
caauacaggcgaccgggcagaca

SEQ ID NO: 1756425 - RNA, 22 nt, Salmonella enterica enterica serovar Typhi Ty2
caauacagcccgccagcaccag

SEQ ID NO: 1756426 - RNA, 16 nt, Salmonella enterica enterica serovar Typhi Ty2
caauaaucgaaauaaa

SEQ ID NO: 1756427 - RNA, 18 nt, Salmonella enterica enterica serovar Typhi Ty2
caauaaucgaaauaaagu

SEQ ID NO: 1756428 - RNA, 19 nt, Salmonella enterica enterica serovar Typhi Ty2
caauaaucccuucuuuuac

SEQ ID NO: 1756429 - RNA, 18 nt, Salmonella enterica enterica serovar Typhi Ty2
caauaaucgcgagaaaau

SEQ ID NO: 1756430 - RNA, 19 nt, Salmonella enterica enterica serovar Typhi Ty2
caauaauggagaugaaaau

SEQ ID NO: 1756431 - RNA, 15 nt, Salmonella enterica enterica serovar Typhi Ty2
caauaccaauuaccg

SEQ ID NO: 1756432 - RNA, 18 nt, Salmonella enterica enterica serovar Typhi Ty2
caauaccacaaccggaau

SEQ ID NO: 1756433 - RNA, 14 nt, Salmonella enterica enterica serovar Typhi Ty2
caauaccaauuacc

SEQ ID NO: 1756434 - RNA, 15 nt, Salmonella enterica enterica serovar Typhi Ty2
caauacccagcgcca

SEQ ID NO: 1756435 - RNA, 21 nt, Salmonella enterica enterica serovar Typhi Ty2
caauauaguugagccauucca

SEQ ID NO: 1756436 - RNA, 14 nt, Salmonella enterica enterica serovar Typhi Ty2
caauauaugagcaa

SEQ ID NO: 1756437 - RNA, 18 nt, Salmonella enterica enterica serovar Typhi Ty2
caauaucaacgaccgucg

SEQ ID NO: 1756438 - RNA, 12 nt, Salmonella enterica enterica serovar Typhi Ty2
caauauacuuau

SEQ ID NO: 1756439 - RNA, 23 nt, Salmonella enterica enterica serovar Typhi Ty2
caauagaguaaugacaaaaauua

SEQ ID NO: 1756440 - RNA, 17 nt, Salmonella enterica enterica serovar Typhi Ty2
caauagcaaucuguaac

SEQ ID NO: 1756441 - RNA, 23 nt, Salmonella enterica enterica serovar Typhi Ty2
caauaccuguaaacgcuucugcg

SEQ ID NO: 1756442 - RNA, 19 nt, Salmonella enterica enterica serovar Typhi Ty2
caauacgagugacauuauu

SEQ ID NO: 1756443 - RNA, 22 nt, Salmonella enterica enterica serovar Typhi Ty2
caauacuuuuugacuccugaca

SEQ ID NO: 1756444 - RNA, 21 nt, Salmonella enterica enterica serovar Typhi Ty2
caauaugcuguuuauggcgcu

SEQ ID NO: 1756445 - RNA, 16 nt, Salmonella enterica enterica serovar Typhi Ty2
caauaugcuguuuaug

SEQ ID NO: 1756446 - RNA, 15 nt, Salmonella enterica enterica serovar Typhi Ty2
caauauggcaccgaa

SEQ ID NO: 1756447 - RNA, 15 nt, Salmonella enterica enterica serovar Typhi Ty2
caauaugcuguuuau

SEQ ID NO: 1756448 - RNA, 23 nt, Salmonella enterica enterica serovar Typhi Ty2
caauauguuuaaagaagaaagac

SEQ ID NO: 1756449 - RNA, 17 nt, Salmonella enterica enterica serovar Typhi Ty2
caauaugugcaucggca

SEQ ID NO: 1756450 - RNA, 22 nt, Salmonella enterica enterica serovar Typhi Ty2
caauaugguauucgugcaucag

SEQ ID NO: 1756451 - RNA, 17 nt, Salmonella enterica enterica serovar Typhi Ty2
caauaugucuuaaacag

SEQ ID NO: 1756452 - RNA, 22 nt, Salmonella enterica enterica serovar Typhi Ty2
caauaugguuauccagcaggua

SEQ ID NO: 1756453 - RNA, 16 nt, Salmonella enterica enterica serovar Typhi Ty2
caaucaacuccauaau

SEQ ID NO: 1756454 - RNA, 14 nt, Salmonella enterica enterica serovar Typhi Ty2
caauauuaaaugac

SEQ ID NO: 1756455 - RNA, 13 nt, Salmonella enterica enterica serovar Typhi Ty2
caauauuaaauga

SEQ ID NO: 1756456 - RNA, 15 nt, Salmonella enterica enterica serovar Typhi Ty2
caauauuaaauaaau

SEQ ID NO: 1756457 - RNA, 15 nt, Salmonella enterica enterica serovar Typhi Ty2
caaucaccaucccau

SEQ ID NO: 1756458 - RNA, 12 nt, Salmonella enterica enterica serovar Typhi Ty2
caaucaccguug

SEQ ID NO: 1756459 - RNA, 21 nt, Salmonella enterica enterica serovar Typhi Ty2
caaucaccugaugcccauacg

SEQ ID NO: 1756460 - RNA, 16 nt, Salmonella enterica enterica serovar Typhi Ty2
caaucacgcccagcgc

SEQ ID NO: 1756461 - RNA, 19 nt, Salmonella enterica enterica serovar Typhi Ty2
caaucacguuauagccgcc

SEQ ID NO: 1756462 - RNA, 22 nt, Salmonella enterica enterica serovar Typhi Ty2
caaucacugaugccacacccug

SEQ ID NO: 1756463 - RNA, 15 nt, Salmonella enterica enterica serovar Typhi Ty2
caagaauaugcagug

SEQ ID NO: 1756464 - RNA, 16 nt, Salmonella enterica enterica serovar Typhi Ty2
caagaauaugagauug

SEQ ID NO: 1756465 - RNA, 18 nt, Salmonella enterica enterica serovar Typhi Ty2
caagaagcguugaccgua

SEQ ID NO: 1756466 - RNA, 17 nt, Salmonella enterica enterica serovar Typhi Ty2
caagaaccgcuuuuccu

SEQ ID NO: 1756467 - RNA, 23 nt, Salmonella enterica enterica serovar Typhi Ty2
caagaaccgcuuuuccugcugcc

SEQ ID NO: 1756468 - RNA, 18 nt, Salmonella enterica enterica serovar Typhi Ty2
caagaacagagcaauuac

SEQ ID NO: 1756469 - RNA, 20 nt, Salmonella enterica enterica serovar Typhi Ty2
caacuuuuucuuaagcugag

SEQ ID NO: 1756470 - RNA, 19 nt, Salmonella enterica enterica serovar Typhi Ty2
caacuugaaguaugaaggg

SEQ ID NO: 1756471 - RNA, 12 nt, Salmonella enterica enterica serovar Typhi Ty2
caacuucugcug

SEQ ID NO: 1756472 - RNA, 20 nt, Salmonella enterica enterica serovar Typhi Ty2
caagaucgguugaaccaucu

SEQ ID NO: 1756473 - RNA, 14 nt, Salmonella enterica enterica serovar Typhi Ty2
caagaucccucacc

SEQ ID NO: 1756474 - RNA, 18 nt, Salmonella enterica enterica serovar Typhi Ty2
caagaucgcgcagcaggc

SEQ ID NO: 1756475 - RNA, 17 nt, Salmonella enterica enterica serovar Typhi Ty2
caagauccaacacggcg

SEQ ID NO: 1756476 - RNA, 14 nt, Salmonella enterica enterica serovar Typhi Ty2
caagauccguccau

SEQ ID NO: 1756477 - RNA, 23 nt, Salmonella enterica enterica serovar Typhi Ty2
caagaucauccggguuaaaccag

SEQ ID NO: 1756478 - RNA, 17 nt, Salmonella enterica enterica serovar Typhi Ty2
caagagcguccaguccu

SEQ ID NO: 1756479 - RNA, 24 nt, Salmonella enterica enterica serovar Typhi Ty2
caagagguaaugcccgauggcgcu

SEQ ID NO: 1756480 - RNA, 18 nt, Salmonella enterica enterica serovar Typhi Ty2
caagaccgccuaacagcg

SEQ ID NO: 1756481 - RNA, 21 nt, Salmonella enterica enterica serovar Typhi Ty2
caagaccgauagagacugccg

SEQ ID NO: 1756482 - RNA, 16 nt, Salmonella enterica enterica serovar Typhi Ty2
caagaccgggcugcac

SEQ ID NO: 1756483 - RNA, 16 nt, Salmonella enterica enterica serovar Typhi Ty2
caagacgaaaaaugaa

SEQ ID NO: 1756484 - RNA, 16 nt, Salmonella enterica enterica serovar Typhi Ty2
caagaauuaaauaacg

SEQ ID NO: 1756485 - RNA, 16 nt, Salmonella enterica enterica serovar Typhi Ty2
caagaauuuaucgcaa

SEQ ID NO: 1756486 - RNA, 22 nt, Salmonella enterica enterica serovar Typhi Ty2
caagacacgcuuccagaugaag

SEQ ID NO: 1756487 - RNA, 19 nt, Salmonella enterica enterica serovar Typhi Ty2
caagagauucaggccgcca

SEQ ID NO: 1756488 - RNA, 17 nt, Salmonella enterica enterica serovar Typhi Ty2
caagagaugcagacaau

SEQ ID NO: 1756489 - RNA, 15 nt, Salmonella enterica enterica serovar Typhi Ty2
caagagccgccgcca

SEQ ID NO: 1756490 - RNA, 20 nt, Salmonella enterica enterica serovar Typhi Ty2
caagagaaaaaucagucauu

SEQ ID NO: 1756491 - RNA, 21 nt, Salmonella enterica enterica serovar Typhi Ty2
caagacgguuauuuuucagau

SEQ ID NO: 1756492 - RNA, 23 nt, Salmonella enterica enterica serovar Typhi Ty2
caacgacccgaagggcgaagcgc

SEQ ID NO: 1756493 - RNA, 23 nt, Salmonella enterica enterica serovar Typhi Ty2
caacgaccgucgugccugcggua

SEQ ID NO: 1756494 - RNA, 23 nt, Salmonella enterica enterica serovar Typhi Ty2
caacgcaaugcgauaagcgucuu

SEQ ID NO: 1756495 - RNA, 20 nt, Salmonella enterica enterica serovar Typhi Ty2
caacgcacuguaacgcacug

SEQ ID NO: 1756496 - RNA, 16 nt, Salmonella enterica enterica serovar Typhi Ty2
caacgagaauaagacc

SEQ ID NO: 1756497 - RNA, 21 nt, Salmonella enterica enterica serovar Typhi Ty2
caacgaggugaauaaauccuu

SEQ ID NO: 1756498 - RNA, 23 nt, Salmonella enterica enterica serovar Typhi Ty2
caacauagcuaaauaaaaauaau

SEQ ID NO: 1756499 - RNA, 20 nt, Salmonella enterica enterica serovar Typhi Ty2
caacauauuuuucacacaua

SEQ ID NO: 1756500 - RNA, 17 nt, Salmonella enterica enterica serovar Typhi Ty2
caacauauuuuucacac

SEQ ID NO: 1756501 - RNA, 12 nt, Salmonella enterica enterica serovar Typhi Ty2
caacaucauccc

SEQ ID NO: 1756502 - RNA, 17 nt, Salmonella enterica enterica serovar Typhi Ty2
caacaucaucggaucca

SEQ ID NO: 1756503 - RNA, 19 nt, Salmonella enterica enterica serovar Typhi Ty2
caacaucagcgcuaccagc

SEQ ID NO: 1756504 - RNA, 17 nt, Salmonella enterica enterica serovar Typhi Ty2
caaccugcgcugacggc

SEQ ID NO: 1756505 - RNA, 12 nt, Salmonella enterica enterica serovar Typhi Ty2
caaccugcgcug

SEQ ID NO: 1756506 - RNA, 15 nt, Salmonella enterica enterica serovar Typhi Ty2
caaccugcgcugacg

SEQ ID NO: 1756507 - RNA, 20 nt, Salmonella enterica enterica serovar Typhi Ty2
caaccugccgaugaaagagc

SEQ ID NO: 1756508 - RNA, 11 nt, Salmonella enterica enterica serovar Typhi Ty2
caaccugauau

SEQ ID NO: 1756509 - RNA, 21 nt, Salmonella enterica enterica serovar Typhi Ty2
caacucgaauuauuuaggguu

SEQ ID NO: 1756510 - RNA, 13 nt, Salmonella enterica enterica serovar Typhi Ty2
caacucgcacuga

SEQ ID NO: 1756511 - RNA, 23 nt, Salmonella enterica enterica serovar Typhi Ty2
caacuccgccggcgcggaaggga

SEQ ID NO: 1756512 - RNA, 13 nt, Salmonella enterica enterica serovar Typhi Ty2
caacuccgccggc

SEQ ID NO: 1756513 - RNA, 19 nt, Salmonella enterica enterica serovar Typhi Ty2
caacguuucuuucaucaga

SEQ ID NO: 1756514 - RNA, 20 nt, Salmonella enterica enterica serovar Typhi Ty2
caacguuucuuucaucagau

SEQ ID NO: 1756515 - RNA, 22 nt, Salmonella enterica enterica serovar Typhi Ty2
caacguuucuuucaucagauca

SEQ ID NO: 1756516 - RNA, 18 nt, Salmonella enterica enterica serovar Typhi Ty2
caacgcaucgcugcgcuu

SEQ ID NO: 1756517 - RNA, 17 nt, Salmonella enterica enterica serovar Typhi Ty2
caacgcaggcuggagag

SEQ ID NO: 1756518 - RNA, 15 nt, Salmonella enterica enterica serovar Typhi Ty2
caacgcauaaaaacg

SEQ ID NO: 1756519 - RNA, 19 nt, Salmonella enterica enterica serovar Typhi Ty2
caacgccggcaacacccgc

SEQ ID NO: 1756520 - RNA, 14 nt, Salmonella enterica enterica serovar Typhi Ty2
caacgcgcaucaac

SEQ ID NO: 1756521 - RNA, 21 nt, Salmonella enterica enterica serovar Typhi Ty2
caacgcgaguauucgcgcccu

SEQ ID NO: 1756522 - RNA, 15 nt, Salmonella enterica enterica serovar Typhi Ty2
caacgccuccugccg

SEQ ID NO: 1756523 - RNA, 16 nt, Salmonella enterica enterica serovar Typhi Ty2
caacgccuucugcuug

SEQ ID NO: 1756524 - RNA, 17 nt, Salmonella enterica enterica serovar Typhi Ty2
caacgggacggcggcca

SEQ ID NO: 1756525 - RNA, 16 nt, Salmonella enterica enterica serovar Typhi Ty2
caacgggcaaugccac

SEQ ID NO: 1756526 - RNA, 18 nt, Salmonella enterica enterica serovar Typhi Ty2
caacggucggucuuuuug

SEQ ID NO: 1756527 - RNA, 22 nt, Salmonella enterica enterica serovar Typhi Ty2
auuuuaucgacgcuauuuuuca

SEQ ID NO: 1756528 - RNA, 20 nt, Salmonella enterica enterica serovar Typhi Ty2
auuuuauuuuucaaugccau

SEQ ID NO: 1756529 - RNA, 12 nt, Salmonella enterica enterica serovar Typhi Ty2
auuuuauuuuua

SEQ ID NO: 1756530 - RNA, 22 nt, Salmonella enterica enterica serovar Typhi Ty2
auuuuccaugccuuuauuucaa

SEQ ID NO: 1756531 - RNA, 14 nt, Salmonella enterica enterica serovar Typhi Ty2
auuuugaauuuuua

SEQ ID NO: 1756532 - RNA, 22 nt, Salmonella enterica enterica serovar Typhi Ty2
auuuugcucauauuguguuuuu

SEQ ID NO: 1756533 - RNA, 15 nt, Salmonella enterica enterica serovar Typhi Ty2
auuuugcgguuuuaa

SEQ ID NO: 1756534 - RNA, 12 nt, Salmonella enterica enterica serovar Typhi Ty2
auuuugcgccua

SEQ ID NO: 1756535 - RNA, 21 nt, Salmonella enterica enterica serovar Typhi Ty2
auuuuuaagguauugauuuuu

SEQ ID NO: 1756536 - RNA, 15 nt, Salmonella enterica enterica serovar Typhi Ty2
auuuuuacaaauuua

SEQ ID NO: 1756537 - RNA, 19 nt, Salmonella enterica enterica serovar Typhi Ty2
auuuuuaccgcauuauaaa

SEQ ID NO: 1756538 - RNA, 20 nt, Salmonella enterica enterica serovar Typhi Ty2
auuuugguuacuauuuuuca

SEQ ID NO: 1756539 - RNA, 16 nt, Salmonella enterica enterica serovar Typhi Ty2
auuuuggggaaaauac

SEQ ID NO: 1756540 - RNA, 15 nt, Salmonella enterica enterica serovar Typhi Ty2
auuuguugguuuaaa

SEQ ID NO: 1756541 - RNA, 19 nt, Salmonella enterica enterica serovar Typhi Ty2
auuuguacaaaaaauguga

SEQ ID NO: 1756542 - RNA, 16 nt, Salmonella enterica enterica serovar Typhi Ty2
auuuguacuucagagc

SEQ ID NO: 1756543 - RNA, 23 nt, Salmonella enterica enterica serovar Typhi Ty2
auuugacgagucggaucaugaaa

SEQ ID NO: 1756544 - RNA, 14 nt, Salmonella enterica enterica serovar Typhi Ty2
auuugcuguuuuau

SEQ ID NO: 1756545 - RNA, 13 nt, Salmonella enterica enterica serovar Typhi Ty2
auuugcuguuuuu

SEQ ID NO: 1756546 - RNA, 20 nt, Salmonella enterica enterica serovar Typhi Ty2
auuugcuguuuuuuguugau

SEQ ID NO: 1756547 - RNA, 23 nt, Salmonella enterica enterica serovar Typhi Ty2
auuugcuguuuuuuguugauuuu

SEQ ID NO: 1756548 - RNA, 16 nt, Salmonella enterica enterica serovar Typhi Ty2
auuugcugcugcucgc

SEQ ID NO: 1756549 - RNA, 23 nt, Salmonella enterica enterica serovar Typhi Ty2
auuucuuagcacccaccaucacu

SEQ ID NO: 1756550 - RNA, 17 nt, Salmonella enterica enterica serovar Typhi Ty2
auuucuugcaauagcgc

SEQ ID NO: 1756551 - RNA, 23 nt, Salmonella enterica enterica serovar Typhi Ty2
auuucuuuaaugcccgguauuuu

SEQ ID NO: 1756552 - RNA, 17 nt, Salmonella enterica enterica serovar Typhi Ty2
auuucugcugccagcgc

SEQ ID NO: 1756553 - RNA, 15 nt, Salmonella enterica enterica serovar Typhi Ty2
auuucugcuggacgu

SEQ ID NO: 1756554 - RNA, 23 nt, Salmonella enterica enterica serovar Typhi Ty2
auuucguagccgcgcgccgccuc

SEQ ID NO: 1756555 - RNA, 15 nt, Salmonella enterica enterica serovar Typhi Ty2
auuucguagccgcgc

SEQ ID NO: 1756556 - RNA, 19 nt, Salmonella enterica enterica serovar Typhi Ty2
auuucggcgcuguuuuccg

SEQ ID NO: 1756557 - RNA, 20 nt, Salmonella enterica enterica serovar Typhi Ty2
auuucgucgauguuacgacc

SEQ ID NO: 1756558 - RNA, 19 nt, Salmonella enterica enterica serovar Typhi Ty2
auuucucuuuuauuauuuu

SEQ ID NO: 1756559 - RNA, 13 nt, Salmonella enterica enterica serovar Typhi Ty2
auuuaaaauucca

SEQ ID NO: 1756560 - RNA, 22 nt, Salmonella enterica enterica serovar Typhi Ty2
auuuacaaaaaagauaaccauu

SEQ ID NO: 1756561 - RNA, 13 nt, Salmonella enterica enterica serovar Typhi Ty2
auuuaauguuuca

SEQ ID NO: 1756562 - RNA, 17 nt, Salmonella enterica enterica serovar Typhi Ty2
auuggucauucggcggu

SEQ ID NO: 1756563 - RNA, 15 nt, Salmonella enterica enterica serovar Typhi Ty2
auugguagacgcacc

SEQ ID NO: 1756564 - RNA, 15 nt, Salmonella enterica enterica serovar Typhi Ty2
auuuaggucuuguca

SEQ ID NO: 1756565 - RNA, 14 nt, Salmonella enterica enterica serovar Typhi Ty2
auuuauauuagggc

SEQ ID NO: 1756566 - RNA, 14 nt, Salmonella enterica enterica serovar Typhi Ty2
auuuacugaauaaa

SEQ ID NO: 1756567 - RNA, 16 nt, Salmonella enterica enterica serovar Typhi Ty2
auuuacuccaaaaaua

SEQ ID NO: 1756568 - RNA, 11 nt, Salmonella enterica enterica serovar Typhi Ty2
auuuacugccg

SEQ ID NO: 1756569 - RNA, 21 nt, Salmonella enterica enterica serovar Typhi Ty2
auuuacgccaacgagaauaag

SEQ ID NO: 1756570 - RNA, 17 nt, Salmonella enterica enterica serovar Typhi Ty2
auuuaccagugcuaaaa

SEQ ID NO: 1756571 - RNA, 13 nt, Salmonella enterica enterica serovar Typhi Ty2
auuucgccgccgc

SEQ ID NO: 1756572 - RNA, 20 nt, Salmonella enterica enterica serovar Typhi Ty2
auuucgcuggcggccccucu

SEQ ID NO: 1756573 - RNA, 12 nt, Salmonella enterica enterica serovar Typhi Ty2
auuucgauggua

SEQ ID NO: 1756574 - RNA, 19 nt, Salmonella enterica enterica serovar Typhi Ty2
auuucgacgauaaaaaaag

SEQ ID NO: 1756575 - RNA, 14 nt, Salmonella enterica enterica serovar Typhi Ty2
auuucccuucaauc

SEQ ID NO: 1756576 - RNA, 12 nt, Salmonella enterica enterica serovar Typhi Ty2
auuuccgcagcc

SEQ ID NO: 1756577 - RNA, 16 nt, Salmonella enterica enterica serovar Typhi Ty2
auuuccgccauuuuuc

SEQ ID NO: 1756578 - RNA, 21 nt, Salmonella enterica enterica serovar Typhi Ty2
auuuccggaccguuaucaaaa

SEQ ID NO: 1756579 - RNA, 21 nt, Salmonella enterica enterica serovar Typhi Ty2
auuuccgguuccagcggccgc

SEQ ID NO: 1756580 - RNA, 14 nt, Salmonella enterica enterica serovar Typhi Ty2
auuuccauuuuuca

SEQ ID NO: 1756581 - RNA, 13 nt, Salmonella enterica enterica serovar Typhi Ty2
auuuccauuuuuc

SEQ ID NO: 1756582 - RNA, 16 nt, Salmonella enterica enterica serovar Typhi Ty2
auuuccaccuucucuu

SEQ ID NO: 1756583 - RNA, 21 nt, Salmonella enterica enterica serovar Typhi Ty2
auuucaguacagccaaaaaua

SEQ ID NO: 1756584 - RNA, 14 nt, Salmonella enterica enterica serovar Typhi Ty2
auuucauaauaagc

SEQ ID NO: 1756585 - RNA, 18 nt, Salmonella enterica enterica serovar Typhi Ty2
auuucagggaaaagaagu

SEQ ID NO: 1756586 - RNA, 16 nt, Salmonella enterica enterica serovar Typhi Ty2
auuucacuuaucccug

SEQ ID NO: 1756587 - RNA, 23 nt, Salmonella enterica enterica serovar Typhi Ty2
auuucacgucacguucauccugg

SEQ ID NO: 1756588 - RNA, 15 nt, Salmonella enterica enterica serovar Typhi Ty2
auuucacuucaucau

SEQ ID NO: 1756589 - RNA, 14 nt, Salmonella enterica enterica serovar Typhi Ty2
auuucacuucauca

SEQ ID NO: 1756590 - RNA, 14 nt, Salmonella enterica enterica serovar Typhi Ty2
auuucacgcagcac

SEQ ID NO: 1756591 - RNA, 17 nt, Salmonella enterica enterica serovar Typhi Ty2
auuucaccuuuggcuuc

SEQ ID NO: 1756592 - RNA, 15 nt, Salmonella enterica enterica serovar Typhi Ty2
auuucacgaauaucg

SEQ ID NO: 1756593 - RNA, 20 nt, Salmonella enterica enterica serovar Typhi Ty2
auuuaugauuuuaacaucac

SEQ ID NO: 1756594 - RNA, 21 nt, Salmonella enterica enterica serovar Typhi Ty2
auuuauggcgucaccauuacu

SEQ ID NO: 1756595 - RNA, 19 nt, Salmonella enterica enterica serovar Typhi Ty2
auuuaugauuuuaacauca

SEQ ID NO: 1756596 - RNA, 14 nt, Salmonella enterica enterica serovar Typhi Ty2
auuucacaaauuaa

SEQ ID NO: 1756597 - RNA, 14 nt, Salmonella enterica enterica serovar Typhi Ty2
auuucaauguaauu

SEQ ID NO: 1756598 - RNA, 15 nt, Salmonella enterica enterica serovar Typhi Ty2
auuccgcuuccagaa

SEQ ID NO: 1756599 - RNA, 16 nt, Salmonella enterica enterica serovar Typhi Ty2
auuccgcuuccagaau

SEQ ID NO: 1756600 - RNA, 22 nt, Salmonella enterica enterica serovar Typhi Ty2
auuccgcuuccagaauucguac

SEQ ID NO: 1756601 - RNA, 20 nt, Salmonella enterica enterica serovar Typhi Ty2
auucccacgcauaguccugc

SEQ ID NO: 1756602 - RNA, 22 nt, Salmonella enterica enterica serovar Typhi Ty2
auucccaguaaccuauuuuaca

SEQ ID NO: 1756603 - RNA, 17 nt, Salmonella enterica enterica serovar Typhi Ty2
auuccccaccaggaaug

SEQ ID NO: 1756604 - RNA, 13 nt, Salmonella enterica enterica serovar Typhi Ty2
auucccccugcgu

SEQ ID NO: 1756605 - RNA, 21 nt, Salmonella enterica enterica serovar Typhi Ty2
auucccugguucgaauccagg

SEQ ID NO: 1756606 - RNA, 18 nt, Salmonella enterica enterica serovar Typhi Ty2
auucccguaaaagaagaa

SEQ ID NO: 1756607 - RNA, 15 nt, Salmonella enterica enterica serovar Typhi Ty2
auucccgucccugca

SEQ ID NO: 1756608 - RNA, 17 nt, Salmonella enterica enterica serovar Typhi Ty2
auucccguaucuucaug

SEQ ID NO: 1756609 - RNA, 14 nt, Salmonella enterica enterica serovar Typhi Ty2
auucccgccuuaag

SEQ ID NO: 1756610 - RNA, 20 nt, Salmonella enterica enterica serovar Typhi Ty2
auuccugccgccgcaccacu

SEQ ID NO: 1756611 - RNA, 14 nt, Salmonella enterica enterica serovar Typhi Ty2
auuccugcauguuu

SEQ ID NO: 1756612 - RNA, 16 nt, Salmonella enterica enterica serovar Typhi Ty2
auuccugacgcacagu

SEQ ID NO: 1756613 - RNA, 19 nt, Salmonella enterica enterica serovar Typhi Ty2
auuccugacauuuauauua

SEQ ID NO: 1756614 - RNA, 14 nt, Salmonella enterica enterica serovar Typhi Ty2
auuccuggauuaaa

SEQ ID NO: 1756615 - RNA, 14 nt, Salmonella enterica enterica serovar Typhi Ty2
auuccugacugcgc

SEQ ID NO: 1756616 - RNA, 20 nt, Salmonella enterica enterica serovar Typhi Ty2
auuccuggcguaugcuuuca

SEQ ID NO: 1756617 - RNA, 17 nt, Salmonella enterica enterica serovar Typhi Ty2
auuccuuguccgaugca

SEQ ID NO: 1756618 - RNA, 15 nt, Salmonella enterica enterica serovar Typhi Ty2
auuccuuuaaauauc

SEQ ID NO: 1756619 - RNA, 13 nt, Salmonella enterica enterica serovar Typhi Ty2
auuccuuaucaca

SEQ ID NO: 1756620 - RNA, 22 nt, Salmonella enterica enterica serovar Typhi Ty2
auucgacaguucccggcaacag

SEQ ID NO: 1756621 - RNA, 20 nt, Salmonella enterica enterica serovar Typhi Ty2
auuccuuuuuccgccaccug

SEQ ID NO: 1756622 - RNA, 22 nt, Salmonella enterica enterica serovar Typhi Ty2
auucgacugcggucguauuuac

SEQ ID NO: 1756623 - RNA, 18 nt, Salmonella enterica enterica serovar Typhi Ty2
auucgaucuguguacuuu

SEQ ID NO: 1756624 - RNA, 23 nt, Salmonella enterica enterica serovar Typhi Ty2
auucgccaccgcgcgcuuaaucg

SEQ ID NO: 1756625 - RNA, 16 nt, Salmonella enterica enterica serovar Typhi Ty2
auucgccaccaggcuc

SEQ ID NO: 1756626 - RNA, 18 nt, Salmonella enterica enterica serovar Typhi Ty2
auucgccaguaaggggau

SEQ ID NO: 1756627 - RNA, 15 nt, Salmonella enterica enterica serovar Typhi Ty2
auucgccccagcaua

SEQ ID NO: 1756628 - RNA, 13 nt, Salmonella enterica enterica serovar Typhi Ty2
auucgcccggcag

SEQ ID NO: 1756629 - RNA, 19 nt, Salmonella enterica enterica serovar Typhi Ty2
auucgcuaauccccccuuu

SEQ ID NO: 1756630 - RNA, 14 nt, Salmonella enterica enterica serovar Typhi Ty2
auucgcuaauaaau

SEQ ID NO: 1756631 - RNA, 23 nt, Salmonella enterica enterica serovar Typhi Ty2
auucgcgcuaaaugacaaauaga

SEQ ID NO: 1756632 - RNA, 20 nt, Salmonella enterica enterica serovar Typhi Ty2
auucgcgcuaaaugacaaau

SEQ ID NO: 1756633 - RNA, 22 nt, Salmonella enterica enterica serovar Typhi Ty2
auucgggacaaacccccagcca

SEQ ID NO: 1756634 - RNA, 23 nt, Salmonella enterica enterica serovar Typhi Ty2
auucgggacaaacccccagccau

SEQ ID NO: 1756635 - RNA, 16 nt, Salmonella enterica enterica serovar Typhi Ty2
auucggcgaaagaagc

SEQ ID NO: 1756636 - RNA, 14 nt, Salmonella enterica enterica serovar Typhi Ty2
auucggcccugcgc

SEQ ID NO: 1756637 - RNA, 22 nt, Salmonella enterica enterica serovar Typhi Ty2
auucggcgcuucgcagcgauau

SEQ ID NO: 1756638 - RNA, 20 nt, Salmonella enterica enterica serovar Typhi Ty2
auucggaaugaugugcuauu

SEQ ID NO: 1756639 - RNA, 17 nt, Salmonella enterica enterica serovar Typhi Ty2
auucgcuuguuucacug

SEQ ID NO: 1756640 - RNA, 15 nt, Salmonella enterica enterica serovar Typhi Ty2
auucaucuccucuuc

SEQ ID NO: 1756641 - RNA, 15 nt, Salmonella enterica enterica serovar Typhi Ty2
auucaugaucuuucc

SEQ ID NO: 1756642 - RNA, 19 nt, Salmonella enterica enterica serovar Typhi Ty2
auucaugccagaagcaaau

SEQ ID NO: 1756643 - RNA, 23 nt, Salmonella enterica enterica serovar Typhi Ty2
auucaugccagaagcaaauucag

SEQ ID NO: 1756644 - RNA, 21 nt, Salmonella enterica enterica serovar Typhi Ty2
auucaugaucuuuccuuuuuc

SEQ ID NO: 1756645 - RNA, 15 nt, Salmonella enterica enterica serovar Typhi Ty2
auucaucaaaaugca

SEQ ID NO: 1756646 - RNA, 14 nt, Salmonella enterica enterica serovar Typhi Ty2
auucauauuagcuc

SEQ ID NO: 1756647 - RNA, 16 nt, Salmonella enterica enterica serovar Typhi Ty2
auucauauuagcuccg

SEQ ID NO: 1756648 - RNA, 15 nt, Salmonella enterica enterica serovar Typhi Ty2
auucaucaucuuguc

SEQ ID NO: 1756649 - RNA, 16 nt, Salmonella enterica enterica serovar Typhi Ty2
auucaucaucuugucc

SEQ ID NO: 1756650 - RNA, 20 nt, Salmonella enterica enterica serovar Typhi Ty2
auucaucgauacgcggaugu

SEQ ID NO: 1756651 - RNA, 24 nt, Salmonella enterica enterica serovar Typhi Ty2
auucauagagcgcguccagacguu

SEQ ID NO: 1756652 - RNA, 17 nt, Salmonella enterica enterica serovar Typhi Ty2
auucauaacaccaauac

SEQ ID NO: 1756653 - RNA, 15 nt, Salmonella enterica enterica serovar Typhi Ty2
auguugccacaggcu

SEQ ID NO: 1756654 - RNA, 21 nt, Salmonella enterica enterica serovar Typhi Ty2
auguugaucguaaaaugaaaa

SEQ ID NO: 1756655 - RNA, 18 nt, Salmonella enterica enterica serovar Typhi Ty2
auguugauacagaaaacc

SEQ ID NO: 1756656 - RNA, 22 nt, Salmonella enterica enterica serovar Typhi Ty2
auuccagcgugccgagcaacag

SEQ ID NO: 1756657 - RNA, 11 nt, Salmonella enterica enterica serovar Typhi Ty2
auuccagaccc

SEQ ID NO: 1756658 - RNA, 21 nt, Salmonella enterica enterica serovar Typhi Ty2
auuccagaaaggaugcccgua

SEQ ID NO: 1756659 - RNA, 21 nt, Salmonella enterica enterica serovar Typhi Ty2
auuccagaagcgcuuugccaa

SEQ ID NO: 1756660 - RNA, 14 nt, Salmonella enterica enterica serovar Typhi Ty2
auuccagaaaggau

SEQ ID NO: 1756661 - RNA, 13 nt, Salmonella enterica enterica serovar Typhi Ty2
auuccauuggcca

SEQ ID NO: 1756662 - RNA, 20 nt, Salmonella enterica enterica serovar Typhi Ty2
auuccauuagcauucccuua

SEQ ID NO: 1756663 - RNA, 20 nt, Salmonella enterica enterica serovar Typhi Ty2
auuccauauaacagaauaag

SEQ ID NO: 1756664 - RNA, 13 nt, Salmonella enterica enterica serovar Typhi Ty2
auuccaucggcau

SEQ ID NO: 1756665 - RNA, 14 nt, Salmonella enterica enterica serovar Typhi Ty2
auucauuuccagca

SEQ ID NO: 1756666 - RNA, 16 nt, Salmonella enterica enterica serovar Typhi Ty2
auucauucugucagaa

SEQ ID NO: 1756667 - RNA, 22 nt, Salmonella enterica enterica serovar Typhi Ty2
auucauuauuuuuaaauaacuu

SEQ ID NO: 1756668 - RNA, 17 nt, Salmonella enterica enterica serovar Typhi Ty2
auucauuauuuuuaaau

SEQ ID NO: 1756669 - RNA, 12 nt, Salmonella enterica enterica serovar Typhi Ty2
auuccaauauuu

SEQ ID NO: 1756670 - RNA, 20 nt, Salmonella enterica enterica serovar Typhi Ty2
auugcagauaauuuugcaua

SEQ ID NO: 1756671 - RNA, 17 nt, Salmonella enterica enterica serovar Typhi Ty2
auugcagcgaccuggga

SEQ ID NO: 1756672 - RNA, 21 nt, Salmonella enterica enterica serovar Typhi Ty2
auugcagcauuacacuauguu

SEQ ID NO: 1756673 - RNA, 14 nt, Salmonella enterica enterica serovar Typhi Ty2
auugauucugugau

SEQ ID NO: 1756674 - RNA, 20 nt, Salmonella enterica enterica serovar Typhi Ty2
auugaugccugcccaucuaa

SEQ ID NO: 1756675 - RNA, 15 nt, Salmonella enterica enterica serovar Typhi Ty2
auugauggccagccc

SEQ ID NO: 1756676 - RNA, 16 nt, Salmonella enterica enterica serovar Typhi Ty2
auugacccucccugcg

SEQ ID NO: 1756677 - RNA, 14 nt, Salmonella enterica enterica serovar Typhi Ty2
auugaccaggagca

SEQ ID NO: 1756678 - RNA, 20 nt, Salmonella enterica enterica serovar Typhi Ty2
auugauauagaguccagcca

SEQ ID NO: 1756679 - RNA, 15 nt, Salmonella enterica enterica serovar Typhi Ty2
auugauaagcggguu

SEQ ID NO: 1756680 - RNA, 18 nt, Salmonella enterica enterica serovar Typhi Ty2
auugcuuuuggcaacggc

SEQ ID NO: 1756681 - RNA, 19 nt, Salmonella enterica enterica serovar Typhi Ty2
auugcuggcagaugaacau

SEQ ID NO: 1756682 - RNA, 14 nt, Salmonella enterica enterica serovar Typhi Ty2
auugcuuuuuucca

SEQ ID NO: 1756683 - RNA, 16 nt, Salmonella enterica enterica serovar Typhi Ty2
auugcugaagauaaaa

SEQ ID NO: 1756684 - RNA, 20 nt, Salmonella enterica enterica serovar Typhi Ty2
auugcugcuauauaacauau

SEQ ID NO: 1756685 - RNA, 15 nt, Salmonella enterica enterica serovar Typhi Ty2
auuggcggcaaagaa

SEQ ID NO: 1756686 - RNA, 18 nt, Salmonella enterica enterica serovar Typhi Ty2
auuggaaaacuccagcag

SEQ ID NO: 1756687 - RNA, 13 nt, Salmonella enterica enterica serovar Typhi Ty2
auugcauaucgcu

SEQ ID NO: 1756688 - RNA, 18 nt, Salmonella enterica enterica serovar Typhi Ty2
auugccauguuaauacca

SEQ ID NO: 1756689 - RNA, 20 nt, Salmonella enterica enterica serovar Typhi Ty2
auugccaugcgacuaaccug

SEQ ID NO: 1756690 - RNA, 13 nt, Salmonella enterica enterica serovar Typhi Ty2
auugccacuuaau

SEQ ID NO: 1756691 - RNA, 21 nt, Salmonella enterica enterica serovar Typhi Ty2
auugcgccugggauaagcaga

SEQ ID NO: 1756692 - RNA, 20 nt, Salmonella enterica enterica serovar Typhi Ty2
auugcucuuccggcauaaaa

SEQ ID NO: 1756693 - RNA, 22 nt, Salmonella enterica enterica serovar Typhi Ty2
auugcugacaaaauaaagugaa

SEQ ID NO: 1756694 - RNA, 19 nt, Salmonella enterica enterica serovar Typhi Ty2
auugcugacgcgcuuuuuc

SEQ ID NO: 1756695 - RNA, 15 nt, Salmonella enterica enterica serovar Typhi Ty2
auugcugaagauaaa

SEQ ID NO: 1756696 - RNA, 16 nt, Salmonella enterica enterica serovar Typhi Ty2
auugcguaaugagcgu

SEQ ID NO: 1756697 - RNA, 19 nt, Salmonella enterica enterica serovar Typhi Ty2
auugcggggguuguuuuac

SEQ ID NO: 1756698 - RNA, 19 nt, Salmonella enterica enterica serovar Typhi Ty2
auucucaucagaccgugaa

SEQ ID NO: 1756699 - RNA, 23 nt, Salmonella enterica enterica serovar Typhi Ty2
auucucacagaaucaucaggcua

SEQ ID NO: 1756700 - RNA, 21 nt, Salmonella enterica enterica serovar Typhi Ty2
auucuacaguuugucaucagu

SEQ ID NO: 1756701 - RNA, 17 nt, Salmonella enterica enterica serovar Typhi Ty2
auucucugucgccgccc

SEQ ID NO: 1756702 - RNA, 14 nt, Salmonella enterica enterica serovar Typhi Ty2
auucucuucuacca

SEQ ID NO: 1756703 - RNA, 22 nt, Salmonella enterica enterica serovar Typhi Ty2
auucugaaaaggggauaacaac

SEQ ID NO: 1756704 - RNA, 17 nt, Salmonella enterica enterica serovar Typhi Ty2
auucucccaaauuuuuu

SEQ ID NO: 1756705 - RNA, 15 nt, Salmonella enterica enterica serovar Typhi Ty2
auucgucaauaccua

SEQ ID NO: 1756706 - RNA, 15 nt, Salmonella enterica enterica serovar Typhi Ty2
auucgguggaaaccg

SEQ ID NO: 1756707 - RNA, 15 nt, Salmonella enterica enterica serovar Typhi Ty2
auucgucuucaucuu

SEQ ID NO: 1756708 - RNA, 19 nt, Salmonella enterica enterica serovar Typhi Ty2
auucuuuuacgaucgccac

SEQ ID NO: 1756709 - RNA, 18 nt, Salmonella enterica enterica serovar Typhi Ty2
auugaaauuaaucaggca

SEQ ID NO: 1756710 - RNA, 12 nt, Salmonella enterica enterica serovar Typhi Ty2
auugaacgugau

SEQ ID NO: 1756711 - RNA, 14 nt, Salmonella enterica enterica serovar Typhi Ty2
auugaacauuuuuu

SEQ ID NO: 1756712 - RNA, 19 nt, Salmonella enterica enterica serovar Typhi Ty2
auucuuuaauuugugccag

SEQ ID NO: 1756713 - RNA, 23 nt, Salmonella enterica enterica serovar Typhi Ty2
auucuugcccuauaauaacaagc

SEQ ID NO: 1756714 - RNA, 18 nt, Salmonella enterica enterica serovar Typhi Ty2
auucuucgaaugucucaa

SEQ ID NO: 1756715 - RNA, 16 nt, Salmonella enterica enterica serovar Typhi Ty2
auucugcgccagccag

SEQ ID NO: 1756716 - RNA, 15 nt, Salmonella enterica enterica serovar Typhi Ty2
auucugccaguucac

SEQ ID NO: 1756717 - RNA, 18 nt, Salmonella enterica enterica serovar Typhi Ty2
auucugacgcagcuucug

SEQ ID NO: 1756718 - RNA, 19 nt, Salmonella enterica enterica serovar Typhi Ty2
cacucguaacgcauaucca

SEQ ID NO: 1756719 - RNA, 22 nt, Salmonella enterica enterica serovar Typhi Ty2
cacucguaacgcauauccagca

SEQ ID NO: 1756720 - RNA, 16 nt, Salmonella enterica enterica serovar Typhi Ty2
cacucuauucaugcau

SEQ ID NO: 1756721 - RNA, 16 nt, Salmonella enterica enterica serovar Typhi Ty2
cacuccggcugcacca

SEQ ID NO: 1756722 - RNA, 15 nt, Salmonella enterica enterica serovar Typhi Ty2
cacuccuaagagaaa

SEQ ID NO: 1756723 - RNA, 16 nt, Salmonella enterica enterica serovar Typhi Ty2
cacugacgaaaaccgu

SEQ ID NO: 1756724 - RNA, 19 nt, Salmonella enterica enterica serovar Typhi Ty2
cacugaagccuggugccca

SEQ ID NO: 1756725 - RNA, 14 nt, Salmonella enterica enterica serovar Typhi Ty2
cacucuuuuuggcu

SEQ ID NO: 1756726 - RNA, 22 nt, Salmonella enterica enterica serovar Typhi Ty2
cacucuuuggacggcaucagga

SEQ ID NO: 1756727 - RNA, 18 nt, Salmonella enterica enterica serovar Typhi Ty2
cacucagaaaauuauuuu

SEQ ID NO: 1756728 - RNA, 21 nt, Salmonella enterica enterica serovar Typhi Ty2
cacucagaaaauuauuuuaaa

SEQ ID NO: 1756729 - RNA, 12 nt, Salmonella enterica enterica serovar Typhi Ty2
cacuccagaccu

SEQ ID NO: 1756730 - RNA, 14 nt, Salmonella enterica enterica serovar Typhi Ty2
cacuccaucgccug

SEQ ID NO: 1756731 - RNA, 14 nt, Salmonella enterica enterica serovar Typhi Ty2
cacucauccagcaa

SEQ ID NO: 1756732 - RNA, 16 nt, Salmonella enterica enterica serovar Typhi Ty2
cacucauccagcaaaa

SEQ ID NO: 1756733 - RNA, 14 nt, Salmonella enterica enterica serovar Typhi Ty2
cacucagaaaauua

SEQ ID NO: 1756734 - RNA, 18 nt, Salmonella enterica enterica serovar Typhi Ty2
cacuauauguccuuuacu

SEQ ID NO: 1756735 - RNA, 15 nt, Salmonella enterica enterica serovar Typhi Ty2
cacuauccagucagc

SEQ ID NO: 1756736 - RNA, 16 nt, Salmonella enterica enterica serovar Typhi Ty2
cacuaccgccgcggau

SEQ ID NO: 1756737 - RNA, 22 nt, Salmonella enterica enterica serovar Typhi Ty2
cacuaccugauuggcuccccgc

SEQ ID NO: 1756738 - RNA, 12 nt, Salmonella enterica enterica serovar Typhi Ty2
cacuaauuugcg

SEQ ID NO: 1756739 - RNA, 21 nt, Salmonella enterica enterica serovar Typhi Ty2
cacuaccgggcagcaucucga

SEQ ID NO: 1756740 - RNA, 22 nt, Salmonella enterica enterica serovar Typhi Ty2
cacuaccauuuccggcgcgccu

SEQ ID NO: 1756741 - RNA, 20 nt, Salmonella enterica enterica serovar Typhi Ty2
cacuaacgauguaaaaccug

SEQ ID NO: 1756742 - RNA, 16 nt, Salmonella enterica enterica serovar Typhi Ty2
cacuaacgauguaaaa

SEQ ID NO: 1756743 - RNA, 15 nt, Salmonella enterica enterica serovar Typhi Ty2
cacuaacugaccaua

SEQ ID NO: 1756744 - RNA, 18 nt, Salmonella enterica enterica serovar Typhi Ty2
cacuaacuaauuguuugu

SEQ ID NO: 1756745 - RNA, 14 nt, Salmonella enterica enterica serovar Typhi Ty2
cacuaaaaacaggc

SEQ ID NO: 1756746 - RNA, 13 nt, Salmonella enterica enterica serovar Typhi Ty2
cacuaaaacaccg

SEQ ID NO: 1756747 - RNA, 17 nt, Salmonella enterica enterica serovar Typhi Ty2
cacguuauaccacuggu

SEQ ID NO: 1756748 - RNA, 22 nt, Salmonella enterica enterica serovar Typhi Ty2
cacguuaccgcgcaguucaaua

SEQ ID NO: 1756749 - RNA, 19 nt, Salmonella enterica enterica serovar Typhi Ty2
cacguacccaaauaucaaa

SEQ ID NO: 1756750 - RNA, 18 nt, Salmonella enterica enterica serovar Typhi Ty2
cacguauaaacgccgccg

SEQ ID NO: 1756751 - RNA, 17 nt, Salmonella enterica enterica serovar Typhi Ty2
cacguaacucggcagcg

SEQ ID NO: 1756752 - RNA, 13 nt, Salmonella enterica enterica serovar Typhi Ty2
cacguaauuuauu

SEQ ID NO: 1756753 - RNA, 13 nt, Salmonella enterica enterica serovar Typhi Ty2
cacgguugaagcg

SEQ ID NO: 1756754 - RNA, 19 nt, Salmonella enterica enterica serovar Typhi Ty2
cacgucagcgaccauugcg

SEQ ID NO: 1756755 - RNA, 20 nt, Salmonella enterica enterica serovar Typhi Ty2
cacguauucggcuuacccaa

SEQ ID NO: 1756756 - RNA, 17 nt, Salmonella enterica enterica serovar Typhi Ty2
cacgucauccggcaagc

SEQ ID NO: 1756757 - RNA, 18 nt, Salmonella enterica enterica serovar Typhi Ty2
cacggugugaucaccgcc

SEQ ID NO: 1756758 - RNA, 14 nt, Salmonella enterica enterica serovar Typhi Ty2
cacgguaaaccucu

SEQ ID NO: 1756759 - RNA, 17 nt, Salmonella enterica enterica serovar Typhi Ty2
cacggucaaucaucaga

SEQ ID NO: 1756760 - RNA, 17 nt, Salmonella enterica enterica serovar Typhi Ty2
cacgguauuaacaggcg

SEQ ID NO: 1756761 - RNA, 15 nt, Salmonella enterica enterica serovar Typhi Ty2
cacgggcgcaccaua

SEQ ID NO: 1756762 - RNA, 22 nt, Salmonella enterica enterica serovar Typhi Ty2
cacgcaaugccugaccaacguc

SEQ ID NO: 1756763 - RNA, 22 nt, Salmonella enterica enterica serovar Typhi Ty2
cacgcacaucccgaauacgcug

SEQ ID NO: 1756764 - RNA, 16 nt, Salmonella enterica enterica serovar Typhi Ty2
cacgcaaaauggccug

SEQ ID NO: 1756765 - RNA, 19 nt, Salmonella enterica enterica serovar Typhi Ty2
cacgcacgacagugcuaua

SEQ ID NO: 1756766 - RNA, 24 nt, Salmonella enterica enterica serovar Typhi Ty2
cacgcagacgccgcgguugacggc

SEQ ID NO: 1756767 - RNA, 20 nt, Salmonella enterica enterica serovar Typhi Ty2
cacgcagauaucuuccagcg

SEQ ID NO: 1756768 - RNA, 24 nt, Salmonella enterica enterica serovar Typhi Ty2
cacgcagcgcagaccgagcgcaug

SEQ ID NO: 1756769 - RNA, 19 nt, Salmonella enterica enterica serovar Typhi Ty2
cacgcagauaucuuccagc

SEQ ID NO: 1756770 - RNA, 15 nt, Salmonella enterica enterica serovar Typhi Ty2
cacgcaguccaacaa

SEQ ID NO: 1756771 - RNA, 16 nt, Salmonella enterica enterica serovar Typhi Ty2
cacgcaguccaacaag

SEQ ID NO: 1756772 - RNA, 22 nt, Salmonella enterica enterica serovar Typhi Ty2
cacgauggcgauuuucaccggc

SEQ ID NO: 1756773 - RNA, 12 nt, Salmonella enterica enterica serovar Typhi Ty2
cacgauggcaaa

SEQ ID NO: 1756774 - RNA, 15 nt, Salmonella enterica enterica serovar Typhi Ty2
cacgaugcauaugca

SEQ ID NO: 1756775 - RNA, 16 nt, Salmonella enterica enterica serovar Typhi Ty2
cacgauagacagcacc

SEQ ID NO: 1756776 - RNA, 24 nt, Salmonella enterica enterica serovar Typhi Ty2
cacgauagacagcaccaucaugca

SEQ ID NO: 1756777 - RNA, 20 nt, Salmonella enterica enterica serovar Typhi Ty2
cacgauacuguugcaguuua

SEQ ID NO: 1756778 - RNA, 16 nt, Salmonella enterica enterica serovar Typhi Ty2
cacgaucgaugcccug

SEQ ID NO: 1756779 - RNA, 11 nt, Salmonella enterica enterica serovar Typhi Ty2
cacgaucaucg

SEQ ID NO: 1756780 - RNA, 20 nt, Salmonella enterica enterica serovar Typhi Ty2
cacgaucgagucaggcgcca

SEQ ID NO: 1756781 - RNA, 15 nt, Salmonella enterica enterica serovar Typhi Ty2
cacgccagauaaauc

SEQ ID NO: 1756782 - RNA, 16 nt, Salmonella enterica enterica serovar Typhi Ty2
cacgccaucagggacg

SEQ ID NO: 1756783 - RNA, 16 nt, Salmonella enterica enterica serovar Typhi Ty2
cacgccaucauuggcu

SEQ ID NO: 1756784 - RNA, 17 nt, Salmonella enterica enterica serovar Typhi Ty2
cacgccauggccgcagc

SEQ ID NO: 1756785 - RNA, 14 nt, Salmonella enterica enterica serovar Typhi Ty2
cacgccaucggcua

SEQ ID NO: 1756786 - RNA, 16 nt, Salmonella enterica enterica serovar Typhi Ty2
cacgccaucgccugau

SEQ ID NO: 1756787 - RNA, 11 nt, Salmonella enterica enterica serovar Typhi Ty2
cacgcccagcg

SEQ ID NO: 1756788 - RNA, 18 nt, Salmonella enterica enterica serovar Typhi Ty2
cacgcauugccacagccu

SEQ ID NO: 1756789 - RNA, 18 nt, Salmonella enterica enterica serovar Typhi Ty2
cacgcauucuuuuuucuc

SEQ ID NO: 1756790 - RNA, 22 nt, Salmonella enterica enterica serovar Typhi Ty2
cacgcauggcguugcugcaaau

SEQ ID NO: 1756791 - RNA, 21 nt, Salmonella enterica enterica serovar Typhi Ty2
cacgcaucgggucgcgcgccg

SEQ ID NO: 1756792 - RNA, 21 nt, Salmonella enterica enterica serovar Typhi Ty2
cacgcauaaaaaaggcucgca

SEQ ID NO: 1756793 - RNA, 11 nt, Salmonella enterica enterica serovar Typhi Ty2
cacgccaccgg

SEQ ID NO: 1756794 - RNA, 14 nt, Salmonella enterica enterica serovar Typhi Ty2
cacgccaccgggcc

SEQ ID NO: 1756795 - RNA, 13 nt, Salmonella enterica enterica serovar Typhi Ty2
cacgccaccaucc

SEQ ID NO: 1756796 - RNA, 19 nt, Salmonella enterica enterica serovar Typhi Ty2
cacgccagauaaaucagcc

SEQ ID NO: 1756797 - RNA, 13 nt, Salmonella enterica enterica serovar Typhi Ty2
cacgccagcagcu

SEQ ID NO: 1756798 - RNA, 20 nt, Salmonella enterica enterica serovar Typhi Ty2
cacgccgugaauuucugcug

SEQ ID NO: 1756799 - RNA, 21 nt, Salmonella enterica enterica serovar Typhi Ty2
cacgccgugcacuucugcggu

SEQ ID NO: 1756800 - RNA, 21 nt, Salmonella enterica enterica serovar Typhi Ty2
cacgccguagcugcgcgccgc

SEQ ID NO: 1756801 - RNA, 23 nt, Salmonella enterica enterica serovar Typhi Ty2
cacgccgcccgccugagcgcgca

SEQ ID NO: 1756802 - RNA, 19 nt, Salmonella enterica enterica serovar Typhi Ty2
cacgccgccauccggcacu

SEQ ID NO: 1756803 - RNA, 12 nt, Salmonella enterica enterica serovar Typhi Ty2
cacgccgcgcug

SEQ ID NO: 1756804 - RNA, 16 nt, Salmonella enterica enterica serovar Typhi Ty2
cacgccgcuccacagc

SEQ ID NO: 1756805 - RNA, 23 nt, Salmonella enterica enterica serovar Typhi Ty2
cacgccgcuaucgaccagcaccu

SEQ ID NO: 1756806 - RNA, 24 nt, Salmonella enterica enterica serovar Typhi Ty2
cacgccgcuaucgaccagcaccug

SEQ ID NO: 1756807 - RNA, 16 nt, Salmonella enterica enterica serovar Typhi Ty2
cacgccgcuacugccg

SEQ ID NO: 1756808 - RNA, 21 nt, Salmonella enterica enterica serovar Typhi Ty2
cacgccggaaucgcgauccag

SEQ ID NO: 1756809 - RNA, 22 nt, Salmonella enterica enterica serovar Typhi Ty2
cacgccgacucacgcagcgcuc

SEQ ID NO: 1756810 - RNA, 17 nt, Salmonella enterica enterica serovar Typhi Ty2
cacgccgcacacagcag

SEQ ID NO: 1756811 - RNA, 17 nt, Salmonella enterica enterica serovar Typhi Ty2
cacgccccuaaggcagc

SEQ ID NO: 1756812 - RNA, 21 nt, Salmonella enterica enterica serovar Typhi Ty2
cacgcccugccauucccagcc

SEQ ID NO: 1756813 - RNA, 17 nt, Salmonella enterica enterica serovar Typhi Ty2
cacgcugaccuuuuuca

SEQ ID NO: 1756814 - RNA, 19 nt, Salmonella enterica enterica serovar Typhi Ty2
cacgcugaccacgccgccg

SEQ ID NO: 1756815 - RNA, 16 nt, Salmonella enterica enterica serovar Typhi Ty2
cacgcugccgccgcuc

SEQ ID NO: 1756816 - RNA, 15 nt, Salmonella enterica enterica serovar Typhi Ty2
cacgcuggcaucaau

SEQ ID NO: 1756817 - RNA, 18 nt, Salmonella enterica enterica serovar Typhi Ty2
cacgcuaaaaaaggcaga

SEQ ID NO: 1756818 - RNA, 18 nt, Salmonella enterica enterica serovar Typhi Ty2
cacgcucccggaaccgac

SEQ ID NO: 1756819 - RNA, 15 nt, Salmonella enterica enterica serovar Typhi Ty2
cacgcucgaguucuu

SEQ ID NO: 1756820 - RNA, 14 nt, Salmonella enterica enterica serovar Typhi Ty2
cacgccugcuucac

SEQ ID NO: 1756821 - RNA, 17 nt, Salmonella enterica enterica serovar Typhi Ty2
cacgccuuccuccagca

SEQ ID NO: 1756822 - RNA, 13 nt, Salmonella enterica enterica serovar Typhi Ty2
cacgcgacgccag

SEQ ID NO: 1756823 - RNA, 14 nt, Salmonella enterica enterica serovar Typhi Ty2
cacgcgacgccagc

SEQ ID NO: 1756824 - RNA, 14 nt, Salmonella enterica enterica serovar Typhi Ty2
cacgcgacgcgcca

SEQ ID NO: 1756825 - RNA, 22 nt, Salmonella enterica enterica serovar Typhi Ty2
cacgcgaauagccagacagccc

SEQ ID NO: 1756826 - RNA, 19 nt, Salmonella enterica enterica serovar Typhi Ty2
cacgcgcggcuacugccag

SEQ ID NO: 1756827 - RNA, 14 nt, Salmonella enterica enterica serovar Typhi Ty2
cacgcgcggcgcca

SEQ ID NO: 1756828 - RNA, 16 nt, Salmonella enterica enterica serovar Typhi Ty2
cacgcgccagcaccac

SEQ ID NO: 1756829 - RNA, 20 nt, Salmonella enterica enterica serovar Typhi Ty2
cacggagagacaguucagau

SEQ ID NO: 1756830 - RNA, 18 nt, Salmonella enterica enterica serovar Typhi Ty2
cacgcuuuuacaucgcug

SEQ ID NO: 1756831 - RNA, 13 nt, Salmonella enterica enterica serovar Typhi Ty2
cacgcuucgccug

SEQ ID NO: 1756832 - RNA, 13 nt, Salmonella enterica enterica serovar Typhi Ty2
cacgcuguuuauu

SEQ ID NO: 1756833 - RNA, 15 nt, Salmonella enterica enterica serovar Typhi Ty2
cacggauggccucug

SEQ ID NO: 1756834 - RNA, 19 nt, Salmonella enterica enterica serovar Typhi Ty2
cacggaucaucuacccgua

SEQ ID NO: 1756835 - RNA, 17 nt, Salmonella enterica enterica serovar Typhi Ty2
cacggaugaucuucaua

SEQ ID NO: 1756836 - RNA, 15 nt, Salmonella enterica enterica serovar Typhi Ty2
cacggcauaagccuc

SEQ ID NO: 1756837 - RNA, 15 nt, Salmonella enterica enterica serovar Typhi Ty2
cacggccacagccau

SEQ ID NO: 1756838 - RNA, 23 nt, Salmonella enterica enterica serovar Typhi Ty2
cacggcauucacgucgcgcgccg

SEQ ID NO: 1756839 - RNA, 19 nt, Salmonella enterica enterica serovar Typhi Ty2
cacggcucgaucccgaccc

SEQ ID NO: 1756840 - RNA, 20 nt, Salmonella enterica enterica serovar Typhi Ty2
cacggcguguugaaauccuc

SEQ ID NO: 1756841 - RNA, 22 nt, Salmonella enterica enterica serovar Typhi Ty2
cacggcguguugaaauccucua

SEQ ID NO: 1756842 - RNA, 21 nt, Salmonella enterica enterica serovar Typhi Ty2
cacggcucgccuuugcgcccg

SEQ ID NO: 1756843 - RNA, 15 nt, Salmonella enterica enterica serovar Typhi Ty2
cacccggagagaaac

SEQ ID NO: 1756844 - RNA, 11 nt, Salmonella enterica enterica serovar Typhi Ty2
cacccucugcg

SEQ ID NO: 1756845 - RNA, 19 nt, Salmonella enterica enterica serovar Typhi Ty2
cacccucgucuuugccucg

SEQ ID NO: 1756846 - RNA, 13 nt, Salmonella enterica enterica serovar Typhi Ty2
cacccuauaagcu

SEQ ID NO: 1756847 - RNA, 13 nt, Salmonella enterica enterica serovar Typhi Ty2
caccgccagcagu

SEQ ID NO: 1756848 - RNA, 13 nt, Salmonella enterica enterica serovar Typhi Ty2
caccgccagagca

SEQ ID NO: 1756849 - RNA, 18 nt, Salmonella enterica enterica serovar Typhi Ty2
caccgccagacgccccaa

SEQ ID NO: 1756850 - RNA, 13 nt, Salmonella enterica enterica serovar Typhi Ty2
caccgccagacgc

SEQ ID NO: 1756851 - RNA, 18 nt, Salmonella enterica enterica serovar Typhi Ty2
caccgccacuuccgcuac

SEQ ID NO: 1756852 - RNA, 13 nt, Salmonella enterica enterica serovar Typhi Ty2
caccgcaucggca

SEQ ID NO: 1756853 - RNA, 12 nt, Salmonella enterica enterica serovar Typhi Ty2
caccgcauggcu

SEQ ID NO: 1756854 - RNA, 18 nt, Salmonella enterica enterica serovar Typhi Ty2
caccgccaaccgcccguc

SEQ ID NO: 1756855 - RNA, 23 nt, Salmonella enterica enterica serovar Typhi Ty2
caccgauuucaucgcugaauuug

SEQ ID NO: 1756856 - RNA, 14 nt, Salmonella enterica enterica serovar Typhi Ty2
caccgcacgggcaa

SEQ ID NO: 1756857 - RNA, 14 nt, Salmonella enterica enterica serovar Typhi Ty2
caccgaggguuugu

SEQ ID NO: 1756858 - RNA, 15 nt, Salmonella enterica enterica serovar Typhi Ty2
caccgaccugccuug

SEQ ID NO: 1756859 - RNA, 12 nt, Salmonella enterica enterica serovar Typhi Ty2
caccgacuccuc

SEQ ID NO: 1756860 - RNA, 14 nt, Salmonella enterica enterica serovar Typhi Ty2
caccgggccaccga

SEQ ID NO: 1756861 - RNA, 12 nt, Salmonella enterica enterica serovar Typhi Ty2
caccggcggcca

SEQ ID NO: 1756862 - RNA, 14 nt, Salmonella enterica enterica serovar Typhi Ty2
caccggcggcgcca

SEQ ID NO: 1756863 - RNA, 13 nt, Salmonella enterica enterica serovar Typhi Ty2
caccggcgcgcca

SEQ ID NO: 1756864 - RNA, 20 nt, Salmonella enterica enterica serovar Typhi Ty2
caccggccauugccgcgccg

SEQ ID NO: 1756865 - RNA, 14 nt, Salmonella enterica enterica serovar Typhi Ty2
caccggauacccag

SEQ ID NO: 1756866 - RNA, 22 nt, Salmonella enterica enterica serovar Typhi Ty2
caccgcgucguuacgcucguca

SEQ ID NO: 1756867 - RNA, 16 nt, Salmonella enterica enterica serovar Typhi Ty2
caccggaccgccgagu

SEQ ID NO: 1756868 - RNA, 14 nt, Salmonella enterica enterica serovar Typhi Ty2
caccggacauccca

SEQ ID NO: 1756869 - RNA, 20 nt, Salmonella enterica enterica serovar Typhi Ty2
caccgcuugccggcgcagcg

SEQ ID NO: 1756870 - RNA, 16 nt, Salmonella enterica enterica serovar Typhi Ty2
caccgcccuggcggga

SEQ ID NO: 1756871 - RNA, 18 nt, Salmonella enterica enterica serovar Typhi Ty2
caccgccgccaccaaaaa

SEQ ID NO: 1756872 - RNA, 22 nt, Salmonella enterica enterica serovar Typhi Ty2
caccgccauauuaugcuggccu

SEQ ID NO: 1756873 - RNA, 15 nt, Salmonella enterica enterica serovar Typhi Ty2
caccgcccgccgggc

SEQ ID NO: 1756874 - RNA, 12 nt, Salmonella enterica enterica serovar Typhi Ty2
caccgccgggcu

SEQ ID NO: 1756875 - RNA, 15 nt, Salmonella enterica enterica serovar Typhi Ty2
caccgcgaugcugcu

SEQ ID NO: 1756876 - RNA, 21 nt, Salmonella enterica enterica serovar Typhi Ty2
caccgcggcgcucgccagccc

SEQ ID NO: 1756877 - RNA, 20 nt, Salmonella enterica enterica serovar Typhi Ty2
caccgcggagaucgcucccg

SEQ ID NO: 1756878 - RNA, 21 nt, Salmonella enterica enterica serovar Typhi Ty2
caccuggucuauucguucucu

SEQ ID NO: 1756879 - RNA, 23 nt, Salmonella enterica enterica serovar Typhi Ty2
caccuguaaccccagcaucugca

SEQ ID NO: 1756880 - RNA, 18 nt, Salmonella enterica enterica serovar Typhi Ty2
caccuuacgcacaugauc

SEQ ID NO: 1756881 - RNA, 18 nt, Salmonella enterica enterica serovar Typhi Ty2
caccuggaugcugccugc

SEQ ID NO: 1756882 - RNA, 19 nt, Salmonella enterica enterica serovar Typhi Ty2
caccugcuggucaccuggc

SEQ ID NO: 1756883 - RNA, 13 nt, Salmonella enterica enterica serovar Typhi Ty2
caccuuucugcca

SEQ ID NO: 1756884 - RNA, 23 nt, Salmonella enterica enterica serovar Typhi Ty2
caccuuuacuuaauucugcugcc

SEQ ID NO: 1756885 - RNA, 18 nt, Salmonella enterica enterica serovar Typhi Ty2
cacgaaugucgcgucagg

SEQ ID NO: 1756886 - RNA, 22 nt, Salmonella enterica enterica serovar Typhi Ty2
cacgaaucuggucguaagaauu

SEQ ID NO: 1756887 - RNA, 15 nt, Salmonella enterica enterica serovar Typhi Ty2
cacgacagugcuaua

SEQ ID NO: 1756888 - RNA, 17 nt, Salmonella enterica enterica serovar Typhi Ty2
cacgaacgauauaaaaa

SEQ ID NO: 1756889 - RNA, 18 nt, Salmonella enterica enterica serovar Typhi Ty2
caccuuuuuauuuacugc

SEQ ID NO: 1756890 - RNA, 17 nt, Salmonella enterica enterica serovar Typhi Ty2
cacgaaaaauaaaaaaa

SEQ ID NO: 1756891 - RNA, 21 nt, Salmonella enterica enterica serovar Typhi Ty2
cacgaaauaacgcacuaccag

SEQ ID NO: 1756892 - RNA, 16 nt, Salmonella enterica enterica serovar Typhi Ty2
cacgaggccacgcagc

SEQ ID NO: 1756893 - RNA, 22 nt, Salmonella enterica enterica serovar Typhi Ty2
caccucagguaaauccgccagu

SEQ ID NO: 1756894 - RNA, 12 nt, Salmonella enterica enterica serovar Typhi Ty2
caccucauauuu

SEQ ID NO: 1756895 - RNA, 16 nt, Salmonella enterica enterica serovar Typhi Ty2
caccucaucaacgcca

SEQ ID NO: 1756896 - RNA, 16 nt, Salmonella enterica enterica serovar Typhi Ty2
caccucagccacccac

SEQ ID NO: 1756897 - RNA, 23 nt, Salmonella enterica enterica serovar Typhi Ty2
caccucaccggcuguauacacuu

SEQ ID NO: 1756898 - RNA, 23 nt, Salmonella enterica enterica serovar Typhi Ty2
caccucgcgacggugagcugaaa

SEQ ID NO: 1756899 - RNA, 20 nt, Salmonella enterica enterica serovar Typhi Ty2
caccugaauaacccgcagcc

SEQ ID NO: 1756900 - RNA, 15 nt, Salmonella enterica enterica serovar Typhi Ty2
caccugaaugcaaag

SEQ ID NO: 1756901 - RNA, 16 nt, Salmonella enterica enterica serovar Typhi Ty2
caccugaaugcaaaga

SEQ ID NO: 1756902 - RNA, 15 nt, Salmonella enterica enterica serovar Typhi Ty2
caccugacggcagcc

SEQ ID NO: 1756903 - RNA, 22 nt, Salmonella enterica enterica serovar Typhi Ty2
caccugauugauacgcgcccga

SEQ ID NO: 1756904 - RNA, 14 nt, Salmonella enterica enterica serovar Typhi Ty2
caccugaucgccaa

SEQ ID NO: 1756905 - RNA, 12 nt, Salmonella enterica enterica serovar Typhi Ty2
caccugaugccc

SEQ ID NO: 1756906 - RNA, 22 nt, Salmonella enterica enterica serovar Typhi Ty2
caccugcaucacgcccggcggu

SEQ ID NO: 1756907 - RNA, 18 nt, Salmonella enterica enterica serovar Typhi Ty2
caccugccaguccgcccg

SEQ ID NO: 1756908 - RNA, 15 nt, Salmonella enterica enterica serovar Typhi Ty2
caccuaacccaccau

SEQ ID NO: 1756909 - RNA, 14 nt, Salmonella enterica enterica serovar Typhi Ty2
caccguuuuccagg

SEQ ID NO: 1756910 - RNA, 20 nt, Salmonella enterica enterica serovar Typhi Ty2
caccguuuaaucgcccugcg

SEQ ID NO: 1756911 - RNA, 19 nt, Salmonella enterica enterica serovar Typhi Ty2
caccgucgcggcaucguag

SEQ ID NO: 1756912 - RNA, 19 nt, Salmonella enterica enterica serovar Typhi Ty2
caccgucuccggcgcgccg

SEQ ID NO: 1756913 - RNA, 22 nt, Salmonella enterica enterica serovar Typhi Ty2
caccguaucgacauaguacccu

SEQ ID NO: 1756914 - RNA, 19 nt, Salmonella enterica enterica serovar Typhi Ty2
caccguaaaaggaaucaac

SEQ ID NO: 1756915 - RNA, 13 nt, Salmonella enterica enterica serovar Typhi Ty2
caccgucaauaac

SEQ ID NO: 1756916 - RNA, 21 nt, Salmonella enterica enterica serovar Typhi Ty2
caccgguugcgcaaccuccgc

SEQ ID NO: 1756917 - RNA, 22 nt, Salmonella enterica enterica serovar Typhi Ty2
caccgguuuuuccgcuucaccu

SEQ ID NO: 1756918 - RNA, 18 nt, Salmonella enterica enterica serovar Typhi Ty2
caccggguuaaagcccug

SEQ ID NO: 1756919 - RNA, 19 nt, Salmonella enterica enterica serovar Typhi Ty2
caccggguuaaagcccuga

SEQ ID NO: 1756920 - RNA, 21 nt, Salmonella enterica enterica serovar Typhi Ty2
caccaggaaugcggccauccu

SEQ ID NO: 1756921 - RNA, 17 nt, Salmonella enterica enterica serovar Typhi Ty2
caccauauucgccaccg

SEQ ID NO: 1756922 - RNA, 14 nt, Salmonella enterica enterica serovar Typhi Ty2
caccauaucuucca

SEQ ID NO: 1756923 - RNA, 21 nt, Salmonella enterica enterica serovar Typhi Ty2
caccaguaaccgccacagcau

SEQ ID NO: 1756924 - RNA, 16 nt, Salmonella enterica enterica serovar Typhi Ty2
caccaguucauauuug

SEQ ID NO: 1756925 - RNA, 15 nt, Salmonella enterica enterica serovar Typhi Ty2
caccagucccagccc

SEQ ID NO: 1756926 - RNA, 15 nt, Salmonella enterica enterica serovar Typhi Ty2
caccagcgucgcaug

SEQ ID NO: 1756927 - RNA, 13 nt, Salmonella enterica enterica serovar Typhi Ty2
caccaggaacgcc

SEQ ID NO: 1756928 - RNA, 19 nt, Salmonella enterica enterica serovar Typhi Ty2
caccagcguggcuauccau

SEQ ID NO: 1756929 - RNA, 20 nt, Salmonella enterica enterica serovar Typhi Ty2
caccagccguucaccagcca

SEQ ID NO: 1756930 - RNA, 18 nt, Salmonella enterica enterica serovar Typhi Ty2
caccagcgauaucaacgu

SEQ ID NO: 1756931 - RNA, 14 nt, Salmonella enterica enterica serovar Typhi Ty2
caccagcgccaggc

SEQ ID NO: 1756932 - RNA, 13 nt, Salmonella enterica enterica serovar Typhi Ty2
caccagcgcgccg

SEQ ID NO: 1756933 - RNA, 17 nt, Salmonella enterica enterica serovar Typhi Ty2
caccagcgcgccgccgc

SEQ ID NO: 1756934 - RNA, 13 nt, Salmonella enterica enterica serovar Typhi Ty2
caccagcacagcc

SEQ ID NO: 1756935 - RNA, 23 nt, Salmonella enterica enterica serovar Typhi Ty2
caccagcaacguaaucccgccag

SEQ ID NO: 1756936 - RNA, 13 nt, Salmonella enterica enterica serovar Typhi Ty2
caccagcccaacg

SEQ ID NO: 1756937 - RNA, 14 nt, Salmonella enterica enterica serovar Typhi Ty2
caccagcaguugcc

SEQ ID NO: 1756938 - RNA, 18 nt, Salmonella enterica enterica serovar Typhi Ty2
cacccgaaagucaaaaua

SEQ ID NO: 1756939 - RNA, 15 nt, Salmonella enterica enterica serovar Typhi Ty2
caccccuugcgcguu

SEQ ID NO: 1756940 - RNA, 18 nt, Salmonella enterica enterica serovar Typhi Ty2
cacccgauaaaaucaucg

SEQ ID NO: 1756941 - RNA, 15 nt, Salmonella enterica enterica serovar Typhi Ty2
cacccgcagccagaa

SEQ ID NO: 1756942 - RNA, 22 nt, Salmonella enterica enterica serovar Typhi Ty2
cacccgcagccgcaaucagcgu

SEQ ID NO: 1756943 - RNA, 21 nt, Salmonella enterica enterica serovar Typhi Ty2
caccccaacaaauagcacaca

SEQ ID NO: 1756944 - RNA, 14 nt, Salmonella enterica enterica serovar Typhi Ty2
cacccccaucgccc

SEQ ID NO: 1756945 - RNA, 11 nt, Salmonella enterica enterica serovar Typhi Ty2
caccccagccu

SEQ ID NO: 1756946 - RNA, 14 nt, Salmonella enterica enterica serovar Typhi Ty2
cacccacaggagcc

SEQ ID NO: 1756947 - RNA, 13 nt, Salmonella enterica enterica serovar Typhi Ty2
cacccacgccgga

SEQ ID NO: 1756948 - RNA, 14 nt, Salmonella enterica enterica serovar Typhi Ty2
caccauuucacaaa

SEQ ID NO: 1756949 - RNA, 19 nt, Salmonella enterica enterica serovar Typhi Ty2
caccauuucacaaauuaaa

SEQ ID NO: 1756950 - RNA, 16 nt, Salmonella enterica enterica serovar Typhi Ty2
caccauucccagcgcc

SEQ ID NO: 1756951 - RNA, 21 nt, Salmonella enterica enterica serovar Typhi Ty2
caccauuaugaccaauaauaa

SEQ ID NO: 1756952 - RNA, 12 nt, Salmonella enterica enterica serovar Typhi Ty2
caccauucuuca

SEQ ID NO: 1756953 - RNA, 14 nt, Salmonella enterica enterica serovar Typhi Ty2
caccauucuucaac

SEQ ID NO: 1756954 - RNA, 18 nt, Salmonella enterica enterica serovar Typhi Ty2
caccauguggcgcggccu

SEQ ID NO: 1756955 - RNA, 13 nt, Salmonella enterica enterica serovar Typhi Ty2
caccaucuuuuuu

SEQ ID NO: 1756956 - RNA, 20 nt, Salmonella enterica enterica serovar Typhi Ty2
caccaucguugccagcggcc

SEQ ID NO: 1756957 - RNA, 21 nt, Salmonella enterica enterica serovar Typhi Ty2
caccaucguugccagcggcca

SEQ ID NO: 1756958 - RNA, 19 nt, Salmonella enterica enterica serovar Typhi Ty2
caccaucguugccagcggc

SEQ ID NO: 1756959 - RNA, 21 nt, Salmonella enterica enterica serovar Typhi Ty2
caccaucgucgccagacccag

SEQ ID NO: 1756960 - RNA, 16 nt, Salmonella enterica enterica serovar Typhi Ty2
caccaugcaaaaugcu

SEQ ID NO: 1756961 - RNA, 17 nt, Salmonella enterica enterica serovar Typhi Ty2
caccauccggcgcugcg

SEQ ID NO: 1756962 - RNA, 14 nt, Salmonella enterica enterica serovar Typhi Ty2
caccauccggcgcu

SEQ ID NO: 1756963 - RNA, 20 nt, Salmonella enterica enterica serovar Typhi Ty2
caccaucgucgccagaccca

SEQ ID NO: 1756964 - RNA, 15 nt, Salmonella enterica enterica serovar Typhi Ty2
caccaucgccggaga

SEQ ID NO: 1756965 - RNA, 13 nt, Salmonella enterica enterica serovar Typhi Ty2
caccaucccgcuc

SEQ ID NO: 1756966 - RNA, 14 nt, Salmonella enterica enterica serovar Typhi Ty2
caccaucccggcgu

SEQ ID NO: 1756967 - RNA, 14 nt, Salmonella enterica enterica serovar Typhi Ty2
caccauccgcgcau

SEQ ID NO: 1756968 - RNA, 19 nt, Salmonella enterica enterica serovar Typhi Ty2
caccaucaugcaagagucc

SEQ ID NO: 1756969 - RNA, 14 nt, Salmonella enterica enterica serovar Typhi Ty2
caccaccuccugcu

SEQ ID NO: 1756970 - RNA, 15 nt, Salmonella enterica enterica serovar Typhi Ty2
caccaccuccugcug

SEQ ID NO: 1756971 - RNA, 14 nt, Salmonella enterica enterica serovar Typhi Ty2
caccaccucaaacg

SEQ ID NO: 1756972 - RNA, 18 nt, Salmonella enterica enterica serovar Typhi Ty2
caccaccaguacauggcu

SEQ ID NO: 1756973 - RNA, 22 nt, Salmonella enterica enterica serovar Typhi Ty2
caccacccguucgaaugagaac

SEQ ID NO: 1756974 - RNA, 19 nt, Salmonella enterica enterica serovar Typhi Ty2
caccacagucaucgcgcca

SEQ ID NO: 1756975 - RNA, 21 nt, Salmonella enterica enterica serovar Typhi Ty2
caccacauaccgucaccacgc

SEQ ID NO: 1756976 - RNA, 22 nt, Salmonella enterica enterica serovar Typhi Ty2
caccaaugucauauuugugagc

SEQ ID NO: 1756977 - RNA, 12 nt, Salmonella enterica enterica serovar Typhi Ty2
caccaauugcca

SEQ ID NO: 1756978 - RNA, 21 nt, Salmonella enterica enterica serovar Typhi Ty2
caccagaacucccuguuccug

SEQ ID NO: 1756979 - RNA, 18 nt, Salmonella enterica enterica serovar Typhi Ty2
caccagaacucccuguuc

SEQ ID NO: 1756980 - RNA, 20 nt, Salmonella enterica enterica serovar Typhi Ty2
caccacuuuguuuuuguccg

SEQ ID NO: 1756981 - RNA, 19 nt, Salmonella enterica enterica serovar Typhi Ty2
caccacuggcagcgccuga

SEQ ID NO: 1756982 - RNA, 23 nt, Salmonella enterica enterica serovar Typhi Ty2
caccacuggcagcgccugacggc

SEQ ID NO: 1756983 - RNA, 15 nt, Salmonella enterica enterica serovar Typhi Ty2
caccagaaucgccag

SEQ ID NO: 1756984 - RNA, 20 nt, Salmonella enterica enterica serovar Typhi Ty2
caccagacuaaaacgugcug

SEQ ID NO: 1756985 - RNA, 21 nt, Salmonella enterica enterica serovar Typhi Ty2
caccagaccgacaagcccccc

SEQ ID NO: 1756986 - RNA, 14 nt, Salmonella enterica enterica serovar Typhi Ty2
caccagaucggcau

SEQ ID NO: 1756987 - RNA, 19 nt, Salmonella enterica enterica serovar Typhi Ty2
caccacgccuaaugaagcg

SEQ ID NO: 1756988 - RNA, 11 nt, Salmonella enterica enterica serovar Typhi Ty2
caccacgcggg

SEQ ID NO: 1756989 - RNA, 14 nt, Salmonella enterica enterica serovar Typhi Ty2
caccacgcagcccg

SEQ ID NO: 1756990 - RNA, 13 nt, Salmonella enterica enterica serovar Typhi Ty2
caccacgcacagu

SEQ ID NO: 1756991 - RNA, 15 nt, Salmonella enterica enterica serovar Typhi Ty2
caccacgcaaaccgc

SEQ ID NO: 1756992 - RNA, 18 nt, Salmonella enterica enterica serovar Typhi Ty2
caccacgguguaccccgc

SEQ ID NO: 1756993 - RNA, 16 nt, Salmonella enterica enterica serovar Typhi Ty2
caccacgguguacccc

SEQ ID NO: 1756994 - RNA, 16 nt, Salmonella enterica enterica serovar Typhi Ty2
caccacgucauccucc

SEQ ID NO: 1756995 - RNA, 21 nt, Salmonella enterica enterica serovar Typhi Ty2
caccaacggcgacgcccgcca

SEQ ID NO: 1756996 - RNA, 17 nt, Salmonella enterica enterica serovar Typhi Ty2
caccaauacgugagcga

SEQ ID NO: 1756997 - RNA, 13 nt, Salmonella enterica enterica serovar Typhi Ty2
cacauuuuuauca

SEQ ID NO: 1756998 - RNA, 10 nt, Salmonella enterica enterica serovar Typhi Ty2
caccaaaaac

SEQ ID NO: 1756999 - RNA, 17 nt, Salmonella enterica enterica serovar Typhi Ty2
cacauuucagcgcagaa

SEQ ID NO: 1757000 - RNA, 15 nt, Salmonella enterica enterica serovar Typhi Ty2
cacauuggccccugg

SEQ ID NO: 1757001 - RNA, 12 nt, Salmonella enterica enterica serovar Typhi Ty2
cacauuggcaaa

SEQ ID NO: 1757002 - RNA, 20 nt, Salmonella enterica enterica serovar Typhi Ty2
cacauuggcugcgcuucuga

SEQ ID NO: 1757003 - RNA, 22 nt, Salmonella enterica enterica serovar Typhi Ty2
cacauucugcccgcguuuccac

SEQ ID NO: 1757004 - RNA, 14 nt, Salmonella enterica enterica serovar Typhi Ty2
cacauugagcgaga

SEQ ID NO: 1757005 - RNA, 16 nt, Salmonella enterica enterica serovar Typhi Ty2
cacauugcgguucauu

SEQ ID NO: 1757006 - RNA, 23 nt, Salmonella enterica enterica serovar Typhi Ty2
cacauucagcagcgcccagccaa

SEQ ID NO: 1757007 - RNA, 21 nt, Salmonella enterica enterica serovar Typhi Ty2
cacauucagagcguccacgcc

SEQ ID NO: 1757008 - RNA, 13 nt, Salmonella enterica enterica serovar Typhi Ty2
cacauucagcagc

SEQ ID NO: 1757009 - RNA, 13 nt, Salmonella enterica enterica serovar Typhi Ty2
cacauccauguac

SEQ ID NO: 1757010 - RNA, 20 nt, Salmonella enterica enterica serovar Typhi Ty2
cacaucaugaugaucuucag

SEQ ID NO: 1757011 - RNA, 23 nt, Salmonella enterica enterica serovar Typhi Ty2
cacaucaugaugaucuucagccc

SEQ ID NO: 1757012 - RNA, 13 nt, Salmonella enterica enterica serovar Typhi Ty2
cacauccagcccc

SEQ ID NO: 1757013 - RNA, 20 nt, Salmonella enterica enterica serovar Typhi Ty2
cacauccagacagccgacgg

SEQ ID NO: 1757014 - RNA, 23 nt, Salmonella enterica enterica serovar Typhi Ty2
cacauccagcgccagcgccaccu

SEQ ID NO: 1757015 - RNA, 20 nt, Salmonella enterica enterica serovar Typhi Ty2
cacaucgacaugcagaucgc

SEQ ID NO: 1757016 - RNA, 14 nt, Salmonella enterica enterica serovar Typhi Ty2
cacauccugcggga

SEQ ID NO: 1757017 - RNA, 16 nt, Salmonella enterica enterica serovar Typhi Ty2
cacauccgccagcgcc

SEQ ID NO: 1757018 - RNA, 17 nt, Salmonella enterica enterica serovar Typhi Ty2
cacauccgccagcgccu

SEQ ID NO: 1757019 - RNA, 20 nt, Salmonella enterica enterica serovar Typhi Ty2
cacaucagccaacuuuuucu

SEQ ID NO: 1757020 - RNA, 12 nt, Salmonella enterica enterica serovar Typhi Ty2
cacaucauuaaa

SEQ ID NO: 1757021 - RNA, 15 nt, Salmonella enterica enterica serovar Typhi Ty2
cacaucacaaucucc

SEQ ID NO: 1757022 - RNA, 19 nt, Salmonella enterica enterica serovar Typhi Ty2
cacauauucaauaauauua

SEQ ID NO: 1757023 - RNA, 23 nt, Salmonella enterica enterica serovar Typhi Ty2
cacauaucgcaauugauacauuu

SEQ ID NO: 1757024 - RNA, 12 nt, Salmonella enterica enterica serovar Typhi Ty2
cacaugggcagg

SEQ ID NO: 1757025 - RNA, 17 nt, Salmonella enterica enterica serovar Typhi Ty2
cacaugauguuuuaaca

SEQ ID NO: 1757026 - RNA, 19 nt, Salmonella enterica enterica serovar Typhi Ty2
cacaugcaagucgaacggu

SEQ ID NO: 1757027 - RNA, 18 nt, Salmonella enterica enterica serovar Typhi Ty2
cacaucguuaucuaugcu

SEQ ID NO: 1757028 - RNA, 17 nt, Salmonella enterica enterica serovar Typhi Ty2
cacaucgcccugauggc

SEQ ID NO: 1757029 - RNA, 20 nt, Salmonella enterica enterica serovar Typhi Ty2
cacaucgccauuaaaagcca

SEQ ID NO: 1757030 - RNA, 15 nt, Salmonella enterica enterica serovar Typhi Ty2
cacaugaccagcgcc

SEQ ID NO: 1757031 - RNA, 16 nt, Salmonella enterica enterica serovar Typhi Ty2
cacagcacaauaccuu

SEQ ID NO: 1757032 - RNA, 22 nt, Salmonella enterica enterica serovar Typhi Ty2
cacagcacauagaagcucaugu

SEQ ID NO: 1757033 - RNA, 15 nt, Salmonella enterica enterica serovar Typhi Ty2
cacagcacauagaag

SEQ ID NO: 1757034 - RNA, 21 nt, Salmonella enterica enterica serovar Typhi Ty2
cacagcaccauguugaccagg

SEQ ID NO: 1757035 - RNA, 14 nt, Salmonella enterica enterica serovar Typhi Ty2
cacagcagaaagca

SEQ ID NO: 1757036 - RNA, 17 nt, Salmonella enterica enterica serovar Typhi Ty2
cacagcaaaugaaagga

SEQ ID NO: 1757037 - RNA, 17 nt, Salmonella enterica enterica serovar Typhi Ty2
cacagcaaacauccccg

SEQ ID NO: 1757038 - RNA, 22 nt, Salmonella enterica enterica serovar Typhi Ty2
cacagauuaugcaguucuucgc

SEQ ID NO: 1757039 - RNA, 19 nt, Salmonella enterica enterica serovar Typhi Ty2
cacagaucgaaugaaaaug

SEQ ID NO: 1757040 - RNA, 23 nt, Salmonella enterica enterica serovar Typhi Ty2
cacagaauuacauaugcgcggcg

SEQ ID NO: 1757041 - RNA, 16 nt, Salmonella enterica enterica serovar Typhi Ty2
cacagacccaguacaa

SEQ ID NO: 1757042 - RNA, 14 nt, Salmonella enterica enterica serovar Typhi Ty2
cacagcggaauaga

SEQ ID NO: 1757043 - RNA, 13 nt, Salmonella enterica enterica serovar Typhi Ty2
cacagccuuauaa

SEQ ID NO: 1757044 - RNA, 14 nt, Salmonella enterica enterica serovar Typhi Ty2
cacagccguguccg

SEQ ID NO: 1757045 - RNA, 21 nt, Salmonella enterica enterica serovar Typhi Ty2
cacagcguacaauggcaggca

SEQ ID NO: 1757046 - RNA, 22 nt, Salmonella enterica enterica serovar Typhi Ty2
cacagcguacaauggcaggcau

SEQ ID NO: 1757047 - RNA, 16 nt, Salmonella enterica enterica serovar Typhi Ty2
cacagccccagcacca

SEQ ID NO: 1757048 - RNA, 14 nt, Salmonella enterica enterica serovar Typhi Ty2
cacagccccagcac

SEQ ID NO: 1757049 - RNA, 19 nt, Salmonella enterica enterica serovar Typhi Ty2
cacagccgcauuuuuucuu

SEQ ID NO: 1757050 - RNA, 17 nt, Salmonella enterica enterica serovar Typhi Ty2
cacagccccagcaccaa

SEQ ID NO: 1757051 - RNA, 22 nt, Salmonella enterica enterica serovar Typhi Ty2
cacagcaugaauaaccucccgc

SEQ ID NO: 1757052 - RNA, 19 nt, Salmonella enterica enterica serovar Typhi Ty2
cacagccaguaagaacgag

SEQ ID NO: 1757053 - RNA, 15 nt, Salmonella enterica enterica serovar Typhi Ty2
cacagccacacugcu

SEQ ID NO: 1757054 - RNA, 18 nt, Salmonella enterica enterica serovar Typhi Ty2
cacagugacccgccgcca

SEQ ID NO: 1757055 - RNA, 22 nt, Salmonella enterica enterica serovar Typhi Ty2
cacagugacccgccgccagcac

SEQ ID NO: 1757056 - RNA, 15 nt, Salmonella enterica enterica serovar Typhi Ty2
cacauaggcaaacac

SEQ ID NO: 1757057 - RNA, 14 nt, Salmonella enterica enterica serovar Typhi Ty2
cacauaggcaaaca

SEQ ID NO: 1757058 - RNA, 15 nt, Salmonella enterica enterica serovar Typhi Ty2
cacauauauuucugu

SEQ ID NO: 1757059 - RNA, 17 nt, Salmonella enterica enterica serovar Typhi Ty2
cacauacagcacuuccc

SEQ ID NO: 1757060 - RNA, 18 nt, Salmonella enterica enterica serovar Typhi Ty2
cacauaagcaacuugaag

SEQ ID NO: 1757061 - RNA, 18 nt, Salmonella enterica enterica serovar Typhi Ty2
cacaggcggaaaacauuc

SEQ ID NO: 1757062 - RNA, 13 nt, Salmonella enterica enterica serovar Typhi Ty2
cacaggaaccggu

SEQ ID NO: 1757063 - RNA, 13 nt, Salmonella enterica enterica serovar Typhi Ty2
cacaggccaacau

SEQ ID NO: 1757064 - RNA, 13 nt, Salmonella enterica enterica serovar Typhi Ty2
cacagguuaucgc

SEQ ID NO: 1757065 - RNA, 21 nt, Salmonella enterica enterica serovar Typhi Ty2
cacagguacaggccgccgccu

SEQ ID NO: 1757066 - RNA, 20 nt, Salmonella enterica enterica serovar Typhi Ty2
cacaguaaaaaaacgccugu

SEQ ID NO: 1757067 - RNA, 17 nt, Salmonella enterica enterica serovar Typhi Ty2
cacaggcuuggcagccc

SEQ ID NO: 1757068 - RNA, 22 nt, Salmonella enterica enterica serovar Typhi Ty2
cacaaugcgacuuaucagaacu

SEQ ID NO: 1757069 - RNA, 21 nt, Salmonella enterica enterica serovar Typhi Ty2
cacaaugguugccuggugucc

SEQ ID NO: 1757070 - RNA, 23 nt, Salmonella enterica enterica serovar Typhi Ty2
cacaauuuucuuaauaugcugcc

SEQ ID NO: 1757071 - RNA, 22 nt, Salmonella enterica enterica serovar Typhi Ty2
cacaauguuuuuguaccaggcc

SEQ ID NO: 1757072 - RNA, 18 nt, Salmonella enterica enterica serovar Typhi Ty2
cacacauaagcacaccau

SEQ ID NO: 1757073 - RNA, 14 nt, Salmonella enterica enterica serovar Typhi Ty2
cacacaucacaauc

SEQ ID NO: 1757074 - RNA, 20 nt, Salmonella enterica enterica serovar Typhi Ty2
cacacagcagaaagcaacag

SEQ ID NO: 1757075 - RNA, 13 nt, Salmonella enterica enterica serovar Typhi Ty2
cacacacuguuua

SEQ ID NO: 1757076 - RNA, 18 nt, Salmonella enterica enterica serovar Typhi Ty2
cacaaucagccacggcaa

SEQ ID NO: 1757077 - RNA, 19 nt, Salmonella enterica enterica serovar Typhi Ty2
cacaaucuccagaccgcug

SEQ ID NO: 1757078 - RNA, 20 nt, Salmonella enterica enterica serovar Typhi Ty2
cacaaucgccgugaucccaa

SEQ ID NO: 1757079 - RNA, 20 nt, Salmonella enterica enterica serovar Typhi Ty2
cacaaucgcgccugccagga

SEQ ID NO: 1757080 - RNA, 19 nt, Salmonella enterica enterica serovar Typhi Ty2
cacaaucgucgugccuucc

SEQ ID NO: 1757081 - RNA, 14 nt, Salmonella enterica enterica serovar Typhi Ty2
cacaauauccgccc

SEQ ID NO: 1757082 - RNA, 20 nt, Salmonella enterica enterica serovar Typhi Ty2
cacaauaugguuauccagca

SEQ ID NO: 1757083 - RNA, 13 nt, Salmonella enterica enterica serovar Typhi Ty2
cacaaucacagcg

SEQ ID NO: 1757084 - RNA, 16 nt, Salmonella enterica enterica serovar Typhi Ty2
cacaaguuuauccagc

SEQ ID NO: 1757085 - RNA, 16 nt, Salmonella enterica enterica serovar Typhi Ty2
cacaagagcagcaacc

SEQ ID NO: 1757086 - RNA, 17 nt, Salmonella enterica enterica serovar Typhi Ty2
cacaagccccacgcccg

SEQ ID NO: 1757087 - RNA, 17 nt, Salmonella enterica enterica serovar Typhi Ty2
cacaagcuguuucuccg

SEQ ID NO: 1757088 - RNA, 15 nt, Salmonella enterica enterica serovar Typhi Ty2
cacaagcuguuucuc

SEQ ID NO: 1757089 - RNA, 20 nt, Salmonella enterica enterica serovar Typhi Ty2
cacaagccccacgcccgcca

SEQ ID NO: 1757090 - RNA, 20 nt, Salmonella enterica enterica serovar Typhi Ty2
cacaccauuucacaaauuaa

SEQ ID NO: 1757091 - RNA, 13 nt, Salmonella enterica enterica serovar Typhi Ty2
cacacccauagca

SEQ ID NO: 1757092 - RNA, 22 nt, Salmonella enterica enterica serovar Typhi Ty2
cacaccugaugguuauuuucag

SEQ ID NO: 1757093 - RNA, 21 nt, Salmonella enterica enterica serovar Typhi Ty2
cacaccguuacgaccccauua

SEQ ID NO: 1757094 - RNA, 19 nt, Salmonella enterica enterica serovar Typhi Ty2
cacaccgucaacaucaucc

SEQ ID NO: 1757095 - RNA, 20 nt, Salmonella enterica enterica serovar Typhi Ty2
cacacgccuggccaggcuuu

SEQ ID NO: 1757096 - RNA, 14 nt, Salmonella enterica enterica serovar Typhi Ty2
cacacugcgccgcc

SEQ ID NO: 1757097 - RNA, 16 nt, Salmonella enterica enterica serovar Typhi Ty2
cacacgucugagcagg

SEQ ID NO: 1757098 - RNA, 14 nt, Salmonella enterica enterica serovar Typhi Ty2
cacacucucuccag

SEQ ID NO: 1757099 - RNA, 15 nt, Salmonella enterica enterica serovar Typhi Ty2
cacacggccaccaua

SEQ ID NO: 1757100 - RNA, 21 nt, Salmonella enterica enterica serovar Typhi Ty2
cacagaaaaaccaaaaaauau

SEQ ID NO: 1757101 - RNA, 24 nt, Salmonella enterica enterica serovar Typhi Ty2
cacacuuucgcccggcgccagcuc

SEQ ID NO: 1757102 - RNA, 15 nt, Salmonella enterica enterica serovar Typhi Ty2
cacacugcgccgcca

SEQ ID NO: 1757103 - RNA, 14 nt, Salmonella enterica enterica serovar Typhi Ty2
cacaacgucauccc

SEQ ID NO: 1757104 - RNA, 21 nt, Salmonella enterica enterica serovar Typhi Ty2
cacaacgugaugaucguguug

SEQ ID NO: 1757105 - RNA, 22 nt, Salmonella enterica enterica serovar Typhi Ty2
cacaacgugccagaaacaagaa

SEQ ID NO: 1757106 - RNA, 16 nt, Salmonella enterica enterica serovar Typhi Ty2
cacaacgcgaguauuc

SEQ ID NO: 1757107 - RNA, 14 nt, Salmonella enterica enterica serovar Typhi Ty2
cacaacgcauuggc

SEQ ID NO: 1757108 - RNA, 16 nt, Salmonella enterica enterica serovar Typhi Ty2
cacaacguaaucauca

SEQ ID NO: 1757109 - RNA, 16 nt, Salmonella enterica enterica serovar Typhi Ty2
cacaacccaaaggcca

SEQ ID NO: 1757110 - RNA, 19 nt, Salmonella enterica enterica serovar Typhi Ty2
cacaaccuccacgcccagc

SEQ ID NO: 1757111 - RNA, 17 nt, Salmonella enterica enterica serovar Typhi Ty2
cacaaccuccacgccca

SEQ ID NO: 1757112 - RNA, 13 nt, Salmonella enterica enterica serovar Typhi Ty2
cacaaccuccacg

SEQ ID NO: 1757113 - RNA, 18 nt, Salmonella enterica enterica serovar Typhi Ty2
cacaaaucuguuaucugg

SEQ ID NO: 1757114 - RNA, 21 nt, Salmonella enterica enterica serovar Typhi Ty2
cacaaauuugaauaaaacggg

SEQ ID NO: 1757115 - RNA, 14 nt, Salmonella enterica enterica serovar Typhi Ty2
cacaaauuucgagc

SEQ ID NO: 1757116 - RNA, 19 nt, Salmonella enterica enterica serovar Typhi Ty2
cacaaauuucgagcagaac

SEQ ID NO: 1757117 - RNA, 23 nt, Salmonella enterica enterica serovar Typhi Ty2
cacaaaauuuugcauaaauaaug

SEQ ID NO: 1757118 - RNA, 14 nt, Salmonella enterica enterica serovar Typhi Ty2
cacaaacaauuucc

SEQ ID NO: 1757119 - RNA, 23 nt, Salmonella enterica enterica serovar Typhi Ty2
cacaaacaauuuacgcagcccca

SEQ ID NO: 1757120 - RNA, 15 nt, Salmonella enterica enterica serovar Typhi Ty2
cacaaacaauuuacg

SEQ ID NO: 1757121 - RNA, 18 nt, Salmonella enterica enterica serovar Typhi Ty2
cacaaacggcaucgauau

SEQ ID NO: 1757122 - RNA, 21 nt, Salmonella enterica enterica serovar Typhi Ty2
cacaaacuccagacgaugaua

SEQ ID NO: 1757123 - RNA, 16 nt, Salmonella enterica enterica serovar Typhi Ty2
caauuuccgcugaaau

SEQ ID NO: 1757124 - RNA, 20 nt, Salmonella enterica enterica serovar Typhi Ty2
caauuuccgcugaaauagcc

SEQ ID NO: 1757125 - RNA, 13 nt, Salmonella enterica enterica serovar Typhi Ty2
caauuugaaaagg

SEQ ID NO: 1757126 - RNA, 20 nt, Salmonella enterica enterica serovar Typhi Ty2
caauuuccccugcgaacagc

SEQ ID NO: 1757127 - RNA, 17 nt, Salmonella enterica enterica serovar Typhi Ty2
caauuucccuucaauca

SEQ ID NO: 1757128 - RNA, 15 nt, Salmonella enterica enterica serovar Typhi Ty2
caauuuaucugcgug

SEQ ID NO: 1757129 - RNA, 17 nt, Salmonella enterica enterica serovar Typhi Ty2
caauuuaucugcgugau

SEQ ID NO: 1757130 - RNA, 20 nt, Salmonella enterica enterica serovar Typhi Ty2
caauuuuuacaaauuuaaac

SEQ ID NO: 1757131 - RNA, 22 nt, Salmonella enterica enterica serovar Typhi Ty2
cacaaaacuauuuuccccuucu

SEQ ID NO: 1757132 - RNA, 15 nt, Salmonella enterica enterica serovar Typhi Ty2
caauuuuaagaauau

SEQ ID NO: 1757133 - RNA, 21 nt, Salmonella enterica enterica serovar Typhi Ty2
caauuugguuagggaucaucu

SEQ ID NO: 1757134 - RNA, 22 nt, Salmonella enterica enterica serovar Typhi Ty2
caauuugguuagggaucaucuu

SEQ ID NO: 1757135 - RNA, 22 nt, Salmonella enterica enterica serovar Typhi Ty2
caauuuucuuaauaugcugccu

SEQ ID NO: 1757136 - RNA, 18 nt, Salmonella enterica enterica serovar Typhi Ty2
caauuuugccgcaucgau

SEQ ID NO: 1757137 - RNA, 11 nt, Salmonella enterica enterica serovar Typhi Ty2
caauuuugcuc

SEQ ID NO: 1757138 - RNA, 19 nt, Salmonella enterica enterica serovar Typhi Ty2
caauuuugauaagagaaaa

SEQ ID NO: 1757139 - RNA, 20 nt, Salmonella enterica enterica serovar Typhi Ty2
caaucaguacgcgcgcggcg

SEQ ID NO: 1757140 - RNA, 17 nt, Salmonella enterica enterica serovar Typhi Ty2
caaucagguauuuccug

SEQ ID NO: 1757141 - RNA, 22 nt, Salmonella enterica enterica serovar Typhi Ty2
caaucaggcgcaaacgcgugcu

SEQ ID NO: 1757142 - RNA, 22 nt, Salmonella enterica enterica serovar Typhi Ty2
caaucaggaaagagccgcgcag

SEQ ID NO: 1757143 - RNA, 14 nt, Salmonella enterica enterica serovar Typhi Ty2
caaucagaagaaau

SEQ ID NO: 1757144 - RNA, 22 nt, Salmonella enterica enterica serovar Typhi Ty2
caaucacuuuugcgacccacaa

SEQ ID NO: 1757145 - RNA, 19 nt, Salmonella enterica enterica serovar Typhi Ty2
caaucagccccagcaccag

SEQ ID NO: 1757146 - RNA, 14 nt, Salmonella enterica enterica serovar Typhi Ty2
caaucagcaccauu

SEQ ID NO: 1757147 - RNA, 20 nt, Salmonella enterica enterica serovar Typhi Ty2
caauuaauauuuaacacauu

SEQ ID NO: 1757148 - RNA, 17 nt, Salmonella enterica enterica serovar Typhi Ty2
caauuagcgacgcauac

SEQ ID NO: 1757149 - RNA, 21 nt, Salmonella enterica enterica serovar Typhi Ty2
caauuauauugcguaaaaacc

SEQ ID NO: 1757150 - RNA, 22 nt, Salmonella enterica enterica serovar Typhi Ty2
caauuacguuggggauaaccag

SEQ ID NO: 1757151 - RNA, 12 nt, Salmonella enterica enterica serovar Typhi Ty2
caauuacguugg

SEQ ID NO: 1757152 - RNA, 13 nt, Salmonella enterica enterica serovar Typhi Ty2
caauucagaaagu

SEQ ID NO: 1757153 - RNA, 22 nt, Salmonella enterica enterica serovar Typhi Ty2
caauucuggaaucaauuucccu

SEQ ID NO: 1757154 - RNA, 20 nt, Salmonella enterica enterica serovar Typhi Ty2
caauucuggaaucaauuucc

SEQ ID NO: 1757155 - RNA, 23 nt, Salmonella enterica enterica serovar Typhi Ty2
caauucgagauuuuucugcgcca

SEQ ID NO: 1757156 - RNA, 14 nt, Salmonella enterica enterica serovar Typhi Ty2
caauuccacaggcg

SEQ ID NO: 1757157 - RNA, 23 nt, Salmonella enterica enterica serovar Typhi Ty2
caauuccaccaccucggcacgga

SEQ ID NO: 1757158 - RNA, 12 nt, Salmonella enterica enterica serovar Typhi Ty2
auccuucuucca

SEQ ID NO: 1757159 - RNA, 14 nt, Salmonella enterica enterica serovar Typhi Ty2
auccuucuaccuuc

SEQ ID NO: 1757160 - RNA, 15 nt, Salmonella enterica enterica serovar Typhi Ty2
auccuucuuccauuc

SEQ ID NO: 1757161 - RNA, 16 nt, Salmonella enterica enterica serovar Typhi Ty2
auccuucuuccauucc

SEQ ID NO: 1757162 - RNA, 22 nt, Salmonella enterica enterica serovar Typhi Ty2
auccuucauucagaucaaaaau

SEQ ID NO: 1757163 - RNA, 14 nt, Salmonella enterica enterica serovar Typhi Ty2
auccuuccagcccg

SEQ ID NO: 1757164 - RNA, 13 nt, Salmonella enterica enterica serovar Typhi Ty2
auccuuccagccc

SEQ ID NO: 1757165 - RNA, 23 nt, Salmonella enterica enterica serovar Typhi Ty2
auccugugaaguaaaaaaaccgu

SEQ ID NO: 1757166 - RNA, 22 nt, Salmonella enterica enterica serovar Typhi Ty2
auccuuacuucgauggccucau

SEQ ID NO: 1757167 - RNA, 21 nt, Salmonella enterica enterica serovar Typhi Ty2
aucgaacgcuuccgggcucau

SEQ ID NO: 1757168 - RNA, 19 nt, Salmonella enterica enterica serovar Typhi Ty2
aucgaacauucuuaugcaa

SEQ ID NO: 1757169 - RNA, 15 nt, Salmonella enterica enterica serovar Typhi Ty2
aucgaacugaaaugg

SEQ ID NO: 1757170 - RNA, 17 nt, Salmonella enterica enterica serovar Typhi Ty2
aucgaaggcaucuucag

SEQ ID NO: 1757171 - RNA, 15 nt, Salmonella enterica enterica serovar Typhi Ty2
aucgaauccagcagg

SEQ ID NO: 1757172 - RNA, 18 nt, Salmonella enterica enterica serovar Typhi Ty2
aucgaauggggaaauaaa

SEQ ID NO: 1757173 - RNA, 23 nt, Salmonella enterica enterica serovar Typhi Ty2
aucgaccauacuaaugcugccca

SEQ ID NO: 1757174 - RNA, 20 nt, Salmonella enterica enterica serovar Typhi Ty2
aucgacgauaacaagccggc

SEQ ID NO: 1757175 - RNA, 13 nt, Salmonella enterica enterica serovar Typhi Ty2
aucgacgaaaugg

SEQ ID NO: 1757176 - RNA, 18 nt, Salmonella enterica enterica serovar Typhi Ty2
aucgacaguggcuuuaac

SEQ ID NO: 1757177 - RNA, 18 nt, Salmonella enterica enterica serovar Typhi Ty2
aucgacaacgcguuuauu

SEQ ID NO: 1757178 - RNA, 21 nt, Salmonella enterica enterica serovar Typhi Ty2
aucgauuuagagcuaaucaau

SEQ ID NO: 1757179 - RNA, 23 nt, Salmonella enterica enterica serovar Typhi Ty2
aucgccacgauagacagcaccau

SEQ ID NO: 1757180 - RNA, 17 nt, Salmonella enterica enterica serovar Typhi Ty2
aucgccaacgaccggcg

SEQ ID NO: 1757181 - RNA, 19 nt, Salmonella enterica enterica serovar Typhi Ty2
aucgccaaagcguaaacag

SEQ ID NO: 1757182 - RNA, 22 nt, Salmonella enterica enterica serovar Typhi Ty2
aucgccaaagucauugcugcca

SEQ ID NO: 1757183 - RNA, 22 nt, Salmonella enterica enterica serovar Typhi Ty2
aucgaugccacagcgcauucac

SEQ ID NO: 1757184 - RNA, 21 nt, Salmonella enterica enterica serovar Typhi Ty2
aucgccaucgauagcagcgcu

SEQ ID NO: 1757185 - RNA, 17 nt, Salmonella enterica enterica serovar Typhi Ty2
aucgccauauacgccac

SEQ ID NO: 1757186 - RNA, 14 nt, Salmonella enterica enterica serovar Typhi Ty2
aucgccagcgccug

SEQ ID NO: 1757187 - RNA, 15 nt, Salmonella enterica enterica serovar Typhi Ty2
aucgccagcacguuu

SEQ ID NO: 1757188 - RNA, 18 nt, Salmonella enterica enterica serovar Typhi Ty2
aucgccgacuaauuauuu

SEQ ID NO: 1757189 - RNA, 13 nt, Salmonella enterica enterica serovar Typhi Ty2
aucgccgaucaca

SEQ ID NO: 1757190 - RNA, 15 nt, Salmonella enterica enterica serovar Typhi Ty2
aucgccgaucacaaa

SEQ ID NO: 1757191 - RNA, 19 nt, Salmonella enterica enterica serovar Typhi Ty2
aucgccgaaagcgaucaca

SEQ ID NO: 1757192 - RNA, 19 nt, Salmonella enterica enterica serovar Typhi Ty2
aucgccgaucacaaaguca

SEQ ID NO: 1757193 - RNA, 20 nt, Salmonella enterica enterica serovar Typhi Ty2
aucgccgcaaugaccacaaa

SEQ ID NO: 1757194 - RNA, 16 nt, Salmonella enterica enterica serovar Typhi Ty2
aucgccugaugaccgc

SEQ ID NO: 1757195 - RNA, 22 nt, Salmonella enterica enterica serovar Typhi Ty2
aucgccggagccgccuggccug

SEQ ID NO: 1757196 - RNA, 23 nt, Salmonella enterica enterica serovar Typhi Ty2
aucggcgccggggugcuguucuu

SEQ ID NO: 1757197 - RNA, 22 nt, Salmonella enterica enterica serovar Typhi Ty2
aucgcuucaaucagcguggcgu

SEQ ID NO: 1757198 - RNA, 17 nt, Salmonella enterica enterica serovar Typhi Ty2
aucgcuuaacggcccag

SEQ ID NO: 1757199 - RNA, 15 nt, Salmonella enterica enterica serovar Typhi Ty2
aucgccugcgcgccu

SEQ ID NO: 1757200 - RNA, 17 nt, Salmonella enterica enterica serovar Typhi Ty2
aucgccugguaaggcaa

SEQ ID NO: 1757201 - RNA, 23 nt, Salmonella enterica enterica serovar Typhi Ty2
aucgcucaggagcgccugacagg

SEQ ID NO: 1757202 - RNA, 23 nt, Salmonella enterica enterica serovar Typhi Ty2
aucgcuaucugacagccaaacug

SEQ ID NO: 1757203 - RNA, 18 nt, Salmonella enterica enterica serovar Typhi Ty2
aucgcucuauauccugcc

SEQ ID NO: 1757204 - RNA, 17 nt, Salmonella enterica enterica serovar Typhi Ty2
aucgcucuauauccugc

SEQ ID NO: 1757205 - RNA, 12 nt, Salmonella enterica enterica serovar Typhi Ty2
aucgcuccuccc

SEQ ID NO: 1757206 - RNA, 16 nt, Salmonella enterica enterica serovar Typhi Ty2
aucgcugacgaucaug

SEQ ID NO: 1757207 - RNA, 13 nt, Salmonella enterica enterica serovar Typhi Ty2
aucgcugcgcccg

SEQ ID NO: 1757208 - RNA, 17 nt, Salmonella enterica enterica serovar Typhi Ty2
aucgcugauauuguuga

SEQ ID NO: 1757209 - RNA, 13 nt, Salmonella enterica enterica serovar Typhi Ty2
aucguuuuucuuc

SEQ ID NO: 1757210 - RNA, 12 nt, Salmonella enterica enterica serovar Typhi Ty2
aucguuuuucuu

SEQ ID NO: 1757211 - RNA, 21 nt, Salmonella enterica enterica serovar Typhi Ty2
aucguuuuaucucuuuugcuu

SEQ ID NO: 1757212 - RNA, 21 nt, Salmonella enterica enterica serovar Typhi Ty2
aucguuuacguuaucauucac

SEQ ID NO: 1757213 - RNA, 17 nt, Salmonella enterica enterica serovar Typhi Ty2
aucuaacccgcucagac

SEQ ID NO: 1757214 - RNA, 19 nt, Salmonella enterica enterica serovar Typhi Ty2
aucgugauaggccagacga

SEQ ID NO: 1757215 - RNA, 16 nt, Salmonella enterica enterica serovar Typhi Ty2
aucgucgugucucaga

SEQ ID NO: 1757216 - RNA, 23 nt, Salmonella enterica enterica serovar Typhi Ty2
aucguauccagcggcaaaggcau

SEQ ID NO: 1757217 - RNA, 18 nt, Salmonella enterica enterica serovar Typhi Ty2
aucguaaaucaaaugaga

SEQ ID NO: 1757218 - RNA, 16 nt, Salmonella enterica enterica serovar Typhi Ty2
aucgucaccaggaugc

SEQ ID NO: 1757219 - RNA, 15 nt, Salmonella enterica enterica serovar Typhi Ty2
aucggcguugcccau

SEQ ID NO: 1757220 - RNA, 16 nt, Salmonella enterica enterica serovar Typhi Ty2
aucggcguguuucauc

SEQ ID NO: 1757221 - RNA, 16 nt, Salmonella enterica enterica serovar Typhi Ty2
aucggcgggguuuaac

SEQ ID NO: 1757222 - RNA, 16 nt, Salmonella enterica enterica serovar Typhi Ty2
aucggcgcgcuggcgu

SEQ ID NO: 1757223 - RNA, 17 nt, Salmonella enterica enterica serovar Typhi Ty2
aucggcuuauaaaacgc

SEQ ID NO: 1757224 - RNA, 14 nt, Salmonella enterica enterica serovar Typhi Ty2
aucgguuaauugcc

SEQ ID NO: 1757225 - RNA, 13 nt, Salmonella enterica enterica serovar Typhi Ty2
aucguaaaucaaa

SEQ ID NO: 1757226 - RNA, 19 nt, Salmonella enterica enterica serovar Typhi Ty2
aucguaaaaucaacagcaa

SEQ ID NO: 1757227 - RNA, 18 nt, Salmonella enterica enterica serovar Typhi Ty2
aucgguuugagcaccacg

SEQ ID NO: 1757228 - RNA, 15 nt, Salmonella enterica enterica serovar Typhi Ty2
auccuguaccaccac

SEQ ID NO: 1757229 - RNA, 23 nt, Salmonella enterica enterica serovar Typhi Ty2
auccuguaacaacuguuuuucac

SEQ ID NO: 1757230 - RNA, 24 nt, Salmonella enterica enterica serovar Typhi Ty2
auccuguaacaacuguuuuucacu

SEQ ID NO: 1757231 - RNA, 17 nt, Salmonella enterica enterica serovar Typhi Ty2
auccugcuugccugugc

SEQ ID NO: 1757232 - RNA, 20 nt, Salmonella enterica enterica serovar Typhi Ty2
auccuggauacguuccagca

SEQ ID NO: 1757233 - RNA, 21 nt, Salmonella enterica enterica serovar Typhi Ty2
auccugcggguucaucgccac

SEQ ID NO: 1757234 - RNA, 21 nt, Salmonella enterica enterica serovar Typhi Ty2
auccugcaccgccugcggcau

SEQ ID NO: 1757235 - RNA, 14 nt, Salmonella enterica enterica serovar Typhi Ty2
auccugcacuucca

SEQ ID NO: 1757236 - RNA, 18 nt, Salmonella enterica enterica serovar Typhi Ty2
auccucuuggguuauuuc

SEQ ID NO: 1757237 - RNA, 22 nt, Salmonella enterica enterica serovar Typhi Ty2
auccugaagacaugcuguugaa

SEQ ID NO: 1757238 - RNA, 19 nt, Salmonella enterica enterica serovar Typhi Ty2
auccugaagacaugcuguu

SEQ ID NO: 1757239 - RNA, 17 nt, Salmonella enterica enterica serovar Typhi Ty2
auccugaguauaaaacu

SEQ ID NO: 1757240 - RNA, 21 nt, Salmonella enterica enterica serovar Typhi Ty2
auccugauuuuacugacuauc

SEQ ID NO: 1757241 - RNA, 10 nt, Salmonella enterica enterica serovar Typhi Ty2
auccugaucu

SEQ ID NO: 1757242 - RNA, 16 nt, Salmonella enterica enterica serovar Typhi Ty2
auccugcaaauagcgc

SEQ ID NO: 1757243 - RNA, 22 nt, Salmonella enterica enterica serovar Typhi Ty2
auccugauccugcaacagcacc

SEQ ID NO: 1757244 - RNA, 17 nt, Salmonella enterica enterica serovar Typhi Ty2
auccugacuauugcuga

SEQ ID NO: 1757245 - RNA, 16 nt, Salmonella enterica enterica serovar Typhi Ty2
auccucgcauccucca

SEQ ID NO: 1757246 - RNA, 19 nt, Salmonella enterica enterica serovar Typhi Ty2
auccuccauaaauaacauu

SEQ ID NO: 1757247 - RNA, 19 nt, Salmonella enterica enterica serovar Typhi Ty2
auccucauuaguucaaguu

SEQ ID NO: 1757248 - RNA, 13 nt, Salmonella enterica enterica serovar Typhi Ty2
auccucuauuuuu

SEQ ID NO: 1757249 - RNA, 21 nt, Salmonella enterica enterica serovar Typhi Ty2
auccucuauuuuuuauauucg

SEQ ID NO: 1757250 - RNA, 20 nt, Salmonella enterica enterica serovar Typhi Ty2
auccggcauaagauuuacaa

SEQ ID NO: 1757251 - RNA, 13 nt, Salmonella enterica enterica serovar Typhi Ty2
auccggcauuuuu

SEQ ID NO: 1757252 - RNA, 17 nt, Salmonella enterica enterica serovar Typhi Ty2
auccggccuacaaaaac

SEQ ID NO: 1757253 - RNA, 16 nt, Salmonella enterica enterica serovar Typhi Ty2
auccggcaagcgcugg

SEQ ID NO: 1757254 - RNA, 11 nt, Salmonella enterica enterica serovar Typhi Ty2
auccggcacug

SEQ ID NO: 1757255 - RNA, 12 nt, Salmonella enterica enterica serovar Typhi Ty2
auccggcacugu

SEQ ID NO: 1757256 - RNA, 22 nt, Salmonella enterica enterica serovar Typhi Ty2
auccggcuuacggcuauuccuc

SEQ ID NO: 1757257 - RNA, 14 nt, Salmonella enterica enterica serovar Typhi Ty2
auccggccuggcgc

SEQ ID NO: 1757258 - RNA, 20 nt, Salmonella enterica enterica serovar Typhi Ty2
auccggccuguaaggucuca

SEQ ID NO: 1757259 - RNA, 19 nt, Salmonella enterica enterica serovar Typhi Ty2
auccggccuccaccaccuc

SEQ ID NO: 1757260 - RNA, 21 nt, Salmonella enterica enterica serovar Typhi Ty2
auccgguugacgauaaaaugc

SEQ ID NO: 1757261 - RNA, 12 nt, Salmonella enterica enterica serovar Typhi Ty2
auccgguaaacg

SEQ ID NO: 1757262 - RNA, 17 nt, Salmonella enterica enterica serovar Typhi Ty2
auccucacuugccgagu

SEQ ID NO: 1757263 - RNA, 15 nt, Salmonella enterica enterica serovar Typhi Ty2
auccucaauguuaac

SEQ ID NO: 1757264 - RNA, 12 nt, Salmonella enterica enterica serovar Typhi Ty2
auccguuauuua

SEQ ID NO: 1757265 - RNA, 16 nt, Salmonella enterica enterica serovar Typhi Ty2
auccguuaagcccuga

SEQ ID NO: 1757266 - RNA, 14 nt, Salmonella enterica enterica serovar Typhi Ty2
auccgugaccugcu

SEQ ID NO: 1757267 - RNA, 16 nt, Salmonella enterica enterica serovar Typhi Ty2
auccgacagauagugg

SEQ ID NO: 1757268 - RNA, 19 nt, Salmonella enterica enterica serovar Typhi Ty2
auccgaaaugaccaccgca

SEQ ID NO: 1757269 - RNA, 21 nt, Salmonella enterica enterica serovar Typhi Ty2
aucccuuucaaaaaagagaag

SEQ ID NO: 1757270 - RNA, 18 nt, Salmonella enterica enterica serovar Typhi Ty2
auccgacgcucaaccggu

SEQ ID NO: 1757271 - RNA, 15 nt, Salmonella enterica enterica serovar Typhi Ty2
auccgacgccuuuac

SEQ ID NO: 1757272 - RNA, 17 nt, Salmonella enterica enterica serovar Typhi Ty2
auccgacgccuguucga

SEQ ID NO: 1757273 - RNA, 20 nt, Salmonella enterica enterica serovar Typhi Ty2
auccgcaaauuacugugccc

SEQ ID NO: 1757274 - RNA, 16 nt, Salmonella enterica enterica serovar Typhi Ty2
auccgcagauccagca

SEQ ID NO: 1757275 - RNA, 22 nt, Salmonella enterica enterica serovar Typhi Ty2
auccgcagacuuuaaccauucc

SEQ ID NO: 1757276 - RNA, 15 nt, Salmonella enterica enterica serovar Typhi Ty2
auccggcaaacucag

SEQ ID NO: 1757277 - RNA, 14 nt, Salmonella enterica enterica serovar Typhi Ty2
auccggcaaaauua

SEQ ID NO: 1757278 - RNA, 14 nt, Salmonella enterica enterica serovar Typhi Ty2
auccggcaagcgcu

SEQ ID NO: 1757279 - RNA, 15 nt, Salmonella enterica enterica serovar Typhi Ty2
auccggaauaagaau

SEQ ID NO: 1757280 - RNA, 20 nt, Salmonella enterica enterica serovar Typhi Ty2
auccgcucccgcuucaaaac

SEQ ID NO: 1757281 - RNA, 20 nt, Salmonella enterica enterica serovar Typhi Ty2
auccgcuucucuauacggcg

SEQ ID NO: 1757282 - RNA, 18 nt, Salmonella enterica enterica serovar Typhi Ty2
auccgcuccacauccugu

SEQ ID NO: 1757283 - RNA, 14 nt, Salmonella enterica enterica serovar Typhi Ty2
auccgcauccguca

SEQ ID NO: 1757284 - RNA, 15 nt, Salmonella enterica enterica serovar Typhi Ty2
auccgcauacaccuu

SEQ ID NO: 1757285 - RNA, 13 nt, Salmonella enterica enterica serovar Typhi Ty2
auccgccgccgca

SEQ ID NO: 1757286 - RNA, 16 nt, Salmonella enterica enterica serovar Typhi Ty2
auccgccgagggcauu

SEQ ID NO: 1757287 - RNA, 18 nt, Salmonella enterica enterica serovar Typhi Ty2
auccccagcaucaugucc

SEQ ID NO: 1757288 - RNA, 15 nt, Salmonella enterica enterica serovar Typhi Ty2
auccccaccaccgcc

SEQ ID NO: 1757289 - RNA, 22 nt, Salmonella enterica enterica serovar Typhi Ty2
aucccauuagggcuauuuuacu

SEQ ID NO: 1757290 - RNA, 15 nt, Salmonella enterica enterica serovar Typhi Ty2
aucccccugccacaa

SEQ ID NO: 1757291 - RNA, 14 nt, Salmonella enterica enterica serovar Typhi Ty2
auccccauauucca

SEQ ID NO: 1757292 - RNA, 12 nt, Salmonella enterica enterica serovar Typhi Ty2
auccccagcgcu

SEQ ID NO: 1757293 - RNA, 13 nt, Salmonella enterica enterica serovar Typhi Ty2
auccccggcaacc

SEQ ID NO: 1757294 - RNA, 16 nt, Salmonella enterica enterica serovar Typhi Ty2
auccccgccucaccgc

SEQ ID NO: 1757295 - RNA, 18 nt, Salmonella enterica enterica serovar Typhi Ty2
auccccgccgagaaaaua

SEQ ID NO: 1757296 - RNA, 13 nt, Salmonella enterica enterica serovar Typhi Ty2
auccccugcuccu

SEQ ID NO: 1757297 - RNA, 16 nt, Salmonella enterica enterica serovar Typhi Ty2
auccccuucaggaaua

SEQ ID NO: 1757298 - RNA, 17 nt, Salmonella enterica enterica serovar Typhi Ty2
aucccggcgcgcguggc

SEQ ID NO: 1757299 - RNA, 14 nt, Salmonella enterica enterica serovar Typhi Ty2
aucccgccgcuggc

SEQ ID NO: 1757300 - RNA, 17 nt, Salmonella enterica enterica serovar Typhi Ty2
aucccgcgccaauaacg

SEQ ID NO: 1757301 - RNA, 18 nt, Salmonella enterica enterica serovar Typhi Ty2
aucccucaccucccccgc

SEQ ID NO: 1757302 - RNA, 17 nt, Salmonella enterica enterica serovar Typhi Ty2
aucccuaauaagguauu

SEQ ID NO: 1757303 - RNA, 13 nt, Salmonella enterica enterica serovar Typhi Ty2
aucccgugguggg

SEQ ID NO: 1757304 - RNA, 15 nt, Salmonella enterica enterica serovar Typhi Ty2
aucccguagccgcuu

SEQ ID NO: 1757305 - RNA, 21 nt, Salmonella enterica enterica serovar Typhi Ty2
aucccgguauuccguuccuuc

SEQ ID NO: 1757306 - RNA, 22 nt, Salmonella enterica enterica serovar Typhi Ty2
aucccgggcgauaaaccagccc

SEQ ID NO: 1757307 - RNA, 15 nt, Salmonella enterica enterica serovar Typhi Ty2
auccagcgucacagg

SEQ ID NO: 1757308 - RNA, 22 nt, Salmonella enterica enterica serovar Typhi Ty2
auccagcgccugcuguaaaaua

SEQ ID NO: 1757309 - RNA, 19 nt, Salmonella enterica enterica serovar Typhi Ty2
auccagcgaaccuuccauc

SEQ ID NO: 1757310 - RNA, 14 nt, Salmonella enterica enterica serovar Typhi Ty2
auccagccucuccc

SEQ ID NO: 1757311 - RNA, 16 nt, Salmonella enterica enterica serovar Typhi Ty2
auccaggaauuuuccc

SEQ ID NO: 1757312 - RNA, 16 nt, Salmonella enterica enterica serovar Typhi Ty2
auccaggaaguaaauu

SEQ ID NO: 1757313 - RNA, 18 nt, Salmonella enterica enterica serovar Typhi Ty2
auccagcgguuacuuuug

SEQ ID NO: 1757314 - RNA, 11 nt, Salmonella enterica enterica serovar Typhi Ty2
auccagcccca

SEQ ID NO: 1757315 - RNA, 23 nt, Salmonella enterica enterica serovar Typhi Ty2
auccagccccagcgccagcugcg

SEQ ID NO: 1757316 - RNA, 19 nt, Salmonella enterica enterica serovar Typhi Ty2
auccagcaaccagguaauc

SEQ ID NO: 1757317 - RNA, 14 nt, Salmonella enterica enterica serovar Typhi Ty2
auccagcaaaauaa

SEQ ID NO: 1757318 - RNA, 12 nt, Salmonella enterica enterica serovar Typhi Ty2
auccagcagcca

SEQ ID NO: 1757319 - RNA, 17 nt, Salmonella enterica enterica serovar Typhi Ty2
auccagcacgguaaacc

SEQ ID NO: 1757320 - RNA, 17 nt, Salmonella enterica enterica serovar Typhi Ty2
auccaguaauuuuuccg

SEQ ID NO: 1757321 - RNA, 14 nt, Salmonella enterica enterica serovar Typhi Ty2
auccagguggaucg

SEQ ID NO: 1757322 - RNA, 15 nt, Salmonella enterica enterica serovar Typhi Ty2
auccaggagcauugg

SEQ ID NO: 1757323 - RNA, 15 nt, Salmonella enterica enterica serovar Typhi Ty2
auccaggacgucuug

SEQ ID NO: 1757324 - RNA, 18 nt, Salmonella enterica enterica serovar Typhi Ty2
auccaggacgucuugcaa

SEQ ID NO: 1757325 - RNA, 20 nt, Salmonella enterica enterica serovar Typhi Ty2
auccaggccgucggcgccag

SEQ ID NO: 1757326 - RNA, 18 nt, Salmonella enterica enterica serovar Typhi Ty2
auccauaauuuuccccag

SEQ ID NO: 1757327 - RNA, 17 nt, Salmonella enterica enterica serovar Typhi Ty2
auccauaagaugaaaga

SEQ ID NO: 1757328 - RNA, 14 nt, Salmonella enterica enterica serovar Typhi Ty2
auccaguuucuucg

SEQ ID NO: 1757329 - RNA, 20 nt, Salmonella enterica enterica serovar Typhi Ty2
auccaguuuuuuccagcgcg

SEQ ID NO: 1757330 - RNA, 15 nt, Salmonella enterica enterica serovar Typhi Ty2
auccaguugaugaug

SEQ ID NO: 1757331 - RNA, 17 nt, Salmonella enterica enterica serovar Typhi Ty2
aucccaccauaaagcga

SEQ ID NO: 1757332 - RNA, 20 nt, Salmonella enterica enterica serovar Typhi Ty2
aucccagggcggcgucgcca

SEQ ID NO: 1757333 - RNA, 15 nt, Salmonella enterica enterica serovar Typhi Ty2
aucccacggagaaaa

SEQ ID NO: 1757334 - RNA, 19 nt, Salmonella enterica enterica serovar Typhi Ty2
auccaugcuuucaauaaau

SEQ ID NO: 1757335 - RNA, 18 nt, Salmonella enterica enterica serovar Typhi Ty2
auccauucucaucagacc

SEQ ID NO: 1757336 - RNA, 16 nt, Salmonella enterica enterica serovar Typhi Ty2
auccauguugccauga

SEQ ID NO: 1757337 - RNA, 14 nt, Salmonella enterica enterica serovar Typhi Ty2
auccauuaaaaucu

SEQ ID NO: 1757338 - RNA, 17 nt, Salmonella enterica enterica serovar Typhi Ty2
auccaucagccaggguu

SEQ ID NO: 1757339 - RNA, 20 nt, Salmonella enterica enterica serovar Typhi Ty2
auccaucgguucucugccau

SEQ ID NO: 1757340 - RNA, 23 nt, Salmonella enterica enterica serovar Typhi Ty2
auccauaccgcuuuguaaaacau

SEQ ID NO: 1757341 - RNA, 19 nt, Salmonella enterica enterica serovar Typhi Ty2
auccauacgguuguugauu

SEQ ID NO: 1757342 - RNA, 22 nt, Salmonella enterica enterica serovar Typhi Ty2
auccacgucauaacgcgcauuc

SEQ ID NO: 1757343 - RNA, 15 nt, Salmonella enterica enterica serovar Typhi Ty2
auccaccuuauccug

SEQ ID NO: 1757344 - RNA, 19 nt, Salmonella enterica enterica serovar Typhi Ty2
auccacggguuacaacugc

SEQ ID NO: 1757345 - RNA, 19 nt, Salmonella enterica enterica serovar Typhi Ty2
auccacucccugcuuuuuc

SEQ ID NO: 1757346 - RNA, 20 nt, Salmonella enterica enterica serovar Typhi Ty2
auccacucccugcuuuuuca

SEQ ID NO: 1757347 - RNA, 23 nt, Salmonella enterica enterica serovar Typhi Ty2
auccacucggcgcugucguucca

SEQ ID NO: 1757348 - RNA, 22 nt, Salmonella enterica enterica serovar Typhi Ty2
auccagaggguaauuucuucca

SEQ ID NO: 1757349 - RNA, 21 nt, Salmonella enterica enterica serovar Typhi Ty2
auccagaauacgccgccgccc

SEQ ID NO: 1757350 - RNA, 18 nt, Salmonella enterica enterica serovar Typhi Ty2
auccagaauaccagaauc

SEQ ID NO: 1757351 - RNA, 19 nt, Salmonella enterica enterica serovar Typhi Ty2
auccacaguaaccccauac

SEQ ID NO: 1757352 - RNA, 17 nt, Salmonella enterica enterica serovar Typhi Ty2
auccacauugguuuugc

SEQ ID NO: 1757353 - RNA, 14 nt, Salmonella enterica enterica serovar Typhi Ty2
auccaccagcccca

SEQ ID NO: 1757354 - RNA, 15 nt, Salmonella enterica enterica serovar Typhi Ty2
auccaccagaauaaa

SEQ ID NO: 1757355 - RNA, 20 nt, Salmonella enterica enterica serovar Typhi Ty2
auccaccaccugauucugca

SEQ ID NO: 1757356 - RNA, 17 nt, Salmonella enterica enterica serovar Typhi Ty2
auccaccacguaaugcg

SEQ ID NO: 1757357 - RNA, 13 nt, Salmonella enterica enterica serovar Typhi Ty2
auccaccaccuga

SEQ ID NO: 1757358 - RNA, 17 nt, Salmonella enterica enterica serovar Typhi Ty2
auccaccaccagcauca

SEQ ID NO: 1757359 - RNA, 16 nt, Salmonella enterica enterica serovar Typhi Ty2
auccaccaggcaugca

SEQ ID NO: 1757360 - RNA, 23 nt, Salmonella enterica enterica serovar Typhi Ty2
auccaccccuugcgcguuucuga

SEQ ID NO: 1757361 - RNA, 14 nt, Salmonella enterica enterica serovar Typhi Ty2
auccacaaucgucg

SEQ ID NO: 1757362 - RNA, 12 nt, Salmonella enterica enterica serovar Typhi Ty2
auccacaaccgg

SEQ ID NO: 1757363 - RNA, 13 nt, Salmonella enterica enterica serovar Typhi Ty2
auccaagccccuc

SEQ ID NO: 1757364 - RNA, 17 nt, Salmonella enterica enterica serovar Typhi Ty2
auccaacgcggaaaugu

SEQ ID NO: 1757365 - RNA, 18 nt, Salmonella enterica enterica serovar Typhi Ty2
auccaacgcggaaaugua

SEQ ID NO: 1757366 - RNA, 18 nt, Salmonella enterica enterica serovar Typhi Ty2
aucauuuguacaaaaaau

SEQ ID NO: 1757367 - RNA, 12 nt, Salmonella enterica enterica serovar Typhi Ty2
aucauuuucuuu

SEQ ID NO: 1757368 - RNA, 18 nt, Salmonella enterica enterica serovar Typhi Ty2
aucauuggggggaaauua

SEQ ID NO: 1757369 - RNA, 18 nt, Salmonella enterica enterica serovar Typhi Ty2
aucauuggggaaccuggc

SEQ ID NO: 1757370 - RNA, 11 nt, Salmonella enterica enterica serovar Typhi Ty2
aucauuuccac

SEQ ID NO: 1757371 - RNA, 14 nt, Salmonella enterica enterica serovar Typhi Ty2
aucauugacuucaa

SEQ ID NO: 1757372 - RNA, 23 nt, Salmonella enterica enterica serovar Typhi Ty2
aucauucgggaugcauaaaaaaa

SEQ ID NO: 1757373 - RNA, 22 nt, Salmonella enterica enterica serovar Typhi Ty2
aucauucgggaugcauaaaaaa

SEQ ID NO: 1757374 - RNA, 20 nt, Salmonella enterica enterica serovar Typhi Ty2
aucauucccgcccaguauuc

SEQ ID NO: 1757375 - RNA, 22 nt, Salmonella enterica enterica serovar Typhi Ty2
aucauucccguaucuucauguu

SEQ ID NO: 1757376 - RNA, 13 nt, Salmonella enterica enterica serovar Typhi Ty2
aucauucccgccc

SEQ ID NO: 1757377 - RNA, 16 nt, Salmonella enterica enterica serovar Typhi Ty2
aucauguuuuucuccc

SEQ ID NO: 1757378 - RNA, 22 nt, Salmonella enterica enterica serovar Typhi Ty2
aucauuaccuacgcgauaaaaa

SEQ ID NO: 1757379 - RNA, 13 nt, Salmonella enterica enterica serovar Typhi Ty2
aucauuaccauag

SEQ ID NO: 1757380 - RNA, 13 nt, Salmonella enterica enterica serovar Typhi Ty2
aucauuaauuuac

SEQ ID NO: 1757381 - RNA, 13 nt, Salmonella enterica enterica serovar Typhi Ty2
aucauuacaggcg

SEQ ID NO: 1757382 - RNA, 20 nt, Salmonella enterica enterica serovar Typhi Ty2
aucaugguugaaaaaagccg

SEQ ID NO: 1757383 - RNA, 21 nt, Salmonella enterica enterica serovar Typhi Ty2
aucaugguugacuuacaaaaa

SEQ ID NO: 1757384 - RNA, 17 nt, Salmonella enterica enterica serovar Typhi Ty2
aucaugucacccacgcc

SEQ ID NO: 1757385 - RNA, 15 nt, Salmonella enterica enterica serovar Typhi Ty2
aucauuaucgccaaa

SEQ ID NO: 1757386 - RNA, 13 nt, Salmonella enterica enterica serovar Typhi Ty2
aucauuauucccc

SEQ ID NO: 1757387 - RNA, 15 nt, Salmonella enterica enterica serovar Typhi Ty2
aucauuauuccccuc

SEQ ID NO: 1757388 - RNA, 16 nt, Salmonella enterica enterica serovar Typhi Ty2
aucauuauuccccucc

SEQ ID NO: 1757389 - RNA, 18 nt, Salmonella enterica enterica serovar Typhi Ty2
aucauucaacgcaucaaa

SEQ ID NO: 1757390 - RNA, 20 nt, Salmonella enterica enterica serovar Typhi Ty2
aucauucaacgcaucaaaua

SEQ ID NO: 1757391 - RNA, 18 nt, Salmonella enterica enterica serovar Typhi Ty2
aucauuacuuauauuuau

SEQ ID NO: 1757392 - RNA, 23 nt, Salmonella enterica enterica serovar Typhi Ty2
aucauuauauagucuuaauuugc

SEQ ID NO: 1757393 - RNA, 20 nt, Salmonella enterica enterica serovar Typhi Ty2
aucaugaaaaauauaaaaag

SEQ ID NO: 1757394 - RNA, 17 nt, Salmonella enterica enterica serovar Typhi Ty2
aucaugacagauuuaau

SEQ ID NO: 1757395 - RNA, 21 nt, Salmonella enterica enterica serovar Typhi Ty2
aucaugcccaaaccugagcau

SEQ ID NO: 1757396 - RNA, 15 nt, Salmonella enterica enterica serovar Typhi Ty2
aucaugguugaaaaa

SEQ ID NO: 1757397 - RNA, 19 nt, Salmonella enterica enterica serovar Typhi Ty2
aucaugggcucaucaaaca

SEQ ID NO: 1757398 - RNA, 14 nt, Salmonella enterica enterica serovar Typhi Ty2
aucaugcugcaccg

SEQ ID NO: 1757399 - RNA, 16 nt, Salmonella enterica enterica serovar Typhi Ty2
aucaugcugaugacua

SEQ ID NO: 1757400 - RNA, 15 nt, Salmonella enterica enterica serovar Typhi Ty2
aucaucagggcgaaa

SEQ ID NO: 1757401 - RNA, 14 nt, Salmonella enterica enterica serovar Typhi Ty2
aucauccccggcag

SEQ ID NO: 1757402 - RNA, 19 nt, Salmonella enterica enterica serovar Typhi Ty2
aucauccccaccgcugaug

SEQ ID NO: 1757403 - RNA, 20 nt, Salmonella enterica enterica serovar Typhi Ty2
aucauccccaccgcugaugg

SEQ ID NO: 1757404 - RNA, 12 nt, Salmonella enterica enterica serovar Typhi Ty2
aucauccagccc

SEQ ID NO: 1757405 - RNA, 20 nt, Salmonella enterica enterica serovar Typhi Ty2
aucauccagucagcaauuaa

SEQ ID NO: 1757406 - RNA, 14 nt, Salmonella enterica enterica serovar Typhi Ty2
aucaucacaauuag

SEQ ID NO: 1757407 - RNA, 18 nt, Salmonella enterica enterica serovar Typhi Ty2
aucaucaccguuuuccag

SEQ ID NO: 1757408 - RNA, 15 nt, Salmonella enterica enterica serovar Typhi Ty2
aucaucguaccaaua

SEQ ID NO: 1757409 - RNA, 21 nt, Salmonella enterica enterica serovar Typhi Ty2
aucaucgguuacuccuuauuu

SEQ ID NO: 1757410 - RNA, 21 nt, Salmonella enterica enterica serovar Typhi Ty2
aucaucuucacuucacaaaca

SEQ ID NO: 1757411 - RNA, 12 nt, Salmonella enterica enterica serovar Typhi Ty2
aucaucuaccuu

SEQ ID NO: 1757412 - RNA, 22 nt, Salmonella enterica enterica serovar Typhi Ty2
aucaucgcgcugauauuuuuac

SEQ ID NO: 1757413 - RNA, 20 nt, Salmonella enterica enterica serovar Typhi Ty2
aucaucgcuugcccagcaua

SEQ ID NO: 1757414 - RNA, 22 nt, Salmonella enterica enterica serovar Typhi Ty2
aucaucgaggccaccaaaaauu

SEQ ID NO: 1757415 - RNA, 23 nt, Salmonella enterica enterica serovar Typhi Ty2
aucauccuucgggcgauuuuugc

SEQ ID NO: 1757416 - RNA, 19 nt, Salmonella enterica enterica serovar Typhi Ty2
aucauccgggcauaaaaaa

SEQ ID NO: 1757417 - RNA, 21 nt, Salmonella enterica enterica serovar Typhi Ty2
aucauccccguuuucgccgga

SEQ ID NO: 1757418 - RNA, 17 nt, Salmonella enterica enterica serovar Typhi Ty2
aucauaucaauauguuc

SEQ ID NO: 1757419 - RNA, 18 nt, Salmonella enterica enterica serovar Typhi Ty2
aucauauucgcagcucug

SEQ ID NO: 1757420 - RNA, 11 nt, Salmonella enterica enterica serovar Typhi Ty2
aucauauccuc

SEQ ID NO: 1757421 - RNA, 19 nt, Salmonella enterica enterica serovar Typhi Ty2
aucauaguuuuuccccauc

SEQ ID NO: 1757422 - RNA, 13 nt, Salmonella enterica enterica serovar Typhi Ty2
aucauaagggagc

SEQ ID NO: 1757423 - RNA, 14 nt, Salmonella enterica enterica serovar Typhi Ty2
aucauacugaacuc

SEQ ID NO: 1757424 - RNA, 20 nt, Salmonella enterica enterica serovar Typhi Ty2
aucauaccggcagcagugag

SEQ ID NO: 1757425 - RNA, 20 nt, Salmonella enterica enterica serovar Typhi Ty2
aucaguuccaaucucuuuug

SEQ ID NO: 1757426 - RNA, 19 nt, Salmonella enterica enterica serovar Typhi Ty2
aucaguuccaacccuugcu

SEQ ID NO: 1757427 - RNA, 15 nt, Salmonella enterica enterica serovar Typhi Ty2
aucaguugcaggaag

SEQ ID NO: 1757428 - RNA, 18 nt, Salmonella enterica enterica serovar Typhi Ty2
aucauaaagcgcccggug

SEQ ID NO: 1757429 - RNA, 21 nt, Salmonella enterica enterica serovar Typhi Ty2
aucauaaaaggcugagaaggu

SEQ ID NO: 1757430 - RNA, 14 nt, Salmonella enterica enterica serovar Typhi Ty2
aucauaaaaggcau

SEQ ID NO: 1757431 - RNA, 20 nt, Salmonella enterica enterica serovar Typhi Ty2
aucaguggggccuuuuuaau

SEQ ID NO: 1757432 - RNA, 16 nt, Salmonella enterica enterica serovar Typhi Ty2
aucaguaacagaacaa

SEQ ID NO: 1757433 - RNA, 22 nt, Salmonella enterica enterica serovar Typhi Ty2
aucaguacgaccccgccgagaa

SEQ ID NO: 1757434 - RNA, 17 nt, Salmonella enterica enterica serovar Typhi Ty2
aucaguaauguccagau

SEQ ID NO: 1757435 - RNA, 15 nt, Salmonella enterica enterica serovar Typhi Ty2
aucaggcguuacaga

SEQ ID NO: 1757436 - RNA, 16 nt, Salmonella enterica enterica serovar Typhi Ty2
aucaggcgugaugacu

SEQ ID NO: 1757437 - RNA, 15 nt, Salmonella enterica enterica serovar Typhi Ty2
aucaggccuaccagc

SEQ ID NO: 1757438 - RNA, 17 nt, Salmonella enterica enterica serovar Typhi Ty2
aucaggccuaccagccg

SEQ ID NO: 1757439 - RNA, 17 nt, Salmonella enterica enterica serovar Typhi Ty2
aucaggccuaccaucgc

SEQ ID NO: 1757440 - RNA, 14 nt, Salmonella enterica enterica serovar Typhi Ty2
aucaggccugccug

SEQ ID NO: 1757441 - RNA, 21 nt, Salmonella enterica enterica serovar Typhi Ty2
aucaggcguugaccgcuucgc

SEQ ID NO: 1757442 - RNA, 14 nt, Salmonella enterica enterica serovar Typhi Ty2
aucaggaucuucau

SEQ ID NO: 1757443 - RNA, 15 nt, Salmonella enterica enterica serovar Typhi Ty2
aucaggauuauuaca

SEQ ID NO: 1757444 - RNA, 22 nt, Salmonella enterica enterica serovar Typhi Ty2
aucaggauucgacggccagcgc

SEQ ID NO: 1757445 - RNA, 17 nt, Salmonella enterica enterica serovar Typhi Ty2
aucaggcacaacccaaa

SEQ ID NO: 1757446 - RNA, 20 nt, Salmonella enterica enterica serovar Typhi Ty2
aucaggcacacguuaaaccc

SEQ ID NO: 1757447 - RNA, 16 nt, Salmonella enterica enterica serovar Typhi Ty2
aucaggcauaaaccua

SEQ ID NO: 1757448 - RNA, 17 nt, Salmonella enterica enterica serovar Typhi Ty2
aucaggcauguugcgca

SEQ ID NO: 1757449 - RNA, 18 nt, Salmonella enterica enterica serovar Typhi Ty2
aucaggaaaucuuccagu

SEQ ID NO: 1757450 - RNA, 15 nt, Salmonella enterica enterica serovar Typhi Ty2
aucaggaaaucuucc

SEQ ID NO: 1757451 - RNA, 17 nt, Salmonella enterica enterica serovar Typhi Ty2
augcgcccggagcggug

SEQ ID NO: 1757452 - RNA, 13 nt, Salmonella enterica enterica serovar Typhi Ty2
augcgccauccca

SEQ ID NO: 1757453 - RNA, 18 nt, Salmonella enterica enterica serovar Typhi Ty2
augcgccaggcagcaccu

SEQ ID NO: 1757454 - RNA, 17 nt, Salmonella enterica enterica serovar Typhi Ty2
augcgccuguuagggcg

SEQ ID NO: 1757455 - RNA, 16 nt, Salmonella enterica enterica serovar Typhi Ty2
augcgccugucuuaaa

SEQ ID NO: 1757456 - RNA, 18 nt, Salmonella enterica enterica serovar Typhi Ty2
augcgcgucaggccaggg

SEQ ID NO: 1757457 - RNA, 14 nt, Salmonella enterica enterica serovar Typhi Ty2
augcgcggugucau

SEQ ID NO: 1757458 - RNA, 13 nt, Salmonella enterica enterica serovar Typhi Ty2
augcgcugggcac

SEQ ID NO: 1757459 - RNA, 23 nt, Salmonella enterica enterica serovar Typhi Ty2
augcggcaaaaauccuucuucca

SEQ ID NO: 1757460 - RNA, 21 nt, Salmonella enterica enterica serovar Typhi Ty2
augcggauaaagcgaucggcc

SEQ ID NO: 1757461 - RNA, 15 nt, Salmonella enterica enterica serovar Typhi Ty2
augcgcaugggcaua

SEQ ID NO: 1757462 - RNA, 16 nt, Salmonella enterica enterica serovar Typhi Ty2
augcgaauaacaucau

SEQ ID NO: 1757463 - RNA, 15 nt, Salmonella enterica enterica serovar Typhi Ty2
augcgaauaaucgcc

SEQ ID NO: 1757464 - RNA, 22 nt, Salmonella enterica enterica serovar Typhi Ty2
augcauuugauuuguuuuuuau

SEQ ID NO: 1757465 - RNA, 12 nt, Salmonella enterica enterica serovar Typhi Ty2
augcauuugauu

SEQ ID NO: 1757466 - RNA, 14 nt, Salmonella enterica enterica serovar Typhi Ty2
augcauuugauuug

SEQ ID NO: 1757467 - RNA, 15 nt, Salmonella enterica enterica serovar Typhi Ty2
augcgaaaaguaaag

SEQ ID NO: 1757468 - RNA, 19 nt, Salmonella enterica enterica serovar Typhi Ty2
augccaaauagcacgugca

SEQ ID NO: 1757469 - RNA, 12 nt, Salmonella enterica enterica serovar Typhi Ty2
augcauugcuga

SEQ ID NO: 1757470 - RNA, 16 nt, Salmonella enterica enterica serovar Typhi Ty2
augcaucuugaaugau

SEQ ID NO: 1757471 - RNA, 20 nt, Salmonella enterica enterica serovar Typhi Ty2
augcguaauccggccuggcg

SEQ ID NO: 1757472 - RNA, 18 nt, Salmonella enterica enterica serovar Typhi Ty2
augcgguucucccggcau

SEQ ID NO: 1757473 - RNA, 16 nt, Salmonella enterica enterica serovar Typhi Ty2
augcggcuuugcgccg

SEQ ID NO: 1757474 - RNA, 18 nt, Salmonella enterica enterica serovar Typhi Ty2
augcgggcgaucggcugu

SEQ ID NO: 1757475 - RNA, 17 nt, Salmonella enterica enterica serovar Typhi Ty2
augcgggguuugcagau

SEQ ID NO: 1757476 - RNA, 18 nt, Salmonella enterica enterica serovar Typhi Ty2
augcgggggcaguaaauu

SEQ ID NO: 1757477 - RNA, 15 nt, Salmonella enterica enterica serovar Typhi Ty2
augcguccgcccaga

SEQ ID NO: 1757478 - RNA, 20 nt, Salmonella enterica enterica serovar Typhi Ty2
augcguagggugaugccuuc

SEQ ID NO: 1757479 - RNA, 17 nt, Salmonella enterica enterica serovar Typhi Ty2
augcguauuuccaccuu

SEQ ID NO: 1757480 - RNA, 21 nt, Salmonella enterica enterica serovar Typhi Ty2
augcgucggcaccauucccac

SEQ ID NO: 1757481 - RNA, 17 nt, Salmonella enterica enterica serovar Typhi Ty2
augcucauuuugauaaa

SEQ ID NO: 1757482 - RNA, 12 nt, Salmonella enterica enterica serovar Typhi Ty2
augcucaaccag

SEQ ID NO: 1757483 - RNA, 22 nt, Salmonella enterica enterica serovar Typhi Ty2
augcuauucagcaguucauucg

SEQ ID NO: 1757484 - RNA, 14 nt, Salmonella enterica enterica serovar Typhi Ty2
augcuauucagcag

SEQ ID NO: 1757485 - RNA, 15 nt, Salmonella enterica enterica serovar Typhi Ty2
augcucauuauuugg

SEQ ID NO: 1757486 - RNA, 16 nt, Salmonella enterica enterica serovar Typhi Ty2
augcucaugaaggcau

SEQ ID NO: 1757487 - RNA, 23 nt, Salmonella enterica enterica serovar Typhi Ty2
augcuguuaccguaagcgggaug

SEQ ID NO: 1757488 - RNA, 21 nt, Salmonella enterica enterica serovar Typhi Ty2
augcuuaaaaucccgccgcug

SEQ ID NO: 1757489 - RNA, 21 nt, Salmonella enterica enterica serovar Typhi Ty2
augcugucgccggaaaaaaug

SEQ ID NO: 1757490 - RNA, 21 nt, Salmonella enterica enterica serovar Typhi Ty2
augcuggugaagacgcugcaa

SEQ ID NO: 1757491 - RNA, 22 nt, Salmonella enterica enterica serovar Typhi Ty2
augcuuccaaagagcugaaugu

SEQ ID NO: 1757492 - RNA, 20 nt, Salmonella enterica enterica serovar Typhi Ty2
augcugggcgugucccugga

SEQ ID NO: 1757493 - RNA, 20 nt, Salmonella enterica enterica serovar Typhi Ty2
augcuggcugaaauggccgu

SEQ ID NO: 1757494 - RNA, 23 nt, Salmonella enterica enterica serovar Typhi Ty2
augcugcgguuauaauaauaauu

SEQ ID NO: 1757495 - RNA, 20 nt, Salmonella enterica enterica serovar Typhi Ty2
augcugaauagccagccccc

SEQ ID NO: 1757496 - RNA, 18 nt, Salmonella enterica enterica serovar Typhi Ty2
augcugacggauucuucc

SEQ ID NO: 1757497 - RNA, 13 nt, Salmonella enterica enterica serovar Typhi Ty2
augcugcagggcc

SEQ ID NO: 1757498 - RNA, 15 nt, Salmonella enterica enterica serovar Typhi Ty2
augcugauacaaagc

SEQ ID NO: 1757499 - RNA, 21 nt, Salmonella enterica enterica serovar Typhi Ty2
augcugacggauucuuccucu

SEQ ID NO: 1757500 - RNA, 19 nt, Salmonella enterica enterica serovar Typhi Ty2
auggaaucggcuaguaaua

SEQ ID NO: 1757501 - RNA, 20 nt, Salmonella enterica enterica serovar Typhi Ty2
auggaacugccuggcucauu

SEQ ID NO: 1757502 - RNA, 21 nt, Salmonella enterica enterica serovar Typhi Ty2
auggaacucugcgacgccagg

SEQ ID NO: 1757503 - RNA, 14 nt, Salmonella enterica enterica serovar Typhi Ty2
auggaaaugcacgu

SEQ ID NO: 1757504 - RNA, 17 nt, Salmonella enterica enterica serovar Typhi Ty2
augcuuucaauacucca

SEQ ID NO: 1757505 - RNA, 15 nt, Salmonella enterica enterica serovar Typhi Ty2
augcuuucagcaugu

SEQ ID NO: 1757506 - RNA, 14 nt, Salmonella enterica enterica serovar Typhi Ty2
augcuuuaaaugcc

SEQ ID NO: 1757507 - RNA, 22 nt, Salmonella enterica enterica serovar Typhi Ty2
augcuuuccagccaugccagca

SEQ ID NO: 1757508 - RNA, 17 nt, Salmonella enterica enterica serovar Typhi Ty2
augcuuuuugugccgaa

SEQ ID NO: 1757509 - RNA, 18 nt, Salmonella enterica enterica serovar Typhi Ty2
auggauaacgaaaagggu

SEQ ID NO: 1757510 - RNA, 16 nt, Salmonella enterica enterica serovar Typhi Ty2
auggauagucaugaaa

SEQ ID NO: 1757511 - RNA, 14 nt, Salmonella enterica enterica serovar Typhi Ty2
auggaggcagugaa

SEQ ID NO: 1757512 - RNA, 23 nt, Salmonella enterica enterica serovar Typhi Ty2
auggaugcccaccugaaaaaggg

SEQ ID NO: 1757513 - RNA, 22 nt, Salmonella enterica enterica serovar Typhi Ty2
auggaugcccaccugaaaaagg

SEQ ID NO: 1757514 - RNA, 16 nt, Salmonella enterica enterica serovar Typhi Ty2
auggauaacgaaaagg

SEQ ID NO: 1757515 - RNA, 16 nt, Salmonella enterica enterica serovar Typhi Ty2
auggaucgacaucuuc

SEQ ID NO: 1757516 - RNA, 18 nt, Salmonella enterica enterica serovar Typhi Ty2
auggacaccggaagugaa

SEQ ID NO: 1757517 - RNA, 14 nt, Salmonella enterica enterica serovar Typhi Ty2
auggagaugaaaau

SEQ ID NO: 1757518 - RNA, 23 nt, Salmonella enterica enterica serovar Typhi Ty2
auggacgggauacggcgagacca

SEQ ID NO: 1757519 - RNA, 12 nt, Salmonella enterica enterica serovar Typhi Ty2
augucuggcgcu

SEQ ID NO: 1757520 - RNA, 19 nt, Salmonella enterica enterica serovar Typhi Ty2
augugguugugguaaucaa

SEQ ID NO: 1757521 - RNA, 19 nt, Salmonella enterica enterica serovar Typhi Ty2
augugcuauuuucucuugc

SEQ ID NO: 1757522 - RNA, 23 nt, Salmonella enterica enterica serovar Typhi Ty2
augugcggagaagacgccgccgc

SEQ ID NO: 1757523 - RNA, 14 nt, Salmonella enterica enterica serovar Typhi Ty2
augugcgccagccu

SEQ ID NO: 1757524 - RNA, 16 nt, Salmonella enterica enterica serovar Typhi Ty2
auguuaggguagaaaa

SEQ ID NO: 1757525 - RNA, 23 nt, Salmonella enterica enterica serovar Typhi Ty2
auguuccuggacguggguuucaa

SEQ ID NO: 1757526 - RNA, 18 nt, Salmonella enterica enterica serovar Typhi Ty2
auguuccgcaggggauuc

SEQ ID NO: 1757527 - RNA, 14 nt, Salmonella enterica enterica serovar Typhi Ty2
auguucuaacagau

SEQ ID NO: 1757528 - RNA, 14 nt, Salmonella enterica enterica serovar Typhi Ty2
augucaacuuaaac

SEQ ID NO: 1757529 - RNA, 12 nt, Salmonella enterica enterica serovar Typhi Ty2
augucaggauca

SEQ ID NO: 1757530 - RNA, 15 nt, Salmonella enterica enterica serovar Typhi Ty2
auguauuucagacuu

SEQ ID NO: 1757531 - RNA, 17 nt, Salmonella enterica enterica serovar Typhi Ty2
augucggcgaaaauccu

SEQ ID NO: 1757532 - RNA, 22 nt, Salmonella enterica enterica serovar Typhi Ty2
augucaucaacauuggaaaacu

SEQ ID NO: 1757533 - RNA, 14 nt, Salmonella enterica enterica serovar Typhi Ty2
augucauaauugcc

SEQ ID NO: 1757534 - RNA, 20 nt, Salmonella enterica enterica serovar Typhi Ty2
augucaucaggcgguguugu

SEQ ID NO: 1757535 - RNA, 22 nt, Salmonella enterica enterica serovar Typhi Ty2
auguauucucccgucagcaaca

SEQ ID NO: 1757536 - RNA, 17 nt, Salmonella enterica enterica serovar Typhi Ty2
auguacgccuaaaaaug

SEQ ID NO: 1757537 - RNA, 17 nt, Salmonella enterica enterica serovar Typhi Ty2
auguaccugcguuaaac

SEQ ID NO: 1757538 - RNA, 20 nt, Salmonella enterica enterica serovar Typhi Ty2
auguaccauugucaaaaaua

SEQ ID NO: 1757539 - RNA, 22 nt, Salmonella enterica enterica serovar Typhi Ty2
auguacuguauucgguggaaac

SEQ ID NO: 1757540 - RNA, 16 nt, Salmonella enterica enterica serovar Typhi Ty2
auguaacgccuuugcc

SEQ ID NO: 1757541 - RNA, 12 nt, Salmonella enterica enterica serovar Typhi Ty2
auguaaaugacg

SEQ ID NO: 1757542 - RNA, 16 nt, Salmonella enterica enterica serovar Typhi Ty2
auguaauucaccaaau

SEQ ID NO: 1757543 - RNA, 20 nt, Salmonella enterica enterica serovar Typhi Ty2
auguacacgaaauagcgcag

SEQ ID NO: 1757544 - RNA, 13 nt, Salmonella enterica enterica serovar Typhi Ty2
auguacaggugaa

SEQ ID NO: 1757545 - RNA, 16 nt, Salmonella enterica enterica serovar Typhi Ty2
auguacaacuucauga

SEQ ID NO: 1757546 - RNA, 18 nt, Salmonella enterica enterica serovar Typhi Ty2
auguaccauugucaaaaa

SEQ ID NO: 1757547 - RNA, 20 nt, Salmonella enterica enterica serovar Typhi Ty2
auguacauaggcaauauccu

SEQ ID NO: 1757548 - RNA, 23 nt, Salmonella enterica enterica serovar Typhi Ty2
auguacaggugaaauaggggaga

SEQ ID NO: 1757549 - RNA, 17 nt, Salmonella enterica enterica serovar Typhi Ty2
augguuauccagcaggu

SEQ ID NO: 1757550 - RNA, 18 nt, Salmonella enterica enterica serovar Typhi Ty2
augguuauaguccacuuu

SEQ ID NO: 1757551 - RNA, 13 nt, Salmonella enterica enterica serovar Typhi Ty2
auggugcucagcc

SEQ ID NO: 1757552 - RNA, 18 nt, Salmonella enterica enterica serovar Typhi Ty2
auggugcggcgcacugcc

SEQ ID NO: 1757553 - RNA, 16 nt, Salmonella enterica enterica serovar Typhi Ty2
auguaaaggugagcuc

SEQ ID NO: 1757554 - RNA, 22 nt, Salmonella enterica enterica serovar Typhi Ty2
auguaaagucggccauuuuuuu

SEQ ID NO: 1757555 - RNA, 18 nt, Salmonella enterica enterica serovar Typhi Ty2
auguaaacuccauuaaau

SEQ ID NO: 1757556 - RNA, 23 nt, Salmonella enterica enterica serovar Typhi Ty2
augguugacuuacaaaaaauaca

SEQ ID NO: 1757557 - RNA, 17 nt, Salmonella enterica enterica serovar Typhi Ty2
auggguuccaguugcac

SEQ ID NO: 1757558 - RNA, 20 nt, Salmonella enterica enterica serovar Typhi Ty2
augggucacauccagacagc

SEQ ID NO: 1757559 - RNA, 20 nt, Salmonella enterica enterica serovar Typhi Ty2
auggcuuucagauuagccag

SEQ ID NO: 1757560 - RNA, 20 nt, Salmonella enterica enterica serovar Typhi Ty2
auggguaggccggauaagcg

SEQ ID NO: 1757561 - RNA, 23 nt, Salmonella enterica enterica serovar Typhi Ty2
auggguaucgccuucgacuuccg

SEQ ID NO: 1757562 - RNA, 21 nt, Salmonella enterica enterica serovar Typhi Ty2
auggccuggcggaugaugcgu

SEQ ID NO: 1757563 - RNA, 12 nt, Salmonella enterica enterica serovar Typhi Ty2
auggcaaagucg

SEQ ID NO: 1757564 - RNA, 18 nt, Salmonella enterica enterica serovar Typhi Ty2
auggcaacaaagccugcu

SEQ ID NO: 1757565 - RNA, 21 nt, Salmonella enterica enterica serovar Typhi Ty2
auggcaaaagacauccccgcc

SEQ ID NO: 1757566 - RNA, 22 nt, Salmonella enterica enterica serovar Typhi Ty2
auggauucaugguacucaacau

SEQ ID NO: 1757567 - RNA, 15 nt, Salmonella enterica enterica serovar Typhi Ty2
auggcgguauaacug

SEQ ID NO: 1757568 - RNA, 22 nt, Salmonella enterica enterica serovar Typhi Ty2
auggcgggcgcagguuuuacuu

SEQ ID NO: 1757569 - RNA, 22 nt, Salmonella enterica enterica serovar Typhi Ty2
auggcgccagccauagcagcaa

SEQ ID NO: 1757570 - RNA, 18 nt, Salmonella enterica enterica serovar Typhi Ty2
auggcgcagcauacgcug

SEQ ID NO: 1757571 - RNA, 21 nt, Salmonella enterica enterica serovar Typhi Ty2
auggcgaaaaucggcaggccg

SEQ ID NO: 1757572 - RNA, 18 nt, Salmonella enterica enterica serovar Typhi Ty2
auggcgacgacgcuguuu

SEQ ID NO: 1757573 - RNA, 12 nt, Salmonella enterica enterica serovar Typhi Ty2
auggcuggauga

SEQ ID NO: 1757574 - RNA, 18 nt, Salmonella enterica enterica serovar Typhi Ty2
auggcugauggcgaaaau

SEQ ID NO: 1757575 - RNA, 22 nt, Salmonella enterica enterica serovar Typhi Ty2
auggcugcacccggagagaaac

SEQ ID NO: 1757576 - RNA, 21 nt, Salmonella enterica enterica serovar Typhi Ty2
auggcggugcuuaaccgggau

SEQ ID NO: 1757577 - RNA, 20 nt, Salmonella enterica enterica serovar Typhi Ty2
auggcgguauaacugccuua

SEQ ID NO: 1757578 - RNA, 18 nt, Salmonella enterica enterica serovar Typhi Ty2
auggcgucgcuacgggcg

SEQ ID NO: 1757579 - RNA, 15 nt, Salmonella enterica enterica serovar Typhi Ty2
augauugagcguuuc

SEQ ID NO: 1757580 - RNA, 14 nt, Salmonella enterica enterica serovar Typhi Ty2
augauuuucuuauu

SEQ ID NO: 1757581 - RNA, 22 nt, Salmonella enterica enterica serovar Typhi Ty2
augauuuucuuauuacaagaaa

SEQ ID NO: 1757582 - RNA, 15 nt, Salmonella enterica enterica serovar Typhi Ty2
augauuauuguuaaa

SEQ ID NO: 1757583 - RNA, 17 nt, Salmonella enterica enterica serovar Typhi Ty2
augauucaaucggcgau

SEQ ID NO: 1757584 - RNA, 16 nt, Salmonella enterica enterica serovar Typhi Ty2
augcaccagucccagc

SEQ ID NO: 1757585 - RNA, 16 nt, Salmonella enterica enterica serovar Typhi Ty2
augcaccgccuugccc

SEQ ID NO: 1757586 - RNA, 14 nt, Salmonella enterica enterica serovar Typhi Ty2
augcaaaagaaaaa

SEQ ID NO: 1757587 - RNA, 15 nt, Salmonella enterica enterica serovar Typhi Ty2
augcaaaagaaaaaa

SEQ ID NO: 1757588 - RNA, 13 nt, Salmonella enterica enterica serovar Typhi Ty2
augcaaaagaaaa

SEQ ID NO: 1757589 - RNA, 20 nt, Salmonella enterica enterica serovar Typhi Ty2
augcauacggaugaaauacu

SEQ ID NO: 1757590 - RNA, 15 nt, Salmonella enterica enterica serovar Typhi Ty2
augcauaugcacagc

SEQ ID NO: 1757591 - RNA, 15 nt, Salmonella enterica enterica serovar Typhi Ty2
augcauaugaaugau

SEQ ID NO: 1757592 - RNA, 18 nt, Salmonella enterica enterica serovar Typhi Ty2
augcauauuauucaugau

SEQ ID NO: 1757593 - RNA, 14 nt, Salmonella enterica enterica serovar Typhi Ty2
augcauaaugcagc

SEQ ID NO: 1757594 - RNA, 21 nt, Salmonella enterica enterica serovar Typhi Ty2
augcagcaggucgaccaccug

SEQ ID NO: 1757595 - RNA, 14 nt, Salmonella enterica enterica serovar Typhi Ty2
augcacugcugaua

SEQ ID NO: 1757596 - RNA, 18 nt, Salmonella enterica enterica serovar Typhi Ty2
augcacugcaauuucugc

SEQ ID NO: 1757597 - RNA, 16 nt, Salmonella enterica enterica serovar Typhi Ty2
augcaccucuuuaugc

SEQ ID NO: 1757598 - RNA, 14 nt, Salmonella enterica enterica serovar Typhi Ty2
augauuaaaauaaa

SEQ ID NO: 1757599 - RNA, 14 nt, Salmonella enterica enterica serovar Typhi Ty2
augauuaaagccac

SEQ ID NO: 1757600 - RNA, 15 nt, Salmonella enterica enterica serovar Typhi Ty2
augauuaaaauaaau

SEQ ID NO: 1757601 - RNA, 13 nt, Salmonella enterica enterica serovar Typhi Ty2
augaugcguuacu

SEQ ID NO: 1757602 - RNA, 15 nt, Salmonella enterica enterica serovar Typhi Ty2
augauuaauuguacc

SEQ ID NO: 1757603 - RNA, 19 nt, Salmonella enterica enterica serovar Typhi Ty2
augauuagauagauauuuu

SEQ ID NO: 1757604 - RNA, 19 nt, Salmonella enterica enterica serovar Typhi Ty2
augaucuuaccucuccuga

SEQ ID NO: 1757605 - RNA, 14 nt, Salmonella enterica enterica serovar Typhi Ty2
augaucuucauaaa

SEQ ID NO: 1757606 - RNA, 16 nt, Salmonella enterica enterica serovar Typhi Ty2
augaugcauuugauuu

SEQ ID NO: 1757607 - RNA, 18 nt, Salmonella enterica enterica serovar Typhi Ty2
augaugccaggaccaggu

SEQ ID NO: 1757608 - RNA, 17 nt, Salmonella enterica enterica serovar Typhi Ty2
augaugcgcuguaaaug

SEQ ID NO: 1757609 - RNA, 23 nt, Salmonella enterica enterica serovar Typhi Ty2
augaugccuugcgaauggagaag

SEQ ID NO: 1757610 - RNA, 18 nt, Salmonella enterica enterica serovar Typhi Ty2
augaugccacgagaaauc

SEQ ID NO: 1757611 - RNA, 16 nt, Salmonella enterica enterica serovar Typhi Ty2
augaucgcccagccac

SEQ ID NO: 1757612 - RNA, 21 nt, Salmonella enterica enterica serovar Typhi Ty2
augaucguaugcagccaggcc

SEQ ID NO: 1757613 - RNA, 19 nt, Salmonella enterica enterica serovar Typhi Ty2
augaucguuuuuuguugau

SEQ ID NO: 1757614 - RNA, 16 nt, Salmonella enterica enterica serovar Typhi Ty2
augaucguaugcagcc

SEQ ID NO: 1757615 - RNA, 22 nt, Salmonella enterica enterica serovar Typhi Ty2
augauaucggccggaugccagu

SEQ ID NO: 1757616 - RNA, 21 nt, Salmonella enterica enterica serovar Typhi Ty2
augauaucggccggaugccag

SEQ ID NO: 1757617 - RNA, 15 nt, Salmonella enterica enterica serovar Typhi Ty2
augaucauacugccg

SEQ ID NO: 1757618 - RNA, 15 nt, Salmonella enterica enterica serovar Typhi Ty2
augaucaccaucuuc

SEQ ID NO: 1757619 - RNA, 22 nt, Salmonella enterica enterica serovar Typhi Ty2
augaucaccaucuucacauauc

SEQ ID NO: 1757620 - RNA, 16 nt, Salmonella enterica enterica serovar Typhi Ty2
augauaauaugcucaa

SEQ ID NO: 1757621 - RNA, 13 nt, Salmonella enterica enterica serovar Typhi Ty2
augauaaugccgc

SEQ ID NO: 1757622 - RNA, 23 nt, Salmonella enterica enterica serovar Typhi Ty2
augaggccagaaggcgaacauaa

SEQ ID NO: 1757623 - RNA, 16 nt, Salmonella enterica enterica serovar Typhi Ty2
augauauauucaugau

SEQ ID NO: 1757624 - RNA, 19 nt, Salmonella enterica enterica serovar Typhi Ty2
augauagcgccauauaaau

SEQ ID NO: 1757625 - RNA, 15 nt, Salmonella enterica enterica serovar Typhi Ty2
augacguggccagca

SEQ ID NO: 1757626 - RNA, 12 nt, Salmonella enterica enterica serovar Typhi Ty2
augagcaggcca

SEQ ID NO: 1757627 - RNA, 15 nt, Salmonella enterica enterica serovar Typhi Ty2
augagcaggccaggg

SEQ ID NO: 1757628 - RNA, 18 nt, Salmonella enterica enterica serovar Typhi Ty2
augacucauuaaaaaaac

SEQ ID NO: 1757629 - RNA, 17 nt, Salmonella enterica enterica serovar Typhi Ty2
augagcucaaauaugau

SEQ ID NO: 1757630 - RNA, 12 nt, Salmonella enterica enterica serovar Typhi Ty2
augagcaggccc

SEQ ID NO: 1757631 - RNA, 18 nt, Salmonella enterica enterica serovar Typhi Ty2
augagccagauggauaac

SEQ ID NO: 1757632 - RNA, 12 nt, Salmonella enterica enterica serovar Typhi Ty2
augagccagccc

SEQ ID NO: 1757633 - RNA, 15 nt, Salmonella enterica enterica serovar Typhi Ty2
augaacucaauccau

SEQ ID NO: 1757634 - RNA, 20 nt, Salmonella enterica enterica serovar Typhi Ty2
augaacucuaugcaaaagaa

SEQ ID NO: 1757635 - RNA, 21 nt, Salmonella enterica enterica serovar Typhi Ty2
augaacucuaugcaaaagaaa

SEQ ID NO: 1757636 - RNA, 11 nt, Salmonella enterica enterica serovar Typhi Ty2
augaaccggga

SEQ ID NO: 1757637 - RNA, 19 nt, Salmonella enterica enterica serovar Typhi Ty2
augaacccucgaaugugaa

SEQ ID NO: 1757638 - RNA, 22 nt, Salmonella enterica enterica serovar Typhi Ty2
augaacccucgaaugugaauuc

SEQ ID NO: 1757639 - RNA, 21 nt, Salmonella enterica enterica serovar Typhi Ty2
augaaccauaucaaacaggac

SEQ ID NO: 1757640 - RNA, 13 nt, Salmonella enterica enterica serovar Typhi Ty2
augacaaaaauua

SEQ ID NO: 1757641 - RNA, 13 nt, Salmonella enterica enterica serovar Typhi Ty2
augacagaaagcg

SEQ ID NO: 1757642 - RNA, 14 nt, Salmonella enterica enterica serovar Typhi Ty2
augacgucagcaag

SEQ ID NO: 1757643 - RNA, 23 nt, Salmonella enterica enterica serovar Typhi Ty2
augacgggaucgaaccgccgacc

SEQ ID NO: 1757644 - RNA, 23 nt, Salmonella enterica enterica serovar Typhi Ty2
augacggcagucgcuacaaccag

SEQ ID NO: 1757645 - RNA, 18 nt, Salmonella enterica enterica serovar Typhi Ty2
augacggcgcguuaucgu

SEQ ID NO: 1757646 - RNA, 13 nt, Salmonella enterica enterica serovar Typhi Ty2
augacgggggcga

SEQ ID NO: 1757647 - RNA, 17 nt, Salmonella enterica enterica serovar Typhi Ty2
augacgcuggaaguaug

SEQ ID NO: 1757648 - RNA, 21 nt, Salmonella enterica enterica serovar Typhi Ty2
augacggcaaagcccacgccc

SEQ ID NO: 1757649 - RNA, 20 nt, Salmonella enterica enterica serovar Typhi Ty2
augacggacgcagaccaaag

SEQ ID NO: 1757650 - RNA, 18 nt, Salmonella enterica enterica serovar Typhi Ty2
augaccguauuacaagua

SEQ ID NO: 1757651 - RNA, 22 nt, Salmonella enterica enterica serovar Typhi Ty2
augacauagcauaauaaugaau

SEQ ID NO: 1757652 - RNA, 13 nt, Salmonella enterica enterica serovar Typhi Ty2
augaccauucaca

SEQ ID NO: 1757653 - RNA, 15 nt, Salmonella enterica enterica serovar Typhi Ty2
augaccgccuuuuuu

SEQ ID NO: 1757654 - RNA, 16 nt, Salmonella enterica enterica serovar Typhi Ty2
augaccgcacagcaga

SEQ ID NO: 1757655 - RNA, 14 nt, Salmonella enterica enterica serovar Typhi Ty2
aucuuuguucuguu

SEQ ID NO: 1757656 - RNA, 15 nt, Salmonella enterica enterica serovar Typhi Ty2
aucuuuuaaaaucag

SEQ ID NO: 1757657 - RNA, 14 nt, Salmonella enterica enterica serovar Typhi Ty2
aucuuugccgcaaa

SEQ ID NO: 1757658 - RNA, 16 nt, Salmonella enterica enterica serovar Typhi Ty2
aucuuugccacgucga

SEQ ID NO: 1757659 - RNA, 16 nt, Salmonella enterica enterica serovar Typhi Ty2
aucuuugagcagauaa

SEQ ID NO: 1757660 - RNA, 17 nt, Salmonella enterica enterica serovar Typhi Ty2
aucuuuaugucaguaau

SEQ ID NO: 1757661 - RNA, 19 nt, Salmonella enterica enterica serovar Typhi Ty2
augaaaugagaccaauaag

SEQ ID NO: 1757662 - RNA, 12 nt, Salmonella enterica enterica serovar Typhi Ty2
augaaaacucgg

SEQ ID NO: 1757663 - RNA, 10 nt, Salmonella enterica enterica serovar Typhi Ty2
augaaaaaaa

SEQ ID NO: 1757664 - RNA, 15 nt, Salmonella enterica enterica serovar Typhi Ty2
aucuuuuugcuccug

SEQ ID NO: 1757665 - RNA, 15 nt, Salmonella enterica enterica serovar Typhi Ty2
augaaaaaucggcaa

SEQ ID NO: 1757666 - RNA, 17 nt, Salmonella enterica enterica serovar Typhi Ty2
augaaaaaaguuauuuu

SEQ ID NO: 1757667 - RNA, 21 nt, Salmonella enterica enterica serovar Typhi Ty2
aucuucggcgggaucuccaga

SEQ ID NO: 1757668 - RNA, 21 nt, Salmonella enterica enterica serovar Typhi Ty2
aucuuccucacagccuugcca

SEQ ID NO: 1757669 - RNA, 20 nt, Salmonella enterica enterica serovar Typhi Ty2
aucuuccgggucaguuuuuu

SEQ ID NO: 1757670 - RNA, 15 nt, Salmonella enterica enterica serovar Typhi Ty2
aucuuccagguagug

SEQ ID NO: 1757671 - RNA, 14 nt, Salmonella enterica enterica serovar Typhi Ty2
aucuuccaguugcu

SEQ ID NO: 1757672 - RNA, 23 nt, Salmonella enterica enterica serovar Typhi Ty2
aucuuccacccgcgcgcuuucca

SEQ ID NO: 1757673 - RNA, 19 nt, Salmonella enterica enterica serovar Typhi Ty2
aucuucuacaugcccuucu

SEQ ID NO: 1757674 - RNA, 17 nt, Salmonella enterica enterica serovar Typhi Ty2
aucuucuaccuggaacc

SEQ ID NO: 1757675 - RNA, 14 nt, Salmonella enterica enterica serovar Typhi Ty2
aucuugcguuaugu

SEQ ID NO: 1757676 - RNA, 14 nt, Salmonella enterica enterica serovar Typhi Ty2
aucuugugaguaau

SEQ ID NO: 1757677 - RNA, 18 nt, Salmonella enterica enterica serovar Typhi Ty2
aucugcuccgccagcaau

SEQ ID NO: 1757678 - RNA, 20 nt, Salmonella enterica enterica serovar Typhi Ty2
aucugcugacacccucugcg

SEQ ID NO: 1757679 - RNA, 22 nt, Salmonella enterica enterica serovar Typhi Ty2
aucuggucaggugauugcccuc

SEQ ID NO: 1757680 - RNA, 16 nt, Salmonella enterica enterica serovar Typhi Ty2
aucuggucauggcuua

SEQ ID NO: 1757681 - RNA, 22 nt, Salmonella enterica enterica serovar Typhi Ty2
aucugugugggcacucgaagau

SEQ ID NO: 1757682 - RNA, 17 nt, Salmonella enterica enterica serovar Typhi Ty2
aucugugccagcccaau

SEQ ID NO: 1757683 - RNA, 15 nt, Salmonella enterica enterica serovar Typhi Ty2
aucuguauaaauaac

SEQ ID NO: 1757684 - RNA, 15 nt, Salmonella enterica enterica serovar Typhi Ty2
aucugucccagccuu

SEQ ID NO: 1757685 - RNA, 20 nt, Salmonella enterica enterica serovar Typhi Ty2
aucuguaggcccgguaagcg

SEQ ID NO: 1757686 - RNA, 17 nt, Salmonella enterica enterica serovar Typhi Ty2
aucuguaauuauaaaua

SEQ ID NO: 1757687 - RNA, 14 nt, Salmonella enterica enterica serovar Typhi Ty2
aucugguucacaga

SEQ ID NO: 1757688 - RNA, 18 nt, Salmonella enterica enterica serovar Typhi Ty2
aucugguuauccaccagc

SEQ ID NO: 1757689 - RNA, 17 nt, Salmonella enterica enterica serovar Typhi Ty2
aucugguggaaaagaaa

SEQ ID NO: 1757690 - RNA, 15 nt, Salmonella enterica enterica serovar Typhi Ty2
aucuggugauaaagc

SEQ ID NO: 1757691 - RNA, 17 nt, Salmonella enterica enterica serovar Typhi Ty2
aucuggugauaaagcag

SEQ ID NO: 1757692 - RNA, 14 nt, Salmonella enterica enterica serovar Typhi Ty2
aucuggugauaaag

SEQ ID NO: 1757693 - RNA, 15 nt, Salmonella enterica enterica serovar Typhi Ty2
aucuguuuuagcaug

SEQ ID NO: 1757694 - RNA, 15 nt, Salmonella enterica enterica serovar Typhi Ty2
aucuguuugagaaaa

SEQ ID NO: 1757695 - RNA, 15 nt, Salmonella enterica enterica serovar Typhi Ty2
aucuguucaaaaaca

SEQ ID NO: 1757696 - RNA, 16 nt, Salmonella enterica enterica serovar Typhi Ty2
aucuguucguugcugu

SEQ ID NO: 1757697 - RNA, 21 nt, Salmonella enterica enterica serovar Typhi Ty2
aucuguuccacagaucuaucu

SEQ ID NO: 1757698 - RNA, 14 nt, Salmonella enterica enterica serovar Typhi Ty2
aucuguuccagcga

SEQ ID NO: 1757699 - RNA, 16 nt, Salmonella enterica enterica serovar Typhi Ty2
aucuguugcgcaagca

SEQ ID NO: 1757700 - RNA, 14 nt, Salmonella enterica enterica serovar Typhi Ty2
aucuguugcgccag

SEQ ID NO: 1757701 - RNA, 12 nt, Salmonella enterica enterica serovar Typhi Ty2
aucuucaguaag

SEQ ID NO: 1757702 - RNA, 15 nt, Salmonella enterica enterica serovar Typhi Ty2
aucuucagcccguuc

SEQ ID NO: 1757703 - RNA, 14 nt, Salmonella enterica enterica serovar Typhi Ty2
aucuucaucccauc

SEQ ID NO: 1757704 - RNA, 19 nt, Salmonella enterica enterica serovar Typhi Ty2
aucuucaccgaugcccagc

SEQ ID NO: 1757705 - RNA, 22 nt, Salmonella enterica enterica serovar Typhi Ty2
aucuucaccgaugcccagcuug

SEQ ID NO: 1757706 - RNA, 21 nt, Salmonella enterica enterica serovar Typhi Ty2
aucuucaaucgugaccaccgc

SEQ ID NO: 1757707 - RNA, 23 nt, Salmonella enterica enterica serovar Typhi Ty2
aucuuauuuuccguuagccaaug

SEQ ID NO: 1757708 - RNA, 21 nt, Salmonella enterica enterica serovar Typhi Ty2
auaugcagugcugcugccauu

SEQ ID NO: 1757709 - RNA, 19 nt, Salmonella enterica enterica serovar Typhi Ty2
auaugcaggcauaaaaaag

SEQ ID NO: 1757710 - RNA, 16 nt, Salmonella enterica enterica serovar Typhi Ty2
auaugcagcagccagu

SEQ ID NO: 1757711 - RNA, 17 nt, Salmonella enterica enterica serovar Typhi Ty2
auaugaaccaagauaag

SEQ ID NO: 1757712 - RNA, 13 nt, Salmonella enterica enterica serovar Typhi Ty2
auaugaaccaaga

SEQ ID NO: 1757713 - RNA, 14 nt, Salmonella enterica enterica serovar Typhi Ty2
auaugaauauacga

SEQ ID NO: 1757714 - RNA, 17 nt, Salmonella enterica enterica serovar Typhi Ty2
auaugaaucaucagaau

SEQ ID NO: 1757715 - RNA, 18 nt, Salmonella enterica enterica serovar Typhi Ty2
auaugaaucaucagaauc

SEQ ID NO: 1757716 - RNA, 13 nt, Salmonella enterica enterica serovar Typhi Ty2
auaugauuuaaaa

SEQ ID NO: 1757717 - RNA, 18 nt, Salmonella enterica enterica serovar Typhi Ty2
auaugacguauugaaaau

SEQ ID NO: 1757718 - RNA, 19 nt, Salmonella enterica enterica serovar Typhi Ty2
auaucccggcugacauaau

SEQ ID NO: 1757719 - RNA, 15 nt, Salmonella enterica enterica serovar Typhi Ty2
auaucccgcauaccg

SEQ ID NO: 1757720 - RNA, 15 nt, Salmonella enterica enterica serovar Typhi Ty2
auaucccuauuagca

SEQ ID NO: 1757721 - RNA, 20 nt, Salmonella enterica enterica serovar Typhi Ty2
auaucccuauuagcacgccc

SEQ ID NO: 1757722 - RNA, 15 nt, Salmonella enterica enterica serovar Typhi Ty2
auauccgguacacca

SEQ ID NO: 1757723 - RNA, 13 nt, Salmonella enterica enterica serovar Typhi Ty2
auauccuccggca

SEQ ID NO: 1757724 - RNA, 19 nt, Salmonella enterica enterica serovar Typhi Ty2
auauccucgcauccuccau

SEQ ID NO: 1757725 - RNA, 23 nt, Salmonella enterica enterica serovar Typhi Ty2
auauccgugcgcaauuccagcaa

SEQ ID NO: 1757726 - RNA, 22 nt, Salmonella enterica enterica serovar Typhi Ty2
auauccgcugcggucaggaaug

SEQ ID NO: 1757727 - RNA, 15 nt, Salmonella enterica enterica serovar Typhi Ty2
auauccuguaacuca

SEQ ID NO: 1757728 - RNA, 16 nt, Salmonella enterica enterica serovar Typhi Ty2
auaucgcggaaauuca

SEQ ID NO: 1757729 - RNA, 22 nt, Salmonella enterica enterica serovar Typhi Ty2
auaucgcggguaaacucaccca

SEQ ID NO: 1757730 - RNA, 17 nt, Salmonella enterica enterica serovar Typhi Ty2
auaucgcgauaaacuga

SEQ ID NO: 1757731 - RNA, 14 nt, Salmonella enterica enterica serovar Typhi Ty2
auaucgcuaaccaa

SEQ ID NO: 1757732 - RNA, 21 nt, Salmonella enterica enterica serovar Typhi Ty2
auauauauuuucucaauuuua

SEQ ID NO: 1757733 - RNA, 19 nt, Salmonella enterica enterica serovar Typhi Ty2
auauaucgcgucaucaaac

SEQ ID NO: 1757734 - RNA, 12 nt, Salmonella enterica enterica serovar Typhi Ty2
auauaugaaauc

SEQ ID NO: 1757735 - RNA, 15 nt, Salmonella enterica enterica serovar Typhi Ty2
auauaugcaaaacug

SEQ ID NO: 1757736 - RNA, 20 nt, Salmonella enterica enterica serovar Typhi Ty2
auauaugaaccaagauaaga

SEQ ID NO: 1757737 - RNA, 22 nt, Salmonella enterica enterica serovar Typhi Ty2
auaucaucgucauuaaugccua

SEQ ID NO: 1757738 - RNA, 16 nt, Salmonella enterica enterica serovar Typhi Ty2
auauccccaucccaga

SEQ ID NO: 1757739 - RNA, 13 nt, Salmonella enterica enterica serovar Typhi Ty2
auauccaguugcg

SEQ ID NO: 1757740 - RNA, 22 nt, Salmonella enterica enterica serovar Typhi Ty2
auaguucaucgugaaauuauuc

SEQ ID NO: 1757741 - RNA, 21 nt, Salmonella enterica enterica serovar Typhi Ty2
auaguuauacauuuuuuucuu

SEQ ID NO: 1757742 - RNA, 16 nt, Salmonella enterica enterica serovar Typhi Ty2
auaguugagcagcgcg

SEQ ID NO: 1757743 - RNA, 13 nt, Salmonella enterica enterica serovar Typhi Ty2
auagcgagaggca

SEQ ID NO: 1757744 - RNA, 15 nt, Salmonella enterica enterica serovar Typhi Ty2
auagcgccauccugc

SEQ ID NO: 1757745 - RNA, 16 nt, Salmonella enterica enterica serovar Typhi Ty2
auagcgccauccugcc

SEQ ID NO: 1757746 - RNA, 22 nt, Salmonella enterica enterica serovar Typhi Ty2
auagccuuugucgaaauugccg

SEQ ID NO: 1757747 - RNA, 18 nt, Salmonella enterica enterica serovar Typhi Ty2
auaguauccauaauuuuc

SEQ ID NO: 1757748 - RNA, 21 nt, Salmonella enterica enterica serovar Typhi Ty2
auagcgccccggugcuuucuc

SEQ ID NO: 1757749 - RNA, 17 nt, Salmonella enterica enterica serovar Typhi Ty2
auagcgcgaaugauuuu

SEQ ID NO: 1757750 - RNA, 16 nt, Salmonella enterica enterica serovar Typhi Ty2
auagucauaauuaaaa

SEQ ID NO: 1757751 - RNA, 17 nt, Salmonella enterica enterica serovar Typhi Ty2
auagucauaauuaaaaa

SEQ ID NO: 1757752 - RNA, 19 nt, Salmonella enterica enterica serovar Typhi Ty2
auagucauugacagcaagu

SEQ ID NO: 1757753 - RNA, 19 nt, Salmonella enterica enterica serovar Typhi Ty2
auauaagcgccgucauccg

SEQ ID NO: 1757754 - RNA, 18 nt, Salmonella enterica enterica serovar Typhi Ty2
auauaaggaucggaagac

SEQ ID NO: 1757755 - RNA, 14 nt, Salmonella enterica enterica serovar Typhi Ty2
auauaaucuaccau

SEQ ID NO: 1757756 - RNA, 17 nt, Salmonella enterica enterica serovar Typhi Ty2
auauacccccugcaauu

SEQ ID NO: 1757757 - RNA, 15 nt, Salmonella enterica enterica serovar Typhi Ty2
auauacgccacggcc

SEQ ID NO: 1757758 - RNA, 16 nt, Salmonella enterica enterica serovar Typhi Ty2
auauagaguugugaaa

SEQ ID NO: 1757759 - RNA, 23 nt, Salmonella enterica enterica serovar Typhi Ty2
auauagagcccucuguccacaca

SEQ ID NO: 1757760 - RNA, 16 nt, Salmonella enterica enterica serovar Typhi Ty2
auauaguuuauugaag

SEQ ID NO: 1757761 - RNA, 16 nt, Salmonella enterica enterica serovar Typhi Ty2
auauaggggccaagcg

SEQ ID NO: 1757762 - RNA, 23 nt, Salmonella enterica enterica serovar Typhi Ty2
auauagcuaaugcaauaaacuaa

SEQ ID NO: 1757763 - RNA, 14 nt, Salmonella enterica enterica serovar Typhi Ty2
auauagccguggcu

SEQ ID NO: 1757764 - RNA, 16 nt, Salmonella enterica enterica serovar Typhi Ty2
auauagccguggcugg

SEQ ID NO: 1757765 - RNA, 16 nt, Salmonella enterica enterica serovar Typhi Ty2
auauuaguguuauaua

SEQ ID NO: 1757766 - RNA, 19 nt, Salmonella enterica enterica serovar Typhi Ty2
auauuagcgguacucuuuu

SEQ ID NO: 1757767 - RNA, 22 nt, Salmonella enterica enterica serovar Typhi Ty2
auauuagcgguacucuuuuucc

SEQ ID NO: 1757768 - RNA, 14 nt, Salmonella enterica enterica serovar Typhi Ty2
auauuacaacaugu

SEQ ID NO: 1757769 - RNA, 24 nt, Salmonella enterica enterica serovar Typhi Ty2
auauguuugauaaacugcgccaug

SEQ ID NO: 1757770 - RNA, 13 nt, Salmonella enterica enterica serovar Typhi Ty2
auauguaaaucgg

SEQ ID NO: 1757771 - RNA, 19 nt, Salmonella enterica enterica serovar Typhi Ty2
auauggccguuuucaugca

SEQ ID NO: 1757772 - RNA, 19 nt, Salmonella enterica enterica serovar Typhi Ty2
auauuaucgcgcugaauaa

SEQ ID NO: 1757773 - RNA, 12 nt, Salmonella enterica enterica serovar Typhi Ty2
auauuauauuuu

SEQ ID NO: 1757774 - RNA, 14 nt, Salmonella enterica enterica serovar Typhi Ty2
auauuaucauaaug

SEQ ID NO: 1757775 - RNA, 12 nt, Salmonella enterica enterica serovar Typhi Ty2
auauuauaaaau

SEQ ID NO: 1757776 - RNA, 11 nt, Salmonella enterica enterica serovar Typhi Ty2
auauuccagaa

SEQ ID NO: 1757777 - RNA, 18 nt, Salmonella enterica enterica serovar Typhi Ty2
auauuccgccucguguaa

SEQ ID NO: 1757778 - RNA, 19 nt, Salmonella enterica enterica serovar Typhi Ty2
auauugaccgcuuuuucca

SEQ ID NO: 1757779 - RNA, 16 nt, Salmonella enterica enterica serovar Typhi Ty2
auauugcguaaaaacc

SEQ ID NO: 1757780 - RNA, 13 nt, Salmonella enterica enterica serovar Typhi Ty2
auauugguagcau

SEQ ID NO: 1757781 - RNA, 17 nt, Salmonella enterica enterica serovar Typhi Ty2
aucaauaaccgccagca

SEQ ID NO: 1757782 - RNA, 17 nt, Salmonella enterica enterica serovar Typhi Ty2
aucaauaaaauuaucca

SEQ ID NO: 1757783 - RNA, 21 nt, Salmonella enterica enterica serovar Typhi Ty2
aucaaucacuacggguuuuug

SEQ ID NO: 1757784 - RNA, 19 nt, Salmonella enterica enterica serovar Typhi Ty2
aucaauacagagauauuaa

SEQ ID NO: 1757785 - RNA, 20 nt, Salmonella enterica enterica serovar Typhi Ty2
aucaauaacgauaauuuuac

SEQ ID NO: 1757786 - RNA, 18 nt, Salmonella enterica enterica serovar Typhi Ty2
aucaauaagcgaauugcc

SEQ ID NO: 1757787 - RNA, 18 nt, Salmonella enterica enterica serovar Typhi Ty2
aucaacguuguccagcgg

SEQ ID NO: 1757788 - RNA, 20 nt, Salmonella enterica enterica serovar Typhi Ty2
aucaacaucgcaaaauuccg

SEQ ID NO: 1757789 - RNA, 14 nt, Salmonella enterica enterica serovar Typhi Ty2
aucaacuccuccgg

SEQ ID NO: 1757790 - RNA, 14 nt, Salmonella enterica enterica serovar Typhi Ty2
aucaacucuccuuu

SEQ ID NO: 1757791 - RNA, 23 nt, Salmonella enterica enterica serovar Typhi Ty2
aucaacaggcgauucggacucau

SEQ ID NO: 1757792 - RNA, 23 nt, Salmonella enterica enterica serovar Typhi Ty2
aucaacagcggagagacauuggu

SEQ ID NO: 1757793 - RNA, 17 nt, Salmonella enterica enterica serovar Typhi Ty2
aucaaauaccuuuucau

SEQ ID NO: 1757794 - RNA, 21 nt, Salmonella enterica enterica serovar Typhi Ty2
aucaaauacgcuauuuaaaaa

SEQ ID NO: 1757795 - RNA, 16 nt, Salmonella enterica enterica serovar Typhi Ty2
aucaaaugagaauaga

SEQ ID NO: 1757796 - RNA, 22 nt, Salmonella enterica enterica serovar Typhi Ty2
aucaaaggcgucgccgaauaaa

SEQ ID NO: 1757797 - RNA, 18 nt, Salmonella enterica enterica serovar Typhi Ty2
auauuuauuuaauguuuc

SEQ ID NO: 1757798 - RNA, 18 nt, Salmonella enterica enterica serovar Typhi Ty2
auauuuauuugcauugua

SEQ ID NO: 1757799 - RNA, 23 nt, Salmonella enterica enterica serovar Typhi Ty2
aucaaaacuacgccaaugaacuc

SEQ ID NO: 1757800 - RNA, 16 nt, Salmonella enterica enterica serovar Typhi Ty2
aucaaaaucaucgcca

SEQ ID NO: 1757801 - RNA, 18 nt, Salmonella enterica enterica serovar Typhi Ty2
auacaucaugcuugcuuu

SEQ ID NO: 1757802 - RNA, 18 nt, Salmonella enterica enterica serovar Typhi Ty2
auacaucaguccuguuga

SEQ ID NO: 1757803 - RNA, 13 nt, Salmonella enterica enterica serovar Typhi Ty2
auacaugcuacag

SEQ ID NO: 1757804 - RNA, 21 nt, Salmonella enterica enterica serovar Typhi Ty2
auacaugccugcgccauguuc

SEQ ID NO: 1757805 - RNA, 21 nt, Salmonella enterica enterica serovar Typhi Ty2
auacaugaggauuuugagcac

SEQ ID NO: 1757806 - RNA, 14 nt, Salmonella enterica enterica serovar Typhi Ty2
auacauucucugcc

SEQ ID NO: 1757807 - RNA, 13 nt, Salmonella enterica enterica serovar Typhi Ty2
auacauucuguuu

SEQ ID NO: 1757808 - RNA, 18 nt, Salmonella enterica enterica serovar Typhi Ty2
auacauuugaauaauucu

SEQ ID NO: 1757809 - RNA, 14 nt, Salmonella enterica enterica serovar Typhi Ty2
auacagccagguug

SEQ ID NO: 1757810 - RNA, 12 nt, Salmonella enterica enterica serovar Typhi Ty2
auacagcagcac

SEQ ID NO: 1757811 - RNA, 19 nt, Salmonella enterica enterica serovar Typhi Ty2
auacagaugcugucuuagu

SEQ ID NO: 1757812 - RNA, 16 nt, Salmonella enterica enterica serovar Typhi Ty2
auacauaaauccggau

SEQ ID NO: 1757813 - RNA, 21 nt, Salmonella enterica enterica serovar Typhi Ty2
auacauaccacgcagcggcau

SEQ ID NO: 1757814 - RNA, 19 nt, Salmonella enterica enterica serovar Typhi Ty2
auacaguucgacaaugucc

SEQ ID NO: 1757815 - RNA, 13 nt, Salmonella enterica enterica serovar Typhi Ty2
auacaguaccuuu

SEQ ID NO: 1757816 - RNA, 17 nt, Salmonella enterica enterica serovar Typhi Ty2
auacaggguuugucagc

SEQ ID NO: 1757817 - RNA, 19 nt, Salmonella enterica enterica serovar Typhi Ty2
auaauuuuauuauauuuaa

SEQ ID NO: 1757818 - RNA, 14 nt, Salmonella enterica enterica serovar Typhi Ty2
auacaaaacccaua

SEQ ID NO: 1757819 - RNA, 13 nt, Salmonella enterica enterica serovar Typhi Ty2
auacaaauauccc

SEQ ID NO: 1757820 - RNA, 21 nt, Salmonella enterica enterica serovar Typhi Ty2
auacaccaaacgaauuuaaau

SEQ ID NO: 1757821 - RNA, 18 nt, Salmonella enterica enterica serovar Typhi Ty2
auacaccgccauauauuu

SEQ ID NO: 1757822 - RNA, 20 nt, Salmonella enterica enterica serovar Typhi Ty2
auacaccucggguaaagguu

SEQ ID NO: 1757823 - RNA, 14 nt, Salmonella enterica enterica serovar Typhi Ty2
auacacgaacacag

SEQ ID NO: 1757824 - RNA, 15 nt, Salmonella enterica enterica serovar Typhi Ty2
auacacguaauacau

SEQ ID NO: 1757825 - RNA, 19 nt, Salmonella enterica enterica serovar Typhi Ty2
auacacgccuuccuccagc

SEQ ID NO: 1757826 - RNA, 21 nt, Salmonella enterica enterica serovar Typhi Ty2
auacacgccuuccuccagcau

SEQ ID NO: 1757827 - RNA, 20 nt, Salmonella enterica enterica serovar Typhi Ty2
auaaugacgcuauucaugcc

SEQ ID NO: 1757828 - RNA, 21 nt, Salmonella enterica enterica serovar Typhi Ty2
auaauggggauuaucaggaug

SEQ ID NO: 1757829 - RNA, 21 nt, Salmonella enterica enterica serovar Typhi Ty2
auaaugcaaucaguuccaauc

SEQ ID NO: 1757830 - RNA, 16 nt, Salmonella enterica enterica serovar Typhi Ty2
auaaugcaaugccuaa

SEQ ID NO: 1757831 - RNA, 20 nt, Salmonella enterica enterica serovar Typhi Ty2
auaauccuuccuuucauuuu

SEQ ID NO: 1757832 - RNA, 18 nt, Salmonella enterica enterica serovar Typhi Ty2
auaauccuuguccaugua

SEQ ID NO: 1757833 - RNA, 12 nt, Salmonella enterica enterica serovar Typhi Ty2
auaauccuuccu

SEQ ID NO: 1757834 - RNA, 12 nt, Salmonella enterica enterica serovar Typhi Ty2
auaauccuuccc

SEQ ID NO: 1757835 - RNA, 18 nt, Salmonella enterica enterica serovar Typhi Ty2
auaaucgacaguggcuuu

SEQ ID NO: 1757836 - RNA, 20 nt, Salmonella enterica enterica serovar Typhi Ty2
auaaucugugauugaauuca

SEQ ID NO: 1757837 - RNA, 20 nt, Salmonella enterica enterica serovar Typhi Ty2
auaauccgccuuuuccccca

SEQ ID NO: 1757838 - RNA, 18 nt, Salmonella enterica enterica serovar Typhi Ty2
auaacggcgcaaagacag

SEQ ID NO: 1757839 - RNA, 21 nt, Salmonella enterica enterica serovar Typhi Ty2
auaacggguuugauugccauc

SEQ ID NO: 1757840 - RNA, 19 nt, Salmonella enterica enterica serovar Typhi Ty2
auaacgcgagaagaagaau

SEQ ID NO: 1757841 - RNA, 17 nt, Salmonella enterica enterica serovar Typhi Ty2
auaacgcccugcgcgcc

SEQ ID NO: 1757842 - RNA, 22 nt, Salmonella enterica enterica serovar Typhi Ty2
auaacgccgaugccgccgacaa

SEQ ID NO: 1757843 - RNA, 19 nt, Salmonella enterica enterica serovar Typhi Ty2
auaacgccgcccccaugcc

SEQ ID NO: 1757844 - RNA, 20 nt, Salmonella enterica enterica serovar Typhi Ty2
auaacgaccaaacaagaucg

SEQ ID NO: 1757845 - RNA, 19 nt, Salmonella enterica enterica serovar Typhi Ty2
auaacgcggcuaaucaggg

SEQ ID NO: 1757846 - RNA, 20 nt, Salmonella enterica enterica serovar Typhi Ty2
auaacgcggcccgggagaac

SEQ ID NO: 1757847 - RNA, 11 nt, Salmonella enterica enterica serovar Typhi Ty2
auaauugcucu

SEQ ID NO: 1757848 - RNA, 12 nt, Salmonella enterica enterica serovar Typhi Ty2
auaauugcugcc

SEQ ID NO: 1757849 - RNA, 15 nt, Salmonella enterica enterica serovar Typhi Ty2
auaauugauaauaac

SEQ ID NO: 1757850 - RNA, 22 nt, Salmonella enterica enterica serovar Typhi Ty2
auaauucgaguugcuuaaaagc

SEQ ID NO: 1757851 - RNA, 19 nt, Salmonella enterica enterica serovar Typhi Ty2
auaauguaaaaaaauaaaa

SEQ ID NO: 1757852 - RNA, 15 nt, Salmonella enterica enterica serovar Typhi Ty2
auaaugucauuacua

SEQ ID NO: 1757853 - RNA, 19 nt, Salmonella enterica enterica serovar Typhi Ty2
auaaugguggaaugcccca

SEQ ID NO: 1757854 - RNA, 22 nt, Salmonella enterica enterica serovar Typhi Ty2
auaauuaugccugucaucauca

SEQ ID NO: 1757855 - RNA, 15 nt, Salmonella enterica enterica serovar Typhi Ty2
auaccaaaaauaauu

SEQ ID NO: 1757856 - RNA, 19 nt, Salmonella enterica enterica serovar Typhi Ty2
auacauuuuuguaauaaaa

SEQ ID NO: 1757857 - RNA, 21 nt, Salmonella enterica enterica serovar Typhi Ty2
auaccagcggcaaacagcgac

SEQ ID NO: 1757858 - RNA, 19 nt, Salmonella enterica enterica serovar Typhi Ty2
auaccaccacuucacuauc

SEQ ID NO: 1757859 - RNA, 18 nt, Salmonella enterica enterica serovar Typhi Ty2
auacccaccucguucaaa

SEQ ID NO: 1757860 - RNA, 16 nt, Salmonella enterica enterica serovar Typhi Ty2
auaccccuguucaaaa

SEQ ID NO: 1757861 - RNA, 19 nt, Salmonella enterica enterica serovar Typhi Ty2
auaccccgcacaaacgcuu

SEQ ID NO: 1757862 - RNA, 22 nt, Salmonella enterica enterica serovar Typhi Ty2
auacccugcggcgaaacagagu

SEQ ID NO: 1757863 - RNA, 17 nt, Salmonella enterica enterica serovar Typhi Ty2
auacccgacucuuuuuu

SEQ ID NO: 1757864 - RNA, 20 nt, Salmonella enterica enterica serovar Typhi Ty2
auaccagucgacaguauaga

SEQ ID NO: 1757865 - RNA, 17 nt, Salmonella enterica enterica serovar Typhi Ty2
auaccaggcacuugaga

SEQ ID NO: 1757866 - RNA, 17 nt, Salmonella enterica enterica serovar Typhi Ty2
auaccaucggcugguua

SEQ ID NO: 1757867 - RNA, 16 nt, Salmonella enterica enterica serovar Typhi Ty2
auaccuauaaaaauga

SEQ ID NO: 1757868 - RNA, 19 nt, Salmonella enterica enterica serovar Typhi Ty2
auaccuacuuuauuuuucg

SEQ ID NO: 1757869 - RNA, 13 nt, Salmonella enterica enterica serovar Typhi Ty2
auaccuauuuaau

SEQ ID NO: 1757870 - RNA, 16 nt, Salmonella enterica enterica serovar Typhi Ty2
auaccuaacucuuccg

SEQ ID NO: 1757871 - RNA, 14 nt, Salmonella enterica enterica serovar Typhi Ty2
auaccuaauagcga

SEQ ID NO: 1757872 - RNA, 12 nt, Salmonella enterica enterica serovar Typhi Ty2
auaccuuuucau

SEQ ID NO: 1757873 - RNA, 13 nt, Salmonella enterica enterica serovar Typhi Ty2
auacgaaugggua

SEQ ID NO: 1757874 - RNA, 20 nt, Salmonella enterica enterica serovar Typhi Ty2
auaccguccagacuccuuuu

SEQ ID NO: 1757875 - RNA, 19 nt, Salmonella enterica enterica serovar Typhi Ty2
auaccgugagcuacagcgu

SEQ ID NO: 1757876 - RNA, 15 nt, Salmonella enterica enterica serovar Typhi Ty2
auaccgccagcccca

SEQ ID NO: 1757877 - RNA, 17 nt, Salmonella enterica enterica serovar Typhi Ty2
auacuaaaacuuuaaca

SEQ ID NO: 1757878 - RNA, 16 nt, Salmonella enterica enterica serovar Typhi Ty2
auacgcgucaaauaga

SEQ ID NO: 1757879 - RNA, 13 nt, Salmonella enterica enterica serovar Typhi Ty2
auacgcgauaaaa

SEQ ID NO: 1757880 - RNA, 17 nt, Salmonella enterica enterica serovar Typhi Ty2
auacgcugcaccauuuu

SEQ ID NO: 1757881 - RNA, 13 nt, Salmonella enterica enterica serovar Typhi Ty2
auacgcuccagcu

SEQ ID NO: 1757882 - RNA, 13 nt, Salmonella enterica enterica serovar Typhi Ty2
auacgcuuucuga

SEQ ID NO: 1757883 - RNA, 17 nt, Salmonella enterica enterica serovar Typhi Ty2
auagcaacguccgcagc

SEQ ID NO: 1757884 - RNA, 17 nt, Salmonella enterica enterica serovar Typhi Ty2
auagcaacuuaauaaua

SEQ ID NO: 1757885 - RNA, 13 nt, Salmonella enterica enterica serovar Typhi Ty2
auagcaucaccag

SEQ ID NO: 1757886 - RNA, 18 nt, Salmonella enterica enterica serovar Typhi Ty2
auagcaacguccgcagcc

SEQ ID NO: 1757887 - RNA, 16 nt, Salmonella enterica enterica serovar Typhi Ty2
auagccaacacauaag

SEQ ID NO: 1757888 - RNA, 15 nt, Salmonella enterica enterica serovar Typhi Ty2
auagauaugaaagaa

SEQ ID NO: 1757889 - RNA, 23 nt, Salmonella enterica enterica serovar Typhi Ty2
auagaucagacgaccauccacca

SEQ ID NO: 1757890 - RNA, 23 nt, Salmonella enterica enterica serovar Typhi Ty2
auagacuccgucaaagaaaacuu

SEQ ID NO: 1757891 - RNA, 15 nt, Salmonella enterica enterica serovar Typhi Ty2
auagacauccagcau

SEQ ID NO: 1757892 - RNA, 21 nt, Salmonella enterica enterica serovar Typhi Ty2
auagacagcggcuaauuuauu

SEQ ID NO: 1757893 - RNA, 19 nt, Salmonella enterica enterica serovar Typhi Ty2
auagaccaggcgacuauuc

SEQ ID NO: 1757894 - RNA, 22 nt, Salmonella enterica enterica serovar Typhi Ty2
auagacgacaucuuuuccugaa

SEQ ID NO: 1757895 - RNA, 18 nt, Salmonella enterica enterica serovar Typhi Ty2
auagacgccggucaugcc

SEQ ID NO: 1757896 - RNA, 15 nt, Salmonella enterica enterica serovar Typhi Ty2
auagacggccugcaa

SEQ ID NO: 1757897 - RNA, 18 nt, Salmonella enterica enterica serovar Typhi Ty2
auagacgacaucuuuucc

SEQ ID NO: 1757898 - RNA, 13 nt, Salmonella enterica enterica serovar Typhi Ty2
auagacgauauag

SEQ ID NO: 1757899 - RNA, 18 nt, Salmonella enterica enterica serovar Typhi Ty2
auagacgcccugcaaagc

SEQ ID NO: 1757900 - RNA, 15 nt, Salmonella enterica enterica serovar Typhi Ty2
auacuguuuuugcuu

SEQ ID NO: 1757901 - RNA, 22 nt, Salmonella enterica enterica serovar Typhi Ty2
auacuguuuuugcuuuaauauu

SEQ ID NO: 1757902 - RNA, 23 nt, Salmonella enterica enterica serovar Typhi Ty2
auacuacugguggaauaaauaua

SEQ ID NO: 1757903 - RNA, 21 nt, Salmonella enterica enterica serovar Typhi Ty2
auagaauaggaaauaauuaau

SEQ ID NO: 1757904 - RNA, 14 nt, Salmonella enterica enterica serovar Typhi Ty2
auagaaauagccuu

SEQ ID NO: 1757905 - RNA, 17 nt, Salmonella enterica enterica serovar Typhi Ty2
auagaaagucuuuuguu

SEQ ID NO: 1757906 - RNA, 23 nt, Salmonella enterica enterica serovar Typhi Ty2
auagaacgguuuugcgcugguac

SEQ ID NO: 1757907 - RNA, 16 nt, Salmonella enterica enterica serovar Typhi Ty2
aguuugcgcgauuuau

SEQ ID NO: 1757908 - RNA, 16 nt, Salmonella enterica enterica serovar Typhi Ty2
aguuucaugccauacu

SEQ ID NO: 1757909 - RNA, 23 nt, Salmonella enterica enterica serovar Typhi Ty2
aguuugccccauuguucuuucau

SEQ ID NO: 1757910 - RNA, 14 nt, Salmonella enterica enterica serovar Typhi Ty2
aguuucaugccaua

SEQ ID NO: 1757911 - RNA, 15 nt, Salmonella enterica enterica serovar Typhi Ty2
aguuucagugguggc

SEQ ID NO: 1757912 - RNA, 14 nt, Salmonella enterica enterica serovar Typhi Ty2
aguuucaguaucau

SEQ ID NO: 1757913 - RNA, 17 nt, Salmonella enterica enterica serovar Typhi Ty2
aguuucaucagcacaaa

SEQ ID NO: 1757914 - RNA, 14 nt, Salmonella enterica enterica serovar Typhi Ty2
aguuuuucaaucuu

SEQ ID NO: 1757915 - RNA, 21 nt, Salmonella enterica enterica serovar Typhi Ty2
auaaaaaagccguauuuuauu

SEQ ID NO: 1757916 - RNA, 13 nt, Salmonella enterica enterica serovar Typhi Ty2
auaaaaacgggua

SEQ ID NO: 1757917 - RNA, 22 nt, Salmonella enterica enterica serovar Typhi Ty2
auaaaaacgcgcucgccagcgc

SEQ ID NO: 1757918 - RNA, 17 nt, Salmonella enterica enterica serovar Typhi Ty2
auaaaaacaauaaauaa

SEQ ID NO: 1757919 - RNA, 18 nt, Salmonella enterica enterica serovar Typhi Ty2
auaaaaaagccguauuuu

SEQ ID NO: 1757920 - RNA, 21 nt, Salmonella enterica enterica serovar Typhi Ty2
aguugcauauaaggcccauac

SEQ ID NO: 1757921 - RNA, 21 nt, Salmonella enterica enterica serovar Typhi Ty2
aguugacgccccauguggcca

SEQ ID NO: 1757922 - RNA, 15 nt, Salmonella enterica enterica serovar Typhi Ty2
aguuuauugagauaa

SEQ ID NO: 1757923 - RNA, 16 nt, Salmonella enterica enterica serovar Typhi Ty2
aguuuauugagauaau

SEQ ID NO: 1757924 - RNA, 13 nt, Salmonella enterica enterica serovar Typhi Ty2
aguugguucccag

SEQ ID NO: 1757925 - RNA, 15 nt, Salmonella enterica enterica serovar Typhi Ty2
aguuggugggugaug

SEQ ID NO: 1757926 - RNA, 19 nt, Salmonella enterica enterica serovar Typhi Ty2
aguuaagcaacugauuaau

SEQ ID NO: 1757927 - RNA, 21 nt, Salmonella enterica enterica serovar Typhi Ty2
aguuaaucagcgccgucgcca

SEQ ID NO: 1757928 - RNA, 23 nt, Salmonella enterica enterica serovar Typhi Ty2
aguuaaugccaucaucaguaaca

SEQ ID NO: 1757929 - RNA, 20 nt, Salmonella enterica enterica serovar Typhi Ty2
aguggccaucuuccagcauc

SEQ ID NO: 1757930 - RNA, 21 nt, Salmonella enterica enterica serovar Typhi Ty2
aguggcgaaacuccuccggga

SEQ ID NO: 1757931 - RNA, 20 nt, Salmonella enterica enterica serovar Typhi Ty2
aguggcgcaauaacugacuc

SEQ ID NO: 1757932 - RNA, 22 nt, Salmonella enterica enterica serovar Typhi Ty2
aguuaaauaaacaaaaaccugc

SEQ ID NO: 1757933 - RNA, 15 nt, Salmonella enterica enterica serovar Typhi Ty2
aguuaaauaaacaaa

SEQ ID NO: 1757934 - RNA, 14 nt, Salmonella enterica enterica serovar Typhi Ty2
aguggcggcaaaaa

SEQ ID NO: 1757935 - RNA, 15 nt, Salmonella enterica enterica serovar Typhi Ty2
aguggcggcaaaaaa

SEQ ID NO: 1757936 - RNA, 15 nt, Salmonella enterica enterica serovar Typhi Ty2
aguggcuaauuucaa

SEQ ID NO: 1757937 - RNA, 20 nt, Salmonella enterica enterica serovar Typhi Ty2
aguggcuaauuucaauuuug

SEQ ID NO: 1757938 - RNA, 15 nt, Salmonella enterica enterica serovar Typhi Ty2
aguucagcagcacca

SEQ ID NO: 1757939 - RNA, 21 nt, Salmonella enterica enterica serovar Typhi Ty2
aguucaccaguuuuucgccaa

SEQ ID NO: 1757940 - RNA, 20 nt, Salmonella enterica enterica serovar Typhi Ty2
aguucacuccuaagagaaaa

SEQ ID NO: 1757941 - RNA, 19 nt, Salmonella enterica enterica serovar Typhi Ty2
aguuauguuauccccacuu

SEQ ID NO: 1757942 - RNA, 21 nt, Salmonella enterica enterica serovar Typhi Ty2
aguuaccauccauuaaaaucu

SEQ ID NO: 1757943 - RNA, 17 nt, Salmonella enterica enterica serovar Typhi Ty2
aguucucgcgccaccug

SEQ ID NO: 1757944 - RNA, 14 nt, Salmonella enterica enterica serovar Typhi Ty2
aguucuugcaggca

SEQ ID NO: 1757945 - RNA, 15 nt, Salmonella enterica enterica serovar Typhi Ty2
aguucgcugaggcgu

SEQ ID NO: 1757946 - RNA, 15 nt, Salmonella enterica enterica serovar Typhi Ty2
aguucuaacaggaag

SEQ ID NO: 1757947 - RNA, 13 nt, Salmonella enterica enterica serovar Typhi Ty2
aguucucaaugaa

SEQ ID NO: 1757948 - RNA, 13 nt, Salmonella enterica enterica serovar Typhi Ty2
aguuccgccagac

SEQ ID NO: 1757949 - RNA, 19 nt, Salmonella enterica enterica serovar Typhi Ty2
aguuccgccagacucagcc

SEQ ID NO: 1757950 - RNA, 23 nt, Salmonella enterica enterica serovar Typhi Ty2
aguucccuucuccucaacagaca

SEQ ID NO: 1757951 - RNA, 17 nt, Salmonella enterica enterica serovar Typhi Ty2
aguucccagcgguggau

SEQ ID NO: 1757952 - RNA, 16 nt, Salmonella enterica enterica serovar Typhi Ty2
aguucgccgccaggaa

SEQ ID NO: 1757953 - RNA, 13 nt, Salmonella enterica enterica serovar Typhi Ty2
aguucgccgccgg

SEQ ID NO: 1757954 - RNA, 23 nt, Salmonella enterica enterica serovar Typhi Ty2
aguucaguaugaucaugcccggc

SEQ ID NO: 1757955 - RNA, 17 nt, Salmonella enterica enterica serovar Typhi Ty2
aguucaggcacgugcau

SEQ ID NO: 1757956 - RNA, 11 nt, Salmonella enterica enterica serovar Typhi Ty2
aguucccagcg

SEQ ID NO: 1757957 - RNA, 18 nt, Salmonella enterica enterica serovar Typhi Ty2
auaaaaauagcuggcugu

SEQ ID NO: 1757958 - RNA, 17 nt, Salmonella enterica enterica serovar Typhi Ty2
auaaaaauagcuggcug

SEQ ID NO: 1757959 - RNA, 22 nt, Salmonella enterica enterica serovar Typhi Ty2
auaaaaacugcuaaaagaagcu

SEQ ID NO: 1757960 - RNA, 20 nt, Salmonella enterica enterica serovar Typhi Ty2
auaaaacauuccugacauuu

SEQ ID NO: 1757961 - RNA, 14 nt, Salmonella enterica enterica serovar Typhi Ty2
auaaaaccggcaua

SEQ ID NO: 1757962 - RNA, 16 nt, Salmonella enterica enterica serovar Typhi Ty2
auaaaacgcucucuuu

SEQ ID NO: 1757963 - RNA, 14 nt, Salmonella enterica enterica serovar Typhi Ty2
auaaaauaaacacu

SEQ ID NO: 1757964 - RNA, 12 nt, Salmonella enterica enterica serovar Typhi Ty2
auaaaauaacua

SEQ ID NO: 1757965 - RNA, 21 nt, Salmonella enterica enterica serovar Typhi Ty2
auaaaagggaucuacggaucc

SEQ ID NO: 1757966 - RNA, 18 nt, Salmonella enterica enterica serovar Typhi Ty2
auaaaacugccgucaauu

SEQ ID NO: 1757967 - RNA, 21 nt, Salmonella enterica enterica serovar Typhi Ty2
auaaaagccgccguguuuuuu

SEQ ID NO: 1757968 - RNA, 13 nt, Salmonella enterica enterica serovar Typhi Ty2
auaaaauuauaaa

SEQ ID NO: 1757969 - RNA, 17 nt, Salmonella enterica enterica serovar Typhi Ty2
auaaaauuauuggcuuu

SEQ ID NO: 1757970 - RNA, 13 nt, Salmonella enterica enterica serovar Typhi Ty2
auaaaauggaugc

SEQ ID NO: 1757971 - RNA, 14 nt, Salmonella enterica enterica serovar Typhi Ty2
auaaaaugucuguu

SEQ ID NO: 1757972 - RNA, 22 nt, Salmonella enterica enterica serovar Typhi Ty2
auaaaaguugcucggcaauuuc

SEQ ID NO: 1757973 - RNA, 23 nt, Salmonella enterica enterica serovar Typhi Ty2
auaaaaucaucgcgcugauauuu

SEQ ID NO: 1757974 - RNA, 14 nt, Salmonella enterica enterica serovar Typhi Ty2
auaaaauccucuac

SEQ ID NO: 1757975 - RNA, 22 nt, Salmonella enterica enterica serovar Typhi Ty2
auaaacgggcccggcuuucugu

SEQ ID NO: 1757976 - RNA, 18 nt, Salmonella enterica enterica serovar Typhi Ty2
auaaacgcgccaaguaaa

SEQ ID NO: 1757977 - RNA, 19 nt, Salmonella enterica enterica serovar Typhi Ty2
auaaacgcgccaaguaaau

SEQ ID NO: 1757978 - RNA, 18 nt, Salmonella enterica enterica serovar Typhi Ty2
auaaacggcgcguccagc

SEQ ID NO: 1757979 - RNA, 16 nt, Salmonella enterica enterica serovar Typhi Ty2
auaaacgccucauccg

SEQ ID NO: 1757980 - RNA, 15 nt, Salmonella enterica enterica serovar Typhi Ty2
auaaacgccugacga

SEQ ID NO: 1757981 - RNA, 22 nt, Salmonella enterica enterica serovar Typhi Ty2
auaaacagcucggcaaagccca

SEQ ID NO: 1757982 - RNA, 15 nt, Salmonella enterica enterica serovar Typhi Ty2
auaaacauaaagaca

SEQ ID NO: 1757983 - RNA, 16 nt, Salmonella enterica enterica serovar Typhi Ty2
auaaacagguaaaaca

SEQ ID NO: 1757984 - RNA, 13 nt, Salmonella enterica enterica serovar Typhi Ty2
auaaagaaauauu

SEQ ID NO: 1757985 - RNA, 19 nt, Salmonella enterica enterica serovar Typhi Ty2
auaaagaacggccucccaa

SEQ ID NO: 1757986 - RNA, 18 nt, Salmonella enterica enterica serovar Typhi Ty2
auaaagaaagcauuaaau

SEQ ID NO: 1757987 - RNA, 21 nt, Salmonella enterica enterica serovar Typhi Ty2
auaaagaaaguagaucaccag

SEQ ID NO: 1757988 - RNA, 13 nt, Salmonella enterica enterica serovar Typhi Ty2
auaaaguuuauuu

SEQ ID NO: 1757989 - RNA, 17 nt, Salmonella enterica enterica serovar Typhi Ty2
auaaauaccguaaugcc

SEQ ID NO: 1757990 - RNA, 14 nt, Salmonella enterica enterica serovar Typhi Ty2
auaaauaguaaaua

SEQ ID NO: 1757991 - RNA, 15 nt, Salmonella enterica enterica serovar Typhi Ty2
auaaauauaagaucu

SEQ ID NO: 1757992 - RNA, 12 nt, Salmonella enterica enterica serovar Typhi Ty2
auaaaucauuac

SEQ ID NO: 1757993 - RNA, 13 nt, Salmonella enterica enterica serovar Typhi Ty2
auaaaucagcaca

SEQ ID NO: 1757994 - RNA, 17 nt, Salmonella enterica enterica serovar Typhi Ty2
auaaaucaaaagugcac

SEQ ID NO: 1757995 - RNA, 14 nt, Salmonella enterica enterica serovar Typhi Ty2
auaaccagaaaacc

SEQ ID NO: 1757996 - RNA, 16 nt, Salmonella enterica enterica serovar Typhi Ty2
auaaccagaaaaccga

SEQ ID NO: 1757997 - RNA, 16 nt, Salmonella enterica enterica serovar Typhi Ty2
auaaccagauggggcu

SEQ ID NO: 1757998 - RNA, 12 nt, Salmonella enterica enterica serovar Typhi Ty2
auaacaucaucc

SEQ ID NO: 1757999 - RNA, 15 nt, Salmonella enterica enterica serovar Typhi Ty2
auaaccaugcucagc

SEQ ID NO: 1758000 - RNA, 15 nt, Salmonella enterica enterica serovar Typhi Ty2
auaacgaugauuauu

SEQ ID NO: 1758001 - RNA, 15 nt, Salmonella enterica enterica serovar Typhi Ty2
auaacgaaaaggguc

SEQ ID NO: 1758002 - RNA, 21 nt, Salmonella enterica enterica serovar Typhi Ty2
auaaauucuuuacgcagcaag

SEQ ID NO: 1758003 - RNA, 21 nt, Salmonella enterica enterica serovar Typhi Ty2
auaaauucugucucaauaaaa

SEQ ID NO: 1758004 - RNA, 19 nt, Salmonella enterica enterica serovar Typhi Ty2
auaaauucugucucaauaa

SEQ ID NO: 1758005 - RNA, 20 nt, Salmonella enterica enterica serovar Typhi Ty2
auaaauuucauccaugccaa

SEQ ID NO: 1758006 - RNA, 14 nt, Salmonella enterica enterica serovar Typhi Ty2
auaaauuucagugg

SEQ ID NO: 1758007 - RNA, 13 nt, Salmonella enterica enterica serovar Typhi Ty2
auaacagcgcugg

SEQ ID NO: 1758008 - RNA, 17 nt, Salmonella enterica enterica serovar Typhi Ty2
auaacagccagcgggcg

SEQ ID NO: 1758009 - RNA, 18 nt, Salmonella enterica enterica serovar Typhi Ty2
auaacaauauuaaauaaa

SEQ ID NO: 1758010 - RNA, 14 nt, Salmonella enterica enterica serovar Typhi Ty2
auaacaggaaucau

SEQ ID NO: 1758011 - RNA, 20 nt, Salmonella enterica enterica serovar Typhi Ty2
agucuccgccaccugaauaa

SEQ ID NO: 1758012 - RNA, 12 nt, Salmonella enterica enterica serovar Typhi Ty2
agucuauuuccu

SEQ ID NO: 1758013 - RNA, 15 nt, Salmonella enterica enterica serovar Typhi Ty2
agucucaggagugaa

SEQ ID NO: 1758014 - RNA, 16 nt, Salmonella enterica enterica serovar Typhi Ty2
agucguagaacaccac

SEQ ID NO: 1758015 - RNA, 20 nt, Salmonella enterica enterica serovar Typhi Ty2
agucgucauggcguaaaucg

SEQ ID NO: 1758016 - RNA, 15 nt, Salmonella enterica enterica serovar Typhi Ty2
agugaaagaccugcc

SEQ ID NO: 1758017 - RNA, 22 nt, Salmonella enterica enterica serovar Typhi Ty2
agugaaaguugguguuucucaa

SEQ ID NO: 1758018 - RNA, 12 nt, Salmonella enterica enterica serovar Typhi Ty2
agugaaauaaau

SEQ ID NO: 1758019 - RNA, 14 nt, Salmonella enterica enterica serovar Typhi Ty2
agugaaaagcugga

SEQ ID NO: 1758020 - RNA, 20 nt, Salmonella enterica enterica serovar Typhi Ty2
agugaaauuugucgauaaaa

SEQ ID NO: 1758021 - RNA, 22 nt, Salmonella enterica enterica serovar Typhi Ty2
agugaaggccaaguuuagaaaa

SEQ ID NO: 1758022 - RNA, 20 nt, Salmonella enterica enterica serovar Typhi Ty2
agugaagcgccggaugagga

SEQ ID NO: 1758023 - RNA, 20 nt, Salmonella enterica enterica serovar Typhi Ty2
agugauaaagcacagcccca

SEQ ID NO: 1758024 - RNA, 17 nt, Salmonella enterica enterica serovar Typhi Ty2
agugauuauaaaucaau

SEQ ID NO: 1758025 - RNA, 15 nt, Salmonella enterica enterica serovar Typhi Ty2
agugcaaaggccucu

SEQ ID NO: 1758026 - RNA, 15 nt, Salmonella enterica enterica serovar Typhi Ty2
agugcccgaaagcaa

SEQ ID NO: 1758027 - RNA, 12 nt, Salmonella enterica enterica serovar Typhi Ty2
agugcagaaagu

SEQ ID NO: 1758028 - RNA, 17 nt, Salmonella enterica enterica serovar Typhi Ty2
agugcugcgcaaauacg

SEQ ID NO: 1758029 - RNA, 16 nt, Salmonella enterica enterica serovar Typhi Ty2
agugcuucugcaaaau

SEQ ID NO: 1758030 - RNA, 23 nt, Salmonella enterica enterica serovar Typhi Ty2
aguggaaaacagcauaauaaagc

SEQ ID NO: 1758031 - RNA, 12 nt, Salmonella enterica enterica serovar Typhi Ty2
agugcgcggcga

SEQ ID NO: 1758032 - RNA, 14 nt, Salmonella enterica enterica serovar Typhi Ty2
agucauggcuuuua

SEQ ID NO: 1758033 - RNA, 18 nt, Salmonella enterica enterica serovar Typhi Ty2
agucaugaaaucuaucug

SEQ ID NO: 1758034 - RNA, 14 nt, Salmonella enterica enterica serovar Typhi Ty2
agucaucaauugcu

SEQ ID NO: 1758035 - RNA, 21 nt, Salmonella enterica enterica serovar Typhi Ty2
agucauauuaucgcgcugaau

SEQ ID NO: 1758036 - RNA, 15 nt, Salmonella enterica enterica serovar Typhi Ty2
agucauaccuguucc

SEQ ID NO: 1758037 - RNA, 16 nt, Salmonella enterica enterica serovar Typhi Ty2
agucauaccuguuccu

SEQ ID NO: 1758038 - RNA, 14 nt, Salmonella enterica enterica serovar Typhi Ty2
agucauaauuaaaa

SEQ ID NO: 1758039 - RNA, 18 nt, Salmonella enterica enterica serovar Typhi Ty2
agucaucugccaguuauc

SEQ ID NO: 1758040 - RNA, 19 nt, Salmonella enterica enterica serovar Typhi Ty2
agucaucgccuucauccgc

SEQ ID NO: 1758041 - RNA, 19 nt, Salmonella enterica enterica serovar Typhi Ty2
agucauccgguucauaauc

SEQ ID NO: 1758042 - RNA, 21 nt, Salmonella enterica enterica serovar Typhi Ty2
aguccauaccguuucaacugc

SEQ ID NO: 1758043 - RNA, 21 nt, Salmonella enterica enterica serovar Typhi Ty2
aguccauauccguacauaaca

SEQ ID NO: 1758044 - RNA, 19 nt, Salmonella enterica enterica serovar Typhi Ty2
aguccacguuuuacuuccu

SEQ ID NO: 1758045 - RNA, 15 nt, Salmonella enterica enterica serovar Typhi Ty2
aguccagccauaauc

SEQ ID NO: 1758046 - RNA, 15 nt, Salmonella enterica enterica serovar Typhi Ty2
aguccuguaucuucg

SEQ ID NO: 1758047 - RNA, 15 nt, Salmonella enterica enterica serovar Typhi Ty2
agucgcagcggcugc

SEQ ID NO: 1758048 - RNA, 17 nt, Salmonella enterica enterica serovar Typhi Ty2
agucgggaaagggcggc

SEQ ID NO: 1758049 - RNA, 16 nt, Salmonella enterica enterica serovar Typhi Ty2
agucgggaucgccaga

SEQ ID NO: 1758050 - RNA, 18 nt, Salmonella enterica enterica serovar Typhi Ty2
agucggaucaugaaaaau

SEQ ID NO: 1758051 - RNA, 22 nt, Salmonella enterica enterica serovar Typhi Ty2
aguccgaagaagcgugucucuu

SEQ ID NO: 1758052 - RNA, 14 nt, Salmonella enterica enterica serovar Typhi Ty2
aguccugcucaugc

SEQ ID NO: 1758053 - RNA, 13 nt, Salmonella enterica enterica serovar Typhi Ty2
aguccuguaucuu

SEQ ID NO: 1758054 - RNA, 22 nt, Salmonella enterica enterica serovar Typhi Ty2
aguccugccauucgacaagcgg

SEQ ID NO: 1758055 - RNA, 21 nt, Salmonella enterica enterica serovar Typhi Ty2
aguccucuaucuuuucaauca

SEQ ID NO: 1758056 - RNA, 15 nt, Salmonella enterica enterica serovar Typhi Ty2
aguccuaacaccugc

SEQ ID NO: 1758057 - RNA, 15 nt, Salmonella enterica enterica serovar Typhi Ty2
aguccgccguugaga

SEQ ID NO: 1758058 - RNA, 14 nt, Salmonella enterica enterica serovar Typhi Ty2
aguccucagcgaau

SEQ ID NO: 1758059 - RNA, 14 nt, Salmonella enterica enterica serovar Typhi Ty2
aguauugcaccagg

SEQ ID NO: 1758060 - RNA, 20 nt, Salmonella enterica enterica serovar Typhi Ty2
aguauuuacaaaaaagauaa

SEQ ID NO: 1758061 - RNA, 19 nt, Salmonella enterica enterica serovar Typhi Ty2
aguauuuaccuacuguggu

SEQ ID NO: 1758062 - RNA, 14 nt, Salmonella enterica enterica serovar Typhi Ty2
aguauuggcaagaa

SEQ ID NO: 1758063 - RNA, 20 nt, Salmonella enterica enterica serovar Typhi Ty2
aguauuucgacuuucuucgg

SEQ ID NO: 1758064 - RNA, 21 nt, Salmonella enterica enterica serovar Typhi Ty2
aguauggccucuucaaauuug

SEQ ID NO: 1758065 - RNA, 16 nt, Salmonella enterica enterica serovar Typhi Ty2
aguauguuaggguaga

SEQ ID NO: 1758066 - RNA, 21 nt, Salmonella enterica enterica serovar Typhi Ty2
aguaucucgccaguaaagaca

SEQ ID NO: 1758067 - RNA, 23 nt, Salmonella enterica enterica serovar Typhi Ty2
aguaugaaggguauauaaaucaa

SEQ ID NO: 1758068 - RNA, 20 nt, Salmonella enterica enterica serovar Typhi Ty2
aguaucgagauaaugcucau

SEQ ID NO: 1758069 - RNA, 19 nt, Salmonella enterica enterica serovar Typhi Ty2
aguaucgcucuauauccug

SEQ ID NO: 1758070 - RNA, 20 nt, Salmonella enterica enterica serovar Typhi Ty2
aguaucgcucuauauccugc

SEQ ID NO: 1758071 - RNA, 17 nt, Salmonella enterica enterica serovar Typhi Ty2
aguaucgcucuauaucc

SEQ ID NO: 1758072 - RNA, 17 nt, Salmonella enterica enterica serovar Typhi Ty2
agucacagauccagaca

SEQ ID NO: 1758073 - RNA, 22 nt, Salmonella enterica enterica serovar Typhi Ty2
agucaaaauaaaauuauauucu

SEQ ID NO: 1758074 - RNA, 17 nt, Salmonella enterica enterica serovar Typhi Ty2
agucaaauuccagcaau

SEQ ID NO: 1758075 - RNA, 22 nt, Salmonella enterica enterica serovar Typhi Ty2
agucagggcgcggcgcaacuuu

SEQ ID NO: 1758076 - RNA, 13 nt, Salmonella enterica enterica serovar Typhi Ty2
agucagcguuacu

SEQ ID NO: 1758077 - RNA, 14 nt, Salmonella enterica enterica serovar Typhi Ty2
agucagcaauuaac

SEQ ID NO: 1758078 - RNA, 15 nt, Salmonella enterica enterica serovar Typhi Ty2
agucagcaacaugga

SEQ ID NO: 1758079 - RNA, 15 nt, Salmonella enterica enterica serovar Typhi Ty2
agucagaggaauucu

SEQ ID NO: 1758080 - RNA, 19 nt, Salmonella enterica enterica serovar Typhi Ty2
agucacuuacuuucuugcc

SEQ ID NO: 1758081 - RNA, 15 nt, Salmonella enterica enterica serovar Typhi Ty2
agucagacaccagcc

SEQ ID NO: 1758082 - RNA, 15 nt, Salmonella enterica enterica serovar Typhi Ty2
aguauaagcgccgcu

SEQ ID NO: 1758083 - RNA, 14 nt, Salmonella enterica enterica serovar Typhi Ty2
aguauaaauaccuu

SEQ ID NO: 1758084 - RNA, 12 nt, Salmonella enterica enterica serovar Typhi Ty2
aguaguuggugg

SEQ ID NO: 1758085 - RNA, 18 nt, Salmonella enterica enterica serovar Typhi Ty2
aguaguugaauaaccuca

SEQ ID NO: 1758086 - RNA, 12 nt, Salmonella enterica enterica serovar Typhi Ty2
aguauaaagcug

SEQ ID NO: 1758087 - RNA, 12 nt, Salmonella enterica enterica serovar Typhi Ty2
aguauaaaacuc

SEQ ID NO: 1758088 - RNA, 16 nt, Salmonella enterica enterica serovar Typhi Ty2
aguagguauccagcag

SEQ ID NO: 1758089 - RNA, 22 nt, Salmonella enterica enterica serovar Typhi Ty2
aguaguauccccggcaaccuua

SEQ ID NO: 1758090 - RNA, 14 nt, Salmonella enterica enterica serovar Typhi Ty2
aguagcuaaugauu

SEQ ID NO: 1758091 - RNA, 20 nt, Salmonella enterica enterica serovar Typhi Ty2
aguagcugagcgucaggcgc

SEQ ID NO: 1758092 - RNA, 19 nt, Salmonella enterica enterica serovar Typhi Ty2
aguagcccugacgaacaga

SEQ ID NO: 1758093 - RNA, 16 nt, Salmonella enterica enterica serovar Typhi Ty2
aguagccugccagcaa

SEQ ID NO: 1758094 - RNA, 15 nt, Salmonella enterica enterica serovar Typhi Ty2
aguagcguucuuucc

SEQ ID NO: 1758095 - RNA, 22 nt, Salmonella enterica enterica serovar Typhi Ty2
aguagccaugcauaaugcagcc

SEQ ID NO: 1758096 - RNA, 14 nt, Salmonella enterica enterica serovar Typhi Ty2
aguagcagagaaaa

SEQ ID NO: 1758097 - RNA, 18 nt, Salmonella enterica enterica serovar Typhi Ty2
aguagaugucaucaacau

SEQ ID NO: 1758098 - RNA, 16 nt, Salmonella enterica enterica serovar Typhi Ty2
aguacuucacaaucag

SEQ ID NO: 1758099 - RNA, 15 nt, Salmonella enterica enterica serovar Typhi Ty2
aguacugaccagaca

SEQ ID NO: 1758100 - RNA, 16 nt, Salmonella enterica enterica serovar Typhi Ty2
aguacuggaauaucua

SEQ ID NO: 1758101 - RNA, 21 nt, Salmonella enterica enterica serovar Typhi Ty2
agcuggcaagaccgauagaga

SEQ ID NO: 1758102 - RNA, 19 nt, Salmonella enterica enterica serovar Typhi Ty2
agcuggccggaucggcggu

SEQ ID NO: 1758103 - RNA, 17 nt, Salmonella enterica enterica serovar Typhi Ty2
aguaccugacuuuucca

SEQ ID NO: 1758104 - RNA, 15 nt, Salmonella enterica enterica serovar Typhi Ty2
aguacgccugaaaac

SEQ ID NO: 1758105 - RNA, 21 nt, Salmonella enterica enterica serovar Typhi Ty2
aguacgccugaaaacagaaau

SEQ ID NO: 1758106 - RNA, 15 nt, Salmonella enterica enterica serovar Typhi Ty2
aguacgcaaggaaau

SEQ ID NO: 1758107 - RNA, 22 nt, Salmonella enterica enterica serovar Typhi Ty2
aguacgauagcaauuaauaaac

SEQ ID NO: 1758108 - RNA, 15 nt, Salmonella enterica enterica serovar Typhi Ty2
aguacgggcagaugg

SEQ ID NO: 1758109 - RNA, 14 nt, Salmonella enterica enterica serovar Typhi Ty2
agccggcggaaaaa

SEQ ID NO: 1758110 - RNA, 16 nt, Salmonella enterica enterica serovar Typhi Ty2
agccggcgauagcgcc

SEQ ID NO: 1758111 - RNA, 19 nt, Salmonella enterica enterica serovar Typhi Ty2
agccgggcgggaaccugcu

SEQ ID NO: 1758112 - RNA, 13 nt, Salmonella enterica enterica serovar Typhi Ty2
agccgggcaggaa

SEQ ID NO: 1758113 - RNA, 22 nt, Salmonella enterica enterica serovar Typhi Ty2
agccggguaauaaguugcacuc

SEQ ID NO: 1758114 - RNA, 19 nt, Salmonella enterica enterica serovar Typhi Ty2
agccgguaaucacugccgc

SEQ ID NO: 1758115 - RNA, 16 nt, Salmonella enterica enterica serovar Typhi Ty2
agccguagcagaagac

SEQ ID NO: 1758116 - RNA, 22 nt, Salmonella enterica enterica serovar Typhi Ty2
agccgugccugcuccgccaggg

SEQ ID NO: 1758117 - RNA, 23 nt, Salmonella enterica enterica serovar Typhi Ty2
agccguucaccagccacugcgcc

SEQ ID NO: 1758118 - RNA, 17 nt, Salmonella enterica enterica serovar Typhi Ty2
agccguuaccgccgagc

SEQ ID NO: 1758119 - RNA, 18 nt, Salmonella enterica enterica serovar Typhi Ty2
agccguuacuucccccau

SEQ ID NO: 1758120 - RNA, 15 nt, Salmonella enterica enterica serovar Typhi Ty2
agccguuaccgccga

SEQ ID NO: 1758121 - RNA, 15 nt, Salmonella enterica enterica serovar Typhi Ty2
agccguucuccagcg

SEQ ID NO: 1758122 - RNA, 13 nt, Salmonella enterica enterica serovar Typhi Ty2
agccguucuccag

SEQ ID NO: 1758123 - RNA, 14 nt, Salmonella enterica enterica serovar Typhi Ty2
agccguuucuuguc

SEQ ID NO: 1758124 - RNA, 18 nt, Salmonella enterica enterica serovar Typhi Ty2
agccugaagccagcaauc

SEQ ID NO: 1758125 - RNA, 20 nt, Salmonella enterica enterica serovar Typhi Ty2
agccugcccugcggcaggca

SEQ ID NO: 1758126 - RNA, 22 nt, Salmonella enterica enterica serovar Typhi Ty2
agccugccagcaacccaccugc

SEQ ID NO: 1758127 - RNA, 18 nt, Salmonella enterica enterica serovar Typhi Ty2
agccugauacuuuuacuc

SEQ ID NO: 1758128 - RNA, 21 nt, Salmonella enterica enterica serovar Typhi Ty2
agccugacuacgucagauggg

SEQ ID NO: 1758129 - RNA, 21 nt, Salmonella enterica enterica serovar Typhi Ty2
agccucauuuuugaguuuguc

SEQ ID NO: 1758130 - RNA, 13 nt, Salmonella enterica enterica serovar Typhi Ty2
agccuauuaucag

SEQ ID NO: 1758131 - RNA, 24 nt, Salmonella enterica enterica serovar Typhi Ty2
agccuaucgccauauacgccacgg

SEQ ID NO: 1758132 - RNA, 14 nt, Salmonella enterica enterica serovar Typhi Ty2
agccuaccugccgc

SEQ ID NO: 1758133 - RNA, 22 nt, Salmonella enterica enterica serovar Typhi Ty2
agccuaaugggccagauucuua

SEQ ID NO: 1758134 - RNA, 23 nt, Salmonella enterica enterica serovar Typhi Ty2
agccuaaugggccagauucuuag

SEQ ID NO: 1758135 - RNA, 22 nt, Salmonella enterica enterica serovar Typhi Ty2
agccuaaugacggacgcagacc

SEQ ID NO: 1758136 - RNA, 19 nt, Salmonella enterica enterica serovar Typhi Ty2
agccguuuuggcagcgccc

SEQ ID NO: 1758137 - RNA, 22 nt, Salmonella enterica enterica serovar Typhi Ty2
agccguuuuggcagcgcccgcu

SEQ ID NO: 1758138 - RNA, 23 nt, Salmonella enterica enterica serovar Typhi Ty2
agcgaacaguacggucaggcuca

SEQ ID NO: 1758139 - RNA, 20 nt, Salmonella enterica enterica serovar Typhi Ty2
agcgaagaagucagugcuga

SEQ ID NO: 1758140 - RNA, 19 nt, Salmonella enterica enterica serovar Typhi Ty2
agcgaacguccagcggcca

SEQ ID NO: 1758141 - RNA, 20 nt, Salmonella enterica enterica serovar Typhi Ty2
agcgaauaaucccggcgcca

SEQ ID NO: 1758142 - RNA, 15 nt, Salmonella enterica enterica serovar Typhi Ty2
agcgaaugcgcgcca

SEQ ID NO: 1758143 - RNA, 23 nt, Salmonella enterica enterica serovar Typhi Ty2
agcgaauguauuaacgcuuugcc

SEQ ID NO: 1758144 - RNA, 19 nt, Salmonella enterica enterica serovar Typhi Ty2
agcgaauccagaucgcccu

SEQ ID NO: 1758145 - RNA, 13 nt, Salmonella enterica enterica serovar Typhi Ty2
agcgacaaaugaa

SEQ ID NO: 1758146 - RNA, 15 nt, Salmonella enterica enterica serovar Typhi Ty2
agcgacagcccggcg

SEQ ID NO: 1758147 - RNA, 18 nt, Salmonella enterica enterica serovar Typhi Ty2
agcgacaucgucacaaua

SEQ ID NO: 1758148 - RNA, 19 nt, Salmonella enterica enterica serovar Typhi Ty2
agcgacucauucagcaacu

SEQ ID NO: 1758149 - RNA, 21 nt, Salmonella enterica enterica serovar Typhi Ty2
agcgacguugucuucaucuau

SEQ ID NO: 1758150 - RNA, 14 nt, Salmonella enterica enterica serovar Typhi Ty2
agcgacggcgcugg

SEQ ID NO: 1758151 - RNA, 21 nt, Salmonella enterica enterica serovar Typhi Ty2
agcgacgguccuggccaggcu

SEQ ID NO: 1758152 - RNA, 22 nt, Salmonella enterica enterica serovar Typhi Ty2
agcgacgguuuuauccccuuca

SEQ ID NO: 1758153 - RNA, 23 nt, Salmonella enterica enterica serovar Typhi Ty2
agcgacucuguauuuaauaccug

SEQ ID NO: 1758154 - RNA, 17 nt, Salmonella enterica enterica serovar Typhi Ty2
agcgaccggcgucauca

SEQ ID NO: 1758155 - RNA, 17 nt, Salmonella enterica enterica serovar Typhi Ty2
agcgacgcuggcggccc

SEQ ID NO: 1758156 - RNA, 15 nt, Salmonella enterica enterica serovar Typhi Ty2
agcgacggcgcgccg

SEQ ID NO: 1758157 - RNA, 17 nt, Salmonella enterica enterica serovar Typhi Ty2
agcgagcugguuucaau

SEQ ID NO: 1758158 - RNA, 19 nt, Salmonella enterica enterica serovar Typhi Ty2
agcgagcgccugaugccgc

SEQ ID NO: 1758159 - RNA, 22 nt, Salmonella enterica enterica serovar Typhi Ty2
agcgagcgauagagaguuccuc

SEQ ID NO: 1758160 - RNA, 14 nt, Salmonella enterica enterica serovar Typhi Ty2
agcgagacgcugga

SEQ ID NO: 1758161 - RNA, 15 nt, Salmonella enterica enterica serovar Typhi Ty2
agcgagacuuuugcc

SEQ ID NO: 1758162 - RNA, 14 nt, Salmonella enterica enterica serovar Typhi Ty2
agccuuuccgcaug

SEQ ID NO: 1758163 - RNA, 15 nt, Salmonella enterica enterica serovar Typhi Ty2
agcgaaaugcgaauc

SEQ ID NO: 1758164 - RNA, 23 nt, Salmonella enterica enterica serovar Typhi Ty2
agccuucgccuucacgcauucuu

SEQ ID NO: 1758165 - RNA, 17 nt, Salmonella enterica enterica serovar Typhi Ty2
agccuucgccuucacgc

SEQ ID NO: 1758166 - RNA, 21 nt, Salmonella enterica enterica serovar Typhi Ty2
agccuggauagcaauuucagc

SEQ ID NO: 1758167 - RNA, 23 nt, Salmonella enterica enterica serovar Typhi Ty2
agccuggugcccaaccugcgcag

SEQ ID NO: 1758168 - RNA, 14 nt, Salmonella enterica enterica serovar Typhi Ty2
agccuggugcccaa

SEQ ID NO: 1758169 - RNA, 15 nt, Salmonella enterica enterica serovar Typhi Ty2
agccugugcgccugc

SEQ ID NO: 1758170 - RNA, 18 nt, Salmonella enterica enterica serovar Typhi Ty2
agccugugcgccugcugc

SEQ ID NO: 1758171 - RNA, 17 nt, Salmonella enterica enterica serovar Typhi Ty2
agccugugaucggagaa

SEQ ID NO: 1758172 - RNA, 12 nt, Salmonella enterica enterica serovar Typhi Ty2
agccuuauaaga

SEQ ID NO: 1758173 - RNA, 16 nt, Salmonella enterica enterica serovar Typhi Ty2
agccuuauaagaacca

SEQ ID NO: 1758174 - RNA, 15 nt, Salmonella enterica enterica serovar Typhi Ty2
agccuuagcgggagg

SEQ ID NO: 1758175 - RNA, 22 nt, Salmonella enterica enterica serovar Typhi Ty2
agccuuacaggcgcaucagaaa

SEQ ID NO: 1758176 - RNA, 16 nt, Salmonella enterica enterica serovar Typhi Ty2
agccuguuccagcugc

SEQ ID NO: 1758177 - RNA, 18 nt, Salmonella enterica enterica serovar Typhi Ty2
agccuuccuggucugcca

SEQ ID NO: 1758178 - RNA, 13 nt, Salmonella enterica enterica serovar Typhi Ty2
agccuucaacaaa

SEQ ID NO: 1758179 - RNA, 17 nt, Salmonella enterica enterica serovar Typhi Ty2
agccuuauaagaaccau

SEQ ID NO: 1758180 - RNA, 16 nt, Salmonella enterica enterica serovar Typhi Ty2
agccuucaaguuuuag

SEQ ID NO: 1758181 - RNA, 22 nt, Salmonella enterica enterica serovar Typhi Ty2
agccgauuuuucggcacgcugg

SEQ ID NO: 1758182 - RNA, 18 nt, Salmonella enterica enterica serovar Typhi Ty2
agccgauggaaguacugg

SEQ ID NO: 1758183 - RNA, 15 nt, Salmonella enterica enterica serovar Typhi Ty2
agccgccaccacaaa

SEQ ID NO: 1758184 - RNA, 13 nt, Salmonella enterica enterica serovar Typhi Ty2
agccgcagaacca

SEQ ID NO: 1758185 - RNA, 13 nt, Salmonella enterica enterica serovar Typhi Ty2
agccgaccgccga

SEQ ID NO: 1758186 - RNA, 13 nt, Salmonella enterica enterica serovar Typhi Ty2
agccgacgcucuu

SEQ ID NO: 1758187 - RNA, 16 nt, Salmonella enterica enterica serovar Typhi Ty2
agccgacuaucuucuu

SEQ ID NO: 1758188 - RNA, 20 nt, Salmonella enterica enterica serovar Typhi Ty2
agccgaaguuccccguggcc

SEQ ID NO: 1758189 - RNA, 14 nt, Salmonella enterica enterica serovar Typhi Ty2
agccgaccaccauc

SEQ ID NO: 1758190 - RNA, 19 nt, Salmonella enterica enterica serovar Typhi Ty2
agcccuuaucgccccagcc

SEQ ID NO: 1758191 - RNA, 15 nt, Salmonella enterica enterica serovar Typhi Ty2
agcccuguuauucag

SEQ ID NO: 1758192 - RNA, 13 nt, Salmonella enterica enterica serovar Typhi Ty2
agcccuuugcccu

SEQ ID NO: 1758193 - RNA, 17 nt, Salmonella enterica enterica serovar Typhi Ty2
agccggaaaagcgcugg

SEQ ID NO: 1758194 - RNA, 21 nt, Salmonella enterica enterica serovar Typhi Ty2
agccggaaaagcgcuggcugg

SEQ ID NO: 1758195 - RNA, 15 nt, Salmonella enterica enterica serovar Typhi Ty2
agccggaaaagcgcu

SEQ ID NO: 1758196 - RNA, 16 nt, Salmonella enterica enterica serovar Typhi Ty2
agccgcuuuccgccgc

SEQ ID NO: 1758197 - RNA, 13 nt, Salmonella enterica enterica serovar Typhi Ty2
agccggagguuuu

SEQ ID NO: 1758198 - RNA, 18 nt, Salmonella enterica enterica serovar Typhi Ty2
agccggauaaaauuauuu

SEQ ID NO: 1758199 - RNA, 16 nt, Salmonella enterica enterica serovar Typhi Ty2
agccggauuuuaaauu

SEQ ID NO: 1758200 - RNA, 11 nt, Salmonella enterica enterica serovar Typhi Ty2
agccgcugccu

SEQ ID NO: 1758201 - RNA, 20 nt, Salmonella enterica enterica serovar Typhi Ty2
agccgcgcccuaacaggcgc

SEQ ID NO: 1758202 - RNA, 21 nt, Salmonella enterica enterica serovar Typhi Ty2
agccgcgccguaacgcgaugc

SEQ ID NO: 1758203 - RNA, 14 nt, Salmonella enterica enterica serovar Typhi Ty2
agccgcgcgccgcc

SEQ ID NO: 1758204 - RNA, 18 nt, Salmonella enterica enterica serovar Typhi Ty2
agccgcgcucaagcuggg

SEQ ID NO: 1758205 - RNA, 22 nt, Salmonella enterica enterica serovar Typhi Ty2
agccgccaggcaaucagcagcc

SEQ ID NO: 1758206 - RNA, 12 nt, Salmonella enterica enterica serovar Typhi Ty2
agccgccaggca

SEQ ID NO: 1758207 - RNA, 20 nt, Salmonella enterica enterica serovar Typhi Ty2
agccgccaggcaaucagcag

SEQ ID NO: 1758208 - RNA, 12 nt, Salmonella enterica enterica serovar Typhi Ty2
agccgcccaucc

SEQ ID NO: 1758209 - RNA, 23 nt, Salmonella enterica enterica serovar Typhi Ty2
agccgcccgcgauaaaaauccug

SEQ ID NO: 1758210 - RNA, 12 nt, Salmonella enterica enterica serovar Typhi Ty2
agccgcccggcg

SEQ ID NO: 1758211 - RNA, 21 nt, Salmonella enterica enterica serovar Typhi Ty2
agccgcccggcgcgcuggagg

SEQ ID NO: 1758212 - RNA, 18 nt, Salmonella enterica enterica serovar Typhi Ty2
agccgcccaucccuaaua

SEQ ID NO: 1758213 - RNA, 13 nt, Salmonella enterica enterica serovar Typhi Ty2
agccgccauuaau

SEQ ID NO: 1758214 - RNA, 21 nt, Salmonella enterica enterica serovar Typhi Ty2
agccccauaaccgaugcacau

SEQ ID NO: 1758215 - RNA, 18 nt, Salmonella enterica enterica serovar Typhi Ty2
agccccagcgccagcgac

SEQ ID NO: 1758216 - RNA, 13 nt, Salmonella enterica enterica serovar Typhi Ty2
agccccagcacca

SEQ ID NO: 1758217 - RNA, 12 nt, Salmonella enterica enterica serovar Typhi Ty2
agccccacgccc

SEQ ID NO: 1758218 - RNA, 15 nt, Salmonella enterica enterica serovar Typhi Ty2
agcccauaaagcacu

SEQ ID NO: 1758219 - RNA, 14 nt, Salmonella enterica enterica serovar Typhi Ty2
agcccaucagcgcc

SEQ ID NO: 1758220 - RNA, 20 nt, Salmonella enterica enterica serovar Typhi Ty2
agcccaucagcgccagcccu

SEQ ID NO: 1758221 - RNA, 20 nt, Salmonella enterica enterica serovar Typhi Ty2
agcccaguaauauccccauc

SEQ ID NO: 1758222 - RNA, 23 nt, Salmonella enterica enterica serovar Typhi Ty2
agcccaugauggugaacagaauc

SEQ ID NO: 1758223 - RNA, 18 nt, Salmonella enterica enterica serovar Typhi Ty2
agcccagguagaauccca

SEQ ID NO: 1758224 - RNA, 17 nt, Salmonella enterica enterica serovar Typhi Ty2
agcccagcucauaggau

SEQ ID NO: 1758225 - RNA, 12 nt, Salmonella enterica enterica serovar Typhi Ty2
agcccagcgccg

SEQ ID NO: 1758226 - RNA, 14 nt, Salmonella enterica enterica serovar Typhi Ty2
agcccagcgccgca

SEQ ID NO: 1758227 - RNA, 23 nt, Salmonella enterica enterica serovar Typhi Ty2
agcccacuggcaaguaugaaaag

SEQ ID NO: 1758228 - RNA, 23 nt, Salmonella enterica enterica serovar Typhi Ty2
agccauugcugcuauauaacaua

SEQ ID NO: 1758229 - RNA, 14 nt, Salmonella enterica enterica serovar Typhi Ty2
agccauucggcugc

SEQ ID NO: 1758230 - RNA, 14 nt, Salmonella enterica enterica serovar Typhi Ty2
agcccacacaucac

SEQ ID NO: 1758231 - RNA, 19 nt, Salmonella enterica enterica serovar Typhi Ty2
agcccaauaucccuauuag

SEQ ID NO: 1758232 - RNA, 16 nt, Salmonella enterica enterica serovar Typhi Ty2
agcccaauaucccuau

SEQ ID NO: 1758233 - RNA, 15 nt, Salmonella enterica enterica serovar Typhi Ty2
agcccggcuucccau

SEQ ID NO: 1758234 - RNA, 13 nt, Salmonella enterica enterica serovar Typhi Ty2
agcccugacagaa

SEQ ID NO: 1758235 - RNA, 15 nt, Salmonella enterica enterica serovar Typhi Ty2
agccccugacgcugc

SEQ ID NO: 1758236 - RNA, 17 nt, Salmonella enterica enterica serovar Typhi Ty2
agccccggucaacgcgc

SEQ ID NO: 1758237 - RNA, 16 nt, Salmonella enterica enterica serovar Typhi Ty2
agccccugaaauaaca

SEQ ID NO: 1758238 - RNA, 16 nt, Salmonella enterica enterica serovar Typhi Ty2
agcccgcccacaggcu

SEQ ID NO: 1758239 - RNA, 15 nt, Salmonella enterica enterica serovar Typhi Ty2
agcccgcccagcauu

SEQ ID NO: 1758240 - RNA, 16 nt, Salmonella enterica enterica serovar Typhi Ty2
agcccgcccagcauua

SEQ ID NO: 1758241 - RNA, 21 nt, Salmonella enterica enterica serovar Typhi Ty2
agcccgccuccaccuuaucaa

SEQ ID NO: 1758242 - RNA, 20 nt, Salmonella enterica enterica serovar Typhi Ty2
agcccgcuucacgcgcggcu

SEQ ID NO: 1758243 - RNA, 14 nt, Salmonella enterica enterica serovar Typhi Ty2
agcgccacgcccaa

SEQ ID NO: 1758244 - RNA, 23 nt, Salmonella enterica enterica serovar Typhi Ty2
agcgccacgcgaugcaaccccug

SEQ ID NO: 1758245 - RNA, 22 nt, Salmonella enterica enterica serovar Typhi Ty2
agcgccagacagauaacaccag

SEQ ID NO: 1758246 - RNA, 13 nt, Salmonella enterica enterica serovar Typhi Ty2
agcgccagcagca

SEQ ID NO: 1758247 - RNA, 15 nt, Salmonella enterica enterica serovar Typhi Ty2
agcgccagcgacaga

SEQ ID NO: 1758248 - RNA, 13 nt, Salmonella enterica enterica serovar Typhi Ty2
agcgccagcaugg

SEQ ID NO: 1758249 - RNA, 16 nt, Salmonella enterica enterica serovar Typhi Ty2
agcgccagcgguguuu

SEQ ID NO: 1758250 - RNA, 13 nt, Salmonella enterica enterica serovar Typhi Ty2
agcgccagcucca

SEQ ID NO: 1758251 - RNA, 21 nt, Salmonella enterica enterica serovar Typhi Ty2
agcgccaucaggcaugccaaa

SEQ ID NO: 1758252 - RNA, 16 nt, Salmonella enterica enterica serovar Typhi Ty2
agcgccauauugcugu

SEQ ID NO: 1758253 - RNA, 14 nt, Salmonella enterica enterica serovar Typhi Ty2
agcgccaucgggca

SEQ ID NO: 1758254 - RNA, 18 nt, Salmonella enterica enterica serovar Typhi Ty2
agcgccaucgggcauuua

SEQ ID NO: 1758255 - RNA, 20 nt, Salmonella enterica enterica serovar Typhi Ty2
agcgccaguuuuuccuguuc

SEQ ID NO: 1758256 - RNA, 14 nt, Salmonella enterica enterica serovar Typhi Ty2
agcgccaguuuuuc

SEQ ID NO: 1758257 - RNA, 14 nt, Salmonella enterica enterica serovar Typhi Ty2
agcgccagugacgc

SEQ ID NO: 1758258 - RNA, 14 nt, Salmonella enterica enterica serovar Typhi Ty2
agcgccaccacaaa

SEQ ID NO: 1758259 - RNA, 23 nt, Salmonella enterica enterica serovar Typhi Ty2
agcgccaaaaagaaaaaagugau

SEQ ID NO: 1758260 - RNA, 23 nt, Salmonella enterica enterica serovar Typhi Ty2
agcgccaccaaagccaggccgcc

SEQ ID NO: 1758261 - RNA, 16 nt, Salmonella enterica enterica serovar Typhi Ty2
agcgcauugcgcccca

SEQ ID NO: 1758262 - RNA, 20 nt, Salmonella enterica enterica serovar Typhi Ty2
agcgcauugcgccccagcac

SEQ ID NO: 1758263 - RNA, 18 nt, Salmonella enterica enterica serovar Typhi Ty2
agcgcagcgccaucaggc

SEQ ID NO: 1758264 - RNA, 22 nt, Salmonella enterica enterica serovar Typhi Ty2
agcgcagcgccauugagcauuc

SEQ ID NO: 1758265 - RNA, 16 nt, Salmonella enterica enterica serovar Typhi Ty2
agcgcagcgagaaagc

SEQ ID NO: 1758266 - RNA, 12 nt, Salmonella enterica enterica serovar Typhi Ty2
agcgcagcgcca

SEQ ID NO: 1758267 - RNA, 18 nt, Salmonella enterica enterica serovar Typhi Ty2
agcgcagugaccagcauc

SEQ ID NO: 1758268 - RNA, 13 nt, Salmonella enterica enterica serovar Typhi Ty2
agcgcauagcugc

SEQ ID NO: 1758269 - RNA, 16 nt, Salmonella enterica enterica serovar Typhi Ty2
agcgcauccagcucuu

SEQ ID NO: 1758270 - RNA, 11 nt, Salmonella enterica enterica serovar Typhi Ty2
agcgagucaga

SEQ ID NO: 1758271 - RNA, 21 nt, Salmonella enterica enterica serovar Typhi Ty2
agcgaguacguaaugugaaaa

SEQ ID NO: 1758272 - RNA, 15 nt, Salmonella enterica enterica serovar Typhi Ty2
agcgauauuucuccg

SEQ ID NO: 1758273 - RNA, 14 nt, Salmonella enterica enterica serovar Typhi Ty2
agcgauagacuguu

SEQ ID NO: 1758274 - RNA, 23 nt, Salmonella enterica enterica serovar Typhi Ty2
agcgaugacgccugccagauagu

SEQ ID NO: 1758275 - RNA, 18 nt, Salmonella enterica enterica serovar Typhi Ty2
agcgaucgagauaagauc

SEQ ID NO: 1758276 - RNA, 15 nt, Salmonella enterica enterica serovar Typhi Ty2
agcgaucgagauaag

SEQ ID NO: 1758277 - RNA, 23 nt, Salmonella enterica enterica serovar Typhi Ty2
agcgaucuggcggcgaaagagaa

SEQ ID NO: 1758278 - RNA, 13 nt, Salmonella enterica enterica serovar Typhi Ty2
agcgaugcgcgcg

SEQ ID NO: 1758279 - RNA, 23 nt, Salmonella enterica enterica serovar Typhi Ty2
agcgcacuguuugcugacaaucu

SEQ ID NO: 1758280 - RNA, 23 nt, Salmonella enterica enterica serovar Typhi Ty2
agcgcagaccgagcgcauguucu

SEQ ID NO: 1758281 - RNA, 14 nt, Salmonella enterica enterica serovar Typhi Ty2
agcgauuuauccac

SEQ ID NO: 1758282 - RNA, 17 nt, Salmonella enterica enterica serovar Typhi Ty2
agcgcaaaagcgcgccc

SEQ ID NO: 1758283 - RNA, 13 nt, Salmonella enterica enterica serovar Typhi Ty2
agcgcaaggccga

SEQ ID NO: 1758284 - RNA, 19 nt, Salmonella enterica enterica serovar Typhi Ty2
agcgcaaauauccuaccac

SEQ ID NO: 1758285 - RNA, 16 nt, Salmonella enterica enterica serovar Typhi Ty2
agcgccucugauuuuu

SEQ ID NO: 1758286 - RNA, 14 nt, Salmonella enterica enterica serovar Typhi Ty2
agcgccucgcaaaa

SEQ ID NO: 1758287 - RNA, 18 nt, Salmonella enterica enterica serovar Typhi Ty2
agcgccguuaacgcggcc

SEQ ID NO: 1758288 - RNA, 22 nt, Salmonella enterica enterica serovar Typhi Ty2
agcgccugcuguaaaauauccc

SEQ ID NO: 1758289 - RNA, 22 nt, Salmonella enterica enterica serovar Typhi Ty2
agcgccuguaaacguuccugcc

SEQ ID NO: 1758290 - RNA, 19 nt, Salmonella enterica enterica serovar Typhi Ty2
agcgccucugauuuuucca

SEQ ID NO: 1758291 - RNA, 18 nt, Salmonella enterica enterica serovar Typhi Ty2
agcgccgcgcgaucaauc

SEQ ID NO: 1758292 - RNA, 19 nt, Salmonella enterica enterica serovar Typhi Ty2
agcgccgcgcgaucaauca

SEQ ID NO: 1758293 - RNA, 16 nt, Salmonella enterica enterica serovar Typhi Ty2
agcgccggcaaagcca

SEQ ID NO: 1758294 - RNA, 16 nt, Salmonella enterica enterica serovar Typhi Ty2
agcgccggcagcaguu

SEQ ID NO: 1758295 - RNA, 15 nt, Salmonella enterica enterica serovar Typhi Ty2
agcgccgguuucucc

SEQ ID NO: 1758296 - RNA, 21 nt, Salmonella enterica enterica serovar Typhi Ty2
agcgccgucauggcaaacgaa

SEQ ID NO: 1758297 - RNA, 14 nt, Salmonella enterica enterica serovar Typhi Ty2
agcgccguccgaca

SEQ ID NO: 1758298 - RNA, 21 nt, Salmonella enterica enterica serovar Typhi Ty2
agcgcccgcuguccgcccagu

SEQ ID NO: 1758299 - RNA, 15 nt, Salmonella enterica enterica serovar Typhi Ty2
agcgcccccagcaaa

SEQ ID NO: 1758300 - RNA, 14 nt, Salmonella enterica enterica serovar Typhi Ty2
agcgccccaguaac

SEQ ID NO: 1758301 - RNA, 19 nt, Salmonella enterica enterica serovar Typhi Ty2
agcgccaucaggcaugcca

SEQ ID NO: 1758302 - RNA, 13 nt, Salmonella enterica enterica serovar Typhi Ty2
agcgcccagcagc

SEQ ID NO: 1758303 - RNA, 22 nt, Salmonella enterica enterica serovar Typhi Ty2
agcgccccucuugcagcaagaa

SEQ ID NO: 1758304 - RNA, 18 nt, Salmonella enterica enterica serovar Typhi Ty2
agcgccgccagauaaagc

SEQ ID NO: 1758305 - RNA, 21 nt, Salmonella enterica enterica serovar Typhi Ty2
agcgccgccagauaaagcgaa

SEQ ID NO: 1758306 - RNA, 20 nt, Salmonella enterica enterica serovar Typhi Ty2
agcgccgccagaaucaccuc

SEQ ID NO: 1758307 - RNA, 14 nt, Salmonella enterica enterica serovar Typhi Ty2
agcgccgccaagau

SEQ ID NO: 1758308 - RNA, 14 nt, Salmonella enterica enterica serovar Typhi Ty2
agcgccgcagggcg

SEQ ID NO: 1758309 - RNA, 17 nt, Salmonella enterica enterica serovar Typhi Ty2
agcgcucaaauaaugca

SEQ ID NO: 1758310 - RNA, 16 nt, Salmonella enterica enterica serovar Typhi Ty2
agcgcuaauugugcgg

SEQ ID NO: 1758311 - RNA, 15 nt, Salmonella enterica enterica serovar Typhi Ty2
agcgcuccggcauaa

SEQ ID NO: 1758312 - RNA, 12 nt, Salmonella enterica enterica serovar Typhi Ty2
agcgcuccccac

SEQ ID NO: 1758313 - RNA, 16 nt, Salmonella enterica enterica serovar Typhi Ty2
agcgcuucgcuugccc

SEQ ID NO: 1758314 - RNA, 13 nt, Salmonella enterica enterica serovar Typhi Ty2
agcgcuuuugccg

SEQ ID NO: 1758315 - RNA, 23 nt, Salmonella enterica enterica serovar Typhi Ty2
agcgcuuuccagucccugaagaa

SEQ ID NO: 1758316 - RNA, 21 nt, Salmonella enterica enterica serovar Typhi Ty2
agcgcuuuggaggucauuauu

SEQ ID NO: 1758317 - RNA, 14 nt, Salmonella enterica enterica serovar Typhi Ty2
agcgcuuucuucuu

SEQ ID NO: 1758318 - RNA, 17 nt, Salmonella enterica enterica serovar Typhi Ty2
agcggauggccugcuca

SEQ ID NO: 1758319 - RNA, 14 nt, Salmonella enterica enterica serovar Typhi Ty2
agcggauuaaaacg

SEQ ID NO: 1758320 - RNA, 22 nt, Salmonella enterica enterica serovar Typhi Ty2
agcggaucgcguccauuacucu

SEQ ID NO: 1758321 - RNA, 21 nt, Salmonella enterica enterica serovar Typhi Ty2
agcgcgguggcuuuuuccugc

SEQ ID NO: 1758322 - RNA, 14 nt, Salmonella enterica enterica serovar Typhi Ty2
agcgcgacauagag

SEQ ID NO: 1758323 - RNA, 16 nt, Salmonella enterica enterica serovar Typhi Ty2
agcgcgaaugauuuua

SEQ ID NO: 1758324 - RNA, 17 nt, Salmonella enterica enterica serovar Typhi Ty2
agcgccuguucaacaug

SEQ ID NO: 1758325 - RNA, 13 nt, Salmonella enterica enterica serovar Typhi Ty2
agcgcgaaauuua

SEQ ID NO: 1758326 - RNA, 20 nt, Salmonella enterica enterica serovar Typhi Ty2
agcgcgucagcgccuccgcg

SEQ ID NO: 1758327 - RNA, 20 nt, Salmonella enterica enterica serovar Typhi Ty2
agcgcgucguucacgccaaa

SEQ ID NO: 1758328 - RNA, 19 nt, Salmonella enterica enterica serovar Typhi Ty2
agcgcguucgccgucacgc

SEQ ID NO: 1758329 - RNA, 14 nt, Salmonella enterica enterica serovar Typhi Ty2
agcgcguucagggu

SEQ ID NO: 1758330 - RNA, 15 nt, Salmonella enterica enterica serovar Typhi Ty2
agcgcgucagcgccu

SEQ ID NO: 1758331 - RNA, 22 nt, Salmonella enterica enterica serovar Typhi Ty2
agcuagccaauaaucgaaauaa

SEQ ID NO: 1758332 - RNA, 22 nt, Salmonella enterica enterica serovar Typhi Ty2
agcuacuugaucggcuggcgca

SEQ ID NO: 1758333 - RNA, 14 nt, Salmonella enterica enterica serovar Typhi Ty2
agcuagccaauaau

SEQ ID NO: 1758334 - RNA, 22 nt, Salmonella enterica enterica serovar Typhi Ty2
agcguuuugauguccagaugcu

SEQ ID NO: 1758335 - RNA, 18 nt, Salmonella enterica enterica serovar Typhi Ty2
agcgugcaaccccuugcg

SEQ ID NO: 1758336 - RNA, 20 nt, Salmonella enterica enterica serovar Typhi Ty2
agcgucuucuuaccgugucu

SEQ ID NO: 1758337 - RNA, 21 nt, Salmonella enterica enterica serovar Typhi Ty2
agcgucuuccuguaucccaaa

SEQ ID NO: 1758338 - RNA, 20 nt, Salmonella enterica enterica serovar Typhi Ty2
agcgugacgaccggcacggu

SEQ ID NO: 1758339 - RNA, 15 nt, Salmonella enterica enterica serovar Typhi Ty2
agcgugacccagaca

SEQ ID NO: 1758340 - RNA, 19 nt, Salmonella enterica enterica serovar Typhi Ty2
agcguuuaaaaagcugcau

SEQ ID NO: 1758341 - RNA, 19 nt, Salmonella enterica enterica serovar Typhi Ty2
agcguuugacggauuuuuu

SEQ ID NO: 1758342 - RNA, 15 nt, Salmonella enterica enterica serovar Typhi Ty2
agcguuucgccguaa

SEQ ID NO: 1758343 - RNA, 18 nt, Salmonella enterica enterica serovar Typhi Ty2
agcguucugcacgccggu

SEQ ID NO: 1758344 - RNA, 20 nt, Salmonella enterica enterica serovar Typhi Ty2
agcguucucacggucuccug

SEQ ID NO: 1758345 - RNA, 19 nt, Salmonella enterica enterica serovar Typhi Ty2
agcggcaggauccccaucc

SEQ ID NO: 1758346 - RNA, 14 nt, Salmonella enterica enterica serovar Typhi Ty2
agcggcagugauga

SEQ ID NO: 1758347 - RNA, 14 nt, Salmonella enterica enterica serovar Typhi Ty2
agcggcaguaaauu

SEQ ID NO: 1758348 - RNA, 14 nt, Salmonella enterica enterica serovar Typhi Ty2
agcggcaagacaga

SEQ ID NO: 1758349 - RNA, 22 nt, Salmonella enterica enterica serovar Typhi Ty2
agcggcaagccgaucagcgugu

SEQ ID NO: 1758350 - RNA, 15 nt, Salmonella enterica enterica serovar Typhi Ty2
agcggcaaucgccuc

SEQ ID NO: 1758351 - RNA, 15 nt, Salmonella enterica enterica serovar Typhi Ty2
agcggcaccagcacg

SEQ ID NO: 1758352 - RNA, 22 nt, Salmonella enterica enterica serovar Typhi Ty2
agcgggugcauuuucaccugga

SEQ ID NO: 1758353 - RNA, 18 nt, Salmonella enterica enterica serovar Typhi Ty2
agcgguaagagccagacg

SEQ ID NO: 1758354 - RNA, 11 nt, Salmonella enterica enterica serovar Typhi Ty2
agcgguaaaau

SEQ ID NO: 1758355 - RNA, 18 nt, Salmonella enterica enterica serovar Typhi Ty2
agcgggucccagaagaaa

SEQ ID NO: 1758356 - RNA, 16 nt, Salmonella enterica enterica serovar Typhi Ty2
agcggguagagcuuuu

SEQ ID NO: 1758357 - RNA, 19 nt, Salmonella enterica enterica serovar Typhi Ty2
agcgucagacacaauauug

SEQ ID NO: 1758358 - RNA, 17 nt, Salmonella enterica enterica serovar Typhi Ty2
agcgucagguagcccgg

SEQ ID NO: 1758359 - RNA, 22 nt, Salmonella enterica enterica serovar Typhi Ty2
agcgucagguagcccggcaggc

SEQ ID NO: 1758360 - RNA, 17 nt, Salmonella enterica enterica serovar Typhi Ty2
agcgucaguaaaagccc

SEQ ID NO: 1758361 - RNA, 19 nt, Salmonella enterica enterica serovar Typhi Ty2
agcguccguucugauacuc

SEQ ID NO: 1758362 - RNA, 19 nt, Salmonella enterica enterica serovar Typhi Ty2
agcguccggaaaauccuca

SEQ ID NO: 1758363 - RNA, 20 nt, Salmonella enterica enterica serovar Typhi Ty2
agcguccaguccugucccug

SEQ ID NO: 1758364 - RNA, 15 nt, Salmonella enterica enterica serovar Typhi Ty2
agcguccaguccugu

SEQ ID NO: 1758365 - RNA, 12 nt, Salmonella enterica enterica serovar Typhi Ty2
agcguccagcag

SEQ ID NO: 1758366 - RNA, 22 nt, Salmonella enterica enterica serovar Typhi Ty2
agcguccagcagacucauggac

SEQ ID NO: 1758367 - RNA, 23 nt, Salmonella enterica enterica serovar Typhi Ty2
agcguccaguccugucccugcca

SEQ ID NO: 1758368 - RNA, 19 nt, Salmonella enterica enterica serovar Typhi Ty2
agcguaaauagcccggauc

SEQ ID NO: 1758369 - RNA, 18 nt, Salmonella enterica enterica serovar Typhi Ty2
agcguaaugcgccaggca

SEQ ID NO: 1758370 - RNA, 20 nt, Salmonella enterica enterica serovar Typhi Ty2
agcucgcaggccauaaaacg

SEQ ID NO: 1758371 - RNA, 21 nt, Salmonella enterica enterica serovar Typhi Ty2
agcucgcaugcauagccgcug

SEQ ID NO: 1758372 - RNA, 21 nt, Salmonella enterica enterica serovar Typhi Ty2
agcuccuuucggacuuccugu

SEQ ID NO: 1758373 - RNA, 15 nt, Salmonella enterica enterica serovar Typhi Ty2
agcucgcccagcacu

SEQ ID NO: 1758374 - RNA, 20 nt, Salmonella enterica enterica serovar Typhi Ty2
agcucggcaaagcccaucac

SEQ ID NO: 1758375 - RNA, 21 nt, Salmonella enterica enterica serovar Typhi Ty2
agcucggcaaagcccaucacc

SEQ ID NO: 1758376 - RNA, 21 nt, Salmonella enterica enterica serovar Typhi Ty2
agcucauuuuuacagacacga

SEQ ID NO: 1758377 - RNA, 22 nt, Salmonella enterica enterica serovar Typhi Ty2
agcucauguagucauauugcgc

SEQ ID NO: 1758378 - RNA, 17 nt, Salmonella enterica enterica serovar Typhi Ty2
agcuccagccgcugccu

SEQ ID NO: 1758379 - RNA, 16 nt, Salmonella enterica enterica serovar Typhi Ty2
agcuccggacgcacca

SEQ ID NO: 1758380 - RNA, 22 nt, Salmonella enterica enterica serovar Typhi Ty2
agcuccgcguauucucaaccag

SEQ ID NO: 1758381 - RNA, 16 nt, Salmonella enterica enterica serovar Typhi Ty2
agcuccagcucagggu

SEQ ID NO: 1758382 - RNA, 19 nt, Salmonella enterica enterica serovar Typhi Ty2
agcuccauagaaaucagca

SEQ ID NO: 1758383 - RNA, 20 nt, Salmonella enterica enterica serovar Typhi Ty2
agcucuucaggcguauauuc

SEQ ID NO: 1758384 - RNA, 19 nt, Salmonella enterica enterica serovar Typhi Ty2
agcucuuucauuucugccu

SEQ ID NO: 1758385 - RNA, 18 nt, Salmonella enterica enterica serovar Typhi Ty2
agcugacaaugugccgga

SEQ ID NO: 1758386 - RNA, 19 nt, Salmonella enterica enterica serovar Typhi Ty2
agcugacgacgccagcccu

SEQ ID NO: 1758387 - RNA, 22 nt, Salmonella enterica enterica serovar Typhi Ty2
agcucugguugcagcgccagag

SEQ ID NO: 1758388 - RNA, 15 nt, Salmonella enterica enterica serovar Typhi Ty2
agcucguuauuuccg

SEQ ID NO: 1758389 - RNA, 14 nt, Salmonella enterica enterica serovar Typhi Ty2
agcucguuauuucc

SEQ ID NO: 1758390 - RNA, 20 nt, Salmonella enterica enterica serovar Typhi Ty2
agcucggcuucgacauagcc

SEQ ID NO: 1758391 - RNA, 18 nt, Salmonella enterica enterica serovar Typhi Ty2
agcugauugauuuuguaa

SEQ ID NO: 1758392 - RNA, 20 nt, Salmonella enterica enterica serovar Typhi Ty2
agcugauaagcuaguaaaga

SEQ ID NO: 1758393 - RNA, 19 nt, Salmonella enterica enterica serovar Typhi Ty2
agcugagcuaaucacccac

SEQ ID NO: 1758394 - RNA, 13 nt, Salmonella enterica enterica serovar Typhi Ty2
agcugauuuuucg

SEQ ID NO: 1758395 - RNA, 17 nt, Salmonella enterica enterica serovar Typhi Ty2
agcugcuggcgagcagg

SEQ ID NO: 1758396 - RNA, 14 nt, Salmonella enterica enterica serovar Typhi Ty2
agcugauugauuuu

SEQ ID NO: 1758397 - RNA, 13 nt, Salmonella enterica enterica serovar Typhi Ty2
agcaaggcggcgg

SEQ ID NO: 1758398 - RNA, 14 nt, Salmonella enterica enterica serovar Typhi Ty2
agcaauaaaaggaa

SEQ ID NO: 1758399 - RNA, 12 nt, Salmonella enterica enterica serovar Typhi Ty2
agcaauaauccg

SEQ ID NO: 1758400 - RNA, 15 nt, Salmonella enterica enterica serovar Typhi Ty2
agcaauuaacaaaua

SEQ ID NO: 1758401 - RNA, 20 nt, Salmonella enterica enterica serovar Typhi Ty2
agcaauuaacaaauaaagcg

SEQ ID NO: 1758402 - RNA, 16 nt, Salmonella enterica enterica serovar Typhi Ty2
agcaauuaauaaacaa

SEQ ID NO: 1758403 - RNA, 16 nt, Salmonella enterica enterica serovar Typhi Ty2
agcaauacaauuauug

SEQ ID NO: 1758404 - RNA, 20 nt, Salmonella enterica enterica serovar Typhi Ty2
agcaauccauuuuaaauaca

SEQ ID NO: 1758405 - RNA, 22 nt, Salmonella enterica enterica serovar Typhi Ty2
agcaaucucuauaccauaaaug

SEQ ID NO: 1758406 - RNA, 20 nt, Salmonella enterica enterica serovar Typhi Ty2
agcaacguuuguaacagcag

SEQ ID NO: 1758407 - RNA, 19 nt, Salmonella enterica enterica serovar Typhi Ty2
agcaacguaaucccgccag

SEQ ID NO: 1758408 - RNA, 21 nt, Salmonella enterica enterica serovar Typhi Ty2
agcaacguuaaggccgcaaac

SEQ ID NO: 1758409 - RNA, 16 nt, Salmonella enterica enterica serovar Typhi Ty2
agcaacggaagcugac

SEQ ID NO: 1758410 - RNA, 20 nt, Salmonella enterica enterica serovar Typhi Ty2
agcaacgccaucagcaaaau

SEQ ID NO: 1758411 - RNA, 18 nt, Salmonella enterica enterica serovar Typhi Ty2
agcaagaacagagcaauu

SEQ ID NO: 1758412 - RNA, 19 nt, Salmonella enterica enterica serovar Typhi Ty2
agcaagaacagagcaauua

SEQ ID NO: 1758413 - RNA, 22 nt, Salmonella enterica enterica serovar Typhi Ty2
agcaagaaguuccgcuuuucug

SEQ ID NO: 1758414 - RNA, 16 nt, Salmonella enterica enterica serovar Typhi Ty2
agcaagaauaccacuu

SEQ ID NO: 1758415 - RNA, 13 nt, Salmonella enterica enterica serovar Typhi Ty2
agcaacugccagg

SEQ ID NO: 1758416 - RNA, 20 nt, Salmonella enterica enterica serovar Typhi Ty2
agcaacugcgcgcggguuuc

SEQ ID NO: 1758417 - RNA, 15 nt, Salmonella enterica enterica serovar Typhi Ty2
agcaaauuuaaucau

SEQ ID NO: 1758418 - RNA, 13 nt, Salmonella enterica enterica serovar Typhi Ty2
agcaaauugcuga

SEQ ID NO: 1758419 - RNA, 20 nt, Salmonella enterica enterica serovar Typhi Ty2
agcaacagauugaugcccuc

SEQ ID NO: 1758420 - RNA, 19 nt, Salmonella enterica enterica serovar Typhi Ty2
agcaaccagcuaaccuguu

SEQ ID NO: 1758421 - RNA, 21 nt, Salmonella enterica enterica serovar Typhi Ty2
agcaacagugggcuaugaaga

SEQ ID NO: 1758422 - RNA, 20 nt, Salmonella enterica enterica serovar Typhi Ty2
agcaacccuggcgcuuuaaa

SEQ ID NO: 1758423 - RNA, 12 nt, Salmonella enterica enterica serovar Typhi Ty2
agcaacccuuuu

SEQ ID NO: 1758424 - RNA, 22 nt, Salmonella enterica enterica serovar Typhi Ty2
agcaacccugccgucucaacca

SEQ ID NO: 1758425 - RNA, 14 nt, Salmonella enterica enterica serovar Typhi Ty2
agcaaaaaucacca

SEQ ID NO: 1758426 - RNA, 15 nt, Salmonella enterica enterica serovar Typhi Ty2
agcaaaaacauuacc

SEQ ID NO: 1758427 - RNA, 15 nt, Salmonella enterica enterica serovar Typhi Ty2
agcaaaauggcaauu

SEQ ID NO: 1758428 - RNA, 21 nt, Salmonella enterica enterica serovar Typhi Ty2
agcaaagcguacaugaauaau

SEQ ID NO: 1758429 - RNA, 18 nt, Salmonella enterica enterica serovar Typhi Ty2
agcaaaccggcaugaaga

SEQ ID NO: 1758430 - RNA, 20 nt, Salmonella enterica enterica serovar Typhi Ty2
agcaaacauccccgcuugca

SEQ ID NO: 1758431 - RNA, 21 nt, Salmonella enterica enterica serovar Typhi Ty2
agcaaaucgcccaucacaugu

SEQ ID NO: 1758432 - RNA, 12 nt, Salmonella enterica enterica serovar Typhi Ty2
agauaauagcug

SEQ ID NO: 1758433 - RNA, 18 nt, Salmonella enterica enterica serovar Typhi Ty2
agauaauagcugaaaaga

SEQ ID NO: 1758434 - RNA, 14 nt, Salmonella enterica enterica serovar Typhi Ty2
agauaaguguugga

SEQ ID NO: 1758435 - RNA, 17 nt, Salmonella enterica enterica serovar Typhi Ty2
agauaagcgucugcaau

SEQ ID NO: 1758436 - RNA, 19 nt, Salmonella enterica enterica serovar Typhi Ty2
agauaaggagaaagaccuu

SEQ ID NO: 1758437 - RNA, 22 nt, Salmonella enterica enterica serovar Typhi Ty2
agauaauccagcgucgccagca

SEQ ID NO: 1758438 - RNA, 15 nt, Salmonella enterica enterica serovar Typhi Ty2
agauugucaccguaa

SEQ ID NO: 1758439 - RNA, 16 nt, Salmonella enterica enterica serovar Typhi Ty2
agauuggugaugcgca

SEQ ID NO: 1758440 - RNA, 13 nt, Salmonella enterica enterica serovar Typhi Ty2
agauuuaaaacaa

SEQ ID NO: 1758441 - RNA, 21 nt, Salmonella enterica enterica serovar Typhi Ty2
agauugugcuuuagcuuuacu

SEQ ID NO: 1758442 - RNA, 16 nt, Salmonella enterica enterica serovar Typhi Ty2
agauaauuaugccugu

SEQ ID NO: 1758443 - RNA, 19 nt, Salmonella enterica enterica serovar Typhi Ty2
agauuucuuaauuccucag

SEQ ID NO: 1758444 - RNA, 16 nt, Salmonella enterica enterica serovar Typhi Ty2
agauuucuuaauuccu

SEQ ID NO: 1758445 - RNA, 15 nt, Salmonella enterica enterica serovar Typhi Ty2
agauuuacaacagau

SEQ ID NO: 1758446 - RNA, 15 nt, Salmonella enterica enterica serovar Typhi Ty2
agauuuaucaauuuu

SEQ ID NO: 1758447 - RNA, 24 nt, Salmonella enterica enterica serovar Typhi Ty2
agauuucaucaggcugacgaagaa

SEQ ID NO: 1758448 - RNA, 23 nt, Salmonella enterica enterica serovar Typhi Ty2
agcagaacguagcccauugucau

SEQ ID NO: 1758449 - RNA, 13 nt, Salmonella enterica enterica serovar Typhi Ty2
agcagacguuggu

SEQ ID NO: 1758450 - RNA, 22 nt, Salmonella enterica enterica serovar Typhi Ty2
agcagacguuuaagcaugguga

SEQ ID NO: 1758451 - RNA, 13 nt, Salmonella enterica enterica serovar Typhi Ty2
agcagacuguaaa

SEQ ID NO: 1758452 - RNA, 13 nt, Salmonella enterica enterica serovar Typhi Ty2
agcagacgagaaa

SEQ ID NO: 1758453 - RNA, 22 nt, Salmonella enterica enterica serovar Typhi Ty2
agcacuucgcugauaccgcccu

SEQ ID NO: 1758454 - RNA, 16 nt, Salmonella enterica enterica serovar Typhi Ty2
agcacuuugguaaaac

SEQ ID NO: 1758455 - RNA, 14 nt, Salmonella enterica enterica serovar Typhi Ty2
agcagaaagcaaca

SEQ ID NO: 1758456 - RNA, 18 nt, Salmonella enterica enterica serovar Typhi Ty2
agcagaaagcaacagcaa

SEQ ID NO: 1758457 - RNA, 19 nt, Salmonella enterica enterica serovar Typhi Ty2
agcagaaagcaacagcaag

SEQ ID NO: 1758458 - RNA, 15 nt, Salmonella enterica enterica serovar Typhi Ty2
agcagcaacccugcc

SEQ ID NO: 1758459 - RNA, 17 nt, Salmonella enterica enterica serovar Typhi Ty2
agcagcaacccugccgu

SEQ ID NO: 1758460 - RNA, 16 nt, Salmonella enterica enterica serovar Typhi Ty2
agcagcagcagcgcuu

SEQ ID NO: 1758461 - RNA, 20 nt, Salmonella enterica enterica serovar Typhi Ty2
agcagauaccagccuucgga

SEQ ID NO: 1758462 - RNA, 15 nt, Salmonella enterica enterica serovar Typhi Ty2
agcagauacugcgcg

SEQ ID NO: 1758463 - RNA, 20 nt, Salmonella enterica enterica serovar Typhi Ty2
agcagauaccgaccgugaga

SEQ ID NO: 1758464 - RNA, 19 nt, Salmonella enterica enterica serovar Typhi Ty2
agcagauuuuuauccgucg

SEQ ID NO: 1758465 - RNA, 22 nt, Salmonella enterica enterica serovar Typhi Ty2
agcagcaaaccgauaaucacca

SEQ ID NO: 1758466 - RNA, 20 nt, Salmonella enterica enterica serovar Typhi Ty2
agcagauagcccgccagcac

SEQ ID NO: 1758467 - RNA, 14 nt, Salmonella enterica enterica serovar Typhi Ty2
agcacguaggccug

SEQ ID NO: 1758468 - RNA, 21 nt, Salmonella enterica enterica serovar Typhi Ty2
agcacuaacagcagcagcaaa

SEQ ID NO: 1758469 - RNA, 16 nt, Salmonella enterica enterica serovar Typhi Ty2
agcacuaacagcagca

SEQ ID NO: 1758470 - RNA, 18 nt, Salmonella enterica enterica serovar Typhi Ty2
agcacuacggcaaacaca

SEQ ID NO: 1758471 - RNA, 19 nt, Salmonella enterica enterica serovar Typhi Ty2
agcacugcuuaaauuuuuu

SEQ ID NO: 1758472 - RNA, 15 nt, Salmonella enterica enterica serovar Typhi Ty2
agcacugcccaggac

SEQ ID NO: 1758473 - RNA, 15 nt, Salmonella enterica enterica serovar Typhi Ty2
agcacucggcgccuu

SEQ ID NO: 1758474 - RNA, 13 nt, Salmonella enterica enterica serovar Typhi Ty2
agcacgcccgguc

SEQ ID NO: 1758475 - RNA, 16 nt, Salmonella enterica enterica serovar Typhi Ty2
agcacgcgcugcgccg

SEQ ID NO: 1758476 - RNA, 19 nt, Salmonella enterica enterica serovar Typhi Ty2
agcacggggguuuugugau

SEQ ID NO: 1758477 - RNA, 19 nt, Salmonella enterica enterica serovar Typhi Ty2
agcacgguaaaccucuuug

SEQ ID NO: 1758478 - RNA, 17 nt, Salmonella enterica enterica serovar Typhi Ty2
agcacgcuuacccagca

SEQ ID NO: 1758479 - RNA, 13 nt, Salmonella enterica enterica serovar Typhi Ty2
agcacgacacaaa

SEQ ID NO: 1758480 - RNA, 17 nt, Salmonella enterica enterica serovar Typhi Ty2
agcacgauauccagcac

SEQ ID NO: 1758481 - RNA, 17 nt, Salmonella enterica enterica serovar Typhi Ty2
agcaccuuauccggccu

SEQ ID NO: 1758482 - RNA, 20 nt, Salmonella enterica enterica serovar Typhi Ty2
agcaccucaucgcuaccuuc

SEQ ID NO: 1758483 - RNA, 15 nt, Salmonella enterica enterica serovar Typhi Ty2
agcaccagcaggugg

SEQ ID NO: 1758484 - RNA, 12 nt, Salmonella enterica enterica serovar Typhi Ty2
agcaccagcagu

SEQ ID NO: 1758485 - RNA, 13 nt, Salmonella enterica enterica serovar Typhi Ty2
agcaccagcaggu

SEQ ID NO: 1758486 - RNA, 13 nt, Salmonella enterica enterica serovar Typhi Ty2
agcaccaggccaa

SEQ ID NO: 1758487 - RNA, 14 nt, Salmonella enterica enterica serovar Typhi Ty2
agcaccaggccaac

SEQ ID NO: 1758488 - RNA, 13 nt, Salmonella enterica enterica serovar Typhi Ty2
agcacccaggcac

SEQ ID NO: 1758489 - RNA, 20 nt, Salmonella enterica enterica serovar Typhi Ty2
agcacccaccaucacuucca

SEQ ID NO: 1758490 - RNA, 16 nt, Salmonella enterica enterica serovar Typhi Ty2
agcaccauucuucaac

SEQ ID NO: 1758491 - RNA, 21 nt, Salmonella enterica enterica serovar Typhi Ty2
agcaccucgguauguccugcc

SEQ ID NO: 1758492 - RNA, 15 nt, Salmonella enterica enterica serovar Typhi Ty2
agcaccgccagcgcc

SEQ ID NO: 1758493 - RNA, 16 nt, Salmonella enterica enterica serovar Typhi Ty2
agcacccggcccggcg

SEQ ID NO: 1758494 - RNA, 20 nt, Salmonella enterica enterica serovar Typhi Ty2
agcaccggaacagaagccug

SEQ ID NO: 1758495 - RNA, 21 nt, Salmonella enterica enterica serovar Typhi Ty2
agcaccgccgggaagaaauua

SEQ ID NO: 1758496 - RNA, 18 nt, Salmonella enterica enterica serovar Typhi Ty2
agcacaucagcaaaugaa

SEQ ID NO: 1758497 - RNA, 21 nt, Salmonella enterica enterica serovar Typhi Ty2
agcacaucacucauaaugaug

SEQ ID NO: 1758498 - RNA, 17 nt, Salmonella enterica enterica serovar Typhi Ty2
agcacagcccaguaaua

SEQ ID NO: 1758499 - RNA, 15 nt, Salmonella enterica enterica serovar Typhi Ty2
agcaccacgcccgga

SEQ ID NO: 1758500 - RNA, 15 nt, Salmonella enterica enterica serovar Typhi Ty2
agcacaugcagauau

SEQ ID NO: 1758501 - RNA, 21 nt, Salmonella enterica enterica serovar Typhi Ty2
agcacaaagaauucuucugug

SEQ ID NO: 1758502 - RNA, 21 nt, Salmonella enterica enterica serovar Typhi Ty2
agcaauuucagcauccuccgg

SEQ ID NO: 1758503 - RNA, 18 nt, Salmonella enterica enterica serovar Typhi Ty2
agcaauuggccaucuucg

SEQ ID NO: 1758504 - RNA, 19 nt, Salmonella enterica enterica serovar Typhi Ty2
agcaauuccgccaucucau

SEQ ID NO: 1758505 - RNA, 15 nt, Salmonella enterica enterica serovar Typhi Ty2
agcacaagaacuuaa

SEQ ID NO: 1758506 - RNA, 22 nt, Salmonella enterica enterica serovar Typhi Ty2
agcacaacgcauuggcaauuaa

SEQ ID NO: 1758507 - RNA, 16 nt, Salmonella enterica enterica serovar Typhi Ty2
agcagggucaggaacu

SEQ ID NO: 1758508 - RNA, 22 nt, Salmonella enterica enterica serovar Typhi Ty2
agcagggucaggaacugcggcc

SEQ ID NO: 1758509 - RNA, 14 nt, Salmonella enterica enterica serovar Typhi Ty2
agcagggucaggaa

SEQ ID NO: 1758510 - RNA, 17 nt, Salmonella enterica enterica serovar Typhi Ty2
agcagguuaaacagaca

SEQ ID NO: 1758511 - RNA, 18 nt, Salmonella enterica enterica serovar Typhi Ty2
agcaggucaaagacgaaa

SEQ ID NO: 1758512 - RNA, 15 nt, Salmonella enterica enterica serovar Typhi Ty2
agcagggucaggaac

SEQ ID NO: 1758513 - RNA, 13 nt, Salmonella enterica enterica serovar Typhi Ty2
agcaggcgggcuu

SEQ ID NO: 1758514 - RNA, 23 nt, Salmonella enterica enterica serovar Typhi Ty2
agcaggaaaagaccauccgguuu

SEQ ID NO: 1758515 - RNA, 13 nt, Salmonella enterica enterica serovar Typhi Ty2
agcagcuccgaaa

SEQ ID NO: 1758516 - RNA, 14 nt, Salmonella enterica enterica serovar Typhi Ty2
agcagcuucaugca

SEQ ID NO: 1758517 - RNA, 13 nt, Salmonella enterica enterica serovar Typhi Ty2
agcagcugcugua

SEQ ID NO: 1758518 - RNA, 17 nt, Salmonella enterica enterica serovar Typhi Ty2
agcagcggcguaucuuc

SEQ ID NO: 1758519 - RNA, 16 nt, Salmonella enterica enterica serovar Typhi Ty2
agcagccagacccgcg

SEQ ID NO: 1758520 - RNA, 18 nt, Salmonella enterica enterica serovar Typhi Ty2
agcagccagaaaaaggga

SEQ ID NO: 1758521 - RNA, 16 nt, Salmonella enterica enterica serovar Typhi Ty2
agcagcauaaaaccgc

SEQ ID NO: 1758522 - RNA, 20 nt, Salmonella enterica enterica serovar Typhi Ty2
agcagcauacgacaucgcca

SEQ ID NO: 1758523 - RNA, 14 nt, Salmonella enterica enterica serovar Typhi Ty2
agcagcaggcugga

SEQ ID NO: 1758524 - RNA, 16 nt, Salmonella enterica enterica serovar Typhi Ty2
agcagcaggcuggaga

SEQ ID NO: 1758525 - RNA, 17 nt, Salmonella enterica enterica serovar Typhi Ty2
agcagcagugaggauaa

SEQ ID NO: 1758526 - RNA, 17 nt, Salmonella enterica enterica serovar Typhi Ty2
agcagcgaugacagcag

SEQ ID NO: 1758527 - RNA, 19 nt, Salmonella enterica enterica serovar Typhi Ty2
agcagcgaugacagcagga

SEQ ID NO: 1758528 - RNA, 17 nt, Salmonella enterica enterica serovar Typhi Ty2
agcagcgcaucaugguc

SEQ ID NO: 1758529 - RNA, 18 nt, Salmonella enterica enterica serovar Typhi Ty2
agcaguccugcgggaaca

SEQ ID NO: 1758530 - RNA, 19 nt, Salmonella enterica enterica serovar Typhi Ty2
agcaguaucguguuauuuu

SEQ ID NO: 1758531 - RNA, 15 nt, Salmonella enterica enterica serovar Typhi Ty2
agcaguaacgcacuu

SEQ ID NO: 1758532 - RNA, 20 nt, Salmonella enterica enterica serovar Typhi Ty2
agcaguuccccgccgcggcg

SEQ ID NO: 1758533 - RNA, 23 nt, Salmonella enterica enterica serovar Typhi Ty2
agcauagucgcuccccauaaaga

SEQ ID NO: 1758534 - RNA, 18 nt, Salmonella enterica enterica serovar Typhi Ty2
agcauagcgccuucaggc

SEQ ID NO: 1758535 - RNA, 14 nt, Salmonella enterica enterica serovar Typhi Ty2
agcauacugauguc

SEQ ID NO: 1758536 - RNA, 15 nt, Salmonella enterica enterica serovar Typhi Ty2
agcauacugcgucgg

SEQ ID NO: 1758537 - RNA, 13 nt, Salmonella enterica enterica serovar Typhi Ty2
agcauaccgccca

SEQ ID NO: 1758538 - RNA, 17 nt, Salmonella enterica enterica serovar Typhi Ty2
agcauaauaaagcagcg

SEQ ID NO: 1758539 - RNA, 21 nt, Salmonella enterica enterica serovar Typhi Ty2
agcauaaaaccgccgcccauu

SEQ ID NO: 1758540 - RNA, 17 nt, Salmonella enterica enterica serovar Typhi Ty2
agcauaaaaaacaucau

SEQ ID NO: 1758541 - RNA, 15 nt, Salmonella enterica enterica serovar Typhi Ty2
agcaucugcauaaug

SEQ ID NO: 1758542 - RNA, 18 nt, Salmonella enterica enterica serovar Typhi Ty2
agcaucugcggcuuucau

SEQ ID NO: 1758543 - RNA, 15 nt, Salmonella enterica enterica serovar Typhi Ty2
agcaucgggaaucau

SEQ ID NO: 1758544 - RNA, 17 nt, Salmonella enterica enterica serovar Typhi Ty2
agcaucgcuaaccggcg

SEQ ID NO: 1758545 - RNA, 22 nt, Salmonella enterica enterica serovar Typhi Ty2
agcaucgcuuuuaggcugaaag

SEQ ID NO: 1758546 - RNA, 18 nt, Salmonella enterica enterica serovar Typhi Ty2
agcaucgccgguagcuuc

SEQ ID NO: 1758547 - RNA, 22 nt, Salmonella enterica enterica serovar Typhi Ty2
agcaucgacccuugcgaccacu

SEQ ID NO: 1758548 - RNA, 21 nt, Salmonella enterica enterica serovar Typhi Ty2
agcauccgcaagacacgcuuc

SEQ ID NO: 1758549 - RNA, 18 nt, Salmonella enterica enterica serovar Typhi Ty2
agcauccgggauauaaaa

SEQ ID NO: 1758550 - RNA, 19 nt, Salmonella enterica enterica serovar Typhi Ty2
agcaucccgcaggcggcga

SEQ ID NO: 1758551 - RNA, 12 nt, Salmonella enterica enterica serovar Typhi Ty2
agcaucccacga

SEQ ID NO: 1758552 - RNA, 15 nt, Salmonella enterica enterica serovar Typhi Ty2
agcaucaucugccau

SEQ ID NO: 1758553 - RNA, 16 nt, Salmonella enterica enterica serovar Typhi Ty2
agcaucaucugccauu

SEQ ID NO: 1758554 - RNA, 13 nt, Salmonella enterica enterica serovar Typhi Ty2
agcaucaggugga

SEQ ID NO: 1758555 - RNA, 23 nt, Salmonella enterica enterica serovar Typhi Ty2
agcaucagguggaagaaacgcuu

SEQ ID NO: 1758556 - RNA, 19 nt, Salmonella enterica enterica serovar Typhi Ty2
agcaucaaacuuuuaaauu

SEQ ID NO: 1758557 - RNA, 20 nt, Salmonella enterica enterica serovar Typhi Ty2
agccaggccgccagcaacgu

SEQ ID NO: 1758558 - RNA, 20 nt, Salmonella enterica enterica serovar Typhi Ty2
agccaggcccgguggcgcca

SEQ ID NO: 1758559 - RNA, 15 nt, Salmonella enterica enterica serovar Typhi Ty2
agccaggcaaagccc

SEQ ID NO: 1758560 - RNA, 14 nt, Salmonella enterica enterica serovar Typhi Ty2
agccaggcaccauc

SEQ ID NO: 1758561 - RNA, 15 nt, Salmonella enterica enterica serovar Typhi Ty2
agccaggccagcgcu

SEQ ID NO: 1758562 - RNA, 16 nt, Salmonella enterica enterica serovar Typhi Ty2
agccagguugccagaa

SEQ ID NO: 1758563 - RNA, 20 nt, Salmonella enterica enterica serovar Typhi Ty2
agccagguugccagaaacaa

SEQ ID NO: 1758564 - RNA, 16 nt, Salmonella enterica enterica serovar Typhi Ty2
agccaguagcugguga

SEQ ID NO: 1758565 - RNA, 17 nt, Salmonella enterica enterica serovar Typhi Ty2
agccagucgccaggcaa

SEQ ID NO: 1758566 - RNA, 22 nt, Salmonella enterica enterica serovar Typhi Ty2
agccaguucgccuucuucaucu

SEQ ID NO: 1758567 - RNA, 20 nt, Salmonella enterica enterica serovar Typhi Ty2
agccagugggcgucaaaauc

SEQ ID NO: 1758568 - RNA, 20 nt, Salmonella enterica enterica serovar Typhi Ty2
agccauacauugaguaaaua

SEQ ID NO: 1758569 - RNA, 14 nt, Salmonella enterica enterica serovar Typhi Ty2
agccaucaauccau

SEQ ID NO: 1758570 - RNA, 18 nt, Salmonella enterica enterica serovar Typhi Ty2
agccauccucacgcaacc

SEQ ID NO: 1758571 - RNA, 15 nt, Salmonella enterica enterica serovar Typhi Ty2
agccaugccauugcu

SEQ ID NO: 1758572 - RNA, 19 nt, Salmonella enterica enterica serovar Typhi Ty2
agccaugcauaaugcagcc

SEQ ID NO: 1758573 - RNA, 19 nt, Salmonella enterica enterica serovar Typhi Ty2
agccauguagaauagcgcc

SEQ ID NO: 1758574 - RNA, 14 nt, Salmonella enterica enterica serovar Typhi Ty2
agccauuaaagaag

SEQ ID NO: 1758575 - RNA, 23 nt, Salmonella enterica enterica serovar Typhi Ty2
agccagacggcgcccagccugcc

SEQ ID NO: 1758576 - RNA, 19 nt, Salmonella enterica enterica serovar Typhi Ty2
agccagagauccacauugg

SEQ ID NO: 1758577 - RNA, 19 nt, Salmonella enterica enterica serovar Typhi Ty2
agccagacgcgcagcaccg

SEQ ID NO: 1758578 - RNA, 18 nt, Salmonella enterica enterica serovar Typhi Ty2
agccagacgccagccacu

SEQ ID NO: 1758579 - RNA, 16 nt, Salmonella enterica enterica serovar Typhi Ty2
agccagacgcgcagca

SEQ ID NO: 1758580 - RNA, 23 nt, Salmonella enterica enterica serovar Typhi Ty2
agccagacgcuccgcaguaauca

SEQ ID NO: 1758581 - RNA, 22 nt, Salmonella enterica enterica serovar Typhi Ty2
agccagacgcuccgcaguaauc

SEQ ID NO: 1758582 - RNA, 18 nt, Salmonella enterica enterica serovar Typhi Ty2
agccagauaaagcagcga

SEQ ID NO: 1758583 - RNA, 18 nt, Salmonella enterica enterica serovar Typhi Ty2
agccagauguaaucugac

SEQ ID NO: 1758584 - RNA, 20 nt, Salmonella enterica enterica serovar Typhi Ty2
agccagacggcgcccagccu

SEQ ID NO: 1758585 - RNA, 14 nt, Salmonella enterica enterica serovar Typhi Ty2
agccagauaaagca

SEQ ID NO: 1758586 - RNA, 21 nt, Salmonella enterica enterica serovar Typhi Ty2
agccagauguaaucugacaga

SEQ ID NO: 1758587 - RNA, 15 nt, Salmonella enterica enterica serovar Typhi Ty2
agccagcagcucaac

SEQ ID NO: 1758588 - RNA, 18 nt, Salmonella enterica enterica serovar Typhi Ty2
agccagcaucaugggcuc

SEQ ID NO: 1758589 - RNA, 16 nt, Salmonella enterica enterica serovar Typhi Ty2
agccagcauuuccagc

SEQ ID NO: 1758590 - RNA, 21 nt, Salmonella enterica enterica serovar Typhi Ty2
agccagccaaauagcgccaga

SEQ ID NO: 1758591 - RNA, 13 nt, Salmonella enterica enterica serovar Typhi Ty2
agccagcagcuca

SEQ ID NO: 1758592 - RNA, 19 nt, Salmonella enterica enterica serovar Typhi Ty2
agccagcgggcgcagucca

SEQ ID NO: 1758593 - RNA, 18 nt, Salmonella enterica enterica serovar Typhi Ty2
agccagcguuucuggaag

SEQ ID NO: 1758594 - RNA, 19 nt, Salmonella enterica enterica serovar Typhi Ty2
agccagccgccaaaaauau

SEQ ID NO: 1758595 - RNA, 15 nt, Salmonella enterica enterica serovar Typhi Ty2
agccagcccucaaca

SEQ ID NO: 1758596 - RNA, 16 nt, Salmonella enterica enterica serovar Typhi Ty2
agccagccauggcccu

SEQ ID NO: 1758597 - RNA, 13 nt, Salmonella enterica enterica serovar Typhi Ty2
agccacuauccag

SEQ ID NO: 1758598 - RNA, 15 nt, Salmonella enterica enterica serovar Typhi Ty2
agccacguucuucca

SEQ ID NO: 1758599 - RNA, 18 nt, Salmonella enterica enterica serovar Typhi Ty2
agccacguucuuccagaa

SEQ ID NO: 1758600 - RNA, 18 nt, Salmonella enterica enterica serovar Typhi Ty2
agccacugcgccauuaac

SEQ ID NO: 1758601 - RNA, 15 nt, Salmonella enterica enterica serovar Typhi Ty2
agccagaacagaagu

SEQ ID NO: 1758602 - RNA, 20 nt, Salmonella enterica enterica serovar Typhi Ty2
agccagaacgagaggaggag

SEQ ID NO: 1758603 - RNA, 13 nt, Salmonella enterica enterica serovar Typhi Ty2
agccagaagccug

SEQ ID NO: 1758604 - RNA, 13 nt, Salmonella enterica enterica serovar Typhi Ty2
agccagaacagaa

SEQ ID NO: 1758605 - RNA, 13 nt, Salmonella enterica enterica serovar Typhi Ty2
agccagacaucac

SEQ ID NO: 1758606 - RNA, 21 nt, Salmonella enterica enterica serovar Typhi Ty2
agccacuucuuccagcggcag

SEQ ID NO: 1758607 - RNA, 18 nt, Salmonella enterica enterica serovar Typhi Ty2
agccacuucaugcgcuuu

SEQ ID NO: 1758608 - RNA, 11 nt, Salmonella enterica enterica serovar Typhi Ty2
agccacuggcu

SEQ ID NO: 1758609 - RNA, 15 nt, Salmonella enterica enterica serovar Typhi Ty2
agccacgcaagcagc

SEQ ID NO: 1758610 - RNA, 18 nt, Salmonella enterica enterica serovar Typhi Ty2
agccacgcaagcagcaca

SEQ ID NO: 1758611 - RNA, 17 nt, Salmonella enterica enterica serovar Typhi Ty2
agccaccggauugccuu

SEQ ID NO: 1758612 - RNA, 18 nt, Salmonella enterica enterica serovar Typhi Ty2
agccaccgcccagagaau

SEQ ID NO: 1758613 - RNA, 22 nt, Salmonella enterica enterica serovar Typhi Ty2
agcaugugaauaugaucugcac

SEQ ID NO: 1758614 - RNA, 18 nt, Salmonella enterica enterica serovar Typhi Ty2
agcaugggcauccccaug

SEQ ID NO: 1758615 - RNA, 16 nt, Salmonella enterica enterica serovar Typhi Ty2
agcaugggcuaaagca

SEQ ID NO: 1758616 - RNA, 21 nt, Salmonella enterica enterica serovar Typhi Ty2
agcauugccguuuucaauaau

SEQ ID NO: 1758617 - RNA, 16 nt, Salmonella enterica enterica serovar Typhi Ty2
agcauuggaaauucag

SEQ ID NO: 1758618 - RNA, 18 nt, Salmonella enterica enterica serovar Typhi Ty2
agcauuggaaauucaggg

SEQ ID NO: 1758619 - RNA, 14 nt, Salmonella enterica enterica serovar Typhi Ty2
agcauucuauuguu

SEQ ID NO: 1758620 - RNA, 23 nt, Salmonella enterica enterica serovar Typhi Ty2
agcauuacccccgccauaaugca

SEQ ID NO: 1758621 - RNA, 13 nt, Salmonella enterica enterica serovar Typhi Ty2
agcauuauuuuua

SEQ ID NO: 1758622 - RNA, 16 nt, Salmonella enterica enterica serovar Typhi Ty2
agcauuaccccguggu

SEQ ID NO: 1758623 - RNA, 19 nt, Salmonella enterica enterica serovar Typhi Ty2
agcauuaccccgugguggg

SEQ ID NO: 1758624 - RNA, 17 nt, Salmonella enterica enterica serovar Typhi Ty2
agccaauccagaauacc

SEQ ID NO: 1758625 - RNA, 17 nt, Salmonella enterica enterica serovar Typhi Ty2
agccacaaucugauaau

SEQ ID NO: 1758626 - RNA, 16 nt, Salmonella enterica enterica serovar Typhi Ty2
agccacaaucugauaa

SEQ ID NO: 1758627 - RNA, 18 nt, Salmonella enterica enterica serovar Typhi Ty2
agccacacccauagcagc

SEQ ID NO: 1758628 - RNA, 22 nt, Salmonella enterica enterica serovar Typhi Ty2
agccacacugcaucgaaaucuc

SEQ ID NO: 1758629 - RNA, 14 nt, Salmonella enterica enterica serovar Typhi Ty2
agccacagcgguua

SEQ ID NO: 1758630 - RNA, 12 nt, Salmonella enterica enterica serovar Typhi Ty2
agccacccacgg

SEQ ID NO: 1758631 - RNA, 14 nt, Salmonella enterica enterica serovar Typhi Ty2
agccacauuguaug

SEQ ID NO: 1758632 - RNA, 20 nt, Salmonella enterica enterica serovar Typhi Ty2
agccacauuguaugcaagaa

SEQ ID NO: 1758633 - RNA, 17 nt, Salmonella enterica enterica serovar Typhi Ty2
agcauuuuaagaaaauu

SEQ ID NO: 1758634 - RNA, 16 nt, Salmonella enterica enterica serovar Typhi Ty2
agcauuucuucaagcg

SEQ ID NO: 1758635 - RNA, 16 nt, Salmonella enterica enterica serovar Typhi Ty2
agccaaacaauauccc

SEQ ID NO: 1758636 - RNA, 11 nt, Salmonella enterica enterica serovar Typhi Ty2
agcauuuuucc

SEQ ID NO: 1758637 - RNA, 22 nt, Salmonella enterica enterica serovar Typhi Ty2
agccaaaaauaacgcccugcgc

SEQ ID NO: 1758638 - RNA, 20 nt, Salmonella enterica enterica serovar Typhi Ty2
agccaacguauaaaauggca

SEQ ID NO: 1758639 - RNA, 13 nt, Salmonella enterica enterica serovar Typhi Ty2
agccaacccacgc

SEQ ID NO: 1758640 - RNA, 16 nt, Salmonella enterica enterica serovar Typhi Ty2
agccaacaaagaggca

SEQ ID NO: 1758641 - RNA, 15 nt, Salmonella enterica enterica serovar Typhi Ty2
agccaacacauaagc

SEQ ID NO: 1758642 - RNA, 23 nt, Salmonella enterica enterica serovar Typhi Ty2
agccaaagauuagccccagcgcc

SEQ ID NO: 1758643 - RNA, 19 nt, Salmonella enterica enterica serovar Typhi Ty2
agccaaagcgagguaaaaa

SEQ ID NO: 1758644 - RNA, 20 nt, Salmonella enterica enterica serovar Typhi Ty2
acuugauuccuggcuugcca

SEQ ID NO: 1758645 - RNA, 22 nt, Salmonella enterica enterica serovar Typhi Ty2
acuugccguuuuucucaucaag

SEQ ID NO: 1758646 - RNA, 17 nt, Salmonella enterica enterica serovar Typhi Ty2
acuugacgcuuugcauu

SEQ ID NO: 1758647 - RNA, 14 nt, Salmonella enterica enterica serovar Typhi Ty2
acuugaccagcacu

SEQ ID NO: 1758648 - RNA, 21 nt, Salmonella enterica enterica serovar Typhi Ty2
acuucuugguaccaaacagca

SEQ ID NO: 1758649 - RNA, 22 nt, Salmonella enterica enterica serovar Typhi Ty2
acuucuugguaccaaacagcag

SEQ ID NO: 1758650 - RNA, 16 nt, Salmonella enterica enterica serovar Typhi Ty2
acuucugacccaauca

SEQ ID NO: 1758651 - RNA, 15 nt, Salmonella enterica enterica serovar Typhi Ty2
acuucgcuuccugca

SEQ ID NO: 1758652 - RNA, 20 nt, Salmonella enterica enterica serovar Typhi Ty2
acuucggcaaauucuuuuca

SEQ ID NO: 1758653 - RNA, 22 nt, Salmonella enterica enterica serovar Typhi Ty2
acuuccagaccacuaacccggc

SEQ ID NO: 1758654 - RNA, 16 nt, Salmonella enterica enterica serovar Typhi Ty2
acugucaaaaauaaca

SEQ ID NO: 1758655 - RNA, 16 nt, Salmonella enterica enterica serovar Typhi Ty2
acuguauucgguggaa

SEQ ID NO: 1758656 - RNA, 21 nt, Salmonella enterica enterica serovar Typhi Ty2
acugucccagggccaaacugg

SEQ ID NO: 1758657 - RNA, 22 nt, Salmonella enterica enterica serovar Typhi Ty2
acugucccagggccaaacuggc

SEQ ID NO: 1758658 - RNA, 21 nt, Salmonella enterica enterica serovar Typhi Ty2
acugacggcgcucuuuacaua

SEQ ID NO: 1758659 - RNA, 14 nt, Salmonella enterica enterica serovar Typhi Ty2
acugacgaaaaccg

SEQ ID NO: 1758660 - RNA, 15 nt, Salmonella enterica enterica serovar Typhi Ty2
acuguaagccucgcu

SEQ ID NO: 1758661 - RNA, 14 nt, Salmonella enterica enterica serovar Typhi Ty2
acuguaaaucugcc

SEQ ID NO: 1758662 - RNA, 16 nt, Salmonella enterica enterica serovar Typhi Ty2
acugacuauccacagc

SEQ ID NO: 1758663 - RNA, 20 nt, Salmonella enterica enterica serovar Typhi Ty2
acuguagcaacugccaggcg

SEQ ID NO: 1758664 - RNA, 18 nt, Salmonella enterica enterica serovar Typhi Ty2
acuguacgcgggaaauac

SEQ ID NO: 1758665 - RNA, 20 nt, Salmonella enterica enterica serovar Typhi Ty2
acugugccgucguacucacc

SEQ ID NO: 1758666 - RNA, 13 nt, Salmonella enterica enterica serovar Typhi Ty2
acugugacgggug

SEQ ID NO: 1758667 - RNA, 21 nt, Salmonella enterica enterica serovar Typhi Ty2
acugugaggcgucuuccagca

SEQ ID NO: 1758668 - RNA, 14 nt, Salmonella enterica enterica serovar Typhi Ty2
acugucgaaaccag

SEQ ID NO: 1758669 - RNA, 18 nt, Salmonella enterica enterica serovar Typhi Ty2
acuguggugugccugcgu

SEQ ID NO: 1758670 - RNA, 16 nt, Salmonella enterica enterica serovar Typhi Ty2
acugugggauuuuugg

SEQ ID NO: 1758671 - RNA, 12 nt, Salmonella enterica enterica serovar Typhi Ty2
acuguggugugc

SEQ ID NO: 1758672 - RNA, 18 nt, Salmonella enterica enterica serovar Typhi Ty2
acugugcgucgcguucgc

SEQ ID NO: 1758673 - RNA, 15 nt, Salmonella enterica enterica serovar Typhi Ty2
acuguuugcugacaa

SEQ ID NO: 1758674 - RNA, 18 nt, Salmonella enterica enterica serovar Typhi Ty2
acuguuugucucagguau

SEQ ID NO: 1758675 - RNA, 21 nt, Salmonella enterica enterica serovar Typhi Ty2
acuguuuuaucagggaauggu

SEQ ID NO: 1758676 - RNA, 14 nt, Salmonella enterica enterica serovar Typhi Ty2
acuguuugcugaca

SEQ ID NO: 1758677 - RNA, 15 nt, Salmonella enterica enterica serovar Typhi Ty2
acuguugcaguuuac

SEQ ID NO: 1758678 - RNA, 23 nt, Salmonella enterica enterica serovar Typhi Ty2
acuguugccgacagcggaaaauc

SEQ ID NO: 1758679 - RNA, 17 nt, Salmonella enterica enterica serovar Typhi Ty2
acuuauuuuauuuuuau

SEQ ID NO: 1758680 - RNA, 16 nt, Salmonella enterica enterica serovar Typhi Ty2
acuuauugauccacgg

SEQ ID NO: 1758681 - RNA, 11 nt, Salmonella enterica enterica serovar Typhi Ty2
acuuauuucua

SEQ ID NO: 1758682 - RNA, 17 nt, Salmonella enterica enterica serovar Typhi Ty2
acuucaaaaauggcuuc

SEQ ID NO: 1758683 - RNA, 12 nt, Salmonella enterica enterica serovar Typhi Ty2
acuuacuuucuu

SEQ ID NO: 1758684 - RNA, 16 nt, Salmonella enterica enterica serovar Typhi Ty2
acuuaccgggcaucug

SEQ ID NO: 1758685 - RNA, 13 nt, Salmonella enterica enterica serovar Typhi Ty2
acuuacccagcaa

SEQ ID NO: 1758686 - RNA, 20 nt, Salmonella enterica enterica serovar Typhi Ty2
acuuuccauucgacaguucc

SEQ ID NO: 1758687 - RNA, 17 nt, Salmonella enterica enterica serovar Typhi Ty2
acuuucuugccacuggc

SEQ ID NO: 1758688 - RNA, 18 nt, Salmonella enterica enterica serovar Typhi Ty2
acuuucuugccacuggcc

SEQ ID NO: 1758689 - RNA, 21 nt, Salmonella enterica enterica serovar Typhi Ty2
acuuucuuuugauacucugcu

SEQ ID NO: 1758690 - RNA, 22 nt, Salmonella enterica enterica serovar Typhi Ty2
acuuucucggcuuuccagcuca

SEQ ID NO: 1758691 - RNA, 16 nt, Salmonella enterica enterica serovar Typhi Ty2
acuuugccaugaauaa

SEQ ID NO: 1758692 - RNA, 15 nt, Salmonella enterica enterica serovar Typhi Ty2
acuuugaccagcauc

SEQ ID NO: 1758693 - RNA, 17 nt, Salmonella enterica enterica serovar Typhi Ty2
acuuugcuuuucugcuu

SEQ ID NO: 1758694 - RNA, 15 nt, Salmonella enterica enterica serovar Typhi Ty2
acuuuuagaauuauc

SEQ ID NO: 1758695 - RNA, 20 nt, Salmonella enterica enterica serovar Typhi Ty2
acuuucauuucacuuguucu

SEQ ID NO: 1758696 - RNA, 15 nt, Salmonella enterica enterica serovar Typhi Ty2
acuuucauuccuuua

SEQ ID NO: 1758697 - RNA, 12 nt, Salmonella enterica enterica serovar Typhi Ty2
acuuucagauuu

SEQ ID NO: 1758698 - RNA, 11 nt, Salmonella enterica enterica serovar Typhi Ty2
acuuucaaaau

SEQ ID NO: 1758699 - RNA, 18 nt, Salmonella enterica enterica serovar Typhi Ty2
acuuuauuuuucgccaga

SEQ ID NO: 1758700 - RNA, 22 nt, Salmonella enterica enterica serovar Typhi Ty2
acuuuaaagcccagcacggcaa

SEQ ID NO: 1758701 - RNA, 21 nt, Salmonella enterica enterica serovar Typhi Ty2
acuuuacccacaucaaucacc

SEQ ID NO: 1758702 - RNA, 13 nt, Salmonella enterica enterica serovar Typhi Ty2
acuuguucuucug

SEQ ID NO: 1758703 - RNA, 19 nt, Salmonella enterica enterica serovar Typhi Ty2
agaaaucaacgaaaucaga

SEQ ID NO: 1758704 - RNA, 23 nt, Salmonella enterica enterica serovar Typhi Ty2
agaaauagacgagcgaaaaacug

SEQ ID NO: 1758705 - RNA, 22 nt, Salmonella enterica enterica serovar Typhi Ty2
agaaauagccgguaacuuuccc

SEQ ID NO: 1758706 - RNA, 12 nt, Salmonella enterica enterica serovar Typhi Ty2
agaaauauucag

SEQ ID NO: 1758707 - RNA, 22 nt, Salmonella enterica enterica serovar Typhi Ty2
agaaauagacgagcgaaaaacu

SEQ ID NO: 1758708 - RNA, 20 nt, Salmonella enterica enterica serovar Typhi Ty2
agaaauagaacagcuggugc

SEQ ID NO: 1758709 - RNA, 13 nt, Salmonella enterica enterica serovar Typhi Ty2
agaaauccacauu

SEQ ID NO: 1758710 - RNA, 13 nt, Salmonella enterica enterica serovar Typhi Ty2
agaaaucugaaug

SEQ ID NO: 1758711 - RNA, 22 nt, Salmonella enterica enterica serovar Typhi Ty2
agaaaucucaucugcaaaauau

SEQ ID NO: 1758712 - RNA, 15 nt, Salmonella enterica enterica serovar Typhi Ty2
agaaacaccagaaug

SEQ ID NO: 1758713 - RNA, 14 nt, Salmonella enterica enterica serovar Typhi Ty2
agaaauaaaauacg

SEQ ID NO: 1758714 - RNA, 12 nt, Salmonella enterica enterica serovar Typhi Ty2
agaaauaaaaua

SEQ ID NO: 1758715 - RNA, 22 nt, Salmonella enterica enterica serovar Typhi Ty2
agaaauaaaauacgcucaauau

SEQ ID NO: 1758716 - RNA, 14 nt, Salmonella enterica enterica serovar Typhi Ty2
agaaauaaaaccag

SEQ ID NO: 1758717 - RNA, 22 nt, Salmonella enterica enterica serovar Typhi Ty2
agaaagauaaaauacgugcgga

SEQ ID NO: 1758718 - RNA, 13 nt, Salmonella enterica enterica serovar Typhi Ty2
agaaacaacacga

SEQ ID NO: 1758719 - RNA, 18 nt, Salmonella enterica enterica serovar Typhi Ty2
agaaacaauccguuauuu

SEQ ID NO: 1758720 - RNA, 19 nt, Salmonella enterica enterica serovar Typhi Ty2
agaaaauagaggaaauaac

SEQ ID NO: 1758721 - RNA, 21 nt, Salmonella enterica enterica serovar Typhi Ty2
agaaaauaacaauauuaaaua

SEQ ID NO: 1758722 - RNA, 12 nt, Salmonella enterica enterica serovar Typhi Ty2
agaaaauaacaa

SEQ ID NO: 1758723 - RNA, 15 nt, Salmonella enterica enterica serovar Typhi Ty2
agaaaauaacaauau

SEQ ID NO: 1758724 - RNA, 20 nt, Salmonella enterica enterica serovar Typhi Ty2
agaaaauaauucuuaaccca

SEQ ID NO: 1758725 - RNA, 19 nt, Salmonella enterica enterica serovar Typhi Ty2
agaaaacuuucauuucacu

SEQ ID NO: 1758726 - RNA, 16 nt, Salmonella enterica enterica serovar Typhi Ty2
agaaaagcgaaaauaa

SEQ ID NO: 1758727 - RNA, 18 nt, Salmonella enterica enterica serovar Typhi Ty2
agaaaaccgacagcaaua

SEQ ID NO: 1758728 - RNA, 19 nt, Salmonella enterica enterica serovar Typhi Ty2
agaaaaccgacagcaauau

SEQ ID NO: 1758729 - RNA, 22 nt, Salmonella enterica enterica serovar Typhi Ty2
agaaaaagaccgacaucgccag

SEQ ID NO: 1758730 - RNA, 23 nt, Salmonella enterica enterica serovar Typhi Ty2
agaaaacagcaugguguuaguuu

SEQ ID NO: 1758731 - RNA, 12 nt, Salmonella enterica enterica serovar Typhi Ty2
agaaaaaauuaa

SEQ ID NO: 1758732 - RNA, 15 nt, Salmonella enterica enterica serovar Typhi Ty2
agaaaaaauuaaaaa

SEQ ID NO: 1758733 - RNA, 18 nt, Salmonella enterica enterica serovar Typhi Ty2
agaaaaaacucaggaaau

SEQ ID NO: 1758734 - RNA, 15 nt, Salmonella enterica enterica serovar Typhi Ty2
agaaaaaacuggugc

SEQ ID NO: 1758735 - RNA, 21 nt, Salmonella enterica enterica serovar Typhi Ty2
agagcauuuguagcggcaaca

SEQ ID NO: 1758736 - RNA, 14 nt, Salmonella enterica enterica serovar Typhi Ty2
agagcauccgcagc

SEQ ID NO: 1758737 - RNA, 14 nt, Salmonella enterica enterica serovar Typhi Ty2
agagcaucaucugc

SEQ ID NO: 1758738 - RNA, 19 nt, Salmonella enterica enterica serovar Typhi Ty2
agagcagcgccagcgacag

SEQ ID NO: 1758739 - RNA, 18 nt, Salmonella enterica enterica serovar Typhi Ty2
agagcaguuuuacgugga

SEQ ID NO: 1758740 - RNA, 18 nt, Salmonella enterica enterica serovar Typhi Ty2
agagcauaugcgcugcga

SEQ ID NO: 1758741 - RNA, 17 nt, Salmonella enterica enterica serovar Typhi Ty2
agagcaucaauggugaa

SEQ ID NO: 1758742 - RNA, 22 nt, Salmonella enterica enterica serovar Typhi Ty2
agagcggauaagcgcagcgcca

SEQ ID NO: 1758743 - RNA, 17 nt, Salmonella enterica enterica serovar Typhi Ty2
agagcucgaccaacaua

SEQ ID NO: 1758744 - RNA, 19 nt, Salmonella enterica enterica serovar Typhi Ty2
agagcuaaucaauaaguuu

SEQ ID NO: 1758745 - RNA, 20 nt, Salmonella enterica enterica serovar Typhi Ty2
agagcuaaucaauaaguuuu

SEQ ID NO: 1758746 - RNA, 20 nt, Salmonella enterica enterica serovar Typhi Ty2
agaggcgccgacuuuacggc

SEQ ID NO: 1758747 - RNA, 23 nt, Salmonella enterica enterica serovar Typhi Ty2
agaggaucuggacgccaauuccu

SEQ ID NO: 1758748 - RNA, 11 nt, Salmonella enterica enterica serovar Typhi Ty2
agaggcagcaa

SEQ ID NO: 1758749 - RNA, 20 nt, Salmonella enterica enterica serovar Typhi Ty2
agagguuccccagccgcuuu

SEQ ID NO: 1758750 - RNA, 18 nt, Salmonella enterica enterica serovar Typhi Ty2
agagguguuauggcaggc

SEQ ID NO: 1758751 - RNA, 20 nt, Salmonella enterica enterica serovar Typhi Ty2
agagguguuauggcaggcga

SEQ ID NO: 1758752 - RNA, 18 nt, Salmonella enterica enterica serovar Typhi Ty2
agaguucacguagcucaa

SEQ ID NO: 1758753 - RNA, 24 nt, Salmonella enterica enterica serovar Typhi Ty2
agaguucauaacgcacaacgucag

SEQ ID NO: 1758754 - RNA, 16 nt, Salmonella enterica enterica serovar Typhi Ty2
agaguguccauaaagu

SEQ ID NO: 1758755 - RNA, 20 nt, Salmonella enterica enterica serovar Typhi Ty2
agauaaaguacggcgcgcca

SEQ ID NO: 1758756 - RNA, 15 nt, Salmonella enterica enterica serovar Typhi Ty2
agauaaacagcagcg

SEQ ID NO: 1758757 - RNA, 12 nt, Salmonella enterica enterica serovar Typhi Ty2
agauaagaucuu

SEQ ID NO: 1758758 - RNA, 15 nt, Salmonella enterica enterica serovar Typhi Ty2
agauaacgcaucaga

SEQ ID NO: 1758759 - RNA, 22 nt, Salmonella enterica enterica serovar Typhi Ty2
agauaaccgucggcgccggcgu

SEQ ID NO: 1758760 - RNA, 13 nt, Salmonella enterica enterica serovar Typhi Ty2
agauaaaucagcc

SEQ ID NO: 1758761 - RNA, 12 nt, Salmonella enterica enterica serovar Typhi Ty2
agagaacagcau

SEQ ID NO: 1758762 - RNA, 21 nt, Salmonella enterica enterica serovar Typhi Ty2
agagaaccaacgcauaaaaac

SEQ ID NO: 1758763 - RNA, 20 nt, Salmonella enterica enterica serovar Typhi Ty2
agagaaccugaacaauaauc

SEQ ID NO: 1758764 - RNA, 18 nt, Salmonella enterica enterica serovar Typhi Ty2
agagaaccugaacaauaa

SEQ ID NO: 1758765 - RNA, 15 nt, Salmonella enterica enterica serovar Typhi Ty2
agagaaccaacguca

SEQ ID NO: 1758766 - RNA, 12 nt, Salmonella enterica enterica serovar Typhi Ty2
agagaaccguuc

SEQ ID NO: 1758767 - RNA, 14 nt, Salmonella enterica enterica serovar Typhi Ty2
agagaaccugaaca

SEQ ID NO: 1758768 - RNA, 23 nt, Salmonella enterica enterica serovar Typhi Ty2
agagaacguugccgcaggcaacg

SEQ ID NO: 1758769 - RNA, 23 nt, Salmonella enterica enterica serovar Typhi Ty2
agagaacgacgcauaaaaaauga

SEQ ID NO: 1758770 - RNA, 16 nt, Salmonella enterica enterica serovar Typhi Ty2
agagaaccugaacaau

SEQ ID NO: 1758771 - RNA, 17 nt, Salmonella enterica enterica serovar Typhi Ty2
agagaauggccagcaca

SEQ ID NO: 1758772 - RNA, 15 nt, Salmonella enterica enterica serovar Typhi Ty2
agagaauaacgauga

SEQ ID NO: 1758773 - RNA, 19 nt, Salmonella enterica enterica serovar Typhi Ty2
agagaauaacgaugaugaa

SEQ ID NO: 1758774 - RNA, 11 nt, Salmonella enterica enterica serovar Typhi Ty2
agagaaaaaaa

SEQ ID NO: 1758775 - RNA, 12 nt, Salmonella enterica enterica serovar Typhi Ty2
agagaaaaaaau

SEQ ID NO: 1758776 - RNA, 18 nt, Salmonella enterica enterica serovar Typhi Ty2
agagaaaauaacaauauu

SEQ ID NO: 1758777 - RNA, 15 nt, Salmonella enterica enterica serovar Typhi Ty2
agagaaacaacaccg

SEQ ID NO: 1758778 - RNA, 14 nt, Salmonella enterica enterica serovar Typhi Ty2
agagaaagcgcuga

SEQ ID NO: 1758779 - RNA, 16 nt, Salmonella enterica enterica serovar Typhi Ty2
agacuuuccagcacga

SEQ ID NO: 1758780 - RNA, 13 nt, Salmonella enterica enterica serovar Typhi Ty2
agacuucuuccau

SEQ ID NO: 1758781 - RNA, 13 nt, Salmonella enterica enterica serovar Typhi Ty2
agacugauaucca

SEQ ID NO: 1758782 - RNA, 16 nt, Salmonella enterica enterica serovar Typhi Ty2
agacugauauccauug

SEQ ID NO: 1758783 - RNA, 22 nt, Salmonella enterica enterica serovar Typhi Ty2
agacucgcuucacgcggauugc

SEQ ID NO: 1758784 - RNA, 22 nt, Salmonella enterica enterica serovar Typhi Ty2
agacuggguaagcgcagcgcca

SEQ ID NO: 1758785 - RNA, 14 nt, Salmonella enterica enterica serovar Typhi Ty2
agacuuagcccugg

SEQ ID NO: 1758786 - RNA, 18 nt, Salmonella enterica enterica serovar Typhi Ty2
agacuuaggaaugcccag

SEQ ID NO: 1758787 - RNA, 21 nt, Salmonella enterica enterica serovar Typhi Ty2
agacuguugaaagccccggcu

SEQ ID NO: 1758788 - RNA, 12 nt, Salmonella enterica enterica serovar Typhi Ty2
agacuggaugga

SEQ ID NO: 1758789 - RNA, 14 nt, Salmonella enterica enterica serovar Typhi Ty2
agacugcuccggca

SEQ ID NO: 1758790 - RNA, 13 nt, Salmonella enterica enterica serovar Typhi Ty2
agacugcccggca

SEQ ID NO: 1758791 - RNA, 21 nt, Salmonella enterica enterica serovar Typhi Ty2
agacugcacuuccugcgucag

SEQ ID NO: 1758792 - RNA, 17 nt, Salmonella enterica enterica serovar Typhi Ty2
agacugcacuuccugcg

SEQ ID NO: 1758793 - RNA, 18 nt, Salmonella enterica enterica serovar Typhi Ty2
agacucaucgccgcaaug

SEQ ID NO: 1758794 - RNA, 13 nt, Salmonella enterica enterica serovar Typhi Ty2
agacucagcagcg

SEQ ID NO: 1758795 - RNA, 18 nt, Salmonella enterica enterica serovar Typhi Ty2
agacucagccaggucugc

SEQ ID NO: 1758796 - RNA, 16 nt, Salmonella enterica enterica serovar Typhi Ty2
agacucagcgacugaa

SEQ ID NO: 1758797 - RNA, 12 nt, Salmonella enterica enterica serovar Typhi Ty2
agacucaucgcc

SEQ ID NO: 1758798 - RNA, 19 nt, Salmonella enterica enterica serovar Typhi Ty2
agacgcuuacaucgccauc

SEQ ID NO: 1758799 - RNA, 18 nt, Salmonella enterica enterica serovar Typhi Ty2
agacgcuggcacuggcag

SEQ ID NO: 1758800 - RNA, 19 nt, Salmonella enterica enterica serovar Typhi Ty2
agacgcuggcacuggcagc

SEQ ID NO: 1758801 - RNA, 18 nt, Salmonella enterica enterica serovar Typhi Ty2
agacucaccccuucuuua

SEQ ID NO: 1758802 - RNA, 21 nt, Salmonella enterica enterica serovar Typhi Ty2
agacgcuucauaucgcccagc

SEQ ID NO: 1758803 - RNA, 19 nt, Salmonella enterica enterica serovar Typhi Ty2
agacgcuccgcaguaauca

SEQ ID NO: 1758804 - RNA, 16 nt, Salmonella enterica enterica serovar Typhi Ty2
agacgcguaaaucaga

SEQ ID NO: 1758805 - RNA, 18 nt, Salmonella enterica enterica serovar Typhi Ty2
agacgccgcgcugcggcg

SEQ ID NO: 1758806 - RNA, 14 nt, Salmonella enterica enterica serovar Typhi Ty2
agacgcgcagcacc

SEQ ID NO: 1758807 - RNA, 20 nt, Salmonella enterica enterica serovar Typhi Ty2
agacgccgaaccuggcgggc

SEQ ID NO: 1758808 - RNA, 18 nt, Salmonella enterica enterica serovar Typhi Ty2
agacgcccugcaaagcaa

SEQ ID NO: 1758809 - RNA, 22 nt, Salmonella enterica enterica serovar Typhi Ty2
agacgcccugcaaagcaaaaau

SEQ ID NO: 1758810 - RNA, 15 nt, Salmonella enterica enterica serovar Typhi Ty2
agacaugaucuuacc

SEQ ID NO: 1758811 - RNA, 19 nt, Salmonella enterica enterica serovar Typhi Ty2
agacaugaccgcacagcag

SEQ ID NO: 1758812 - RNA, 19 nt, Salmonella enterica enterica serovar Typhi Ty2
agacauugguuucaugcau

SEQ ID NO: 1758813 - RNA, 15 nt, Salmonella enterica enterica serovar Typhi Ty2
agacauucgcgcacg

SEQ ID NO: 1758814 - RNA, 12 nt, Salmonella enterica enterica serovar Typhi Ty2
agaccaauacga

SEQ ID NO: 1758815 - RNA, 14 nt, Salmonella enterica enterica serovar Typhi Ty2
agaccgacaaaacu

SEQ ID NO: 1758816 - RNA, 20 nt, Salmonella enterica enterica serovar Typhi Ty2
agacgcaucuuuuucccggu

SEQ ID NO: 1758817 - RNA, 22 nt, Salmonella enterica enterica serovar Typhi Ty2
agacgccaacgucgacagacgc

SEQ ID NO: 1758818 - RNA, 18 nt, Salmonella enterica enterica serovar Typhi Ty2
agaccuuuuacuucacgu

SEQ ID NO: 1758819 - RNA, 16 nt, Salmonella enterica enterica serovar Typhi Ty2
agaccggcgaaaucgu

SEQ ID NO: 1758820 - RNA, 17 nt, Salmonella enterica enterica serovar Typhi Ty2
agaccggcaucucaucu

SEQ ID NO: 1758821 - RNA, 15 nt, Salmonella enterica enterica serovar Typhi Ty2
agaccggcagccugc

SEQ ID NO: 1758822 - RNA, 12 nt, Salmonella enterica enterica serovar Typhi Ty2
agaccggcacaa

SEQ ID NO: 1758823 - RNA, 18 nt, Salmonella enterica enterica serovar Typhi Ty2
agaccggcaaucaauaca

SEQ ID NO: 1758824 - RNA, 18 nt, Salmonella enterica enterica serovar Typhi Ty2
agaccggaugauggccug

SEQ ID NO: 1758825 - RNA, 20 nt, Salmonella enterica enterica serovar Typhi Ty2
agaccgcugcggaacaccag

SEQ ID NO: 1758826 - RNA, 16 nt, Salmonella enterica enterica serovar Typhi Ty2
agaccgccuaacagcg

SEQ ID NO: 1758827 - RNA, 23 nt, Salmonella enterica enterica serovar Typhi Ty2
agaccgccgcuuucaaaaccgac

SEQ ID NO: 1758828 - RNA, 14 nt, Salmonella enterica enterica serovar Typhi Ty2
agaccgacgccaac

SEQ ID NO: 1758829 - RNA, 13 nt, Salmonella enterica enterica serovar Typhi Ty2
agaccgauaaaua

SEQ ID NO: 1758830 - RNA, 16 nt, Salmonella enterica enterica serovar Typhi Ty2
agacagcauuuuucac

SEQ ID NO: 1758831 - RNA, 19 nt, Salmonella enterica enterica serovar Typhi Ty2
agacagcccuauaacagcg

SEQ ID NO: 1758832 - RNA, 17 nt, Salmonella enterica enterica serovar Typhi Ty2
agacaggccagaauuca

SEQ ID NO: 1758833 - RNA, 19 nt, Salmonella enterica enterica serovar Typhi Ty2
agacaguacggaugaugua

SEQ ID NO: 1758834 - RNA, 21 nt, Salmonella enterica enterica serovar Typhi Ty2
agacaucggagauuucauccu

SEQ ID NO: 1758835 - RNA, 12 nt, Salmonella enterica enterica serovar Typhi Ty2
agacaugaccgc

SEQ ID NO: 1758836 - RNA, 14 nt, Salmonella enterica enterica serovar Typhi Ty2
agacaccccagccu

SEQ ID NO: 1758837 - RNA, 21 nt, Salmonella enterica enterica serovar Typhi Ty2
agacacaacgugccagaaaca

SEQ ID NO: 1758838 - RNA, 18 nt, Salmonella enterica enterica serovar Typhi Ty2
agacacaauauugcugug

SEQ ID NO: 1758839 - RNA, 14 nt, Salmonella enterica enterica serovar Typhi Ty2
agacagaucgguuu

SEQ ID NO: 1758840 - RNA, 18 nt, Salmonella enterica enterica serovar Typhi Ty2
agaauuuguuuaugccgg

SEQ ID NO: 1758841 - RNA, 11 nt, Salmonella enterica enterica serovar Typhi Ty2
agacaaauaac

SEQ ID NO: 1758842 - RNA, 15 nt, Salmonella enterica enterica serovar Typhi Ty2
agacaaaguugacuu

SEQ ID NO: 1758843 - RNA, 18 nt, Salmonella enterica enterica serovar Typhi Ty2
agacaaaauucagacuca

SEQ ID NO: 1758844 - RNA, 20 nt, Salmonella enterica enterica serovar Typhi Ty2
agaagggcaggggaaagcug

SEQ ID NO: 1758845 - RNA, 16 nt, Salmonella enterica enterica serovar Typhi Ty2
agaagugccaguaacu

SEQ ID NO: 1758846 - RNA, 14 nt, Salmonella enterica enterica serovar Typhi Ty2
agaagucugugaga

SEQ ID NO: 1758847 - RNA, 22 nt, Salmonella enterica enterica serovar Typhi Ty2
agaagucugugagaaaagcgaa

SEQ ID NO: 1758848 - RNA, 17 nt, Salmonella enterica enterica serovar Typhi Ty2
agaagcgccugucuauu

SEQ ID NO: 1758849 - RNA, 18 nt, Salmonella enterica enterica serovar Typhi Ty2
agaaauucgcagcgcagg

SEQ ID NO: 1758850 - RNA, 17 nt, Salmonella enterica enterica serovar Typhi Ty2
agaaauguccauaaaua

SEQ ID NO: 1758851 - RNA, 12 nt, Salmonella enterica enterica serovar Typhi Ty2
agaauaugccag

SEQ ID NO: 1758852 - RNA, 13 nt, Salmonella enterica enterica serovar Typhi Ty2
agaauaugccagg

SEQ ID NO: 1758853 - RNA, 14 nt, Salmonella enterica enterica serovar Typhi Ty2
agaauaugcagugc

SEQ ID NO: 1758854 - RNA, 22 nt, Salmonella enterica enterica serovar Typhi Ty2
agaaucauuaauacacugcgua

SEQ ID NO: 1758855 - RNA, 17 nt, Salmonella enterica enterica serovar Typhi Ty2
agaauguguucucccug

SEQ ID NO: 1758856 - RNA, 14 nt, Salmonella enterica enterica serovar Typhi Ty2
agaauguccccaua

SEQ ID NO: 1758857 - RNA, 13 nt, Salmonella enterica enterica serovar Typhi Ty2
agaaugcccugcu

SEQ ID NO: 1758858 - RNA, 15 nt, Salmonella enterica enterica serovar Typhi Ty2
agaaugcccagcaag

SEQ ID NO: 1758859 - RNA, 18 nt, Salmonella enterica enterica serovar Typhi Ty2
agaaugcgagcaaaaccc

SEQ ID NO: 1758860 - RNA, 15 nt, Salmonella enterica enterica serovar Typhi Ty2
agaaugaccagccga

SEQ ID NO: 1758861 - RNA, 21 nt, Salmonella enterica enterica serovar Typhi Ty2
agaauaacgaugaugaaaaag

SEQ ID NO: 1758862 - RNA, 14 nt, Salmonella enterica enterica serovar Typhi Ty2
agaauaaaacagcu

SEQ ID NO: 1758863 - RNA, 18 nt, Salmonella enterica enterica serovar Typhi Ty2
agaauauaguuagaaaau

SEQ ID NO: 1758864 - RNA, 17 nt, Salmonella enterica enterica serovar Typhi Ty2
agaauagcgucaauaau

SEQ ID NO: 1758865 - RNA, 16 nt, Salmonella enterica enterica serovar Typhi Ty2
agaauaggaaauaauu

SEQ ID NO: 1758866 - RNA, 20 nt, Salmonella enterica enterica serovar Typhi Ty2
agaauagccggauaaaauua

SEQ ID NO: 1758867 - RNA, 13 nt, Salmonella enterica enterica serovar Typhi Ty2
agaauaacucagc

SEQ ID NO: 1758868 - RNA, 23 nt, Salmonella enterica enterica serovar Typhi Ty2
acggcaguguuucccaacaaugc

SEQ ID NO: 1758869 - RNA, 15 nt, Salmonella enterica enterica serovar Typhi Ty2
acggcauaagccagu

SEQ ID NO: 1758870 - RNA, 20 nt, Salmonella enterica enterica serovar Typhi Ty2
acggcaggcccgauaaacgg

SEQ ID NO: 1758871 - RNA, 13 nt, Salmonella enterica enterica serovar Typhi Ty2
acggcaucaggaa

SEQ ID NO: 1758872 - RNA, 22 nt, Salmonella enterica enterica serovar Typhi Ty2
acggcgcacacgaaauccaaac

SEQ ID NO: 1758873 - RNA, 20 nt, Salmonella enterica enterica serovar Typhi Ty2
acggcgcgccaauaaagcuu

SEQ ID NO: 1758874 - RNA, 23 nt, Salmonella enterica enterica serovar Typhi Ty2
acggcgcagauauuuuccaucac

SEQ ID NO: 1758875 - RNA, 18 nt, Salmonella enterica enterica serovar Typhi Ty2
acggcguaccagaaugcc

SEQ ID NO: 1758876 - RNA, 16 nt, Salmonella enterica enterica serovar Typhi Ty2
acggcguaagcgcuau

SEQ ID NO: 1758877 - RNA, 22 nt, Salmonella enterica enterica serovar Typhi Ty2
acggcgcuccugucaggcgagc

SEQ ID NO: 1758878 - RNA, 22 nt, Salmonella enterica enterica serovar Typhi Ty2
acggcugccuuuguacagcuug

SEQ ID NO: 1758879 - RNA, 20 nt, Salmonella enterica enterica serovar Typhi Ty2
acggcuuuccagcagccaga

SEQ ID NO: 1758880 - RNA, 20 nt, Salmonella enterica enterica serovar Typhi Ty2
acggcuuucuuucuccagcg

SEQ ID NO: 1758881 - RNA, 19 nt, Salmonella enterica enterica serovar Typhi Ty2
acggcugcacaaaauacug

SEQ ID NO: 1758882 - RNA, 23 nt, Salmonella enterica enterica serovar Typhi Ty2
acggcuauuccucgaucgccugg

SEQ ID NO: 1758883 - RNA, 13 nt, Salmonella enterica enterica serovar Typhi Ty2
acggcuccuuuuu

SEQ ID NO: 1758884 - RNA, 23 nt, Salmonella enterica enterica serovar Typhi Ty2
acggcuacuuguugucaaaaucg

SEQ ID NO: 1758885 - RNA, 19 nt, Salmonella enterica enterica serovar Typhi Ty2
acgcuuucuucccuccccu

SEQ ID NO: 1758886 - RNA, 21 nt, Salmonella enterica enterica serovar Typhi Ty2
acgcuuugcgauagcccggca

SEQ ID NO: 1758887 - RNA, 17 nt, Salmonella enterica enterica serovar Typhi Ty2
acgcuuuguacagacaa

SEQ ID NO: 1758888 - RNA, 23 nt, Salmonella enterica enterica serovar Typhi Ty2
acgcuuuauucugucgccaccac

SEQ ID NO: 1758889 - RNA, 21 nt, Salmonella enterica enterica serovar Typhi Ty2
acgcuuuccaguugcggcauc

SEQ ID NO: 1758890 - RNA, 16 nt, Salmonella enterica enterica serovar Typhi Ty2
acggaggugccagaga

SEQ ID NO: 1758891 - RNA, 21 nt, Salmonella enterica enterica serovar Typhi Ty2
acggagauuaacagcgcgacc

SEQ ID NO: 1758892 - RNA, 23 nt, Salmonella enterica enterica serovar Typhi Ty2
acggagcauaauuuuccugucgu

SEQ ID NO: 1758893 - RNA, 17 nt, Salmonella enterica enterica serovar Typhi Ty2
acggagagacaguucag

SEQ ID NO: 1758894 - RNA, 22 nt, Salmonella enterica enterica serovar Typhi Ty2
acggacuugaucgugccguccg

SEQ ID NO: 1758895 - RNA, 20 nt, Salmonella enterica enterica serovar Typhi Ty2
acggaguuggaaccaaacac

SEQ ID NO: 1758896 - RNA, 12 nt, Salmonella enterica enterica serovar Typhi Ty2
acggauaaaaac

SEQ ID NO: 1758897 - RNA, 22 nt, Salmonella enterica enterica serovar Typhi Ty2
acggagugcgcggcgaaaaagc

SEQ ID NO: 1758898 - RNA, 19 nt, Salmonella enterica enterica serovar Typhi Ty2
acggauacgcugcgucagg

SEQ ID NO: 1758899 - RNA, 20 nt, Salmonella enterica enterica serovar Typhi Ty2
acggcaccggaaccggcauc

SEQ ID NO: 1758900 - RNA, 21 nt, Salmonella enterica enterica serovar Typhi Ty2
acggcagccgccaccacaaag

SEQ ID NO: 1758901 - RNA, 16 nt, Salmonella enterica enterica serovar Typhi Ty2
acgcuucagagcaggu

SEQ ID NO: 1758902 - RNA, 20 nt, Salmonella enterica enterica serovar Typhi Ty2
acgcuuccggcgaggcguaa

SEQ ID NO: 1758903 - RNA, 14 nt, Salmonella enterica enterica serovar Typhi Ty2
acgcuucugcgccg

SEQ ID NO: 1758904 - RNA, 15 nt, Salmonella enterica enterica serovar Typhi Ty2
acgcuucagagcagg

SEQ ID NO: 1758905 - RNA, 21 nt, Salmonella enterica enterica serovar Typhi Ty2
acgcuugcaugaccauccacg

SEQ ID NO: 1758906 - RNA, 15 nt, Salmonella enterica enterica serovar Typhi Ty2
acgcugaugaaaacc

SEQ ID NO: 1758907 - RNA, 21 nt, Salmonella enterica enterica serovar Typhi Ty2
acgcugcaaaguuauuacauu

SEQ ID NO: 1758908 - RNA, 18 nt, Salmonella enterica enterica serovar Typhi Ty2
acgcugagagaacugcga

SEQ ID NO: 1758909 - RNA, 16 nt, Salmonella enterica enterica serovar Typhi Ty2
acgcuuaucccagccg

SEQ ID NO: 1758910 - RNA, 14 nt, Salmonella enterica enterica serovar Typhi Ty2
acgcuuaucccagc

SEQ ID NO: 1758911 - RNA, 15 nt, Salmonella enterica enterica serovar Typhi Ty2
acgcugcggccugcc

SEQ ID NO: 1758912 - RNA, 15 nt, Salmonella enterica enterica serovar Typhi Ty2
acgcugcgccgcgcc

SEQ ID NO: 1758913 - RNA, 15 nt, Salmonella enterica enterica serovar Typhi Ty2
acgcgaugccaguag

SEQ ID NO: 1758914 - RNA, 15 nt, Salmonella enterica enterica serovar Typhi Ty2
acgcgaugagauaau

SEQ ID NO: 1758915 - RNA, 21 nt, Salmonella enterica enterica serovar Typhi Ty2
acgcgauacacuccggcgcgc

SEQ ID NO: 1758916 - RNA, 21 nt, Salmonella enterica enterica serovar Typhi Ty2
acgcgcaaaacucucaccgac

SEQ ID NO: 1758917 - RNA, 21 nt, Salmonella enterica enterica serovar Typhi Ty2
acgcgagaagaagaauuauua

SEQ ID NO: 1758918 - RNA, 16 nt, Salmonella enterica enterica serovar Typhi Ty2
acgcgacgcgccagcc

SEQ ID NO: 1758919 - RNA, 19 nt, Salmonella enterica enterica serovar Typhi Ty2
acgcgacucccaggcgcgc

SEQ ID NO: 1758920 - RNA, 20 nt, Salmonella enterica enterica serovar Typhi Ty2
acgcgauaaaaacccaccag

SEQ ID NO: 1758921 - RNA, 22 nt, Salmonella enterica enterica serovar Typhi Ty2
acgcgagcugccaguucauucc

SEQ ID NO: 1758922 - RNA, 13 nt, Salmonella enterica enterica serovar Typhi Ty2
acgcgccagccag

SEQ ID NO: 1758923 - RNA, 15 nt, Salmonella enterica enterica serovar Typhi Ty2
acgcgccagccagcg

SEQ ID NO: 1758924 - RNA, 18 nt, Salmonella enterica enterica serovar Typhi Ty2
acgcgccgccagcgacuu

SEQ ID NO: 1758925 - RNA, 14 nt, Salmonella enterica enterica serovar Typhi Ty2
acgcgccggaaggc

SEQ ID NO: 1758926 - RNA, 17 nt, Salmonella enterica enterica serovar Typhi Ty2
acgcgcccucugagcug

SEQ ID NO: 1758927 - RNA, 20 nt, Salmonella enterica enterica serovar Typhi Ty2
acgcgccacuuccagcgcgc

SEQ ID NO: 1758928 - RNA, 15 nt, Salmonella enterica enterica serovar Typhi Ty2
acgcgcaucuucacu

SEQ ID NO: 1758929 - RNA, 20 nt, Salmonella enterica enterica serovar Typhi Ty2
acgcgcagcaucucauccac

SEQ ID NO: 1758930 - RNA, 14 nt, Salmonella enterica enterica serovar Typhi Ty2
acgcgcuaaaugca

SEQ ID NO: 1758931 - RNA, 16 nt, Salmonella enterica enterica serovar Typhi Ty2
acgcgcggcuacugcc

SEQ ID NO: 1758932 - RNA, 20 nt, Salmonella enterica enterica serovar Typhi Ty2
acgcgcgccugccgccagca

SEQ ID NO: 1758933 - RNA, 13 nt, Salmonella enterica enterica serovar Typhi Ty2
acgcgcgcccugc

SEQ ID NO: 1758934 - RNA, 23 nt, Salmonella enterica enterica serovar Typhi Ty2
acgcgcgccggugaucccaccag

SEQ ID NO: 1758935 - RNA, 23 nt, Salmonella enterica enterica serovar Typhi Ty2
acgcgccugcucccgcugcggcg

SEQ ID NO: 1758936 - RNA, 18 nt, Salmonella enterica enterica serovar Typhi Ty2
acgcgccuggaucugcgc

SEQ ID NO: 1758937 - RNA, 20 nt, Salmonella enterica enterica serovar Typhi Ty2
acgcgcuuuuucuuccguca

SEQ ID NO: 1758938 - RNA, 15 nt, Salmonella enterica enterica serovar Typhi Ty2
acgcgcucgccagcg

SEQ ID NO: 1758939 - RNA, 14 nt, Salmonella enterica enterica serovar Typhi Ty2
acgcggaucggcac

SEQ ID NO: 1758940 - RNA, 14 nt, Salmonella enterica enterica serovar Typhi Ty2
acgcggaagaaaua

SEQ ID NO: 1758941 - RNA, 18 nt, Salmonella enterica enterica serovar Typhi Ty2
acgcggcaucaagcauaa

SEQ ID NO: 1758942 - RNA, 17 nt, Salmonella enterica enterica serovar Typhi Ty2
acgcggcaucaggcaua

SEQ ID NO: 1758943 - RNA, 18 nt, Salmonella enterica enterica serovar Typhi Ty2
acgcggcuaaucagggua

SEQ ID NO: 1758944 - RNA, 16 nt, Salmonella enterica enterica serovar Typhi Ty2
acgcggguacgggacg

SEQ ID NO: 1758945 - RNA, 15 nt, Salmonella enterica enterica serovar Typhi Ty2
acgcgguacccaccu

SEQ ID NO: 1758946 - RNA, 16 nt, Salmonella enterica enterica serovar Typhi Ty2
acgcgguaugauuaua

SEQ ID NO: 1758947 - RNA, 15 nt, Salmonella enterica enterica serovar Typhi Ty2
acgcggucaggguga

SEQ ID NO: 1758948 - RNA, 15 nt, Salmonella enterica enterica serovar Typhi Ty2
acgcugaccacgccg

SEQ ID NO: 1758949 - RNA, 19 nt, Salmonella enterica enterica serovar Typhi Ty2
acgcugaccacgccgccgc

SEQ ID NO: 1758950 - RNA, 14 nt, Salmonella enterica enterica serovar Typhi Ty2
acgcucgcugaugg

SEQ ID NO: 1758951 - RNA, 19 nt, Salmonella enterica enterica serovar Typhi Ty2
acgcucgcugauggcgaga

SEQ ID NO: 1758952 - RNA, 16 nt, Salmonella enterica enterica serovar Typhi Ty2
acgcucgaguucuuca

SEQ ID NO: 1758953 - RNA, 19 nt, Salmonella enterica enterica serovar Typhi Ty2
acgcucgaguucuucacgc

SEQ ID NO: 1758954 - RNA, 22 nt, Salmonella enterica enterica serovar Typhi Ty2
acgcuccgguuuuugcgcgcug

SEQ ID NO: 1758955 - RNA, 16 nt, Salmonella enterica enterica serovar Typhi Ty2
acgcuaaaaaaggcag

SEQ ID NO: 1758956 - RNA, 22 nt, Salmonella enterica enterica serovar Typhi Ty2
acgcgucagugaauauccccug

SEQ ID NO: 1758957 - RNA, 15 nt, Salmonella enterica enterica serovar Typhi Ty2
acgcucaaccgguuu

SEQ ID NO: 1758958 - RNA, 23 nt, Salmonella enterica enterica serovar Typhi Ty2
acgcucacgcagauauucauuga

SEQ ID NO: 1758959 - RNA, 22 nt, Salmonella enterica enterica serovar Typhi Ty2
acgcuaccgucgccgacaacgc

SEQ ID NO: 1758960 - RNA, 16 nt, Salmonella enterica enterica serovar Typhi Ty2
acgcuaaaccacauga

SEQ ID NO: 1758961 - RNA, 23 nt, Salmonella enterica enterica serovar Typhi Ty2
acgcuaaucccgcucgccaggug

SEQ ID NO: 1758962 - RNA, 19 nt, Salmonella enterica enterica serovar Typhi Ty2
acgccagucuuugcaggag

SEQ ID NO: 1758963 - RNA, 18 nt, Salmonella enterica enterica serovar Typhi Ty2
acgccaggguaauacugg

SEQ ID NO: 1758964 - RNA, 14 nt, Salmonella enterica enterica serovar Typhi Ty2
acgccaucaacagc

SEQ ID NO: 1758965 - RNA, 15 nt, Salmonella enterica enterica serovar Typhi Ty2
acgccauggccgcag

SEQ ID NO: 1758966 - RNA, 20 nt, Salmonella enterica enterica serovar Typhi Ty2
acgccaugcucauccaacug

SEQ ID NO: 1758967 - RNA, 22 nt, Salmonella enterica enterica serovar Typhi Ty2
acgccauuaucgaacugaaaug

SEQ ID NO: 1758968 - RNA, 21 nt, Salmonella enterica enterica serovar Typhi Ty2
acgccauugcgaacaucacga

SEQ ID NO: 1758969 - RNA, 20 nt, Salmonella enterica enterica serovar Typhi Ty2
acgccaucugugccagccca

SEQ ID NO: 1758970 - RNA, 21 nt, Salmonella enterica enterica serovar Typhi Ty2
acgccaugacgccaagcugca

SEQ ID NO: 1758971 - RNA, 18 nt, Salmonella enterica enterica serovar Typhi Ty2
acgccagaccgacgccaa

SEQ ID NO: 1758972 - RNA, 24 nt, Salmonella enterica enterica serovar Typhi Ty2
acgccagacuauccguccucuuuc

SEQ ID NO: 1758973 - RNA, 23 nt, Salmonella enterica enterica serovar Typhi Ty2
acgccaccggguuaaagcccuga

SEQ ID NO: 1758974 - RNA, 17 nt, Salmonella enterica enterica serovar Typhi Ty2
acgccaccgccaccugc

SEQ ID NO: 1758975 - RNA, 17 nt, Salmonella enterica enterica serovar Typhi Ty2
acgccagcgggugaucg

SEQ ID NO: 1758976 - RNA, 11 nt, Salmonella enterica enterica serovar Typhi Ty2
acgccagcaga

SEQ ID NO: 1758977 - RNA, 18 nt, Salmonella enterica enterica serovar Typhi Ty2
acgccagccauuaaagaa

SEQ ID NO: 1758978 - RNA, 19 nt, Salmonella enterica enterica serovar Typhi Ty2
acgccagccagaauauuag

SEQ ID NO: 1758979 - RNA, 16 nt, Salmonella enterica enterica serovar Typhi Ty2
acgccaccacagucau

SEQ ID NO: 1758980 - RNA, 14 nt, Salmonella enterica enterica serovar Typhi Ty2
acgccaccacgccg

SEQ ID NO: 1758981 - RNA, 23 nt, Salmonella enterica enterica serovar Typhi Ty2
acgccaagcagcggcguaucuuc

SEQ ID NO: 1758982 - RNA, 12 nt, Salmonella enterica enterica serovar Typhi Ty2
acgccaacgcgc

SEQ ID NO: 1758983 - RNA, 14 nt, Salmonella enterica enterica serovar Typhi Ty2
acgccaagcugcaa

SEQ ID NO: 1758984 - RNA, 15 nt, Salmonella enterica enterica serovar Typhi Ty2
acgccaagcugcaau

SEQ ID NO: 1758985 - RNA, 15 nt, Salmonella enterica enterica serovar Typhi Ty2
acgccaaaaagugaa

SEQ ID NO: 1758986 - RNA, 16 nt, Salmonella enterica enterica serovar Typhi Ty2
acgcauuucaagcagg

SEQ ID NO: 1758987 - RNA, 18 nt, Salmonella enterica enterica serovar Typhi Ty2
acgcauuucaagcaggcg

SEQ ID NO: 1758988 - RNA, 18 nt, Salmonella enterica enterica serovar Typhi Ty2
acgcauuggcaauuaaac

SEQ ID NO: 1758989 - RNA, 15 nt, Salmonella enterica enterica serovar Typhi Ty2
acgcaugguuagcca

SEQ ID NO: 1758990 - RNA, 18 nt, Salmonella enterica enterica serovar Typhi Ty2
acgcaucugggcugagaa

SEQ ID NO: 1758991 - RNA, 18 nt, Salmonella enterica enterica serovar Typhi Ty2
acgcaugacccaggcauc

SEQ ID NO: 1758992 - RNA, 22 nt, Salmonella enterica enterica serovar Typhi Ty2
acgcaucauauucgcagcucug

SEQ ID NO: 1758993 - RNA, 16 nt, Salmonella enterica enterica serovar Typhi Ty2
acgcauccugcacuuu

SEQ ID NO: 1758994 - RNA, 20 nt, Salmonella enterica enterica serovar Typhi Ty2
acgcaucaaagccacccacg

SEQ ID NO: 1758995 - RNA, 23 nt, Salmonella enterica enterica serovar Typhi Ty2
acgcaucaaauaccuuuucauug

SEQ ID NO: 1758996 - RNA, 17 nt, Salmonella enterica enterica serovar Typhi Ty2
acgcauauccagcagau

SEQ ID NO: 1758997 - RNA, 15 nt, Salmonella enterica enterica serovar Typhi Ty2
acgcauaccagccau

SEQ ID NO: 1758998 - RNA, 17 nt, Salmonella enterica enterica serovar Typhi Ty2
acgcaggcgaaaucaaa

SEQ ID NO: 1758999 - RNA, 16 nt, Salmonella enterica enterica serovar Typhi Ty2
acgcaggcuaacgcgc

SEQ ID NO: 1759000 - RNA, 16 nt, Salmonella enterica enterica serovar Typhi Ty2
acgcaggcuugcccau

SEQ ID NO: 1759001 - RNA, 14 nt, Salmonella enterica enterica serovar Typhi Ty2
acgcagcuccagcu

SEQ ID NO: 1759002 - RNA, 20 nt, Salmonella enterica enterica serovar Typhi Ty2
acgcagcucauacccuucca

SEQ ID NO: 1759003 - RNA, 17 nt, Salmonella enterica enterica serovar Typhi Ty2
acgcagcuuaaagccaa

SEQ ID NO: 1759004 - RNA, 14 nt, Salmonella enterica enterica serovar Typhi Ty2
acgcagcuucgccg

SEQ ID NO: 1759005 - RNA, 17 nt, Salmonella enterica enterica serovar Typhi Ty2
acgcagccgaggcuuaa

SEQ ID NO: 1759006 - RNA, 14 nt, Salmonella enterica enterica serovar Typhi Ty2
acgcagcaagaaca

SEQ ID NO: 1759007 - RNA, 15 nt, Salmonella enterica enterica serovar Typhi Ty2
acgcagauauucauu

SEQ ID NO: 1759008 - RNA, 17 nt, Salmonella enterica enterica serovar Typhi Ty2
acgcagcaagaacagag

SEQ ID NO: 1759009 - RNA, 12 nt, Salmonella enterica enterica serovar Typhi Ty2
acgcagccaugu

SEQ ID NO: 1759010 - RNA, 21 nt, Salmonella enterica enterica serovar Typhi Ty2
acgcaccgccaaacgcgguca

SEQ ID NO: 1759011 - RNA, 13 nt, Salmonella enterica enterica serovar Typhi Ty2
acgcagaccaaag

SEQ ID NO: 1759012 - RNA, 13 nt, Salmonella enterica enterica serovar Typhi Ty2
acgcaccagccag

SEQ ID NO: 1759013 - RNA, 16 nt, Salmonella enterica enterica serovar Typhi Ty2
acgcaccagccaggcg

SEQ ID NO: 1759014 - RNA, 23 nt, Salmonella enterica enterica serovar Typhi Ty2
accggaugggcagauagaaugcu

SEQ ID NO: 1759015 - RNA, 15 nt, Salmonella enterica enterica serovar Typhi Ty2
accggauauggcaaa

SEQ ID NO: 1759016 - RNA, 17 nt, Salmonella enterica enterica serovar Typhi Ty2
accggauauggcaaaaa

SEQ ID NO: 1759017 - RNA, 18 nt, Salmonella enterica enterica serovar Typhi Ty2
accggauaccgguucuuu

SEQ ID NO: 1759018 - RNA, 18 nt, Salmonella enterica enterica serovar Typhi Ty2
accggaucaauaaacagc

SEQ ID NO: 1759019 - RNA, 19 nt, Salmonella enterica enterica serovar Typhi Ty2
accggaucgaucccggcaa

SEQ ID NO: 1759020 - RNA, 19 nt, Salmonella enterica enterica serovar Typhi Ty2
acgccuuauccgaccuaca

SEQ ID NO: 1759021 - RNA, 21 nt, Salmonella enterica enterica serovar Typhi Ty2
acgccuucauauuaaauuccg

SEQ ID NO: 1759022 - RNA, 19 nt, Salmonella enterica enterica serovar Typhi Ty2
acgccuuuacccuuacggc

SEQ ID NO: 1759023 - RNA, 16 nt, Salmonella enterica enterica serovar Typhi Ty2
acgccuuugcccggug

SEQ ID NO: 1759024 - RNA, 23 nt, Salmonella enterica enterica serovar Typhi Ty2
acgcgaagauuaacccggucauc

SEQ ID NO: 1759025 - RNA, 20 nt, Salmonella enterica enterica serovar Typhi Ty2
acgccugggauagugcugcg

SEQ ID NO: 1759026 - RNA, 15 nt, Salmonella enterica enterica serovar Typhi Ty2
acgccugcuucacgu

SEQ ID NO: 1759027 - RNA, 19 nt, Salmonella enterica enterica serovar Typhi Ty2
acgccugaaaugcuuaaaa

SEQ ID NO: 1759028 - RNA, 19 nt, Salmonella enterica enterica serovar Typhi Ty2
acgccggcaacacccgccg

SEQ ID NO: 1759029 - RNA, 23 nt, Salmonella enterica enterica serovar Typhi Ty2
acgccggauauguuugacaagca

SEQ ID NO: 1759030 - RNA, 18 nt, Salmonella enterica enterica serovar Typhi Ty2
acgccgcuguuuucacuc

SEQ ID NO: 1759031 - RNA, 14 nt, Salmonella enterica enterica serovar Typhi Ty2
acgccgggccugcc

SEQ ID NO: 1759032 - RNA, 15 nt, Salmonella enterica enterica serovar Typhi Ty2
acgccgguaucauca

SEQ ID NO: 1759033 - RNA, 18 nt, Salmonella enterica enterica serovar Typhi Ty2
acgccgggaaauuuuucg

SEQ ID NO: 1759034 - RNA, 16 nt, Salmonella enterica enterica serovar Typhi Ty2
acgccuaaaaaugagg

SEQ ID NO: 1759035 - RNA, 20 nt, Salmonella enterica enterica serovar Typhi Ty2
acgccucauccggccuggcg

SEQ ID NO: 1759036 - RNA, 16 nt, Salmonella enterica enterica serovar Typhi Ty2
acgccuaaugaagcgc

SEQ ID NO: 1759037 - RNA, 15 nt, Salmonella enterica enterica serovar Typhi Ty2
acgccguccaggcuc

SEQ ID NO: 1759038 - RNA, 14 nt, Salmonella enterica enterica serovar Typhi Ty2
acgccguccagcac

SEQ ID NO: 1759039 - RNA, 16 nt, Salmonella enterica enterica serovar Typhi Ty2
acgccgucacaaagcc

SEQ ID NO: 1759040 - RNA, 17 nt, Salmonella enterica enterica serovar Typhi Ty2
acgccguacuccagccc

SEQ ID NO: 1759041 - RNA, 21 nt, Salmonella enterica enterica serovar Typhi Ty2
acgccggugauuuuaaaguaa

SEQ ID NO: 1759042 - RNA, 18 nt, Salmonella enterica enterica serovar Typhi Ty2
acgcccugcucccacagc

SEQ ID NO: 1759043 - RNA, 16 nt, Salmonella enterica enterica serovar Typhi Ty2
acgcccugcaaagcaa

SEQ ID NO: 1759044 - RNA, 17 nt, Salmonella enterica enterica serovar Typhi Ty2
acgcccucaauaucuuu

SEQ ID NO: 1759045 - RNA, 13 nt, Salmonella enterica enterica serovar Typhi Ty2
acgcccgcccgcc

SEQ ID NO: 1759046 - RNA, 15 nt, Salmonella enterica enterica serovar Typhi Ty2
acgcccgcauucaua

SEQ ID NO: 1759047 - RNA, 17 nt, Salmonella enterica enterica serovar Typhi Ty2
acgcccgccgccagcau

SEQ ID NO: 1759048 - RNA, 22 nt, Salmonella enterica enterica serovar Typhi Ty2
acgcccggcggguauggcaaug

SEQ ID NO: 1759049 - RNA, 23 nt, Salmonella enterica enterica serovar Typhi Ty2
acgcccaucagcaucccaccgga

SEQ ID NO: 1759050 - RNA, 17 nt, Salmonella enterica enterica serovar Typhi Ty2
acgcccaucagcauccc

SEQ ID NO: 1759051 - RNA, 16 nt, Salmonella enterica enterica serovar Typhi Ty2
acgcccauuaugccgc

SEQ ID NO: 1759052 - RNA, 18 nt, Salmonella enterica enterica serovar Typhi Ty2
acgccccaauaccacaac

SEQ ID NO: 1759053 - RNA, 20 nt, Salmonella enterica enterica serovar Typhi Ty2
acgcccgaccacgcccagcu

SEQ ID NO: 1759054 - RNA, 22 nt, Salmonella enterica enterica serovar Typhi Ty2
acgccgcuggcggaaauaaaca

SEQ ID NO: 1759055 - RNA, 23 nt, Salmonella enterica enterica serovar Typhi Ty2
acgccgccgcguccuaccgccgc

SEQ ID NO: 1759056 - RNA, 15 nt, Salmonella enterica enterica serovar Typhi Ty2
acgccgccgcccaga

SEQ ID NO: 1759057 - RNA, 13 nt, Salmonella enterica enterica serovar Typhi Ty2
acgccgccgccca

SEQ ID NO: 1759058 - RNA, 21 nt, Salmonella enterica enterica serovar Typhi Ty2
acgccgcccgccugagcgcgc

SEQ ID NO: 1759059 - RNA, 16 nt, Salmonella enterica enterica serovar Typhi Ty2
acgccgccaaagcgau

SEQ ID NO: 1759060 - RNA, 15 nt, Salmonella enterica enterica serovar Typhi Ty2
acgccgccagccacu

SEQ ID NO: 1759061 - RNA, 17 nt, Salmonella enterica enterica serovar Typhi Ty2
acgccgccauccggcac

SEQ ID NO: 1759062 - RNA, 23 nt, Salmonella enterica enterica serovar Typhi Ty2
acgccgagcaucgcuuuuaggcu

SEQ ID NO: 1759063 - RNA, 22 nt, Salmonella enterica enterica serovar Typhi Ty2
acgccgcacacagcagaaagca

SEQ ID NO: 1759064 - RNA, 20 nt, Salmonella enterica enterica serovar Typhi Ty2
acgccgaacaacacggcggc

SEQ ID NO: 1759065 - RNA, 23 nt, Salmonella enterica enterica serovar Typhi Ty2
acugaaugccuuuuacaauaacc

SEQ ID NO: 1759066 - RNA, 14 nt, Salmonella enterica enterica serovar Typhi Ty2
acugaaccaacagc

SEQ ID NO: 1759067 - RNA, 13 nt, Salmonella enterica enterica serovar Typhi Ty2
acugaagauaaac

SEQ ID NO: 1759068 - RNA, 20 nt, Salmonella enterica enterica serovar Typhi Ty2
acugacaauaagugguucgu

SEQ ID NO: 1759069 - RNA, 17 nt, Salmonella enterica enterica serovar Typhi Ty2
acugaauuaucaggguu

SEQ ID NO: 1759070 - RNA, 20 nt, Salmonella enterica enterica serovar Typhi Ty2
acugaauuacugcguaaacc

SEQ ID NO: 1759071 - RNA, 13 nt, Salmonella enterica enterica serovar Typhi Ty2
acucuucaucgcg

SEQ ID NO: 1759072 - RNA, 20 nt, Salmonella enterica enterica serovar Typhi Ty2
acucuuccccgaucagaaaa

SEQ ID NO: 1759073 - RNA, 21 nt, Salmonella enterica enterica serovar Typhi Ty2
acucuuccccgaucagaaaac

SEQ ID NO: 1759074 - RNA, 19 nt, Salmonella enterica enterica serovar Typhi Ty2
acucuuuacccagcgggug

SEQ ID NO: 1759075 - RNA, 22 nt, Salmonella enterica enterica serovar Typhi Ty2
acucuucgacacauuucagcgc

SEQ ID NO: 1759076 - RNA, 17 nt, Salmonella enterica enterica serovar Typhi Ty2
acucuucgacauauuua

SEQ ID NO: 1759077 - RNA, 21 nt, Salmonella enterica enterica serovar Typhi Ty2
acucuucugaccaucuuaccu

SEQ ID NO: 1759078 - RNA, 14 nt, Salmonella enterica enterica serovar Typhi Ty2
acuccgcccuaauc

SEQ ID NO: 1759079 - RNA, 19 nt, Salmonella enterica enterica serovar Typhi Ty2
acucgcacaguacaccugc

SEQ ID NO: 1759080 - RNA, 14 nt, Salmonella enterica enterica serovar Typhi Ty2
acucgcacaguaca

SEQ ID NO: 1759081 - RNA, 16 nt, Salmonella enterica enterica serovar Typhi Ty2
acucgccucgcugcug

SEQ ID NO: 1759082 - RNA, 15 nt, Salmonella enterica enterica serovar Typhi Ty2
acucgccuuucucca

SEQ ID NO: 1759083 - RNA, 21 nt, Salmonella enterica enterica serovar Typhi Ty2
acucgccuuucuccaugguca

SEQ ID NO: 1759084 - RNA, 18 nt, Salmonella enterica enterica serovar Typhi Ty2
acucccugagucuugccu

SEQ ID NO: 1759085 - RNA, 23 nt, Salmonella enterica enterica serovar Typhi Ty2
acucccgcacgcuggcaucaaua

SEQ ID NO: 1759086 - RNA, 18 nt, Salmonella enterica enterica serovar Typhi Ty2
acucccgucgccuguuuc

SEQ ID NO: 1759087 - RNA, 22 nt, Salmonella enterica enterica serovar Typhi Ty2
acucccaggcgcgcagcugcca

SEQ ID NO: 1759088 - RNA, 21 nt, Salmonella enterica enterica serovar Typhi Ty2
acucccaggugugacguccca

SEQ ID NO: 1759089 - RNA, 12 nt, Salmonella enterica enterica serovar Typhi Ty2
acucccaguccg

SEQ ID NO: 1759090 - RNA, 14 nt, Salmonella enterica enterica serovar Typhi Ty2
acuccccuuuuuuc

SEQ ID NO: 1759091 - RNA, 21 nt, Salmonella enterica enterica serovar Typhi Ty2
acucguaaucuaaaauuauuu

SEQ ID NO: 1759092 - RNA, 15 nt, Salmonella enterica enterica serovar Typhi Ty2
acucguaagaggcgu

SEQ ID NO: 1759093 - RNA, 15 nt, Salmonella enterica enterica serovar Typhi Ty2
acucguagccaaaau

SEQ ID NO: 1759094 - RNA, 17 nt, Salmonella enterica enterica serovar Typhi Ty2
acucgucccgauauaaa

SEQ ID NO: 1759095 - RNA, 21 nt, Salmonella enterica enterica serovar Typhi Ty2
acucgggccagcucuuuucug

SEQ ID NO: 1759096 - RNA, 13 nt, Salmonella enterica enterica serovar Typhi Ty2
acucggugccgcu

SEQ ID NO: 1759097 - RNA, 22 nt, Salmonella enterica enterica serovar Typhi Ty2
acucggugccgcugcugaccuu

SEQ ID NO: 1759098 - RNA, 20 nt, Salmonella enterica enterica serovar Typhi Ty2
acucucaccgaccugccuug

SEQ ID NO: 1759099 - RNA, 19 nt, Salmonella enterica enterica serovar Typhi Ty2
acucucaccgaccugccuu

SEQ ID NO: 1759100 - RNA, 21 nt, Salmonella enterica enterica serovar Typhi Ty2
acucucaaugcccaucugacg

SEQ ID NO: 1759101 - RNA, 19 nt, Salmonella enterica enterica serovar Typhi Ty2
acucguucccguuuauguu

SEQ ID NO: 1759102 - RNA, 17 nt, Salmonella enterica enterica serovar Typhi Ty2
acucaccguuacaaaua

SEQ ID NO: 1759103 - RNA, 11 nt, Salmonella enterica enterica serovar Typhi Ty2
acucagcaaua

SEQ ID NO: 1759104 - RNA, 18 nt, Salmonella enterica enterica serovar Typhi Ty2
acucagaccgggcgaagu

SEQ ID NO: 1759105 - RNA, 22 nt, Salmonella enterica enterica serovar Typhi Ty2
acucagaaaauuauuuuaaauu

SEQ ID NO: 1759106 - RNA, 21 nt, Salmonella enterica enterica serovar Typhi Ty2
acucacguuccccagcaccga

SEQ ID NO: 1759107 - RNA, 15 nt, Salmonella enterica enterica serovar Typhi Ty2
acucacguuccccag

SEQ ID NO: 1759108 - RNA, 15 nt, Salmonella enterica enterica serovar Typhi Ty2
acucacgguuuuuau

SEQ ID NO: 1759109 - RNA, 13 nt, Salmonella enterica enterica serovar Typhi Ty2
acucagggcaaaa

SEQ ID NO: 1759110 - RNA, 23 nt, Salmonella enterica enterica serovar Typhi Ty2
acucaggccuuuuuauugccaca

SEQ ID NO: 1759111 - RNA, 13 nt, Salmonella enterica enterica serovar Typhi Ty2
acucagccagguc

SEQ ID NO: 1759112 - RNA, 16 nt, Salmonella enterica enterica serovar Typhi Ty2
acucagcgacguaauc

SEQ ID NO: 1759113 - RNA, 14 nt, Salmonella enterica enterica serovar Typhi Ty2
acuccagaauauug

SEQ ID NO: 1759114 - RNA, 21 nt, Salmonella enterica enterica serovar Typhi Ty2
acuccagcccaucagucccca

SEQ ID NO: 1759115 - RNA, 22 nt, Salmonella enterica enterica serovar Typhi Ty2
acuccagcagaccggcaaaaau

SEQ ID NO: 1759116 - RNA, 15 nt, Salmonella enterica enterica serovar Typhi Ty2
acuccauugucggca

SEQ ID NO: 1759117 - RNA, 21 nt, Salmonella enterica enterica serovar Typhi Ty2
acuccauucccagcucuuuca

SEQ ID NO: 1759118 - RNA, 16 nt, Salmonella enterica enterica serovar Typhi Ty2
acuccauuaaauuacu

SEQ ID NO: 1759119 - RNA, 18 nt, Salmonella enterica enterica serovar Typhi Ty2
acuccauucccagcucuu

SEQ ID NO: 1759120 - RNA, 16 nt, Salmonella enterica enterica serovar Typhi Ty2
acuccaugcccacaca

SEQ ID NO: 1759121 - RNA, 17 nt, Salmonella enterica enterica serovar Typhi Ty2
acuccagcggcaggauc

SEQ ID NO: 1759122 - RNA, 14 nt, Salmonella enterica enterica serovar Typhi Ty2
acucauccagacca

SEQ ID NO: 1759123 - RNA, 13 nt, Salmonella enterica enterica serovar Typhi Ty2
acucauccaccuu

SEQ ID NO: 1759124 - RNA, 19 nt, Salmonella enterica enterica serovar Typhi Ty2
acucauccaccuuauccug

SEQ ID NO: 1759125 - RNA, 16 nt, Salmonella enterica enterica serovar Typhi Ty2
acucaucgccgcaaug

SEQ ID NO: 1759126 - RNA, 13 nt, Salmonella enterica enterica serovar Typhi Ty2
acucaucuuuauu

SEQ ID NO: 1759127 - RNA, 18 nt, Salmonella enterica enterica serovar Typhi Ty2
acucaucgccgcaaugac

SEQ ID NO: 1759128 - RNA, 14 nt, Salmonella enterica enterica serovar Typhi Ty2
acucaucggaacag

SEQ ID NO: 1759129 - RNA, 21 nt, Salmonella enterica enterica serovar Typhi Ty2
acucaucacagccacacugcu

SEQ ID NO: 1759130 - RNA, 23 nt, Salmonella enterica enterica serovar Typhi Ty2
acucaucauaauccuuauuuaau

SEQ ID NO: 1759131 - RNA, 20 nt, Salmonella enterica enterica serovar Typhi Ty2
acucaucacagccacacugc

SEQ ID NO: 1759132 - RNA, 12 nt, Salmonella enterica enterica serovar Typhi Ty2
acucauaauauc

SEQ ID NO: 1759133 - RNA, 14 nt, Salmonella enterica enterica serovar Typhi Ty2
acucauuaaaaaaa

SEQ ID NO: 1759134 - RNA, 16 nt, Salmonella enterica enterica serovar Typhi Ty2
acucauuaaaaaaaca

SEQ ID NO: 1759135 - RNA, 19 nt, Salmonella enterica enterica serovar Typhi Ty2
acguucguuguccacuguu

SEQ ID NO: 1759136 - RNA, 14 nt, Salmonella enterica enterica serovar Typhi Ty2
acguuccccagcac

SEQ ID NO: 1759137 - RNA, 19 nt, Salmonella enterica enterica serovar Typhi Ty2
acguucuucgauaaaggga

SEQ ID NO: 1759138 - RNA, 22 nt, Salmonella enterica enterica serovar Typhi Ty2
acguugccguaggcgacgccaa

SEQ ID NO: 1759139 - RNA, 12 nt, Salmonella enterica enterica serovar Typhi Ty2
acguucuucucc

SEQ ID NO: 1759140 - RNA, 14 nt, Salmonella enterica enterica serovar Typhi Ty2
acuaacagcagcag

SEQ ID NO: 1759141 - RNA, 15 nt, Salmonella enterica enterica serovar Typhi Ty2
acuaagaccagcauc

SEQ ID NO: 1759142 - RNA, 20 nt, Salmonella enterica enterica serovar Typhi Ty2
acuaagaccagcaucagaau

SEQ ID NO: 1759143 - RNA, 19 nt, Salmonella enterica enterica serovar Typhi Ty2
acuaagguuuugucauggu

SEQ ID NO: 1759144 - RNA, 16 nt, Salmonella enterica enterica serovar Typhi Ty2
acuaaguaaggaggaa

SEQ ID NO: 1759145 - RNA, 18 nt, Salmonella enterica enterica serovar Typhi Ty2
acuaagccaguucucaau

SEQ ID NO: 1759146 - RNA, 19 nt, Salmonella enterica enterica serovar Typhi Ty2
acuaacgaggccaccauca

SEQ ID NO: 1759147 - RNA, 22 nt, Salmonella enterica enterica serovar Typhi Ty2
acuaacggcgucauccugcagg

SEQ ID NO: 1759148 - RNA, 15 nt, Salmonella enterica enterica serovar Typhi Ty2
acuaacgaggccacc

SEQ ID NO: 1759149 - RNA, 16 nt, Salmonella enterica enterica serovar Typhi Ty2
acuaacugaccauaua

SEQ ID NO: 1759150 - RNA, 17 nt, Salmonella enterica enterica serovar Typhi Ty2
acuaauccccauuuuuu

SEQ ID NO: 1759151 - RNA, 22 nt, Salmonella enterica enterica serovar Typhi Ty2
acuaauccaguccucgcccacu

SEQ ID NO: 1759152 - RNA, 17 nt, Salmonella enterica enterica serovar Typhi Ty2
acuaauccucuucucug

SEQ ID NO: 1759153 - RNA, 16 nt, Salmonella enterica enterica serovar Typhi Ty2
acuagcgcgauuuucu

SEQ ID NO: 1759154 - RNA, 14 nt, Salmonella enterica enterica serovar Typhi Ty2
acuacagaaagcca

SEQ ID NO: 1759155 - RNA, 21 nt, Salmonella enterica enterica serovar Typhi Ty2
acuacagaaagccauaaaacu

SEQ ID NO: 1759156 - RNA, 21 nt, Salmonella enterica enterica serovar Typhi Ty2
acuacgguaaaccaggccagc

SEQ ID NO: 1759157 - RNA, 15 nt, Salmonella enterica enterica serovar Typhi Ty2
acuacgguaaaccag

SEQ ID NO: 1759158 - RNA, 11 nt, Salmonella enterica enterica serovar Typhi Ty2
acuacagcccu

SEQ ID NO: 1759159 - RNA, 21 nt, Salmonella enterica enterica serovar Typhi Ty2
acuacgguugccuuucgccag

SEQ ID NO: 1759160 - RNA, 21 nt, Salmonella enterica enterica serovar Typhi Ty2
acuaaucugucgcuaaagcac

SEQ ID NO: 1759161 - RNA, 15 nt, Salmonella enterica enterica serovar Typhi Ty2
acuacuacaccaccc

SEQ ID NO: 1759162 - RNA, 19 nt, Salmonella enterica enterica serovar Typhi Ty2
acuacucguaaucuaaaau

SEQ ID NO: 1759163 - RNA, 22 nt, Salmonella enterica enterica serovar Typhi Ty2
acuacugguggaauaaauauaa

SEQ ID NO: 1759164 - RNA, 13 nt, Salmonella enterica enterica serovar Typhi Ty2
acguuaauacauc

SEQ ID NO: 1759165 - RNA, 20 nt, Salmonella enterica enterica serovar Typhi Ty2
acguuacauuuuccaugccu

SEQ ID NO: 1759166 - RNA, 18 nt, Salmonella enterica enterica serovar Typhi Ty2
acguuaccauaauuugau

SEQ ID NO: 1759167 - RNA, 21 nt, Salmonella enterica enterica serovar Typhi Ty2
acguucaccccgucauauuac

SEQ ID NO: 1759168 - RNA, 16 nt, Salmonella enterica enterica serovar Typhi Ty2
acguguuaugcgccug

SEQ ID NO: 1759169 - RNA, 16 nt, Salmonella enterica enterica serovar Typhi Ty2
acguucagcauaucca

SEQ ID NO: 1759170 - RNA, 14 nt, Salmonella enterica enterica serovar Typhi Ty2
acguucaucuuccc

SEQ ID NO: 1759171 - RNA, 12 nt, Salmonella enterica enterica serovar Typhi Ty2
acguucaucuuc

SEQ ID NO: 1759172 - RNA, 14 nt, Salmonella enterica enterica serovar Typhi Ty2
acguggcuucgccg

SEQ ID NO: 1759173 - RNA, 16 nt, Salmonella enterica enterica serovar Typhi Ty2
acguggggguucaagu

SEQ ID NO: 1759174 - RNA, 17 nt, Salmonella enterica enterica serovar Typhi Ty2
acgugacgcgccagcgg

SEQ ID NO: 1759175 - RNA, 20 nt, Salmonella enterica enterica serovar Typhi Ty2
acgucugcgcuguugauaac

SEQ ID NO: 1759176 - RNA, 21 nt, Salmonella enterica enterica serovar Typhi Ty2
acgugaaacugauaguuuaaa

SEQ ID NO: 1759177 - RNA, 15 nt, Salmonella enterica enterica serovar Typhi Ty2
acgugaccuuucaac

SEQ ID NO: 1759178 - RNA, 14 nt, Salmonella enterica enterica serovar Typhi Ty2
acgucaucaugaaa

SEQ ID NO: 1759179 - RNA, 23 nt, Salmonella enterica enterica serovar Typhi Ty2
acgucaugccuuuuuuaccaauu

SEQ ID NO: 1759180 - RNA, 10 nt, Salmonella enterica enterica serovar Typhi Ty2
acgucaugcc

SEQ ID NO: 1759181 - RNA, 22 nt, Salmonella enterica enterica serovar Typhi Ty2
acgucauuaccaguugaccaaa

SEQ ID NO: 1759182 - RNA, 21 nt, Salmonella enterica enterica serovar Typhi Ty2
acgucaguacguaaccgcaaa

SEQ ID NO: 1759183 - RNA, 19 nt, Salmonella enterica enterica serovar Typhi Ty2
acgucaguggaaaacagca

SEQ ID NO: 1759184 - RNA, 17 nt, Salmonella enterica enterica serovar Typhi Ty2
acgucaguggaaaacag

SEQ ID NO: 1759185 - RNA, 21 nt, Salmonella enterica enterica serovar Typhi Ty2
acgucagcgaccauugcguau

SEQ ID NO: 1759186 - RNA, 11 nt, Salmonella enterica enterica serovar Typhi Ty2
acgucaccaug

SEQ ID NO: 1759187 - RNA, 14 nt, Salmonella enterica enterica serovar Typhi Ty2
acguauuauuauua

SEQ ID NO: 1759188 - RNA, 22 nt, Salmonella enterica enterica serovar Typhi Ty2
acguagcaaagcguacaugaau

SEQ ID NO: 1759189 - RNA, 16 nt, Salmonella enterica enterica serovar Typhi Ty2
acguagcccauuguca

SEQ ID NO: 1759190 - RNA, 16 nt, Salmonella enterica enterica serovar Typhi Ty2
acguaggccugauaag

SEQ ID NO: 1759191 - RNA, 12 nt, Salmonella enterica enterica serovar Typhi Ty2
acgggccaggcg

SEQ ID NO: 1759192 - RNA, 22 nt, Salmonella enterica enterica serovar Typhi Ty2
acgggcauuguuaauccagagc

SEQ ID NO: 1759193 - RNA, 16 nt, Salmonella enterica enterica serovar Typhi Ty2
acccugaaaaguuaca

SEQ ID NO: 1759194 - RNA, 16 nt, Salmonella enterica enterica serovar Typhi Ty2
acccugagcgccgcca

SEQ ID NO: 1759195 - RNA, 16 nt, Salmonella enterica enterica serovar Typhi Ty2
acccugaaauccggcu

SEQ ID NO: 1759196 - RNA, 15 nt, Salmonella enterica enterica serovar Typhi Ty2
acccugcugauacac

SEQ ID NO: 1759197 - RNA, 15 nt, Salmonella enterica enterica serovar Typhi Ty2
acccugguuugcugg

SEQ ID NO: 1759198 - RNA, 14 nt, Salmonella enterica enterica serovar Typhi Ty2
acccuucaugcagc

SEQ ID NO: 1759199 - RNA, 16 nt, Salmonella enterica enterica serovar Typhi Ty2
acccguucgaaugaga

SEQ ID NO: 1759200 - RNA, 21 nt, Salmonella enterica enterica serovar Typhi Ty2
acccguuauucauucacccaa

SEQ ID NO: 1759201 - RNA, 17 nt, Salmonella enterica enterica serovar Typhi Ty2
acccguuauucauucac

SEQ ID NO: 1759202 - RNA, 22 nt, Salmonella enterica enterica serovar Typhi Ty2
acccguuacgcagucagcacug

SEQ ID NO: 1759203 - RNA, 20 nt, Salmonella enterica enterica serovar Typhi Ty2
acccguuaaauaccagcacc

SEQ ID NO: 1759204 - RNA, 19 nt, Salmonella enterica enterica serovar Typhi Ty2
acccguuaaauaccagcac

SEQ ID NO: 1759205 - RNA, 18 nt, Salmonella enterica enterica serovar Typhi Ty2
acccuauugccacaauau

SEQ ID NO: 1759206 - RNA, 21 nt, Salmonella enterica enterica serovar Typhi Ty2
acccuauaagcugccucuuug

SEQ ID NO: 1759207 - RNA, 16 nt, Salmonella enterica enterica serovar Typhi Ty2
acccucgaaugugaau

SEQ ID NO: 1759208 - RNA, 14 nt, Salmonella enterica enterica serovar Typhi Ty2
acccuuuggccacc

SEQ ID NO: 1759209 - RNA, 19 nt, Salmonella enterica enterica serovar Typhi Ty2
acccuuuuccggaugcccc

SEQ ID NO: 1759210 - RNA, 22 nt, Salmonella enterica enterica serovar Typhi Ty2
accgaaacgcauacgcaggacu

SEQ ID NO: 1759211 - RNA, 13 nt, Salmonella enterica enterica serovar Typhi Ty2
accgaaaucauca

SEQ ID NO: 1759212 - RNA, 12 nt, Salmonella enterica enterica serovar Typhi Ty2
accgaaagcgac

SEQ ID NO: 1759213 - RNA, 16 nt, Salmonella enterica enterica serovar Typhi Ty2
accgacaacguuuuca

SEQ ID NO: 1759214 - RNA, 22 nt, Salmonella enterica enterica serovar Typhi Ty2
accgagaauguguucucccugc

SEQ ID NO: 1759215 - RNA, 15 nt, Salmonella enterica enterica serovar Typhi Ty2
accgacuaucagaaa

SEQ ID NO: 1759216 - RNA, 17 nt, Salmonella enterica enterica serovar Typhi Ty2
accgacagauagcccug

SEQ ID NO: 1759217 - RNA, 17 nt, Salmonella enterica enterica serovar Typhi Ty2
accgaccgugagaaucg

SEQ ID NO: 1759218 - RNA, 12 nt, Salmonella enterica enterica serovar Typhi Ty2
accgaucaucau

SEQ ID NO: 1759219 - RNA, 13 nt, Salmonella enterica enterica serovar Typhi Ty2
accgauaaauacc

SEQ ID NO: 1759220 - RNA, 24 nt, Salmonella enterica enterica serovar Typhi Ty2
accgaguaauguugaugucacuca

SEQ ID NO: 1759221 - RNA, 20 nt, Salmonella enterica enterica serovar Typhi Ty2
accgcagaaggucacgccgg

SEQ ID NO: 1759222 - RNA, 13 nt, Salmonella enterica enterica serovar Typhi Ty2
accgcagaaaaag

SEQ ID NO: 1759223 - RNA, 21 nt, Salmonella enterica enterica serovar Typhi Ty2
accgcaaaccgaauucgucca

SEQ ID NO: 1759224 - RNA, 14 nt, Salmonella enterica enterica serovar Typhi Ty2
accgcauacugaac

SEQ ID NO: 1759225 - RNA, 15 nt, Salmonella enterica enterica serovar Typhi Ty2
accgcaucgcgccca

SEQ ID NO: 1759226 - RNA, 15 nt, Salmonella enterica enterica serovar Typhi Ty2
accgcagcgcggccu

SEQ ID NO: 1759227 - RNA, 18 nt, Salmonella enterica enterica serovar Typhi Ty2
accgccagcaguagcuug

SEQ ID NO: 1759228 - RNA, 18 nt, Salmonella enterica enterica serovar Typhi Ty2
accgccgccaaacugcgc

SEQ ID NO: 1759229 - RNA, 16 nt, Salmonella enterica enterica serovar Typhi Ty2
accgccgacaccggcc

SEQ ID NO: 1759230 - RNA, 21 nt, Salmonella enterica enterica serovar Typhi Ty2
accgccgacaccggccugccu

SEQ ID NO: 1759231 - RNA, 22 nt, Salmonella enterica enterica serovar Typhi Ty2
accgccagcggcguuuuuuccu

SEQ ID NO: 1759232 - RNA, 23 nt, Salmonella enterica enterica serovar Typhi Ty2
accgcccgcgcuuuagggcuucc

SEQ ID NO: 1759233 - RNA, 19 nt, Salmonella enterica enterica serovar Typhi Ty2
accgcguuugcgcaacaga

SEQ ID NO: 1759234 - RNA, 16 nt, Salmonella enterica enterica serovar Typhi Ty2
accgcuaaaaaacagg

SEQ ID NO: 1759235 - RNA, 14 nt, Salmonella enterica enterica serovar Typhi Ty2
accgcuacaaucca

SEQ ID NO: 1759236 - RNA, 12 nt, Salmonella enterica enterica serovar Typhi Ty2
accgcuaugaau

SEQ ID NO: 1759237 - RNA, 21 nt, Salmonella enterica enterica serovar Typhi Ty2
accgcucacgguuucaacuuc

SEQ ID NO: 1759238 - RNA, 17 nt, Salmonella enterica enterica serovar Typhi Ty2
accgcuucgccuucgcc

SEQ ID NO: 1759239 - RNA, 20 nt, Salmonella enterica enterica serovar Typhi Ty2
accggaccuaauagccagcc

SEQ ID NO: 1759240 - RNA, 23 nt, Salmonella enterica enterica serovar Typhi Ty2
accggaaauggucgcuccggaac

SEQ ID NO: 1759241 - RNA, 17 nt, Salmonella enterica enterica serovar Typhi Ty2
accgcuuucccggcaug

SEQ ID NO: 1759242 - RNA, 16 nt, Salmonella enterica enterica serovar Typhi Ty2
accgcgaugaccauca

SEQ ID NO: 1759243 - RNA, 14 nt, Salmonella enterica enterica serovar Typhi Ty2
accgcgcaaucaaa

SEQ ID NO: 1759244 - RNA, 14 nt, Salmonella enterica enterica serovar Typhi Ty2
accgccgcgcguca

SEQ ID NO: 1759245 - RNA, 22 nt, Salmonella enterica enterica serovar Typhi Ty2
accgccgcuuuucagggguccc

SEQ ID NO: 1759246 - RNA, 22 nt, Salmonella enterica enterica serovar Typhi Ty2
accgccgcgauagaccacgcca

SEQ ID NO: 1759247 - RNA, 21 nt, Salmonella enterica enterica serovar Typhi Ty2
accgcgaucgaugugauaaau

SEQ ID NO: 1759248 - RNA, 13 nt, Salmonella enterica enterica serovar Typhi Ty2
acccgccggcagc

SEQ ID NO: 1759249 - RNA, 16 nt, Salmonella enterica enterica serovar Typhi Ty2
acccggagagaaacaa

SEQ ID NO: 1759250 - RNA, 18 nt, Salmonella enterica enterica serovar Typhi Ty2
acccgcuuuuccuguucu

SEQ ID NO: 1759251 - RNA, 13 nt, Salmonella enterica enterica serovar Typhi Ty2
acccgcuccagaa

SEQ ID NO: 1759252 - RNA, 16 nt, Salmonella enterica enterica serovar Typhi Ty2
acccgcuccagaagca

SEQ ID NO: 1759253 - RNA, 13 nt, Salmonella enterica enterica serovar Typhi Ty2
acccgcuaugaag

SEQ ID NO: 1759254 - RNA, 18 nt, Salmonella enterica enterica serovar Typhi Ty2
acccgggaaaaaugacgc

SEQ ID NO: 1759255 - RNA, 21 nt, Salmonella enterica enterica serovar Typhi Ty2
acccggcuuuuuuauugccua

SEQ ID NO: 1759256 - RNA, 16 nt, Salmonella enterica enterica serovar Typhi Ty2
acccggcuuuugcuuu

SEQ ID NO: 1759257 - RNA, 21 nt, Salmonella enterica enterica serovar Typhi Ty2
acccgggccaucuuuuuucac

SEQ ID NO: 1759258 - RNA, 17 nt, Salmonella enterica enterica serovar Typhi Ty2
acccggcgcaaacuuca

SEQ ID NO: 1759259 - RNA, 20 nt, Salmonella enterica enterica serovar Typhi Ty2
acccggugcggcaagcgcgc

SEQ ID NO: 1759260 - RNA, 17 nt, Salmonella enterica enterica serovar Typhi Ty2
accccggcgcggcgcgc

SEQ ID NO: 1759261 - RNA, 20 nt, Salmonella enterica enterica serovar Typhi Ty2
accccuucuggagaauaucc

SEQ ID NO: 1759262 - RNA, 15 nt, Salmonella enterica enterica serovar Typhi Ty2
acccaugacgguagc

SEQ ID NO: 1759263 - RNA, 12 nt, Salmonella enterica enterica serovar Typhi Ty2
acccaucaauaa

SEQ ID NO: 1759264 - RNA, 19 nt, Salmonella enterica enterica serovar Typhi Ty2
acccaucagggaaaaaugu

SEQ ID NO: 1759265 - RNA, 13 nt, Salmonella enterica enterica serovar Typhi Ty2
acccauccccaua

SEQ ID NO: 1759266 - RNA, 20 nt, Salmonella enterica enterica serovar Typhi Ty2
acccgcagccagaacagaag

SEQ ID NO: 1759267 - RNA, 16 nt, Salmonella enterica enterica serovar Typhi Ty2
acccgcccgguuuugu

SEQ ID NO: 1759268 - RNA, 19 nt, Salmonella enterica enterica serovar Typhi Ty2
acccgauaccgccagcccc

SEQ ID NO: 1759269 - RNA, 15 nt, Salmonella enterica enterica serovar Typhi Ty2
acccgauaccgccag

SEQ ID NO: 1759270 - RNA, 22 nt, Salmonella enterica enterica serovar Typhi Ty2
acccgaucgccauccugcaccg

SEQ ID NO: 1759271 - RNA, 14 nt, Salmonella enterica enterica serovar Typhi Ty2
acccgacacggcuc

SEQ ID NO: 1759272 - RNA, 21 nt, Salmonella enterica enterica serovar Typhi Ty2
acccacggcaaagaccgcguc

SEQ ID NO: 1759273 - RNA, 15 nt, Salmonella enterica enterica serovar Typhi Ty2
acccaggccaucaga

SEQ ID NO: 1759274 - RNA, 20 nt, Salmonella enterica enterica serovar Typhi Ty2
acccaguucaaaucgaugcc

SEQ ID NO: 1759275 - RNA, 14 nt, Salmonella enterica enterica serovar Typhi Ty2
acccagugccacca

SEQ ID NO: 1759276 - RNA, 19 nt, Salmonella enterica enterica serovar Typhi Ty2
acccauaguagcuaaugau

SEQ ID NO: 1759277 - RNA, 21 nt, Salmonella enterica enterica serovar Typhi Ty2
acccauauuccugcggcccca

SEQ ID NO: 1759278 - RNA, 18 nt, Salmonella enterica enterica serovar Typhi Ty2
acccauacaguacagacu

SEQ ID NO: 1759279 - RNA, 16 nt, Salmonella enterica enterica serovar Typhi Ty2
acccaaaaaccccgac

SEQ ID NO: 1759280 - RNA, 10 nt, Salmonella enterica enterica serovar Typhi Ty2
acccaaaaau

SEQ ID NO: 1759281 - RNA, 19 nt, Salmonella enterica enterica serovar Typhi Ty2
accaugguucccgccacug

SEQ ID NO: 1759282 - RNA, 20 nt, Salmonella enterica enterica serovar Typhi Ty2
accaugcucagcggcggcgg

SEQ ID NO: 1759283 - RNA, 14 nt, Salmonella enterica enterica serovar Typhi Ty2
accauuaacaucag

SEQ ID NO: 1759284 - RNA, 13 nt, Salmonella enterica enterica serovar Typhi Ty2
accauuaacgcca

SEQ ID NO: 1759285 - RNA, 19 nt, Salmonella enterica enterica serovar Typhi Ty2
accauuaagacagguaacu

SEQ ID NO: 1759286 - RNA, 14 nt, Salmonella enterica enterica serovar Typhi Ty2
accaugcugguugg

SEQ ID NO: 1759287 - RNA, 16 nt, Salmonella enterica enterica serovar Typhi Ty2
accaucaaaaaaaaua

SEQ ID NO: 1759288 - RNA, 20 nt, Salmonella enterica enterica serovar Typhi Ty2
accaucaaaaaaaauagcca

SEQ ID NO: 1759289 - RNA, 15 nt, Salmonella enterica enterica serovar Typhi Ty2
accauccggcgcugc

SEQ ID NO: 1759290 - RNA, 20 nt, Salmonella enterica enterica serovar Typhi Ty2
accaucccagguuauucagg

SEQ ID NO: 1759291 - RNA, 21 nt, Salmonella enterica enterica serovar Typhi Ty2
accaucccagguuauucaggu

SEQ ID NO: 1759292 - RNA, 18 nt, Salmonella enterica enterica serovar Typhi Ty2
accagcuuguuauccauc

SEQ ID NO: 1759293 - RNA, 17 nt, Salmonella enterica enterica serovar Typhi Ty2
accaggcaaaccagcac

SEQ ID NO: 1759294 - RNA, 15 nt, Salmonella enterica enterica serovar Typhi Ty2
accaggcaaaccagc

SEQ ID NO: 1759295 - RNA, 20 nt, Salmonella enterica enterica serovar Typhi Ty2
accaggcagcgcgccagcgc

SEQ ID NO: 1759296 - RNA, 18 nt, Salmonella enterica enterica serovar Typhi Ty2
accaggcaaugccccgcc

SEQ ID NO: 1759297 - RNA, 15 nt, Salmonella enterica enterica serovar Typhi Ty2
accaggcaugcagcu

SEQ ID NO: 1759298 - RNA, 22 nt, Salmonella enterica enterica serovar Typhi Ty2
accaucuggcccugacgaaauu

SEQ ID NO: 1759299 - RNA, 21 nt, Salmonella enterica enterica serovar Typhi Ty2
accauccgguuuuaaauuccu

SEQ ID NO: 1759300 - RNA, 23 nt, Salmonella enterica enterica serovar Typhi Ty2
accaucgcguuguaaucgccuga

SEQ ID NO: 1759301 - RNA, 14 nt, Salmonella enterica enterica serovar Typhi Ty2
accaucgccggaga

SEQ ID NO: 1759302 - RNA, 21 nt, Salmonella enterica enterica serovar Typhi Ty2
accaccaguaaccgccacagc

SEQ ID NO: 1759303 - RNA, 14 nt, Salmonella enterica enterica serovar Typhi Ty2
accaccaggaacgc

SEQ ID NO: 1759304 - RNA, 15 nt, Salmonella enterica enterica serovar Typhi Ty2
accacgcacaugggc

SEQ ID NO: 1759305 - RNA, 13 nt, Salmonella enterica enterica serovar Typhi Ty2
accaccguccgag

SEQ ID NO: 1759306 - RNA, 22 nt, Salmonella enterica enterica serovar Typhi Ty2
accacuguccgguuacaaccgu

SEQ ID NO: 1759307 - RNA, 14 nt, Salmonella enterica enterica serovar Typhi Ty2
accacguuaucuuc

SEQ ID NO: 1759308 - RNA, 15 nt, Salmonella enterica enterica serovar Typhi Ty2
accacgccaccgccg

SEQ ID NO: 1759309 - RNA, 17 nt, Salmonella enterica enterica serovar Typhi Ty2
accacgcccgccgccag

SEQ ID NO: 1759310 - RNA, 14 nt, Salmonella enterica enterica serovar Typhi Ty2
accacgcugccgcc

SEQ ID NO: 1759311 - RNA, 18 nt, Salmonella enterica enterica serovar Typhi Ty2
accacguaacucggcagc

SEQ ID NO: 1759312 - RNA, 16 nt, Salmonella enterica enterica serovar Typhi Ty2
accacuuuguuuuugu

SEQ ID NO: 1759313 - RNA, 16 nt, Salmonella enterica enterica serovar Typhi Ty2
accagcaaugagacaa

SEQ ID NO: 1759314 - RNA, 14 nt, Salmonella enterica enterica serovar Typhi Ty2
accagcacagccca

SEQ ID NO: 1759315 - RNA, 22 nt, Salmonella enterica enterica serovar Typhi Ty2
accagcaaugauaacggcgcca

SEQ ID NO: 1759316 - RNA, 11 nt, Salmonella enterica enterica serovar Typhi Ty2
accagcagcau

SEQ ID NO: 1759317 - RNA, 13 nt, Salmonella enterica enterica serovar Typhi Ty2
accagcagcgcca

SEQ ID NO: 1759318 - RNA, 14 nt, Salmonella enterica enterica serovar Typhi Ty2
accagcagcgccag

SEQ ID NO: 1759319 - RNA, 13 nt, Salmonella enterica enterica serovar Typhi Ty2
accagccaugcca

SEQ ID NO: 1759320 - RNA, 18 nt, Salmonella enterica enterica serovar Typhi Ty2
accagccaggaaccgccg

SEQ ID NO: 1759321 - RNA, 17 nt, Salmonella enterica enterica serovar Typhi Ty2
accagcgugcgcucagg

SEQ ID NO: 1759322 - RNA, 20 nt, Salmonella enterica enterica serovar Typhi Ty2
accagcgggccgcugauguu

SEQ ID NO: 1759323 - RNA, 21 nt, Salmonella enterica enterica serovar Typhi Ty2
accagcgucagccagaacgaa

SEQ ID NO: 1759324 - RNA, 22 nt, Salmonella enterica enterica serovar Typhi Ty2
accagcugacgacgccagcccu

SEQ ID NO: 1759325 - RNA, 15 nt, Salmonella enterica enterica serovar Typhi Ty2
accagcugacgcagc

SEQ ID NO: 1759326 - RNA, 18 nt, Salmonella enterica enterica serovar Typhi Ty2
accagccgauaacucuuc

SEQ ID NO: 1759327 - RNA, 15 nt, Salmonella enterica enterica serovar Typhi Ty2
accagccgaucauca

SEQ ID NO: 1759328 - RNA, 14 nt, Salmonella enterica enterica serovar Typhi Ty2
accagccccacggu

SEQ ID NO: 1759329 - RNA, 12 nt, Salmonella enterica enterica serovar Typhi Ty2
accagcccauga

SEQ ID NO: 1759330 - RNA, 15 nt, Salmonella enterica enterica serovar Typhi Ty2
accagccccaaaauu

SEQ ID NO: 1759331 - RNA, 22 nt, Salmonella enterica enterica serovar Typhi Ty2
accagcgcuucuguuaaaaaau

SEQ ID NO: 1759332 - RNA, 16 nt, Salmonella enterica enterica serovar Typhi Ty2
accagcggcaccagca

SEQ ID NO: 1759333 - RNA, 22 nt, Salmonella enterica enterica serovar Typhi Ty2
accagcggaauccccgccgcca

SEQ ID NO: 1759334 - RNA, 17 nt, Salmonella enterica enterica serovar Typhi Ty2
accagcggcaccagcac

SEQ ID NO: 1759335 - RNA, 18 nt, Salmonella enterica enterica serovar Typhi Ty2
accacagucaucgcgcca

SEQ ID NO: 1759336 - RNA, 21 nt, Salmonella enterica enterica serovar Typhi Ty2
accacagccuuauaagaacca

SEQ ID NO: 1759337 - RNA, 22 nt, Salmonella enterica enterica serovar Typhi Ty2
accacagccuuauaagaaccau

SEQ ID NO: 1759338 - RNA, 19 nt, Salmonella enterica enterica serovar Typhi Ty2
accacacgcuuauccugcc

SEQ ID NO: 1759339 - RNA, 21 nt, Salmonella enterica enterica serovar Typhi Ty2
accacacggaauccccggcuu

SEQ ID NO: 1759340 - RNA, 15 nt, Salmonella enterica enterica serovar Typhi Ty2
accaaugugcaaaga

SEQ ID NO: 1759341 - RNA, 13 nt, Salmonella enterica enterica serovar Typhi Ty2
accaaugugcaaa

SEQ ID NO: 1759342 - RNA, 17 nt, Salmonella enterica enterica serovar Typhi Ty2
accaaugccaaaaaaac

SEQ ID NO: 1759343 - RNA, 21 nt, Salmonella enterica enterica serovar Typhi Ty2
accacaaguuuauccagcacg

SEQ ID NO: 1759344 - RNA, 22 nt, Salmonella enterica enterica serovar Typhi Ty2
accaauaaaggucggcugcccu

SEQ ID NO: 1759345 - RNA, 19 nt, Salmonella enterica enterica serovar Typhi Ty2
accaauaaaggucggcugc

SEQ ID NO: 1759346 - RNA, 14 nt, Salmonella enterica enterica serovar Typhi Ty2
accaauaagaacuu

SEQ ID NO: 1759347 - RNA, 21 nt, Salmonella enterica enterica serovar Typhi Ty2
accaauaauugccgaauauug

SEQ ID NO: 1759348 - RNA, 22 nt, Salmonella enterica enterica serovar Typhi Ty2
accaauagagagcgacagcccg

SEQ ID NO: 1759349 - RNA, 18 nt, Salmonella enterica enterica serovar Typhi Ty2
acauuuuuacaguuacca

SEQ ID NO: 1759350 - RNA, 21 nt, Salmonella enterica enterica serovar Typhi Ty2
accaaaauggcaaguaaaaua

SEQ ID NO: 1759351 - RNA, 15 nt, Salmonella enterica enterica serovar Typhi Ty2
accaaaugcccagcu

SEQ ID NO: 1759352 - RNA, 15 nt, Salmonella enterica enterica serovar Typhi Ty2
accaaacgaauuuaa

SEQ ID NO: 1759353 - RNA, 14 nt, Salmonella enterica enterica serovar Typhi Ty2
acauuggcgcggca

SEQ ID NO: 1759354 - RNA, 21 nt, Salmonella enterica enterica serovar Typhi Ty2
acauuggcgcggcaggaaugu

SEQ ID NO: 1759355 - RNA, 18 nt, Salmonella enterica enterica serovar Typhi Ty2
acauugucagcugaacag

SEQ ID NO: 1759356 - RNA, 22 nt, Salmonella enterica enterica serovar Typhi Ty2
acauuguaugcaagaacgggcu

SEQ ID NO: 1759357 - RNA, 13 nt, Salmonella enterica enterica serovar Typhi Ty2
acauuacauccuc

SEQ ID NO: 1759358 - RNA, 11 nt, Salmonella enterica enterica serovar Typhi Ty2
acauuacccau

SEQ ID NO: 1759359 - RNA, 20 nt, Salmonella enterica enterica serovar Typhi Ty2
acauucaaaccuucaagaau

SEQ ID NO: 1759360 - RNA, 21 nt, Salmonella enterica enterica serovar Typhi Ty2
acauuauuaaaaugucuuuuc

SEQ ID NO: 1759361 - RNA, 14 nt, Salmonella enterica enterica serovar Typhi Ty2
acauuaugcgcaug

SEQ ID NO: 1759362 - RNA, 19 nt, Salmonella enterica enterica serovar Typhi Ty2
acauuauaggugucagauc

SEQ ID NO: 1759363 - RNA, 21 nt, Salmonella enterica enterica serovar Typhi Ty2
acauuccauuuuucgaucuuc

SEQ ID NO: 1759364 - RNA, 17 nt, Salmonella enterica enterica serovar Typhi Ty2
acauuccugacauuuau

SEQ ID NO: 1759365 - RNA, 15 nt, Salmonella enterica enterica serovar Typhi Ty2
acauucgauaaccgc

SEQ ID NO: 1759366 - RNA, 15 nt, Salmonella enterica enterica serovar Typhi Ty2
acauucguaacaugc

SEQ ID NO: 1759367 - RNA, 18 nt, Salmonella enterica enterica serovar Typhi Ty2
acauucugcuuccagaau

SEQ ID NO: 1759368 - RNA, 21 nt, Salmonella enterica enterica serovar Typhi Ty2
acauugaguaaauaaaucagc

SEQ ID NO: 1759369 - RNA, 14 nt, Salmonella enterica enterica serovar Typhi Ty2
acauugaguaaaua

SEQ ID NO: 1759370 - RNA, 12 nt, Salmonella enterica enterica serovar Typhi Ty2
acauugccccuc

SEQ ID NO: 1759371 - RNA, 19 nt, Salmonella enterica enterica serovar Typhi Ty2
acauugccggauggcggcg

SEQ ID NO: 1759372 - RNA, 14 nt, Salmonella enterica enterica serovar Typhi Ty2
acauugccggcauc

SEQ ID NO: 1759373 - RNA, 22 nt, Salmonella enterica enterica serovar Typhi Ty2
acauuggcaaaccccugcucgc

SEQ ID NO: 1759374 - RNA, 18 nt, Salmonella enterica enterica serovar Typhi Ty2
acauugcuguggaaaauc

SEQ ID NO: 1759375 - RNA, 20 nt, Salmonella enterica enterica serovar Typhi Ty2
acauugcgccgcacuucacg

SEQ ID NO: 1759376 - RNA, 17 nt, Salmonella enterica enterica serovar Typhi Ty2
acaugcguaccugcgcg

SEQ ID NO: 1759377 - RNA, 22 nt, Salmonella enterica enterica serovar Typhi Ty2
acaugccggugcgagaaaaagc

SEQ ID NO: 1759378 - RNA, 21 nt, Salmonella enterica enterica serovar Typhi Ty2
acaugccggugcgagaaaaag

SEQ ID NO: 1759379 - RNA, 16 nt, Salmonella enterica enterica serovar Typhi Ty2
acaugccguuaauaau

SEQ ID NO: 1759380 - RNA, 18 nt, Salmonella enterica enterica serovar Typhi Ty2
acauuaaucgccauugca

SEQ ID NO: 1759381 - RNA, 20 nt, Salmonella enterica enterica serovar Typhi Ty2
acauccugugaaguaaaaaa

SEQ ID NO: 1759382 - RNA, 22 nt, Salmonella enterica enterica serovar Typhi Ty2
acaucguaaaucaaaugagaau

SEQ ID NO: 1759383 - RNA, 12 nt, Salmonella enterica enterica serovar Typhi Ty2
acaucguaaauc

SEQ ID NO: 1759384 - RNA, 20 nt, Salmonella enterica enterica serovar Typhi Ty2
acaugccggugcgagaaaaa

SEQ ID NO: 1759385 - RNA, 13 nt, Salmonella enterica enterica serovar Typhi Ty2
acaucuuugccaa

SEQ ID NO: 1759386 - RNA, 21 nt, Salmonella enterica enterica serovar Typhi Ty2
acauccccgccgagaaaauac

SEQ ID NO: 1759387 - RNA, 19 nt, Salmonella enterica enterica serovar Typhi Ty2
acauccccgccgagaaaau

SEQ ID NO: 1759388 - RNA, 21 nt, Salmonella enterica enterica serovar Typhi Ty2
acauccccgcguuaagccccu

SEQ ID NO: 1759389 - RNA, 15 nt, Salmonella enterica enterica serovar Typhi Ty2
acaucccagacaaaa

SEQ ID NO: 1759390 - RNA, 17 nt, Salmonella enterica enterica serovar Typhi Ty2
acauccugugaaguaaa

SEQ ID NO: 1759391 - RNA, 18 nt, Salmonella enterica enterica serovar Typhi Ty2
acauccugugaaguaaaa

SEQ ID NO: 1759392 - RNA, 13 nt, Salmonella enterica enterica serovar Typhi Ty2
acauccucuccug

SEQ ID NO: 1759393 - RNA, 23 nt, Salmonella enterica enterica serovar Typhi Ty2
acauccgcuuuugguuuuucaac

SEQ ID NO: 1759394 - RNA, 21 nt, Salmonella enterica enterica serovar Typhi Ty2
acaucaugaugaucuucagcc

SEQ ID NO: 1759395 - RNA, 12 nt, Salmonella enterica enterica serovar Typhi Ty2
acauccacuggu

SEQ ID NO: 1759396 - RNA, 14 nt, Salmonella enterica enterica serovar Typhi Ty2
acauccagacagcc

SEQ ID NO: 1759397 - RNA, 19 nt, Salmonella enterica enterica serovar Typhi Ty2
acauccagcgccugcugua

SEQ ID NO: 1759398 - RNA, 17 nt, Salmonella enterica enterica serovar Typhi Ty2
acauccaucacuccuua

SEQ ID NO: 1759399 - RNA, 21 nt, Salmonella enterica enterica serovar Typhi Ty2
acaucaucguuugcgcgcacg

SEQ ID NO: 1759400 - RNA, 12 nt, Salmonella enterica enterica serovar Typhi Ty2
acauaugaagga

SEQ ID NO: 1759401 - RNA, 18 nt, Salmonella enterica enterica serovar Typhi Ty2
acauaucgcaauugauac

SEQ ID NO: 1759402 - RNA, 22 nt, Salmonella enterica enterica serovar Typhi Ty2
acauaucgcaauugauacauuu

SEQ ID NO: 1759403 - RNA, 20 nt, Salmonella enterica enterica serovar Typhi Ty2
acauaucgacauaaguaaau

SEQ ID NO: 1759404 - RNA, 13 nt, Salmonella enterica enterica serovar Typhi Ty2
acauauacugucu

SEQ ID NO: 1759405 - RNA, 14 nt, Salmonella enterica enterica serovar Typhi Ty2
acauauaauuaaca

SEQ ID NO: 1759406 - RNA, 17 nt, Salmonella enterica enterica serovar Typhi Ty2
acauauacucuucgcca

SEQ ID NO: 1759407 - RNA, 16 nt, Salmonella enterica enterica serovar Typhi Ty2
acaucaagcccacaca

SEQ ID NO: 1759408 - RNA, 13 nt, Salmonella enterica enterica serovar Typhi Ty2
acaucaagagaaa

SEQ ID NO: 1759409 - RNA, 22 nt, Salmonella enterica enterica serovar Typhi Ty2
acagccaaacugcuguagcugu

SEQ ID NO: 1759410 - RNA, 21 nt, Salmonella enterica enterica serovar Typhi Ty2
acaguuuuuccuuucugcgcc

SEQ ID NO: 1759411 - RNA, 20 nt, Salmonella enterica enterica serovar Typhi Ty2
acaguuuuuucguuccagag

SEQ ID NO: 1759412 - RNA, 21 nt, Salmonella enterica enterica serovar Typhi Ty2
acaguuuugucaucagaucau

SEQ ID NO: 1759413 - RNA, 13 nt, Salmonella enterica enterica serovar Typhi Ty2
acauaaguaaaua

SEQ ID NO: 1759414 - RNA, 19 nt, Salmonella enterica enterica serovar Typhi Ty2
acauaauauuccagcgugc

SEQ ID NO: 1759415 - RNA, 21 nt, Salmonella enterica enterica serovar Typhi Ty2
acauaacgcgauagauaccau

SEQ ID NO: 1759416 - RNA, 16 nt, Salmonella enterica enterica serovar Typhi Ty2
acauaacugagacuca

SEQ ID NO: 1759417 - RNA, 15 nt, Salmonella enterica enterica serovar Typhi Ty2
acauagcugaacaau

SEQ ID NO: 1759418 - RNA, 15 nt, Salmonella enterica enterica serovar Typhi Ty2
acauagcuauauuua

SEQ ID NO: 1759419 - RNA, 19 nt, Salmonella enterica enterica serovar Typhi Ty2
acauagcuaaauaaaaaua

SEQ ID NO: 1759420 - RNA, 21 nt, Salmonella enterica enterica serovar Typhi Ty2
acauagaaaauauaugacaac

SEQ ID NO: 1759421 - RNA, 20 nt, Salmonella enterica enterica serovar Typhi Ty2
acauacgccgccagccacug

SEQ ID NO: 1759422 - RNA, 23 nt, Salmonella enterica enterica serovar Typhi Ty2
acagauagcccugagcccacagc

SEQ ID NO: 1759423 - RNA, 16 nt, Salmonella enterica enterica serovar Typhi Ty2
acagauaagcgucugc

SEQ ID NO: 1759424 - RNA, 17 nt, Salmonella enterica enterica serovar Typhi Ty2
acagacuucauuuucca

SEQ ID NO: 1759425 - RNA, 13 nt, Salmonella enterica enterica serovar Typhi Ty2
acagaaucaucag

SEQ ID NO: 1759426 - RNA, 23 nt, Salmonella enterica enterica serovar Typhi Ty2
acagaccccgcaucgcccgcucc

SEQ ID NO: 1759427 - RNA, 23 nt, Salmonella enterica enterica serovar Typhi Ty2
acagaagguuauucgccuuucac

SEQ ID NO: 1759428 - RNA, 13 nt, Salmonella enterica enterica serovar Typhi Ty2
acagacgaaaaaa

SEQ ID NO: 1759429 - RNA, 12 nt, Salmonella enterica enterica serovar Typhi Ty2
acagacgcugcg

SEQ ID NO: 1759430 - RNA, 14 nt, Salmonella enterica enterica serovar Typhi Ty2
acagacgcaggccg

SEQ ID NO: 1759431 - RNA, 14 nt, Salmonella enterica enterica serovar Typhi Ty2
acagcagcgcggca

SEQ ID NO: 1759432 - RNA, 22 nt, Salmonella enterica enterica serovar Typhi Ty2
acagauuuugcacuuuugccag

SEQ ID NO: 1759433 - RNA, 17 nt, Salmonella enterica enterica serovar Typhi Ty2
acagcaggcuuugcugc

SEQ ID NO: 1759434 - RNA, 16 nt, Salmonella enterica enterica serovar Typhi Ty2
acacgcguaaacuucc

SEQ ID NO: 1759435 - RNA, 17 nt, Salmonella enterica enterica serovar Typhi Ty2
acacgcgcgcugcgccu

SEQ ID NO: 1759436 - RNA, 19 nt, Salmonella enterica enterica serovar Typhi Ty2
acacgcuuuucagcgccag

SEQ ID NO: 1759437 - RNA, 16 nt, Salmonella enterica enterica serovar Typhi Ty2
acacgcuuagcuugcc

SEQ ID NO: 1759438 - RNA, 12 nt, Salmonella enterica enterica serovar Typhi Ty2
acacggcggcua

SEQ ID NO: 1759439 - RNA, 19 nt, Salmonella enterica enterica serovar Typhi Ty2
acacguaauucauuacgaa

SEQ ID NO: 1759440 - RNA, 13 nt, Salmonella enterica enterica serovar Typhi Ty2
acacuaaaucaua

SEQ ID NO: 1759441 - RNA, 21 nt, Salmonella enterica enterica serovar Typhi Ty2
acacguuugcccgaugucgcu

SEQ ID NO: 1759442 - RNA, 17 nt, Salmonella enterica enterica serovar Typhi Ty2
acagaagcugagaaaag

SEQ ID NO: 1759443 - RNA, 13 nt, Salmonella enterica enterica serovar Typhi Ty2
acagaagcggccu

SEQ ID NO: 1759444 - RNA, 13 nt, Salmonella enterica enterica serovar Typhi Ty2
acacuauauugcg

SEQ ID NO: 1759445 - RNA, 22 nt, Salmonella enterica enterica serovar Typhi Ty2
acagaaaaucacaaauaacaga

SEQ ID NO: 1759446 - RNA, 11 nt, Salmonella enterica enterica serovar Typhi Ty2
acacucaacca

SEQ ID NO: 1759447 - RNA, 16 nt, Salmonella enterica enterica serovar Typhi Ty2
acacauuucuuuugau

SEQ ID NO: 1759448 - RNA, 21 nt, Salmonella enterica enterica serovar Typhi Ty2
acacaugcaaaaaagcccauc

SEQ ID NO: 1759449 - RNA, 23 nt, Salmonella enterica enterica serovar Typhi Ty2
acaccaaugucauauuugugagc

SEQ ID NO: 1759450 - RNA, 18 nt, Salmonella enterica enterica serovar Typhi Ty2
acaccaaugucauauuug

SEQ ID NO: 1759451 - RNA, 18 nt, Salmonella enterica enterica serovar Typhi Ty2
acaccaacggcgacgccc

SEQ ID NO: 1759452 - RNA, 12 nt, Salmonella enterica enterica serovar Typhi Ty2
acaccacgcagg

SEQ ID NO: 1759453 - RNA, 13 nt, Salmonella enterica enterica serovar Typhi Ty2
acaccagaaugcu

SEQ ID NO: 1759454 - RNA, 12 nt, Salmonella enterica enterica serovar Typhi Ty2
acaccagcgccg

SEQ ID NO: 1759455 - RNA, 20 nt, Salmonella enterica enterica serovar Typhi Ty2
acaccagggauuuugcuuuu

SEQ ID NO: 1759456 - RNA, 18 nt, Salmonella enterica enterica serovar Typhi Ty2
acaccaggaguuaaaccu

SEQ ID NO: 1759457 - RNA, 14 nt, Salmonella enterica enterica serovar Typhi Ty2
acaccauuucacaa

SEQ ID NO: 1759458 - RNA, 12 nt, Salmonella enterica enterica serovar Typhi Ty2
acacccaauaua

SEQ ID NO: 1759459 - RNA, 23 nt, Salmonella enterica enterica serovar Typhi Ty2
acaccgcaggccggauaaggcau

SEQ ID NO: 1759460 - RNA, 12 nt, Salmonella enterica enterica serovar Typhi Ty2
acacccugcccc

SEQ ID NO: 1759461 - RNA, 23 nt, Salmonella enterica enterica serovar Typhi Ty2
acaccguuuaucguuaccggcuc

SEQ ID NO: 1759462 - RNA, 21 nt, Salmonella enterica enterica serovar Typhi Ty2
acaccguauccggccugcagg

SEQ ID NO: 1759463 - RNA, 14 nt, Salmonella enterica enterica serovar Typhi Ty2
acaccgcuugccgg

SEQ ID NO: 1759464 - RNA, 14 nt, Salmonella enterica enterica serovar Typhi Ty2
acacgaccagcgac

SEQ ID NO: 1759465 - RNA, 14 nt, Salmonella enterica enterica serovar Typhi Ty2
acacgaacacagaa

SEQ ID NO: 1759466 - RNA, 14 nt, Salmonella enterica enterica serovar Typhi Ty2
acacgauggcaaau

SEQ ID NO: 1759467 - RNA, 16 nt, Salmonella enterica enterica serovar Typhi Ty2
acacgcagacccaggc

SEQ ID NO: 1759468 - RNA, 12 nt, Salmonella enterica enterica serovar Typhi Ty2
acacgauaguga

SEQ ID NO: 1759469 - RNA, 23 nt, Salmonella enterica enterica serovar Typhi Ty2
acaccugcuggucaccuggcugg

SEQ ID NO: 1759470 - RNA, 20 nt, Salmonella enterica enterica serovar Typhi Ty2
acaaucuccagaccgcugcg

SEQ ID NO: 1759471 - RNA, 19 nt, Salmonella enterica enterica serovar Typhi Ty2
acaauccguuauuucacag

SEQ ID NO: 1759472 - RNA, 19 nt, Salmonella enterica enterica serovar Typhi Ty2
acaaucgccgugaucccaa

SEQ ID NO: 1759473 - RNA, 21 nt, Salmonella enterica enterica serovar Typhi Ty2
acaaucgccgugaucccaaug

SEQ ID NO: 1759474 - RNA, 18 nt, Salmonella enterica enterica serovar Typhi Ty2
acaaugaucagacgcaca

SEQ ID NO: 1759475 - RNA, 20 nt, Salmonella enterica enterica serovar Typhi Ty2
acaaucaggcugcggaugau

SEQ ID NO: 1759476 - RNA, 16 nt, Salmonella enterica enterica serovar Typhi Ty2
acaauccgacgcucaa

SEQ ID NO: 1759477 - RNA, 15 nt, Salmonella enterica enterica serovar Typhi Ty2
acaaucacagcgcag

SEQ ID NO: 1759478 - RNA, 16 nt, Salmonella enterica enterica serovar Typhi Ty2
acaaucacagcgcaga

SEQ ID NO: 1759479 - RNA, 12 nt, Salmonella enterica enterica serovar Typhi Ty2
acaaucagaaga

SEQ ID NO: 1759480 - RNA, 17 nt, Salmonella enterica enterica serovar Typhi Ty2
acaaucagcacacuaca

SEQ ID NO: 1759481 - RNA, 18 nt, Salmonella enterica enterica serovar Typhi Ty2
acaauauccucgcauccu

SEQ ID NO: 1759482 - RNA, 18 nt, Salmonella enterica enterica serovar Typhi Ty2
acaauaugaccacuaacu

SEQ ID NO: 1759483 - RNA, 20 nt, Salmonella enterica enterica serovar Typhi Ty2
acaauaugguuauccagcag

SEQ ID NO: 1759484 - RNA, 23 nt, Salmonella enterica enterica serovar Typhi Ty2
acaauagcgcuaaacagcgccgc

SEQ ID NO: 1759485 - RNA, 20 nt, Salmonella enterica enterica serovar Typhi Ty2
acaauaacgccggauauguu

SEQ ID NO: 1759486 - RNA, 19 nt, Salmonella enterica enterica serovar Typhi Ty2
acaauaacaccacaacaca

SEQ ID NO: 1759487 - RNA, 14 nt, Salmonella enterica enterica serovar Typhi Ty2
acaaguuuauccag

SEQ ID NO: 1759488 - RNA, 19 nt, Salmonella enterica enterica serovar Typhi Ty2
acaauaccguuuggaucug

SEQ ID NO: 1759489 - RNA, 18 nt, Salmonella enterica enterica serovar Typhi Ty2
acaauagcaaucuguaac

SEQ ID NO: 1759490 - RNA, 13 nt, Salmonella enterica enterica serovar Typhi Ty2
acaauaccaauaa

SEQ ID NO: 1759491 - RNA, 18 nt, Salmonella enterica enterica serovar Typhi Ty2
acaaguaauaaaauaaua

SEQ ID NO: 1759492 - RNA, 16 nt, Salmonella enterica enterica serovar Typhi Ty2
acaaguaauaaaauaa

SEQ ID NO: 1759493 - RNA, 14 nt, Salmonella enterica enterica serovar Typhi Ty2
acaaguaauaaaau

SEQ ID NO: 1759494 - RNA, 18 nt, Salmonella enterica enterica serovar Typhi Ty2
acaaguagccugccagca

SEQ ID NO: 1759495 - RNA, 20 nt, Salmonella enterica enterica serovar Typhi Ty2
acaaguagccugccagcaac

SEQ ID NO: 1759496 - RNA, 19 nt, Salmonella enterica enterica serovar Typhi Ty2
acaaggcauucaggccgga

SEQ ID NO: 1759497 - RNA, 14 nt, Salmonella enterica enterica serovar Typhi Ty2
acaaggaaugacac

SEQ ID NO: 1759498 - RNA, 14 nt, Salmonella enterica enterica serovar Typhi Ty2
acaaggauauguau

SEQ ID NO: 1759499 - RNA, 12 nt, Salmonella enterica enterica serovar Typhi Ty2
acacagaauuac

SEQ ID NO: 1759500 - RNA, 20 nt, Salmonella enterica enterica serovar Typhi Ty2
acacagacugcuuguuuaau

SEQ ID NO: 1759501 - RNA, 13 nt, Salmonella enterica enterica serovar Typhi Ty2
acacagaucgaau

SEQ ID NO: 1759502 - RNA, 20 nt, Salmonella enterica enterica serovar Typhi Ty2
acacaauaucgccaucguag

SEQ ID NO: 1759503 - RNA, 21 nt, Salmonella enterica enterica serovar Typhi Ty2
acacacucggugcauuugucg

SEQ ID NO: 1759504 - RNA, 13 nt, Salmonella enterica enterica serovar Typhi Ty2
acacacgcgcuga

SEQ ID NO: 1759505 - RNA, 16 nt, Salmonella enterica enterica serovar Typhi Ty2
acacacaaucgguuau

SEQ ID NO: 1759506 - RNA, 13 nt, Salmonella enterica enterica serovar Typhi Ty2
acacaauuuucuu

SEQ ID NO: 1759507 - RNA, 14 nt, Salmonella enterica enterica serovar Typhi Ty2
acacaguaaaaaaa

SEQ ID NO: 1759508 - RNA, 15 nt, Salmonella enterica enterica serovar Typhi Ty2
acacaguaaaaaaac

SEQ ID NO: 1759509 - RNA, 15 nt, Salmonella enterica enterica serovar Typhi Ty2
acacaggccugcauu

SEQ ID NO: 1759510 - RNA, 19 nt, Salmonella enterica enterica serovar Typhi Ty2
acacaggcgugguggauau

SEQ ID NO: 1759511 - RNA, 22 nt, Salmonella enterica enterica serovar Typhi Ty2
acacagggucgucaaacuuuua

SEQ ID NO: 1759512 - RNA, 14 nt, Salmonella enterica enterica serovar Typhi Ty2
acacagccagcacg

SEQ ID NO: 1759513 - RNA, 19 nt, Salmonella enterica enterica serovar Typhi Ty2
acacagucucauugaucag

SEQ ID NO: 1759514 - RNA, 17 nt, Salmonella enterica enterica serovar Typhi Ty2
acacaucacaaucucca

SEQ ID NO: 1759515 - RNA, 15 nt, Salmonella enterica enterica serovar Typhi Ty2
acacaucaggaaugc

SEQ ID NO: 1759516 - RNA, 19 nt, Salmonella enterica enterica serovar Typhi Ty2
acacauaucgccagccaug

SEQ ID NO: 1759517 - RNA, 14 nt, Salmonella enterica enterica serovar Typhi Ty2
acacauagauaaaa

SEQ ID NO: 1759518 - RNA, 14 nt, Salmonella enterica enterica serovar Typhi Ty2
acaaugcugacacu

SEQ ID NO: 1759519 - RNA, 13 nt, Salmonella enterica enterica serovar Typhi Ty2
acaaugcccggca

SEQ ID NO: 1759520 - RNA, 15 nt, Salmonella enterica enterica serovar Typhi Ty2
acaauuacgcaagag

SEQ ID NO: 1759521 - RNA, 15 nt, Salmonella enterica enterica serovar Typhi Ty2
acaauucaacucacu

SEQ ID NO: 1759522 - RNA, 14 nt, Salmonella enterica enterica serovar Typhi Ty2
acaauucauagcca

SEQ ID NO: 1759523 - RNA, 15 nt, Salmonella enterica enterica serovar Typhi Ty2
acaauugccagcagg

SEQ ID NO: 1759524 - RNA, 13 nt, Salmonella enterica enterica serovar Typhi Ty2
acaauuuaucugc

SEQ ID NO: 1759525 - RNA, 21 nt, Salmonella enterica enterica serovar Typhi Ty2
acaauugcugcguaacugcca

SEQ ID NO: 1759526 - RNA, 18 nt, Salmonella enterica enterica serovar Typhi Ty2
acaauuuugauaagagaa

SEQ ID NO: 1759527 - RNA, 21 nt, Salmonella enterica enterica serovar Typhi Ty2
acaauuuugauaagagaaaau

SEQ ID NO: 1759528 - RNA, 17 nt, Salmonella enterica enterica serovar Typhi Ty2
aauuuccaguucaauca

SEQ ID NO: 1759529 - RNA, 19 nt, Salmonella enterica enterica serovar Typhi Ty2
aauuucccccacuucugac

SEQ ID NO: 1759530 - RNA, 13 nt, Salmonella enterica enterica serovar Typhi Ty2
aauuucgcauaau

SEQ ID NO: 1759531 - RNA, 17 nt, Salmonella enterica enterica serovar Typhi Ty2
aauuucuuccauuagcu

SEQ ID NO: 1759532 - RNA, 18 nt, Salmonella enterica enterica serovar Typhi Ty2
aauuucugguaccagauc

SEQ ID NO: 1759533 - RNA, 14 nt, Salmonella enterica enterica serovar Typhi Ty2
aauuugugagauaa

SEQ ID NO: 1759534 - RNA, 17 nt, Salmonella enterica enterica serovar Typhi Ty2
aauuuuaccauucagcu

SEQ ID NO: 1759535 - RNA, 9 nt, Salmonella enterica enterica serovar Typhi Ty2
aauuugauu

SEQ ID NO: 1759536 - RNA, 16 nt, Salmonella enterica enterica serovar Typhi Ty2
aauuugauagcgccac

SEQ ID NO: 1759537 - RNA, 11 nt, Salmonella enterica enterica serovar Typhi Ty2
aauuugacgac

SEQ ID NO: 1759538 - RNA, 23 nt, Salmonella enterica enterica serovar Typhi Ty2
acaaaaggcuggaacagauguuu

SEQ ID NO: 1759539 - RNA, 19 nt, Salmonella enterica enterica serovar Typhi Ty2
acaaaauaaagugaaauaa

SEQ ID NO: 1759540 - RNA, 12 nt, Salmonella enterica enterica serovar Typhi Ty2
acaaaauuuuuu

SEQ ID NO: 1759541 - RNA, 16 nt, Salmonella enterica enterica serovar Typhi Ty2
acaaaauuuugcauaa

SEQ ID NO: 1759542 - RNA, 16 nt, Salmonella enterica enterica serovar Typhi Ty2
acaaaauucagacuca

SEQ ID NO: 1759543 - RNA, 13 nt, Salmonella enterica enterica serovar Typhi Ty2
acaaaauggcuga

SEQ ID NO: 1759544 - RNA, 14 nt, Salmonella enterica enterica serovar Typhi Ty2
acaaaagaaagcaa

SEQ ID NO: 1759545 - RNA, 13 nt, Salmonella enterica enterica serovar Typhi Ty2
aauuuuuugauug

SEQ ID NO: 1759546 - RNA, 19 nt, Salmonella enterica enterica serovar Typhi Ty2
aauuuugcaccaucaacgc

SEQ ID NO: 1759547 - RNA, 15 nt, Salmonella enterica enterica serovar Typhi Ty2
aauuuugcauaaaua

SEQ ID NO: 1759548 - RNA, 12 nt, Salmonella enterica enterica serovar Typhi Ty2
aauuuucaacca

SEQ ID NO: 1759549 - RNA, 20 nt, Salmonella enterica enterica serovar Typhi Ty2
acaaccagcgaaaugacggc

SEQ ID NO: 1759550 - RNA, 18 nt, Salmonella enterica enterica serovar Typhi Ty2
acaaccaucacugaaccc

SEQ ID NO: 1759551 - RNA, 14 nt, Salmonella enterica enterica serovar Typhi Ty2
acaacauugaggcu

SEQ ID NO: 1759552 - RNA, 17 nt, Salmonella enterica enterica serovar Typhi Ty2
acaacauguuucuugug

SEQ ID NO: 1759553 - RNA, 16 nt, Salmonella enterica enterica serovar Typhi Ty2
acaacaucccagaaaa

SEQ ID NO: 1759554 - RNA, 15 nt, Salmonella enterica enterica serovar Typhi Ty2
acaacauaaaggggu

SEQ ID NO: 1759555 - RNA, 20 nt, Salmonella enterica enterica serovar Typhi Ty2
acaaccgcccccaacugagc

SEQ ID NO: 1759556 - RNA, 19 nt, Salmonella enterica enterica serovar Typhi Ty2
acaaccuccacgcccagcg

SEQ ID NO: 1759557 - RNA, 13 nt, Salmonella enterica enterica serovar Typhi Ty2
acaaccugcccuu

SEQ ID NO: 1759558 - RNA, 16 nt, Salmonella enterica enterica serovar Typhi Ty2
acaacgcauauuauga

SEQ ID NO: 1759559 - RNA, 19 nt, Salmonella enterica enterica serovar Typhi Ty2
acaacgagauucaauaaug

SEQ ID NO: 1759560 - RNA, 21 nt, Salmonella enterica enterica serovar Typhi Ty2
acaacgucaguggaaaacagc

SEQ ID NO: 1759561 - RNA, 21 nt, Salmonella enterica enterica serovar Typhi Ty2
acaacuucuaauuuuuccagc

SEQ ID NO: 1759562 - RNA, 19 nt, Salmonella enterica enterica serovar Typhi Ty2
acaacuucuaauuuuucca

SEQ ID NO: 1759563 - RNA, 12 nt, Salmonella enterica enterica serovar Typhi Ty2
acaagaagggua

SEQ ID NO: 1759564 - RNA, 19 nt, Salmonella enterica enterica serovar Typhi Ty2
acaagaaggguauagagca

SEQ ID NO: 1759565 - RNA, 19 nt, Salmonella enterica enterica serovar Typhi Ty2
acaagaacuuaaauuaaug

SEQ ID NO: 1759566 - RNA, 23 nt, Salmonella enterica enterica serovar Typhi Ty2
acaagaacuuaaauuaaugauua

SEQ ID NO: 1759567 - RNA, 21 nt, Salmonella enterica enterica serovar Typhi Ty2
acaagaauuuaucgcaauaua

SEQ ID NO: 1759568 - RNA, 22 nt, Salmonella enterica enterica serovar Typhi Ty2
acaagaggaguguaacgccgaa

SEQ ID NO: 1759569 - RNA, 11 nt, Salmonella enterica enterica serovar Typhi Ty2
acaagcaguua

SEQ ID NO: 1759570 - RNA, 19 nt, Salmonella enterica enterica serovar Typhi Ty2
acaagccccccgcacagca

SEQ ID NO: 1759571 - RNA, 22 nt, Salmonella enterica enterica serovar Typhi Ty2
acaagccccccgcacagcacau

SEQ ID NO: 1759572 - RNA, 23 nt, Salmonella enterica enterica serovar Typhi Ty2
acaagccgccaacgccagcagcg

SEQ ID NO: 1759573 - RNA, 15 nt, Salmonella enterica enterica serovar Typhi Ty2
acaagcgaucgccag

SEQ ID NO: 1759574 - RNA, 23 nt, Salmonella enterica enterica serovar Typhi Ty2
acaaacagcgccccgacaaaacg

SEQ ID NO: 1759575 - RNA, 16 nt, Salmonella enterica enterica serovar Typhi Ty2
acaaaccacugcugua

SEQ ID NO: 1759576 - RNA, 16 nt, Salmonella enterica enterica serovar Typhi Ty2
acaaaccccacccacu

SEQ ID NO: 1759577 - RNA, 18 nt, Salmonella enterica enterica serovar Typhi Ty2
acaaaccccacccacuga

SEQ ID NO: 1759578 - RNA, 17 nt, Salmonella enterica enterica serovar Typhi Ty2
acaaacgccaccgccac

SEQ ID NO: 1759579 - RNA, 22 nt, Salmonella enterica enterica serovar Typhi Ty2
acaaacgccgucacaaagccca

SEQ ID NO: 1759580 - RNA, 14 nt, Salmonella enterica enterica serovar Typhi Ty2
acaaacgcuuuuuu

SEQ ID NO: 1759581 - RNA, 15 nt, Salmonella enterica enterica serovar Typhi Ty2
acaaagagcucccca

SEQ ID NO: 1759582 - RNA, 16 nt, Salmonella enterica enterica serovar Typhi Ty2
acaaagaauucuucug

SEQ ID NO: 1759583 - RNA, 16 nt, Salmonella enterica enterica serovar Typhi Ty2
acaaagccugcuggaa

SEQ ID NO: 1759584 - RNA, 19 nt, Salmonella enterica enterica serovar Typhi Ty2
acaaagcgguaaaucgcaa

SEQ ID NO: 1759585 - RNA, 11 nt, Salmonella enterica enterica serovar Typhi Ty2
acaaagagcuc

SEQ ID NO: 1759586 - RNA, 17 nt, Salmonella enterica enterica serovar Typhi Ty2
acaaagguuuguuuaau

SEQ ID NO: 1759587 - RNA, 23 nt, Salmonella enterica enterica serovar Typhi Ty2
acaaagguugcgccaaagcaauc

SEQ ID NO: 1759588 - RNA, 12 nt, Salmonella enterica enterica serovar Typhi Ty2
acaaauuuaaac

SEQ ID NO: 1759589 - RNA, 19 nt, Salmonella enterica enterica serovar Typhi Ty2
acaaauuccggcacaaccu

SEQ ID NO: 1759590 - RNA, 21 nt, Salmonella enterica enterica serovar Typhi Ty2
acaacaaaguauaaagcuggu

SEQ ID NO: 1759591 - RNA, 17 nt, Salmonella enterica enterica serovar Typhi Ty2
acaaauuuugauaaaaa

SEQ ID NO: 1759592 - RNA, 23 nt, Salmonella enterica enterica serovar Typhi Ty2
acaacacacguaacaaccagaau

SEQ ID NO: 1759593 - RNA, 13 nt, Salmonella enterica enterica serovar Typhi Ty2
acaaauaaaucca

SEQ ID NO: 1759594 - RNA, 23 nt, Salmonella enterica enterica serovar Typhi Ty2
acaaauaacagacgaaaaaaaag

SEQ ID NO: 1759595 - RNA, 15 nt, Salmonella enterica enterica serovar Typhi Ty2
acaaauaacuuuccu

SEQ ID NO: 1759596 - RNA, 21 nt, Salmonella enterica enterica serovar Typhi Ty2
acaaaucacuggagcgcauuu

SEQ ID NO: 1759597 - RNA, 16 nt, Salmonella enterica enterica serovar Typhi Ty2
acaaaucgacagccag

SEQ ID NO: 1759598 - RNA, 22 nt, Salmonella enterica enterica serovar Typhi Ty2
acaaaucgggcgggcauuauac

SEQ ID NO: 1759599 - RNA, 22 nt, Salmonella enterica enterica serovar Typhi Ty2
aaggccagacucaucgccgcaa

SEQ ID NO: 1759600 - RNA, 18 nt, Salmonella enterica enterica serovar Typhi Ty2
aaggccgauaaagcguuu

SEQ ID NO: 1759601 - RNA, 18 nt, Salmonella enterica enterica serovar Typhi Ty2
aaggccgggaaaucuucu

SEQ ID NO: 1759602 - RNA, 22 nt, Salmonella enterica enterica serovar Typhi Ty2
aaggccucaucgggacggcggu

SEQ ID NO: 1759603 - RNA, 23 nt, Salmonella enterica enterica serovar Typhi Ty2
aaggccuggcugagaaaaauacg

SEQ ID NO: 1759604 - RNA, 22 nt, Salmonella enterica enterica serovar Typhi Ty2
aaggcgacgaugugcauaaccg

SEQ ID NO: 1759605 - RNA, 23 nt, Salmonella enterica enterica serovar Typhi Ty2
aaggcgacgaugugcauaaccgc

SEQ ID NO: 1759606 - RNA, 17 nt, Salmonella enterica enterica serovar Typhi Ty2
aaggcgacgcuucacgu

SEQ ID NO: 1759607 - RNA, 18 nt, Salmonella enterica enterica serovar Typhi Ty2
aaggcgauucaacagggc

SEQ ID NO: 1759608 - RNA, 14 nt, Salmonella enterica enterica serovar Typhi Ty2
aaggcgccuuuuuu

SEQ ID NO: 1759609 - RNA, 15 nt, Salmonella enterica enterica serovar Typhi Ty2
aaggcgcuagccgca

SEQ ID NO: 1759610 - RNA, 22 nt, Salmonella enterica enterica serovar Typhi Ty2
aaggcaaauaugcugucuauug

SEQ ID NO: 1759611 - RNA, 19 nt, Salmonella enterica enterica serovar Typhi Ty2
aaggcaugaugccacgaga

SEQ ID NO: 1759612 - RNA, 15 nt, Salmonella enterica enterica serovar Typhi Ty2
aaggcaucuucagac

SEQ ID NO: 1759613 - RNA, 23 nt, Salmonella enterica enterica serovar Typhi Ty2
aaggcauuauguuuugaacauau

SEQ ID NO: 1759614 - RNA, 19 nt, Salmonella enterica enterica serovar Typhi Ty2
aaggcauuugccagacuug

SEQ ID NO: 1759615 - RNA, 11 nt, Salmonella enterica enterica serovar Typhi Ty2
aaggccagacu

SEQ ID NO: 1759616 - RNA, 18 nt, Salmonella enterica enterica serovar Typhi Ty2
aaggcagaagaaucugcc

SEQ ID NO: 1759617 - RNA, 14 nt, Salmonella enterica enterica serovar Typhi Ty2
aaggugagcucuuu

SEQ ID NO: 1759618 - RNA, 13 nt, Salmonella enterica enterica serovar Typhi Ty2
aagguugccgcaa

SEQ ID NO: 1759619 - RNA, 17 nt, Salmonella enterica enterica serovar Typhi Ty2
aagguaacgcgaaaaaa

SEQ ID NO: 1759620 - RNA, 23 nt, Salmonella enterica enterica serovar Typhi Ty2
aagguaaacgcgaccagcgcgcc

SEQ ID NO: 1759621 - RNA, 23 nt, Salmonella enterica enterica serovar Typhi Ty2
aaggucugacaacuauugcugcc

SEQ ID NO: 1759622 - RNA, 13 nt, Salmonella enterica enterica serovar Typhi Ty2
aaggugagaaaaa

SEQ ID NO: 1759623 - RNA, 13 nt, Salmonella enterica enterica serovar Typhi Ty2
aagguauguuugu

SEQ ID NO: 1759624 - RNA, 22 nt, Salmonella enterica enterica serovar Typhi Ty2
aaggcgcuugugauaucugacu

SEQ ID NO: 1759625 - RNA, 23 nt, Salmonella enterica enterica serovar Typhi Ty2
aaggcggacaacgcauauuauga

SEQ ID NO: 1759626 - RNA, 16 nt, Salmonella enterica enterica serovar Typhi Ty2
aaggcggcaaagauaa

SEQ ID NO: 1759627 - RNA, 17 nt, Salmonella enterica enterica serovar Typhi Ty2
aaggcggcaaagauaau

SEQ ID NO: 1759628 - RNA, 15 nt, Salmonella enterica enterica serovar Typhi Ty2
aaggcucucuuacca

SEQ ID NO: 1759629 - RNA, 18 nt, Salmonella enterica enterica serovar Typhi Ty2
aaggcugcgcguuuucau

SEQ ID NO: 1759630 - RNA, 13 nt, Salmonella enterica enterica serovar Typhi Ty2
aagcuuucuguua

SEQ ID NO: 1759631 - RNA, 14 nt, Salmonella enterica enterica serovar Typhi Ty2
aagcuuguagaaaa

SEQ ID NO: 1759632 - RNA, 17 nt, Salmonella enterica enterica serovar Typhi Ty2
aagcuuaggauaagaau

SEQ ID NO: 1759633 - RNA, 21 nt, Salmonella enterica enterica serovar Typhi Ty2
aagcuguuucuccguuguugc

SEQ ID NO: 1759634 - RNA, 20 nt, Salmonella enterica enterica serovar Typhi Ty2
aagcuguuccggcuucguua

SEQ ID NO: 1759635 - RNA, 13 nt, Salmonella enterica enterica serovar Typhi Ty2
aagcuguuguugc

SEQ ID NO: 1759636 - RNA, 23 nt, Salmonella enterica enterica serovar Typhi Ty2
aagcuguuaauuugcaucaggcc

SEQ ID NO: 1759637 - RNA, 16 nt, Salmonella enterica enterica serovar Typhi Ty2
aagcugccgucccagc

SEQ ID NO: 1759638 - RNA, 17 nt, Salmonella enterica enterica serovar Typhi Ty2
aagcugcaccaggagca

SEQ ID NO: 1759639 - RNA, 21 nt, Salmonella enterica enterica serovar Typhi Ty2
aagcugcggcccagauaacgc

SEQ ID NO: 1759640 - RNA, 19 nt, Salmonella enterica enterica serovar Typhi Ty2
aagcugcggcccagauaac

SEQ ID NO: 1759641 - RNA, 19 nt, Salmonella enterica enterica serovar Typhi Ty2
aagcugcuggcgagcagga

SEQ ID NO: 1759642 - RNA, 20 nt, Salmonella enterica enterica serovar Typhi Ty2
aagcuuugcguaaaaaacau

SEQ ID NO: 1759643 - RNA, 19 nt, Salmonella enterica enterica serovar Typhi Ty2
aagcuuugcguaaaaaaca

SEQ ID NO: 1759644 - RNA, 21 nt, Salmonella enterica enterica serovar Typhi Ty2
aagcuuugcguaaaaaacauc

SEQ ID NO: 1759645 - RNA, 23 nt, Salmonella enterica enterica serovar Typhi Ty2
aagcuuuuucugcgugagccgga

SEQ ID NO: 1759646 - RNA, 16 nt, Salmonella enterica enterica serovar Typhi Ty2
aaggauacggaaugga

SEQ ID NO: 1759647 - RNA, 18 nt, Salmonella enterica enterica serovar Typhi Ty2
aagcgucaguaaaagccc

SEQ ID NO: 1759648 - RNA, 15 nt, Salmonella enterica enterica serovar Typhi Ty2
aagcgucaggcgaag

SEQ ID NO: 1759649 - RNA, 22 nt, Salmonella enterica enterica serovar Typhi Ty2
aagcgucucagauggaaaaaaa

SEQ ID NO: 1759650 - RNA, 19 nt, Salmonella enterica enterica serovar Typhi Ty2
aagcgucaguaaaagcccg

SEQ ID NO: 1759651 - RNA, 21 nt, Salmonella enterica enterica serovar Typhi Ty2
aagcgucuuuaaagccuucau

SEQ ID NO: 1759652 - RNA, 23 nt, Salmonella enterica enterica serovar Typhi Ty2
aagcguccgguugcaguacaggc

SEQ ID NO: 1759653 - RNA, 21 nt, Salmonella enterica enterica serovar Typhi Ty2
aagcggauaagauagcaggcg

SEQ ID NO: 1759654 - RNA, 17 nt, Salmonella enterica enterica serovar Typhi Ty2
aagcggauaagauagca

SEQ ID NO: 1759655 - RNA, 17 nt, Salmonella enterica enterica serovar Typhi Ty2
aagcggacugccuaacu

SEQ ID NO: 1759656 - RNA, 23 nt, Salmonella enterica enterica serovar Typhi Ty2
aagcggcagacgugauuuuggca

SEQ ID NO: 1759657 - RNA, 18 nt, Salmonella enterica enterica serovar Typhi Ty2
aagcgcuuuggucaggcu

SEQ ID NO: 1759658 - RNA, 16 nt, Salmonella enterica enterica serovar Typhi Ty2
aagcggaccaaugcug

SEQ ID NO: 1759659 - RNA, 23 nt, Salmonella enterica enterica serovar Typhi Ty2
aagcggaaaggacguucuucucc

SEQ ID NO: 1759660 - RNA, 13 nt, Salmonella enterica enterica serovar Typhi Ty2
aagccacacugca

SEQ ID NO: 1759661 - RNA, 23 nt, Salmonella enterica enterica serovar Typhi Ty2
aagcgucucagauggaaaaaaag

SEQ ID NO: 1759662 - RNA, 19 nt, Salmonella enterica enterica serovar Typhi Ty2
aagcguuacggaaaaaaua

SEQ ID NO: 1759663 - RNA, 22 nt, Salmonella enterica enterica serovar Typhi Ty2
aagcguuaaugcguuuacacag

SEQ ID NO: 1759664 - RNA, 20 nt, Salmonella enterica enterica serovar Typhi Ty2
aagcuaguaaagaaauuuug

SEQ ID NO: 1759665 - RNA, 16 nt, Salmonella enterica enterica serovar Typhi Ty2
aagcuaguaaagaaau

SEQ ID NO: 1759666 - RNA, 23 nt, Salmonella enterica enterica serovar Typhi Ty2
aagcucauuucccaauaguuuau

SEQ ID NO: 1759667 - RNA, 21 nt, Salmonella enterica enterica serovar Typhi Ty2
aagugcauguaaauaaggcug

SEQ ID NO: 1759668 - RNA, 22 nt, Salmonella enterica enterica serovar Typhi Ty2
aaguuaaucagcgccgucgcca

SEQ ID NO: 1759669 - RNA, 15 nt, Salmonella enterica enterica serovar Typhi Ty2
aaguaauaaaauaau

SEQ ID NO: 1759670 - RNA, 13 nt, Salmonella enterica enterica serovar Typhi Ty2
aaguaaggcauga

SEQ ID NO: 1759671 - RNA, 22 nt, Salmonella enterica enterica serovar Typhi Ty2
aagucucagggagaacucaucu

SEQ ID NO: 1759672 - RNA, 18 nt, Salmonella enterica enterica serovar Typhi Ty2
aagucucaggagugaaca

SEQ ID NO: 1759673 - RNA, 17 nt, Salmonella enterica enterica serovar Typhi Ty2
aagucgggaaagggcgg

SEQ ID NO: 1759674 - RNA, 18 nt, Salmonella enterica enterica serovar Typhi Ty2
aagucggggcguaaaaau

SEQ ID NO: 1759675 - RNA, 18 nt, Salmonella enterica enterica serovar Typhi Ty2
aaguccaaguauguuaac

SEQ ID NO: 1759676 - RNA, 15 nt, Salmonella enterica enterica serovar Typhi Ty2
aagucccagaaagua

SEQ ID NO: 1759677 - RNA, 16 nt, Salmonella enterica enterica serovar Typhi Ty2
aagucccuggcgcgcc

SEQ ID NO: 1759678 - RNA, 16 nt, Salmonella enterica enterica serovar Typhi Ty2
aaguuuuucauaucca

SEQ ID NO: 1759679 - RNA, 19 nt, Salmonella enterica enterica serovar Typhi Ty2
aaguuugaugcaaauguca

SEQ ID NO: 1759680 - RNA, 20 nt, Salmonella enterica enterica serovar Typhi Ty2
aaguuuagaaaaaauuaaaa

SEQ ID NO: 1759681 - RNA, 15 nt, Salmonella enterica enterica serovar Typhi Ty2
aaguuuagaaaaaau

SEQ ID NO: 1759682 - RNA, 19 nt, Salmonella enterica enterica serovar Typhi Ty2
aaguuuaacgcgcguucau

SEQ ID NO: 1759683 - RNA, 15 nt, Salmonella enterica enterica serovar Typhi Ty2
aaguugaaaggaaag

SEQ ID NO: 1759684 - RNA, 20 nt, Salmonella enterica enterica serovar Typhi Ty2
aaguuagccccuuaucaaag

SEQ ID NO: 1759685 - RNA, 14 nt, Salmonella enterica enterica serovar Typhi Ty2
aauaaaauuauauu

SEQ ID NO: 1759686 - RNA, 13 nt, Salmonella enterica enterica serovar Typhi Ty2
aauaaaauaacua

SEQ ID NO: 1759687 - RNA, 20 nt, Salmonella enterica enterica serovar Typhi Ty2
aauaaacauuuuuuuugcau

SEQ ID NO: 1759688 - RNA, 16 nt, Salmonella enterica enterica serovar Typhi Ty2
aauaaacacuaaauca

SEQ ID NO: 1759689 - RNA, 22 nt, Salmonella enterica enterica serovar Typhi Ty2
aauaaacaccauacgacgaucc

SEQ ID NO: 1759690 - RNA, 22 nt, Salmonella enterica enterica serovar Typhi Ty2
aauaaacacgauggcaaauaau

SEQ ID NO: 1759691 - RNA, 23 nt, Salmonella enterica enterica serovar Typhi Ty2
aauaaacacgauggcaaauaaua

SEQ ID NO: 1759692 - RNA, 18 nt, Salmonella enterica enterica serovar Typhi Ty2
aauaaagaaagcauuaaa

SEQ ID NO: 1759693 - RNA, 21 nt, Salmonella enterica enterica serovar Typhi Ty2
aauaaagaaagcauuaaauca

SEQ ID NO: 1759694 - RNA, 11 nt, Salmonella enterica enterica serovar Typhi Ty2
aauaaagaaag

SEQ ID NO: 1759695 - RNA, 22 nt, Salmonella enterica enterica serovar Typhi Ty2
aauaaacgccaguggaugcgcu

SEQ ID NO: 1759696 - RNA, 12 nt, Salmonella enterica enterica serovar Typhi Ty2
aauaaaaggaau

SEQ ID NO: 1759697 - RNA, 21 nt, Salmonella enterica enterica serovar Typhi Ty2
aauaaaacugccgucaauuuu

SEQ ID NO: 1759698 - RNA, 13 nt, Salmonella enterica enterica serovar Typhi Ty2
aauaaaaauuccc

SEQ ID NO: 1759699 - RNA, 14 nt, Salmonella enterica enterica serovar Typhi Ty2
aauaaaaaaaccuc

SEQ ID NO: 1759700 - RNA, 18 nt, Salmonella enterica enterica serovar Typhi Ty2
aagauuggccgucacuuu

SEQ ID NO: 1759701 - RNA, 12 nt, Salmonella enterica enterica serovar Typhi Ty2
aagauuccagau

SEQ ID NO: 1759702 - RNA, 18 nt, Salmonella enterica enterica serovar Typhi Ty2
aagauugauuuauucacu

SEQ ID NO: 1759703 - RNA, 15 nt, Salmonella enterica enterica serovar Typhi Ty2
aagaugcuacccguc

SEQ ID NO: 1759704 - RNA, 22 nt, Salmonella enterica enterica serovar Typhi Ty2
aagaugcguaccgcuaucgcca

SEQ ID NO: 1759705 - RNA, 16 nt, Salmonella enterica enterica serovar Typhi Ty2
aagauuaaccagcagu

SEQ ID NO: 1759706 - RNA, 18 nt, Salmonella enterica enterica serovar Typhi Ty2
aagaucuaaagccaguuu

SEQ ID NO: 1759707 - RNA, 19 nt, Salmonella enterica enterica serovar Typhi Ty2
aagaucgcggggcaacaga

SEQ ID NO: 1759708 - RNA, 21 nt, Salmonella enterica enterica serovar Typhi Ty2
aagaucgcauuuaaucgccug

SEQ ID NO: 1759709 - RNA, 18 nt, Salmonella enterica enterica serovar Typhi Ty2
aagaucgccaagcuguga

SEQ ID NO: 1759710 - RNA, 12 nt, Salmonella enterica enterica serovar Typhi Ty2
aagaucccaggg

SEQ ID NO: 1759711 - RNA, 21 nt, Salmonella enterica enterica serovar Typhi Ty2
aagaucccgaccaguuuuugc

SEQ ID NO: 1759712 - RNA, 22 nt, Salmonella enterica enterica serovar Typhi Ty2
aagauauugucgcccugcaauu

SEQ ID NO: 1759713 - RNA, 23 nt, Salmonella enterica enterica serovar Typhi Ty2
aagauaauguccccuaaauaauu

SEQ ID NO: 1759714 - RNA, 23 nt, Salmonella enterica enterica serovar Typhi Ty2
aagcagcuuaucuuuacgcuugu

SEQ ID NO: 1759715 - RNA, 20 nt, Salmonella enterica enterica serovar Typhi Ty2
aagcagcugcugguaccuuu

SEQ ID NO: 1759716 - RNA, 12 nt, Salmonella enterica enterica serovar Typhi Ty2
aagcagcugcug

SEQ ID NO: 1759717 - RNA, 23 nt, Salmonella enterica enterica serovar Typhi Ty2
aagcagcgccuguaaacguuccu

SEQ ID NO: 1759718 - RNA, 15 nt, Salmonella enterica enterica serovar Typhi Ty2
aagcagauaccagcc

SEQ ID NO: 1759719 - RNA, 16 nt, Salmonella enterica enterica serovar Typhi Ty2
aagcagcauaaugaau

SEQ ID NO: 1759720 - RNA, 18 nt, Salmonella enterica enterica serovar Typhi Ty2
aagcagaacguagcccau

SEQ ID NO: 1759721 - RNA, 15 nt, Salmonella enterica enterica serovar Typhi Ty2
aagcaguuccagcau

SEQ ID NO: 1759722 - RNA, 17 nt, Salmonella enterica enterica serovar Typhi Ty2
aagcaguuaauacagug

SEQ ID NO: 1759723 - RNA, 17 nt, Salmonella enterica enterica serovar Typhi Ty2
aagcagcuugcugcuuu

SEQ ID NO: 1759724 - RNA, 23 nt, Salmonella enterica enterica serovar Typhi Ty2
aagcagguagcgccuuuacuggu

SEQ ID NO: 1759725 - RNA, 14 nt, Salmonella enterica enterica serovar Typhi Ty2
aagcauaccuucac

SEQ ID NO: 1759726 - RNA, 15 nt, Salmonella enterica enterica serovar Typhi Ty2
aagcauaccuucaca

SEQ ID NO: 1759727 - RNA, 19 nt, Salmonella enterica enterica serovar Typhi Ty2
aagcauagcgccuucaggc

SEQ ID NO: 1759728 - RNA, 15 nt, Salmonella enterica enterica serovar Typhi Ty2
aagccaaaauuuuca

SEQ ID NO: 1759729 - RNA, 13 nt, Salmonella enterica enterica serovar Typhi Ty2
aagcauuagcgcc

SEQ ID NO: 1759730 - RNA, 19 nt, Salmonella enterica enterica serovar Typhi Ty2
aagcacucguaagaggcgu

SEQ ID NO: 1759731 - RNA, 20 nt, Salmonella enterica enterica serovar Typhi Ty2
aagcacauaacugagacuca

SEQ ID NO: 1759732 - RNA, 19 nt, Salmonella enterica enterica serovar Typhi Ty2
aagcaccaucgcaaauuca

SEQ ID NO: 1759733 - RNA, 14 nt, Salmonella enterica enterica serovar Typhi Ty2
aagcaccgccagcg

SEQ ID NO: 1759734 - RNA, 20 nt, Salmonella enterica enterica serovar Typhi Ty2
aagcaagaggugacucacau

SEQ ID NO: 1759735 - RNA, 23 nt, Salmonella enterica enterica serovar Typhi Ty2
aagcaacugauuaaucugccgac

SEQ ID NO: 1759736 - RNA, 23 nt, Salmonella enterica enterica serovar Typhi Ty2
aagcaacugggcuugcauugcuu

SEQ ID NO: 1759737 - RNA, 14 nt, Salmonella enterica enterica serovar Typhi Ty2
aagcaaugccagaa

SEQ ID NO: 1759738 - RNA, 15 nt, Salmonella enterica enterica serovar Typhi Ty2
aagcaaucgccagcg

SEQ ID NO: 1759739 - RNA, 21 nt, Salmonella enterica enterica serovar Typhi Ty2
aagcaauccauuuuaaauaca

SEQ ID NO: 1759740 - RNA, 14 nt, Salmonella enterica enterica serovar Typhi Ty2
aagauaaaaagaca

SEQ ID NO: 1759741 - RNA, 12 nt, Salmonella enterica enterica serovar Typhi Ty2
aagauaaaaaua

SEQ ID NO: 1759742 - RNA, 18 nt, Salmonella enterica enterica serovar Typhi Ty2
aagauaaaaagacagaua

SEQ ID NO: 1759743 - RNA, 20 nt, Salmonella enterica enterica serovar Typhi Ty2
aagagcguuacccagacagc

SEQ ID NO: 1759744 - RNA, 21 nt, Salmonella enterica enterica serovar Typhi Ty2
aagagcguuacccagacagca

SEQ ID NO: 1759745 - RNA, 16 nt, Salmonella enterica enterica serovar Typhi Ty2
aagagcacuuugguaa

SEQ ID NO: 1759746 - RNA, 15 nt, Salmonella enterica enterica serovar Typhi Ty2
aagagcugaauguau

SEQ ID NO: 1759747 - RNA, 18 nt, Salmonella enterica enterica serovar Typhi Ty2
aagacuggcccugccgga

SEQ ID NO: 1759748 - RNA, 19 nt, Salmonella enterica enterica serovar Typhi Ty2
aagacugauuuaucaccca

SEQ ID NO: 1759749 - RNA, 16 nt, Salmonella enterica enterica serovar Typhi Ty2
aagacgguaaucagac

SEQ ID NO: 1759750 - RNA, 22 nt, Salmonella enterica enterica serovar Typhi Ty2
aagacuacuuaccggcgccaga

SEQ ID NO: 1759751 - RNA, 21 nt, Salmonella enterica enterica serovar Typhi Ty2
aagagagccuuacaggcgcau

SEQ ID NO: 1759752 - RNA, 11 nt, Salmonella enterica enterica serovar Typhi Ty2
aagagaaaacc

SEQ ID NO: 1759753 - RNA, 17 nt, Salmonella enterica enterica serovar Typhi Ty2
aagagaaaaaucaguca

SEQ ID NO: 1759754 - RNA, 13 nt, Salmonella enterica enterica serovar Typhi Ty2
aagagaaaauacc

SEQ ID NO: 1759755 - RNA, 17 nt, Salmonella enterica enterica serovar Typhi Ty2
aagagaauggccagcac

SEQ ID NO: 1759756 - RNA, 17 nt, Salmonella enterica enterica serovar Typhi Ty2
aagagacacgcugaccu

SEQ ID NO: 1759757 - RNA, 13 nt, Salmonella enterica enterica serovar Typhi Ty2
aagaauacccuuu

SEQ ID NO: 1759758 - RNA, 14 nt, Salmonella enterica enterica serovar Typhi Ty2
aaauugagaauuau

SEQ ID NO: 1759759 - RNA, 12 nt, Salmonella enterica enterica serovar Typhi Ty2
aaauucuuuuca

SEQ ID NO: 1759760 - RNA, 17 nt, Salmonella enterica enterica serovar Typhi Ty2
aagaauuauuaccaaug

SEQ ID NO: 1759761 - RNA, 17 nt, Salmonella enterica enterica serovar Typhi Ty2
aagaauguccaucucuu

SEQ ID NO: 1759762 - RNA, 14 nt, Salmonella enterica enterica serovar Typhi Ty2
aagaaugaaaaaaa

SEQ ID NO: 1759763 - RNA, 12 nt, Salmonella enterica enterica serovar Typhi Ty2
aagaauaugaga

SEQ ID NO: 1759764 - RNA, 22 nt, Salmonella enterica enterica serovar Typhi Ty2
aagaauaucggcgucaacguuu

SEQ ID NO: 1759765 - RNA, 19 nt, Salmonella enterica enterica serovar Typhi Ty2
aagacagaagcugagaaaa

SEQ ID NO: 1759766 - RNA, 16 nt, Salmonella enterica enterica serovar Typhi Ty2
aagacaccccagccua

SEQ ID NO: 1759767 - RNA, 20 nt, Salmonella enterica enterica serovar Typhi Ty2
aagaauuauuaucaauuuca

SEQ ID NO: 1759768 - RNA, 16 nt, Salmonella enterica enterica serovar Typhi Ty2
aagaauuugaacucuu

SEQ ID NO: 1759769 - RNA, 19 nt, Salmonella enterica enterica serovar Typhi Ty2
aagaauuucgcgaauaauc

SEQ ID NO: 1759770 - RNA, 23 nt, Salmonella enterica enterica serovar Typhi Ty2
aagacaugaucuuaccucuccug

SEQ ID NO: 1759771 - RNA, 22 nt, Salmonella enterica enterica serovar Typhi Ty2
aagaccaauaaaacgcccccug

SEQ ID NO: 1759772 - RNA, 11 nt, Salmonella enterica enterica serovar Typhi Ty2
aagaccagcau

SEQ ID NO: 1759773 - RNA, 14 nt, Salmonella enterica enterica serovar Typhi Ty2
aagacauucacaua

SEQ ID NO: 1759774 - RNA, 16 nt, Salmonella enterica enterica serovar Typhi Ty2
aagacgaauaaggaau

SEQ ID NO: 1759775 - RNA, 21 nt, Salmonella enterica enterica serovar Typhi Ty2
aagacgaaaaaugaauaccaa

SEQ ID NO: 1759776 - RNA, 15 nt, Salmonella enterica enterica serovar Typhi Ty2
aagaccuccgcccgg

SEQ ID NO: 1759777 - RNA, 18 nt, Salmonella enterica enterica serovar Typhi Ty2
aagaccaugaacaccuca

SEQ ID NO: 1759778 - RNA, 20 nt, Salmonella enterica enterica serovar Typhi Ty2
aaugucaugacugguuuuuc

SEQ ID NO: 1759779 - RNA, 20 nt, Salmonella enterica enterica serovar Typhi Ty2
aauguccagcagugucugcu

SEQ ID NO: 1759780 - RNA, 12 nt, Salmonella enterica enterica serovar Typhi Ty2
aaugucaucauc

SEQ ID NO: 1759781 - RNA, 21 nt, Salmonella enterica enterica serovar Typhi Ty2
aaugucguuacggcugaagcu

SEQ ID NO: 1759782 - RNA, 16 nt, Salmonella enterica enterica serovar Typhi Ty2
aaugucguccaugcug

SEQ ID NO: 1759783 - RNA, 16 nt, Salmonella enterica enterica serovar Typhi Ty2
aaugucgcaaucggcu

SEQ ID NO: 1759784 - RNA, 15 nt, Salmonella enterica enterica serovar Typhi Ty2
aaugucgcgcaggcg

SEQ ID NO: 1759785 - RNA, 14 nt, Salmonella enterica enterica serovar Typhi Ty2
aaugucgcgucagg

SEQ ID NO: 1759786 - RNA, 17 nt, Salmonella enterica enterica serovar Typhi Ty2
aaugucgcgucagguuu

SEQ ID NO: 1759787 - RNA, 19 nt, Salmonella enterica enterica serovar Typhi Ty2
aaugucuggcgcuaaaauc

SEQ ID NO: 1759788 - RNA, 23 nt, Salmonella enterica enterica serovar Typhi Ty2
aaugucuuccuuuucuagccaau

SEQ ID NO: 1759789 - RNA, 21 nt, Salmonella enterica enterica serovar Typhi Ty2
aaugugaaauacagccagguu

SEQ ID NO: 1759790 - RNA, 18 nt, Salmonella enterica enterica serovar Typhi Ty2
aauggucccugauauaca

SEQ ID NO: 1759791 - RNA, 23 nt, Salmonella enterica enterica serovar Typhi Ty2
aaugguauuaugcggaccgauag

SEQ ID NO: 1759792 - RNA, 19 nt, Salmonella enterica enterica serovar Typhi Ty2
aauggcucaacuccgccgg

SEQ ID NO: 1759793 - RNA, 16 nt, Salmonella enterica enterica serovar Typhi Ty2
aaugggcaggagauga

SEQ ID NO: 1759794 - RNA, 22 nt, Salmonella enterica enterica serovar Typhi Ty2
aauguauucucccgucagcaac

SEQ ID NO: 1759795 - RNA, 23 nt, Salmonella enterica enterica serovar Typhi Ty2
aauguauucucccgucagcaaca

SEQ ID NO: 1759796 - RNA, 22 nt, Salmonella enterica enterica serovar Typhi Ty2
aauguauaauccaacauuauca

SEQ ID NO: 1759797 - RNA, 14 nt, Salmonella enterica enterica serovar Typhi Ty2
aauggucgcgccag

SEQ ID NO: 1759798 - RNA, 21 nt, Salmonella enterica enterica serovar Typhi Ty2
aauggucuuaaaugccgccgg

SEQ ID NO: 1759799 - RNA, 18 nt, Salmonella enterica enterica serovar Typhi Ty2
aaugcuggugcaucuggg

SEQ ID NO: 1759800 - RNA, 19 nt, Salmonella enterica enterica serovar Typhi Ty2
aauggcagaauaaaacagc

SEQ ID NO: 1759801 - RNA, 15 nt, Salmonella enterica enterica serovar Typhi Ty2
aauggcguugcuggc

SEQ ID NO: 1759802 - RNA, 18 nt, Salmonella enterica enterica serovar Typhi Ty2
aauggcaaguaaaauagc

SEQ ID NO: 1759803 - RNA, 23 nt, Salmonella enterica enterica serovar Typhi Ty2
aaugccaucaucaguaacacccg

SEQ ID NO: 1759804 - RNA, 19 nt, Salmonella enterica enterica serovar Typhi Ty2
aaugccauaauuuauccuc

SEQ ID NO: 1759805 - RNA, 19 nt, Salmonella enterica enterica serovar Typhi Ty2
aaugcccagcgcaaucacg

SEQ ID NO: 1759806 - RNA, 13 nt, Salmonella enterica enterica serovar Typhi Ty2
aaugcccacgccg

SEQ ID NO: 1759807 - RNA, 18 nt, Salmonella enterica enterica serovar Typhi Ty2
aaugcuccaauaaauauu

SEQ ID NO: 1759808 - RNA, 19 nt, Salmonella enterica enterica serovar Typhi Ty2
aauguuagcgucugcggcu

SEQ ID NO: 1759809 - RNA, 16 nt, Salmonella enterica enterica serovar Typhi Ty2
aauguuccgcagggga

SEQ ID NO: 1759810 - RNA, 19 nt, Salmonella enterica enterica serovar Typhi Ty2
aaugugccgguaagaagaa

SEQ ID NO: 1759811 - RNA, 18 nt, Salmonella enterica enterica serovar Typhi Ty2
aauguguguacaaccauc

SEQ ID NO: 1759812 - RNA, 19 nt, Salmonella enterica enterica serovar Typhi Ty2
aauguuuucugccagcaga

SEQ ID NO: 1759813 - RNA, 20 nt, Salmonella enterica enterica serovar Typhi Ty2
aauguuuagucuuuuaguau

SEQ ID NO: 1759814 - RNA, 15 nt, Salmonella enterica enterica serovar Typhi Ty2
aauguuguuccagag

SEQ ID NO: 1759815 - RNA, 22 nt, Salmonella enterica enterica serovar Typhi Ty2
aauguuuaaucggccagcgaaa

SEQ ID NO: 1759816 - RNA, 16 nt, Salmonella enterica enterica serovar Typhi Ty2
aauuaaugauuaaaau

SEQ ID NO: 1759817 - RNA, 17 nt, Salmonella enterica enterica serovar Typhi Ty2
aauuacaucaauaaaca

SEQ ID NO: 1759818 - RNA, 13 nt, Salmonella enterica enterica serovar Typhi Ty2
aauuacuuaugau

SEQ ID NO: 1759819 - RNA, 17 nt, Salmonella enterica enterica serovar Typhi Ty2
aauuacuuaugauauau

SEQ ID NO: 1759820 - RNA, 23 nt, Salmonella enterica enterica serovar Typhi Ty2
aauuaagcaauccauuuuaaaua

SEQ ID NO: 1759821 - RNA, 16 nt, Salmonella enterica enterica serovar Typhi Ty2
aauuaaaugcuugcuu

SEQ ID NO: 1759822 - RNA, 18 nt, Salmonella enterica enterica serovar Typhi Ty2
aauuaaauaacaaaugaa

SEQ ID NO: 1759823 - RNA, 19 nt, Salmonella enterica enterica serovar Typhi Ty2
aaucgcaucauaaauggcu

SEQ ID NO: 1759824 - RNA, 19 nt, Salmonella enterica enterica serovar Typhi Ty2
aaucgauauaauuuuauua

SEQ ID NO: 1759825 - RNA, 19 nt, Salmonella enterica enterica serovar Typhi Ty2
aaucgauagcgauuuuuga

SEQ ID NO: 1759826 - RNA, 13 nt, Salmonella enterica enterica serovar Typhi Ty2
aaucggcuucucc

SEQ ID NO: 1759827 - RNA, 18 nt, Salmonella enterica enterica serovar Typhi Ty2
aaucggcgucuggagcgu

SEQ ID NO: 1759828 - RNA, 19 nt, Salmonella enterica enterica serovar Typhi Ty2
aaucggcuaguaauaccag

SEQ ID NO: 1759829 - RNA, 20 nt, Salmonella enterica enterica serovar Typhi Ty2
aaucggccagcgaaaaccag

SEQ ID NO: 1759830 - RNA, 21 nt, Salmonella enterica enterica serovar Typhi Ty2
aaucguucuugcacaauacuu

SEQ ID NO: 1759831 - RNA, 19 nt, Salmonella enterica enterica serovar Typhi Ty2
aaucguucgccagugacaa

SEQ ID NO: 1759832 - RNA, 18 nt, Salmonella enterica enterica serovar Typhi Ty2
aaucgugaccaccgccau

SEQ ID NO: 1759833 - RNA, 14 nt, Salmonella enterica enterica serovar Typhi Ty2
aaucaucaucaucc

SEQ ID NO: 1759834 - RNA, 18 nt, Salmonella enterica enterica serovar Typhi Ty2
aaucaucaccguuuucca

SEQ ID NO: 1759835 - RNA, 14 nt, Salmonella enterica enterica serovar Typhi Ty2
aaucaucauauccc

SEQ ID NO: 1759836 - RNA, 21 nt, Salmonella enterica enterica serovar Typhi Ty2
aauccuuuuucaugcaauaau

SEQ ID NO: 1759837 - RNA, 14 nt, Salmonella enterica enterica serovar Typhi Ty2
aaucgauaagccag

SEQ ID NO: 1759838 - RNA, 13 nt, Salmonella enterica enterica serovar Typhi Ty2
aaucgagcccaga

SEQ ID NO: 1759839 - RNA, 21 nt, Salmonella enterica enterica serovar Typhi Ty2
aaucgaaucguucgccaguga

SEQ ID NO: 1759840 - RNA, 21 nt, Salmonella enterica enterica serovar Typhi Ty2
aaucgacaugucggcgaaaau

SEQ ID NO: 1759841 - RNA, 16 nt, Salmonella enterica enterica serovar Typhi Ty2
aaucucuacgccggcg

SEQ ID NO: 1759842 - RNA, 16 nt, Salmonella enterica enterica serovar Typhi Ty2
aaucucuggccaggca

SEQ ID NO: 1759843 - RNA, 15 nt, Salmonella enterica enterica serovar Typhi Ty2
aaucucgaaacaaua

SEQ ID NO: 1759844 - RNA, 22 nt, Salmonella enterica enterica serovar Typhi Ty2
aaucuccuccggcuucagcaac

SEQ ID NO: 1759845 - RNA, 13 nt, Salmonella enterica enterica serovar Typhi Ty2
aaucuaaaauuau

SEQ ID NO: 1759846 - RNA, 13 nt, Salmonella enterica enterica serovar Typhi Ty2
aaucguuuuaugc

SEQ ID NO: 1759847 - RNA, 23 nt, Salmonella enterica enterica serovar Typhi Ty2
aaucucagauaauagcugcggcu

SEQ ID NO: 1759848 - RNA, 20 nt, Salmonella enterica enterica serovar Typhi Ty2
aaucucaucugcaaaauaua

SEQ ID NO: 1759849 - RNA, 20 nt, Salmonella enterica enterica serovar Typhi Ty2
aaucuccagaccgcugcgga

SEQ ID NO: 1759850 - RNA, 12 nt, Salmonella enterica enterica serovar Typhi Ty2
aaucuccagcau

SEQ ID NO: 1759851 - RNA, 15 nt, Salmonella enterica enterica serovar Typhi Ty2
aaugaccagcgccca

SEQ ID NO: 1759852 - RNA, 21 nt, Salmonella enterica enterica serovar Typhi Ty2
aaugaccacaccgucaacauc

SEQ ID NO: 1759853 - RNA, 15 nt, Salmonella enterica enterica serovar Typhi Ty2
aaugauaaugccgcu

SEQ ID NO: 1759854 - RNA, 12 nt, Salmonella enterica enterica serovar Typhi Ty2
aaugauuaaaau

SEQ ID NO: 1759855 - RNA, 18 nt, Salmonella enterica enterica serovar Typhi Ty2
aaugauuacggaacaaaa

SEQ ID NO: 1759856 - RNA, 20 nt, Salmonella enterica enterica serovar Typhi Ty2
aaugcaauauuacaaagcag

SEQ ID NO: 1759857 - RNA, 15 nt, Salmonella enterica enterica serovar Typhi Ty2
aaugcacaauacgcc

SEQ ID NO: 1759858 - RNA, 15 nt, Salmonella enterica enterica serovar Typhi Ty2
aaugaucaauggcgc

SEQ ID NO: 1759859 - RNA, 18 nt, Salmonella enterica enterica serovar Typhi Ty2
aaugauaccaauuugagc

SEQ ID NO: 1759860 - RNA, 18 nt, Salmonella enterica enterica serovar Typhi Ty2
aaugaagcggaaaggacg

SEQ ID NO: 1759861 - RNA, 17 nt, Salmonella enterica enterica serovar Typhi Ty2
aaugaauugaacuaaaa

SEQ ID NO: 1759862 - RNA, 12 nt, Salmonella enterica enterica serovar Typhi Ty2
aaucugcuuuuu

SEQ ID NO: 1759863 - RNA, 21 nt, Salmonella enterica enterica serovar Typhi Ty2
aaucugcauguaguaagccau

SEQ ID NO: 1759864 - RNA, 18 nt, Salmonella enterica enterica serovar Typhi Ty2
aaucugccgucaucgacu

SEQ ID NO: 1759865 - RNA, 15 nt, Salmonella enterica enterica serovar Typhi Ty2
aaucugccaucagca

SEQ ID NO: 1759866 - RNA, 20 nt, Salmonella enterica enterica serovar Typhi Ty2
aaucuggccuacggaaagcu

SEQ ID NO: 1759867 - RNA, 17 nt, Salmonella enterica enterica serovar Typhi Ty2
aaucacaaaauggcuga

SEQ ID NO: 1759868 - RNA, 16 nt, Salmonella enterica enterica serovar Typhi Ty2
aaucacaaagccgucg

SEQ ID NO: 1759869 - RNA, 13 nt, Salmonella enterica enterica serovar Typhi Ty2
aaucacauccgcc

SEQ ID NO: 1759870 - RNA, 16 nt, Salmonella enterica enterica serovar Typhi Ty2
aaucacauacagcacu

SEQ ID NO: 1759871 - RNA, 20 nt, Salmonella enterica enterica serovar Typhi Ty2
aaucacauacagcacuuccc

SEQ ID NO: 1759872 - RNA, 14 nt, Salmonella enterica enterica serovar Typhi Ty2
aaucaccagcccga

SEQ ID NO: 1759873 - RNA, 13 nt, Salmonella enterica enterica serovar Typhi Ty2
aaucaccagcgca

SEQ ID NO: 1759874 - RNA, 21 nt, Salmonella enterica enterica serovar Typhi Ty2
aaucaccguuguggcgaccag

SEQ ID NO: 1759875 - RNA, 15 nt, Salmonella enterica enterica serovar Typhi Ty2
aaucaccccaagcaa

SEQ ID NO: 1759876 - RNA, 16 nt, Salmonella enterica enterica serovar Typhi Ty2
aaucaauguauuuaag

SEQ ID NO: 1759877 - RNA, 20 nt, Salmonella enterica enterica serovar Typhi Ty2
aaucaacgccgccaggauaa

SEQ ID NO: 1759878 - RNA, 22 nt, Salmonella enterica enterica serovar Typhi Ty2
aaucaacgccacaccgagacag

SEQ ID NO: 1759879 - RNA, 14 nt, Salmonella enterica enterica serovar Typhi Ty2
aaucaaccggguaa

SEQ ID NO: 1759880 - RNA, 15 nt, Salmonella enterica enterica serovar Typhi Ty2
aaucaacguagaauc

SEQ ID NO: 1759881 - RNA, 18 nt, Salmonella enterica enterica serovar Typhi Ty2
aaucaacuccauaauuug

SEQ ID NO: 1759882 - RNA, 17 nt, Salmonella enterica enterica serovar Typhi Ty2
aaucaagcccagcucag

SEQ ID NO: 1759883 - RNA, 22 nt, Salmonella enterica enterica serovar Typhi Ty2
aaucaucagaccgauaaauacc

SEQ ID NO: 1759884 - RNA, 22 nt, Salmonella enterica enterica serovar Typhi Ty2
aaucaguggcggcaaaaaauau

SEQ ID NO: 1759885 - RNA, 14 nt, Salmonella enterica enterica serovar Typhi Ty2
aaucagugcugaaa

SEQ ID NO: 1759886 - RNA, 15 nt, Salmonella enterica enterica serovar Typhi Ty2
aaucagcgcaauaaa

SEQ ID NO: 1759887 - RNA, 22 nt, Salmonella enterica enterica serovar Typhi Ty2
aaucagcgccgucgccaucacc

SEQ ID NO: 1759888 - RNA, 21 nt, Salmonella enterica enterica serovar Typhi Ty2
aaucagcagccgggccagacg

SEQ ID NO: 1759889 - RNA, 17 nt, Salmonella enterica enterica serovar Typhi Ty2
aaucagcgauaaccaga

SEQ ID NO: 1759890 - RNA, 23 nt, Salmonella enterica enterica serovar Typhi Ty2
aaucagccaaagcgagguaaaaa

SEQ ID NO: 1759891 - RNA, 17 nt, Salmonella enterica enterica serovar Typhi Ty2
aaucagauugccacagg

SEQ ID NO: 1759892 - RNA, 22 nt, Salmonella enterica enterica serovar Typhi Ty2
aaucagauacggcuccagcaca

SEQ ID NO: 1759893 - RNA, 16 nt, Salmonella enterica enterica serovar Typhi Ty2
aaucacuuaucaaacc

SEQ ID NO: 1759894 - RNA, 20 nt, Salmonella enterica enterica serovar Typhi Ty2
aaucacuuaucaaaccagcu

SEQ ID NO: 1759895 - RNA, 15 nt, Salmonella enterica enterica serovar Typhi Ty2
aaucacuacggguuu

SEQ ID NO: 1759896 - RNA, 20 nt, Salmonella enterica enterica serovar Typhi Ty2
aaucacguuuacuaaaacgg

SEQ ID NO: 1759897 - RNA, 16 nt, Salmonella enterica enterica serovar Typhi Ty2
aaucaccugcaucacg

SEQ ID NO: 1759898 - RNA, 12 nt, Salmonella enterica enterica serovar Typhi Ty2
aauauuuuuccg

SEQ ID NO: 1759899 - RNA, 17 nt, Salmonella enterica enterica serovar Typhi Ty2
aauauuugaucacauca

SEQ ID NO: 1759900 - RNA, 14 nt, Salmonella enterica enterica serovar Typhi Ty2
aauauuuauuauuu

SEQ ID NO: 1759901 - RNA, 17 nt, Salmonella enterica enterica serovar Typhi Ty2
aaucaaaaaguuaugcu

SEQ ID NO: 1759902 - RNA, 18 nt, Salmonella enterica enterica serovar Typhi Ty2
aauauugccgccauuauu

SEQ ID NO: 1759903 - RNA, 14 nt, Salmonella enterica enterica serovar Typhi Ty2
aauauucauuucca

SEQ ID NO: 1759904 - RNA, 16 nt, Salmonella enterica enterica serovar Typhi Ty2
aauauucaucaaaaug

SEQ ID NO: 1759905 - RNA, 17 nt, Salmonella enterica enterica serovar Typhi Ty2
aauauucacgcgaauuc

SEQ ID NO: 1759906 - RNA, 18 nt, Salmonella enterica enterica serovar Typhi Ty2
aauauucagaauaugcca

SEQ ID NO: 1759907 - RNA, 19 nt, Salmonella enterica enterica serovar Typhi Ty2
aauauucagaauaugccag

SEQ ID NO: 1759908 - RNA, 16 nt, Salmonella enterica enterica serovar Typhi Ty2
aauaugaucugcacaa

SEQ ID NO: 1759909 - RNA, 14 nt, Salmonella enterica enterica serovar Typhi Ty2
aauaugauuuaaaa

SEQ ID NO: 1759910 - RNA, 17 nt, Salmonella enterica enterica serovar Typhi Ty2
aauauauuucacuucau

SEQ ID NO: 1759911 - RNA, 15 nt, Salmonella enterica enterica serovar Typhi Ty2
aauauauucaucuuu

SEQ ID NO: 1759912 - RNA, 17 nt, Salmonella enterica enterica serovar Typhi Ty2
aauauaaccaauuuaaa

SEQ ID NO: 1759913 - RNA, 17 nt, Salmonella enterica enterica serovar Typhi Ty2
aauauaugacaacacuc

SEQ ID NO: 1759914 - RNA, 20 nt, Salmonella enterica enterica serovar Typhi Ty2
aauaucagccauuaaccaga

SEQ ID NO: 1759915 - RNA, 23 nt, Salmonella enterica enterica serovar Typhi Ty2
aauaucaauucaacacuuagaac

SEQ ID NO: 1759916 - RNA, 13 nt, Salmonella enterica enterica serovar Typhi Ty2
aauaucaaucagc

SEQ ID NO: 1759917 - RNA, 14 nt, Salmonella enterica enterica serovar Typhi Ty2
aauaucaauauaau

SEQ ID NO: 1759918 - RNA, 23 nt, Salmonella enterica enterica serovar Typhi Ty2
aauaucgaaauuggaguuaucau

SEQ ID NO: 1759919 - RNA, 18 nt, Salmonella enterica enterica serovar Typhi Ty2
aauaucgauagcauuuuu

SEQ ID NO: 1759920 - RNA, 15 nt, Salmonella enterica enterica serovar Typhi Ty2
aauaugaaagagaaa

SEQ ID NO: 1759921 - RNA, 14 nt, Salmonella enterica enterica serovar Typhi Ty2
aauaucgucaguau

SEQ ID NO: 1759922 - RNA, 19 nt, Salmonella enterica enterica serovar Typhi Ty2
aauaguaaauagaaaauaa

SEQ ID NO: 1759923 - RNA, 20 nt, Salmonella enterica enterica serovar Typhi Ty2
aauaguugucagaccuucaa

SEQ ID NO: 1759924 - RNA, 23 nt, Salmonella enterica enterica serovar Typhi Ty2
aauaguuuauugagauaauuuau

SEQ ID NO: 1759925 - RNA, 22 nt, Salmonella enterica enterica serovar Typhi Ty2
aauaguauggagcaggaaaaga

SEQ ID NO: 1759926 - RNA, 19 nt, Salmonella enterica enterica serovar Typhi Ty2
aauagagaaaauaacaaua

SEQ ID NO: 1759927 - RNA, 17 nt, Salmonella enterica enterica serovar Typhi Ty2
aauagagaaaucaacga

SEQ ID NO: 1759928 - RNA, 18 nt, Salmonella enterica enterica serovar Typhi Ty2
aauagagaaaauaacaau

SEQ ID NO: 1759929 - RNA, 21 nt, Salmonella enterica enterica serovar Typhi Ty2
aauagacuucacuuucccgga

SEQ ID NO: 1759930 - RNA, 23 nt, Salmonella enterica enterica serovar Typhi Ty2
aauagagagcgacagcccggcgu

SEQ ID NO: 1759931 - RNA, 17 nt, Salmonella enterica enterica serovar Typhi Ty2
aauagagagaaucgggu

SEQ ID NO: 1759932 - RNA, 21 nt, Salmonella enterica enterica serovar Typhi Ty2
aauagacaacaucccagaaaa

SEQ ID NO: 1759933 - RNA, 16 nt, Salmonella enterica enterica serovar Typhi Ty2
aauagaggaaauaaca

SEQ ID NO: 1759934 - RNA, 16 nt, Salmonella enterica enterica serovar Typhi Ty2
aauagaguaaugacaa

SEQ ID NO: 1759935 - RNA, 14 nt, Salmonella enterica enterica serovar Typhi Ty2
aauagaguaaugac

SEQ ID NO: 1759936 - RNA, 14 nt, Salmonella enterica enterica serovar Typhi Ty2
aauagcggcacaga

SEQ ID NO: 1759937 - RNA, 18 nt, Salmonella enterica enterica serovar Typhi Ty2
aauaccagcguaauccuc

SEQ ID NO: 1759938 - RNA, 21 nt, Salmonella enterica enterica serovar Typhi Ty2
aauaccacuucggcagaaaaa

SEQ ID NO: 1759939 - RNA, 19 nt, Salmonella enterica enterica serovar Typhi Ty2
aauaccaggcggcuuuuuc

SEQ ID NO: 1759940 - RNA, 14 nt, Salmonella enterica enterica serovar Typhi Ty2
aauacgaaaauccu

SEQ ID NO: 1759941 - RNA, 22 nt, Salmonella enterica enterica serovar Typhi Ty2
aauaccccaggggcauauauua

SEQ ID NO: 1759942 - RNA, 24 nt, Salmonella enterica enterica serovar Typhi Ty2
aauacgguuagccagugggcguca

SEQ ID NO: 1759943 - RNA, 20 nt, Salmonella enterica enterica serovar Typhi Ty2
aauacgucucgaguaaucac

SEQ ID NO: 1759944 - RNA, 20 nt, Salmonella enterica enterica serovar Typhi Ty2
aauacgagugacauuauuca

SEQ ID NO: 1759945 - RNA, 18 nt, Salmonella enterica enterica serovar Typhi Ty2
aauacgagugacauuauu

SEQ ID NO: 1759946 - RNA, 19 nt, Salmonella enterica enterica serovar Typhi Ty2
aauacgaaauugagaauua

SEQ ID NO: 1759947 - RNA, 18 nt, Salmonella enterica enterica serovar Typhi Ty2
aauacuucgcucucuuuu

SEQ ID NO: 1759948 - RNA, 14 nt, Salmonella enterica enterica serovar Typhi Ty2
aauacuuaaaccug

SEQ ID NO: 1759949 - RNA, 14 nt, Salmonella enterica enterica serovar Typhi Ty2
aauacuuccugcuc

SEQ ID NO: 1759950 - RNA, 18 nt, Salmonella enterica enterica serovar Typhi Ty2
aauacguuuauucuuuuc

SEQ ID NO: 1759951 - RNA, 22 nt, Salmonella enterica enterica serovar Typhi Ty2
aauacuacugguggaauaaaua

SEQ ID NO: 1759952 - RNA, 21 nt, Salmonella enterica enterica serovar Typhi Ty2
aauacuccugcaacagaagag

SEQ ID NO: 1759953 - RNA, 21 nt, Salmonella enterica enterica serovar Typhi Ty2
aauacaggguuugucagcaua

SEQ ID NO: 1759954 - RNA, 21 nt, Salmonella enterica enterica serovar Typhi Ty2
aauacagccagguugccagaa

SEQ ID NO: 1759955 - RNA, 20 nt, Salmonella enterica enterica serovar Typhi Ty2
aauacacgguaaauucuuua

SEQ ID NO: 1759956 - RNA, 16 nt, Salmonella enterica enterica serovar Typhi Ty2
aauaaagccagauacg

SEQ ID NO: 1759957 - RNA, 20 nt, Salmonella enterica enterica serovar Typhi Ty2
aauaaagcccuguuauucag

SEQ ID NO: 1759958 - RNA, 21 nt, Salmonella enterica enterica serovar Typhi Ty2
aauaaagcggucuuucaacau

SEQ ID NO: 1759959 - RNA, 20 nt, Salmonella enterica enterica serovar Typhi Ty2
aauaaaggcgcuguuggcau

SEQ ID NO: 1759960 - RNA, 21 nt, Salmonella enterica enterica serovar Typhi Ty2
aauaaaggauuguacuuauua

SEQ ID NO: 1759961 - RNA, 14 nt, Salmonella enterica enterica serovar Typhi Ty2
aauaaagugcugaa

SEQ ID NO: 1759962 - RNA, 19 nt, Salmonella enterica enterica serovar Typhi Ty2
aauacaauucaacucacua

SEQ ID NO: 1759963 - RNA, 18 nt, Salmonella enterica enterica serovar Typhi Ty2
aauacaauucaacucacu

SEQ ID NO: 1759964 - RNA, 15 nt, Salmonella enterica enterica serovar Typhi Ty2
aauacaauucaacuc

SEQ ID NO: 1759965 - RNA, 17 nt, Salmonella enterica enterica serovar Typhi Ty2
aauacaccgccauauau

SEQ ID NO: 1759966 - RNA, 20 nt, Salmonella enterica enterica serovar Typhi Ty2
aauacaccgccauauauuua

SEQ ID NO: 1759967 - RNA, 18 nt, Salmonella enterica enterica serovar Typhi Ty2
aaauuauuggcuuuguaa

SEQ ID NO: 1759968 - RNA, 20 nt, Salmonella enterica enterica serovar Typhi Ty2
aaauuaucuguugauaaaac

SEQ ID NO: 1759969 - RNA, 19 nt, Salmonella enterica enterica serovar Typhi Ty2
aaauuaugggauugcaaaa

SEQ ID NO: 1759970 - RNA, 13 nt, Salmonella enterica enterica serovar Typhi Ty2
uuuuuucaucucc

SEQ ID NO: 1759971 - RNA, 12 nt, Salmonella enterica enterica serovar Typhi Ty2
uuuuuucagccu

SEQ ID NO: 1759972 - RNA, 11 nt, Salmonella enterica enterica serovar Typhi Ty2
uuuuuuggcag

SEQ ID NO: 1759973 - RNA, 11 nt, Salmonella enterica enterica serovar Typhi Ty2
uuuuuuugccc

SEQ ID NO: 1759974 - RNA, 10 nt, Salmonella enterica enterica serovar Typhi Ty2
uuuuuuugca

SEQ ID NO: 1759975 - RNA, 19 nt, Salmonella enterica enterica serovar Typhi Ty2
aaauuccccauaaucgacc

SEQ ID NO: 1759976 - RNA, 21 nt, Salmonella enterica enterica serovar Typhi Ty2
aaauucggcguuacccgucug

SEQ ID NO: 1759977 - RNA, 12 nt, Salmonella enterica enterica serovar Typhi Ty2
aaauucgaaaua

SEQ ID NO: 1759978 - RNA, 16 nt, Salmonella enterica enterica serovar Typhi Ty2
aaauucgaaauaaaga

SEQ ID NO: 1759979 - RNA, 17 nt, Salmonella enterica enterica serovar Typhi Ty2
aaauuccuuguuuuaac

SEQ ID NO: 1759980 - RNA, 17 nt, Salmonella enterica enterica serovar Typhi Ty2
aaauucuaugccaggcg

SEQ ID NO: 1759981 - RNA, 12 nt, Salmonella enterica enterica serovar Typhi Ty2
aaauuauuuuca

SEQ ID NO: 1759982 - RNA, 15 nt, Salmonella enterica enterica serovar Typhi Ty2
aaauuauuuuaaauu

SEQ ID NO: 1759983 - RNA, 14 nt, Salmonella enterica enterica serovar Typhi Ty2
aaauuauuuuaaau

SEQ ID NO: 1759984 - RNA, 19 nt, Salmonella enterica enterica serovar Typhi Ty2
aaauuauuuuuacuuaaaa

SEQ ID NO: 1759985 - RNA, 19 nt, Salmonella enterica enterica serovar Typhi Ty2
aaauucacgcuucucuggc

SEQ ID NO: 1759986 - RNA, 21 nt, Salmonella enterica enterica serovar Typhi Ty2
aaauucacccguuauucauuc

SEQ ID NO: 1759987 - RNA, 17 nt, Salmonella enterica enterica serovar Typhi Ty2
uuuuugccacauuuccc

SEQ ID NO: 1759988 - RNA, 18 nt, Salmonella enterica enterica serovar Typhi Ty2
uuuuugccacauuucccg

SEQ ID NO: 1759989 - RNA, 21 nt, Salmonella enterica enterica serovar Typhi Ty2
uuuuugcgacacgcugcauau

SEQ ID NO: 1759990 - RNA, 13 nt, Salmonella enterica enterica serovar Typhi Ty2
uuuuuguauuccu

SEQ ID NO: 1759991 - RNA, 16 nt, Salmonella enterica enterica serovar Typhi Ty2
uuuuucgaucagcaua

SEQ ID NO: 1759992 - RNA, 21 nt, Salmonella enterica enterica serovar Typhi Ty2
uuuuucucgauaucuuccccg

SEQ ID NO: 1759993 - RNA, 16 nt, Salmonella enterica enterica serovar Typhi Ty2
uuuuugacuaaaguuu

SEQ ID NO: 1759994 - RNA, 22 nt, Salmonella enterica enterica serovar Typhi Ty2
uuuuucucuguccggaauaacu

SEQ ID NO: 1759995 - RNA, 13 nt, Salmonella enterica enterica serovar Typhi Ty2
aaauuaaucgcca

SEQ ID NO: 1759996 - RNA, 14 nt, Salmonella enterica enterica serovar Typhi Ty2
aaauuaagaaagua

SEQ ID NO: 1759997 - RNA, 12 nt, Salmonella enterica enterica serovar Typhi Ty2
aaauguuuuugu

SEQ ID NO: 1759998 - RNA, 14 nt, Salmonella enterica enterica serovar Typhi Ty2
aaauuaaaaauacc

SEQ ID NO: 1759999 - RNA, 19 nt, Salmonella enterica enterica serovar Typhi Ty2
aaauguuguuugaaaagug

SEQ ID NO: 1760000 - RNA, 20 nt, Salmonella enterica enterica serovar Typhi Ty2
uuuuguggccugcuuaaaca

SEQ ID NO: 1760001 - RNA, 15 nt, Salmonella enterica enterica serovar Typhi Ty2
uuuuguugauuuuau

SEQ ID NO: 1760002 - RNA, 17 nt, Salmonella enterica enterica serovar Typhi Ty2
uuuugucaugguaaaug

SEQ ID NO: 1760003 - RNA, 23 nt, Salmonella enterica enterica serovar Typhi Ty2
uuuuguauugcgcgucacaagcu

SEQ ID NO: 1760004 - RNA, 15 nt, Salmonella enterica enterica serovar Typhi Ty2
uuuuggucagcucac

SEQ ID NO: 1760005 - RNA, 19 nt, Salmonella enterica enterica serovar Typhi Ty2
uuuuuaaauguuuuuucau

SEQ ID NO: 1760006 - RNA, 13 nt, Salmonella enterica enterica serovar Typhi Ty2
uuuuuaaaaaacc

SEQ ID NO: 1760007 - RNA, 12 nt, Salmonella enterica enterica serovar Typhi Ty2
uuuuuaauaaua

SEQ ID NO: 1760008 - RNA, 16 nt, Salmonella enterica enterica serovar Typhi Ty2
uuuuuaauauaagccu

SEQ ID NO: 1760009 - RNA, 15 nt, Salmonella enterica enterica serovar Typhi Ty2
uuuuuaauccaggaa

SEQ ID NO: 1760010 - RNA, 15 nt, Salmonella enterica enterica serovar Typhi Ty2
uuuuuacaaauuuaa

SEQ ID NO: 1760011 - RNA, 21 nt, Salmonella enterica enterica serovar Typhi Ty2
uuuuuauauuccgcaggcaag

SEQ ID NO: 1760012 - RNA, 16 nt, Salmonella enterica enterica serovar Typhi Ty2
uuuuuauauucgcuca

SEQ ID NO: 1760013 - RNA, 22 nt, Salmonella enterica enterica serovar Typhi Ty2
uuuuuaccgcauuauaaauauc

SEQ ID NO: 1760014 - RNA, 23 nt, Salmonella enterica enterica serovar Typhi Ty2
uuuuuaccgcauuauaaauauca

SEQ ID NO: 1760015 - RNA, 17 nt, Salmonella enterica enterica serovar Typhi Ty2
uuuuuaggccaaacuua

SEQ ID NO: 1760016 - RNA, 13 nt, Salmonella enterica enterica serovar Typhi Ty2
uuuuucagcggca

SEQ ID NO: 1760017 - RNA, 14 nt, Salmonella enterica enterica serovar Typhi Ty2
uuuuucagccgcgc

SEQ ID NO: 1760018 - RNA, 17 nt, Salmonella enterica enterica serovar Typhi Ty2
uuuuucagaauaucgcc

SEQ ID NO: 1760019 - RNA, 12 nt, Salmonella enterica enterica serovar Typhi Ty2
uuuuucagaucg

SEQ ID NO: 1760020 - RNA, 12 nt, Salmonella enterica enterica serovar Typhi Ty2
uuuuucagaucu

SEQ ID NO: 1760021 - RNA, 13 nt, Salmonella enterica enterica serovar Typhi Ty2
uuuuucagcaaau

SEQ ID NO: 1760022 - RNA, 14 nt, Salmonella enterica enterica serovar Typhi Ty2
uuuuuccagcucag

SEQ ID NO: 1760023 - RNA, 11 nt, Salmonella enterica enterica serovar Typhi Ty2
uuuuuccagcg

SEQ ID NO: 1760024 - RNA, 23 nt, Salmonella enterica enterica serovar Typhi Ty2
uuuuuccgccaccuguuucgcca

SEQ ID NO: 1760025 - RNA, 22 nt, Salmonella enterica enterica serovar Typhi Ty2
uuuuuccccguugcucauguua

SEQ ID NO: 1760026 - RNA, 15 nt, Salmonella enterica enterica serovar Typhi Ty2
uuuuucaugcaauaa

SEQ ID NO: 1760027 - RNA, 11 nt, Salmonella enterica enterica serovar Typhi Ty2
uuuucuucaug

SEQ ID NO: 1760028 - RNA, 20 nt, Salmonella enterica enterica serovar Typhi Ty2
uuuucugucguguccuugcc

SEQ ID NO: 1760029 - RNA, 17 nt, Salmonella enterica enterica serovar Typhi Ty2
uuuugaacauaugaagg

SEQ ID NO: 1760030 - RNA, 23 nt, Salmonella enterica enterica serovar Typhi Ty2
uuuucucuucugcugacaucucu

SEQ ID NO: 1760031 - RNA, 14 nt, Salmonella enterica enterica serovar Typhi Ty2
uuuucugcuuucuu

SEQ ID NO: 1760032 - RNA, 18 nt, Salmonella enterica enterica serovar Typhi Ty2
uuuucugcgccaccagcg

SEQ ID NO: 1760033 - RNA, 22 nt, Salmonella enterica enterica serovar Typhi Ty2
uuuugcacggcaucuuuguucu

SEQ ID NO: 1760034 - RNA, 20 nt, Salmonella enterica enterica serovar Typhi Ty2
uuuugauaagagaaaauacc

SEQ ID NO: 1760035 - RNA, 18 nt, Salmonella enterica enterica serovar Typhi Ty2
uuuugacaacaaaaagau

SEQ ID NO: 1760036 - RNA, 23 nt, Salmonella enterica enterica serovar Typhi Ty2
uuuugacugcgggggcaaaugcg

SEQ ID NO: 1760037 - RNA, 21 nt, Salmonella enterica enterica serovar Typhi Ty2
uuuugccgcccagucacggcu

SEQ ID NO: 1760038 - RNA, 17 nt, Salmonella enterica enterica serovar Typhi Ty2
uuuugcccgcucgcuua

SEQ ID NO: 1760039 - RNA, 21 nt, Salmonella enterica enterica serovar Typhi Ty2
uuuugcccgaucccaugcuca

SEQ ID NO: 1760040 - RNA, 19 nt, Salmonella enterica enterica serovar Typhi Ty2
uuuugccugcggauuugcu

SEQ ID NO: 1760041 - RNA, 17 nt, Salmonella enterica enterica serovar Typhi Ty2
uuuugccguugcuguuc

SEQ ID NO: 1760042 - RNA, 24 nt, Salmonella enterica enterica serovar Typhi Ty2
uuuugccggauggcacugcgcuua

SEQ ID NO: 1760043 - RNA, 16 nt, Salmonella enterica enterica serovar Typhi Ty2
uuuuggggaaaauacc

SEQ ID NO: 1760044 - RNA, 11 nt, Salmonella enterica enterica serovar Typhi Ty2
uuuuggcagcc

SEQ ID NO: 1760045 - RNA, 11 nt, Salmonella enterica enterica serovar Typhi Ty2
uuuugcucagu

SEQ ID NO: 1760046 - RNA, 12 nt, Salmonella enterica enterica serovar Typhi Ty2
uuuuaaaagaag

SEQ ID NO: 1760047 - RNA, 12 nt, Salmonella enterica enterica serovar Typhi Ty2
uuuuaaaaguua

SEQ ID NO: 1760048 - RNA, 12 nt, Salmonella enterica enterica serovar Typhi Ty2
uuuuaaaaauaa

SEQ ID NO: 1760049 - RNA, 16 nt, Salmonella enterica enterica serovar Typhi Ty2
uuuuaaacgccugauc

SEQ ID NO: 1760050 - RNA, 13 nt, Salmonella enterica enterica serovar Typhi Ty2
uuuuaaaaaaccg

SEQ ID NO: 1760051 - RNA, 14 nt, Salmonella enterica enterica serovar Typhi Ty2
uuuguuuuuuauau

SEQ ID NO: 1760052 - RNA, 14 nt, Salmonella enterica enterica serovar Typhi Ty2
uuuguugauuuuau

SEQ ID NO: 1760053 - RNA, 18 nt, Salmonella enterica enterica serovar Typhi Ty2
uuuuaagcauccaggaag

SEQ ID NO: 1760054 - RNA, 12 nt, Salmonella enterica enterica serovar Typhi Ty2
uuuuaaauuccu

SEQ ID NO: 1760055 - RNA, 22 nt, Salmonella enterica enterica serovar Typhi Ty2
uuuuaauguccagcagugucug

SEQ ID NO: 1760056 - RNA, 12 nt, Salmonella enterica enterica serovar Typhi Ty2
uuuuaauuuuua

SEQ ID NO: 1760057 - RNA, 19 nt, Salmonella enterica enterica serovar Typhi Ty2
uuuuaauuuuuaugucauu

SEQ ID NO: 1760058 - RNA, 18 nt, Salmonella enterica enterica serovar Typhi Ty2
uuuuacaggcacuuacuc

SEQ ID NO: 1760059 - RNA, 23 nt, Salmonella enterica enterica serovar Typhi Ty2
uuuuacgagaaccaacugccaaa

SEQ ID NO: 1760060 - RNA, 20 nt, Salmonella enterica enterica serovar Typhi Ty2
uuuggcagacagccauauuu

SEQ ID NO: 1760061 - RNA, 22 nt, Salmonella enterica enterica serovar Typhi Ty2
uuuggcguaaucgauaagcuca

SEQ ID NO: 1760062 - RNA, 15 nt, Salmonella enterica enterica serovar Typhi Ty2
uuuggcgauuuucag

SEQ ID NO: 1760063 - RNA, 13 nt, Salmonella enterica enterica serovar Typhi Ty2
uuuggccugcugc

SEQ ID NO: 1760064 - RNA, 17 nt, Salmonella enterica enterica serovar Typhi Ty2
uuuggcuuaaauaaucu

SEQ ID NO: 1760065 - RNA, 21 nt, Salmonella enterica enterica serovar Typhi Ty2
uuuggcgcgaaauguauuuuu

SEQ ID NO: 1760066 - RNA, 20 nt, Salmonella enterica enterica serovar Typhi Ty2
uuuggguaaauaccaggcac

SEQ ID NO: 1760067 - RNA, 20 nt, Salmonella enterica enterica serovar Typhi Ty2
uuuggucggagccaauaauc

SEQ ID NO: 1760068 - RNA, 18 nt, Salmonella enterica enterica serovar Typhi Ty2
uuugcuuuaauauucauu

SEQ ID NO: 1760069 - RNA, 15 nt, Salmonella enterica enterica serovar Typhi Ty2
uuugcuuuauuuguu

SEQ ID NO: 1760070 - RNA, 18 nt, Salmonella enterica enterica serovar Typhi Ty2
uuugcuucucgccuucgg

SEQ ID NO: 1760071 - RNA, 14 nt, Salmonella enterica enterica serovar Typhi Ty2
uuugcuucucgccu

SEQ ID NO: 1760072 - RNA, 22 nt, Salmonella enterica enterica serovar Typhi Ty2
uuugcuucgccaucuccaucau

SEQ ID NO: 1760073 - RNA, 18 nt, Salmonella enterica enterica serovar Typhi Ty2
uuugcuguuuuauuuccu

SEQ ID NO: 1760074 - RNA, 16 nt, Salmonella enterica enterica serovar Typhi Ty2
uuugcuuauccggccu

SEQ ID NO: 1760075 - RNA, 19 nt, Salmonella enterica enterica serovar Typhi Ty2
uuugcugacaaucugcugg

SEQ ID NO: 1760076 - RNA, 15 nt, Salmonella enterica enterica serovar Typhi Ty2
uuugcugacaaucug

SEQ ID NO: 1760077 - RNA, 15 nt, Salmonella enterica enterica serovar Typhi Ty2
uuugcugcauuucuu

SEQ ID NO: 1760078 - RNA, 22 nt, Salmonella enterica enterica serovar Typhi Ty2
uuugcugguugucucaaaaaau

SEQ ID NO: 1760079 - RNA, 21 nt, Salmonella enterica enterica serovar Typhi Ty2
uuugcugguugucucaaaaaa

SEQ ID NO: 1760080 - RNA, 22 nt, Salmonella enterica enterica serovar Typhi Ty2
uuuguauugcgcgucacaagcu

SEQ ID NO: 1760081 - RNA, 16 nt, Salmonella enterica enterica serovar Typhi Ty2
uuuguacuucagagcu

SEQ ID NO: 1760082 - RNA, 18 nt, Salmonella enterica enterica serovar Typhi Ty2
uuuguacguauuuacaaa

SEQ ID NO: 1760083 - RNA, 16 nt, Salmonella enterica enterica serovar Typhi Ty2
uuuguggcguguggcu

SEQ ID NO: 1760084 - RNA, 16 nt, Salmonella enterica enterica serovar Typhi Ty2
uuugucuccucgccag

SEQ ID NO: 1760085 - RNA, 13 nt, Salmonella enterica enterica serovar Typhi Ty2
uuugugaguucau

SEQ ID NO: 1760086 - RNA, 18 nt, Salmonella enterica enterica serovar Typhi Ty2
uuugugaguucauaaaag

SEQ ID NO: 1760087 - RNA, 17 nt, Salmonella enterica enterica serovar Typhi Ty2
uuugucuccucaugccu

SEQ ID NO: 1760088 - RNA, 22 nt, Salmonella enterica enterica serovar Typhi Ty2
uuugucaucagaucaugaggau

SEQ ID NO: 1760089 - RNA, 17 nt, Salmonella enterica enterica serovar Typhi Ty2
uuuuaugucauuuauuu

SEQ ID NO: 1760090 - RNA, 21 nt, Salmonella enterica enterica serovar Typhi Ty2
uuuuauuauuuugauacucau

SEQ ID NO: 1760091 - RNA, 13 nt, Salmonella enterica enterica serovar Typhi Ty2
uuuuauauuuuua

SEQ ID NO: 1760092 - RNA, 19 nt, Salmonella enterica enterica serovar Typhi Ty2
uuuuaugaugcauuugauu

SEQ ID NO: 1760093 - RNA, 16 nt, Salmonella enterica enterica serovar Typhi Ty2
uuuuaugcguuuaauu

SEQ ID NO: 1760094 - RNA, 20 nt, Salmonella enterica enterica serovar Typhi Ty2
uuuuaugcguuuaauugaau

SEQ ID NO: 1760095 - RNA, 16 nt, Salmonella enterica enterica serovar Typhi Ty2
uuuuaucgauaauauc

SEQ ID NO: 1760096 - RNA, 20 nt, Salmonella enterica enterica serovar Typhi Ty2
uuuuagauccccaaacugcu

SEQ ID NO: 1760097 - RNA, 13 nt, Salmonella enterica enterica serovar Typhi Ty2
uuuuagaaaauaa

SEQ ID NO: 1760098 - RNA, 16 nt, Salmonella enterica enterica serovar Typhi Ty2
uuuuacuuuuuuaaau

SEQ ID NO: 1760099 - RNA, 15 nt, Salmonella enterica enterica serovar Typhi Ty2
uuuuacuuucauucc

SEQ ID NO: 1760100 - RNA, 19 nt, Salmonella enterica enterica serovar Typhi Ty2
uuuuagaauuaucugaaag

SEQ ID NO: 1760101 - RNA, 19 nt, Salmonella enterica enterica serovar Typhi Ty2
uuuuacuuucaaaauacug

SEQ ID NO: 1760102 - RNA, 20 nt, Salmonella enterica enterica serovar Typhi Ty2
uuuuacgccacggcaauuua

SEQ ID NO: 1760103 - RNA, 20 nt, Salmonella enterica enterica serovar Typhi Ty2
uuuuagcuuaaaaaauccug

SEQ ID NO: 1760104 - RNA, 15 nt, Salmonella enterica enterica serovar Typhi Ty2
uuuuaggcuauaaaa

SEQ ID NO: 1760105 - RNA, 14 nt, Salmonella enterica enterica serovar Typhi Ty2
uuuuagcuuaaaaa

SEQ ID NO: 1760106 - RNA, 14 nt, Salmonella enterica enterica serovar Typhi Ty2
uuuuauaaauauag

SEQ ID NO: 1760107 - RNA, 15 nt, Salmonella enterica enterica serovar Typhi Ty2
uuuucgacagcggcg

SEQ ID NO: 1760108 - RNA, 22 nt, Salmonella enterica enterica serovar Typhi Ty2
uuuucgcagagucgcagcggcg

SEQ ID NO: 1760109 - RNA, 16 nt, Salmonella enterica enterica serovar Typhi Ty2
uuuuccugcggcuuga

SEQ ID NO: 1760110 - RNA, 19 nt, Salmonella enterica enterica serovar Typhi Ty2
uuuuccugcugccaucgcu

SEQ ID NO: 1760111 - RNA, 20 nt, Salmonella enterica enterica serovar Typhi Ty2
uuuuccugcugguagagcau

SEQ ID NO: 1760112 - RNA, 13 nt, Salmonella enterica enterica serovar Typhi Ty2
uuuucgaaaauuu

SEQ ID NO: 1760113 - RNA, 12 nt, Salmonella enterica enterica serovar Typhi Ty2
uuuucggcucac

SEQ ID NO: 1760114 - RNA, 14 nt, Salmonella enterica enterica serovar Typhi Ty2
uuuucguuccagag

SEQ ID NO: 1760115 - RNA, 20 nt, Salmonella enterica enterica serovar Typhi Ty2
uuuucauucgaucuguguac

SEQ ID NO: 1760116 - RNA, 14 nt, Salmonella enterica enterica serovar Typhi Ty2
uuuuccacaauacc

SEQ ID NO: 1760117 - RNA, 18 nt, Salmonella enterica enterica serovar Typhi Ty2
uuuuccaggugcugccac

SEQ ID NO: 1760118 - RNA, 11 nt, Salmonella enterica enterica serovar Typhi Ty2
uuuuccagcac

SEQ ID NO: 1760119 - RNA, 12 nt, Salmonella enterica enterica serovar Typhi Ty2
uuuuccagcuca

SEQ ID NO: 1760120 - RNA, 15 nt, Salmonella enterica enterica serovar Typhi Ty2
uuuuccgcuuuuccu

SEQ ID NO: 1760121 - RNA, 21 nt, Salmonella enterica enterica serovar Typhi Ty2
uuuucccgccagcugcgcgcu

SEQ ID NO: 1760122 - RNA, 17 nt, Salmonella enterica enterica serovar Typhi Ty2
uuuuauuuuuauauucc

SEQ ID NO: 1760123 - RNA, 14 nt, Salmonella enterica enterica serovar Typhi Ty2
uuuuauuuuucaau

SEQ ID NO: 1760124 - RNA, 12 nt, Salmonella enterica enterica serovar Typhi Ty2
uuuucaaaaaca

SEQ ID NO: 1760125 - RNA, 13 nt, Salmonella enterica enterica serovar Typhi Ty2
uuuucaaaaacaa

SEQ ID NO: 1760126 - RNA, 19 nt, Salmonella enterica enterica serovar Typhi Ty2
uuuucaacggcaucaauaa

SEQ ID NO: 1760127 - RNA, 12 nt, Salmonella enterica enterica serovar Typhi Ty2
uuuucaauaauc

SEQ ID NO: 1760128 - RNA, 22 nt, Salmonella enterica enterica serovar Typhi Ty2
uuuucaauaauaaaacgacuca

SEQ ID NO: 1760129 - RNA, 18 nt, Salmonella enterica enterica serovar Typhi Ty2
uuuucagaggucaggauu

SEQ ID NO: 1760130 - RNA, 18 nt, Salmonella enterica enterica serovar Typhi Ty2
uuuucagcggcagcucug

SEQ ID NO: 1760131 - RNA, 17 nt, Salmonella enterica enterica serovar Typhi Ty2
uuuucagcgucuuucuu

SEQ ID NO: 1760132 - RNA, 16 nt, Salmonella enterica enterica serovar Typhi Ty2
uuuucagcagugcaaa

SEQ ID NO: 1760133 - RNA, 16 nt, Salmonella enterica enterica serovar Typhi Ty2
uuuucagcaaauacag

SEQ ID NO: 1760134 - RNA, 15 nt, Salmonella enterica enterica serovar Typhi Ty2
uuuucacuaaucccc

SEQ ID NO: 1760135 - RNA, 23 nt, Salmonella enterica enterica serovar Typhi Ty2
uuuucacuaauccccauuuuuuu

SEQ ID NO: 1760136 - RNA, 13 nt, Salmonella enterica enterica serovar Typhi Ty2
uuuucaccauuaa

SEQ ID NO: 1760137 - RNA, 13 nt, Salmonella enterica enterica serovar Typhi Ty2
uuuucaucaucau

SEQ ID NO: 1760138 - RNA, 15 nt, Salmonella enterica enterica serovar Typhi Ty2
uuuucaugcaauaau

SEQ ID NO: 1760139 - RNA, 15 nt, Salmonella enterica enterica serovar Typhi Ty2
uuuucaggcacagaa

SEQ ID NO: 1760140 - RNA, 11 nt, Salmonella enterica enterica serovar Typhi Ty2
uuuucaggccg

SEQ ID NO: 1760141 - RNA, 19 nt, Salmonella enterica enterica serovar Typhi Ty2
uuucugacagugaugaauc

SEQ ID NO: 1760142 - RNA, 12 nt, Salmonella enterica enterica serovar Typhi Ty2
uuucucuucuuu

SEQ ID NO: 1760143 - RNA, 22 nt, Salmonella enterica enterica serovar Typhi Ty2
uuucucugguuucccugccuca

SEQ ID NO: 1760144 - RNA, 21 nt, Salmonella enterica enterica serovar Typhi Ty2
uuucugauagcccuauucgug

SEQ ID NO: 1760145 - RNA, 14 nt, Salmonella enterica enterica serovar Typhi Ty2
uuucugcugccagc

SEQ ID NO: 1760146 - RNA, 12 nt, Salmonella enterica enterica serovar Typhi Ty2
uuucugcugcca

SEQ ID NO: 1760147 - RNA, 20 nt, Salmonella enterica enterica serovar Typhi Ty2
uuucugccagguuccccaau

SEQ ID NO: 1760148 - RNA, 15 nt, Salmonella enterica enterica serovar Typhi Ty2
uuucuccugcggccu

SEQ ID NO: 1760149 - RNA, 11 nt, Salmonella enterica enterica serovar Typhi Ty2
uuucuccugcg

SEQ ID NO: 1760150 - RNA, 16 nt, Salmonella enterica enterica serovar Typhi Ty2
uuucuccugauuaauc

SEQ ID NO: 1760151 - RNA, 14 nt, Salmonella enterica enterica serovar Typhi Ty2
uuucucgccgccau

SEQ ID NO: 1760152 - RNA, 19 nt, Salmonella enterica enterica serovar Typhi Ty2
uuucucggcuuuccagcuc

SEQ ID NO: 1760153 - RNA, 13 nt, Salmonella enterica enterica serovar Typhi Ty2
uuucucaauacga

SEQ ID NO: 1760154 - RNA, 18 nt, Salmonella enterica enterica serovar Typhi Ty2
uuucuaucagguaacaua

SEQ ID NO: 1760155 - RNA, 23 nt, Salmonella enterica enterica serovar Typhi Ty2
uuucggcguguaacugcaaacgc

SEQ ID NO: 1760156 - RNA, 18 nt, Salmonella enterica enterica serovar Typhi Ty2
uuucguccggcugccacu

SEQ ID NO: 1760157 - RNA, 21 nt, Salmonella enterica enterica serovar Typhi Ty2
uuucgacgauaaaaaaaguau

SEQ ID NO: 1760158 - RNA, 23 nt, Salmonella enterica enterica serovar Typhi Ty2
uuucgaccgcaggcucuuuuucu

SEQ ID NO: 1760159 - RNA, 16 nt, Salmonella enterica enterica serovar Typhi Ty2
uuucgccccacuggcc

SEQ ID NO: 1760160 - RNA, 17 nt, Salmonella enterica enterica serovar Typhi Ty2
uuucgccccacuggccc

SEQ ID NO: 1760161 - RNA, 17 nt, Salmonella enterica enterica serovar Typhi Ty2
uuucgcccgcucgcgau

SEQ ID NO: 1760162 - RNA, 20 nt, Salmonella enterica enterica serovar Typhi Ty2
uuucgccacgcucacuuuuc

SEQ ID NO: 1760163 - RNA, 15 nt, Salmonella enterica enterica serovar Typhi Ty2
uuucgcaaacugauc

SEQ ID NO: 1760164 - RNA, 17 nt, Salmonella enterica enterica serovar Typhi Ty2
uuucgcaaacacccgac

SEQ ID NO: 1760165 - RNA, 23 nt, Salmonella enterica enterica serovar Typhi Ty2
uuucgcgauaauagaacccaaag

SEQ ID NO: 1760166 - RNA, 19 nt, Salmonella enterica enterica serovar Typhi Ty2
uuucgcgaauaaucuguuu

SEQ ID NO: 1760167 - RNA, 17 nt, Salmonella enterica enterica serovar Typhi Ty2
uuucgcgaauaaucugu

SEQ ID NO: 1760168 - RNA, 22 nt, Salmonella enterica enterica serovar Typhi Ty2
uuuccguuuguaacauauuuuu

SEQ ID NO: 1760169 - RNA, 17 nt, Salmonella enterica enterica serovar Typhi Ty2
uuuccguugugaacagc

SEQ ID NO: 1760170 - RNA, 16 nt, Salmonella enterica enterica serovar Typhi Ty2
uuuccguccaccuggc

SEQ ID NO: 1760171 - RNA, 13 nt, Salmonella enterica enterica serovar Typhi Ty2
uuuccguuuuuau

SEQ ID NO: 1760172 - RNA, 22 nt, Salmonella enterica enterica serovar Typhi Ty2
uuuccucccauacccagguuug

SEQ ID NO: 1760173 - RNA, 16 nt, Salmonella enterica enterica serovar Typhi Ty2
uuuccucaaccucuuu

SEQ ID NO: 1760174 - RNA, 13 nt, Salmonella enterica enterica serovar Typhi Ty2
uuuccugaaaaaa

SEQ ID NO: 1760175 - RNA, 18 nt, Salmonella enterica enterica serovar Typhi Ty2
uuuccugaugauauuucu

SEQ ID NO: 1760176 - RNA, 19 nt, Salmonella enterica enterica serovar Typhi Ty2
uuuccugaugauauuucuu

SEQ ID NO: 1760177 - RNA, 16 nt, Salmonella enterica enterica serovar Typhi Ty2
uuuccugcugccaucg

SEQ ID NO: 1760178 - RNA, 23 nt, Salmonella enterica enterica serovar Typhi Ty2
uuuccugcauuaacggcaacagu

SEQ ID NO: 1760179 - RNA, 22 nt, Salmonella enterica enterica serovar Typhi Ty2
uuuccugguaaucgauacggga

SEQ ID NO: 1760180 - RNA, 11 nt, Salmonella enterica enterica serovar Typhi Ty2
uuuccauauuu

SEQ ID NO: 1760181 - RNA, 22 nt, Salmonella enterica enterica serovar Typhi Ty2
uuuccauacauuuuuguaauaa

SEQ ID NO: 1760182 - RNA, 19 nt, Salmonella enterica enterica serovar Typhi Ty2
uuuccaguagucgcgccau

SEQ ID NO: 1760183 - RNA, 21 nt, Salmonella enterica enterica serovar Typhi Ty2
uuuccagucccugaagaaaag

SEQ ID NO: 1760184 - RNA, 17 nt, Salmonella enterica enterica serovar Typhi Ty2
uuuccaggugcugccac

SEQ ID NO: 1760185 - RNA, 13 nt, Salmonella enterica enterica serovar Typhi Ty2
uuucccaguggcg

SEQ ID NO: 1760186 - RNA, 22 nt, Salmonella enterica enterica serovar Typhi Ty2
uuuccauucacacaauuuucuu

SEQ ID NO: 1760187 - RNA, 15 nt, Salmonella enterica enterica serovar Typhi Ty2
uuuccauucguucug

SEQ ID NO: 1760188 - RNA, 19 nt, Salmonella enterica enterica serovar Typhi Ty2
uuucccccuccauacccua

SEQ ID NO: 1760189 - RNA, 13 nt, Salmonella enterica enterica serovar Typhi Ty2
uuuccauuuuuca

SEQ ID NO: 1760190 - RNA, 15 nt, Salmonella enterica enterica serovar Typhi Ty2
uuucccuucugaaau

SEQ ID NO: 1760191 - RNA, 20 nt, Salmonella enterica enterica serovar Typhi Ty2
uuucccugaugauagcgcca

SEQ ID NO: 1760192 - RNA, 18 nt, Salmonella enterica enterica serovar Typhi Ty2
uuucccucauauuuguau

SEQ ID NO: 1760193 - RNA, 14 nt, Salmonella enterica enterica serovar Typhi Ty2
uuuccggaaugaga

SEQ ID NO: 1760194 - RNA, 20 nt, Salmonella enterica enterica serovar Typhi Ty2
uuuccgcuaucuguugcgcc

SEQ ID NO: 1760195 - RNA, 18 nt, Salmonella enterica enterica serovar Typhi Ty2
uuuccgcagccagaauca

SEQ ID NO: 1760196 - RNA, 18 nt, Salmonella enterica enterica serovar Typhi Ty2
uuuccgccugaucuuucu

SEQ ID NO: 1760197 - RNA, 21 nt, Salmonella enterica enterica serovar Typhi Ty2
uuuccgggauguuaauuucau

SEQ ID NO: 1760198 - RNA, 18 nt, Salmonella enterica enterica serovar Typhi Ty2
uuuccggcgggagcucua

SEQ ID NO: 1760199 - RNA, 19 nt, Salmonella enterica enterica serovar Typhi Ty2
uuuccggcagcgcauaagc

SEQ ID NO: 1760200 - RNA, 20 nt, Salmonella enterica enterica serovar Typhi Ty2
uuugacgacaaacuccagcu

SEQ ID NO: 1760201 - RNA, 22 nt, Salmonella enterica enterica serovar Typhi Ty2
uuugaccauuaccauuccucac

SEQ ID NO: 1760202 - RNA, 14 nt, Salmonella enterica enterica serovar Typhi Ty2
uuugacauugucau

SEQ ID NO: 1760203 - RNA, 14 nt, Salmonella enterica enterica serovar Typhi Ty2
uuucuguuccgaaa

SEQ ID NO: 1760204 - RNA, 13 nt, Salmonella enterica enterica serovar Typhi Ty2
uuucuuauuuauu

SEQ ID NO: 1760205 - RNA, 13 nt, Salmonella enterica enterica serovar Typhi Ty2
uuucuuccagguu

SEQ ID NO: 1760206 - RNA, 19 nt, Salmonella enterica enterica serovar Typhi Ty2
uuucuuccauuagcuguug

SEQ ID NO: 1760207 - RNA, 13 nt, Salmonella enterica enterica serovar Typhi Ty2
uuucuuucaucag

SEQ ID NO: 1760208 - RNA, 19 nt, Salmonella enterica enterica serovar Typhi Ty2
uuucuucuggccauuucau

SEQ ID NO: 1760209 - RNA, 23 nt, Salmonella enterica enterica serovar Typhi Ty2
uuucuugccacuggccucccagu

SEQ ID NO: 1760210 - RNA, 19 nt, Salmonella enterica enterica serovar Typhi Ty2
uuucuuguuccugcacccg

SEQ ID NO: 1760211 - RNA, 19 nt, Salmonella enterica enterica serovar Typhi Ty2
uuugagguaugucgaauau

SEQ ID NO: 1760212 - RNA, 22 nt, Salmonella enterica enterica serovar Typhi Ty2
uuugauagacguaaugaucaga

SEQ ID NO: 1760213 - RNA, 22 nt, Salmonella enterica enterica serovar Typhi Ty2
uuugauaaacugcgccauguuc

SEQ ID NO: 1760214 - RNA, 21 nt, Salmonella enterica enterica serovar Typhi Ty2
uuugaugcaaaugucagaucg

SEQ ID NO: 1760215 - RNA, 12 nt, Salmonella enterica enterica serovar Typhi Ty2
uuugcagaaaau

SEQ ID NO: 1760216 - RNA, 19 nt, Salmonella enterica enterica serovar Typhi Ty2
uuugcaccgcuaaaaaaca

SEQ ID NO: 1760217 - RNA, 17 nt, Salmonella enterica enterica serovar Typhi Ty2
uuugcacguucugcugg

SEQ ID NO: 1760218 - RNA, 22 nt, Salmonella enterica enterica serovar Typhi Ty2
uuugauuuguuuuuuauauuuu

SEQ ID NO: 1760219 - RNA, 13 nt, Salmonella enterica enterica serovar Typhi Ty2
uuugauugccauc

SEQ ID NO: 1760220 - RNA, 18 nt, Salmonella enterica enterica serovar Typhi Ty2
uuugauuuauuuugaauu

SEQ ID NO: 1760221 - RNA, 21 nt, Salmonella enterica enterica serovar Typhi Ty2
uuugccucuggccaguuucaa

SEQ ID NO: 1760222 - RNA, 23 nt, Salmonella enterica enterica serovar Typhi Ty2
uuugcgcagcaacgucucgacau

SEQ ID NO: 1760223 - RNA, 13 nt, Salmonella enterica enterica serovar Typhi Ty2
uuugcgacaucag

SEQ ID NO: 1760224 - RNA, 19 nt, Salmonella enterica enterica serovar Typhi Ty2
uuugccuuuugacagcaca

SEQ ID NO: 1760225 - RNA, 15 nt, Salmonella enterica enterica serovar Typhi Ty2
uuugccuuucuuauu

SEQ ID NO: 1760226 - RNA, 22 nt, Salmonella enterica enterica serovar Typhi Ty2
uuugcggcguccaguacuuucu

SEQ ID NO: 1760227 - RNA, 19 nt, Salmonella enterica enterica serovar Typhi Ty2
uuugcgcgguccacaggcc

SEQ ID NO: 1760228 - RNA, 15 nt, Salmonella enterica enterica serovar Typhi Ty2
uuugcgccuuccagu

SEQ ID NO: 1760229 - RNA, 15 nt, Salmonella enterica enterica serovar Typhi Ty2
uuugcguaaaaaaca

SEQ ID NO: 1760230 - RNA, 16 nt, Salmonella enterica enterica serovar Typhi Ty2
uuugcguaaaaaacau

SEQ ID NO: 1760231 - RNA, 18 nt, Salmonella enterica enterica serovar Typhi Ty2
uuugcgguuuuaauuucc

SEQ ID NO: 1760232 - RNA, 18 nt, Salmonella enterica enterica serovar Typhi Ty2
uuugcgucguuccgucag

SEQ ID NO: 1760233 - RNA, 12 nt, Salmonella enterica enterica serovar Typhi Ty2
uuugcuccagaa

SEQ ID NO: 1760234 - RNA, 20 nt, Salmonella enterica enterica serovar Typhi Ty2
uuugcucaggcuccgcgcag

SEQ ID NO: 1760235 - RNA, 16 nt, Salmonella enterica enterica serovar Typhi Ty2
uuugcucaauuuuuuu

SEQ ID NO: 1760236 - RNA, 21 nt, Salmonella enterica enterica serovar Typhi Ty2
uuugccccauuguucuuucau

SEQ ID NO: 1760237 - RNA, 12 nt, Salmonella enterica enterica serovar Typhi Ty2
uuugccauaucu

SEQ ID NO: 1760238 - RNA, 14 nt, Salmonella enterica enterica serovar Typhi Ty2
uuugccuuucuuau

SEQ ID NO: 1760239 - RNA, 14 nt, Salmonella enterica enterica serovar Typhi Ty2
uuugccagcaccag

SEQ ID NO: 1760240 - RNA, 13 nt, Salmonella enterica enterica serovar Typhi Ty2
uuugcauucgcuc

SEQ ID NO: 1760241 - RNA, 21 nt, Salmonella enterica enterica serovar Typhi Ty2
uuugcagguuacucacugccg

SEQ ID NO: 1760242 - RNA, 18 nt, Salmonella enterica enterica serovar Typhi Ty2
uuugcagcaacugauuca

SEQ ID NO: 1760243 - RNA, 17 nt, Salmonella enterica enterica serovar Typhi Ty2
uuugcauaccaaguuug

SEQ ID NO: 1760244 - RNA, 21 nt, Salmonella enterica enterica serovar Typhi Ty2
uuugcaguuccgcaauccugg

SEQ ID NO: 1760245 - RNA, 18 nt, Salmonella enterica enterica serovar Typhi Ty2
uuucagauaacgaaccau

SEQ ID NO: 1760246 - RNA, 18 nt, Salmonella enterica enterica serovar Typhi Ty2
uuucagaggucaggauuu

SEQ ID NO: 1760247 - RNA, 18 nt, Salmonella enterica enterica serovar Typhi Ty2
uuucagaucggcaaaagu

SEQ ID NO: 1760248 - RNA, 20 nt, Salmonella enterica enterica serovar Typhi Ty2
uuucagcggcagcucugccu

SEQ ID NO: 1760249 - RNA, 23 nt, Salmonella enterica enterica serovar Typhi Ty2
uuucagcgcagaauuuauuucug

SEQ ID NO: 1760250 - RNA, 12 nt, Salmonella enterica enterica serovar Typhi Ty2
uuucagcgccag

SEQ ID NO: 1760251 - RNA, 18 nt, Salmonella enterica enterica serovar Typhi Ty2
uuucagccgcgcauagcu

SEQ ID NO: 1760252 - RNA, 15 nt, Salmonella enterica enterica serovar Typhi Ty2
uuucagcauccuccg

SEQ ID NO: 1760253 - RNA, 19 nt, Salmonella enterica enterica serovar Typhi Ty2
uuucacucgcauucuucag

SEQ ID NO: 1760254 - RNA, 15 nt, Salmonella enterica enterica serovar Typhi Ty2
uuucagaauaauguu

SEQ ID NO: 1760255 - RNA, 18 nt, Salmonella enterica enterica serovar Typhi Ty2
uuucauaauaagcgcuca

SEQ ID NO: 1760256 - RNA, 22 nt, Salmonella enterica enterica serovar Typhi Ty2
uuucaguuucggccccccccau

SEQ ID NO: 1760257 - RNA, 12 nt, Salmonella enterica enterica serovar Typhi Ty2
uuucauaauguu

SEQ ID NO: 1760258 - RNA, 16 nt, Salmonella enterica enterica serovar Typhi Ty2
uuucauaaugugugua

SEQ ID NO: 1760259 - RNA, 23 nt, Salmonella enterica enterica serovar Typhi Ty2
uuucagcucgcaggccauaaaac

SEQ ID NO: 1760260 - RNA, 20 nt, Salmonella enterica enterica serovar Typhi Ty2
uuucaggcaaaaaaaaaccg

SEQ ID NO: 1760261 - RNA, 11 nt, Salmonella enterica enterica serovar Typhi Ty2
uuucaggucau

SEQ ID NO: 1760262 - RNA, 12 nt, Salmonella enterica enterica serovar Typhi Ty2
uuucagggcuua

SEQ ID NO: 1760263 - RNA, 16 nt, Salmonella enterica enterica serovar Typhi Ty2
uuucagugauaaagcc

SEQ ID NO: 1760264 - RNA, 21 nt, Salmonella enterica enterica serovar Typhi Ty2
uuucagugacgcguuaauauc

SEQ ID NO: 1760265 - RNA, 18 nt, Salmonella enterica enterica serovar Typhi Ty2
uuucaguaauaauauaaa

SEQ ID NO: 1760266 - RNA, 21 nt, Salmonella enterica enterica serovar Typhi Ty2
uuuccaaagcgaagcugcugu

SEQ ID NO: 1760267 - RNA, 23 nt, Salmonella enterica enterica serovar Typhi Ty2
uuuccaaaauccagggaaaccau

SEQ ID NO: 1760268 - RNA, 16 nt, Salmonella enterica enterica serovar Typhi Ty2
uuucauuucugccugc

SEQ ID NO: 1760269 - RNA, 21 nt, Salmonella enterica enterica serovar Typhi Ty2
uuuccacacaggaguucauca

SEQ ID NO: 1760270 - RNA, 15 nt, Salmonella enterica enterica serovar Typhi Ty2
uuuccagcacgccca

SEQ ID NO: 1760271 - RNA, 20 nt, Salmonella enterica enterica serovar Typhi Ty2
uuuccagccccuucgcuguc

SEQ ID NO: 1760272 - RNA, 22 nt, Salmonella enterica enterica serovar Typhi Ty2
uuuccagcacgcccauauccag

SEQ ID NO: 1760273 - RNA, 20 nt, Salmonella enterica enterica serovar Typhi Ty2
uuucauucagggaaucagcg

SEQ ID NO: 1760274 - RNA, 14 nt, Salmonella enterica enterica serovar Typhi Ty2
uuucauucagaccc

SEQ ID NO: 1760275 - RNA, 14 nt, Salmonella enterica enterica serovar Typhi Ty2
uuucauuagccgcc

SEQ ID NO: 1760276 - RNA, 14 nt, Salmonella enterica enterica serovar Typhi Ty2
uuucauauuuuccu

SEQ ID NO: 1760277 - RNA, 12 nt, Salmonella enterica enterica serovar Typhi Ty2
uuucauccucuu

SEQ ID NO: 1760278 - RNA, 24 nt, Salmonella enterica enterica serovar Typhi Ty2
uuucaucgagcgugucagugccau

SEQ ID NO: 1760279 - RNA, 11 nt, Salmonella enterica enterica serovar Typhi Ty2
uuucauccucu

SEQ ID NO: 1760280 - RNA, 15 nt, Salmonella enterica enterica serovar Typhi Ty2
uuuauacucaaaaaa

SEQ ID NO: 1760281 - RNA, 13 nt, Salmonella enterica enterica serovar Typhi Ty2
uuuauaacauaaa

SEQ ID NO: 1760282 - RNA, 12 nt, Salmonella enterica enterica serovar Typhi Ty2
uuuauuaucuga

SEQ ID NO: 1760283 - RNA, 20 nt, Salmonella enterica enterica serovar Typhi Ty2
uuucaacauauuuuucacac

SEQ ID NO: 1760284 - RNA, 23 nt, Salmonella enterica enterica serovar Typhi Ty2
uuucaacauauuuuucacacaua

SEQ ID NO: 1760285 - RNA, 21 nt, Salmonella enterica enterica serovar Typhi Ty2
uuucaaccgcgccaaagauaa

SEQ ID NO: 1760286 - RNA, 23 nt, Salmonella enterica enterica serovar Typhi Ty2
uuucaacccccucagcaaugauu

SEQ ID NO: 1760287 - RNA, 19 nt, Salmonella enterica enterica serovar Typhi Ty2
uuucaaauuucugauguga

SEQ ID NO: 1760288 - RNA, 19 nt, Salmonella enterica enterica serovar Typhi Ty2
uuucaauauagccguggcu

SEQ ID NO: 1760289 - RNA, 13 nt, Salmonella enterica enterica serovar Typhi Ty2
uuucaaucaucau

SEQ ID NO: 1760290 - RNA, 18 nt, Salmonella enterica enterica serovar Typhi Ty2
uuucaauccuucuucuga

SEQ ID NO: 1760291 - RNA, 18 nt, Salmonella enterica enterica serovar Typhi Ty2
uuucaauguaauuacccu

SEQ ID NO: 1760292 - RNA, 12 nt, Salmonella enterica enterica serovar Typhi Ty2
uuucaacuggcu

SEQ ID NO: 1760293 - RNA, 13 nt, Salmonella enterica enterica serovar Typhi Ty2
uuucaacuuccac

SEQ ID NO: 1760294 - RNA, 18 nt, Salmonella enterica enterica serovar Typhi Ty2
uuucacgccauugccagg

SEQ ID NO: 1760295 - RNA, 12 nt, Salmonella enterica enterica serovar Typhi Ty2
uuucaccuucug

SEQ ID NO: 1760296 - RNA, 19 nt, Salmonella enterica enterica serovar Typhi Ty2
uuucaccguggcaucauca

SEQ ID NO: 1760297 - RNA, 14 nt, Salmonella enterica enterica serovar Typhi Ty2
uuucaauuuccagu

SEQ ID NO: 1760298 - RNA, 18 nt, Salmonella enterica enterica serovar Typhi Ty2
uuucaauuugugagauaa

SEQ ID NO: 1760299 - RNA, 17 nt, Salmonella enterica enterica serovar Typhi Ty2
uuuaacaauuuaucaga

SEQ ID NO: 1760300 - RNA, 21 nt, Salmonella enterica enterica serovar Typhi Ty2
uuuaacaaauuaaauccugaa

SEQ ID NO: 1760301 - RNA, 14 nt, Salmonella enterica enterica serovar Typhi Ty2
uuuaacagauaauu

SEQ ID NO: 1760302 - RNA, 20 nt, Salmonella enterica enterica serovar Typhi Ty2
uuuaacagauaauuaauaau

SEQ ID NO: 1760303 - RNA, 17 nt, Salmonella enterica enterica serovar Typhi Ty2
uuguuuauuccauucau

SEQ ID NO: 1760304 - RNA, 19 nt, Salmonella enterica enterica serovar Typhi Ty2
uuguuucggauaauucuga

SEQ ID NO: 1760305 - RNA, 15 nt, Salmonella enterica enterica serovar Typhi Ty2
uuguuucuuaacccc

SEQ ID NO: 1760306 - RNA, 21 nt, Salmonella enterica enterica serovar Typhi Ty2
uugcugagccaucauuaccaa

SEQ ID NO: 1760307 - RNA, 14 nt, Salmonella enterica enterica serovar Typhi Ty2
uugcugauaaucaa

SEQ ID NO: 1760308 - RNA, 21 nt, Salmonella enterica enterica serovar Typhi Ty2
uugcugaggaucaccccaaca

SEQ ID NO: 1760309 - RNA, 13 nt, Salmonella enterica enterica serovar Typhi Ty2
uuuagugcucagc

SEQ ID NO: 1760310 - RNA, 15 nt, Salmonella enterica enterica serovar Typhi Ty2
uuuaggucaaaaaag

SEQ ID NO: 1760311 - RNA, 21 nt, Salmonella enterica enterica serovar Typhi Ty2
uuuaguucagcauauuucuaa

SEQ ID NO: 1760312 - RNA, 20 nt, Salmonella enterica enterica serovar Typhi Ty2
uuuacugauuagccuguugg

SEQ ID NO: 1760313 - RNA, 12 nt, Salmonella enterica enterica serovar Typhi Ty2
uuuacugaauaa

SEQ ID NO: 1760314 - RNA, 15 nt, Salmonella enterica enterica serovar Typhi Ty2
uuuacucucuuucug

SEQ ID NO: 1760315 - RNA, 18 nt, Salmonella enterica enterica serovar Typhi Ty2
uuuacuccauucccagcu

SEQ ID NO: 1760316 - RNA, 17 nt, Salmonella enterica enterica serovar Typhi Ty2
uuuacuauugccgauaa

SEQ ID NO: 1760317 - RNA, 19 nt, Salmonella enterica enterica serovar Typhi Ty2
uuuacgcagcaagaacaga

SEQ ID NO: 1760318 - RNA, 11 nt, Salmonella enterica enterica serovar Typhi Ty2
uuuagcuuuuc

SEQ ID NO: 1760319 - RNA, 18 nt, Salmonella enterica enterica serovar Typhi Ty2
uuuagcuguucaaucacu

SEQ ID NO: 1760320 - RNA, 16 nt, Salmonella enterica enterica serovar Typhi Ty2
uuuagcgccagcagca

SEQ ID NO: 1760321 - RNA, 17 nt, Salmonella enterica enterica serovar Typhi Ty2
uuuagcgccauuccugc

SEQ ID NO: 1760322 - RNA, 19 nt, Salmonella enterica enterica serovar Typhi Ty2
uuuagcguaggccacaaag

SEQ ID NO: 1760323 - RNA, 23 nt, Salmonella enterica enterica serovar Typhi Ty2
uuuagccugcgcguaaauuucac

SEQ ID NO: 1760324 - RNA, 18 nt, Salmonella enterica enterica serovar Typhi Ty2
uuuagccaucccggcgac

SEQ ID NO: 1760325 - RNA, 23 nt, Salmonella enterica enterica serovar Typhi Ty2
uuuaauuccaccagcuuaucuga

SEQ ID NO: 1760326 - RNA, 16 nt, Salmonella enterica enterica serovar Typhi Ty2
uuuaaccucuuuuuca

SEQ ID NO: 1760327 - RNA, 15 nt, Salmonella enterica enterica serovar Typhi Ty2
uuuaacgauuucccc

SEQ ID NO: 1760328 - RNA, 14 nt, Salmonella enterica enterica serovar Typhi Ty2
uuuaauuuuuaugu

SEQ ID NO: 1760329 - RNA, 13 nt, Salmonella enterica enterica serovar Typhi Ty2
uuuaccauucagc

SEQ ID NO: 1760330 - RNA, 22 nt, Salmonella enterica enterica serovar Typhi Ty2
uuuaccauuacgcuauaaaguu

SEQ ID NO: 1760331 - RNA, 18 nt, Salmonella enterica enterica serovar Typhi Ty2
uuuacccacuucuuccag

SEQ ID NO: 1760332 - RNA, 20 nt, Salmonella enterica enterica serovar Typhi Ty2
uuuacccacuucuuccagcg

SEQ ID NO: 1760333 - RNA, 13 nt, Salmonella enterica enterica serovar Typhi Ty2
uugacaucaggau

SEQ ID NO: 1760334 - RNA, 14 nt, Salmonella enterica enterica serovar Typhi Ty2
uugacaugaaaaau

SEQ ID NO: 1760335 - RNA, 19 nt, Salmonella enterica enterica serovar Typhi Ty2
uugaccaggucgccagcgg

SEQ ID NO: 1760336 - RNA, 14 nt, Salmonella enterica enterica serovar Typhi Ty2
uugaauuauaauaa

SEQ ID NO: 1760337 - RNA, 13 nt, Salmonella enterica enterica serovar Typhi Ty2
uugacucugaagc

SEQ ID NO: 1760338 - RNA, 20 nt, Salmonella enterica enterica serovar Typhi Ty2
uugacugaaauuacgccaua

SEQ ID NO: 1760339 - RNA, 20 nt, Salmonella enterica enterica serovar Typhi Ty2
uugacugcgggggcaaaugc

SEQ ID NO: 1760340 - RNA, 16 nt, Salmonella enterica enterica serovar Typhi Ty2
uugacguuauccagua

SEQ ID NO: 1760341 - RNA, 20 nt, Salmonella enterica enterica serovar Typhi Ty2
uugaccgcauaaucugugau

SEQ ID NO: 1760342 - RNA, 16 nt, Salmonella enterica enterica serovar Typhi Ty2
uugaccucaucaccua

SEQ ID NO: 1760343 - RNA, 12 nt, Salmonella enterica enterica serovar Typhi Ty2
uugaccauuacc

SEQ ID NO: 1760344 - RNA, 14 nt, Salmonella enterica enterica serovar Typhi Ty2
uugacgaaaagaua

SEQ ID NO: 1760345 - RNA, 13 nt, Salmonella enterica enterica serovar Typhi Ty2
uugacgcaaacug

SEQ ID NO: 1760346 - RNA, 15 nt, Salmonella enterica enterica serovar Typhi Ty2
uugacgcuuugcauu

SEQ ID NO: 1760347 - RNA, 13 nt, Salmonella enterica enterica serovar Typhi Ty2
uugaagaaaaacc

SEQ ID NO: 1760348 - RNA, 23 nt, Salmonella enterica enterica serovar Typhi Ty2
uugaacggcggcucguuguuuaa

SEQ ID NO: 1760349 - RNA, 19 nt, Salmonella enterica enterica serovar Typhi Ty2
uugaaguuauccagcgccc

SEQ ID NO: 1760350 - RNA, 22 nt, Salmonella enterica enterica serovar Typhi Ty2
uugaaucgccuggcuugccggc

SEQ ID NO: 1760351 - RNA, 17 nt, Salmonella enterica enterica serovar Typhi Ty2
uucugccagcagaagac

SEQ ID NO: 1760352 - RNA, 22 nt, Salmonella enterica enterica serovar Typhi Ty2
uucugcgccgcuugugccgaca

SEQ ID NO: 1760353 - RNA, 19 nt, Salmonella enterica enterica serovar Typhi Ty2
uucuuuauucacuuuuucu

SEQ ID NO: 1760354 - RNA, 19 nt, Salmonella enterica enterica serovar Typhi Ty2
uucuuuacgcagcaagaac

SEQ ID NO: 1760355 - RNA, 17 nt, Salmonella enterica enterica serovar Typhi Ty2
uucuuugcgccuuauuc

SEQ ID NO: 1760356 - RNA, 23 nt, Salmonella enterica enterica serovar Typhi Ty2
uucuuugacccacgccagcagcu

SEQ ID NO: 1760357 - RNA, 16 nt, Salmonella enterica enterica serovar Typhi Ty2
uucuuucauuuuaccu

SEQ ID NO: 1760358 - RNA, 15 nt, Salmonella enterica enterica serovar Typhi Ty2
uucuuuuuauauucc

SEQ ID NO: 1760359 - RNA, 20 nt, Salmonella enterica enterica serovar Typhi Ty2
uucuuuuucgaucagcauau

SEQ ID NO: 1760360 - RNA, 16 nt, Salmonella enterica enterica serovar Typhi Ty2
uucuuuucaauaaagc

SEQ ID NO: 1760361 - RNA, 16 nt, Salmonella enterica enterica serovar Typhi Ty2
uugaaaacaccaggga

SEQ ID NO: 1760362 - RNA, 13 nt, Salmonella enterica enterica serovar Typhi Ty2
uugaaccaucucg

SEQ ID NO: 1760363 - RNA, 12 nt, Salmonella enterica enterica serovar Typhi Ty2
uugaaauccucu

SEQ ID NO: 1760364 - RNA, 13 nt, Salmonella enterica enterica serovar Typhi Ty2
uugaucacaaaau

SEQ ID NO: 1760365 - RNA, 18 nt, Salmonella enterica enterica serovar Typhi Ty2
uugauaaaacgaauacua

SEQ ID NO: 1760366 - RNA, 18 nt, Salmonella enterica enterica serovar Typhi Ty2
uugaguuugcaauccaga

SEQ ID NO: 1760367 - RNA, 19 nt, Salmonella enterica enterica serovar Typhi Ty2
uugcaagucaccaucagua

SEQ ID NO: 1760368 - RNA, 11 nt, Salmonella enterica enterica serovar Typhi Ty2
uugcaaggcga

SEQ ID NO: 1760369 - RNA, 20 nt, Salmonella enterica enterica serovar Typhi Ty2
uugcaagaaauguccauaaa

SEQ ID NO: 1760370 - RNA, 16 nt, Salmonella enterica enterica serovar Typhi Ty2
uugcaaagcccauaaa

SEQ ID NO: 1760371 - RNA, 20 nt, Salmonella enterica enterica serovar Typhi Ty2
uugaugccuggcaguucccu

SEQ ID NO: 1760372 - RNA, 11 nt, Salmonella enterica enterica serovar Typhi Ty2
uugaugcccaa

SEQ ID NO: 1760373 - RNA, 19 nt, Salmonella enterica enterica serovar Typhi Ty2
uugauuuuucugguaaacc

SEQ ID NO: 1760374 - RNA, 15 nt, Salmonella enterica enterica serovar Typhi Ty2
uugcacggcaucuuu

SEQ ID NO: 1760375 - RNA, 19 nt, Salmonella enterica enterica serovar Typhi Ty2
uugcaccgcuaaaaaacag

SEQ ID NO: 1760376 - RNA, 12 nt, Salmonella enterica enterica serovar Typhi Ty2
uugccccuuccg

SEQ ID NO: 1760377 - RNA, 24 nt, Salmonella enterica enterica serovar Typhi Ty2
uugccccgcuuucagcguugcagc

SEQ ID NO: 1760378 - RNA, 15 nt, Salmonella enterica enterica serovar Typhi Ty2
uugccccgcuuucag

SEQ ID NO: 1760379 - RNA, 15 nt, Salmonella enterica enterica serovar Typhi Ty2
uugccacauuucccg

SEQ ID NO: 1760380 - RNA, 14 nt, Salmonella enterica enterica serovar Typhi Ty2
uugccacagccuca

SEQ ID NO: 1760381 - RNA, 15 nt, Salmonella enterica enterica serovar Typhi Ty2
uugccgccgagcaga

SEQ ID NO: 1760382 - RNA, 16 nt, Salmonella enterica enterica serovar Typhi Ty2
uugccgcccugaaagc

SEQ ID NO: 1760383 - RNA, 20 nt, Salmonella enterica enterica serovar Typhi Ty2
uugccgcgcggauucuccag

SEQ ID NO: 1760384 - RNA, 19 nt, Salmonella enterica enterica serovar Typhi Ty2
uugccucgucuugauuuca

SEQ ID NO: 1760385 - RNA, 17 nt, Salmonella enterica enterica serovar Typhi Ty2
uugccggauggcgcuuu

SEQ ID NO: 1760386 - RNA, 18 nt, Salmonella enterica enterica serovar Typhi Ty2
uugcccuggaauuuuucc

SEQ ID NO: 1760387 - RNA, 22 nt, Salmonella enterica enterica serovar Typhi Ty2
uugccgcaauugguaauuaaag

SEQ ID NO: 1760388 - RNA, 19 nt, Salmonella enterica enterica serovar Typhi Ty2
uugccgaguggaaucagcc

SEQ ID NO: 1760389 - RNA, 16 nt, Salmonella enterica enterica serovar Typhi Ty2
uugcccuggaauuuuu

SEQ ID NO: 1760390 - RNA, 17 nt, Salmonella enterica enterica serovar Typhi Ty2
uugcugaagauaaaauu

SEQ ID NO: 1760391 - RNA, 19 nt, Salmonella enterica enterica serovar Typhi Ty2
uugcucaggcgcgaauaau

SEQ ID NO: 1760392 - RNA, 23 nt, Salmonella enterica enterica serovar Typhi Ty2
uugcuccagcagcgccaguuuuu

SEQ ID NO: 1760393 - RNA, 13 nt, Salmonella enterica enterica serovar Typhi Ty2
uugcucaauuuuu

SEQ ID NO: 1760394 - RNA, 23 nt, Salmonella enterica enterica serovar Typhi Ty2
uugcucaacuggaugacugaauu

SEQ ID NO: 1760395 - RNA, 16 nt, Salmonella enterica enterica serovar Typhi Ty2
uugcgccagcccggcg

SEQ ID NO: 1760396 - RNA, 18 nt, Salmonella enterica enterica serovar Typhi Ty2
uugcgccacggauggccu

SEQ ID NO: 1760397 - RNA, 17 nt, Salmonella enterica enterica serovar Typhi Ty2
uugcgcccaggccaaaa

SEQ ID NO: 1760398 - RNA, 23 nt, Salmonella enterica enterica serovar Typhi Ty2
uugcgccuuuccggccugaaugc

SEQ ID NO: 1760399 - RNA, 14 nt, Salmonella enterica enterica serovar Typhi Ty2
uugcgucaccgggc

SEQ ID NO: 1760400 - RNA, 14 nt, Salmonella enterica enterica serovar Typhi Ty2
uugcguccauuaag

SEQ ID NO: 1760401 - RNA, 22 nt, Salmonella enterica enterica serovar Typhi Ty2
uugcgucguuaacugcauuaca

SEQ ID NO: 1760402 - RNA, 13 nt, Salmonella enterica enterica serovar Typhi Ty2
uugcgugucauca

SEQ ID NO: 1760403 - RNA, 15 nt, Salmonella enterica enterica serovar Typhi Ty2
uugccuucuguuuuu

SEQ ID NO: 1760404 - RNA, 17 nt, Salmonella enterica enterica serovar Typhi Ty2
uugccuucgccgcccaa

SEQ ID NO: 1760405 - RNA, 16 nt, Salmonella enterica enterica serovar Typhi Ty2
uugcgcaaccuccgcg

SEQ ID NO: 1760406 - RNA, 12 nt, Salmonella enterica enterica serovar Typhi Ty2
uuccgcaauaag

SEQ ID NO: 1760407 - RNA, 15 nt, Salmonella enterica enterica serovar Typhi Ty2
uuccgcaauacagcc

SEQ ID NO: 1760408 - RNA, 22 nt, Salmonella enterica enterica serovar Typhi Ty2
uuccgcaauaugcgucagcgcg

SEQ ID NO: 1760409 - RNA, 18 nt, Salmonella enterica enterica serovar Typhi Ty2
uucccgccgccauugcca

SEQ ID NO: 1760410 - RNA, 17 nt, Salmonella enterica enterica serovar Typhi Ty2
uucccuuuuuaaaauga

SEQ ID NO: 1760411 - RNA, 12 nt, Salmonella enterica enterica serovar Typhi Ty2
uuccccauaauc

SEQ ID NO: 1760412 - RNA, 11 nt, Salmonella enterica enterica serovar Typhi Ty2
uucccgagcga

SEQ ID NO: 1760413 - RNA, 11 nt, Salmonella enterica enterica serovar Typhi Ty2
uucccgagcgg

SEQ ID NO: 1760414 - RNA, 23 nt, Salmonella enterica enterica serovar Typhi Ty2
uucccgagccggguuauagccuu

SEQ ID NO: 1760415 - RNA, 23 nt, Salmonella enterica enterica serovar Typhi Ty2
uucccgcaccgcgaugcugcucu

SEQ ID NO: 1760416 - RNA, 14 nt, Salmonella enterica enterica serovar Typhi Ty2
uucccaucgcuuug

SEQ ID NO: 1760417 - RNA, 22 nt, Salmonella enterica enterica serovar Typhi Ty2
uucccagugcgcggucauaucu

SEQ ID NO: 1760418 - RNA, 16 nt, Salmonella enterica enterica serovar Typhi Ty2
uucccaucgcuuugca

SEQ ID NO: 1760419 - RNA, 14 nt, Salmonella enterica enterica serovar Typhi Ty2
uucccacugcgccg

SEQ ID NO: 1760420 - RNA, 18 nt, Salmonella enterica enterica serovar Typhi Ty2
uucccagcgggaacauca

SEQ ID NO: 1760421 - RNA, 17 nt, Salmonella enterica enterica serovar Typhi Ty2
uucccagcgggaacauc

SEQ ID NO: 1760422 - RNA, 13 nt, Salmonella enterica enterica serovar Typhi Ty2
uuccauuuuucag

SEQ ID NO: 1760423 - RNA, 15 nt, Salmonella enterica enterica serovar Typhi Ty2
uucccaacuguauuu

SEQ ID NO: 1760424 - RNA, 19 nt, Salmonella enterica enterica serovar Typhi Ty2
uucccaacaaugccacgcc

SEQ ID NO: 1760425 - RNA, 23 nt, Salmonella enterica enterica serovar Typhi Ty2
uucccacgggcgcaccauaccua

SEQ ID NO: 1760426 - RNA, 14 nt, Salmonella enterica enterica serovar Typhi Ty2
uucccaauaguuua

SEQ ID NO: 1760427 - RNA, 16 nt, Salmonella enterica enterica serovar Typhi Ty2
uucccaagucacgccc

SEQ ID NO: 1760428 - RNA, 14 nt, Salmonella enterica enterica serovar Typhi Ty2
uuccuggcuugcca

SEQ ID NO: 1760429 - RNA, 14 nt, Salmonella enterica enterica serovar Typhi Ty2
uuccuggugcgaca

SEQ ID NO: 1760430 - RNA, 18 nt, Salmonella enterica enterica serovar Typhi Ty2
uuccugucucuauuaacc

SEQ ID NO: 1760431 - RNA, 23 nt, Salmonella enterica enterica serovar Typhi Ty2
uuccuguauaauuauuuguuuac

SEQ ID NO: 1760432 - RNA, 18 nt, Salmonella enterica enterica serovar Typhi Ty2
uuccugccaggccggacu

SEQ ID NO: 1760433 - RNA, 17 nt, Salmonella enterica enterica serovar Typhi Ty2
uuccucgucgcgcgccg

SEQ ID NO: 1760434 - RNA, 17 nt, Salmonella enterica enterica serovar Typhi Ty2
uuccugaucaaucaacu

SEQ ID NO: 1760435 - RNA, 16 nt, Salmonella enterica enterica serovar Typhi Ty2
uuccugauccgccuua

SEQ ID NO: 1760436 - RNA, 13 nt, Salmonella enterica enterica serovar Typhi Ty2
uuccucccggugc

SEQ ID NO: 1760437 - RNA, 15 nt, Salmonella enterica enterica serovar Typhi Ty2
uuccgcuuccagaau

SEQ ID NO: 1760438 - RNA, 17 nt, Salmonella enterica enterica serovar Typhi Ty2
uuccgcguuaucaagag

SEQ ID NO: 1760439 - RNA, 18 nt, Salmonella enterica enterica serovar Typhi Ty2
uuccgcuuuuccugccag

SEQ ID NO: 1760440 - RNA, 21 nt, Salmonella enterica enterica serovar Typhi Ty2
uuccagccagugugcgguggc

SEQ ID NO: 1760441 - RNA, 23 nt, Salmonella enterica enterica serovar Typhi Ty2
uuccagccgcccgcgauaaaaau

SEQ ID NO: 1760442 - RNA, 21 nt, Salmonella enterica enterica serovar Typhi Ty2
uuccagaagcgcuuugccaau

SEQ ID NO: 1760443 - RNA, 18 nt, Salmonella enterica enterica serovar Typhi Ty2
uuccagagugcucaauaa

SEQ ID NO: 1760444 - RNA, 15 nt, Salmonella enterica enterica serovar Typhi Ty2
uuccagauucucaac

SEQ ID NO: 1760445 - RNA, 14 nt, Salmonella enterica enterica serovar Typhi Ty2
uuccacgguaaaac

SEQ ID NO: 1760446 - RNA, 21 nt, Salmonella enterica enterica serovar Typhi Ty2
uuccacugagcuucaccgcca

SEQ ID NO: 1760447 - RNA, 18 nt, Salmonella enterica enterica serovar Typhi Ty2
uuccaccucuucugcagu

SEQ ID NO: 1760448 - RNA, 21 nt, Salmonella enterica enterica serovar Typhi Ty2
uuccacgccgucgaugauggc

SEQ ID NO: 1760449 - RNA, 23 nt, Salmonella enterica enterica serovar Typhi Ty2
uuccacgcgcgcgccgauaaauu

SEQ ID NO: 1760450 - RNA, 11 nt, Salmonella enterica enterica serovar Typhi Ty2
uuccaccgcca

SEQ ID NO: 1760451 - RNA, 16 nt, Salmonella enterica enterica serovar Typhi Ty2
uuccaccgcaugguua

SEQ ID NO: 1760452 - RNA, 20 nt, Salmonella enterica enterica serovar Typhi Ty2
uuccaccagcuuaucugacc

SEQ ID NO: 1760453 - RNA, 12 nt, Salmonella enterica enterica serovar Typhi Ty2
uuccaccaccuc

SEQ ID NO: 1760454 - RNA, 16 nt, Salmonella enterica enterica serovar Typhi Ty2
uucagggugaacaugg

SEQ ID NO: 1760455 - RNA, 20 nt, Salmonella enterica enterica serovar Typhi Ty2
uucaggcucaucagcgccau

SEQ ID NO: 1760456 - RNA, 17 nt, Salmonella enterica enterica serovar Typhi Ty2
uucaggcggcaaaaaac

SEQ ID NO: 1760457 - RNA, 17 nt, Salmonella enterica enterica serovar Typhi Ty2
uucaggccgccagcaaa

SEQ ID NO: 1760458 - RNA, 23 nt, Salmonella enterica enterica serovar Typhi Ty2
uuccacaaaaggauacagcgccg

SEQ ID NO: 1760459 - RNA, 13 nt, Salmonella enterica enterica serovar Typhi Ty2
uuccacagaccca

SEQ ID NO: 1760460 - RNA, 19 nt, Salmonella enterica enterica serovar Typhi Ty2
uuccauggcaaaauucgua

SEQ ID NO: 1760461 - RNA, 17 nt, Salmonella enterica enterica serovar Typhi Ty2
uuccauuagcuguuguu

SEQ ID NO: 1760462 - RNA, 16 nt, Salmonella enterica enterica serovar Typhi Ty2
uuccauuaugaugagu

SEQ ID NO: 1760463 - RNA, 19 nt, Salmonella enterica enterica serovar Typhi Ty2
uuccauucaucgauuuccu

SEQ ID NO: 1760464 - RNA, 12 nt, Salmonella enterica enterica serovar Typhi Ty2
uuccauugcugc

SEQ ID NO: 1760465 - RNA, 13 nt, Salmonella enterica enterica serovar Typhi Ty2
uuccaggcgaacc

SEQ ID NO: 1760466 - RNA, 18 nt, Salmonella enterica enterica serovar Typhi Ty2
uuccagcgcguccagccc

SEQ ID NO: 1760467 - RNA, 21 nt, Salmonella enterica enterica serovar Typhi Ty2
uuccagcgcgccgucaucgcu

SEQ ID NO: 1760468 - RNA, 24 nt, Salmonella enterica enterica serovar Typhi Ty2
uuccagcgcgccgucaucgcucau

SEQ ID NO: 1760469 - RNA, 12 nt, Salmonella enterica enterica serovar Typhi Ty2
uuccagcggcag

SEQ ID NO: 1760470 - RNA, 17 nt, Salmonella enterica enterica serovar Typhi Ty2
uuccagcggcggaaugc

SEQ ID NO: 1760471 - RNA, 17 nt, Salmonella enterica enterica serovar Typhi Ty2
uuccaguugcggcauca

SEQ ID NO: 1760472 - RNA, 17 nt, Salmonella enterica enterica serovar Typhi Ty2
uuccaguuucucaaaca

SEQ ID NO: 1760473 - RNA, 20 nt, Salmonella enterica enterica serovar Typhi Ty2
uuccaguugcgcuacuuuau

SEQ ID NO: 1760474 - RNA, 18 nt, Salmonella enterica enterica serovar Typhi Ty2
uuccagggcuuccagaau

SEQ ID NO: 1760475 - RNA, 19 nt, Salmonella enterica enterica serovar Typhi Ty2
uuccaggucaugguaaaac

SEQ ID NO: 1760476 - RNA, 14 nt, Salmonella enterica enterica serovar Typhi Ty2
uuccaguaauuuca

SEQ ID NO: 1760477 - RNA, 13 nt, Salmonella enterica enterica serovar Typhi Ty2
uuccaguccacgu

SEQ ID NO: 1760478 - RNA, 22 nt, Salmonella enterica enterica serovar Typhi Ty2
uucgaacgaaaaaagcgccccu

SEQ ID NO: 1760479 - RNA, 18 nt, Salmonella enterica enterica serovar Typhi Ty2
uucgaaacaggaaaaaca

SEQ ID NO: 1760480 - RNA, 18 nt, Salmonella enterica enterica serovar Typhi Ty2
uucgcagcgauauuucuc

SEQ ID NO: 1760481 - RNA, 12 nt, Salmonella enterica enterica serovar Typhi Ty2
uuccuuuuucag

SEQ ID NO: 1760482 - RNA, 13 nt, Salmonella enterica enterica serovar Typhi Ty2
uucgcucgcuuug

SEQ ID NO: 1760483 - RNA, 15 nt, Salmonella enterica enterica serovar Typhi Ty2
uucgcuuaccaggcc

SEQ ID NO: 1760484 - RNA, 17 nt, Salmonella enterica enterica serovar Typhi Ty2
uucgcuacguucaaauu

SEQ ID NO: 1760485 - RNA, 21 nt, Salmonella enterica enterica serovar Typhi Ty2
uucgcuaauccccccuuuuuu

SEQ ID NO: 1760486 - RNA, 19 nt, Salmonella enterica enterica serovar Typhi Ty2
uucgcauguugacugcgcu

SEQ ID NO: 1760487 - RNA, 22 nt, Salmonella enterica enterica serovar Typhi Ty2
uucgccaaagcagugaaucccc

SEQ ID NO: 1760488 - RNA, 16 nt, Salmonella enterica enterica serovar Typhi Ty2
uucgcauauucugcga

SEQ ID NO: 1760489 - RNA, 19 nt, Salmonella enterica enterica serovar Typhi Ty2
uucgccgcccaaccagccc

SEQ ID NO: 1760490 - RNA, 16 nt, Salmonella enterica enterica serovar Typhi Ty2
uucgccgucaccugaa

SEQ ID NO: 1760491 - RNA, 14 nt, Salmonella enterica enterica serovar Typhi Ty2
uucguuauuuuccu

SEQ ID NO: 1760492 - RNA, 15 nt, Salmonella enterica enterica serovar Typhi Ty2
uucguucagggugaa

SEQ ID NO: 1760493 - RNA, 17 nt, Salmonella enterica enterica serovar Typhi Ty2
uucguuacuuucauaau

SEQ ID NO: 1760494 - RNA, 15 nt, Salmonella enterica enterica serovar Typhi Ty2
uucguuaccggugau

SEQ ID NO: 1760495 - RNA, 19 nt, Salmonella enterica enterica serovar Typhi Ty2
uucguacccgcaggccugg

SEQ ID NO: 1760496 - RNA, 17 nt, Salmonella enterica enterica serovar Typhi Ty2
uucgguguaauuucucg

SEQ ID NO: 1760497 - RNA, 14 nt, Salmonella enterica enterica serovar Typhi Ty2
uucgcuuuuaaaac

SEQ ID NO: 1760498 - RNA, 15 nt, Salmonella enterica enterica serovar Typhi Ty2
uucgcuucgaggaua

SEQ ID NO: 1760499 - RNA, 13 nt, Salmonella enterica enterica serovar Typhi Ty2
uucgguggaaacc

SEQ ID NO: 1760500 - RNA, 21 nt, Salmonella enterica enterica serovar Typhi Ty2
uucggagcgcuuuuuuuaugc

SEQ ID NO: 1760501 - RNA, 17 nt, Salmonella enterica enterica serovar Typhi Ty2
uucugauuauugacauu

SEQ ID NO: 1760502 - RNA, 16 nt, Salmonella enterica enterica serovar Typhi Ty2
uucugauggcuuugcu

SEQ ID NO: 1760503 - RNA, 18 nt, Salmonella enterica enterica serovar Typhi Ty2
uucugaucgauaaaaguu

SEQ ID NO: 1760504 - RNA, 15 nt, Salmonella enterica enterica serovar Typhi Ty2
uucucugucgccgcc

SEQ ID NO: 1760505 - RNA, 14 nt, Salmonella enterica enterica serovar Typhi Ty2
uucucuuccacaaa

SEQ ID NO: 1760506 - RNA, 19 nt, Salmonella enterica enterica serovar Typhi Ty2
uucucuucguuauuuuccu

SEQ ID NO: 1760507 - RNA, 22 nt, Salmonella enterica enterica serovar Typhi Ty2
uucucuucuaccacgcugccgc

SEQ ID NO: 1760508 - RNA, 15 nt, Salmonella enterica enterica serovar Typhi Ty2
uucucuucuucaaug

SEQ ID NO: 1760509 - RNA, 18 nt, Salmonella enterica enterica serovar Typhi Ty2
uucucucucguucccgcc

SEQ ID NO: 1760510 - RNA, 16 nt, Salmonella enterica enterica serovar Typhi Ty2
uucucgcuaauuggcu

SEQ ID NO: 1760511 - RNA, 17 nt, Salmonella enterica enterica serovar Typhi Ty2
uucucggcuuuccagcu

SEQ ID NO: 1760512 - RNA, 15 nt, Salmonella enterica enterica serovar Typhi Ty2
uucucgcgccaccug

SEQ ID NO: 1760513 - RNA, 16 nt, Salmonella enterica enterica serovar Typhi Ty2
uucucauccagcuugc

SEQ ID NO: 1760514 - RNA, 22 nt, Salmonella enterica enterica serovar Typhi Ty2
uucucacagaaucaucaggcua

SEQ ID NO: 1760515 - RNA, 16 nt, Salmonella enterica enterica serovar Typhi Ty2
uucucacggucuccug

SEQ ID NO: 1760516 - RNA, 20 nt, Salmonella enterica enterica serovar Typhi Ty2
uucuaccacgcugccgccgc

SEQ ID NO: 1760517 - RNA, 19 nt, Salmonella enterica enterica serovar Typhi Ty2
uucuaccacccagccagac

SEQ ID NO: 1760518 - RNA, 13 nt, Salmonella enterica enterica serovar Typhi Ty2
uucuauuaaauca

SEQ ID NO: 1760519 - RNA, 16 nt, Salmonella enterica enterica serovar Typhi Ty2
uucuaugccaggcgca

SEQ ID NO: 1760520 - RNA, 16 nt, Salmonella enterica enterica serovar Typhi Ty2
uuaucaaucugcuuuu

SEQ ID NO: 1760521 - RNA, 19 nt, Salmonella enterica enterica serovar Typhi Ty2
uuaucaauuucauauuauu

SEQ ID NO: 1760522 - RNA, 19 nt, Salmonella enterica enterica serovar Typhi Ty2
uuaucacugguuauaugaa

SEQ ID NO: 1760523 - RNA, 21 nt, Salmonella enterica enterica serovar Typhi Ty2
uuaucauaaugucccugccac

SEQ ID NO: 1760524 - RNA, 16 nt, Salmonella enterica enterica serovar Typhi Ty2
uuaucaucguaaaauc

SEQ ID NO: 1760525 - RNA, 14 nt, Salmonella enterica enterica serovar Typhi Ty2
uuaucaugcugacu

SEQ ID NO: 1760526 - RNA, 16 nt, Salmonella enterica enterica serovar Typhi Ty2
uuaucauucacuuuca

SEQ ID NO: 1760527 - RNA, 14 nt, Salmonella enterica enterica serovar Typhi Ty2
uuauccaaauccuu

SEQ ID NO: 1760528 - RNA, 17 nt, Salmonella enterica enterica serovar Typhi Ty2
uuauccuguguuuggcc

SEQ ID NO: 1760529 - RNA, 22 nt, Salmonella enterica enterica serovar Typhi Ty2
uuaucgaaauagcggugaacuu

SEQ ID NO: 1760530 - RNA, 16 nt, Salmonella enterica enterica serovar Typhi Ty2
uuauccguuauuuaau

SEQ ID NO: 1760531 - RNA, 17 nt, Salmonella enterica enterica serovar Typhi Ty2
uuauccugcaaauagcg

SEQ ID NO: 1760532 - RNA, 15 nt, Salmonella enterica enterica serovar Typhi Ty2
uuauccggccugcac

SEQ ID NO: 1760533 - RNA, 16 nt, Salmonella enterica enterica serovar Typhi Ty2
uuauccggcguguaaa

SEQ ID NO: 1760534 - RNA, 18 nt, Salmonella enterica enterica serovar Typhi Ty2
uuauccggccuacgcuua

SEQ ID NO: 1760535 - RNA, 18 nt, Salmonella enterica enterica serovar Typhi Ty2
uuauccggccuacgcguc

SEQ ID NO: 1760536 - RNA, 19 nt, Salmonella enterica enterica serovar Typhi Ty2
uuauauuuaaaauuccaau

SEQ ID NO: 1760537 - RNA, 11 nt, Salmonella enterica enterica serovar Typhi Ty2
uuauauuuauu

SEQ ID NO: 1760538 - RNA, 14 nt, Salmonella enterica enterica serovar Typhi Ty2
uuaucaagccuaca

SEQ ID NO: 1760539 - RNA, 16 nt, Salmonella enterica enterica serovar Typhi Ty2
uuauauuacuggcuau

SEQ ID NO: 1760540 - RNA, 16 nt, Salmonella enterica enterica serovar Typhi Ty2
uuauauucuucgccca

SEQ ID NO: 1760541 - RNA, 12 nt, Salmonella enterica enterica serovar Typhi Ty2
uuauauaaaaau

SEQ ID NO: 1760542 - RNA, 21 nt, Salmonella enterica enterica serovar Typhi Ty2
uuauagacgccggucaugcca

SEQ ID NO: 1760543 - RNA, 18 nt, Salmonella enterica enterica serovar Typhi Ty2
uuauagcucagcgcggca

SEQ ID NO: 1760544 - RNA, 14 nt, Salmonella enterica enterica serovar Typhi Ty2
uuauauaaaaauag

SEQ ID NO: 1760545 - RNA, 14 nt, Salmonella enterica enterica serovar Typhi Ty2
uuauaggucagguu

SEQ ID NO: 1760546 - RNA, 16 nt, Salmonella enterica enterica serovar Typhi Ty2
uuaugacggggaacag

SEQ ID NO: 1760547 - RNA, 20 nt, Salmonella enterica enterica serovar Typhi Ty2
uuaugaccguauuacaagua

SEQ ID NO: 1760548 - RNA, 23 nt, Salmonella enterica enterica serovar Typhi Ty2
uuaugaauaguuucaccuucugc

SEQ ID NO: 1760549 - RNA, 14 nt, Salmonella enterica enterica serovar Typhi Ty2
uuaugaaugacagu

SEQ ID NO: 1760550 - RNA, 19 nt, Salmonella enterica enterica serovar Typhi Ty2
uuaugaccaauaauaaucc

SEQ ID NO: 1760551 - RNA, 18 nt, Salmonella enterica enterica serovar Typhi Ty2
uuaucuucggucgagcuu

SEQ ID NO: 1760552 - RNA, 22 nt, Salmonella enterica enterica serovar Typhi Ty2
uuaucuuuaccagggaauauga

SEQ ID NO: 1760553 - RNA, 16 nt, Salmonella enterica enterica serovar Typhi Ty2
uuaucuuuaaauuuca

SEQ ID NO: 1760554 - RNA, 20 nt, Salmonella enterica enterica serovar Typhi Ty2
uuaucuugagucaaaagauu

SEQ ID NO: 1760555 - RNA, 17 nt, Salmonella enterica enterica serovar Typhi Ty2
uuaucuguaauuauaaa

SEQ ID NO: 1760556 - RNA, 20 nt, Salmonella enterica enterica serovar Typhi Ty2
uuaucuccccaauugcugcu

SEQ ID NO: 1760557 - RNA, 18 nt, Salmonella enterica enterica serovar Typhi Ty2
uuaucguccgucagaucc

SEQ ID NO: 1760558 - RNA, 17 nt, Salmonella enterica enterica serovar Typhi Ty2
uuaucgccgaucacaaa

SEQ ID NO: 1760559 - RNA, 15 nt, Salmonella enterica enterica serovar Typhi Ty2
uuauuaacccuuccu

SEQ ID NO: 1760560 - RNA, 13 nt, Salmonella enterica enterica serovar Typhi Ty2
uuauuaacgugcu

SEQ ID NO: 1760561 - RNA, 15 nt, Salmonella enterica enterica serovar Typhi Ty2
uuauuaaucuuuaca

SEQ ID NO: 1760562 - RNA, 19 nt, Salmonella enterica enterica serovar Typhi Ty2
uuauuacgaaguuuaauuc

SEQ ID NO: 1760563 - RNA, 14 nt, Salmonella enterica enterica serovar Typhi Ty2
uuauuacagacagu

SEQ ID NO: 1760564 - RNA, 15 nt, Salmonella enterica enterica serovar Typhi Ty2
uuauuaaagccccuu

SEQ ID NO: 1760565 - RNA, 13 nt, Salmonella enterica enterica serovar Typhi Ty2
uuauguuugccca

SEQ ID NO: 1760566 - RNA, 14 nt, Salmonella enterica enterica serovar Typhi Ty2
uuauguugauaacg

SEQ ID NO: 1760567 - RNA, 22 nt, Salmonella enterica enterica serovar Typhi Ty2
uuaugcgucaaaguugcaucaa

SEQ ID NO: 1760568 - RNA, 11 nt, Salmonella enterica enterica serovar Typhi Ty2
uuaugccucuu

SEQ ID NO: 1760569 - RNA, 13 nt, Salmonella enterica enterica serovar Typhi Ty2
uuaugcaguuccg

SEQ ID NO: 1760570 - RNA, 22 nt, Salmonella enterica enterica serovar Typhi Ty2
uuaugcaguuccguugcaauau

SEQ ID NO: 1760571 - RNA, 20 nt, Salmonella enterica enterica serovar Typhi Ty2
uuaugcaucuggucagguga

SEQ ID NO: 1760572 - RNA, 22 nt, Salmonella enterica enterica serovar Typhi Ty2
uuaugccgaccaaugacgcuau

SEQ ID NO: 1760573 - RNA, 17 nt, Salmonella enterica enterica serovar Typhi Ty2
uuaugccccauauaagg

SEQ ID NO: 1760574 - RNA, 14 nt, Salmonella enterica enterica serovar Typhi Ty2
uuaugucauucagg

SEQ ID NO: 1760575 - RNA, 15 nt, Salmonella enterica enterica serovar Typhi Ty2
uuaugucauuuauuu

SEQ ID NO: 1760576 - RNA, 14 nt, Salmonella enterica enterica serovar Typhi Ty2
uuauggcccgccag

SEQ ID NO: 1760577 - RNA, 13 nt, Salmonella enterica enterica serovar Typhi Ty2
uuaugggauugca

SEQ ID NO: 1760578 - RNA, 19 nt, Salmonella enterica enterica serovar Typhi Ty2
uucagcauauccagcgccu

SEQ ID NO: 1760579 - RNA, 16 nt, Salmonella enterica enterica serovar Typhi Ty2
uucagcauccuccggc

SEQ ID NO: 1760580 - RNA, 14 nt, Salmonella enterica enterica serovar Typhi Ty2
uucagcauuggcau

SEQ ID NO: 1760581 - RNA, 22 nt, Salmonella enterica enterica serovar Typhi Ty2
uucagcagcgcccagccaaagc

SEQ ID NO: 1760582 - RNA, 13 nt, Salmonella enterica enterica serovar Typhi Ty2
uucagccaggugg

SEQ ID NO: 1760583 - RNA, 13 nt, Salmonella enterica enterica serovar Typhi Ty2
uucagccugaagc

SEQ ID NO: 1760584 - RNA, 15 nt, Salmonella enterica enterica serovar Typhi Ty2
uucagccugaagcca

SEQ ID NO: 1760585 - RNA, 22 nt, Salmonella enterica enterica serovar Typhi Ty2
uucaggacgagagacugauaau

SEQ ID NO: 1760586 - RNA, 23 nt, Salmonella enterica enterica serovar Typhi Ty2
uucagcuucagucauaauccuuc

SEQ ID NO: 1760587 - RNA, 14 nt, Salmonella enterica enterica serovar Typhi Ty2
uucagcucuucaau

SEQ ID NO: 1760588 - RNA, 18 nt, Salmonella enterica enterica serovar Typhi Ty2
uucaggcaaaaaaaaacc

SEQ ID NO: 1760589 - RNA, 17 nt, Salmonella enterica enterica serovar Typhi Ty2
uucaggcaaaggaaugc

SEQ ID NO: 1760590 - RNA, 18 nt, Salmonella enterica enterica serovar Typhi Ty2
uucacguuuuccaggugc

SEQ ID NO: 1760591 - RNA, 23 nt, Salmonella enterica enterica serovar Typhi Ty2
uucacuaauuugaugccuggcag

SEQ ID NO: 1760592 - RNA, 17 nt, Salmonella enterica enterica serovar Typhi Ty2
uucagaauaugccaggg

SEQ ID NO: 1760593 - RNA, 19 nt, Salmonella enterica enterica serovar Typhi Ty2
uucagaauacgaccucaaa

SEQ ID NO: 1760594 - RNA, 19 nt, Salmonella enterica enterica serovar Typhi Ty2
uucagaccuuuuacuucac

SEQ ID NO: 1760595 - RNA, 17 nt, Salmonella enterica enterica serovar Typhi Ty2
uucagaccacuauaguu

SEQ ID NO: 1760596 - RNA, 16 nt, Salmonella enterica enterica serovar Typhi Ty2
uucagaccauagucca

SEQ ID NO: 1760597 - RNA, 23 nt, Salmonella enterica enterica serovar Typhi Ty2
uucagcaauuacccgguguuuuu

SEQ ID NO: 1760598 - RNA, 19 nt, Salmonella enterica enterica serovar Typhi Ty2
uucaccccagcgguaaaau

SEQ ID NO: 1760599 - RNA, 13 nt, Salmonella enterica enterica serovar Typhi Ty2
uucacccccaucg

SEQ ID NO: 1760600 - RNA, 16 nt, Salmonella enterica enterica serovar Typhi Ty2
uucacccguuauucau

SEQ ID NO: 1760601 - RNA, 20 nt, Salmonella enterica enterica serovar Typhi Ty2
uucacccagacugugauggc

SEQ ID NO: 1760602 - RNA, 20 nt, Salmonella enterica enterica serovar Typhi Ty2
uucaccggaugcgcagguaa

SEQ ID NO: 1760603 - RNA, 13 nt, Salmonella enterica enterica serovar Typhi Ty2
uucaccgaggguu

SEQ ID NO: 1760604 - RNA, 20 nt, Salmonella enterica enterica serovar Typhi Ty2
uucacguaccaggcagcgcg

SEQ ID NO: 1760605 - RNA, 23 nt, Salmonella enterica enterica serovar Typhi Ty2
uucaccuucugugaaaguuucag

SEQ ID NO: 1760606 - RNA, 14 nt, Salmonella enterica enterica serovar Typhi Ty2
uucaccucccugca

SEQ ID NO: 1760607 - RNA, 13 nt, Salmonella enterica enterica serovar Typhi Ty2
uucaccucccugc

SEQ ID NO: 1760608 - RNA, 14 nt, Salmonella enterica enterica serovar Typhi Ty2
uucaauaugugcau

SEQ ID NO: 1760609 - RNA, 17 nt, Salmonella enterica enterica serovar Typhi Ty2
uucaaucaucauauccc

SEQ ID NO: 1760610 - RNA, 13 nt, Salmonella enterica enterica serovar Typhi Ty2
uucaaucaucaua

SEQ ID NO: 1760611 - RNA, 18 nt, Salmonella enterica enterica serovar Typhi Ty2
uucaaucagcacgcgguc

SEQ ID NO: 1760612 - RNA, 22 nt, Salmonella enterica enterica serovar Typhi Ty2
uucaaucacugaugccacaccc

SEQ ID NO: 1760613 - RNA, 15 nt, Salmonella enterica enterica serovar Typhi Ty2
uucaauacgaaaacc

SEQ ID NO: 1760614 - RNA, 20 nt, Salmonella enterica enterica serovar Typhi Ty2
uucacaccguuauccggcaa

SEQ ID NO: 1760615 - RNA, 21 nt, Salmonella enterica enterica serovar Typhi Ty2
uucacaccguuauccggcaaa

SEQ ID NO: 1760616 - RNA, 21 nt, Salmonella enterica enterica serovar Typhi Ty2
uucacaccuuuauauuuuucc

SEQ ID NO: 1760617 - RNA, 14 nt, Salmonella enterica enterica serovar Typhi Ty2
uucacagaaggcua

SEQ ID NO: 1760618 - RNA, 16 nt, Salmonella enterica enterica serovar Typhi Ty2
uuauuguuaaaaagac

SEQ ID NO: 1760619 - RNA, 11 nt, Salmonella enterica enterica serovar Typhi Ty2
uuauugugcac

SEQ ID NO: 1760620 - RNA, 23 nt, Salmonella enterica enterica serovar Typhi Ty2
uuauucuuugucugucggacuca

SEQ ID NO: 1760621 - RNA, 19 nt, Salmonella enterica enterica serovar Typhi Ty2
uuauuagaggucagaauaa

SEQ ID NO: 1760622 - RNA, 13 nt, Salmonella enterica enterica serovar Typhi Ty2
uuauuuuuaauug

SEQ ID NO: 1760623 - RNA, 23 nt, Salmonella enterica enterica serovar Typhi Ty2
uucaaaagccuguuuaccaagca

SEQ ID NO: 1760624 - RNA, 17 nt, Salmonella enterica enterica serovar Typhi Ty2
uucaaaccuucaagaau

SEQ ID NO: 1760625 - RNA, 12 nt, Salmonella enterica enterica serovar Typhi Ty2
uucaaccucacu

SEQ ID NO: 1760626 - RNA, 18 nt, Salmonella enterica enterica serovar Typhi Ty2
uucaaccucacuguugau

SEQ ID NO: 1760627 - RNA, 23 nt, Salmonella enterica enterica serovar Typhi Ty2
uucaaccagccgaucagcgccau

SEQ ID NO: 1760628 - RNA, 17 nt, Salmonella enterica enterica serovar Typhi Ty2
uucaaccggcaguuuuu

SEQ ID NO: 1760629 - RNA, 22 nt, Salmonella enterica enterica serovar Typhi Ty2
uucaauaaauugaaauucuaug

SEQ ID NO: 1760630 - RNA, 21 nt, Salmonella enterica enterica serovar Typhi Ty2
uucaauaaauugaaauucuau

SEQ ID NO: 1760631 - RNA, 17 nt, Salmonella enterica enterica serovar Typhi Ty2
uucaauaaguuagcuuu

SEQ ID NO: 1760632 - RNA, 20 nt, Salmonella enterica enterica serovar Typhi Ty2
uucaauaauauuaucauaau

SEQ ID NO: 1760633 - RNA, 17 nt, Salmonella enterica enterica serovar Typhi Ty2
uucaauaauauuaucau

SEQ ID NO: 1760634 - RNA, 18 nt, Salmonella enterica enterica serovar Typhi Ty2
uucaauaauauuaucaua

SEQ ID NO: 1760635 - RNA, 23 nt, Salmonella enterica enterica serovar Typhi Ty2
uucaagccguuuuggcagcgccc

SEQ ID NO: 1760636 - RNA, 14 nt, Salmonella enterica enterica serovar Typhi Ty2
uucaagcaguucca

SEQ ID NO: 1760637 - RNA, 22 nt, Salmonella enterica enterica serovar Typhi Ty2
uucaaguuuagaaaaaauuaaa

SEQ ID NO: 1760638 - RNA, 17 nt, Salmonella enterica enterica serovar Typhi Ty2
uucaagcaguuccagca

SEQ ID NO: 1760639 - RNA, 12 nt, Salmonella enterica enterica serovar Typhi Ty2
uucaagcaauac

SEQ ID NO: 1760640 - RNA, 17 nt, Salmonella enterica enterica serovar Typhi Ty2
uucaacgcguugccuga

SEQ ID NO: 1760641 - RNA, 22 nt, Salmonella enterica enterica serovar Typhi Ty2
uuagcacccaccaucacuucca

SEQ ID NO: 1760642 - RNA, 19 nt, Salmonella enterica enterica serovar Typhi Ty2
uuagcagccacacacuguu

SEQ ID NO: 1760643 - RNA, 20 nt, Salmonella enterica enterica serovar Typhi Ty2
uuagcaauugccauaaaaac

SEQ ID NO: 1760644 - RNA, 16 nt, Salmonella enterica enterica serovar Typhi Ty2
uuagcacagcucuaau

SEQ ID NO: 1760645 - RNA, 17 nt, Salmonella enterica enterica serovar Typhi Ty2
uuagcacagcucuaauu

SEQ ID NO: 1760646 - RNA, 19 nt, Salmonella enterica enterica serovar Typhi Ty2
uuagcacauuuuuaucagg

SEQ ID NO: 1760647 - RNA, 21 nt, Salmonella enterica enterica serovar Typhi Ty2
uuagagcacaucacucauaau

SEQ ID NO: 1760648 - RNA, 13 nt, Salmonella enterica enterica serovar Typhi Ty2
uuagacucagcga

SEQ ID NO: 1760649 - RNA, 15 nt, Salmonella enterica enterica serovar Typhi Ty2
uuagaagugaagaau

SEQ ID NO: 1760650 - RNA, 15 nt, Salmonella enterica enterica serovar Typhi Ty2
uuagcaugacaauaa

SEQ ID NO: 1760651 - RNA, 21 nt, Salmonella enterica enterica serovar Typhi Ty2
uuagccaaacucugaaaaaau

SEQ ID NO: 1760652 - RNA, 14 nt, Salmonella enterica enterica serovar Typhi Ty2
uuagccacgccguc

SEQ ID NO: 1760653 - RNA, 19 nt, Salmonella enterica enterica serovar Typhi Ty2
uuagccaggugacuuugcc

SEQ ID NO: 1760654 - RNA, 18 nt, Salmonella enterica enterica serovar Typhi Ty2
uuaggguaucauuuccac

SEQ ID NO: 1760655 - RNA, 22 nt, Salmonella enterica enterica serovar Typhi Ty2
uuagggcuauuuuacuugccau

SEQ ID NO: 1760656 - RNA, 14 nt, Salmonella enterica enterica serovar Typhi Ty2
uuagcuuuuuacuc

SEQ ID NO: 1760657 - RNA, 19 nt, Salmonella enterica enterica serovar Typhi Ty2
uuagcuuuuuacucucuuu

SEQ ID NO: 1760658 - RNA, 23 nt, Salmonella enterica enterica serovar Typhi Ty2
uuagcugcgcaagaaacaucauc

SEQ ID NO: 1760659 - RNA, 22 nt, Salmonella enterica enterica serovar Typhi Ty2
uuagcucuuucauuucugccug

SEQ ID NO: 1760660 - RNA, 12 nt, Salmonella enterica enterica serovar Typhi Ty2
uuagcuuccagc

SEQ ID NO: 1760661 - RNA, 16 nt, Salmonella enterica enterica serovar Typhi Ty2
uuacugcaagcgaugu

SEQ ID NO: 1760662 - RNA, 12 nt, Salmonella enterica enterica serovar Typhi Ty2
uuacucccgucg

SEQ ID NO: 1760663 - RNA, 13 nt, Salmonella enterica enterica serovar Typhi Ty2
uuacuuucauucc

SEQ ID NO: 1760664 - RNA, 15 nt, Salmonella enterica enterica serovar Typhi Ty2
uuacuuucauuccuu

SEQ ID NO: 1760665 - RNA, 14 nt, Salmonella enterica enterica serovar Typhi Ty2
uuacucacugccgc

SEQ ID NO: 1760666 - RNA, 15 nt, Salmonella enterica enterica serovar Typhi Ty2
uuacuaauaaauauu

SEQ ID NO: 1760667 - RNA, 17 nt, Salmonella enterica enterica serovar Typhi Ty2
uuacuaauaaauauuca

SEQ ID NO: 1760668 - RNA, 14 nt, Salmonella enterica enterica serovar Typhi Ty2
uuaccgcccgcuuc

SEQ ID NO: 1760669 - RNA, 19 nt, Salmonella enterica enterica serovar Typhi Ty2
uuaccgcccuguccuccau

SEQ ID NO: 1760670 - RNA, 15 nt, Salmonella enterica enterica serovar Typhi Ty2
uuaccgccagcggcg

SEQ ID NO: 1760671 - RNA, 23 nt, Salmonella enterica enterica serovar Typhi Ty2
uuacguugguauucaacgccauc

SEQ ID NO: 1760672 - RNA, 15 nt, Salmonella enterica enterica serovar Typhi Ty2
uuacguugauuauca

SEQ ID NO: 1760673 - RNA, 23 nt, Salmonella enterica enterica serovar Typhi Ty2
uuacguguaguuauaaauuuauu

SEQ ID NO: 1760674 - RNA, 11 nt, Salmonella enterica enterica serovar Typhi Ty2
uuauacugaua

SEQ ID NO: 1760675 - RNA, 15 nt, Salmonella enterica enterica serovar Typhi Ty2
uuauacucaaaaaau

SEQ ID NO: 1760676 - RNA, 17 nt, Salmonella enterica enterica serovar Typhi Ty2
uuauacgccuauuuucu

SEQ ID NO: 1760677 - RNA, 15 nt, Salmonella enterica enterica serovar Typhi Ty2
uuauacacucaacca

SEQ ID NO: 1760678 - RNA, 18 nt, Salmonella enterica enterica serovar Typhi Ty2
uuauacaccgggaaaagc

SEQ ID NO: 1760679 - RNA, 13 nt, Salmonella enterica enterica serovar Typhi Ty2
uuauaagcgccaa

SEQ ID NO: 1760680 - RNA, 23 nt, Salmonella enterica enterica serovar Typhi Ty2
uuauaaguacgccugaaaacaga

SEQ ID NO: 1760681 - RNA, 17 nt, Salmonella enterica enterica serovar Typhi Ty2
uuauaagcuuuaaccac

SEQ ID NO: 1760682 - RNA, 16 nt, Salmonella enterica enterica serovar Typhi Ty2
uuauaagccugagcgc

SEQ ID NO: 1760683 - RNA, 21 nt, Salmonella enterica enterica serovar Typhi Ty2
uuauaagaaccaucuaccaua

SEQ ID NO: 1760684 - RNA, 14 nt, Salmonella enterica enterica serovar Typhi Ty2
uuauaaauuuuuua

SEQ ID NO: 1760685 - RNA, 13 nt, Salmonella enterica enterica serovar Typhi Ty2
uuauaacauaaau

SEQ ID NO: 1760686 - RNA, 15 nt, Salmonella enterica enterica serovar Typhi Ty2
uuauaacguaucguu

SEQ ID NO: 1760687 - RNA, 23 nt, Salmonella enterica enterica serovar Typhi Ty2
uuauaaauaaaguguuaucaugu

SEQ ID NO: 1760688 - RNA, 20 nt, Salmonella enterica enterica serovar Typhi Ty2
uuagugacguuaucugucag

SEQ ID NO: 1760689 - RNA, 21 nt, Salmonella enterica enterica serovar Typhi Ty2
uuagucuccugccaaugaaau

SEQ ID NO: 1760690 - RNA, 12 nt, Salmonella enterica enterica serovar Typhi Ty2
uuaguucaaguu

SEQ ID NO: 1760691 - RNA, 20 nt, Salmonella enterica enterica serovar Typhi Ty2
uuaguucaaguuuagaaaaa

SEQ ID NO: 1760692 - RNA, 23 nt, Salmonella enterica enterica serovar Typhi Ty2
uuaguuucuauuaaaucagauaa

SEQ ID NO: 1760693 - RNA, 13 nt, Salmonella enterica enterica serovar Typhi Ty2
uuauaaaauaacg

SEQ ID NO: 1760694 - RNA, 20 nt, Salmonella enterica enterica serovar Typhi Ty2
uuaguaccgaacagccaggc

SEQ ID NO: 1760695 - RNA, 22 nt, Salmonella enterica enterica serovar Typhi Ty2
uuaguaccgaacagccaggcuu

SEQ ID NO: 1760696 - RNA, 21 nt, Salmonella enterica enterica serovar Typhi Ty2
uuaguacgcaaggaaauauua

SEQ ID NO: 1760697 - RNA, 11 nt, Salmonella enterica enterica serovar Typhi Ty2
uuaguaacccc

SEQ ID NO: 1760698 - RNA, 16 nt, Salmonella enterica enterica serovar Typhi Ty2
uuagguucuucaaugc

SEQ ID NO: 1760699 - RNA, 22 nt, Salmonella enterica enterica serovar Typhi Ty2
uuacaggcgcaucagaaaaacc

SEQ ID NO: 1760700 - RNA, 19 nt, Salmonella enterica enterica serovar Typhi Ty2
uuacaggcaucuuccagcg

SEQ ID NO: 1760701 - RNA, 12 nt, Salmonella enterica enterica serovar Typhi Ty2
uuacauuuucca

SEQ ID NO: 1760702 - RNA, 15 nt, Salmonella enterica enterica serovar Typhi Ty2
uuacauuuuccaugc

SEQ ID NO: 1760703 - RNA, 23 nt, Salmonella enterica enterica serovar Typhi Ty2
uuaccaaugccaaaaaaacuaau

SEQ ID NO: 1760704 - RNA, 14 nt, Salmonella enterica enterica serovar Typhi Ty2
uuacagcucauaaa

SEQ ID NO: 1760705 - RNA, 16 nt, Salmonella enterica enterica serovar Typhi Ty2
uuacaauguacagaau

SEQ ID NO: 1760706 - RNA, 17 nt, Salmonella enterica enterica serovar Typhi Ty2
uuacaauuucgcaaaca

SEQ ID NO: 1760707 - RNA, 19 nt, Salmonella enterica enterica serovar Typhi Ty2
uuacaauuuaucugcguga

SEQ ID NO: 1760708 - RNA, 15 nt, Salmonella enterica enterica serovar Typhi Ty2
uuaauuucuuuccaa

SEQ ID NO: 1760709 - RNA, 20 nt, Salmonella enterica enterica serovar Typhi Ty2
uuaauuugcuccagaagauc

SEQ ID NO: 1760710 - RNA, 15 nt, Salmonella enterica enterica serovar Typhi Ty2
uuaauuugugccagc

SEQ ID NO: 1760711 - RNA, 18 nt, Salmonella enterica enterica serovar Typhi Ty2
uuaauuugcaucaggcca

SEQ ID NO: 1760712 - RNA, 20 nt, Salmonella enterica enterica serovar Typhi Ty2
uuaauguuaggaguaaauaa

SEQ ID NO: 1760713 - RNA, 19 nt, Salmonella enterica enterica serovar Typhi Ty2
uuaauggcagaauaaaaca

SEQ ID NO: 1760714 - RNA, 18 nt, Salmonella enterica enterica serovar Typhi Ty2
uuaauggcagaauaaaac

SEQ ID NO: 1760715 - RNA, 20 nt, Salmonella enterica enterica serovar Typhi Ty2
uuaauggugguugcaucauc

SEQ ID NO: 1760716 - RNA, 16 nt, Salmonella enterica enterica serovar Typhi Ty2
uuaaugcuguccugca

SEQ ID NO: 1760717 - RNA, 22 nt, Salmonella enterica enterica serovar Typhi Ty2
uuaaugcuguccugcaaaauac

SEQ ID NO: 1760718 - RNA, 16 nt, Salmonella enterica enterica serovar Typhi Ty2
uuaauggaggcaguga

SEQ ID NO: 1760719 - RNA, 15 nt, Salmonella enterica enterica serovar Typhi Ty2
uuaaugcucugcugu

SEQ ID NO: 1760720 - RNA, 16 nt, Salmonella enterica enterica serovar Typhi Ty2
uuaaugcucuccagca

SEQ ID NO: 1760721 - RNA, 23 nt, Salmonella enterica enterica serovar Typhi Ty2
uuaaugcauggcagauaaaccac

SEQ ID NO: 1760722 - RNA, 22 nt, Salmonella enterica enterica serovar Typhi Ty2
uuaaugaguagaacguauuauu

SEQ ID NO: 1760723 - RNA, 23 nt, Salmonella enterica enterica serovar Typhi Ty2
uuaaugaguagaacguauuauua

SEQ ID NO: 1760724 - RNA, 14 nt, Salmonella enterica enterica serovar Typhi Ty2
uuaaucuauuuaau

SEQ ID NO: 1760725 - RNA, 16 nt, Salmonella enterica enterica serovar Typhi Ty2
uuaaugauuaaaauaa

SEQ ID NO: 1760726 - RNA, 21 nt, Salmonella enterica enterica serovar Typhi Ty2
uuaaugauuugcuuuauuugu

SEQ ID NO: 1760727 - RNA, 19 nt, Salmonella enterica enterica serovar Typhi Ty2
uuaauuacgcacuacggca

SEQ ID NO: 1760728 - RNA, 21 nt, Salmonella enterica enterica serovar Typhi Ty2
uuaauugcugaagauaaaauu

SEQ ID NO: 1760729 - RNA, 21 nt, Salmonella enterica enterica serovar Typhi Ty2
uuaauuccgcaucauucaucu

SEQ ID NO: 1760730 - RNA, 14 nt, Salmonella enterica enterica serovar Typhi Ty2
uuaagucaucuguu

SEQ ID NO: 1760731 - RNA, 14 nt, Salmonella enterica enterica serovar Typhi Ty2
uuaagucauaccug

SEQ ID NO: 1760732 - RNA, 17 nt, Salmonella enterica enterica serovar Typhi Ty2
uuaaggaugaacucuau

SEQ ID NO: 1760733 - RNA, 21 nt, Salmonella enterica enterica serovar Typhi Ty2
uuaauagcguagccugcaugu

SEQ ID NO: 1760734 - RNA, 14 nt, Salmonella enterica enterica serovar Typhi Ty2
uuaaucgauuuucu

SEQ ID NO: 1760735 - RNA, 18 nt, Salmonella enterica enterica serovar Typhi Ty2
uuaaucaagcccagcuca

SEQ ID NO: 1760736 - RNA, 13 nt, Salmonella enterica enterica serovar Typhi Ty2
uuaaucacccgcg

SEQ ID NO: 1760737 - RNA, 21 nt, Salmonella enterica enterica serovar Typhi Ty2
uuaacccagauaucagucugc

SEQ ID NO: 1760738 - RNA, 22 nt, Salmonella enterica enterica serovar Typhi Ty2
uuaacccgcuuacaauuuaucu

SEQ ID NO: 1760739 - RNA, 16 nt, Salmonella enterica enterica serovar Typhi Ty2
uuaaccguucuuccug

SEQ ID NO: 1760740 - RNA, 21 nt, Salmonella enterica enterica serovar Typhi Ty2
uguggaaaacagcgccggcag

SEQ ID NO: 1760741 - RNA, 17 nt, Salmonella enterica enterica serovar Typhi Ty2
uguggaaacuccagcgg

SEQ ID NO: 1760742 - RNA, 15 nt, Salmonella enterica enterica serovar Typhi Ty2
uuaaccagcaguccu

SEQ ID NO: 1760743 - RNA, 21 nt, Salmonella enterica enterica serovar Typhi Ty2
ugugcuuuuuauuuuucuggc

SEQ ID NO: 1760744 - RNA, 21 nt, Salmonella enterica enterica serovar Typhi Ty2
ugugccgguaagaagaaccag

SEQ ID NO: 1760745 - RNA, 16 nt, Salmonella enterica enterica serovar Typhi Ty2
ugugccgguaagaaga

SEQ ID NO: 1760746 - RNA, 18 nt, Salmonella enterica enterica serovar Typhi Ty2
uuaagcgggucccagaag

SEQ ID NO: 1760747 - RNA, 22 nt, Salmonella enterica enterica serovar Typhi Ty2
uuaagcggauuuuuucgcuuuu

SEQ ID NO: 1760748 - RNA, 19 nt, Salmonella enterica enterica serovar Typhi Ty2
uuaagccgggucagccccc

SEQ ID NO: 1760749 - RNA, 19 nt, Salmonella enterica enterica serovar Typhi Ty2
uuaagacagguaacugcac

SEQ ID NO: 1760750 - RNA, 23 nt, Salmonella enterica enterica serovar Typhi Ty2
uuaagacgcuucauaucgcccag

SEQ ID NO: 1760751 - RNA, 19 nt, Salmonella enterica enterica serovar Typhi Ty2
uggccacguagccgucggc

SEQ ID NO: 1760752 - RNA, 22 nt, Salmonella enterica enterica serovar Typhi Ty2
uggccaccuuuacgguggccuu

SEQ ID NO: 1760753 - RNA, 14 nt, Salmonella enterica enterica serovar Typhi Ty2
uggcauuggcaucu

SEQ ID NO: 1760754 - RNA, 19 nt, Salmonella enterica enterica serovar Typhi Ty2
uggcccauuuuggccgcuu

SEQ ID NO: 1760755 - RNA, 16 nt, Salmonella enterica enterica serovar Typhi Ty2
uggcccgcacugccga

SEQ ID NO: 1760756 - RNA, 14 nt, Salmonella enterica enterica serovar Typhi Ty2
uggccccugagcaa

SEQ ID NO: 1760757 - RNA, 17 nt, Salmonella enterica enterica serovar Typhi Ty2
uggcauuggcaucuguc

SEQ ID NO: 1760758 - RNA, 12 nt, Salmonella enterica enterica serovar Typhi Ty2
uggccaccagcu

SEQ ID NO: 1760759 - RNA, 24 nt, Salmonella enterica enterica serovar Typhi Ty2
uggcaugcccggugauauuguguu

SEQ ID NO: 1760760 - RNA, 20 nt, Salmonella enterica enterica serovar Typhi Ty2
uggcauauugcgaucuguac

SEQ ID NO: 1760761 - RNA, 20 nt, Salmonella enterica enterica serovar Typhi Ty2
uggcauagccugauauccac

SEQ ID NO: 1760762 - RNA, 15 nt, Salmonella enterica enterica serovar Typhi Ty2
uggcaucaucaaacg

SEQ ID NO: 1760763 - RNA, 20 nt, Salmonella enterica enterica serovar Typhi Ty2
uggauucaugaucuuuccuu

SEQ ID NO: 1760764 - RNA, 17 nt, Salmonella enterica enterica serovar Typhi Ty2
uggcaaaacgcauccag

SEQ ID NO: 1760765 - RNA, 22 nt, Salmonella enterica enterica serovar Typhi Ty2
uggauuaaaaaaggcagaagaa

SEQ ID NO: 1760766 - RNA, 22 nt, Salmonella enterica enterica serovar Typhi Ty2
uggaugguuucuucgcuggcgg

SEQ ID NO: 1760767 - RNA, 17 nt, Salmonella enterica enterica serovar Typhi Ty2
uggauuacaaaaauaga

SEQ ID NO: 1760768 - RNA, 16 nt, Salmonella enterica enterica serovar Typhi Ty2
uggcagaccguggccg

SEQ ID NO: 1760769 - RNA, 12 nt, Salmonella enterica enterica serovar Typhi Ty2
uggcaggccucu

SEQ ID NO: 1760770 - RNA, 20 nt, Salmonella enterica enterica serovar Typhi Ty2
uggcacuuuccgguuuccau

SEQ ID NO: 1760771 - RNA, 13 nt, Salmonella enterica enterica serovar Typhi Ty2
uggcaagaaucac

SEQ ID NO: 1760772 - RNA, 17 nt, Salmonella enterica enterica serovar Typhi Ty2
uggcaagaauuauuuca

SEQ ID NO: 1760773 - RNA, 21 nt, Salmonella enterica enterica serovar Typhi Ty2
uggcaagaccgauagagacug

SEQ ID NO: 1760774 - RNA, 21 nt, Salmonella enterica enterica serovar Typhi Ty2
uggcaaguaugaaaagcgcgu

SEQ ID NO: 1760775 - RNA, 18 nt, Salmonella enterica enterica serovar Typhi Ty2
uggagucugaaaauaauu

SEQ ID NO: 1760776 - RNA, 17 nt, Salmonella enterica enterica serovar Typhi Ty2
uggaguagauguagcug

SEQ ID NO: 1760777 - RNA, 19 nt, Salmonella enterica enterica serovar Typhi Ty2
uggauaacgaaaaggguca

SEQ ID NO: 1760778 - RNA, 17 nt, Salmonella enterica enterica serovar Typhi Ty2
uggauaacgaaaagggu

SEQ ID NO: 1760779 - RNA, 15 nt, Salmonella enterica enterica serovar Typhi Ty2
uggauaaauaggcug

SEQ ID NO: 1760780 - RNA, 21 nt, Salmonella enterica enterica serovar Typhi Ty2
uggauagcaccauaaacggca

SEQ ID NO: 1760781 - RNA, 18 nt, Salmonella enterica enterica serovar Typhi Ty2
uggauaauugcucugcca

SEQ ID NO: 1760782 - RNA, 17 nt, Salmonella enterica enterica serovar Typhi Ty2
uggaugcgcugaauagc

SEQ ID NO: 1760783 - RNA, 16 nt, Salmonella enterica enterica serovar Typhi Ty2
uggaucggaaaucaaa

SEQ ID NO: 1760784 - RNA, 20 nt, Salmonella enterica enterica serovar Typhi Ty2
uggaucacuuuugccgucag

SEQ ID NO: 1760785 - RNA, 15 nt, Salmonella enterica enterica serovar Typhi Ty2
uggaucagaagcuuc

SEQ ID NO: 1760786 - RNA, 13 nt, Salmonella enterica enterica serovar Typhi Ty2
uggagguuguuuu

SEQ ID NO: 1760787 - RNA, 19 nt, Salmonella enterica enterica serovar Typhi Ty2
uggagguuauccugaaagg

SEQ ID NO: 1760788 - RNA, 18 nt, Salmonella enterica enterica serovar Typhi Ty2
uggaguagauguagcuga

SEQ ID NO: 1760789 - RNA, 20 nt, Salmonella enterica enterica serovar Typhi Ty2
uggaguacgggcagaugguc

SEQ ID NO: 1760790 - RNA, 16 nt, Salmonella enterica enterica serovar Typhi Ty2
uggaggguaagaaagu

SEQ ID NO: 1760791 - RNA, 12 nt, Salmonella enterica enterica serovar Typhi Ty2
uggaggccaaua

SEQ ID NO: 1760792 - RNA, 14 nt, Salmonella enterica enterica serovar Typhi Ty2
uggagcgagcuggu

SEQ ID NO: 1760793 - RNA, 20 nt, Salmonella enterica enterica serovar Typhi Ty2
uggagagcaucaucugccau

SEQ ID NO: 1760794 - RNA, 14 nt, Salmonella enterica enterica serovar Typhi Ty2
uggacgucaugccg

SEQ ID NO: 1760795 - RNA, 13 nt, Salmonella enterica enterica serovar Typhi Ty2
uggacgucaugcc

SEQ ID NO: 1760796 - RNA, 13 nt, Salmonella enterica enterica serovar Typhi Ty2
uggacggcaucag

SEQ ID NO: 1760797 - RNA, 15 nt, Salmonella enterica enterica serovar Typhi Ty2
uggccgaauagcuga

SEQ ID NO: 1760798 - RNA, 15 nt, Salmonella enterica enterica serovar Typhi Ty2
uggccgacuggcacc

SEQ ID NO: 1760799 - RNA, 15 nt, Salmonella enterica enterica serovar Typhi Ty2
uggcccugcaucagc

SEQ ID NO: 1760800 - RNA, 17 nt, Salmonella enterica enterica serovar Typhi Ty2
uggcgaauucggcagac

SEQ ID NO: 1760801 - RNA, 19 nt, Salmonella enterica enterica serovar Typhi Ty2
uggccugcucaauacuuuc

SEQ ID NO: 1760802 - RNA, 11 nt, Salmonella enterica enterica serovar Typhi Ty2
uggccugcugg

SEQ ID NO: 1760803 - RNA, 15 nt, Salmonella enterica enterica serovar Typhi Ty2
uggccugcucaucag

SEQ ID NO: 1760804 - RNA, 17 nt, Salmonella enterica enterica serovar Typhi Ty2
uggcgaccggcagccgu

SEQ ID NO: 1760805 - RNA, 21 nt, Salmonella enterica enterica serovar Typhi Ty2
uggcgaccugauugaccagca

SEQ ID NO: 1760806 - RNA, 21 nt, Salmonella enterica enterica serovar Typhi Ty2
uggcgacgccagccggaaaag

SEQ ID NO: 1760807 - RNA, 14 nt, Salmonella enterica enterica serovar Typhi Ty2
uggcgacgccagcc

SEQ ID NO: 1760808 - RNA, 13 nt, Salmonella enterica enterica serovar Typhi Ty2
uggcgauuuccag

SEQ ID NO: 1760809 - RNA, 16 nt, Salmonella enterica enterica serovar Typhi Ty2
uggcgauuucggugac

SEQ ID NO: 1760810 - RNA, 19 nt, Salmonella enterica enterica serovar Typhi Ty2
uggcgauuuucauagcugg

SEQ ID NO: 1760811 - RNA, 16 nt, Salmonella enterica enterica serovar Typhi Ty2
uggcgagcaacuuuuu

SEQ ID NO: 1760812 - RNA, 15 nt, Salmonella enterica enterica serovar Typhi Ty2
uggcgcaaugucccu

SEQ ID NO: 1760813 - RNA, 20 nt, Salmonella enterica enterica serovar Typhi Ty2
uggcguaauuaaccgcgccg

SEQ ID NO: 1760814 - RNA, 16 nt, Salmonella enterica enterica serovar Typhi Ty2
uggcguagucucccuc

SEQ ID NO: 1760815 - RNA, 22 nt, Salmonella enterica enterica serovar Typhi Ty2
uggcguccggccacuauuucgg

SEQ ID NO: 1760816 - RNA, 15 nt, Salmonella enterica enterica serovar Typhi Ty2
uggcgucaaucaacu

SEQ ID NO: 1760817 - RNA, 21 nt, Salmonella enterica enterica serovar Typhi Ty2
uggcgucgccaaagcagcugc

SEQ ID NO: 1760818 - RNA, 17 nt, Salmonella enterica enterica serovar Typhi Ty2
uggcuaaucgccacgac

SEQ ID NO: 1760819 - RNA, 14 nt, Salmonella enterica enterica serovar Typhi Ty2
uggcuagggaaacg

SEQ ID NO: 1760820 - RNA, 16 nt, Salmonella enterica enterica serovar Typhi Ty2
uggcucaauccaggug

SEQ ID NO: 1760821 - RNA, 20 nt, Salmonella enterica enterica serovar Typhi Ty2
uggcucaagauucaguucca

SEQ ID NO: 1760822 - RNA, 23 nt, Salmonella enterica enterica serovar Typhi Ty2
uggcggcguccggcacgcgcagc

SEQ ID NO: 1760823 - RNA, 17 nt, Salmonella enterica enterica serovar Typhi Ty2
uggcguaaauauucguu

SEQ ID NO: 1760824 - RNA, 21 nt, Salmonella enterica enterica serovar Typhi Ty2
uggcguaaaugugcgccagcc

SEQ ID NO: 1760825 - RNA, 23 nt, Salmonella enterica enterica serovar Typhi Ty2
uggcgcggacgcuuaccgggccu

SEQ ID NO: 1760826 - RNA, 15 nt, Salmonella enterica enterica serovar Typhi Ty2
uggcgccagccuguc

SEQ ID NO: 1760827 - RNA, 18 nt, Salmonella enterica enterica serovar Typhi Ty2
ugggacauaauugcugcc

SEQ ID NO: 1760828 - RNA, 16 nt, Salmonella enterica enterica serovar Typhi Ty2
ugggaauuagcgaauc

SEQ ID NO: 1760829 - RNA, 23 nt, Salmonella enterica enterica serovar Typhi Ty2
ugggaaucgccugaugaagcgga

SEQ ID NO: 1760830 - RNA, 17 nt, Salmonella enterica enterica serovar Typhi Ty2
uggcugucggcagaacc

SEQ ID NO: 1760831 - RNA, 16 nt, Salmonella enterica enterica serovar Typhi Ty2
uggcuggggcguuauc

SEQ ID NO: 1760832 - RNA, 14 nt, Salmonella enterica enterica serovar Typhi Ty2
uggcuggcgucccg

SEQ ID NO: 1760833 - RNA, 15 nt, Salmonella enterica enterica serovar Typhi Ty2
uggcuggcauauugc

SEQ ID NO: 1760834 - RNA, 12 nt, Salmonella enterica enterica serovar Typhi Ty2
uggcuguuuccc

SEQ ID NO: 1760835 - RNA, 19 nt, Salmonella enterica enterica serovar Typhi Ty2
uggcucccgcagccacucc

SEQ ID NO: 1760836 - RNA, 21 nt, Salmonella enterica enterica serovar Typhi Ty2
uggcucccgaacgauaauucg

SEQ ID NO: 1760837 - RNA, 14 nt, Salmonella enterica enterica serovar Typhi Ty2
uggcucggccuguc

SEQ ID NO: 1760838 - RNA, 15 nt, Salmonella enterica enterica serovar Typhi Ty2
uggcuggccagggca

SEQ ID NO: 1760839 - RNA, 21 nt, Salmonella enterica enterica serovar Typhi Ty2
uggcugcgcgucccucuccag

SEQ ID NO: 1760840 - RNA, 13 nt, Salmonella enterica enterica serovar Typhi Ty2
uggcucugggcca

SEQ ID NO: 1760841 - RNA, 19 nt, Salmonella enterica enterica serovar Typhi Ty2
ugggcagugcucgccaaaa

SEQ ID NO: 1760842 - RNA, 22 nt, Salmonella enterica enterica serovar Typhi Ty2
ugggcaggagaugaccugccca

SEQ ID NO: 1760843 - RNA, 17 nt, Salmonella enterica enterica serovar Typhi Ty2
ugggcaggaacagauac

SEQ ID NO: 1760844 - RNA, 17 nt, Salmonella enterica enterica serovar Typhi Ty2
uggguaaauaccaggca

SEQ ID NO: 1760845 - RNA, 17 nt, Salmonella enterica enterica serovar Typhi Ty2
ugggcgcaacagucagc

SEQ ID NO: 1760846 - RNA, 14 nt, Salmonella enterica enterica serovar Typhi Ty2
ugggcgcaacaguc

SEQ ID NO: 1760847 - RNA, 17 nt, Salmonella enterica enterica serovar Typhi Ty2
ugugaucugguuuggua

SEQ ID NO: 1760848 - RNA, 21 nt, Salmonella enterica enterica serovar Typhi Ty2
ugugauccgcccccuccagua

SEQ ID NO: 1760849 - RNA, 20 nt, Salmonella enterica enterica serovar Typhi Ty2
ugugccaguaccgccgccgg

SEQ ID NO: 1760850 - RNA, 21 nt, Salmonella enterica enterica serovar Typhi Ty2
ugugccagcucguuauuuccg

SEQ ID NO: 1760851 - RNA, 17 nt, Salmonella enterica enterica serovar Typhi Ty2
ugugccaguaaucccgg

SEQ ID NO: 1760852 - RNA, 12 nt, Salmonella enterica enterica serovar Typhi Ty2
ugucuuuuucuc

SEQ ID NO: 1760853 - RNA, 22 nt, Salmonella enterica enterica serovar Typhi Ty2
ugugaacaucacguccucccgu

SEQ ID NO: 1760854 - RNA, 19 nt, Salmonella enterica enterica serovar Typhi Ty2
ugugaauaugaucugcaca

SEQ ID NO: 1760855 - RNA, 13 nt, Salmonella enterica enterica serovar Typhi Ty2
ugucuuuauuacg

SEQ ID NO: 1760856 - RNA, 14 nt, Salmonella enterica enterica serovar Typhi Ty2
ugucugaaugaguc

SEQ ID NO: 1760857 - RNA, 13 nt, Salmonella enterica enterica serovar Typhi Ty2
ugucuucaucuau

SEQ ID NO: 1760858 - RNA, 17 nt, Salmonella enterica enterica serovar Typhi Ty2
ugucucgucgccagggc

SEQ ID NO: 1760859 - RNA, 18 nt, Salmonella enterica enterica serovar Typhi Ty2
ugucggccugauuucuga

SEQ ID NO: 1760860 - RNA, 23 nt, Salmonella enterica enterica serovar Typhi Ty2
ugucggccaggugccgagguuaa

SEQ ID NO: 1760861 - RNA, 22 nt, Salmonella enterica enterica serovar Typhi Ty2
ugucguuaaugcucuuaaaaug

SEQ ID NO: 1760862 - RNA, 18 nt, Salmonella enterica enterica serovar Typhi Ty2
uguccuuucugcugccgc

SEQ ID NO: 1760863 - RNA, 23 nt, Salmonella enterica enterica serovar Typhi Ty2
uguccuuuacugcgccagccugc

SEQ ID NO: 1760864 - RNA, 17 nt, Salmonella enterica enterica serovar Typhi Ty2
ugucgaccgcuccacuc

SEQ ID NO: 1760865 - RNA, 17 nt, Salmonella enterica enterica serovar Typhi Ty2
ugucgacaauaaauugc

SEQ ID NO: 1760866 - RNA, 23 nt, Salmonella enterica enterica serovar Typhi Ty2
ugucgcaaccgacacauucaggc

SEQ ID NO: 1760867 - RNA, 15 nt, Salmonella enterica enterica serovar Typhi Ty2
ugucgauaacagcau

SEQ ID NO: 1760868 - RNA, 22 nt, Salmonella enterica enterica serovar Typhi Ty2
ugucgaugagcucguuauaagc

SEQ ID NO: 1760869 - RNA, 23 nt, Salmonella enterica enterica serovar Typhi Ty2
uguccggcgcaaucuuugccgca

SEQ ID NO: 1760870 - RNA, 19 nt, Salmonella enterica enterica serovar Typhi Ty2
uguccggcgacuccagaau

SEQ ID NO: 1760871 - RNA, 16 nt, Salmonella enterica enterica serovar Typhi Ty2
uguccggcgacuccag

SEQ ID NO: 1760872 - RNA, 16 nt, Salmonella enterica enterica serovar Typhi Ty2
uguccguuuucucaaa

SEQ ID NO: 1760873 - RNA, 22 nt, Salmonella enterica enterica serovar Typhi Ty2
uguccgguauugauuagcuuuu

SEQ ID NO: 1760874 - RNA, 13 nt, Salmonella enterica enterica serovar Typhi Ty2
uguccgcugcugu

SEQ ID NO: 1760875 - RNA, 15 nt, Salmonella enterica enterica serovar Typhi Ty2
uguccggaauaacuc

SEQ ID NO: 1760876 - RNA, 16 nt, Salmonella enterica enterica serovar Typhi Ty2
uguccuauugcaacgc

SEQ ID NO: 1760877 - RNA, 15 nt, Salmonella enterica enterica serovar Typhi Ty2
uguccugaaggacaa

SEQ ID NO: 1760878 - RNA, 15 nt, Salmonella enterica enterica serovar Typhi Ty2
ugucagggcggaaca

SEQ ID NO: 1760879 - RNA, 19 nt, Salmonella enterica enterica serovar Typhi Ty2
ugucagaucgcccggauca

SEQ ID NO: 1760880 - RNA, 16 nt, Salmonella enterica enterica serovar Typhi Ty2
ugucacccgcuuuucc

SEQ ID NO: 1760881 - RNA, 13 nt, Salmonella enterica enterica serovar Typhi Ty2
ugucacaccggcg

SEQ ID NO: 1760882 - RNA, 18 nt, Salmonella enterica enterica serovar Typhi Ty2
uguccauugcgagaaaaa

SEQ ID NO: 1760883 - RNA, 20 nt, Salmonella enterica enterica serovar Typhi Ty2
ugucccagugucaacugcgc

SEQ ID NO: 1760884 - RNA, 13 nt, Salmonella enterica enterica serovar Typhi Ty2
ugucccagccuuc

SEQ ID NO: 1760885 - RNA, 20 nt, Salmonella enterica enterica serovar Typhi Ty2
ugucccaucguaacgccguc

SEQ ID NO: 1760886 - RNA, 23 nt, Salmonella enterica enterica serovar Typhi Ty2
uguaucugcugacacccucugcg

SEQ ID NO: 1760887 - RNA, 23 nt, Salmonella enterica enterica serovar Typhi Ty2
uguaucugguggaaaagaaaaca

SEQ ID NO: 1760888 - RNA, 20 nt, Salmonella enterica enterica serovar Typhi Ty2
uguaucgcgcggauuccgcc

SEQ ID NO: 1760889 - RNA, 23 nt, Salmonella enterica enterica serovar Typhi Ty2
uguagcaacccuggcgcuuuaaa

SEQ ID NO: 1760890 - RNA, 23 nt, Salmonella enterica enterica serovar Typhi Ty2
uguagcaaccucggcuugcuuca

SEQ ID NO: 1760891 - RNA, 17 nt, Salmonella enterica enterica serovar Typhi Ty2
uguagcagcgccagcgu

SEQ ID NO: 1760892 - RNA, 18 nt, Salmonella enterica enterica serovar Typhi Ty2
uguauuuaauaccuggua

SEQ ID NO: 1760893 - RNA, 16 nt, Salmonella enterica enterica serovar Typhi Ty2
uguauuguucaugcaa

SEQ ID NO: 1760894 - RNA, 11 nt, Salmonella enterica enterica serovar Typhi Ty2
ugucaccagca

SEQ ID NO: 1760895 - RNA, 16 nt, Salmonella enterica enterica serovar Typhi Ty2
ugucaaucgccugcug

SEQ ID NO: 1760896 - RNA, 18 nt, Salmonella enterica enterica serovar Typhi Ty2
uggucugaaucugcuccg

SEQ ID NO: 1760897 - RNA, 14 nt, Salmonella enterica enterica serovar Typhi Ty2
uggucgguauuauc

SEQ ID NO: 1760898 - RNA, 14 nt, Salmonella enterica enterica serovar Typhi Ty2
uggguaucuucauc

SEQ ID NO: 1760899 - RNA, 19 nt, Salmonella enterica enterica serovar Typhi Ty2
uggguaccucaugccggcu

SEQ ID NO: 1760900 - RNA, 19 nt, Salmonella enterica enterica serovar Typhi Ty2
uggguacguucggacuggg

SEQ ID NO: 1760901 - RNA, 19 nt, Salmonella enterica enterica serovar Typhi Ty2
ugggucacgauaaccaggu

SEQ ID NO: 1760902 - RNA, 16 nt, Salmonella enterica enterica serovar Typhi Ty2
uggucuccaguaucag

SEQ ID NO: 1760903 - RNA, 23 nt, Salmonella enterica enterica serovar Typhi Ty2
uggugaucuggccaauuuuucac

SEQ ID NO: 1760904 - RNA, 17 nt, Salmonella enterica enterica serovar Typhi Ty2
uggugauccagcguagc

SEQ ID NO: 1760905 - RNA, 15 nt, Salmonella enterica enterica serovar Typhi Ty2
uggugcagccgccau

SEQ ID NO: 1760906 - RNA, 21 nt, Salmonella enterica enterica serovar Typhi Ty2
uggugaugaacaugcccggau

SEQ ID NO: 1760907 - RNA, 12 nt, Salmonella enterica enterica serovar Typhi Ty2
uggugcauuuuu

SEQ ID NO: 1760908 - RNA, 12 nt, Salmonella enterica enterica serovar Typhi Ty2
uggugcaucugg

SEQ ID NO: 1760909 - RNA, 17 nt, Salmonella enterica enterica serovar Typhi Ty2
uggugccguuacuguuu

SEQ ID NO: 1760910 - RNA, 16 nt, Salmonella enterica enterica serovar Typhi Ty2
ugguggcgaauacugu

SEQ ID NO: 1760911 - RNA, 19 nt, Salmonella enterica enterica serovar Typhi Ty2
ugguggcuauagcucaguu

SEQ ID NO: 1760912 - RNA, 16 nt, Salmonella enterica enterica serovar Typhi Ty2
ugguggauauccagca

SEQ ID NO: 1760913 - RNA, 23 nt, Salmonella enterica enterica serovar Typhi Ty2
ugguggcagaguccagcggcagc

SEQ ID NO: 1760914 - RNA, 14 nt, Salmonella enterica enterica serovar Typhi Ty2
ugguggucuauggu

SEQ ID NO: 1760915 - RNA, 19 nt, Salmonella enterica enterica serovar Typhi Ty2
ugguggucauccgcccggc

SEQ ID NO: 1760916 - RNA, 15 nt, Salmonella enterica enterica serovar Typhi Ty2
uggugugaacaucac

SEQ ID NO: 1760917 - RNA, 21 nt, Salmonella enterica enterica serovar Typhi Ty2
ugguuaacaauauugcgcuua

SEQ ID NO: 1760918 - RNA, 16 nt, Salmonella enterica enterica serovar Typhi Ty2
ugguuaaccaccagcg

SEQ ID NO: 1760919 - RNA, 18 nt, Salmonella enterica enterica serovar Typhi Ty2
ugguuaaccaccucauua

SEQ ID NO: 1760920 - RNA, 15 nt, Salmonella enterica enterica serovar Typhi Ty2
ugguuaaugaccugc

SEQ ID NO: 1760921 - RNA, 22 nt, Salmonella enterica enterica serovar Typhi Ty2
ugguuaaauucauauuuaaaua

SEQ ID NO: 1760922 - RNA, 20 nt, Salmonella enterica enterica serovar Typhi Ty2
ugguuaaauuaaauaacaaa

SEQ ID NO: 1760923 - RNA, 16 nt, Salmonella enterica enterica serovar Typhi Ty2
ugguguuaguuucuau

SEQ ID NO: 1760924 - RNA, 14 nt, Salmonella enterica enterica serovar Typhi Ty2
ugguuauccagcaa

SEQ ID NO: 1760925 - RNA, 16 nt, Salmonella enterica enterica serovar Typhi Ty2
ugguuagccauuucgc

SEQ ID NO: 1760926 - RNA, 13 nt, Salmonella enterica enterica serovar Typhi Ty2
ugguuagcgcucu

SEQ ID NO: 1760927 - RNA, 18 nt, Salmonella enterica enterica serovar Typhi Ty2
ugguuagaauaccugccu

SEQ ID NO: 1760928 - RNA, 16 nt, Salmonella enterica enterica serovar Typhi Ty2
ugguuacuauuuuuca

SEQ ID NO: 1760929 - RNA, 14 nt, Salmonella enterica enterica serovar Typhi Ty2
ugguuauuuucaga

SEQ ID NO: 1760930 - RNA, 17 nt, Salmonella enterica enterica serovar Typhi Ty2
ugguuauccagcaggua

SEQ ID NO: 1760931 - RNA, 23 nt, Salmonella enterica enterica serovar Typhi Ty2
uguaagaggcauaaaaaaaagcc

SEQ ID NO: 1760932 - RNA, 18 nt, Salmonella enterica enterica serovar Typhi Ty2
uguaagagguauccugaa

SEQ ID NO: 1760933 - RNA, 20 nt, Salmonella enterica enterica serovar Typhi Ty2
uguaagcaauuaauauuuaa

SEQ ID NO: 1760934 - RNA, 21 nt, Salmonella enterica enterica serovar Typhi Ty2
uguaagggaggugcucuccca

SEQ ID NO: 1760935 - RNA, 15 nt, Salmonella enterica enterica serovar Typhi Ty2
uguacaucacauugc

SEQ ID NO: 1760936 - RNA, 16 nt, Salmonella enterica enterica serovar Typhi Ty2
uguacaucuacuucag

SEQ ID NO: 1760937 - RNA, 16 nt, Salmonella enterica enterica serovar Typhi Ty2
uguacgugaagggaau

SEQ ID NO: 1760938 - RNA, 14 nt, Salmonella enterica enterica serovar Typhi Ty2
uguaauuuauaaag

SEQ ID NO: 1760939 - RNA, 14 nt, Salmonella enterica enterica serovar Typhi Ty2
uguaauugacaugg

SEQ ID NO: 1760940 - RNA, 22 nt, Salmonella enterica enterica serovar Typhi Ty2
uguaauucucacagaaucauca

SEQ ID NO: 1760941 - RNA, 15 nt, Salmonella enterica enterica serovar Typhi Ty2
uguaauugcgccagg

SEQ ID NO: 1760942 - RNA, 15 nt, Salmonella enterica enterica serovar Typhi Ty2
uguaauuauaaauau

SEQ ID NO: 1760943 - RNA, 19 nt, Salmonella enterica enterica serovar Typhi Ty2
uguacagcaauaaaaggaa

SEQ ID NO: 1760944 - RNA, 12 nt, Salmonella enterica enterica serovar Typhi Ty2
ugguuucuuuua

SEQ ID NO: 1760945 - RNA, 23 nt, Salmonella enterica enterica serovar Typhi Ty2
ugguucccugaccuuccauccac

SEQ ID NO: 1760946 - RNA, 13 nt, Salmonella enterica enterica serovar Typhi Ty2
ugguuccauucca

SEQ ID NO: 1760947 - RNA, 22 nt, Salmonella enterica enterica serovar Typhi Ty2
ugguucauagaguguuggucuu

SEQ ID NO: 1760948 - RNA, 23 nt, Salmonella enterica enterica serovar Typhi Ty2
ugguucaugcuuccaaagagcug

SEQ ID NO: 1760949 - RNA, 18 nt, Salmonella enterica enterica serovar Typhi Ty2
ugguugaaccgacggugc

SEQ ID NO: 1760950 - RNA, 16 nt, Salmonella enterica enterica serovar Typhi Ty2
ugguugagauccauaa

SEQ ID NO: 1760951 - RNA, 23 nt, Salmonella enterica enterica serovar Typhi Ty2
uguaaagaaugaaaaaaaaauua

SEQ ID NO: 1760952 - RNA, 18 nt, Salmonella enterica enterica serovar Typhi Ty2
ugccgugaauauucagau

SEQ ID NO: 1760953 - RNA, 19 nt, Salmonella enterica enterica serovar Typhi Ty2
ugccucguuucccucauau

SEQ ID NO: 1760954 - RNA, 19 nt, Salmonella enterica enterica serovar Typhi Ty2
ugccucuggccaguuucaa

SEQ ID NO: 1760955 - RNA, 14 nt, Salmonella enterica enterica serovar Typhi Ty2
ugccugccgccucc

SEQ ID NO: 1760956 - RNA, 22 nt, Salmonella enterica enterica serovar Typhi Ty2
ugccugccgucgcggcuuucag

SEQ ID NO: 1760957 - RNA, 17 nt, Salmonella enterica enterica serovar Typhi Ty2
ugccugacagcaaugag

SEQ ID NO: 1760958 - RNA, 18 nt, Salmonella enterica enterica serovar Typhi Ty2
ugccugucgucaccugua

SEQ ID NO: 1760959 - RNA, 13 nt, Salmonella enterica enterica serovar Typhi Ty2
ugccuguccggag

SEQ ID NO: 1760960 - RNA, 18 nt, Salmonella enterica enterica serovar Typhi Ty2
ugccuguguaucgcccug

SEQ ID NO: 1760961 - RNA, 18 nt, Salmonella enterica enterica serovar Typhi Ty2
ugccuguugcgggccagc

SEQ ID NO: 1760962 - RNA, 15 nt, Salmonella enterica enterica serovar Typhi Ty2
ugccuucugaaaguu

SEQ ID NO: 1760963 - RNA, 22 nt, Salmonella enterica enterica serovar Typhi Ty2
ugccuucuuuggugcgacgcca

SEQ ID NO: 1760964 - RNA, 14 nt, Salmonella enterica enterica serovar Typhi Ty2
ugccuucgccgccg

SEQ ID NO: 1760965 - RNA, 17 nt, Salmonella enterica enterica serovar Typhi Ty2
ugccuucggcgcuggga

SEQ ID NO: 1760966 - RNA, 23 nt, Salmonella enterica enterica serovar Typhi Ty2
ugccuuccgggcggcugucccag

SEQ ID NO: 1760967 - RNA, 14 nt, Salmonella enterica enterica serovar Typhi Ty2
ugccuuauccggcc

SEQ ID NO: 1760968 - RNA, 15 nt, Salmonella enterica enterica serovar Typhi Ty2
ugccuucaaauauau

SEQ ID NO: 1760969 - RNA, 22 nt, Salmonella enterica enterica serovar Typhi Ty2
ugccguaaauugaguggacauc

SEQ ID NO: 1760970 - RNA, 19 nt, Salmonella enterica enterica serovar Typhi Ty2
ugccgguuuuagcaaugau

SEQ ID NO: 1760971 - RNA, 21 nt, Salmonella enterica enterica serovar Typhi Ty2
ugccguagaaaaugcgcuggg

SEQ ID NO: 1760972 - RNA, 19 nt, Salmonella enterica enterica serovar Typhi Ty2
ugccgucgcggcuuucagc

SEQ ID NO: 1760973 - RNA, 13 nt, Salmonella enterica enterica serovar Typhi Ty2
ugccgucguacuc

SEQ ID NO: 1760974 - RNA, 21 nt, Salmonella enterica enterica serovar Typhi Ty2
ugccgucggcaauuaacauuu

SEQ ID NO: 1760975 - RNA, 15 nt, Salmonella enterica enterica serovar Typhi Ty2
ugccgguuaacucuu

SEQ ID NO: 1760976 - RNA, 14 nt, Salmonella enterica enterica serovar Typhi Ty2
ugccggugguggug

SEQ ID NO: 1760977 - RNA, 18 nt, Salmonella enterica enterica serovar Typhi Ty2
ugccggugcgagaaaaag

SEQ ID NO: 1760978 - RNA, 13 nt, Salmonella enterica enterica serovar Typhi Ty2
ugccggucggcgu

SEQ ID NO: 1760979 - RNA, 17 nt, Salmonella enterica enterica serovar Typhi Ty2
ugccggugcgagaaaaa

SEQ ID NO: 1760980 - RNA, 16 nt, Salmonella enterica enterica serovar Typhi Ty2
ugccgggugcggcgcu

SEQ ID NO: 1760981 - RNA, 11 nt, Salmonella enterica enterica serovar Typhi Ty2
ugcgaggcgcg

SEQ ID NO: 1760982 - RNA, 15 nt, Salmonella enterica enterica serovar Typhi Ty2
ugcgaggggccaaaa

SEQ ID NO: 1760983 - RNA, 16 nt, Salmonella enterica enterica serovar Typhi Ty2
ugcgaggggccaaaac

SEQ ID NO: 1760984 - RNA, 16 nt, Salmonella enterica enterica serovar Typhi Ty2
ugcgauagcccggcau

SEQ ID NO: 1760985 - RNA, 22 nt, Salmonella enterica enterica serovar Typhi Ty2
ugcgauaaugaagcauaaaaag

SEQ ID NO: 1760986 - RNA, 23 nt, Salmonella enterica enterica serovar Typhi Ty2
ugcgauaaugguugaacaggcug

SEQ ID NO: 1760987 - RNA, 22 nt, Salmonella enterica enterica serovar Typhi Ty2
ugcgacaacaaguccaaguaug

SEQ ID NO: 1760988 - RNA, 14 nt, Salmonella enterica enterica serovar Typhi Ty2
ugcgacaagcucau

SEQ ID NO: 1760989 - RNA, 18 nt, Salmonella enterica enterica serovar Typhi Ty2
ugcgaauaacaucauccg

SEQ ID NO: 1760990 - RNA, 15 nt, Salmonella enterica enterica serovar Typhi Ty2
ugcgaauaaacacau

SEQ ID NO: 1760991 - RNA, 15 nt, Salmonella enterica enterica serovar Typhi Ty2
ugcgaaugcuggcug

SEQ ID NO: 1760992 - RNA, 20 nt, Salmonella enterica enterica serovar Typhi Ty2
ugccuuuuuuaauuccggag

SEQ ID NO: 1760993 - RNA, 12 nt, Salmonella enterica enterica serovar Typhi Ty2
ugcgaaacgucc

SEQ ID NO: 1760994 - RNA, 14 nt, Salmonella enterica enterica serovar Typhi Ty2
ugcgaaagccucuu

SEQ ID NO: 1760995 - RNA, 19 nt, Salmonella enterica enterica serovar Typhi Ty2
ugcgaaagccucuuccgcc

SEQ ID NO: 1760996 - RNA, 16 nt, Salmonella enterica enterica serovar Typhi Ty2
ugccuuuauuucaagc

SEQ ID NO: 1760997 - RNA, 12 nt, Salmonella enterica enterica serovar Typhi Ty2
ugccuuucagau

SEQ ID NO: 1760998 - RNA, 22 nt, Salmonella enterica enterica serovar Typhi Ty2
ugccuuuuacaauaaccggcag

SEQ ID NO: 1760999 - RNA, 19 nt, Salmonella enterica enterica serovar Typhi Ty2
ugccuuuaacaaauuaaau

SEQ ID NO: 1761000 - RNA, 18 nt, Salmonella enterica enterica serovar Typhi Ty2
ugccuuuaacaaauuaaa

SEQ ID NO: 1761001 - RNA, 23 nt, Salmonella enterica enterica serovar Typhi Ty2
ugcgccgacaucgccaccgcaug

SEQ ID NO: 1761002 - RNA, 19 nt, Salmonella enterica enterica serovar Typhi Ty2
ugcgccgcacuucacgcuc

SEQ ID NO: 1761003 - RNA, 16 nt, Salmonella enterica enterica serovar Typhi Ty2
ugcgccgccagcgaca

SEQ ID NO: 1761004 - RNA, 18 nt, Salmonella enterica enterica serovar Typhi Ty2
ugcgccagcgugcuaagc

SEQ ID NO: 1761005 - RNA, 19 nt, Salmonella enterica enterica serovar Typhi Ty2
ugcgccaggcccagccgcu

SEQ ID NO: 1761006 - RNA, 15 nt, Salmonella enterica enterica serovar Typhi Ty2
ugcgccaggcagcac

SEQ ID NO: 1761007 - RNA, 23 nt, Salmonella enterica enterica serovar Typhi Ty2
ugcgccagccagucgccaggcaa

SEQ ID NO: 1761008 - RNA, 22 nt, Salmonella enterica enterica serovar Typhi Ty2
ugcgccagccggauacugcgcu

SEQ ID NO: 1761009 - RNA, 15 nt, Salmonella enterica enterica serovar Typhi Ty2
ugcgccaucgggccg

SEQ ID NO: 1761010 - RNA, 19 nt, Salmonella enterica enterica serovar Typhi Ty2
ugcgccauuucaauaauau

SEQ ID NO: 1761011 - RNA, 19 nt, Salmonella enterica enterica serovar Typhi Ty2
ugcgaucucauaccaggug

SEQ ID NO: 1761012 - RNA, 19 nt, Salmonella enterica enterica serovar Typhi Ty2
ugcgaucuccuuuaaugaa

SEQ ID NO: 1761013 - RNA, 21 nt, Salmonella enterica enterica serovar Typhi Ty2
ugcgaucugugucguccaggc

SEQ ID NO: 1761014 - RNA, 19 nt, Salmonella enterica enterica serovar Typhi Ty2
ugcgaucugugucguccag

SEQ ID NO: 1761015 - RNA, 16 nt, Salmonella enterica enterica serovar Typhi Ty2
ugcgauggccgcugac

SEQ ID NO: 1761016 - RNA, 14 nt, Salmonella enterica enterica serovar Typhi Ty2
ugcgccaaaucggu

SEQ ID NO: 1761017 - RNA, 19 nt, Salmonella enterica enterica serovar Typhi Ty2
ugcgccaacugcauuucau

SEQ ID NO: 1761018 - RNA, 15 nt, Salmonella enterica enterica serovar Typhi Ty2
ugcgcacgccagcgg

SEQ ID NO: 1761019 - RNA, 17 nt, Salmonella enterica enterica serovar Typhi Ty2
ugcgccaccagcgcagu

SEQ ID NO: 1761020 - RNA, 20 nt, Salmonella enterica enterica serovar Typhi Ty2
ugcgccaccagcgcaguaaa

SEQ ID NO: 1761021 - RNA, 13 nt, Salmonella enterica enterica serovar Typhi Ty2
ugcgccagauuca

SEQ ID NO: 1761022 - RNA, 20 nt, Salmonella enterica enterica serovar Typhi Ty2
ugcuccaguuguuccagcag

SEQ ID NO: 1761023 - RNA, 16 nt, Salmonella enterica enterica serovar Typhi Ty2
ugcuccaguuguucca

SEQ ID NO: 1761024 - RNA, 13 nt, Salmonella enterica enterica serovar Typhi Ty2
ugcucccacagcu

SEQ ID NO: 1761025 - RNA, 20 nt, Salmonella enterica enterica serovar Typhi Ty2
ugcuccccaaccgccagcca

SEQ ID NO: 1761026 - RNA, 17 nt, Salmonella enterica enterica serovar Typhi Ty2
ugcuccaugacguucaa

SEQ ID NO: 1761027 - RNA, 19 nt, Salmonella enterica enterica serovar Typhi Ty2
ugcucgaaauccucacggu

SEQ ID NO: 1761028 - RNA, 22 nt, Salmonella enterica enterica serovar Typhi Ty2
ugcuccggcuuaaugcccggcc

SEQ ID NO: 1761029 - RNA, 12 nt, Salmonella enterica enterica serovar Typhi Ty2
ugcuccgggcca

SEQ ID NO: 1761030 - RNA, 14 nt, Salmonella enterica enterica serovar Typhi Ty2
ugcuccgccagcaa

SEQ ID NO: 1761031 - RNA, 12 nt, Salmonella enterica enterica serovar Typhi Ty2
ugcucagccccu

SEQ ID NO: 1761032 - RNA, 22 nt, Salmonella enterica enterica serovar Typhi Ty2
ugcucacccauuuuauccucuu

SEQ ID NO: 1761033 - RNA, 17 nt, Salmonella enterica enterica serovar Typhi Ty2
ugcucaaucacuuuugc

SEQ ID NO: 1761034 - RNA, 16 nt, Salmonella enterica enterica serovar Typhi Ty2
ugcucaaucgcaugac

SEQ ID NO: 1761035 - RNA, 23 nt, Salmonella enterica enterica serovar Typhi Ty2
ugcucaauuauacgcuggugcag

SEQ ID NO: 1761036 - RNA, 21 nt, Salmonella enterica enterica serovar Typhi Ty2
ugcucaauacuuuccgggccg

SEQ ID NO: 1761037 - RNA, 16 nt, Salmonella enterica enterica serovar Typhi Ty2
ugcucaacuuccagag

SEQ ID NO: 1761038 - RNA, 16 nt, Salmonella enterica enterica serovar Typhi Ty2
ugcucaggaucaauuc

SEQ ID NO: 1761039 - RNA, 18 nt, Salmonella enterica enterica serovar Typhi Ty2
ugcucaucgacagaacgg

SEQ ID NO: 1761040 - RNA, 21 nt, Salmonella enterica enterica serovar Typhi Ty2
ugcucaaccaguaccgggccu

SEQ ID NO: 1761041 - RNA, 14 nt, Salmonella enterica enterica serovar Typhi Ty2
ugcuauucagcagu

SEQ ID NO: 1761042 - RNA, 14 nt, Salmonella enterica enterica serovar Typhi Ty2
ugcuaucaaacuga

SEQ ID NO: 1761043 - RNA, 12 nt, Salmonella enterica enterica serovar Typhi Ty2
ugcuaucaggau

SEQ ID NO: 1761044 - RNA, 14 nt, Salmonella enterica enterica serovar Typhi Ty2
ugcuaucccaggcg

SEQ ID NO: 1761045 - RNA, 18 nt, Salmonella enterica enterica serovar Typhi Ty2
ugcguuuugugcggccua

SEQ ID NO: 1761046 - RNA, 16 nt, Salmonella enterica enterica serovar Typhi Ty2
ugcuaaaagaagcugu

SEQ ID NO: 1761047 - RNA, 23 nt, Salmonella enterica enterica serovar Typhi Ty2
ugcuacgaaccugauuguuuuac

SEQ ID NO: 1761048 - RNA, 22 nt, Salmonella enterica enterica serovar Typhi Ty2
ugcuacaggcaaguuuaauucc

SEQ ID NO: 1761049 - RNA, 20 nt, Salmonella enterica enterica serovar Typhi Ty2
ugcuacgggcgcugucgccg

SEQ ID NO: 1761050 - RNA, 23 nt, Salmonella enterica enterica serovar Typhi Ty2
ugcggcaauggccgcagcgccau

SEQ ID NO: 1761051 - RNA, 21 nt, Salmonella enterica enterica serovar Typhi Ty2
ugcggcaauggccgcagcgcc

SEQ ID NO: 1761052 - RNA, 13 nt, Salmonella enterica enterica serovar Typhi Ty2
ugcggcaucagau

SEQ ID NO: 1761053 - RNA, 22 nt, Salmonella enterica enterica serovar Typhi Ty2
ugcggcgaggaguaguuaaaaa

SEQ ID NO: 1761054 - RNA, 17 nt, Salmonella enterica enterica serovar Typhi Ty2
ugcggcuauauaaaauc

SEQ ID NO: 1761055 - RNA, 20 nt, Salmonella enterica enterica serovar Typhi Ty2
ugcggcuauauaaaaucggg

SEQ ID NO: 1761056 - RNA, 18 nt, Salmonella enterica enterica serovar Typhi Ty2
ugcggcguguuguaaaac

SEQ ID NO: 1761057 - RNA, 15 nt, Salmonella enterica enterica serovar Typhi Ty2
ugcggcuuacccuga

SEQ ID NO: 1761058 - RNA, 15 nt, Salmonella enterica enterica serovar Typhi Ty2
ugcggcuuucaucau

SEQ ID NO: 1761059 - RNA, 17 nt, Salmonella enterica enterica serovar Typhi Ty2
ugcggcgcgcccggcaa

SEQ ID NO: 1761060 - RNA, 16 nt, Salmonella enterica enterica serovar Typhi Ty2
ugcggcggccucuuug

SEQ ID NO: 1761061 - RNA, 23 nt, Salmonella enterica enterica serovar Typhi Ty2
ugcggcggggauaaucagcagcg

SEQ ID NO: 1761062 - RNA, 16 nt, Salmonella enterica enterica serovar Typhi Ty2
ugcgcuuuacuguucc

SEQ ID NO: 1761063 - RNA, 21 nt, Salmonella enterica enterica serovar Typhi Ty2
ugcgcuuuccgccaugaaaaa

SEQ ID NO: 1761064 - RNA, 16 nt, Salmonella enterica enterica serovar Typhi Ty2
ugcgcuuuuccaggcg

SEQ ID NO: 1761065 - RNA, 17 nt, Salmonella enterica enterica serovar Typhi Ty2
ugcggaauacacgaaca

SEQ ID NO: 1761066 - RNA, 14 nt, Salmonella enterica enterica serovar Typhi Ty2
ugcggcaagcgcgc

SEQ ID NO: 1761067 - RNA, 21 nt, Salmonella enterica enterica serovar Typhi Ty2
ugcggaacaccagcgccgcgg

SEQ ID NO: 1761068 - RNA, 16 nt, Salmonella enterica enterica serovar Typhi Ty2
ugcggaaccgcccauc

SEQ ID NO: 1761069 - RNA, 15 nt, Salmonella enterica enterica serovar Typhi Ty2
ugcggaacaccagcg

SEQ ID NO: 1761070 - RNA, 17 nt, Salmonella enterica enterica serovar Typhi Ty2
ugcggaacaccagcgcc

SEQ ID NO: 1761071 - RNA, 18 nt, Salmonella enterica enterica serovar Typhi Ty2
ugcgcugguuggcgcgcu

SEQ ID NO: 1761072 - RNA, 17 nt, Salmonella enterica enterica serovar Typhi Ty2
ugcgcuucgaugcguuc

SEQ ID NO: 1761073 - RNA, 21 nt, Salmonella enterica enterica serovar Typhi Ty2
ugcgccggcugcgcugccagc

SEQ ID NO: 1761074 - RNA, 18 nt, Salmonella enterica enterica serovar Typhi Ty2
ugcgguuacguccggcau

SEQ ID NO: 1761075 - RNA, 19 nt, Salmonella enterica enterica serovar Typhi Ty2
ugcgguuauaauaauaauu

SEQ ID NO: 1761076 - RNA, 17 nt, Salmonella enterica enterica serovar Typhi Ty2
ugcgguucucccggcau

SEQ ID NO: 1761077 - RNA, 23 nt, Salmonella enterica enterica serovar Typhi Ty2
ugcgucaaucaggaaagagccgc

SEQ ID NO: 1761078 - RNA, 15 nt, Salmonella enterica enterica serovar Typhi Ty2
ugcgucaccgggcug

SEQ ID NO: 1761079 - RNA, 22 nt, Salmonella enterica enterica serovar Typhi Ty2
ugcgguuuuccugaugauauuu

SEQ ID NO: 1761080 - RNA, 18 nt, Salmonella enterica enterica serovar Typhi Ty2
ugcgggaacagauaaaug

SEQ ID NO: 1761081 - RNA, 16 nt, Salmonella enterica enterica serovar Typhi Ty2
ugcgggacgcaucauc

SEQ ID NO: 1761082 - RNA, 21 nt, Salmonella enterica enterica serovar Typhi Ty2
ugcguuuaaagagaugacugg

SEQ ID NO: 1761083 - RNA, 23 nt, Salmonella enterica enterica serovar Typhi Ty2
ugcguuggaagugcguuaacccg

SEQ ID NO: 1761084 - RNA, 21 nt, Salmonella enterica enterica serovar Typhi Ty2
ugcgugcgccgugaaauaucc

SEQ ID NO: 1761085 - RNA, 16 nt, Salmonella enterica enterica serovar Typhi Ty2
ugcgugcuggcggccg

SEQ ID NO: 1761086 - RNA, 14 nt, Salmonella enterica enterica serovar Typhi Ty2
ugcguccgccgcua

SEQ ID NO: 1761087 - RNA, 16 nt, Salmonella enterica enterica serovar Typhi Ty2
ugcgucagcgcccgau

SEQ ID NO: 1761088 - RNA, 19 nt, Salmonella enterica enterica serovar Typhi Ty2
ugcgucgcgcuuucaaucg

SEQ ID NO: 1761089 - RNA, 22 nt, Salmonella enterica enterica serovar Typhi Ty2
uggacaaaaaaggaaaaugacg

SEQ ID NO: 1761090 - RNA, 13 nt, Salmonella enterica enterica serovar Typhi Ty2
uggaauucuucau

SEQ ID NO: 1761091 - RNA, 14 nt, Salmonella enterica enterica serovar Typhi Ty2
uggaaugagcaucu

SEQ ID NO: 1761092 - RNA, 22 nt, Salmonella enterica enterica serovar Typhi Ty2
uggaaguaugccucgcgcacca

SEQ ID NO: 1761093 - RNA, 22 nt, Salmonella enterica enterica serovar Typhi Ty2
uggaaucaauuucccuucaauc

SEQ ID NO: 1761094 - RNA, 16 nt, Salmonella enterica enterica serovar Typhi Ty2
uggaaucauccaccag

SEQ ID NO: 1761095 - RNA, 19 nt, Salmonella enterica enterica serovar Typhi Ty2
uggacaaaauuuuuuauca

SEQ ID NO: 1761096 - RNA, 13 nt, Salmonella enterica enterica serovar Typhi Ty2
uggacaaggcacc

SEQ ID NO: 1761097 - RNA, 14 nt, Salmonella enterica enterica serovar Typhi Ty2
uggaccagccaggc

SEQ ID NO: 1761098 - RNA, 13 nt, Salmonella enterica enterica serovar Typhi Ty2
uggacgaggaaaa

SEQ ID NO: 1761099 - RNA, 15 nt, Salmonella enterica enterica serovar Typhi Ty2
uggacgaggaaaaau

SEQ ID NO: 1761100 - RNA, 19 nt, Salmonella enterica enterica serovar Typhi Ty2
uggaaggaagggcgcugcc

SEQ ID NO: 1761101 - RNA, 14 nt, Salmonella enterica enterica serovar Typhi Ty2
uggaagcuguuaau

SEQ ID NO: 1761102 - RNA, 19 nt, Salmonella enterica enterica serovar Typhi Ty2
uggaagaacuuccccauca

SEQ ID NO: 1761103 - RNA, 14 nt, Salmonella enterica enterica serovar Typhi Ty2
uggaagaaaauaua

SEQ ID NO: 1761104 - RNA, 15 nt, Salmonella enterica enterica serovar Typhi Ty2
uggaaauucagggug

SEQ ID NO: 1761105 - RNA, 23 nt, Salmonella enterica enterica serovar Typhi Ty2
uggaacagauguuuacgcugcuc

SEQ ID NO: 1761106 - RNA, 15 nt, Salmonella enterica enterica serovar Typhi Ty2
uggaacgcauccagc

SEQ ID NO: 1761107 - RNA, 18 nt, Salmonella enterica enterica serovar Typhi Ty2
uggaaauauucucagcca

SEQ ID NO: 1761108 - RNA, 21 nt, Salmonella enterica enterica serovar Typhi Ty2
uggaaauaccgguaaucaagc

SEQ ID NO: 1761109 - RNA, 17 nt, Salmonella enterica enterica serovar Typhi Ty2
uggaaacuccagcggca

SEQ ID NO: 1761110 - RNA, 14 nt, Salmonella enterica enterica serovar Typhi Ty2
uggaaaauuucagu

SEQ ID NO: 1761111 - RNA, 15 nt, Salmonella enterica enterica serovar Typhi Ty2
uggaaaaucacgcug

SEQ ID NO: 1761112 - RNA, 22 nt, Salmonella enterica enterica serovar Typhi Ty2
uggaaaaccccaucccggcaac

SEQ ID NO: 1761113 - RNA, 21 nt, Salmonella enterica enterica serovar Typhi Ty2
uggaaaacagcauaauaaagc

SEQ ID NO: 1761114 - RNA, 22 nt, Salmonella enterica enterica serovar Typhi Ty2
uggaaaacagcauaauaaagca

SEQ ID NO: 1761115 - RNA, 13 nt, Salmonella enterica enterica serovar Typhi Ty2
uggaaaaaaagaa

SEQ ID NO: 1761116 - RNA, 18 nt, Salmonella enterica enterica serovar Typhi Ty2
ugcuuuuggcaacggcag

SEQ ID NO: 1761117 - RNA, 20 nt, Salmonella enterica enterica serovar Typhi Ty2
ugcuuuuuauuuuucuggcu

SEQ ID NO: 1761118 - RNA, 22 nt, Salmonella enterica enterica serovar Typhi Ty2
ugcuuuuugauacagcagcacc

SEQ ID NO: 1761119 - RNA, 22 nt, Salmonella enterica enterica serovar Typhi Ty2
ugcuuugaucacccacaccaca

SEQ ID NO: 1761120 - RNA, 16 nt, Salmonella enterica enterica serovar Typhi Ty2
ugcuuucucgggccug

SEQ ID NO: 1761121 - RNA, 19 nt, Salmonella enterica enterica serovar Typhi Ty2
ugcuuucgcgauaaucaac

SEQ ID NO: 1761122 - RNA, 16 nt, Salmonella enterica enterica serovar Typhi Ty2
ugcuuucaauaaauca

SEQ ID NO: 1761123 - RNA, 12 nt, Salmonella enterica enterica serovar Typhi Ty2
ugcuuuaauauu

SEQ ID NO: 1761124 - RNA, 14 nt, Salmonella enterica enterica serovar Typhi Ty2
ugcuuuaaaugccu

SEQ ID NO: 1761125 - RNA, 19 nt, Salmonella enterica enterica serovar Typhi Ty2
ugcuuuaaaugccuguuua

SEQ ID NO: 1761126 - RNA, 14 nt, Salmonella enterica enterica serovar Typhi Ty2
ugcuuccagcucca

SEQ ID NO: 1761127 - RNA, 16 nt, Salmonella enterica enterica serovar Typhi Ty2
ugcuuccaguagccua

SEQ ID NO: 1761128 - RNA, 16 nt, Salmonella enterica enterica serovar Typhi Ty2
ugcuucgucccugcau

SEQ ID NO: 1761129 - RNA, 15 nt, Salmonella enterica enterica serovar Typhi Ty2
ugcuugagcaggcag

SEQ ID NO: 1761130 - RNA, 21 nt, Salmonella enterica enterica serovar Typhi Ty2
ugcuucacgggguugaaguag

SEQ ID NO: 1761131 - RNA, 18 nt, Salmonella enterica enterica serovar Typhi Ty2
ugcuucacggaaggggcc

SEQ ID NO: 1761132 - RNA, 20 nt, Salmonella enterica enterica serovar Typhi Ty2
ugcuucaccucagcaaaauc

SEQ ID NO: 1761133 - RNA, 18 nt, Salmonella enterica enterica serovar Typhi Ty2
ugcuuauugucgccgccg

SEQ ID NO: 1761134 - RNA, 18 nt, Salmonella enterica enterica serovar Typhi Ty2
ugcuuauguaggccugau

SEQ ID NO: 1761135 - RNA, 22 nt, Salmonella enterica enterica serovar Typhi Ty2
ugcuuagcuggccaaucagcgg

SEQ ID NO: 1761136 - RNA, 19 nt, Salmonella enterica enterica serovar Typhi Ty2
ugcuuaccguuuaccucau

SEQ ID NO: 1761137 - RNA, 13 nt, Salmonella enterica enterica serovar Typhi Ty2
ugcuuaccagacc

SEQ ID NO: 1761138 - RNA, 17 nt, Salmonella enterica enterica serovar Typhi Ty2
ugcuuaaugcucugcug

SEQ ID NO: 1761139 - RNA, 15 nt, Salmonella enterica enterica serovar Typhi Ty2
ugcuuaaaggcggca

SEQ ID NO: 1761140 - RNA, 17 nt, Salmonella enterica enterica serovar Typhi Ty2
ugcuguuuauggcgcuu

SEQ ID NO: 1761141 - RNA, 23 nt, Salmonella enterica enterica serovar Typhi Ty2
ugcugucgcaauuuaccuauuuc

SEQ ID NO: 1761142 - RNA, 16 nt, Salmonella enterica enterica serovar Typhi Ty2
ugcuguccgccagcaa

SEQ ID NO: 1761143 - RNA, 14 nt, Salmonella enterica enterica serovar Typhi Ty2
ugcugugcauaucu

SEQ ID NO: 1761144 - RNA, 20 nt, Salmonella enterica enterica serovar Typhi Ty2
ugcugugacaucgccccggc

SEQ ID NO: 1761145 - RNA, 14 nt, Salmonella enterica enterica serovar Typhi Ty2
ugcugucuauuguc

SEQ ID NO: 1761146 - RNA, 17 nt, Salmonella enterica enterica serovar Typhi Ty2
ugcugucuauugucccg

SEQ ID NO: 1761147 - RNA, 23 nt, Salmonella enterica enterica serovar Typhi Ty2
ugcuguuaccguaagcgggaugg

SEQ ID NO: 1761148 - RNA, 20 nt, Salmonella enterica enterica serovar Typhi Ty2
ugcugugccaguaccgccgc

SEQ ID NO: 1761149 - RNA, 16 nt, Salmonella enterica enterica serovar Typhi Ty2
aaaugucuguuuguuc

SEQ ID NO: 1761150 - RNA, 19 nt, Salmonella enterica enterica serovar Typhi Ty2
ugcuggugaagacgcugca

SEQ ID NO: 1761151 - RNA, 16 nt, Salmonella enterica enterica serovar Typhi Ty2
ugcuggugaccgccuu

SEQ ID NO: 1761152 - RNA, 22 nt, Salmonella enterica enterica serovar Typhi Ty2
ugcugguagagcaucgcggcau

SEQ ID NO: 1761153 - RNA, 13 nt, Salmonella enterica enterica serovar Typhi Ty2
ugcuguaaaauau

SEQ ID NO: 1761154 - RNA, 14 nt, Salmonella enterica enterica serovar Typhi Ty2
ugcuguaaaauauc

SEQ ID NO: 1761155 - RNA, 14 nt, Salmonella enterica enterica serovar Typhi Ty2
ugcugguugucuca

SEQ ID NO: 1761156 - RNA, 13 nt, Salmonella enterica enterica serovar Typhi Ty2
ugcuggugguggg

SEQ ID NO: 1761157 - RNA, 14 nt, Salmonella enterica enterica serovar Typhi Ty2
ugcugguggugggc

SEQ ID NO: 1761158 - RNA, 22 nt, Salmonella enterica enterica serovar Typhi Ty2
ugcuguagcugcccggauaacc

SEQ ID NO: 1761159 - RNA, 13 nt, Salmonella enterica enterica serovar Typhi Ty2
ugcuguagcacau

SEQ ID NO: 1761160 - RNA, 16 nt, Salmonella enterica enterica serovar Typhi Ty2
ugcuguaauuuauaaa

SEQ ID NO: 1761161 - RNA, 17 nt, Salmonella enterica enterica serovar Typhi Ty2
ugcuguacauauccagu

SEQ ID NO: 1761162 - RNA, 17 nt, Salmonella enterica enterica serovar Typhi Ty2
ugcuguaaguuuccguc

SEQ ID NO: 1761163 - RNA, 15 nt, Salmonella enterica enterica serovar Typhi Ty2
ugcugccuacugccc

SEQ ID NO: 1761164 - RNA, 22 nt, Salmonella enterica enterica serovar Typhi Ty2
ugcugcggcacgaaaaauaaaa

SEQ ID NO: 1761165 - RNA, 20 nt, Salmonella enterica enterica serovar Typhi Ty2
ugcuggccgucauggagacg

SEQ ID NO: 1761166 - RNA, 15 nt, Salmonella enterica enterica serovar Typhi Ty2
ugcuggcggcaaggc

SEQ ID NO: 1761167 - RNA, 20 nt, Salmonella enterica enterica serovar Typhi Ty2
ugcuggcgcgucacaacagc

SEQ ID NO: 1761168 - RNA, 14 nt, Salmonella enterica enterica serovar Typhi Ty2
ugcuggcgaugagu

SEQ ID NO: 1761169 - RNA, 17 nt, Salmonella enterica enterica serovar Typhi Ty2
aaaugucaggaucagau

SEQ ID NO: 1761170 - RNA, 14 nt, Salmonella enterica enterica serovar Typhi Ty2
aaaugguuuugccc

SEQ ID NO: 1761171 - RNA, 17 nt, Salmonella enterica enterica serovar Typhi Ty2
aaauguaggccggauaa

SEQ ID NO: 1761172 - RNA, 14 nt, Salmonella enterica enterica serovar Typhi Ty2
ugcugcaccgcauc

SEQ ID NO: 1761173 - RNA, 20 nt, Salmonella enterica enterica serovar Typhi Ty2
ugcugaugcuguaggccggg

SEQ ID NO: 1761174 - RNA, 21 nt, Salmonella enterica enterica serovar Typhi Ty2
ugcugauguccgcagccgcau

SEQ ID NO: 1761175 - RNA, 15 nt, Salmonella enterica enterica serovar Typhi Ty2
ugcugauuuuggcuu

SEQ ID NO: 1761176 - RNA, 15 nt, Salmonella enterica enterica serovar Typhi Ty2
ugcugccagcgccgc

SEQ ID NO: 1761177 - RNA, 16 nt, Salmonella enterica enterica serovar Typhi Ty2
ugcugccacgucacgc

SEQ ID NO: 1761178 - RNA, 16 nt, Salmonella enterica enterica serovar Typhi Ty2
ugcugccagucugccc

SEQ ID NO: 1761179 - RNA, 15 nt, Salmonella enterica enterica serovar Typhi Ty2
ugcugcccgccgccg

SEQ ID NO: 1761180 - RNA, 14 nt, Salmonella enterica enterica serovar Typhi Ty2
ugcugaugcugguu

SEQ ID NO: 1761181 - RNA, 22 nt, Salmonella enterica enterica serovar Typhi Ty2
ugcugaugacuaauggcauuuc

SEQ ID NO: 1761182 - RNA, 15 nt, Salmonella enterica enterica serovar Typhi Ty2
ugcugaccuuaaucc

SEQ ID NO: 1761183 - RNA, 17 nt, Salmonella enterica enterica serovar Typhi Ty2
ugcugaccuuaauccag

SEQ ID NO: 1761184 - RNA, 20 nt, Salmonella enterica enterica serovar Typhi Ty2
ugcugaccuuaauccagcag

SEQ ID NO: 1761185 - RNA, 15 nt, Salmonella enterica enterica serovar Typhi Ty2
ugcugaaaugauaag

SEQ ID NO: 1761186 - RNA, 22 nt, Salmonella enterica enterica serovar Typhi Ty2
ugcugaaaaagaacaauaauca

SEQ ID NO: 1761187 - RNA, 16 nt, Salmonella enterica enterica serovar Typhi Ty2
ugcucuccacgccgca

SEQ ID NO: 1761188 - RNA, 17 nt, Salmonella enterica enterica serovar Typhi Ty2
ugcucucccagcugagc

SEQ ID NO: 1761189 - RNA, 19 nt, Salmonella enterica enterica serovar Typhi Ty2
ugcucuccuggcauggcuc

SEQ ID NO: 1761190 - RNA, 19 nt, Salmonella enterica enterica serovar Typhi Ty2
ugcucucccagcugagcua

SEQ ID NO: 1761191 - RNA, 23 nt, Salmonella enterica enterica serovar Typhi Ty2
ugcucucccagcugagcuaauca

SEQ ID NO: 1761192 - RNA, 19 nt, Salmonella enterica enterica serovar Typhi Ty2
ugcucuaccaacugagcua

SEQ ID NO: 1761193 - RNA, 20 nt, Salmonella enterica enterica serovar Typhi Ty2
ugcucguaaagcaucagacu

SEQ ID NO: 1761194 - RNA, 23 nt, Salmonella enterica enterica serovar Typhi Ty2
ugcucgucggcaauuugacuaca

SEQ ID NO: 1761195 - RNA, 21 nt, Salmonella enterica enterica serovar Typhi Ty2
ugcucgcuaugaaaacgcagc

SEQ ID NO: 1761196 - RNA, 18 nt, Salmonella enterica enterica serovar Typhi Ty2
ugcucgccauaaaucccg

SEQ ID NO: 1761197 - RNA, 15 nt, Salmonella enterica enterica serovar Typhi Ty2
ugaaaauuuguacuu

SEQ ID NO: 1761198 - RNA, 15 nt, Salmonella enterica enterica serovar Typhi Ty2
ugaaaaucaaaaaca

SEQ ID NO: 1761199 - RNA, 14 nt, Salmonella enterica enterica serovar Typhi Ty2
ugaaaauaauuuuu

SEQ ID NO: 1761200 - RNA, 18 nt, Salmonella enterica enterica serovar Typhi Ty2
ugaaaauaauuuuuauca

SEQ ID NO: 1761201 - RNA, 21 nt, Salmonella enterica enterica serovar Typhi Ty2
ugaaacgccguuuguuuauug

SEQ ID NO: 1761202 - RNA, 21 nt, Salmonella enterica enterica serovar Typhi Ty2
ugaaacguguuuauccccgcu

SEQ ID NO: 1761203 - RNA, 22 nt, Salmonella enterica enterica serovar Typhi Ty2
ugaaauaccaggcggcuuuuuc

SEQ ID NO: 1761204 - RNA, 21 nt, Salmonella enterica enterica serovar Typhi Ty2
ugaaauaauuguguaaucuuu

SEQ ID NO: 1761205 - RNA, 22 nt, Salmonella enterica enterica serovar Typhi Ty2
ugaaaguuugaaguguuccuga

SEQ ID NO: 1761206 - RNA, 23 nt, Salmonella enterica enterica serovar Typhi Ty2
ugaaagauuauuuuaucaucagc

SEQ ID NO: 1761207 - RNA, 14 nt, Salmonella enterica enterica serovar Typhi Ty2
ugaaagauuauuuu

SEQ ID NO: 1761208 - RNA, 17 nt, Salmonella enterica enterica serovar Typhi Ty2
ugaaacucgccaugcca

SEQ ID NO: 1761209 - RNA, 18 nt, Salmonella enterica enterica serovar Typhi Ty2
ugaaaggaagugcaacug

SEQ ID NO: 1761210 - RNA, 14 nt, Salmonella enterica enterica serovar Typhi Ty2
ugaaaggccuaaac

SEQ ID NO: 1761211 - RNA, 16 nt, Salmonella enterica enterica serovar Typhi Ty2
ugaaaaauauaaaaag

SEQ ID NO: 1761212 - RNA, 12 nt, Salmonella enterica enterica serovar Typhi Ty2
ugaaaaaucauu

SEQ ID NO: 1761213 - RNA, 13 nt, Salmonella enterica enterica serovar Typhi Ty2
ugaaaaauguuca

SEQ ID NO: 1761214 - RNA, 13 nt, Salmonella enterica enterica serovar Typhi Ty2
ugaaaacaccagg

SEQ ID NO: 1761215 - RNA, 21 nt, Salmonella enterica enterica serovar Typhi Ty2
ugaaaacgcagccccaguugg

SEQ ID NO: 1761216 - RNA, 15 nt, Salmonella enterica enterica serovar Typhi Ty2
ugaaaacggcaucaa

SEQ ID NO: 1761217 - RNA, 15 nt, Salmonella enterica enterica serovar Typhi Ty2
ugaaaagcagccaga

SEQ ID NO: 1761218 - RNA, 22 nt, Salmonella enterica enterica serovar Typhi Ty2
ugaaaacucggcgggguuuuuu

SEQ ID NO: 1761219 - RNA, 13 nt, Salmonella enterica enterica serovar Typhi Ty2
ugaaaagauaaag

SEQ ID NO: 1761220 - RNA, 16 nt, Salmonella enterica enterica serovar Typhi Ty2
ugaaaaagauagacca

SEQ ID NO: 1761221 - RNA, 22 nt, Salmonella enterica enterica serovar Typhi Ty2
ugaaaaacgguauuuccauuuu

SEQ ID NO: 1761222 - RNA, 11 nt, Salmonella enterica enterica serovar Typhi Ty2
ugaaaaaaacg

SEQ ID NO: 1761223 - RNA, 16 nt, Salmonella enterica enterica serovar Typhi Ty2
ugaagcauaaaaagac

SEQ ID NO: 1761224 - RNA, 13 nt, Salmonella enterica enterica serovar Typhi Ty2
ugaagcagaagug

SEQ ID NO: 1761225 - RNA, 19 nt, Salmonella enterica enterica serovar Typhi Ty2
ugaagccaucaaauuugau

SEQ ID NO: 1761226 - RNA, 22 nt, Salmonella enterica enterica serovar Typhi Ty2
ugaagccaucaaauuugauagu

SEQ ID NO: 1761227 - RNA, 20 nt, Salmonella enterica enterica serovar Typhi Ty2
ugaagccauccucacgcaac

SEQ ID NO: 1761228 - RNA, 13 nt, Salmonella enterica enterica serovar Typhi Ty2
ugaagcuguuuug

SEQ ID NO: 1761229 - RNA, 15 nt, Salmonella enterica enterica serovar Typhi Ty2
ugaagcuggagccac

SEQ ID NO: 1761230 - RNA, 11 nt, Salmonella enterica enterica serovar Typhi Ty2
ugaagccccaa

SEQ ID NO: 1761231 - RNA, 14 nt, Salmonella enterica enterica serovar Typhi Ty2
ugaagcugccguag

SEQ ID NO: 1761232 - RNA, 13 nt, Salmonella enterica enterica serovar Typhi Ty2
ugaauaaaccaga

SEQ ID NO: 1761233 - RNA, 19 nt, Salmonella enterica enterica serovar Typhi Ty2
ugaacuacggcccuggcuc

SEQ ID NO: 1761234 - RNA, 20 nt, Salmonella enterica enterica serovar Typhi Ty2
ugaacuacggcccuggcuca

SEQ ID NO: 1761235 - RNA, 22 nt, Salmonella enterica enterica serovar Typhi Ty2
ugaacuacgccccggcgcgcca

SEQ ID NO: 1761236 - RNA, 14 nt, Salmonella enterica enterica serovar Typhi Ty2
ugaacucuuucaga

SEQ ID NO: 1761237 - RNA, 20 nt, Salmonella enterica enterica serovar Typhi Ty2
ugaacucuaugcaaaagaaa

SEQ ID NO: 1761238 - RNA, 23 nt, Salmonella enterica enterica serovar Typhi Ty2
ugaacucuaugcaaaagaaaaaa

SEQ ID NO: 1761239 - RNA, 16 nt, Salmonella enterica enterica serovar Typhi Ty2
ugaacggcucaaaaua

SEQ ID NO: 1761240 - RNA, 18 nt, Salmonella enterica enterica serovar Typhi Ty2
ugaacagucccaccagcg

SEQ ID NO: 1761241 - RNA, 18 nt, Salmonella enterica enterica serovar Typhi Ty2
ugaaaugacacccucuuu

SEQ ID NO: 1761242 - RNA, 18 nt, Salmonella enterica enterica serovar Typhi Ty2
ugaacagccagaagccug

SEQ ID NO: 1761243 - RNA, 17 nt, Salmonella enterica enterica serovar Typhi Ty2
ugaacagcgucauccag

SEQ ID NO: 1761244 - RNA, 19 nt, Salmonella enterica enterica serovar Typhi Ty2
ugaaauccucuauuuuuua

SEQ ID NO: 1761245 - RNA, 12 nt, Salmonella enterica enterica serovar Typhi Ty2
ugaaauccucua

SEQ ID NO: 1761246 - RNA, 20 nt, Salmonella enterica enterica serovar Typhi Ty2
ugaaaucgccuguuaauggu

SEQ ID NO: 1761247 - RNA, 23 nt, Salmonella enterica enterica serovar Typhi Ty2
ugaaccaucggcaaacgccgccu

SEQ ID NO: 1761248 - RNA, 22 nt, Salmonella enterica enterica serovar Typhi Ty2
ugaacccguaagcccuauuagg

SEQ ID NO: 1761249 - RNA, 20 nt, Salmonella enterica enterica serovar Typhi Ty2
ugaacccgaccgucuuuguc

SEQ ID NO: 1761250 - RNA, 20 nt, Salmonella enterica enterica serovar Typhi Ty2
ugaacaggcugugcaacauc

SEQ ID NO: 1761251 - RNA, 17 nt, Salmonella enterica enterica serovar Typhi Ty2
ucuuuguccugaaggac

SEQ ID NO: 1761252 - RNA, 15 nt, Salmonella enterica enterica serovar Typhi Ty2
ucuuuuauauguuga

SEQ ID NO: 1761253 - RNA, 12 nt, Salmonella enterica enterica serovar Typhi Ty2
ucuuuugcaaua

SEQ ID NO: 1761254 - RNA, 20 nt, Salmonella enterica enterica serovar Typhi Ty2
ucuuuugucguccccuggac

SEQ ID NO: 1761255 - RNA, 18 nt, Salmonella enterica enterica serovar Typhi Ty2
ucuuuuucggcuggcagc

SEQ ID NO: 1761256 - RNA, 13 nt, Salmonella enterica enterica serovar Typhi Ty2
ucuuucccggcaa

SEQ ID NO: 1761257 - RNA, 13 nt, Salmonella enterica enterica serovar Typhi Ty2
ucuuucccuuuuu

SEQ ID NO: 1761258 - RNA, 13 nt, Salmonella enterica enterica serovar Typhi Ty2
ucuuucauuucug

SEQ ID NO: 1761259 - RNA, 17 nt, Salmonella enterica enterica serovar Typhi Ty2
ucuuucauuucugccug

SEQ ID NO: 1761260 - RNA, 23 nt, Salmonella enterica enterica serovar Typhi Ty2
ucuuucagccgacuaucuucuuc

SEQ ID NO: 1761261 - RNA, 15 nt, Salmonella enterica enterica serovar Typhi Ty2
ucuuuccuuuuucag

SEQ ID NO: 1761262 - RNA, 14 nt, Salmonella enterica enterica serovar Typhi Ty2
ucuuucuuuuuaua

SEQ ID NO: 1761263 - RNA, 15 nt, Salmonella enterica enterica serovar Typhi Ty2
ucuugcuuuauuuuu

SEQ ID NO: 1761264 - RNA, 11 nt, Salmonella enterica enterica serovar Typhi Ty2
ucuugcuauca

SEQ ID NO: 1761265 - RNA, 18 nt, Salmonella enterica enterica serovar Typhi Ty2
ucuugguaccaaacagca

SEQ ID NO: 1761266 - RNA, 21 nt, Salmonella enterica enterica serovar Typhi Ty2
ucuugucaggcagaaauaacu

SEQ ID NO: 1761267 - RNA, 22 nt, Salmonella enterica enterica serovar Typhi Ty2
ucuuguagugugauccaucccu

SEQ ID NO: 1761268 - RNA, 20 nt, Salmonella enterica enterica serovar Typhi Ty2
ucuuuaaaaugacucaggac

SEQ ID NO: 1761269 - RNA, 14 nt, Salmonella enterica enterica serovar Typhi Ty2
ucuuuaaauuucag

SEQ ID NO: 1761270 - RNA, 22 nt, Salmonella enterica enterica serovar Typhi Ty2
ucuuuaaacaacgccauaauac

SEQ ID NO: 1761271 - RNA, 21 nt, Salmonella enterica enterica serovar Typhi Ty2
ucuugugcuuccagcuccauc

SEQ ID NO: 1761272 - RNA, 18 nt, Salmonella enterica enterica serovar Typhi Ty2
ucuugugaguaauaauca

SEQ ID NO: 1761273 - RNA, 19 nt, Salmonella enterica enterica serovar Typhi Ty2
ucuuguuucaucgucagcu

SEQ ID NO: 1761274 - RNA, 21 nt, Salmonella enterica enterica serovar Typhi Ty2
ucuuuaucuucugcugcuccc

SEQ ID NO: 1761275 - RNA, 12 nt, Salmonella enterica enterica serovar Typhi Ty2
ucuuuaucuucu

SEQ ID NO: 1761276 - RNA, 13 nt, Salmonella enterica enterica serovar Typhi Ty2
ucuuuaugcguca

SEQ ID NO: 1761277 - RNA, 23 nt, Salmonella enterica enterica serovar Typhi Ty2
ucuuuaugcgagaguuuuucagc

SEQ ID NO: 1761278 - RNA, 23 nt, Salmonella enterica enterica serovar Typhi Ty2
ucuuuaugcggcgcuuccagacu

SEQ ID NO: 1761279 - RNA, 19 nt, Salmonella enterica enterica serovar Typhi Ty2
ucuuucaauccuucuucug

SEQ ID NO: 1761280 - RNA, 17 nt, Salmonella enterica enterica serovar Typhi Ty2
ucuuuagauaauuucgc

SEQ ID NO: 1761281 - RNA, 23 nt, Salmonella enterica enterica serovar Typhi Ty2
ucuuuaaugcccgguauuuuuuc

SEQ ID NO: 1761282 - RNA, 20 nt, Salmonella enterica enterica serovar Typhi Ty2
ucuuuaauuugugccagcgu

SEQ ID NO: 1761283 - RNA, 22 nt, Salmonella enterica enterica serovar Typhi Ty2
ucuuuacgcagcaagaacagag

SEQ ID NO: 1761284 - RNA, 14 nt, Salmonella enterica enterica serovar Typhi Ty2
ucuugccgccaucu

SEQ ID NO: 1761285 - RNA, 14 nt, Salmonella enterica enterica serovar Typhi Ty2
ucuugccacuggcc

SEQ ID NO: 1761286 - RNA, 23 nt, Salmonella enterica enterica serovar Typhi Ty2
ucuucuuugacccacgccagcag

SEQ ID NO: 1761287 - RNA, 14 nt, Salmonella enterica enterica serovar Typhi Ty2
ucuucuacaaugcg

SEQ ID NO: 1761288 - RNA, 14 nt, Salmonella enterica enterica serovar Typhi Ty2
ucuucuccgccugc

SEQ ID NO: 1761289 - RNA, 16 nt, Salmonella enterica enterica serovar Typhi Ty2
ucuucgacauauuuac

SEQ ID NO: 1761290 - RNA, 21 nt, Salmonella enterica enterica serovar Typhi Ty2
ucuucgauuguugacugccag

SEQ ID NO: 1761291 - RNA, 15 nt, Salmonella enterica enterica serovar Typhi Ty2
ucuucgcaaucuccg

SEQ ID NO: 1761292 - RNA, 19 nt, Salmonella enterica enterica serovar Typhi Ty2
ucuucuucgcguuuuucga

SEQ ID NO: 1761293 - RNA, 16 nt, Salmonella enterica enterica serovar Typhi Ty2
ucuucugugauuaucc

SEQ ID NO: 1761294 - RNA, 17 nt, Salmonella enterica enterica serovar Typhi Ty2
ucuucugccuuuuuuaa

SEQ ID NO: 1761295 - RNA, 12 nt, Salmonella enterica enterica serovar Typhi Ty2
ucuucaaagcca

SEQ ID NO: 1761296 - RNA, 22 nt, Salmonella enterica enterica serovar Typhi Ty2
ucuucaacauugucgaacugca

SEQ ID NO: 1761297 - RNA, 18 nt, Salmonella enterica enterica serovar Typhi Ty2
ucuucaguaaccagggag

SEQ ID NO: 1761298 - RNA, 20 nt, Salmonella enterica enterica serovar Typhi Ty2
ucuucaguuccgccagacuc

SEQ ID NO: 1761299 - RNA, 16 nt, Salmonella enterica enterica serovar Typhi Ty2
ucuucaucagccagca

SEQ ID NO: 1761300 - RNA, 13 nt, Salmonella enterica enterica serovar Typhi Ty2
ucuucaucagcca

SEQ ID NO: 1761301 - RNA, 11 nt, Salmonella enterica enterica serovar Typhi Ty2
ucuucaucaaa

SEQ ID NO: 1761302 - RNA, 15 nt, Salmonella enterica enterica serovar Typhi Ty2
ucuucaucguuucug

SEQ ID NO: 1761303 - RNA, 22 nt, Salmonella enterica enterica serovar Typhi Ty2
ucuucaugguaaaauccuuuuu

SEQ ID NO: 1761304 - RNA, 23 nt, Salmonella enterica enterica serovar Typhi Ty2
ucuucauggucggacgggcccug

SEQ ID NO: 1761305 - RNA, 17 nt, Salmonella enterica enterica serovar Typhi Ty2
ucuuccccgaucagaaa

SEQ ID NO: 1761306 - RNA, 21 nt, Salmonella enterica enterica serovar Typhi Ty2
ucuucccgaauagcccucggu

SEQ ID NO: 1761307 - RNA, 15 nt, Salmonella enterica enterica serovar Typhi Ty2
ucuucccgcagauau

SEQ ID NO: 1761308 - RNA, 12 nt, Salmonella enterica enterica serovar Typhi Ty2
ucuucccggcag

SEQ ID NO: 1761309 - RNA, 14 nt, Salmonella enterica enterica serovar Typhi Ty2
ucuuccgccagguc

SEQ ID NO: 1761310 - RNA, 15 nt, Salmonella enterica enterica serovar Typhi Ty2
ucuuaauuauaaagc

SEQ ID NO: 1761311 - RNA, 16 nt, Salmonella enterica enterica serovar Typhi Ty2
ucuuacugaccggccc

SEQ ID NO: 1761312 - RNA, 15 nt, Salmonella enterica enterica serovar Typhi Ty2
ucuuaugccgcuuuu

SEQ ID NO: 1761313 - RNA, 15 nt, Salmonella enterica enterica serovar Typhi Ty2
ucuuauuauuauugu

SEQ ID NO: 1761314 - RNA, 18 nt, Salmonella enterica enterica serovar Typhi Ty2
ucuuauuagcgauuuaau

SEQ ID NO: 1761315 - RNA, 16 nt, Salmonella enterica enterica serovar Typhi Ty2
ucugguacauacuguu

SEQ ID NO: 1761316 - RNA, 15 nt, Salmonella enterica enterica serovar Typhi Ty2
ucuuaaaauagccau

SEQ ID NO: 1761317 - RNA, 17 nt, Salmonella enterica enterica serovar Typhi Ty2
ucugccaguagcugcuc

SEQ ID NO: 1761318 - RNA, 16 nt, Salmonella enterica enterica serovar Typhi Ty2
ucugccauuucugcuc

SEQ ID NO: 1761319 - RNA, 17 nt, Salmonella enterica enterica serovar Typhi Ty2
ucugcaaaauauauaau

SEQ ID NO: 1761320 - RNA, 20 nt, Salmonella enterica enterica serovar Typhi Ty2
ucugauuucgacgauaaaaa

SEQ ID NO: 1761321 - RNA, 23 nt, Salmonella enterica enterica serovar Typhi Ty2
ucugauuucgacgauaaaaaaag

SEQ ID NO: 1761322 - RNA, 16 nt, Salmonella enterica enterica serovar Typhi Ty2
ucugauggcuuugcug

SEQ ID NO: 1761323 - RNA, 15 nt, Salmonella enterica enterica serovar Typhi Ty2
ucugauggcgcugcg

SEQ ID NO: 1761324 - RNA, 16 nt, Salmonella enterica enterica serovar Typhi Ty2
ucugauucaauagugc

SEQ ID NO: 1761325 - RNA, 23 nt, Salmonella enterica enterica serovar Typhi Ty2
ucugcgcuaagcguuacggaaaa

SEQ ID NO: 1761326 - RNA, 17 nt, Salmonella enterica enterica serovar Typhi Ty2
ucugcgccuuuuaccuu

SEQ ID NO: 1761327 - RNA, 17 nt, Salmonella enterica enterica serovar Typhi Ty2
ucugcgccgcaucgcca

SEQ ID NO: 1761328 - RNA, 13 nt, Salmonella enterica enterica serovar Typhi Ty2
ucugcgccaccag

SEQ ID NO: 1761329 - RNA, 14 nt, Salmonella enterica enterica serovar Typhi Ty2
ucugcgccaccagc

SEQ ID NO: 1761330 - RNA, 22 nt, Salmonella enterica enterica serovar Typhi Ty2
ucugcgccagccagcucaccag

SEQ ID NO: 1761331 - RNA, 17 nt, Salmonella enterica enterica serovar Typhi Ty2
ucugcgcauuaacgcca

SEQ ID NO: 1761332 - RNA, 14 nt, Salmonella enterica enterica serovar Typhi Ty2
ucugccugcagacc

SEQ ID NO: 1761333 - RNA, 14 nt, Salmonella enterica enterica serovar Typhi Ty2
ucugccucaacaag

SEQ ID NO: 1761334 - RNA, 22 nt, Salmonella enterica enterica serovar Typhi Ty2
ucugccucagcaagaaguuccg

SEQ ID NO: 1761335 - RNA, 16 nt, Salmonella enterica enterica serovar Typhi Ty2
ucugccuuuaacaaau

SEQ ID NO: 1761336 - RNA, 20 nt, Salmonella enterica enterica serovar Typhi Ty2
ucugccuuuuuuaauccagg

SEQ ID NO: 1761337 - RNA, 17 nt, Salmonella enterica enterica serovar Typhi Ty2
ucuggauagucuucaag

SEQ ID NO: 1761338 - RNA, 15 nt, Salmonella enterica enterica serovar Typhi Ty2
ucuggccaguuucaa

SEQ ID NO: 1761339 - RNA, 15 nt, Salmonella enterica enterica serovar Typhi Ty2
ucuggaguacgggca

SEQ ID NO: 1761340 - RNA, 19 nt, Salmonella enterica enterica serovar Typhi Ty2
ucuggaaucaauuucccuu

SEQ ID NO: 1761341 - RNA, 19 nt, Salmonella enterica enterica serovar Typhi Ty2
ucuggacgggccgccaucu

SEQ ID NO: 1761342 - RNA, 19 nt, Salmonella enterica enterica serovar Typhi Ty2
ucuggaaagcgccucgcaa

SEQ ID NO: 1761343 - RNA, 17 nt, Salmonella enterica enterica serovar Typhi Ty2
ucuggccgucuggcgug

SEQ ID NO: 1761344 - RNA, 19 nt, Salmonella enterica enterica serovar Typhi Ty2
ucuggcgcauuccagaccc

SEQ ID NO: 1761345 - RNA, 17 nt, Salmonella enterica enterica serovar Typhi Ty2
ucuggguaacgcucuua

SEQ ID NO: 1761346 - RNA, 23 nt, Salmonella enterica enterica serovar Typhi Ty2
ucugcugacacccucugcgccuu

SEQ ID NO: 1761347 - RNA, 14 nt, Salmonella enterica enterica serovar Typhi Ty2
ucugcuccggcgua

SEQ ID NO: 1761348 - RNA, 22 nt, Salmonella enterica enterica serovar Typhi Ty2
ucugcuccgcgccgaaauuuuc

SEQ ID NO: 1761349 - RNA, 17 nt, Salmonella enterica enterica serovar Typhi Ty2
ucugcucagaaauauuc

SEQ ID NO: 1761350 - RNA, 16 nt, Salmonella enterica enterica serovar Typhi Ty2
ucugcugaaaugccug

SEQ ID NO: 1761351 - RNA, 13 nt, Salmonella enterica enterica serovar Typhi Ty2
ucugcgugaagac

SEQ ID NO: 1761352 - RNA, 21 nt, Salmonella enterica enterica serovar Typhi Ty2
ucugcgugacgccaagcagcg

SEQ ID NO: 1761353 - RNA, 22 nt, Salmonella enterica enterica serovar Typhi Ty2
ucugcgugagccggacacugcg

SEQ ID NO: 1761354 - RNA, 19 nt, Salmonella enterica enterica serovar Typhi Ty2
ucugcgugaugcaucagaa

SEQ ID NO: 1761355 - RNA, 16 nt, Salmonella enterica enterica serovar Typhi Ty2
ucgccaaaccagaccc

SEQ ID NO: 1761356 - RNA, 13 nt, Salmonella enterica enterica serovar Typhi Ty2
ucgcauagacgcc

SEQ ID NO: 1761357 - RNA, 15 nt, Salmonella enterica enterica serovar Typhi Ty2
ucucugucgccgccc

SEQ ID NO: 1761358 - RNA, 15 nt, Salmonella enterica enterica serovar Typhi Ty2
aaaugcgguuuucuu

SEQ ID NO: 1761359 - RNA, 16 nt, Salmonella enterica enterica serovar Typhi Ty2
ucucuuccgccagcgc

SEQ ID NO: 1761360 - RNA, 17 nt, Salmonella enterica enterica serovar Typhi Ty2
ucucuucgacaucuuca

SEQ ID NO: 1761361 - RNA, 19 nt, Salmonella enterica enterica serovar Typhi Ty2
ucucuuaugccgcuuuugc

SEQ ID NO: 1761362 - RNA, 19 nt, Salmonella enterica enterica serovar Typhi Ty2
ucucuuacguugcauuuau

SEQ ID NO: 1761363 - RNA, 16 nt, Salmonella enterica enterica serovar Typhi Ty2
ucucuucaauaacgaa

SEQ ID NO: 1761364 - RNA, 12 nt, Salmonella enterica enterica serovar Typhi Ty2
ucugaaaguuug

SEQ ID NO: 1761365 - RNA, 18 nt, Salmonella enterica enterica serovar Typhi Ty2
ucucuuuuugcagcagcg

SEQ ID NO: 1761366 - RNA, 22 nt, Salmonella enterica enterica serovar Typhi Ty2
aaaugcucaauuauacgcuggu

SEQ ID NO: 1761367 - RNA, 13 nt, Salmonella enterica enterica serovar Typhi Ty2
ucugaaugguucc

SEQ ID NO: 1761368 - RNA, 22 nt, Salmonella enterica enterica serovar Typhi Ty2
ucugaaucagugcaucuucacu

SEQ ID NO: 1761369 - RNA, 20 nt, Salmonella enterica enterica serovar Typhi Ty2
ucugacugaucgauccacuu

SEQ ID NO: 1761370 - RNA, 22 nt, Salmonella enterica enterica serovar Typhi Ty2
ucugacggguaguaucgcucua

SEQ ID NO: 1761371 - RNA, 13 nt, Salmonella enterica enterica serovar Typhi Ty2
ucugacggccugu

SEQ ID NO: 1761372 - RNA, 17 nt, Salmonella enterica enterica serovar Typhi Ty2
ucugacugcgugagugu

SEQ ID NO: 1761373 - RNA, 23 nt, Salmonella enterica enterica serovar Typhi Ty2
ucugagaauuuggguuuauguag

SEQ ID NO: 1761374 - RNA, 22 nt, Salmonella enterica enterica serovar Typhi Ty2
ucugagccaauuuaugccggag

SEQ ID NO: 1761375 - RNA, 24 nt, Salmonella enterica enterica serovar Typhi Ty2
ucugagccgcccggcgcgcuggag

SEQ ID NO: 1761376 - RNA, 13 nt, Salmonella enterica enterica serovar Typhi Ty2
ugaccaacaacag

SEQ ID NO: 1761377 - RNA, 17 nt, Salmonella enterica enterica serovar Typhi Ty2
ugaccaacaacagauau

SEQ ID NO: 1761378 - RNA, 15 nt, Salmonella enterica enterica serovar Typhi Ty2
ugaauaacagcacca

SEQ ID NO: 1761379 - RNA, 20 nt, Salmonella enterica enterica serovar Typhi Ty2
ugacaucucuuuuaauuuuc

SEQ ID NO: 1761380 - RNA, 18 nt, Salmonella enterica enterica serovar Typhi Ty2
ugacaucucaucggcuuu

SEQ ID NO: 1761381 - RNA, 13 nt, Salmonella enterica enterica serovar Typhi Ty2
ugacccgcagcaa

SEQ ID NO: 1761382 - RNA, 19 nt, Salmonella enterica enterica serovar Typhi Ty2
ugacccgccgccagcaccg

SEQ ID NO: 1761383 - RNA, 14 nt, Salmonella enterica enterica serovar Typhi Ty2
ugacccucccugcg

SEQ ID NO: 1761384 - RNA, 14 nt, Salmonella enterica enterica serovar Typhi Ty2
ugaccacgccgccg

SEQ ID NO: 1761385 - RNA, 15 nt, Salmonella enterica enterica serovar Typhi Ty2
ugaccaccagcgcga

SEQ ID NO: 1761386 - RNA, 13 nt, Salmonella enterica enterica serovar Typhi Ty2
ugaccaccgcauc

SEQ ID NO: 1761387 - RNA, 20 nt, Salmonella enterica enterica serovar Typhi Ty2
ugacgaauaccgugcacgcu

SEQ ID NO: 1761388 - RNA, 17 nt, Salmonella enterica enterica serovar Typhi Ty2
ugacgagggaaggggau

SEQ ID NO: 1761389 - RNA, 15 nt, Salmonella enterica enterica serovar Typhi Ty2
ugacgacccgcuucc

SEQ ID NO: 1761390 - RNA, 20 nt, Salmonella enterica enterica serovar Typhi Ty2
ugaccgaaccgcuguagucu

SEQ ID NO: 1761391 - RNA, 22 nt, Salmonella enterica enterica serovar Typhi Ty2
ugaccgaacuuacgcacaaacc

SEQ ID NO: 1761392 - RNA, 17 nt, Salmonella enterica enterica serovar Typhi Ty2
ugaccgauauagccacu

SEQ ID NO: 1761393 - RNA, 22 nt, Salmonella enterica enterica serovar Typhi Ty2
ugaccguuaguaaucggaucaa

SEQ ID NO: 1761394 - RNA, 14 nt, Salmonella enterica enterica serovar Typhi Ty2
ugaccguccccagc

SEQ ID NO: 1761395 - RNA, 20 nt, Salmonella enterica enterica serovar Typhi Ty2
ugacgccgaccaccgcccug

SEQ ID NO: 1761396 - RNA, 18 nt, Salmonella enterica enterica serovar Typhi Ty2
ugacgcgaauuauagaac

SEQ ID NO: 1761397 - RNA, 19 nt, Salmonella enterica enterica serovar Typhi Ty2
ugacgccgcuguuuucacu

SEQ ID NO: 1761398 - RNA, 18 nt, Salmonella enterica enterica serovar Typhi Ty2
ugacgccgcuguuuucac

SEQ ID NO: 1761399 - RNA, 18 nt, Salmonella enterica enterica serovar Typhi Ty2
ugacgcgcauacucauua

SEQ ID NO: 1761400 - RNA, 22 nt, Salmonella enterica enterica serovar Typhi Ty2
ugacgcguuaauauccuucagc

SEQ ID NO: 1761401 - RNA, 16 nt, Salmonella enterica enterica serovar Typhi Ty2
ugacgccaugcaaaaa

SEQ ID NO: 1761402 - RNA, 12 nt, Salmonella enterica enterica serovar Typhi Ty2
ugacgccaggca

SEQ ID NO: 1761403 - RNA, 21 nt, Salmonella enterica enterica serovar Typhi Ty2
ugacgcaguaauacgccgccg

SEQ ID NO: 1761404 - RNA, 14 nt, Salmonella enterica enterica serovar Typhi Ty2
ugacgcacaguguu

SEQ ID NO: 1761405 - RNA, 18 nt, Salmonella enterica enterica serovar Typhi Ty2
ugacgcaaacugccaggc

SEQ ID NO: 1761406 - RNA, 21 nt, Salmonella enterica enterica serovar Typhi Ty2
ugacgaucaugccgcccaggc

SEQ ID NO: 1761407 - RNA, 19 nt, Salmonella enterica enterica serovar Typhi Ty2
ugacgaucaugccgcccag

SEQ ID NO: 1761408 - RNA, 18 nt, Salmonella enterica enterica serovar Typhi Ty2
ugagacgcagccucucuu

SEQ ID NO: 1761409 - RNA, 17 nt, Salmonella enterica enterica serovar Typhi Ty2
ugagacuguuugucuca

SEQ ID NO: 1761410 - RNA, 17 nt, Salmonella enterica enterica serovar Typhi Ty2
ugagagacggagaaaaa

SEQ ID NO: 1761411 - RNA, 12 nt, Salmonella enterica enterica serovar Typhi Ty2
ugagacucagca

SEQ ID NO: 1761412 - RNA, 12 nt, Salmonella enterica enterica serovar Typhi Ty2
ugagaagaaaaa

SEQ ID NO: 1761413 - RNA, 17 nt, Salmonella enterica enterica serovar Typhi Ty2
ugacugaauuuucagcc

SEQ ID NO: 1761414 - RNA, 22 nt, Salmonella enterica enterica serovar Typhi Ty2
ugacuucugcucgguaaaaagu

SEQ ID NO: 1761415 - RNA, 23 nt, Salmonella enterica enterica serovar Typhi Ty2
ugacugaaauuacgccauaaaaa

SEQ ID NO: 1761416 - RNA, 22 nt, Salmonella enterica enterica serovar Typhi Ty2
ugacucuuguuucucguauuau

SEQ ID NO: 1761417 - RNA, 15 nt, Salmonella enterica enterica serovar Typhi Ty2
ugacucauuaaaaaa

SEQ ID NO: 1761418 - RNA, 13 nt, Salmonella enterica enterica serovar Typhi Ty2
ugacguccaggcc

SEQ ID NO: 1761419 - RNA, 16 nt, Salmonella enterica enterica serovar Typhi Ty2
ugacguagauucugau

SEQ ID NO: 1761420 - RNA, 21 nt, Salmonella enterica enterica serovar Typhi Ty2
ugacgucgcaagacgaaaaau

SEQ ID NO: 1761421 - RNA, 20 nt, Salmonella enterica enterica serovar Typhi Ty2
ugacgucgcagccugauggc

SEQ ID NO: 1761422 - RNA, 16 nt, Salmonella enterica enterica serovar Typhi Ty2
ugacggugauguuggc

SEQ ID NO: 1761423 - RNA, 22 nt, Salmonella enterica enterica serovar Typhi Ty2
ugacgguaaaguaauuuccaua

SEQ ID NO: 1761424 - RNA, 13 nt, Salmonella enterica enterica serovar Typhi Ty2
ugacguacaaaca

SEQ ID NO: 1761425 - RNA, 22 nt, Salmonella enterica enterica serovar Typhi Ty2
ugacgggaaaucucccuggcag

SEQ ID NO: 1761426 - RNA, 20 nt, Salmonella enterica enterica serovar Typhi Ty2
ugacgggaaaucucccuggc

SEQ ID NO: 1761427 - RNA, 16 nt, Salmonella enterica enterica serovar Typhi Ty2
ugacggcgcugucacu

SEQ ID NO: 1761428 - RNA, 23 nt, Salmonella enterica enterica serovar Typhi Ty2
ugacggcaacugaaaacaggccu

SEQ ID NO: 1761429 - RNA, 16 nt, Salmonella enterica enterica serovar Typhi Ty2
ugacggaaaccagcau

SEQ ID NO: 1761430 - RNA, 14 nt, Salmonella enterica enterica serovar Typhi Ty2
ugacgcuuugcauu

SEQ ID NO: 1761431 - RNA, 19 nt, Salmonella enterica enterica serovar Typhi Ty2
ugacggauucuuccucucg

SEQ ID NO: 1761432 - RNA, 11 nt, Salmonella enterica enterica serovar Typhi Ty2
ugacgcugccc

SEQ ID NO: 1761433 - RNA, 21 nt, Salmonella enterica enterica serovar Typhi Ty2
ugacuauacccaaaauaauuc

SEQ ID NO: 1761434 - RNA, 14 nt, Salmonella enterica enterica serovar Typhi Ty2
ugacuacugugacg

SEQ ID NO: 1761435 - RNA, 18 nt, Salmonella enterica enterica serovar Typhi Ty2
ugacguuaacgcagcauc

SEQ ID NO: 1761436 - RNA, 16 nt, Salmonella enterica enterica serovar Typhi Ty2
ugacguuauccaguau

SEQ ID NO: 1761437 - RNA, 17 nt, Salmonella enterica enterica serovar Typhi Ty2
ugacguuaucugucagc

SEQ ID NO: 1761438 - RNA, 14 nt, Salmonella enterica enterica serovar Typhi Ty2
ugacgugagagaaa

SEQ ID NO: 1761439 - RNA, 14 nt, Salmonella enterica enterica serovar Typhi Ty2
ugaucaggcuaaag

SEQ ID NO: 1761440 - RNA, 13 nt, Salmonella enterica enterica serovar Typhi Ty2
ugaucaggcaaaa

SEQ ID NO: 1761441 - RNA, 12 nt, Salmonella enterica enterica serovar Typhi Ty2
ugaucgaauuca

SEQ ID NO: 1761442 - RNA, 14 nt, Salmonella enterica enterica serovar Typhi Ty2
ugaucgaaaaugcg

SEQ ID NO: 1761443 - RNA, 19 nt, Salmonella enterica enterica serovar Typhi Ty2
ugauccgcccccuccagua

SEQ ID NO: 1761444 - RNA, 15 nt, Salmonella enterica enterica serovar Typhi Ty2
ugaucauggcucaga

SEQ ID NO: 1761445 - RNA, 15 nt, Salmonella enterica enterica serovar Typhi Ty2
ugaucauccuuacuu

SEQ ID NO: 1761446 - RNA, 20 nt, Salmonella enterica enterica serovar Typhi Ty2
ugaucaucggcgcgucgcug

SEQ ID NO: 1761447 - RNA, 22 nt, Salmonella enterica enterica serovar Typhi Ty2
ugaucgaggucgccaaauuuag

SEQ ID NO: 1761448 - RNA, 21 nt, Salmonella enterica enterica serovar Typhi Ty2
ugaucgccacgccuaaacuga

SEQ ID NO: 1761449 - RNA, 20 nt, Salmonella enterica enterica serovar Typhi Ty2
ugaucgcgagaguaagccca

SEQ ID NO: 1761450 - RNA, 24 nt, Salmonella enterica enterica serovar Typhi Ty2
ugaucgccggagaauccuuccagu

SEQ ID NO: 1761451 - RNA, 19 nt, Salmonella enterica enterica serovar Typhi Ty2
ugaucuggccaauuuuuca

SEQ ID NO: 1761452 - RNA, 19 nt, Salmonella enterica enterica serovar Typhi Ty2
ugaucuuaccucuccugaa

SEQ ID NO: 1761453 - RNA, 14 nt, Salmonella enterica enterica serovar Typhi Ty2
ugaucugcgccggc

SEQ ID NO: 1761454 - RNA, 13 nt, Salmonella enterica enterica serovar Typhi Ty2
ugaucuggccaau

SEQ ID NO: 1761455 - RNA, 22 nt, Salmonella enterica enterica serovar Typhi Ty2
ugaucuucaaccucuauaacuu

SEQ ID NO: 1761456 - RNA, 16 nt, Salmonella enterica enterica serovar Typhi Ty2
ugauaucgccccagaa

SEQ ID NO: 1761457 - RNA, 20 nt, Salmonella enterica enterica serovar Typhi Ty2
ugauauaccguccagacucc

SEQ ID NO: 1761458 - RNA, 21 nt, Salmonella enterica enterica serovar Typhi Ty2
ugauagguucaauaugccagg

SEQ ID NO: 1761459 - RNA, 23 nt, Salmonella enterica enterica serovar Typhi Ty2
ugauagguucaauaugccaggca

SEQ ID NO: 1761460 - RNA, 18 nt, Salmonella enterica enterica serovar Typhi Ty2
ugauagggcgccuguuua

SEQ ID NO: 1761461 - RNA, 21 nt, Salmonella enterica enterica serovar Typhi Ty2
ugauagcccguuaugccaucu

SEQ ID NO: 1761462 - RNA, 23 nt, Salmonella enterica enterica serovar Typhi Ty2
ugauagcaaucauccugauuuua

SEQ ID NO: 1761463 - RNA, 15 nt, Salmonella enterica enterica serovar Typhi Ty2
ugauaccuauuuaau

SEQ ID NO: 1761464 - RNA, 16 nt, Salmonella enterica enterica serovar Typhi Ty2
ugauaccuaaacgcgu

SEQ ID NO: 1761465 - RNA, 14 nt, Salmonella enterica enterica serovar Typhi Ty2
ugauaccggaggag

SEQ ID NO: 1761466 - RNA, 20 nt, Salmonella enterica enterica serovar Typhi Ty2
ugauaccuuuaaccucuuuu

SEQ ID NO: 1761467 - RNA, 19 nt, Salmonella enterica enterica serovar Typhi Ty2
ugauacgcgucaaauagag

SEQ ID NO: 1761468 - RNA, 21 nt, Salmonella enterica enterica serovar Typhi Ty2
ugagggcgauaauccgcucca

SEQ ID NO: 1761469 - RNA, 15 nt, Salmonella enterica enterica serovar Typhi Ty2
ugagucuugccuguc

SEQ ID NO: 1761470 - RNA, 20 nt, Salmonella enterica enterica serovar Typhi Ty2
ugagguggccgagaggcuga

SEQ ID NO: 1761471 - RNA, 17 nt, Salmonella enterica enterica serovar Typhi Ty2
ugauaaaauaaacacua

SEQ ID NO: 1761472 - RNA, 18 nt, Salmonella enterica enterica serovar Typhi Ty2
ugauaaaauaaacacuaa

SEQ ID NO: 1761473 - RNA, 13 nt, Salmonella enterica enterica serovar Typhi Ty2
ugauaagagaaaa

SEQ ID NO: 1761474 - RNA, 14 nt, Salmonella enterica enterica serovar Typhi Ty2
ugauaagagaaaau

SEQ ID NO: 1761475 - RNA, 14 nt, Salmonella enterica enterica serovar Typhi Ty2
ugauaaaacgcagg

SEQ ID NO: 1761476 - RNA, 12 nt, Salmonella enterica enterica serovar Typhi Ty2
ugaggcgcagcc

SEQ ID NO: 1761477 - RNA, 17 nt, Salmonella enterica enterica serovar Typhi Ty2
ugaggcguugcuccagc

SEQ ID NO: 1761478 - RNA, 15 nt, Salmonella enterica enterica serovar Typhi Ty2
ugaggauauugguau

SEQ ID NO: 1761479 - RNA, 17 nt, Salmonella enterica enterica serovar Typhi Ty2
ugaggcgacaaucucac

SEQ ID NO: 1761480 - RNA, 22 nt, Salmonella enterica enterica serovar Typhi Ty2
ugagcugcugcuugcuuuucau

SEQ ID NO: 1761481 - RNA, 19 nt, Salmonella enterica enterica serovar Typhi Ty2
ugagcguuacgggaacaga

SEQ ID NO: 1761482 - RNA, 18 nt, Salmonella enterica enterica serovar Typhi Ty2
ugagcguuacgggaacag

SEQ ID NO: 1761483 - RNA, 14 nt, Salmonella enterica enterica serovar Typhi Ty2
ugagcgucgccaga

SEQ ID NO: 1761484 - RNA, 17 nt, Salmonella enterica enterica serovar Typhi Ty2
ugagcucuuucugcgca

SEQ ID NO: 1761485 - RNA, 13 nt, Salmonella enterica enterica serovar Typhi Ty2
ugagcucuuucug

SEQ ID NO: 1761486 - RNA, 20 nt, Salmonella enterica enterica serovar Typhi Ty2
ugagauaauuuaugauuuua

SEQ ID NO: 1761487 - RNA, 21 nt, Salmonella enterica enterica serovar Typhi Ty2
ugagauccgggcuggcaaaca

SEQ ID NO: 1761488 - RNA, 18 nt, Salmonella enterica enterica serovar Typhi Ty2
ugagcguagaccgcccag

SEQ ID NO: 1761489 - RNA, 21 nt, Salmonella enterica enterica serovar Typhi Ty2
ugagcgguagcccgacaauaa

SEQ ID NO: 1761490 - RNA, 18 nt, Salmonella enterica enterica serovar Typhi Ty2
ugagcggcucauccagca

SEQ ID NO: 1761491 - RNA, 20 nt, Salmonella enterica enterica serovar Typhi Ty2
ugagcgcuugauccagcucg

SEQ ID NO: 1761492 - RNA, 20 nt, Salmonella enterica enterica serovar Typhi Ty2
ugcauucaggccucugcuuu

SEQ ID NO: 1761493 - RNA, 14 nt, Salmonella enterica enterica serovar Typhi Ty2
ugcauuccaggugu

SEQ ID NO: 1761494 - RNA, 19 nt, Salmonella enterica enterica serovar Typhi Ty2
ugcauucaggccucugcuu

SEQ ID NO: 1761495 - RNA, 15 nt, Salmonella enterica enterica serovar Typhi Ty2
ugcauugcuuuuagu

SEQ ID NO: 1761496 - RNA, 13 nt, Salmonella enterica enterica serovar Typhi Ty2
ugcauuggccagc

SEQ ID NO: 1761497 - RNA, 13 nt, Salmonella enterica enterica serovar Typhi Ty2
ugcauucgcuccu

SEQ ID NO: 1761498 - RNA, 19 nt, Salmonella enterica enterica serovar Typhi Ty2
ugcaucugggggaagauaa

SEQ ID NO: 1761499 - RNA, 17 nt, Salmonella enterica enterica serovar Typhi Ty2
ugcaucucuucaaacaa

SEQ ID NO: 1761500 - RNA, 22 nt, Salmonella enterica enterica serovar Typhi Ty2
ugcaucguuugcaguuccgcaa

SEQ ID NO: 1761501 - RNA, 17 nt, Salmonella enterica enterica serovar Typhi Ty2
ugcaucgcggucagcgg

SEQ ID NO: 1761502 - RNA, 13 nt, Salmonella enterica enterica serovar Typhi Ty2
ugccaaucuccag

SEQ ID NO: 1761503 - RNA, 20 nt, Salmonella enterica enterica serovar Typhi Ty2
ugcauuugauuuguuuuuua

SEQ ID NO: 1761504 - RNA, 15 nt, Salmonella enterica enterica serovar Typhi Ty2
ugcauuugcgcauau

SEQ ID NO: 1761505 - RNA, 17 nt, Salmonella enterica enterica serovar Typhi Ty2
ugcauuucuuguugacg

SEQ ID NO: 1761506 - RNA, 14 nt, Salmonella enterica enterica serovar Typhi Ty2
ugccaccagcgcca

SEQ ID NO: 1761507 - RNA, 14 nt, Salmonella enterica enterica serovar Typhi Ty2
ugccaaugaaauaa

SEQ ID NO: 1761508 - RNA, 22 nt, Salmonella enterica enterica serovar Typhi Ty2
ugccacaaccgcccccaacuga

SEQ ID NO: 1761509 - RNA, 19 nt, Salmonella enterica enterica serovar Typhi Ty2
ugcaguauugcaccaggaa

SEQ ID NO: 1761510 - RNA, 19 nt, Salmonella enterica enterica serovar Typhi Ty2
ugcagucgcggaauaauca

SEQ ID NO: 1761511 - RNA, 18 nt, Salmonella enterica enterica serovar Typhi Ty2
ugcagucugguaacgcaa

SEQ ID NO: 1761512 - RNA, 17 nt, Salmonella enterica enterica serovar Typhi Ty2
ugcagugacagaggaau

SEQ ID NO: 1761513 - RNA, 14 nt, Salmonella enterica enterica serovar Typhi Ty2
ugcagguucccgcc

SEQ ID NO: 1761514 - RNA, 23 nt, Salmonella enterica enterica serovar Typhi Ty2
ugcauacggaugaaauacucuuc

SEQ ID NO: 1761515 - RNA, 15 nt, Salmonella enterica enterica serovar Typhi Ty2
ugcauaauugcugac

SEQ ID NO: 1761516 - RNA, 13 nt, Salmonella enterica enterica serovar Typhi Ty2
ugcauacauaaau

SEQ ID NO: 1761517 - RNA, 23 nt, Salmonella enterica enterica serovar Typhi Ty2
ugcaucagaacaaacuuauccca

SEQ ID NO: 1761518 - RNA, 12 nt, Salmonella enterica enterica serovar Typhi Ty2
ugcauaauggug

SEQ ID NO: 1761519 - RNA, 17 nt, Salmonella enterica enterica serovar Typhi Ty2
ugcauaauauccaggag

SEQ ID NO: 1761520 - RNA, 20 nt, Salmonella enterica enterica serovar Typhi Ty2
ugcauaaagauuggcaucug

SEQ ID NO: 1761521 - RNA, 20 nt, Salmonella enterica enterica serovar Typhi Ty2
ugcauaaaacgguuuucaaa

SEQ ID NO: 1761522 - RNA, 19 nt, Salmonella enterica enterica serovar Typhi Ty2
ugcaguuccguugcaauau

SEQ ID NO: 1761523 - RNA, 14 nt, Salmonella enterica enterica serovar Typhi Ty2
ugcauaaaaaaacg

SEQ ID NO: 1761524 - RNA, 18 nt, Salmonella enterica enterica serovar Typhi Ty2
ugcacagucugcagaccu

SEQ ID NO: 1761525 - RNA, 19 nt, Salmonella enterica enterica serovar Typhi Ty2
ugcacauuagcaauugcca

SEQ ID NO: 1761526 - RNA, 19 nt, Salmonella enterica enterica serovar Typhi Ty2
ugcacauguuucagcaccu

SEQ ID NO: 1761527 - RNA, 18 nt, Salmonella enterica enterica serovar Typhi Ty2
ugcacaucgccauuaaaa

SEQ ID NO: 1761528 - RNA, 17 nt, Salmonella enterica enterica serovar Typhi Ty2
ugcacauugcaggcuuu

SEQ ID NO: 1761529 - RNA, 20 nt, Salmonella enterica enterica serovar Typhi Ty2
ugcaccaacgauaaauuuuc

SEQ ID NO: 1761530 - RNA, 16 nt, Salmonella enterica enterica serovar Typhi Ty2
ugcacaauaccaauaa

SEQ ID NO: 1761531 - RNA, 22 nt, Salmonella enterica enterica serovar Typhi Ty2
ugcacaacauuccgcuuccaga

SEQ ID NO: 1761532 - RNA, 15 nt, Salmonella enterica enterica serovar Typhi Ty2
ugcacaauaccaaua

SEQ ID NO: 1761533 - RNA, 22 nt, Salmonella enterica enterica serovar Typhi Ty2
ugcacgucgagacgguguuuag

SEQ ID NO: 1761534 - RNA, 17 nt, Salmonella enterica enterica serovar Typhi Ty2
ugcacguaccugcucca

SEQ ID NO: 1761535 - RNA, 22 nt, Salmonella enterica enterica serovar Typhi Ty2
ugcaccuuaaccgucugcucag

SEQ ID NO: 1761536 - RNA, 12 nt, Salmonella enterica enterica serovar Typhi Ty2
ugcaccucuuua

SEQ ID NO: 1761537 - RNA, 17 nt, Salmonella enterica enterica serovar Typhi Ty2
ugcaccgcuaaaaaaca

SEQ ID NO: 1761538 - RNA, 16 nt, Salmonella enterica enterica serovar Typhi Ty2
ugcaccaucucuuacu

SEQ ID NO: 1761539 - RNA, 20 nt, Salmonella enterica enterica serovar Typhi Ty2
ugcagaucgcgggcaaucaa

SEQ ID NO: 1761540 - RNA, 22 nt, Salmonella enterica enterica serovar Typhi Ty2
ugcagaucaagcgggggcgccu

SEQ ID NO: 1761541 - RNA, 13 nt, Salmonella enterica enterica serovar Typhi Ty2
ugcagauuuugcu

SEQ ID NO: 1761542 - RNA, 15 nt, Salmonella enterica enterica serovar Typhi Ty2
ugcagauuuugcucc

SEQ ID NO: 1761543 - RNA, 12 nt, Salmonella enterica enterica serovar Typhi Ty2
ugcacuuccugc

SEQ ID NO: 1761544 - RNA, 18 nt, Salmonella enterica enterica serovar Typhi Ty2
ugcacuucaugccgaaca

SEQ ID NO: 1761545 - RNA, 21 nt, Salmonella enterica enterica serovar Typhi Ty2
ugcacugcgcccauuauugau

SEQ ID NO: 1761546 - RNA, 17 nt, Salmonella enterica enterica serovar Typhi Ty2
ugcacugacuuacaggc

SEQ ID NO: 1761547 - RNA, 15 nt, Salmonella enterica enterica serovar Typhi Ty2
ugcagcguuuccagc

SEQ ID NO: 1761548 - RNA, 24 nt, Salmonella enterica enterica serovar Typhi Ty2
ugcagcaagcggcugucaucaaug

SEQ ID NO: 1761549 - RNA, 11 nt, Salmonella enterica enterica serovar Typhi Ty2
ugcagcaagaa

SEQ ID NO: 1761550 - RNA, 18 nt, Salmonella enterica enterica serovar Typhi Ty2
ugcagccauagcgcgccg

SEQ ID NO: 1761551 - RNA, 24 nt, Salmonella enterica enterica serovar Typhi Ty2
ugcaacaucuuaccggugcgauuc

SEQ ID NO: 1761552 - RNA, 19 nt, Salmonella enterica enterica serovar Typhi Ty2
ugcaaccccuugcggugca

SEQ ID NO: 1761553 - RNA, 17 nt, Salmonella enterica enterica serovar Typhi Ty2
ugcaaccgcucuuuugc

SEQ ID NO: 1761554 - RNA, 19 nt, Salmonella enterica enterica serovar Typhi Ty2
ugcaacagcaccagcaggu

SEQ ID NO: 1761555 - RNA, 15 nt, Salmonella enterica enterica serovar Typhi Ty2
ugcaacagcaccagc

SEQ ID NO: 1761556 - RNA, 14 nt, Salmonella enterica enterica serovar Typhi Ty2
ugcaacagcaccag

SEQ ID NO: 1761557 - RNA, 22 nt, Salmonella enterica enterica serovar Typhi Ty2
ugcaacagaagaguuaacuucu

SEQ ID NO: 1761558 - RNA, 13 nt, Salmonella enterica enterica serovar Typhi Ty2
ugcaacagcacca

SEQ ID NO: 1761559 - RNA, 16 nt, Salmonella enterica enterica serovar Typhi Ty2
ugcaaaucugccguca

SEQ ID NO: 1761560 - RNA, 14 nt, Salmonella enterica enterica serovar Typhi Ty2
ugcaaaugucagau

SEQ ID NO: 1761561 - RNA, 19 nt, Salmonella enterica enterica serovar Typhi Ty2
ugcaacuucaccuucggug

SEQ ID NO: 1761562 - RNA, 17 nt, Salmonella enterica enterica serovar Typhi Ty2
ugcaacuccugggcaaa

SEQ ID NO: 1761563 - RNA, 15 nt, Salmonella enterica enterica serovar Typhi Ty2
ugcaacuccacaaau

SEQ ID NO: 1761564 - RNA, 21 nt, Salmonella enterica enterica serovar Typhi Ty2
ugcaacgcuuuagugccgcca

SEQ ID NO: 1761565 - RNA, 16 nt, Salmonella enterica enterica serovar Typhi Ty2
ugcaacuauuaauucu

SEQ ID NO: 1761566 - RNA, 17 nt, Salmonella enterica enterica serovar Typhi Ty2
ugcaacgccagaugcgu

SEQ ID NO: 1761567 - RNA, 20 nt, Salmonella enterica enterica serovar Typhi Ty2
ugcaagaaauguccauaaau

SEQ ID NO: 1761568 - RNA, 16 nt, Salmonella enterica enterica serovar Typhi Ty2
ugcaacuucaccucag

SEQ ID NO: 1761569 - RNA, 13 nt, Salmonella enterica enterica serovar Typhi Ty2
ugcacaaaauacu

SEQ ID NO: 1761570 - RNA, 16 nt, Salmonella enterica enterica serovar Typhi Ty2
ugcaauuguuccugcg

SEQ ID NO: 1761571 - RNA, 16 nt, Salmonella enterica enterica serovar Typhi Ty2
ugcaauguucaauauc

SEQ ID NO: 1761572 - RNA, 21 nt, Salmonella enterica enterica serovar Typhi Ty2
ugcaaugcggcguguggcugu

SEQ ID NO: 1761573 - RNA, 18 nt, Salmonella enterica enterica serovar Typhi Ty2
ugcaaucuuuacccggcg

SEQ ID NO: 1761574 - RNA, 22 nt, Salmonella enterica enterica serovar Typhi Ty2
ugcaaucaguuccaaucucuuu

SEQ ID NO: 1761575 - RNA, 21 nt, Salmonella enterica enterica serovar Typhi Ty2
ugcaaucguucuugcacaaua

SEQ ID NO: 1761576 - RNA, 17 nt, Salmonella enterica enterica serovar Typhi Ty2
ugcaauaccggcugcuu

SEQ ID NO: 1761577 - RNA, 17 nt, Salmonella enterica enterica serovar Typhi Ty2
ugcaauacuacgcaccg

SEQ ID NO: 1761578 - RNA, 20 nt, Salmonella enterica enterica serovar Typhi Ty2
ugcaauaccgggauuguaua

SEQ ID NO: 1761579 - RNA, 15 nt, Salmonella enterica enterica serovar Typhi Ty2
ugcaaucacacuaca

SEQ ID NO: 1761580 - RNA, 23 nt, Salmonella enterica enterica serovar Typhi Ty2
ugcaaucagcgaaggcaacugau

SEQ ID NO: 1761581 - RNA, 12 nt, Salmonella enterica enterica serovar Typhi Ty2
ugcaaucagauu

SEQ ID NO: 1761582 - RNA, 13 nt, Salmonella enterica enterica serovar Typhi Ty2
ugauuuuaugaug

SEQ ID NO: 1761583 - RNA, 13 nt, Salmonella enterica enterica serovar Typhi Ty2
ugauuuucuuauu

SEQ ID NO: 1761584 - RNA, 20 nt, Salmonella enterica enterica serovar Typhi Ty2
ugauuuuuuugcuggccguc

SEQ ID NO: 1761585 - RNA, 22 nt, Salmonella enterica enterica serovar Typhi Ty2
ugcaaagacagcaggcuuugcu

SEQ ID NO: 1761586 - RNA, 17 nt, Salmonella enterica enterica serovar Typhi Ty2
ugcaaauaccacaucag

SEQ ID NO: 1761587 - RNA, 14 nt, Salmonella enterica enterica serovar Typhi Ty2
ugcaaauccaucuc

SEQ ID NO: 1761588 - RNA, 20 nt, Salmonella enterica enterica serovar Typhi Ty2
ugcaaauacugcuuuuccgg

SEQ ID NO: 1761589 - RNA, 21 nt, Salmonella enterica enterica serovar Typhi Ty2
ugcaaaccggguaacaacauu

SEQ ID NO: 1761590 - RNA, 16 nt, Salmonella enterica enterica serovar Typhi Ty2
ugcaaaauuuguggug

SEQ ID NO: 1761591 - RNA, 18 nt, Salmonella enterica enterica serovar Typhi Ty2
ugcaaaaugcuucuucaa

SEQ ID NO: 1761592 - RNA, 14 nt, Salmonella enterica enterica serovar Typhi Ty2
ugcaaaagaaaaaa

SEQ ID NO: 1761593 - RNA, 22 nt, Salmonella enterica enterica serovar Typhi Ty2
ugauugcauaucgcuaaaccaa

SEQ ID NO: 1761594 - RNA, 23 nt, Salmonella enterica enterica serovar Typhi Ty2
ugauugccgccaucuuuacccug

SEQ ID NO: 1761595 - RNA, 20 nt, Salmonella enterica enterica serovar Typhi Ty2
ugauugacuaucagccgcga

SEQ ID NO: 1761596 - RNA, 15 nt, Salmonella enterica enterica serovar Typhi Ty2
ugauucgcuggccuc

SEQ ID NO: 1761597 - RNA, 14 nt, Salmonella enterica enterica serovar Typhi Ty2
ugauuuacuccaaa

SEQ ID NO: 1761598 - RNA, 21 nt, Salmonella enterica enterica serovar Typhi Ty2
ugauuuuaacaucaccuuuca

SEQ ID NO: 1761599 - RNA, 20 nt, Salmonella enterica enterica serovar Typhi Ty2
ugauuuaaaaaaggccgcuu

SEQ ID NO: 1761600 - RNA, 20 nt, Salmonella enterica enterica serovar Typhi Ty2
ugaugauacccccagagauu

SEQ ID NO: 1761601 - RNA, 20 nt, Salmonella enterica enterica serovar Typhi Ty2
ugaugacgcgcaggccguca

SEQ ID NO: 1761602 - RNA, 21 nt, Salmonella enterica enterica serovar Typhi Ty2
ugaugacucauuaaaaaaaca

SEQ ID NO: 1761603 - RNA, 17 nt, Salmonella enterica enterica serovar Typhi Ty2
ugaugagcaggccaggg

SEQ ID NO: 1761604 - RNA, 16 nt, Salmonella enterica enterica serovar Typhi Ty2
ugaugauggaacagac

SEQ ID NO: 1761605 - RNA, 16 nt, Salmonella enterica enterica serovar Typhi Ty2
ugaugauuuaugaaua

SEQ ID NO: 1761606 - RNA, 14 nt, Salmonella enterica enterica serovar Typhi Ty2
ucaguugguuagaa

SEQ ID NO: 1761607 - RNA, 21 nt, Salmonella enterica enterica serovar Typhi Ty2
ucaguucucgcgccaccugca

SEQ ID NO: 1761608 - RNA, 11 nt, Salmonella enterica enterica serovar Typhi Ty2
ucauuaaaaaa

SEQ ID NO: 1761609 - RNA, 12 nt, Salmonella enterica enterica serovar Typhi Ty2
ucauuaaaaugc

SEQ ID NO: 1761610 - RNA, 18 nt, Salmonella enterica enterica serovar Typhi Ty2
ucauuacuuauauuuauu

SEQ ID NO: 1761611 - RNA, 20 nt, Salmonella enterica enterica serovar Typhi Ty2
ucauugacccucccugcgcu

SEQ ID NO: 1761612 - RNA, 19 nt, Salmonella enterica enterica serovar Typhi Ty2
ucauugacgguggccgcca

SEQ ID NO: 1761613 - RNA, 22 nt, Salmonella enterica enterica serovar Typhi Ty2
ucauuaucaauagcuucaauga

SEQ ID NO: 1761614 - RNA, 20 nt, Salmonella enterica enterica serovar Typhi Ty2
ucauuuuguugcuccagcau

SEQ ID NO: 1761615 - RNA, 22 nt, Salmonella enterica enterica serovar Typhi Ty2
uccaacacaucgacaugcagau

SEQ ID NO: 1761616 - RNA, 23 nt, Salmonella enterica enterica serovar Typhi Ty2
uccaaacuggcugugccaauaac

SEQ ID NO: 1761617 - RNA, 23 nt, Salmonella enterica enterica serovar Typhi Ty2
ucauuugcgagaaaaaguguccg

SEQ ID NO: 1761618 - RNA, 20 nt, Salmonella enterica enterica serovar Typhi Ty2
ucauuuguacaaaaaaugug

SEQ ID NO: 1761619 - RNA, 21 nt, Salmonella enterica enterica serovar Typhi Ty2
ucauuuucaugauauucuguc

SEQ ID NO: 1761620 - RNA, 21 nt, Salmonella enterica enterica serovar Typhi Ty2
ucauuuguacaaaaaauguga

SEQ ID NO: 1761621 - RNA, 13 nt, Salmonella enterica enterica serovar Typhi Ty2
ucauuucuuuaau

SEQ ID NO: 1761622 - RNA, 18 nt, Salmonella enterica enterica serovar Typhi Ty2
ucauuucugccugcuuca

SEQ ID NO: 1761623 - RNA, 19 nt, Salmonella enterica enterica serovar Typhi Ty2
ucauugucggaacgcugua

SEQ ID NO: 1761624 - RNA, 18 nt, Salmonella enterica enterica serovar Typhi Ty2
ucauugcgaucuccuuua

SEQ ID NO: 1761625 - RNA, 20 nt, Salmonella enterica enterica serovar Typhi Ty2
ucauugcgccagcuuucggc

SEQ ID NO: 1761626 - RNA, 21 nt, Salmonella enterica enterica serovar Typhi Ty2
ucauugccguuaacugcugcu

SEQ ID NO: 1761627 - RNA, 21 nt, Salmonella enterica enterica serovar Typhi Ty2
ucauugaugaugaagcugcag

SEQ ID NO: 1761628 - RNA, 17 nt, Salmonella enterica enterica serovar Typhi Ty2
uccacggacaucggccu

SEQ ID NO: 1761629 - RNA, 22 nt, Salmonella enterica enterica serovar Typhi Ty2
uccacgguaaaacacgccucca

SEQ ID NO: 1761630 - RNA, 22 nt, Salmonella enterica enterica serovar Typhi Ty2
uccacuguucguccauaaaggc

SEQ ID NO: 1761631 - RNA, 21 nt, Salmonella enterica enterica serovar Typhi Ty2
uccacaccguuacgaccccau

SEQ ID NO: 1761632 - RNA, 14 nt, Salmonella enterica enterica serovar Typhi Ty2
uccacccaguucau

SEQ ID NO: 1761633 - RNA, 18 nt, Salmonella enterica enterica serovar Typhi Ty2
uccaccaggcaugcagcu

SEQ ID NO: 1761634 - RNA, 18 nt, Salmonella enterica enterica serovar Typhi Ty2
uccaccagcuuaucugac

SEQ ID NO: 1761635 - RNA, 14 nt, Salmonella enterica enterica serovar Typhi Ty2
uccaccagcuucau

SEQ ID NO: 1761636 - RNA, 18 nt, Salmonella enterica enterica serovar Typhi Ty2
uccaacuguuaucauaga

SEQ ID NO: 1761637 - RNA, 17 nt, Salmonella enterica enterica serovar Typhi Ty2
uccaacuggcuuucauc

SEQ ID NO: 1761638 - RNA, 19 nt, Salmonella enterica enterica serovar Typhi Ty2
uccaauaacguaaccgcuu

SEQ ID NO: 1761639 - RNA, 15 nt, Salmonella enterica enterica serovar Typhi Ty2
uccaauagacuucac

SEQ ID NO: 1761640 - RNA, 16 nt, Salmonella enterica enterica serovar Typhi Ty2
uccaauaauggagaug

SEQ ID NO: 1761641 - RNA, 20 nt, Salmonella enterica enterica serovar Typhi Ty2
uccaauagacuucacuuucc

SEQ ID NO: 1761642 - RNA, 20 nt, Salmonella enterica enterica serovar Typhi Ty2
uccaauauuuauuuaauguu

SEQ ID NO: 1761643 - RNA, 22 nt, Salmonella enterica enterica serovar Typhi Ty2
uccaguucaucuacacgcacuu

SEQ ID NO: 1761644 - RNA, 14 nt, Salmonella enterica enterica serovar Typhi Ty2
uccaguucauaagu

SEQ ID NO: 1761645 - RNA, 19 nt, Salmonella enterica enterica serovar Typhi Ty2
uccaguugcggcaucagau

SEQ ID NO: 1761646 - RNA, 16 nt, Salmonella enterica enterica serovar Typhi Ty2
uccaguugcuuaccuu

SEQ ID NO: 1761647 - RNA, 17 nt, Salmonella enterica enterica serovar Typhi Ty2
uccaguugcccucuuua

SEQ ID NO: 1761648 - RNA, 16 nt, Salmonella enterica enterica serovar Typhi Ty2
uccaguugcauacaua

SEQ ID NO: 1761649 - RNA, 21 nt, Salmonella enterica enterica serovar Typhi Ty2
uccaguuugcgggaaauacca

SEQ ID NO: 1761650 - RNA, 17 nt, Salmonella enterica enterica serovar Typhi Ty2
uccauagaaaucagcag

SEQ ID NO: 1761651 - RNA, 12 nt, Salmonella enterica enterica serovar Typhi Ty2
uccauauuuauc

SEQ ID NO: 1761652 - RNA, 19 nt, Salmonella enterica enterica serovar Typhi Ty2
uccauauaacagaauaagc

SEQ ID NO: 1761653 - RNA, 23 nt, Salmonella enterica enterica serovar Typhi Ty2
uccagguugugguuaaacacauc

SEQ ID NO: 1761654 - RNA, 18 nt, Salmonella enterica enterica serovar Typhi Ty2
uccagguuuuaguuucac

SEQ ID NO: 1761655 - RNA, 15 nt, Salmonella enterica enterica serovar Typhi Ty2
uccagugcagaaagu

SEQ ID NO: 1761656 - RNA, 12 nt, Salmonella enterica enterica serovar Typhi Ty2
uccagucccuga

SEQ ID NO: 1761657 - RNA, 24 nt, Salmonella enterica enterica serovar Typhi Ty2
uccaguaacgcguccaacuggcuu

SEQ ID NO: 1761658 - RNA, 12 nt, Salmonella enterica enterica serovar Typhi Ty2
uccagcggcgcg

SEQ ID NO: 1761659 - RNA, 22 nt, Salmonella enterica enterica serovar Typhi Ty2
uccagcggccaguguacauagc

SEQ ID NO: 1761660 - RNA, 16 nt, Salmonella enterica enterica serovar Typhi Ty2
uccagcgucgggccgc

SEQ ID NO: 1761661 - RNA, 22 nt, Salmonella enterica enterica serovar Typhi Ty2
uccagcgccugcuguaaaauau

SEQ ID NO: 1761662 - RNA, 16 nt, Salmonella enterica enterica serovar Typhi Ty2
uccagcgcguccuuau

SEQ ID NO: 1761663 - RNA, 18 nt, Salmonella enterica enterica serovar Typhi Ty2
uccagcgcucaaucagcg

SEQ ID NO: 1761664 - RNA, 22 nt, Salmonella enterica enterica serovar Typhi Ty2
uccagcgcauggaagaaaauau

SEQ ID NO: 1761665 - RNA, 15 nt, Salmonella enterica enterica serovar Typhi Ty2
uccagcgccugcugu

SEQ ID NO: 1761666 - RNA, 12 nt, Salmonella enterica enterica serovar Typhi Ty2
uccagcaguguc

SEQ ID NO: 1761667 - RNA, 22 nt, Salmonella enterica enterica serovar Typhi Ty2
uccagcauaauaugaugcagac

SEQ ID NO: 1761668 - RNA, 12 nt, Salmonella enterica enterica serovar Typhi Ty2
uccagccaaagu

SEQ ID NO: 1761669 - RNA, 13 nt, Salmonella enterica enterica serovar Typhi Ty2
uccagcauucuau

SEQ ID NO: 1761670 - RNA, 20 nt, Salmonella enterica enterica serovar Typhi Ty2
uccagcagguggaucugaau

SEQ ID NO: 1761671 - RNA, 19 nt, Salmonella enterica enterica serovar Typhi Ty2
uccagaacugcgaaaucac

SEQ ID NO: 1761672 - RNA, 23 nt, Salmonella enterica enterica serovar Typhi Ty2
uccacuuucucggcuuuccagcu

SEQ ID NO: 1761673 - RNA, 17 nt, Salmonella enterica enterica serovar Typhi Ty2
uccacuuugccuuuauu

SEQ ID NO: 1761674 - RNA, 18 nt, Salmonella enterica enterica serovar Typhi Ty2
uccacuuuugucggccug

SEQ ID NO: 1761675 - RNA, 21 nt, Salmonella enterica enterica serovar Typhi Ty2
uccacuuucucggcuuuccag

SEQ ID NO: 1761676 - RNA, 17 nt, Salmonella enterica enterica serovar Typhi Ty2
uccacuuucucggcuuu

SEQ ID NO: 1761677 - RNA, 17 nt, Salmonella enterica enterica serovar Typhi Ty2
uccacuuucagcggcuu

SEQ ID NO: 1761678 - RNA, 21 nt, Salmonella enterica enterica serovar Typhi Ty2
ucccacauacggcugaaaaau

SEQ ID NO: 1761679 - RNA, 18 nt, Salmonella enterica enterica serovar Typhi Ty2
ucccaacccgaccaggac

SEQ ID NO: 1761680 - RNA, 18 nt, Salmonella enterica enterica serovar Typhi Ty2
ucccaacaaugccacgcc

SEQ ID NO: 1761681 - RNA, 15 nt, Salmonella enterica enterica serovar Typhi Ty2
ucccaacagcgagcu

SEQ ID NO: 1761682 - RNA, 16 nt, Salmonella enterica enterica serovar Typhi Ty2
uccauuccagaacgaa

SEQ ID NO: 1761683 - RNA, 20 nt, Salmonella enterica enterica serovar Typhi Ty2
uccauucacacaauuuucuu

SEQ ID NO: 1761684 - RNA, 13 nt, Salmonella enterica enterica serovar Typhi Ty2
uccauucccagcu

SEQ ID NO: 1761685 - RNA, 14 nt, Salmonella enterica enterica serovar Typhi Ty2
uccauuuuaaauac

SEQ ID NO: 1761686 - RNA, 12 nt, Salmonella enterica enterica serovar Typhi Ty2
uccauuuuucag

SEQ ID NO: 1761687 - RNA, 20 nt, Salmonella enterica enterica serovar Typhi Ty2
uccauuuuucagauaacgaa

SEQ ID NO: 1761688 - RNA, 18 nt, Salmonella enterica enterica serovar Typhi Ty2
uccauuuuggggaaaaua

SEQ ID NO: 1761689 - RNA, 22 nt, Salmonella enterica enterica serovar Typhi Ty2
uccaugcgauacguaggccuga

SEQ ID NO: 1761690 - RNA, 15 nt, Salmonella enterica enterica serovar Typhi Ty2
uccaugccggcccga

SEQ ID NO: 1761691 - RNA, 13 nt, Salmonella enterica enterica serovar Typhi Ty2
uccaugccggcuu

SEQ ID NO: 1761692 - RNA, 17 nt, Salmonella enterica enterica serovar Typhi Ty2
uccaugagaagaaaaag

SEQ ID NO: 1761693 - RNA, 13 nt, Salmonella enterica enterica serovar Typhi Ty2
uccaugcccacac

SEQ ID NO: 1761694 - RNA, 23 nt, Salmonella enterica enterica serovar Typhi Ty2
uccauggucagacgcucagccuu

SEQ ID NO: 1761695 - RNA, 20 nt, Salmonella enterica enterica serovar Typhi Ty2
uccauuaaauuacuuguuga

SEQ ID NO: 1761696 - RNA, 20 nt, Salmonella enterica enterica serovar Typhi Ty2
uccauguuuccccuucuggu

SEQ ID NO: 1761697 - RNA, 19 nt, Salmonella enterica enterica serovar Typhi Ty2
uccauguugccaugguuca

SEQ ID NO: 1761698 - RNA, 20 nt, Salmonella enterica enterica serovar Typhi Ty2
uccauuaagucgaugaauga

SEQ ID NO: 1761699 - RNA, 16 nt, Salmonella enterica enterica serovar Typhi Ty2
uccauuagcgccugau

SEQ ID NO: 1761700 - RNA, 19 nt, Salmonella enterica enterica serovar Typhi Ty2
uccauguaaacuccauuaa

SEQ ID NO: 1761701 - RNA, 16 nt, Salmonella enterica enterica serovar Typhi Ty2
uccaugucuugcuauc

SEQ ID NO: 1761702 - RNA, 15 nt, Salmonella enterica enterica serovar Typhi Ty2
uccauccauugcgcc

SEQ ID NO: 1761703 - RNA, 13 nt, Salmonella enterica enterica serovar Typhi Ty2
uccaucauuuccg

SEQ ID NO: 1761704 - RNA, 13 nt, Salmonella enterica enterica serovar Typhi Ty2
uccaucagcgcgg

SEQ ID NO: 1761705 - RNA, 14 nt, Salmonella enterica enterica serovar Typhi Ty2
uccaucagccaggc

SEQ ID NO: 1761706 - RNA, 13 nt, Salmonella enterica enterica serovar Typhi Ty2
uccaucagccagg

SEQ ID NO: 1761707 - RNA, 13 nt, Salmonella enterica enterica serovar Typhi Ty2
uccaucacuccuu

SEQ ID NO: 1761708 - RNA, 19 nt, Salmonella enterica enterica serovar Typhi Ty2
uccaucacgguaaaccugu

SEQ ID NO: 1761709 - RNA, 22 nt, Salmonella enterica enterica serovar Typhi Ty2
uccaucacguuggggaauaaau

SEQ ID NO: 1761710 - RNA, 18 nt, Salmonella enterica enterica serovar Typhi Ty2
uccaugacgaccacagcc

SEQ ID NO: 1761711 - RNA, 20 nt, Salmonella enterica enterica serovar Typhi Ty2
uccaugacgaccacagccgu

SEQ ID NO: 1761712 - RNA, 15 nt, Salmonella enterica enterica serovar Typhi Ty2
uccgccaugguuggg

SEQ ID NO: 1761713 - RNA, 23 nt, Salmonella enterica enterica serovar Typhi Ty2
uccgccaucgccucgauaaacau

SEQ ID NO: 1761714 - RNA, 20 nt, Salmonella enterica enterica serovar Typhi Ty2
uccgccauaacggcugucca

SEQ ID NO: 1761715 - RNA, 13 nt, Salmonella enterica enterica serovar Typhi Ty2
uccgccagcgccu

SEQ ID NO: 1761716 - RNA, 18 nt, Salmonella enterica enterica serovar Typhi Ty2
uccgccagguauucuaac

SEQ ID NO: 1761717 - RNA, 16 nt, Salmonella enterica enterica serovar Typhi Ty2
uccgccacgcucgcug

SEQ ID NO: 1761718 - RNA, 14 nt, Salmonella enterica enterica serovar Typhi Ty2
uccgcacgcgcgcc

SEQ ID NO: 1761719 - RNA, 20 nt, Salmonella enterica enterica serovar Typhi Ty2
uccgcagccagaaucagccg

SEQ ID NO: 1761720 - RNA, 22 nt, Salmonella enterica enterica serovar Typhi Ty2
uccgcaggggauucugccaucg

SEQ ID NO: 1761721 - RNA, 22 nt, Salmonella enterica enterica serovar Typhi Ty2
uccgcaaucacauacagcacuu

SEQ ID NO: 1761722 - RNA, 14 nt, Salmonella enterica enterica serovar Typhi Ty2
uccgcauucuaaau

SEQ ID NO: 1761723 - RNA, 15 nt, Salmonella enterica enterica serovar Typhi Ty2
uccgcaauccuggcu

SEQ ID NO: 1761724 - RNA, 17 nt, Salmonella enterica enterica serovar Typhi Ty2
uccgcacauaaucaccg

SEQ ID NO: 1761725 - RNA, 16 nt, Salmonella enterica enterica serovar Typhi Ty2
uccgcaauuaauuuau

SEQ ID NO: 1761726 - RNA, 16 nt, Salmonella enterica enterica serovar Typhi Ty2
uccgcaauuuccugau

SEQ ID NO: 1761727 - RNA, 23 nt, Salmonella enterica enterica serovar Typhi Ty2
uccgcaaagcccaucagcgccag

SEQ ID NO: 1761728 - RNA, 13 nt, Salmonella enterica enterica serovar Typhi Ty2
uccgcaauaagug

SEQ ID NO: 1761729 - RNA, 23 nt, Salmonella enterica enterica serovar Typhi Ty2
uccgaggcguaucccaguaaaua

SEQ ID NO: 1761730 - RNA, 20 nt, Salmonella enterica enterica serovar Typhi Ty2
uccgcuaccugcgagcugua

SEQ ID NO: 1761731 - RNA, 23 nt, Salmonella enterica enterica serovar Typhi Ty2
uccgcguuagcaagaccgggcug

SEQ ID NO: 1761732 - RNA, 16 nt, Salmonella enterica enterica serovar Typhi Ty2
uccgcuauuaccagua

SEQ ID NO: 1761733 - RNA, 20 nt, Salmonella enterica enterica serovar Typhi Ty2
uccgcuauuaccaguaauga

SEQ ID NO: 1761734 - RNA, 20 nt, Salmonella enterica enterica serovar Typhi Ty2
uccgcgggcaaaagggccau

SEQ ID NO: 1761735 - RNA, 18 nt, Salmonella enterica enterica serovar Typhi Ty2
uccgcgguagagcgcggu

SEQ ID NO: 1761736 - RNA, 15 nt, Salmonella enterica enterica serovar Typhi Ty2
uccgcgguguccugc

SEQ ID NO: 1761737 - RNA, 19 nt, Salmonella enterica enterica serovar Typhi Ty2
uccgcgccgagugcuugca

SEQ ID NO: 1761738 - RNA, 23 nt, Salmonella enterica enterica serovar Typhi Ty2
uccgcgauaucaaucaccucuuc

SEQ ID NO: 1761739 - RNA, 17 nt, Salmonella enterica enterica serovar Typhi Ty2
uccgcccaagaacauga

SEQ ID NO: 1761740 - RNA, 19 nt, Salmonella enterica enterica serovar Typhi Ty2
uccgcccaguaccagcacu

SEQ ID NO: 1761741 - RNA, 13 nt, Salmonella enterica enterica serovar Typhi Ty2
uccgccccgcugg

SEQ ID NO: 1761742 - RNA, 17 nt, Salmonella enterica enterica serovar Typhi Ty2
uccgccuggaacccagg

SEQ ID NO: 1761743 - RNA, 18 nt, Salmonella enterica enterica serovar Typhi Ty2
uccgccuggaacccaggc

SEQ ID NO: 1761744 - RNA, 15 nt, Salmonella enterica enterica serovar Typhi Ty2
uccgccgucgucacc

SEQ ID NO: 1761745 - RNA, 20 nt, Salmonella enterica enterica serovar Typhi Ty2
aaaucugccgucaucgacuu

SEQ ID NO: 1761746 - RNA, 22 nt, Salmonella enterica enterica serovar Typhi Ty2
aaaucuguuaucuggauguaaa

SEQ ID NO: 1761747 - RNA, 22 nt, Salmonella enterica enterica serovar Typhi Ty2
uccgagacgguaagaauaauaa

SEQ ID NO: 1761748 - RNA, 14 nt, Salmonella enterica enterica serovar Typhi Ty2
ucccuucuuuuacu

SEQ ID NO: 1761749 - RNA, 15 nt, Salmonella enterica enterica serovar Typhi Ty2
ucccuucuuuuacug

SEQ ID NO: 1761750 - RNA, 16 nt, Salmonella enterica enterica serovar Typhi Ty2
ucccuuucaaaaaaga

SEQ ID NO: 1761751 - RNA, 21 nt, Salmonella enterica enterica serovar Typhi Ty2
uccgaauacggacauuuauuu

SEQ ID NO: 1761752 - RNA, 11 nt, Salmonella enterica enterica serovar Typhi Ty2
uccgaauaauc

SEQ ID NO: 1761753 - RNA, 15 nt, Salmonella enterica enterica serovar Typhi Ty2
uccgaacucaugccg

SEQ ID NO: 1761754 - RNA, 19 nt, Salmonella enterica enterica serovar Typhi Ty2
uccgaccacggccacagcc

SEQ ID NO: 1761755 - RNA, 22 nt, Salmonella enterica enterica serovar Typhi Ty2
uccgacagugaacggcauaauc

SEQ ID NO: 1761756 - RNA, 12 nt, Salmonella enterica enterica serovar Typhi Ty2
ucccuguucaaa

SEQ ID NO: 1761757 - RNA, 17 nt, Salmonella enterica enterica serovar Typhi Ty2
ucccuuccgccaccagg

SEQ ID NO: 1761758 - RNA, 12 nt, Salmonella enterica enterica serovar Typhi Ty2
ucccuucuuuua

SEQ ID NO: 1761759 - RNA, 16 nt, Salmonella enterica enterica serovar Typhi Ty2
ucccuucucgcuaaua

SEQ ID NO: 1761760 - RNA, 15 nt, Salmonella enterica enterica serovar Typhi Ty2
ucccugcauucuuuc

SEQ ID NO: 1761761 - RNA, 19 nt, Salmonella enterica enterica serovar Typhi Ty2
ucccugagucuugccuguc

SEQ ID NO: 1761762 - RNA, 17 nt, Salmonella enterica enterica serovar Typhi Ty2
ucccuggauaaaauauc

SEQ ID NO: 1761763 - RNA, 21 nt, Salmonella enterica enterica serovar Typhi Ty2
ucccugccagugaaaguuuuc

SEQ ID NO: 1761764 - RNA, 14 nt, Salmonella enterica enterica serovar Typhi Ty2
ucccucuccagggc

SEQ ID NO: 1761765 - RNA, 12 nt, Salmonella enterica enterica serovar Typhi Ty2
ucccucgccccg

SEQ ID NO: 1761766 - RNA, 17 nt, Salmonella enterica enterica serovar Typhi Ty2
ucccucgacaauuucac

SEQ ID NO: 1761767 - RNA, 14 nt, Salmonella enterica enterica serovar Typhi Ty2
ucccucgaaguauu

SEQ ID NO: 1761768 - RNA, 11 nt, Salmonella enterica enterica serovar Typhi Ty2
ucccucuccag

SEQ ID NO: 1761769 - RNA, 23 nt, Salmonella enterica enterica serovar Typhi Ty2
ucccuauguaaagaaugaaaaaa

SEQ ID NO: 1761770 - RNA, 17 nt, Salmonella enterica enterica serovar Typhi Ty2
ucccucacgcgucacaa

SEQ ID NO: 1761771 - RNA, 14 nt, Salmonella enterica enterica serovar Typhi Ty2
ucccucaccucccc

SEQ ID NO: 1761772 - RNA, 19 nt, Salmonella enterica enterica serovar Typhi Ty2
ucccuacucucgcaugggg

SEQ ID NO: 1761773 - RNA, 17 nt, Salmonella enterica enterica serovar Typhi Ty2
ucccuaagccggcaggc

SEQ ID NO: 1761774 - RNA, 12 nt, Salmonella enterica enterica serovar Typhi Ty2
ucccgccugcug

SEQ ID NO: 1761775 - RNA, 12 nt, Salmonella enterica enterica serovar Typhi Ty2
ucccgccgcgau

SEQ ID NO: 1761776 - RNA, 14 nt, Salmonella enterica enterica serovar Typhi Ty2
ucccgcccagcaac

SEQ ID NO: 1761777 - RNA, 16 nt, Salmonella enterica enterica serovar Typhi Ty2
ucccgcgcuucauccg

SEQ ID NO: 1761778 - RNA, 22 nt, Salmonella enterica enterica serovar Typhi Ty2
ucccgcguucgcgcaguucauc

SEQ ID NO: 1761779 - RNA, 21 nt, Salmonella enterica enterica serovar Typhi Ty2
ucccggaacagcggagcgaag

SEQ ID NO: 1761780 - RNA, 17 nt, Salmonella enterica enterica serovar Typhi Ty2
ucccgcuggcuggcguu

SEQ ID NO: 1761781 - RNA, 18 nt, Salmonella enterica enterica serovar Typhi Ty2
ucccgcugugauccaugu

SEQ ID NO: 1761782 - RNA, 16 nt, Salmonella enterica enterica serovar Typhi Ty2
ucccgggcgauaaacc

SEQ ID NO: 1761783 - RNA, 21 nt, Salmonella enterica enterica serovar Typhi Ty2
ucccggcaauuaccgccagcg

SEQ ID NO: 1761784 - RNA, 15 nt, Salmonella enterica enterica serovar Typhi Ty2
ucccguaaaagaaga

SEQ ID NO: 1761785 - RNA, 14 nt, Salmonella enterica enterica serovar Typhi Ty2
ucccguaaaagaag

SEQ ID NO: 1761786 - RNA, 20 nt, Salmonella enterica enterica serovar Typhi Ty2
ucccguagcgucaacacgag

SEQ ID NO: 1761787 - RNA, 23 nt, Salmonella enterica enterica serovar Typhi Ty2
ucccgguuaucgaacagcuuacc

SEQ ID NO: 1761788 - RNA, 16 nt, Salmonella enterica enterica serovar Typhi Ty2
ucccguaucuucaugu

SEQ ID NO: 1761789 - RNA, 13 nt, Salmonella enterica enterica serovar Typhi Ty2
ucccguuucagug

SEQ ID NO: 1761790 - RNA, 16 nt, Salmonella enterica enterica serovar Typhi Ty2
uccccuuuuuucuguu

SEQ ID NO: 1761791 - RNA, 14 nt, Salmonella enterica enterica serovar Typhi Ty2
uccccuucaggaau

SEQ ID NO: 1761792 - RNA, 21 nt, Salmonella enterica enterica serovar Typhi Ty2
uccccucuuccaucagccagg

SEQ ID NO: 1761793 - RNA, 15 nt, Salmonella enterica enterica serovar Typhi Ty2
uccccucuuccauca

SEQ ID NO: 1761794 - RNA, 16 nt, Salmonella enterica enterica serovar Typhi Ty2
uccccucuuccaucag

SEQ ID NO: 1761795 - RNA, 20 nt, Salmonella enterica enterica serovar Typhi Ty2
uccccugcgguuucuaccac

SEQ ID NO: 1761796 - RNA, 14 nt, Salmonella enterica enterica serovar Typhi Ty2
ucccgauaaugacc

SEQ ID NO: 1761797 - RNA, 13 nt, Salmonella enterica enterica serovar Typhi Ty2
ucccgaucuucau

SEQ ID NO: 1761798 - RNA, 21 nt, Salmonella enterica enterica serovar Typhi Ty2
ucccgaacugucugaaucagu

SEQ ID NO: 1761799 - RNA, 22 nt, Salmonella enterica enterica serovar Typhi Ty2
ucccgagccggguuauagccuu

SEQ ID NO: 1761800 - RNA, 20 nt, Salmonella enterica enterica serovar Typhi Ty2
ucccgacuuuacaccccacu

SEQ ID NO: 1761801 - RNA, 19 nt, Salmonella enterica enterica serovar Typhi Ty2
ucccccucuugccccacau

SEQ ID NO: 1761802 - RNA, 12 nt, Salmonella enterica enterica serovar Typhi Ty2
ucccccuggccc

SEQ ID NO: 1761803 - RNA, 22 nt, Salmonella enterica enterica serovar Typhi Ty2
ucccccuggccugcucaucagg

SEQ ID NO: 1761804 - RNA, 19 nt, Salmonella enterica enterica serovar Typhi Ty2
uccccgacggccucuucac

SEQ ID NO: 1761805 - RNA, 14 nt, Salmonella enterica enterica serovar Typhi Ty2
uccccgccgcggcg

SEQ ID NO: 1761806 - RNA, 20 nt, Salmonella enterica enterica serovar Typhi Ty2
uccccgcuggcgcggggaac

SEQ ID NO: 1761807 - RNA, 20 nt, Salmonella enterica enterica serovar Typhi Ty2
uccccgcuggugcggggaac

SEQ ID NO: 1761808 - RNA, 17 nt, Salmonella enterica enterica serovar Typhi Ty2
uccccguuugcaguccg

SEQ ID NO: 1761809 - RNA, 21 nt, Salmonella enterica enterica serovar Typhi Ty2
uccccucaugacuuuuuucaa

SEQ ID NO: 1761810 - RNA, 21 nt, Salmonella enterica enterica serovar Typhi Ty2
uccccggggugcagaacauca

SEQ ID NO: 1761811 - RNA, 21 nt, Salmonella enterica enterica serovar Typhi Ty2
uccccggucagucccagcguu

SEQ ID NO: 1761812 - RNA, 14 nt, Salmonella enterica enterica serovar Typhi Ty2
uccccggcuucaca

SEQ ID NO: 1761813 - RNA, 17 nt, Salmonella enterica enterica serovar Typhi Ty2
uccccacaaucccgcca

SEQ ID NO: 1761814 - RNA, 18 nt, Salmonella enterica enterica serovar Typhi Ty2
uccccaccgcugauggcg

SEQ ID NO: 1761815 - RNA, 22 nt, Salmonella enterica enterica serovar Typhi Ty2
uccccaacgacagcacuacgcu

SEQ ID NO: 1761816 - RNA, 21 nt, Salmonella enterica enterica serovar Typhi Ty2
uccccacgccgaccaccagcu

SEQ ID NO: 1761817 - RNA, 22 nt, Salmonella enterica enterica serovar Typhi Ty2
uccccaccugacuauacccaaa

SEQ ID NO: 1761818 - RNA, 22 nt, Salmonella enterica enterica serovar Typhi Ty2
uccccacgccgaccaccagcuu

SEQ ID NO: 1761819 - RNA, 16 nt, Salmonella enterica enterica serovar Typhi Ty2
uccccaaccgccagcc

SEQ ID NO: 1761820 - RNA, 19 nt, Salmonella enterica enterica serovar Typhi Ty2
ucccauugggccagcagcg

SEQ ID NO: 1761821 - RNA, 16 nt, Salmonella enterica enterica serovar Typhi Ty2
uccccauuuuuuucag

SEQ ID NO: 1761822 - RNA, 12 nt, Salmonella enterica enterica serovar Typhi Ty2
ucccccacuucu

SEQ ID NO: 1761823 - RNA, 17 nt, Salmonella enterica enterica serovar Typhi Ty2
uccccccuuuuuugcug

SEQ ID NO: 1761824 - RNA, 21 nt, Salmonella enterica enterica serovar Typhi Ty2
ucccccggcaccacgcacagu

SEQ ID NO: 1761825 - RNA, 16 nt, Salmonella enterica enterica serovar Typhi Ty2
uccccagccagagauc

SEQ ID NO: 1761826 - RNA, 16 nt, Salmonella enterica enterica serovar Typhi Ty2
uccccagcaucauguc

SEQ ID NO: 1761827 - RNA, 12 nt, Salmonella enterica enterica serovar Typhi Ty2
uccccagcaccg

SEQ ID NO: 1761828 - RNA, 19 nt, Salmonella enterica enterica serovar Typhi Ty2
uccccauaucccgaaaagc

SEQ ID NO: 1761829 - RNA, 23 nt, Salmonella enterica enterica serovar Typhi Ty2
uccccauacugacggcgcucuuu

SEQ ID NO: 1761830 - RNA, 19 nt, Salmonella enterica enterica serovar Typhi Ty2
uccccauauuccagaaagg

SEQ ID NO: 1761831 - RNA, 16 nt, Salmonella enterica enterica serovar Typhi Ty2
uccccaucccaaucag

SEQ ID NO: 1761832 - RNA, 14 nt, Salmonella enterica enterica serovar Typhi Ty2
ucccauccgggcca

SEQ ID NO: 1761833 - RNA, 19 nt, Salmonella enterica enterica serovar Typhi Ty2
ucccauccgugcgaugaga

SEQ ID NO: 1761834 - RNA, 16 nt, Salmonella enterica enterica serovar Typhi Ty2
ucccauacugcccagc

SEQ ID NO: 1761835 - RNA, 23 nt, Salmonella enterica enterica serovar Typhi Ty2
ucccauaccuguaucaaaccaac

SEQ ID NO: 1761836 - RNA, 14 nt, Salmonella enterica enterica serovar Typhi Ty2
ucccagcugagcua

SEQ ID NO: 1761837 - RNA, 16 nt, Salmonella enterica enterica serovar Typhi Ty2
ucccaggcgcgcagcu

SEQ ID NO: 1761838 - RNA, 17 nt, Salmonella enterica enterica serovar Typhi Ty2
ucccagauuaaaucauc

SEQ ID NO: 1761839 - RNA, 21 nt, Salmonella enterica enterica serovar Typhi Ty2
ucccagccgggcaggaaaagc

SEQ ID NO: 1761840 - RNA, 16 nt, Salmonella enterica enterica serovar Typhi Ty2
ucccacuuugcucacc

SEQ ID NO: 1761841 - RNA, 20 nt, Salmonella enterica enterica serovar Typhi Ty2
ucccacuuaggcagccaggc

SEQ ID NO: 1761842 - RNA, 13 nt, Salmonella enterica enterica serovar Typhi Ty2
ucccagaaaauga

SEQ ID NO: 1761843 - RNA, 12 nt, Salmonella enterica enterica serovar Typhi Ty2
ucccagaagaaa

SEQ ID NO: 1761844 - RNA, 13 nt, Salmonella enterica enterica serovar Typhi Ty2
uccugucccugcc

SEQ ID NO: 1761845 - RNA, 22 nt, Salmonella enterica enterica serovar Typhi Ty2
uccuguagcgucuuuugaguga

SEQ ID NO: 1761846 - RNA, 19 nt, Salmonella enterica enterica serovar Typhi Ty2
uccuguaaaaaauccagcg

SEQ ID NO: 1761847 - RNA, 22 nt, Salmonella enterica enterica serovar Typhi Ty2
uccuguaacaacuguuuuucac

SEQ ID NO: 1761848 - RNA, 18 nt, Salmonella enterica enterica serovar Typhi Ty2
uccugguuuguccagggc

SEQ ID NO: 1761849 - RNA, 20 nt, Salmonella enterica enterica serovar Typhi Ty2
uccugguaacggcacugcuu

SEQ ID NO: 1761850 - RNA, 13 nt, Salmonella enterica enterica serovar Typhi Ty2
uccuuaucagacu

SEQ ID NO: 1761851 - RNA, 15 nt, Salmonella enterica enterica serovar Typhi Ty2
uccuuaucacauuuu

SEQ ID NO: 1761852 - RNA, 21 nt, Salmonella enterica enterica serovar Typhi Ty2
uccuuacuucgauggccucau

SEQ ID NO: 1761853 - RNA, 19 nt, Salmonella enterica enterica serovar Typhi Ty2
uccuguuuuuucagcgcgc

SEQ ID NO: 1761854 - RNA, 18 nt, Salmonella enterica enterica serovar Typhi Ty2
uccuuauuaaagccccuu

SEQ ID NO: 1761855 - RNA, 13 nt, Salmonella enterica enterica serovar Typhi Ty2
uccuucauucaga

SEQ ID NO: 1761856 - RNA, 20 nt, Salmonella enterica enterica serovar Typhi Ty2
uccuggcguuaucaucguaa

SEQ ID NO: 1761857 - RNA, 20 nt, Salmonella enterica enterica serovar Typhi Ty2
uccuggcguaugcuuucagc

SEQ ID NO: 1761858 - RNA, 22 nt, Salmonella enterica enterica serovar Typhi Ty2
uccuggcugucggcagaaccug

SEQ ID NO: 1761859 - RNA, 12 nt, Salmonella enterica enterica serovar Typhi Ty2
uccugcuguggu

SEQ ID NO: 1761860 - RNA, 21 nt, Salmonella enterica enterica serovar Typhi Ty2
uccugcuggcaaaacgcaucc

SEQ ID NO: 1761861 - RNA, 22 nt, Salmonella enterica enterica serovar Typhi Ty2
uccugcgugccguugaccagcu

SEQ ID NO: 1761862 - RNA, 20 nt, Salmonella enterica enterica serovar Typhi Ty2
uccugcucaugcgagguaua

SEQ ID NO: 1761863 - RNA, 17 nt, Salmonella enterica enterica serovar Typhi Ty2
uccugcuccaugcuguc

SEQ ID NO: 1761864 - RNA, 14 nt, Salmonella enterica enterica serovar Typhi Ty2
uccugcuccugcgg

SEQ ID NO: 1761865 - RNA, 21 nt, Salmonella enterica enterica serovar Typhi Ty2
uccugcuccugcggcguggaa

SEQ ID NO: 1761866 - RNA, 17 nt, Salmonella enterica enterica serovar Typhi Ty2
uccugcugcgccagcgc

SEQ ID NO: 1761867 - RNA, 21 nt, Salmonella enterica enterica serovar Typhi Ty2
uccugccagauuuucuuuaau

SEQ ID NO: 1761868 - RNA, 20 nt, Salmonella enterica enterica serovar Typhi Ty2
uccugccagccgcucugcug

SEQ ID NO: 1761869 - RNA, 21 nt, Salmonella enterica enterica serovar Typhi Ty2
uccugccgcaaacgccugcuc

SEQ ID NO: 1761870 - RNA, 13 nt, Salmonella enterica enterica serovar Typhi Ty2
uccugccgccgca

SEQ ID NO: 1761871 - RNA, 22 nt, Salmonella enterica enterica serovar Typhi Ty2
uccugccgccgcaccacugcug

SEQ ID NO: 1761872 - RNA, 15 nt, Salmonella enterica enterica serovar Typhi Ty2
uccugcggcaguucu

SEQ ID NO: 1761873 - RNA, 22 nt, Salmonella enterica enterica serovar Typhi Ty2
uccugcgcuuuuugcuucgcca

SEQ ID NO: 1761874 - RNA, 19 nt, Salmonella enterica enterica serovar Typhi Ty2
uccugcgcugucaccagca

SEQ ID NO: 1761875 - RNA, 20 nt, Salmonella enterica enterica serovar Typhi Ty2
uccugcaggcgagugcuacc

SEQ ID NO: 1761876 - RNA, 20 nt, Salmonella enterica enterica serovar Typhi Ty2
uccugcaucgacauccgauu

SEQ ID NO: 1761877 - RNA, 17 nt, Salmonella enterica enterica serovar Typhi Ty2
uccugcaccgccugcgg

SEQ ID NO: 1761878 - RNA, 13 nt, Salmonella enterica enterica serovar Typhi Ty2
uccugcagcgcca

SEQ ID NO: 1761879 - RNA, 16 nt, Salmonella enterica enterica serovar Typhi Ty2
uccucauacagcccgc

SEQ ID NO: 1761880 - RNA, 13 nt, Salmonella enterica enterica serovar Typhi Ty2
uccucauacagcc

SEQ ID NO: 1761881 - RNA, 19 nt, Salmonella enterica enterica serovar Typhi Ty2
uccucauuuuguugcucca

SEQ ID NO: 1761882 - RNA, 21 nt, Salmonella enterica enterica serovar Typhi Ty2
uccucauuuuguugcuccagc

SEQ ID NO: 1761883 - RNA, 14 nt, Salmonella enterica enterica serovar Typhi Ty2
uccucauucagcgg

SEQ ID NO: 1761884 - RNA, 23 nt, Salmonella enterica enterica serovar Typhi Ty2
uccuccggcauagccggagguuu

SEQ ID NO: 1761885 - RNA, 20 nt, Salmonella enterica enterica serovar Typhi Ty2
uccuccggcgagcgaugcug

SEQ ID NO: 1761886 - RNA, 14 nt, Salmonella enterica enterica serovar Typhi Ty2
uccucgcauccucc

SEQ ID NO: 1761887 - RNA, 14 nt, Salmonella enterica enterica serovar Typhi Ty2
uccucgaucgccug

SEQ ID NO: 1761888 - RNA, 21 nt, Salmonella enterica enterica serovar Typhi Ty2
uccucuuuucgaacgccgaca

SEQ ID NO: 1761889 - RNA, 15 nt, Salmonella enterica enterica serovar Typhi Ty2
uccucuuucccuuuu

SEQ ID NO: 1761890 - RNA, 18 nt, Salmonella enterica enterica serovar Typhi Ty2
uccucuuucccuuuuuaa

SEQ ID NO: 1761891 - RNA, 21 nt, Salmonella enterica enterica serovar Typhi Ty2
uccugaaacccauaauaauga

SEQ ID NO: 1761892 - RNA, 11 nt, Salmonella enterica enterica serovar Typhi Ty2
uccugaaaaaa

SEQ ID NO: 1761893 - RNA, 21 nt, Salmonella enterica enterica serovar Typhi Ty2
uccugaaccagcggcaccagc

SEQ ID NO: 1761894 - RNA, 16 nt, Salmonella enterica enterica serovar Typhi Ty2
uccucuugucaggcag

SEQ ID NO: 1761895 - RNA, 13 nt, Salmonella enterica enterica serovar Typhi Ty2
uccucuucucuga

SEQ ID NO: 1761896 - RNA, 14 nt, Salmonella enterica enterica serovar Typhi Ty2
uccucuuucaaccu

SEQ ID NO: 1761897 - RNA, 13 nt, Salmonella enterica enterica serovar Typhi Ty2
uccugagcgaaug

SEQ ID NO: 1761898 - RNA, 19 nt, Salmonella enterica enterica serovar Typhi Ty2
uccugagcagacauauuuu

SEQ ID NO: 1761899 - RNA, 22 nt, Salmonella enterica enterica serovar Typhi Ty2
uccugaguaaagccugcccugc

SEQ ID NO: 1761900 - RNA, 17 nt, Salmonella enterica enterica serovar Typhi Ty2
uccugaugauggaaaac

SEQ ID NO: 1761901 - RNA, 13 nt, Salmonella enterica enterica serovar Typhi Ty2
uccugauccggcu

SEQ ID NO: 1761902 - RNA, 22 nt, Salmonella enterica enterica serovar Typhi Ty2
uccugauauucccguuccagcu

SEQ ID NO: 1761903 - RNA, 19 nt, Salmonella enterica enterica serovar Typhi Ty2
uccugcaacagcaccagca

SEQ ID NO: 1761904 - RNA, 14 nt, Salmonella enterica enterica serovar Typhi Ty2
uccugcaacagaag

SEQ ID NO: 1761905 - RNA, 16 nt, Salmonella enterica enterica serovar Typhi Ty2
uccugcaacagaagag

SEQ ID NO: 1761906 - RNA, 17 nt, Salmonella enterica enterica serovar Typhi Ty2
uccugcaacagcaccag

SEQ ID NO: 1761907 - RNA, 14 nt, Salmonella enterica enterica serovar Typhi Ty2
uccugauuuuacug

SEQ ID NO: 1761908 - RNA, 15 nt, Salmonella enterica enterica serovar Typhi Ty2
uccugcaaaauaccg

SEQ ID NO: 1761909 - RNA, 22 nt, Salmonella enterica enterica serovar Typhi Ty2
uccucaccguagcuccagaccu

SEQ ID NO: 1761910 - RNA, 19 nt, Salmonella enterica enterica serovar Typhi Ty2
uccucacaaacggcaucga

SEQ ID NO: 1761911 - RNA, 15 nt, Salmonella enterica enterica serovar Typhi Ty2
uccucaauguuaacu

SEQ ID NO: 1761912 - RNA, 20 nt, Salmonella enterica enterica serovar Typhi Ty2
uccucaauauugucuucguc

SEQ ID NO: 1761913 - RNA, 11 nt, Salmonella enterica enterica serovar Typhi Ty2
uccgguuuuug

SEQ ID NO: 1761914 - RNA, 20 nt, Salmonella enterica enterica serovar Typhi Ty2
uccguaagcggcggaccagc

SEQ ID NO: 1761915 - RNA, 20 nt, Salmonella enterica enterica serovar Typhi Ty2
uccguacauaacagcagcag

SEQ ID NO: 1761916 - RNA, 18 nt, Salmonella enterica enterica serovar Typhi Ty2
uccguaaucgcuuucauu

SEQ ID NO: 1761917 - RNA, 19 nt, Salmonella enterica enterica serovar Typhi Ty2
uccggugugaccagcgcgu

SEQ ID NO: 1761918 - RNA, 15 nt, Salmonella enterica enterica serovar Typhi Ty2
uccggucuacaagug

SEQ ID NO: 1761919 - RNA, 13 nt, Salmonella enterica enterica serovar Typhi Ty2
uccguccucuuuc

SEQ ID NO: 1761920 - RNA, 19 nt, Salmonella enterica enterica serovar Typhi Ty2
uccgucagcgaaucgaucu

SEQ ID NO: 1761921 - RNA, 13 nt, Salmonella enterica enterica serovar Typhi Ty2
uccgucaggaugg

SEQ ID NO: 1761922 - RNA, 15 nt, Salmonella enterica enterica serovar Typhi Ty2
uccgucaaagaaaac

SEQ ID NO: 1761923 - RNA, 16 nt, Salmonella enterica enterica serovar Typhi Ty2
uccguagcgauaauga

SEQ ID NO: 1761924 - RNA, 18 nt, Salmonella enterica enterica serovar Typhi Ty2
uccguagcgauaaugacg

SEQ ID NO: 1761925 - RNA, 19 nt, Salmonella enterica enterica serovar Typhi Ty2
uccguauuauccacccccg

SEQ ID NO: 1761926 - RNA, 23 nt, Salmonella enterica enterica serovar Typhi Ty2
uccguuuucgacaugguuggcca

SEQ ID NO: 1761927 - RNA, 21 nt, Salmonella enterica enterica serovar Typhi Ty2
uccguugccacccaaugaucc

SEQ ID NO: 1761928 - RNA, 17 nt, Salmonella enterica enterica serovar Typhi Ty2
uccguuagcucuuucau

SEQ ID NO: 1761929 - RNA, 17 nt, Salmonella enterica enterica serovar Typhi Ty2
uccguuauuucacagca

SEQ ID NO: 1761930 - RNA, 19 nt, Salmonella enterica enterica serovar Typhi Ty2
uccguuaccccuuuuucaa

SEQ ID NO: 1761931 - RNA, 19 nt, Salmonella enterica enterica serovar Typhi Ty2
uccgucucuuuauugaaaa

SEQ ID NO: 1761932 - RNA, 18 nt, Salmonella enterica enterica serovar Typhi Ty2
uccgucgugccuuucagg

SEQ ID NO: 1761933 - RNA, 17 nt, Salmonella enterica enterica serovar Typhi Ty2
uccggcagacggcuggg

SEQ ID NO: 1761934 - RNA, 16 nt, Salmonella enterica enterica serovar Typhi Ty2
uccggcacucuucuuc

SEQ ID NO: 1761935 - RNA, 13 nt, Salmonella enterica enterica serovar Typhi Ty2
uccggcaaugauu

SEQ ID NO: 1761936 - RNA, 15 nt, Salmonella enterica enterica serovar Typhi Ty2
uccggcacacagcgc

SEQ ID NO: 1761937 - RNA, 18 nt, Salmonella enterica enterica serovar Typhi Ty2
uccggcacacagcgcuuu

SEQ ID NO: 1761938 - RNA, 19 nt, Salmonella enterica enterica serovar Typhi Ty2
uccggcauucgcacacuac

SEQ ID NO: 1761939 - RNA, 12 nt, Salmonella enterica enterica serovar Typhi Ty2
uccggcauuuuu

SEQ ID NO: 1761940 - RNA, 18 nt, Salmonella enterica enterica serovar Typhi Ty2
uccggacguacccaggcg

SEQ ID NO: 1761941 - RNA, 15 nt, Salmonella enterica enterica serovar Typhi Ty2
uccggaucaucuuuu

SEQ ID NO: 1761942 - RNA, 14 nt, Salmonella enterica enterica serovar Typhi Ty2
uccggcaaacucag

SEQ ID NO: 1761943 - RNA, 21 nt, Salmonella enterica enterica serovar Typhi Ty2
uccggauggcaguacagggcg

SEQ ID NO: 1761944 - RNA, 20 nt, Salmonella enterica enterica serovar Typhi Ty2
uccggauucgcggcaaacac

SEQ ID NO: 1761945 - RNA, 15 nt, Salmonella enterica enterica serovar Typhi Ty2
uccggaugccccauc

SEQ ID NO: 1761946 - RNA, 19 nt, Salmonella enterica enterica serovar Typhi Ty2
uccggaucgccgaagcggc

SEQ ID NO: 1761947 - RNA, 16 nt, Salmonella enterica enterica serovar Typhi Ty2
uccgcuuuugguuuuu

SEQ ID NO: 1761948 - RNA, 14 nt, Salmonella enterica enterica serovar Typhi Ty2
uccgcuuccagaau

SEQ ID NO: 1761949 - RNA, 19 nt, Salmonella enterica enterica serovar Typhi Ty2
uccgcuucgcgggaccaaa

SEQ ID NO: 1761950 - RNA, 22 nt, Salmonella enterica enterica serovar Typhi Ty2
uccgcuggugcguaacguaacc

SEQ ID NO: 1761951 - RNA, 19 nt, Salmonella enterica enterica serovar Typhi Ty2
uccgggcgcaccaguuccc

SEQ ID NO: 1761952 - RNA, 19 nt, Salmonella enterica enterica serovar Typhi Ty2
uccgggauguuaauuucau

SEQ ID NO: 1761953 - RNA, 15 nt, Salmonella enterica enterica serovar Typhi Ty2
uccgguacgccuaaa

SEQ ID NO: 1761954 - RNA, 16 nt, Salmonella enterica enterica serovar Typhi Ty2
uccgguagagaacgaa

SEQ ID NO: 1761955 - RNA, 21 nt, Salmonella enterica enterica serovar Typhi Ty2
uccgguaucaugcugaugacu

SEQ ID NO: 1761956 - RNA, 19 nt, Salmonella enterica enterica serovar Typhi Ty2
uccgggucaguuuuuugac

SEQ ID NO: 1761957 - RNA, 16 nt, Salmonella enterica enterica serovar Typhi Ty2
uccgggguucgaaucc

SEQ ID NO: 1761958 - RNA, 16 nt, Salmonella enterica enterica serovar Typhi Ty2
uccggccugcagggaa

SEQ ID NO: 1761959 - RNA, 14 nt, Salmonella enterica enterica serovar Typhi Ty2
uccggccugcaggc

SEQ ID NO: 1761960 - RNA, 20 nt, Salmonella enterica enterica serovar Typhi Ty2
uccggccuacgcgucaauua

SEQ ID NO: 1761961 - RNA, 21 nt, Salmonella enterica enterica serovar Typhi Ty2
uccggccuauagcuaauggcu

SEQ ID NO: 1761962 - RNA, 18 nt, Salmonella enterica enterica serovar Typhi Ty2
uccggccuaccugagaug

SEQ ID NO: 1761963 - RNA, 17 nt, Salmonella enterica enterica serovar Typhi Ty2
uccggccuacagacugu

SEQ ID NO: 1761964 - RNA, 14 nt, Salmonella enterica enterica serovar Typhi Ty2
uccggcgcaauaag

SEQ ID NO: 1761965 - RNA, 17 nt, Salmonella enterica enterica serovar Typhi Ty2
uccggcgcugcgcggcg

SEQ ID NO: 1761966 - RNA, 23 nt, Salmonella enterica enterica serovar Typhi Ty2
uccggcgcgguauuucgccgccg

SEQ ID NO: 1761967 - RNA, 21 nt, Salmonella enterica enterica serovar Typhi Ty2
uccggcgugucagggcggaac

SEQ ID NO: 1761968 - RNA, 24 nt, Salmonella enterica enterica serovar Typhi Ty2
uccggcguuucguuuagcgccugc

SEQ ID NO: 1761969 - RNA, 11 nt, Salmonella enterica enterica serovar Typhi Ty2
uccggcugccu

SEQ ID NO: 1761970 - RNA, 16 nt, Salmonella enterica enterica serovar Typhi Ty2
uccggcuaugccggag

SEQ ID NO: 1761971 - RNA, 17 nt, Salmonella enterica enterica serovar Typhi Ty2
uccggcuacgguuuuaa

SEQ ID NO: 1761972 - RNA, 12 nt, Salmonella enterica enterica serovar Typhi Ty2
ucgcagcggcug

SEQ ID NO: 1761973 - RNA, 13 nt, Salmonella enterica enterica serovar Typhi Ty2
ucgcaggccauaa

SEQ ID NO: 1761974 - RNA, 20 nt, Salmonella enterica enterica serovar Typhi Ty2
ucgcagggcugcuggugcgc

SEQ ID NO: 1761975 - RNA, 17 nt, Salmonella enterica enterica serovar Typhi Ty2
ucgcauaaaauuauaaa

SEQ ID NO: 1761976 - RNA, 13 nt, Salmonella enterica enterica serovar Typhi Ty2
ucgcauaacuucg

SEQ ID NO: 1761977 - RNA, 15 nt, Salmonella enterica enterica serovar Typhi Ty2
ucgcagacauggcaa

SEQ ID NO: 1761978 - RNA, 15 nt, Salmonella enterica enterica serovar Typhi Ty2
ucgcagaccauccau

SEQ ID NO: 1761979 - RNA, 22 nt, Salmonella enterica enterica serovar Typhi Ty2
ucgcaacgcuuaucagucccca

SEQ ID NO: 1761980 - RNA, 20 nt, Salmonella enterica enterica serovar Typhi Ty2
ucgcaaggcgcgauccgccc

SEQ ID NO: 1761981 - RNA, 13 nt, Salmonella enterica enterica serovar Typhi Ty2
ucgcaaaauuccg

SEQ ID NO: 1761982 - RNA, 14 nt, Salmonella enterica enterica serovar Typhi Ty2
ucgcaaauaaucuu

SEQ ID NO: 1761983 - RNA, 21 nt, Salmonella enterica enterica serovar Typhi Ty2
ucgcaaagaaaucaacgaauu

SEQ ID NO: 1761984 - RNA, 23 nt, Salmonella enterica enterica serovar Typhi Ty2
ucgcacaucaugaugaucuucag

SEQ ID NO: 1761985 - RNA, 15 nt, Salmonella enterica enterica serovar Typhi Ty2
ucgcaccaccggacu

SEQ ID NO: 1761986 - RNA, 17 nt, Salmonella enterica enterica serovar Typhi Ty2
ucgcaccauagcagcca

SEQ ID NO: 1761987 - RNA, 13 nt, Salmonella enterica enterica serovar Typhi Ty2
ucgcaccauagca

SEQ ID NO: 1761988 - RNA, 18 nt, Salmonella enterica enterica serovar Typhi Ty2
ucgcacgccucuggcgua

SEQ ID NO: 1761989 - RNA, 14 nt, Salmonella enterica enterica serovar Typhi Ty2
ucgcaaugccacca

SEQ ID NO: 1761990 - RNA, 21 nt, Salmonella enterica enterica serovar Typhi Ty2
ucgcaauauaaauaucauucg

SEQ ID NO: 1761991 - RNA, 16 nt, Salmonella enterica enterica serovar Typhi Ty2
ucgauggccucaucau

SEQ ID NO: 1761992 - RNA, 21 nt, Salmonella enterica enterica serovar Typhi Ty2
ucgauuuaaugcuguaaaaga

SEQ ID NO: 1761993 - RNA, 14 nt, Salmonella enterica enterica serovar Typhi Ty2
ucgaugaaaaagag

SEQ ID NO: 1761994 - RNA, 15 nt, Salmonella enterica enterica serovar Typhi Ty2
ucgaugaaaaagagg

SEQ ID NO: 1761995 - RNA, 21 nt, Salmonella enterica enterica serovar Typhi Ty2
ucgaugagcucguuauaagcu

SEQ ID NO: 1761996 - RNA, 18 nt, Salmonella enterica enterica serovar Typhi Ty2
ucgaugcccguugucaca

SEQ ID NO: 1761997 - RNA, 21 nt, Salmonella enterica enterica serovar Typhi Ty2
ucgaugcccguugucacaggc

SEQ ID NO: 1761998 - RNA, 12 nt, Salmonella enterica enterica serovar Typhi Ty2
ucgauggcagug

SEQ ID NO: 1761999 - RNA, 19 nt, Salmonella enterica enterica serovar Typhi Ty2
ucgauaucgauaaucaaca

SEQ ID NO: 1762000 - RNA, 15 nt, Salmonella enterica enterica serovar Typhi Ty2
ucgauaucugccugc

SEQ ID NO: 1762001 - RNA, 22 nt, Salmonella enterica enterica serovar Typhi Ty2
ucgauaucugccugcagaccca

SEQ ID NO: 1762002 - RNA, 16 nt, Salmonella enterica enterica serovar Typhi Ty2
ucgauauaauuuuauu

SEQ ID NO: 1762003 - RNA, 14 nt, Salmonella enterica enterica serovar Typhi Ty2
ucgauagcauuuuu

SEQ ID NO: 1762004 - RNA, 22 nt, Salmonella enterica enterica serovar Typhi Ty2
ucgauacgauugcgcguguuac

SEQ ID NO: 1762005 - RNA, 19 nt, Salmonella enterica enterica serovar Typhi Ty2
ucgauagcguuuuccagcu

SEQ ID NO: 1762006 - RNA, 17 nt, Salmonella enterica enterica serovar Typhi Ty2
ucgauacuauaacgcuu

SEQ ID NO: 1762007 - RNA, 15 nt, Salmonella enterica enterica serovar Typhi Ty2
ucgaucagcuggcuu

SEQ ID NO: 1762008 - RNA, 16 nt, Salmonella enterica enterica serovar Typhi Ty2
ucgauaaccaccagcg

SEQ ID NO: 1762009 - RNA, 20 nt, Salmonella enterica enterica serovar Typhi Ty2
ucgauaaccuguaaauaaua

SEQ ID NO: 1762010 - RNA, 22 nt, Salmonella enterica enterica serovar Typhi Ty2
ucgaguucuugcgacaucgcau

SEQ ID NO: 1762011 - RNA, 22 nt, Salmonella enterica enterica serovar Typhi Ty2
ucgagggugggcgcacaggccu

SEQ ID NO: 1762012 - RNA, 18 nt, Salmonella enterica enterica serovar Typhi Ty2
ucgagcguaauuccggcc

SEQ ID NO: 1762013 - RNA, 15 nt, Salmonella enterica enterica serovar Typhi Ty2
ucgaggccauauuua

SEQ ID NO: 1762014 - RNA, 15 nt, Salmonella enterica enterica serovar Typhi Ty2
ucgaggacggccuga

SEQ ID NO: 1762015 - RNA, 18 nt, Salmonella enterica enterica serovar Typhi Ty2
ucgacuguuguucuucau

SEQ ID NO: 1762016 - RNA, 17 nt, Salmonella enterica enterica serovar Typhi Ty2
ucgacguuuuccaucac

SEQ ID NO: 1762017 - RNA, 19 nt, Salmonella enterica enterica serovar Typhi Ty2
ucgacgcuauuuuucaggg

SEQ ID NO: 1762018 - RNA, 13 nt, Salmonella enterica enterica serovar Typhi Ty2
ucgacggcaaccu

SEQ ID NO: 1762019 - RNA, 20 nt, Salmonella enterica enterica serovar Typhi Ty2
ucgacgggacgaauuuccag

SEQ ID NO: 1762020 - RNA, 20 nt, Salmonella enterica enterica serovar Typhi Ty2
ucgacgacaacgcccacauc

SEQ ID NO: 1762021 - RNA, 13 nt, Salmonella enterica enterica serovar Typhi Ty2
ucgacgccagcgg

SEQ ID NO: 1762022 - RNA, 15 nt, Salmonella enterica enterica serovar Typhi Ty2
ucgacaugggcggga

SEQ ID NO: 1762023 - RNA, 16 nt, Salmonella enterica enterica serovar Typhi Ty2
ucgacaguucccggca

SEQ ID NO: 1762024 - RNA, 19 nt, Salmonella enterica enterica serovar Typhi Ty2
ucgacauaguacccucugc

SEQ ID NO: 1762025 - RNA, 19 nt, Salmonella enterica enterica serovar Typhi Ty2
ucgacaucuuggcgcugcc

SEQ ID NO: 1762026 - RNA, 21 nt, Salmonella enterica enterica serovar Typhi Ty2
ucgacagccagcauuuccagc

SEQ ID NO: 1762027 - RNA, 18 nt, Salmonella enterica enterica serovar Typhi Ty2
ucgacagauuggucagca

SEQ ID NO: 1762028 - RNA, 22 nt, Salmonella enterica enterica serovar Typhi Ty2
ucgacccgcaaugugcagcagg

SEQ ID NO: 1762029 - RNA, 17 nt, Salmonella enterica enterica serovar Typhi Ty2
ucgaccgucagcagcac

SEQ ID NO: 1762030 - RNA, 17 nt, Salmonella enterica enterica serovar Typhi Ty2
ucgaccagcagcgggcu

SEQ ID NO: 1762031 - RNA, 17 nt, Salmonella enterica enterica serovar Typhi Ty2
ucgaaucgccucaacca

SEQ ID NO: 1762032 - RNA, 16 nt, Salmonella enterica enterica serovar Typhi Ty2
ucgaaucgccucaacc

SEQ ID NO: 1762033 - RNA, 14 nt, Salmonella enterica enterica serovar Typhi Ty2
ucgaaugagaacga

SEQ ID NO: 1762034 - RNA, 19 nt, Salmonella enterica enterica serovar Typhi Ty2
ucgacaauaaauugcgacc

SEQ ID NO: 1762035 - RNA, 11 nt, Salmonella enterica enterica serovar Typhi Ty2
ucgacaagcua

SEQ ID NO: 1762036 - RNA, 16 nt, Salmonella enterica enterica serovar Typhi Ty2
ucgaacgguaacagga

SEQ ID NO: 1762037 - RNA, 16 nt, Salmonella enterica enterica serovar Typhi Ty2
ucgaagagcacuuugg

SEQ ID NO: 1762038 - RNA, 15 nt, Salmonella enterica enterica serovar Typhi Ty2
ucgaagaccuggccg

SEQ ID NO: 1762039 - RNA, 20 nt, Salmonella enterica enterica serovar Typhi Ty2
ucgaaaugccuuaccuggca

SEQ ID NO: 1762040 - RNA, 18 nt, Salmonella enterica enterica serovar Typhi Ty2
ucgaaacaggaaaaacau

SEQ ID NO: 1762041 - RNA, 14 nt, Salmonella enterica enterica serovar Typhi Ty2
ucgaacaucugcgu

SEQ ID NO: 1762042 - RNA, 19 nt, Salmonella enterica enterica serovar Typhi Ty2
ucgaacagcggcaggcgga

SEQ ID NO: 1762043 - RNA, 22 nt, Salmonella enterica enterica serovar Typhi Ty2
uccuuuccugugcucgauauau

SEQ ID NO: 1762044 - RNA, 19 nt, Salmonella enterica enterica serovar Typhi Ty2
uccuuucggacuuccugua

SEQ ID NO: 1762045 - RNA, 15 nt, Salmonella enterica enterica serovar Typhi Ty2
uccuuugccuuucuu

SEQ ID NO: 1762046 - RNA, 23 nt, Salmonella enterica enterica serovar Typhi Ty2
uccuuuguuugccgcgaccacgc

SEQ ID NO: 1762047 - RNA, 15 nt, Salmonella enterica enterica serovar Typhi Ty2
uccuuuuucaggcac

SEQ ID NO: 1762048 - RNA, 23 nt, Salmonella enterica enterica serovar Typhi Ty2
uccuugcccuguuucgcaggccg

SEQ ID NO: 1762049 - RNA, 22 nt, Salmonella enterica enterica serovar Typhi Ty2
uccuugcagccagaacucaucu

SEQ ID NO: 1762050 - RNA, 20 nt, Salmonella enterica enterica serovar Typhi Ty2
uccuugccagugaaaaaaag

SEQ ID NO: 1762051 - RNA, 20 nt, Salmonella enterica enterica serovar Typhi Ty2
uccuuuaggguugacugcca

SEQ ID NO: 1762052 - RNA, 19 nt, Salmonella enterica enterica serovar Typhi Ty2
uccuuuaucugcccuuucu

SEQ ID NO: 1762053 - RNA, 19 nt, Salmonella enterica enterica serovar Typhi Ty2
uccuugcacgccaaaaagu

SEQ ID NO: 1762054 - RNA, 14 nt, Salmonella enterica enterica serovar Typhi Ty2
uccuugagugguuu

SEQ ID NO: 1762055 - RNA, 14 nt, Salmonella enterica enterica serovar Typhi Ty2
uccuucuucccccu

SEQ ID NO: 1762056 - RNA, 11 nt, Salmonella enterica enterica serovar Typhi Ty2
uccuucuuccg

SEQ ID NO: 1762057 - RNA, 16 nt, Salmonella enterica enterica serovar Typhi Ty2
uccuucuucgccguca

SEQ ID NO: 1762058 - RNA, 13 nt, Salmonella enterica enterica serovar Typhi Ty2
uccuucuuccauu

SEQ ID NO: 1762059 - RNA, 21 nt, Salmonella enterica enterica serovar Typhi Ty2
uccuuccgccggggagggaug

SEQ ID NO: 1762060 - RNA, 20 nt, Salmonella enterica enterica serovar Typhi Ty2
uccuucguuacuuucauaau

SEQ ID NO: 1762061 - RNA, 15 nt, Salmonella enterica enterica serovar Typhi Ty2
uccuucgcuuccugg

SEQ ID NO: 1762062 - RNA, 23 nt, Salmonella enterica enterica serovar Typhi Ty2
uagucuuguuacucaauaaaagu

SEQ ID NO: 1762063 - RNA, 12 nt, Salmonella enterica enterica serovar Typhi Ty2
uagucuccgcca

SEQ ID NO: 1762064 - RNA, 22 nt, Salmonella enterica enterica serovar Typhi Ty2
uagucuccugccaaugaaauaa

SEQ ID NO: 1762065 - RNA, 15 nt, Salmonella enterica enterica serovar Typhi Ty2
uagucgucuauuucc

SEQ ID NO: 1762066 - RNA, 15 nt, Salmonella enterica enterica serovar Typhi Ty2
uaguggaucagcaga

SEQ ID NO: 1762067 - RNA, 12 nt, Salmonella enterica enterica serovar Typhi Ty2
uaguggaacugu

SEQ ID NO: 1762068 - RNA, 14 nt, Salmonella enterica enterica serovar Typhi Ty2
uaguggauggccca

SEQ ID NO: 1762069 - RNA, 15 nt, Salmonella enterica enterica serovar Typhi Ty2
uaguuauaaauuuau

SEQ ID NO: 1762070 - RNA, 21 nt, Salmonella enterica enterica serovar Typhi Ty2
uaguuaucacguuccuuuacu

SEQ ID NO: 1762071 - RNA, 17 nt, Salmonella enterica enterica serovar Typhi Ty2
uacuuucaaaauacugg

SEQ ID NO: 1762072 - RNA, 21 nt, Salmonella enterica enterica serovar Typhi Ty2
uacuuucacuaccacuuucuu

SEQ ID NO: 1762073 - RNA, 11 nt, Salmonella enterica enterica serovar Typhi Ty2
uacuuuccagc

SEQ ID NO: 1762074 - RNA, 13 nt, Salmonella enterica enterica serovar Typhi Ty2
uaguaacuuacaa

SEQ ID NO: 1762075 - RNA, 22 nt, Salmonella enterica enterica serovar Typhi Ty2
uaguccucgcgcgggaaaucgu

SEQ ID NO: 1762076 - RNA, 16 nt, Salmonella enterica enterica serovar Typhi Ty2
uagucauaauuaaaaa

SEQ ID NO: 1762077 - RNA, 17 nt, Salmonella enterica enterica serovar Typhi Ty2
uagucauaauuaaaaag

SEQ ID NO: 1762078 - RNA, 16 nt, Salmonella enterica enterica serovar Typhi Ty2
uaguacgcaaggaaau

SEQ ID NO: 1762079 - RNA, 20 nt, Salmonella enterica enterica serovar Typhi Ty2
uaguacgcaaggaaauauua

SEQ ID NO: 1762080 - RNA, 13 nt, Salmonella enterica enterica serovar Typhi Ty2
uaguaccgacacc

SEQ ID NO: 1762081 - RNA, 22 nt, Salmonella enterica enterica serovar Typhi Ty2
uaguacccucugcaccagaacu

SEQ ID NO: 1762082 - RNA, 14 nt, Salmonella enterica enterica serovar Typhi Ty2
uauaaaauauuugg

SEQ ID NO: 1762083 - RNA, 17 nt, Salmonella enterica enterica serovar Typhi Ty2
uaguugaauaaccucaa

SEQ ID NO: 1762084 - RNA, 21 nt, Salmonella enterica enterica serovar Typhi Ty2
uauaagaaccaucuaccauau

SEQ ID NO: 1762085 - RNA, 21 nt, Salmonella enterica enterica serovar Typhi Ty2
uauaacccugucugcgcaacg

SEQ ID NO: 1762086 - RNA, 21 nt, Salmonella enterica enterica serovar Typhi Ty2
uauaaauauuaaugaauaaau

SEQ ID NO: 1762087 - RNA, 19 nt, Salmonella enterica enterica serovar Typhi Ty2
uauaaauauuaaugaauaa

SEQ ID NO: 1762088 - RNA, 12 nt, Salmonella enterica enterica serovar Typhi Ty2
uauaaauaucau

SEQ ID NO: 1762089 - RNA, 20 nt, Salmonella enterica enterica serovar Typhi Ty2
uauaauucgucaauaccuaa

SEQ ID NO: 1762090 - RNA, 20 nt, Salmonella enterica enterica serovar Typhi Ty2
uauaauuaacauuuaagaaa

SEQ ID NO: 1762091 - RNA, 18 nt, Salmonella enterica enterica serovar Typhi Ty2
uauaauugcuuuuuucca

SEQ ID NO: 1762092 - RNA, 20 nt, Salmonella enterica enterica serovar Typhi Ty2
uauaauugcccgcaaucucu

SEQ ID NO: 1762093 - RNA, 23 nt, Salmonella enterica enterica serovar Typhi Ty2
uauaaguacgccugaaaacagaa

SEQ ID NO: 1762094 - RNA, 18 nt, Salmonella enterica enterica serovar Typhi Ty2
uauaauuuuauuauauuu

SEQ ID NO: 1762095 - RNA, 17 nt, Salmonella enterica enterica serovar Typhi Ty2
uauaauuuuauuauauu

SEQ ID NO: 1762096 - RNA, 23 nt, Salmonella enterica enterica serovar Typhi Ty2
uauagguguaaaccguuuuuccg

SEQ ID NO: 1762097 - RNA, 13 nt, Salmonella enterica enterica serovar Typhi Ty2
uauaguaaauuga

SEQ ID NO: 1762098 - RNA, 12 nt, Salmonella enterica enterica serovar Typhi Ty2
uauauaaaaaua

SEQ ID NO: 1762099 - RNA, 14 nt, Salmonella enterica enterica serovar Typhi Ty2
uauaguuuauugaa

SEQ ID NO: 1762100 - RNA, 20 nt, Salmonella enterica enterica serovar Typhi Ty2
uauaucgcgauaaacugaca

SEQ ID NO: 1762101 - RNA, 16 nt, Salmonella enterica enterica serovar Typhi Ty2
uauaucgcgauaaacu

SEQ ID NO: 1762102 - RNA, 21 nt, Salmonella enterica enterica serovar Typhi Ty2
uauaugaaaucgccuguuaau

SEQ ID NO: 1762103 - RNA, 13 nt, Salmonella enterica enterica serovar Typhi Ty2
uauauuaguguua

SEQ ID NO: 1762104 - RNA, 19 nt, Salmonella enterica enterica serovar Typhi Ty2
uauaugcaggcauaaaaaa

SEQ ID NO: 1762105 - RNA, 18 nt, Salmonella enterica enterica serovar Typhi Ty2
uauaugcaggcauaaaaa

SEQ ID NO: 1762106 - RNA, 14 nt, Salmonella enterica enterica serovar Typhi Ty2
uauauguugaauau

SEQ ID NO: 1762107 - RNA, 22 nt, Salmonella enterica enterica serovar Typhi Ty2
uaucacacauaucgccagccau

SEQ ID NO: 1762108 - RNA, 19 nt, Salmonella enterica enterica serovar Typhi Ty2
uaucaccgcugacugaacu

SEQ ID NO: 1762109 - RNA, 13 nt, Salmonella enterica enterica serovar Typhi Ty2
uaucagacucagg

SEQ ID NO: 1762110 - RNA, 19 nt, Salmonella enterica enterica serovar Typhi Ty2
uaucagccauuaaccagau

SEQ ID NO: 1762111 - RNA, 16 nt, Salmonella enterica enterica serovar Typhi Ty2
uaucaauuucauauua

SEQ ID NO: 1762112 - RNA, 14 nt, Salmonella enterica enterica serovar Typhi Ty2
uaucaagauaaaaa

SEQ ID NO: 1762113 - RNA, 15 nt, Salmonella enterica enterica serovar Typhi Ty2
uaucaagauaaaaag

SEQ ID NO: 1762114 - RNA, 18 nt, Salmonella enterica enterica serovar Typhi Ty2
uaucggccggaugccagu

SEQ ID NO: 1762115 - RNA, 20 nt, Salmonella enterica enterica serovar Typhi Ty2
uaucggcaauauugccgcac

SEQ ID NO: 1762116 - RNA, 21 nt, Salmonella enterica enterica serovar Typhi Ty2
uaucgcugucggucagauuca

SEQ ID NO: 1762117 - RNA, 14 nt, Salmonella enterica enterica serovar Typhi Ty2
uaucgggccuacca

SEQ ID NO: 1762118 - RNA, 12 nt, Salmonella enterica enterica serovar Typhi Ty2
uaucgucuuauu

SEQ ID NO: 1762119 - RNA, 19 nt, Salmonella enterica enterica serovar Typhi Ty2
uaucguaagccaccgccca

SEQ ID NO: 1762120 - RNA, 24 nt, Salmonella enterica enterica serovar Typhi Ty2
uaucgccggcagacgauagcgggu

SEQ ID NO: 1762121 - RNA, 19 nt, Salmonella enterica enterica serovar Typhi Ty2
uaucgccgacaaacaguga

SEQ ID NO: 1762122 - RNA, 20 nt, Salmonella enterica enterica serovar Typhi Ty2
uaucgccgaaagcgaucaca

SEQ ID NO: 1762123 - RNA, 14 nt, Salmonella enterica enterica serovar Typhi Ty2
uaucgcugcccaga

SEQ ID NO: 1762124 - RNA, 14 nt, Salmonella enterica enterica serovar Typhi Ty2
uaucgcuccggaac

SEQ ID NO: 1762125 - RNA, 21 nt, Salmonella enterica enterica serovar Typhi Ty2
uaucgauaaucaacaaugucg

SEQ ID NO: 1762126 - RNA, 22 nt, Salmonella enterica enterica serovar Typhi Ty2
uaucgaauggggaaauaaauau

SEQ ID NO: 1762127 - RNA, 12 nt, Salmonella enterica enterica serovar Typhi Ty2
uauccuggccug

SEQ ID NO: 1762128 - RNA, 18 nt, Salmonella enterica enterica serovar Typhi Ty2
uauccuguaacucaucug

SEQ ID NO: 1762129 - RNA, 15 nt, Salmonella enterica enterica serovar Typhi Ty2
uauccuuaaguacaa

SEQ ID NO: 1762130 - RNA, 14 nt, Salmonella enterica enterica serovar Typhi Ty2
uauccccgcuggcg

SEQ ID NO: 1762131 - RNA, 18 nt, Salmonella enterica enterica serovar Typhi Ty2
uauccggcaaaagaggcu

SEQ ID NO: 1762132 - RNA, 16 nt, Salmonella enterica enterica serovar Typhi Ty2
uaucccugcaaacuau

SEQ ID NO: 1762133 - RNA, 15 nt, Salmonella enterica enterica serovar Typhi Ty2
uaucccauugcguuc

SEQ ID NO: 1762134 - RNA, 18 nt, Salmonella enterica enterica serovar Typhi Ty2
uauccccagucuuccugc

SEQ ID NO: 1762135 - RNA, 20 nt, Salmonella enterica enterica serovar Typhi Ty2
uauccagcgcguaaauaccu

SEQ ID NO: 1762136 - RNA, 17 nt, Salmonella enterica enterica serovar Typhi Ty2
uauccaggccagcuccg

SEQ ID NO: 1762137 - RNA, 14 nt, Salmonella enterica enterica serovar Typhi Ty2
uauccggcuuaucc

SEQ ID NO: 1762138 - RNA, 20 nt, Salmonella enterica enterica serovar Typhi Ty2
uauccggcaucacaggcuua

SEQ ID NO: 1762139 - RNA, 17 nt, Salmonella enterica enterica serovar Typhi Ty2
uauccggccugcaggca

SEQ ID NO: 1762140 - RNA, 12 nt, Salmonella enterica enterica serovar Typhi Ty2
uauccagcagcc

SEQ ID NO: 1762141 - RNA, 21 nt, Salmonella enterica enterica serovar Typhi Ty2
uauccagcacgguaaaccucu

SEQ ID NO: 1762142 - RNA, 16 nt, Salmonella enterica enterica serovar Typhi Ty2
uauccagcaguaaaua

SEQ ID NO: 1762143 - RNA, 22 nt, Salmonella enterica enterica serovar Typhi Ty2
uauccacugucgggcaaaaugc

SEQ ID NO: 1762144 - RNA, 23 nt, Salmonella enterica enterica serovar Typhi Ty2
uauccagacguuggauaacagcg

SEQ ID NO: 1762145 - RNA, 14 nt, Salmonella enterica enterica serovar Typhi Ty2
uaucagcuugccgu

SEQ ID NO: 1762146 - RNA, 19 nt, Salmonella enterica enterica serovar Typhi Ty2
uaucagcguccggagcagc

SEQ ID NO: 1762147 - RNA, 14 nt, Salmonella enterica enterica serovar Typhi Ty2
uaugcgguucuccc

SEQ ID NO: 1762148 - RNA, 22 nt, Salmonella enterica enterica serovar Typhi Ty2
uaugcggucguauuaccaaccc

SEQ ID NO: 1762149 - RNA, 19 nt, Salmonella enterica enterica serovar Typhi Ty2
uaugcgggggcaguaaauu

SEQ ID NO: 1762150 - RNA, 15 nt, Salmonella enterica enterica serovar Typhi Ty2
uaugcggcgccauca

SEQ ID NO: 1762151 - RNA, 18 nt, Salmonella enterica enterica serovar Typhi Ty2
uaugcgcuuccagcauga

SEQ ID NO: 1762152 - RNA, 21 nt, Salmonella enterica enterica serovar Typhi Ty2
uaugcuccaguuguuccagca

SEQ ID NO: 1762153 - RNA, 19 nt, Salmonella enterica enterica serovar Typhi Ty2
uaugccuggggucgucagc

SEQ ID NO: 1762154 - RNA, 21 nt, Salmonella enterica enterica serovar Typhi Ty2
uaugcgacugaaaaucaaaaa

SEQ ID NO: 1762155 - RNA, 13 nt, Salmonella enterica enterica serovar Typhi Ty2
uaugccuuccaga

SEQ ID NO: 1762156 - RNA, 21 nt, Salmonella enterica enterica serovar Typhi Ty2
uaugccuuccagaaauaaaau

SEQ ID NO: 1762157 - RNA, 23 nt, Salmonella enterica enterica serovar Typhi Ty2
uaugcccggaugauuaucaucua

SEQ ID NO: 1762158 - RNA, 20 nt, Salmonella enterica enterica serovar Typhi Ty2
uaugcccgccgcuggcgggc

SEQ ID NO: 1762159 - RNA, 22 nt, Salmonella enterica enterica serovar Typhi Ty2
uaugcccggaugauuaucaucu

SEQ ID NO: 1762160 - RNA, 16 nt, Salmonella enterica enterica serovar Typhi Ty2
uaugccgcacaaaauu

SEQ ID NO: 1762161 - RNA, 19 nt, Salmonella enterica enterica serovar Typhi Ty2
uaugccggaggauauuuau

SEQ ID NO: 1762162 - RNA, 17 nt, Salmonella enterica enterica serovar Typhi Ty2
uaugguauucgugcauc

SEQ ID NO: 1762163 - RNA, 21 nt, Salmonella enterica enterica serovar Typhi Ty2
uauggguuuccuccaucagcg

SEQ ID NO: 1762164 - RNA, 17 nt, Salmonella enterica enterica serovar Typhi Ty2
uaugggauaacgcagaa

SEQ ID NO: 1762165 - RNA, 18 nt, Salmonella enterica enterica serovar Typhi Ty2
uauggagucaugaauguc

SEQ ID NO: 1762166 - RNA, 12 nt, Salmonella enterica enterica serovar Typhi Ty2
uauggcaaugcc

SEQ ID NO: 1762167 - RNA, 13 nt, Salmonella enterica enterica serovar Typhi Ty2
uauggcaggcgaa

SEQ ID NO: 1762168 - RNA, 18 nt, Salmonella enterica enterica serovar Typhi Ty2
uaugaugccgcuucgcca

SEQ ID NO: 1762169 - RNA, 22 nt, Salmonella enterica enterica serovar Typhi Ty2
uaugaucgguuuuuuuagaacc

SEQ ID NO: 1762170 - RNA, 16 nt, Salmonella enterica enterica serovar Typhi Ty2
uaugauuauacuugcu

SEQ ID NO: 1762171 - RNA, 13 nt, Salmonella enterica enterica serovar Typhi Ty2
uaugcaugguguu

SEQ ID NO: 1762172 - RNA, 15 nt, Salmonella enterica enterica serovar Typhi Ty2
uaugauuuucuuauu

SEQ ID NO: 1762173 - RNA, 15 nt, Salmonella enterica enterica serovar Typhi Ty2
uaugauuuuaacauc

SEQ ID NO: 1762174 - RNA, 22 nt, Salmonella enterica enterica serovar Typhi Ty2
uaugcaaaagaaaaaacuuauu

SEQ ID NO: 1762175 - RNA, 16 nt, Salmonella enterica enterica serovar Typhi Ty2
uaugauuuucuuauua

SEQ ID NO: 1762176 - RNA, 18 nt, Salmonella enterica enterica serovar Typhi Ty2
uaugcagaaauggucagc

SEQ ID NO: 1762177 - RNA, 16 nt, Salmonella enterica enterica serovar Typhi Ty2
uaugaaucaucagaau

SEQ ID NO: 1762178 - RNA, 21 nt, Salmonella enterica enterica serovar Typhi Ty2
uaugauagccguucuccagcg

SEQ ID NO: 1762179 - RNA, 24 nt, Salmonella enterica enterica serovar Typhi Ty2
uaugauaagccugacuacgucaga

SEQ ID NO: 1762180 - RNA, 20 nt, Salmonella enterica enterica serovar Typhi Ty2
uaucuauuucuuagcgccag

SEQ ID NO: 1762181 - RNA, 17 nt, Salmonella enterica enterica serovar Typhi Ty2
uaucguguuauuuucaa

SEQ ID NO: 1762182 - RNA, 12 nt, Salmonella enterica enterica serovar Typhi Ty2
uaucugcugcug

SEQ ID NO: 1762183 - RNA, 22 nt, Salmonella enterica enterica serovar Typhi Ty2
uaucugaaaguaagcuauuccu

SEQ ID NO: 1762184 - RNA, 20 nt, Salmonella enterica enterica serovar Typhi Ty2
uaucucuauugcuuauuaga

SEQ ID NO: 1762185 - RNA, 15 nt, Salmonella enterica enterica serovar Typhi Ty2
uaucucucuggcgca

SEQ ID NO: 1762186 - RNA, 22 nt, Salmonella enterica enterica serovar Typhi Ty2
uaucuucaagguuaugcgcaca

SEQ ID NO: 1762187 - RNA, 18 nt, Salmonella enterica enterica serovar Typhi Ty2
uaucuguaauuauaaaua

SEQ ID NO: 1762188 - RNA, 17 nt, Salmonella enterica enterica serovar Typhi Ty2
uaucugucccagccuuc

SEQ ID NO: 1762189 - RNA, 23 nt, Salmonella enterica enterica serovar Typhi Ty2
uaucugucugcuguaauuuauaa

SEQ ID NO: 1762190 - RNA, 21 nt, Salmonella enterica enterica serovar Typhi Ty2
uaucuguugauaaaacacucu

SEQ ID NO: 1762191 - RNA, 19 nt, Salmonella enterica enterica serovar Typhi Ty2
uaucuucgauaaacucaau

SEQ ID NO: 1762192 - RNA, 22 nt, Salmonella enterica enterica serovar Typhi Ty2
uaucuucggucgagcuuuugcu

SEQ ID NO: 1762193 - RNA, 23 nt, Salmonella enterica enterica serovar Typhi Ty2
uaucuucggucgagcuuuugcug

SEQ ID NO: 1762194 - RNA, 12 nt, Salmonella enterica enterica serovar Typhi Ty2
uaucuuccagcg

SEQ ID NO: 1762195 - RNA, 20 nt, Salmonella enterica enterica serovar Typhi Ty2
uaucuucaucgguaagcgca

SEQ ID NO: 1762196 - RNA, 17 nt, Salmonella enterica enterica serovar Typhi Ty2
uaucuucauguucuaac

SEQ ID NO: 1762197 - RNA, 18 nt, Salmonella enterica enterica serovar Typhi Ty2
uaucuuccacgguaaaac

SEQ ID NO: 1762198 - RNA, 24 nt, Salmonella enterica enterica serovar Typhi Ty2
uaucuuuaccagggaauaugauuu

SEQ ID NO: 1762199 - RNA, 18 nt, Salmonella enterica enterica serovar Typhi Ty2
uaucuucgccguauucuu

SEQ ID NO: 1762200 - RNA, 18 nt, Salmonella enterica enterica serovar Typhi Ty2
uaucuugacaugaaaaau

SEQ ID NO: 1762201 - RNA, 20 nt, Salmonella enterica enterica serovar Typhi Ty2
uaugaacaggcagcguaaua

SEQ ID NO: 1762202 - RNA, 14 nt, Salmonella enterica enterica serovar Typhi Ty2
uaugaacugcauca

SEQ ID NO: 1762203 - RNA, 15 nt, Salmonella enterica enterica serovar Typhi Ty2
uaugaaauucuugcc

SEQ ID NO: 1762204 - RNA, 23 nt, Salmonella enterica enterica serovar Typhi Ty2
uaucuuugccuuuugacagcaca

SEQ ID NO: 1762205 - RNA, 14 nt, Salmonella enterica enterica serovar Typhi Ty2
uaucuuucuuuuua

SEQ ID NO: 1762206 - RNA, 13 nt, Salmonella enterica enterica serovar Typhi Ty2
uaucuuucuuuuu

SEQ ID NO: 1762207 - RNA, 17 nt, Salmonella enterica enterica serovar Typhi Ty2
uaucuuuaugucaguaa

SEQ ID NO: 1762208 - RNA, 20 nt, Salmonella enterica enterica serovar Typhi Ty2
uaucuuuuuuagucuccugc

SEQ ID NO: 1762209 - RNA, 19 nt, Salmonella enterica enterica serovar Typhi Ty2
uauuaugcguuuuuaucuu

SEQ ID NO: 1762210 - RNA, 22 nt, Salmonella enterica enterica serovar Typhi Ty2
uauuauuuugggaauggaaaca

SEQ ID NO: 1762211 - RNA, 16 nt, Salmonella enterica enterica serovar Typhi Ty2
uauucccaggcaaaug

SEQ ID NO: 1762212 - RNA, 16 nt, Salmonella enterica enterica serovar Typhi Ty2
uauucccguuccagcu

SEQ ID NO: 1762213 - RNA, 13 nt, Salmonella enterica enterica serovar Typhi Ty2
uauucuauuccuu

SEQ ID NO: 1762214 - RNA, 23 nt, Salmonella enterica enterica serovar Typhi Ty2
aaauccuggauacguuccagcag

SEQ ID NO: 1762215 - RNA, 11 nt, Salmonella enterica enterica serovar Typhi Ty2
uauugauuuuu

SEQ ID NO: 1762216 - RNA, 14 nt, Salmonella enterica enterica serovar Typhi Ty2
uauugauuuuuaaa

SEQ ID NO: 1762217 - RNA, 15 nt, Salmonella enterica enterica serovar Typhi Ty2
uauugauuuuuaaaa

SEQ ID NO: 1762218 - RNA, 19 nt, Salmonella enterica enterica serovar Typhi Ty2
uauugcaacuauuaauucu

SEQ ID NO: 1762219 - RNA, 17 nt, Salmonella enterica enterica serovar Typhi Ty2
uauugccacaauaucau

SEQ ID NO: 1762220 - RNA, 22 nt, Salmonella enterica enterica serovar Typhi Ty2
uauugcauggcaauuaaauuag

SEQ ID NO: 1762221 - RNA, 20 nt, Salmonella enterica enterica serovar Typhi Ty2
aaauccuccauaaauaacau

SEQ ID NO: 1762222 - RNA, 18 nt, Salmonella enterica enterica serovar Typhi Ty2
aaauccucccaucgagcc

SEQ ID NO: 1762223 - RNA, 17 nt, Salmonella enterica enterica serovar Typhi Ty2
aaauccucauuaguuca

SEQ ID NO: 1762224 - RNA, 16 nt, Salmonella enterica enterica serovar Typhi Ty2
aaauccucuauuuuuu

SEQ ID NO: 1762225 - RNA, 17 nt, Salmonella enterica enterica serovar Typhi Ty2
uauugaacauuuuuuca

SEQ ID NO: 1762226 - RNA, 19 nt, Salmonella enterica enterica serovar Typhi Ty2
aaauccggcugccugccgg

SEQ ID NO: 1762227 - RNA, 21 nt, Salmonella enterica enterica serovar Typhi Ty2
aaauccggcaggcagccggau

SEQ ID NO: 1762228 - RNA, 16 nt, Salmonella enterica enterica serovar Typhi Ty2
uauugaacauuuuuuc

SEQ ID NO: 1762229 - RNA, 17 nt, Salmonella enterica enterica serovar Typhi Ty2
uauuguucaugcaauuc

SEQ ID NO: 1762230 - RNA, 12 nt, Salmonella enterica enterica serovar Typhi Ty2
uauuguuuucua

SEQ ID NO: 1762231 - RNA, 22 nt, Salmonella enterica enterica serovar Typhi Ty2
uauuuaacagagagggaaaaaa

SEQ ID NO: 1762232 - RNA, 15 nt, Salmonella enterica enterica serovar Typhi Ty2
uauuguucaugcaau

SEQ ID NO: 1762233 - RNA, 18 nt, Salmonella enterica enterica serovar Typhi Ty2
uauugguaaguuuuucuc

SEQ ID NO: 1762234 - RNA, 22 nt, Salmonella enterica enterica serovar Typhi Ty2
uauugcuucguggcaaucagca

SEQ ID NO: 1762235 - RNA, 21 nt, Salmonella enterica enterica serovar Typhi Ty2
uauguaaacgcauuaauauuu

SEQ ID NO: 1762236 - RNA, 19 nt, Salmonella enterica enterica serovar Typhi Ty2
uauguaauuugcaaaccau

SEQ ID NO: 1762237 - RNA, 21 nt, Salmonella enterica enterica serovar Typhi Ty2
uaugucaguaauauauuacga

SEQ ID NO: 1762238 - RNA, 21 nt, Salmonella enterica enterica serovar Typhi Ty2
uauguuaacgccgauuaaugc

SEQ ID NO: 1762239 - RNA, 13 nt, Salmonella enterica enterica serovar Typhi Ty2
uauuauaaaauaa

SEQ ID NO: 1762240 - RNA, 11 nt, Salmonella enterica enterica serovar Typhi Ty2
uauuauaaaau

SEQ ID NO: 1762241 - RNA, 18 nt, Salmonella enterica enterica serovar Typhi Ty2
uauuaucugauucaauua

SEQ ID NO: 1762242 - RNA, 15 nt, Salmonella enterica enterica serovar Typhi Ty2
uauuaucugauucaa

SEQ ID NO: 1762243 - RNA, 21 nt, Salmonella enterica enterica serovar Typhi Ty2
uauuacagaucuugugaguaa

SEQ ID NO: 1762244 - RNA, 16 nt, Salmonella enterica enterica serovar Typhi Ty2
uauuacaacauguccu

SEQ ID NO: 1762245 - RNA, 18 nt, Salmonella enterica enterica serovar Typhi Ty2
uauuacauagaaaauaua

SEQ ID NO: 1762246 - RNA, 12 nt, Salmonella enterica enterica serovar Typhi Ty2
uauuacaaaaau

SEQ ID NO: 1762247 - RNA, 19 nt, Salmonella enterica enterica serovar Typhi Ty2
uauuaauuaaggaugaacu

SEQ ID NO: 1762248 - RNA, 14 nt, Salmonella enterica enterica serovar Typhi Ty2
uauuaaaucagaua

SEQ ID NO: 1762249 - RNA, 12 nt, Salmonella enterica enterica serovar Typhi Ty2
uauuaaauaaau

SEQ ID NO: 1762250 - RNA, 23 nt, Salmonella enterica enterica serovar Typhi Ty2
uauuaaagcacaagaacuuaaau

SEQ ID NO: 1762251 - RNA, 18 nt, Salmonella enterica enterica serovar Typhi Ty2
ucaauacagagauauuaa

SEQ ID NO: 1762252 - RNA, 17 nt, Salmonella enterica enterica serovar Typhi Ty2
ucaauaccuuaguaaaa

SEQ ID NO: 1762253 - RNA, 15 nt, Salmonella enterica enterica serovar Typhi Ty2
ucaauagcacaucag

SEQ ID NO: 1762254 - RNA, 15 nt, Salmonella enterica enterica serovar Typhi Ty2
ucaauaguuaauuaa

SEQ ID NO: 1762255 - RNA, 17 nt, Salmonella enterica enterica serovar Typhi Ty2
ucaaguuuagaaaaaau

SEQ ID NO: 1762256 - RNA, 16 nt, Salmonella enterica enterica serovar Typhi Ty2
ucaauaaccgccagca

SEQ ID NO: 1762257 - RNA, 15 nt, Salmonella enterica enterica serovar Typhi Ty2
ucaauaauauuauca

SEQ ID NO: 1762258 - RNA, 19 nt, Salmonella enterica enterica serovar Typhi Ty2
ucaauaauauuaucauaau

SEQ ID NO: 1762259 - RNA, 14 nt, Salmonella enterica enterica serovar Typhi Ty2
ucaauucuuuaauu

SEQ ID NO: 1762260 - RNA, 18 nt, Salmonella enterica enterica serovar Typhi Ty2
ucaauucuggaaucaauu

SEQ ID NO: 1762261 - RNA, 24 nt, Salmonella enterica enterica serovar Typhi Ty2
ucaauguauuguucaugcaauucc

SEQ ID NO: 1762262 - RNA, 19 nt, Salmonella enterica enterica serovar Typhi Ty2
ucaaugucugauggcgcug

SEQ ID NO: 1762263 - RNA, 19 nt, Salmonella enterica enterica serovar Typhi Ty2
ucaauuccuuuuaauuuaa

SEQ ID NO: 1762264 - RNA, 14 nt, Salmonella enterica enterica serovar Typhi Ty2
ucaauuccacaggc

SEQ ID NO: 1762265 - RNA, 20 nt, Salmonella enterica enterica serovar Typhi Ty2
ucaauccaacgaaacucagc

SEQ ID NO: 1762266 - RNA, 22 nt, Salmonella enterica enterica serovar Typhi Ty2
ucaaucacugaugccacacccu

SEQ ID NO: 1762267 - RNA, 14 nt, Salmonella enterica enterica serovar Typhi Ty2
ucaaucacuuauca

SEQ ID NO: 1762268 - RNA, 15 nt, Salmonella enterica enterica serovar Typhi Ty2
ucaaucacuuaucaa

SEQ ID NO: 1762269 - RNA, 16 nt, Salmonella enterica enterica serovar Typhi Ty2
ucaauggguuaugggu

SEQ ID NO: 1762270 - RNA, 14 nt, Salmonella enterica enterica serovar Typhi Ty2
ucaaugcacgccac

SEQ ID NO: 1762271 - RNA, 22 nt, Salmonella enterica enterica serovar Typhi Ty2
ucaauggcgcgaagugccaggu

SEQ ID NO: 1762272 - RNA, 23 nt, Salmonella enterica enterica serovar Typhi Ty2
ucaauggcgcgaagugccagguu

SEQ ID NO: 1762273 - RNA, 15 nt, Salmonella enterica enterica serovar Typhi Ty2
ucacauaucccagac

SEQ ID NO: 1762274 - RNA, 17 nt, Salmonella enterica enterica serovar Typhi Ty2
ucacauauucaauaaua

SEQ ID NO: 1762275 - RNA, 17 nt, Salmonella enterica enterica serovar Typhi Ty2
ucacaucguaaaucagc

SEQ ID NO: 1762276 - RNA, 22 nt, Salmonella enterica enterica serovar Typhi Ty2
ucacaucgccggagaucagcag

SEQ ID NO: 1762277 - RNA, 19 nt, Salmonella enterica enterica serovar Typhi Ty2
ucacaucgccggagaucag

SEQ ID NO: 1762278 - RNA, 13 nt, Salmonella enterica enterica serovar Typhi Ty2
ucacauccagccc

SEQ ID NO: 1762279 - RNA, 11 nt, Salmonella enterica enterica serovar Typhi Ty2
ucacaucauua

SEQ ID NO: 1762280 - RNA, 15 nt, Salmonella enterica enterica serovar Typhi Ty2
ucacaucgcccugau

SEQ ID NO: 1762281 - RNA, 20 nt, Salmonella enterica enterica serovar Typhi Ty2
ucacauggcgaaaaucacua

SEQ ID NO: 1762282 - RNA, 18 nt, Salmonella enterica enterica serovar Typhi Ty2
ucacaugcuuauccagcu

SEQ ID NO: 1762283 - RNA, 22 nt, Salmonella enterica enterica serovar Typhi Ty2
ucacaucguuggcgccaaaacc

SEQ ID NO: 1762284 - RNA, 18 nt, Salmonella enterica enterica serovar Typhi Ty2
ucaccaccgcaggcagcg

SEQ ID NO: 1762285 - RNA, 16 nt, Salmonella enterica enterica serovar Typhi Ty2
ucaccaccgccgcgag

SEQ ID NO: 1762286 - RNA, 22 nt, Salmonella enterica enterica serovar Typhi Ty2
ucaccacgccauagcgcuaugc

SEQ ID NO: 1762287 - RNA, 22 nt, Salmonella enterica enterica serovar Typhi Ty2
ucaccacgcgaauaccuaacag

SEQ ID NO: 1762288 - RNA, 19 nt, Salmonella enterica enterica serovar Typhi Ty2
ucaccacgggguuggcccu

SEQ ID NO: 1762289 - RNA, 20 nt, Salmonella enterica enterica serovar Typhi Ty2
ucaccacgggguuggcccuc

SEQ ID NO: 1762290 - RNA, 12 nt, Salmonella enterica enterica serovar Typhi Ty2
ucaccaggaugc

SEQ ID NO: 1762291 - RNA, 20 nt, Salmonella enterica enterica serovar Typhi Ty2
ucaccagcugacgcagcagu

SEQ ID NO: 1762292 - RNA, 24 nt, Salmonella enterica enterica serovar Typhi Ty2
ucaccaucaguagcacaacgaguc

SEQ ID NO: 1762293 - RNA, 16 nt, Salmonella enterica enterica serovar Typhi Ty2
ucaccaucauaaagcc

SEQ ID NO: 1762294 - RNA, 15 nt, Salmonella enterica enterica serovar Typhi Ty2
ucaccaucccaugau

SEQ ID NO: 1762295 - RNA, 16 nt, Salmonella enterica enterica serovar Typhi Ty2
ucaccaucccaugaug

SEQ ID NO: 1762296 - RNA, 19 nt, Salmonella enterica enterica serovar Typhi Ty2
ucaccaucguugccagcgg

SEQ ID NO: 1762297 - RNA, 18 nt, Salmonella enterica enterica serovar Typhi Ty2
ucaccaguccggcagaaa

SEQ ID NO: 1762298 - RNA, 15 nt, Salmonella enterica enterica serovar Typhi Ty2
ucaccagugauuggc

SEQ ID NO: 1762299 - RNA, 16 nt, Salmonella enterica enterica serovar Typhi Ty2
aaaucggaccuccgcg

SEQ ID NO: 1762300 - RNA, 21 nt, Salmonella enterica enterica serovar Typhi Ty2
ucacauacaaagagaaaauga

SEQ ID NO: 1762301 - RNA, 21 nt, Salmonella enterica enterica serovar Typhi Ty2
aaaucgcuauauugcugcgca

SEQ ID NO: 1762302 - RNA, 16 nt, Salmonella enterica enterica serovar Typhi Ty2
aaaucgcgcaaauauu

SEQ ID NO: 1762303 - RNA, 17 nt, Salmonella enterica enterica serovar Typhi Ty2
aaaucgcgagccuucaa

SEQ ID NO: 1762304 - RNA, 21 nt, Salmonella enterica enterica serovar Typhi Ty2
ucacauaacaaaaccagcauc

SEQ ID NO: 1762305 - RNA, 17 nt, Salmonella enterica enterica serovar Typhi Ty2
ucacagggggaacauuu

SEQ ID NO: 1762306 - RNA, 14 nt, Salmonella enterica enterica serovar Typhi Ty2
ucacaaacaccacc

SEQ ID NO: 1762307 - RNA, 15 nt, Salmonella enterica enterica serovar Typhi Ty2
ucacaaaauggcuga

SEQ ID NO: 1762308 - RNA, 14 nt, Salmonella enterica enterica serovar Typhi Ty2
ucacaggcuuauac

SEQ ID NO: 1762309 - RNA, 16 nt, Salmonella enterica enterica serovar Typhi Ty2
ucacaggcuuggcagc

SEQ ID NO: 1762310 - RNA, 15 nt, Salmonella enterica enterica serovar Typhi Ty2
ucacaggcauacaga

SEQ ID NO: 1762311 - RNA, 17 nt, Salmonella enterica enterica serovar Typhi Ty2
ucacagcgguuacgcua

SEQ ID NO: 1762312 - RNA, 14 nt, Salmonella enterica enterica serovar Typhi Ty2
ucaacaaugucgcc

SEQ ID NO: 1762313 - RNA, 18 nt, Salmonella enterica enterica serovar Typhi Ty2
ucaacaacuucaaaauag

SEQ ID NO: 1762314 - RNA, 19 nt, Salmonella enterica enterica serovar Typhi Ty2
ucaacaacuucaaaauagg

SEQ ID NO: 1762315 - RNA, 20 nt, Salmonella enterica enterica serovar Typhi Ty2
ucaacacgcagacccaggcg

SEQ ID NO: 1762316 - RNA, 14 nt, Salmonella enterica enterica serovar Typhi Ty2
ucaacauuauuaaa

SEQ ID NO: 1762317 - RNA, 18 nt, Salmonella enterica enterica serovar Typhi Ty2
ucaaccaucaaaaaaaau

SEQ ID NO: 1762318 - RNA, 15 nt, Salmonella enterica enterica serovar Typhi Ty2
ucaaccaacggcgcu

SEQ ID NO: 1762319 - RNA, 20 nt, Salmonella enterica enterica serovar Typhi Ty2
ucaaccaccaccgauaaacg

SEQ ID NO: 1762320 - RNA, 20 nt, Salmonella enterica enterica serovar Typhi Ty2
ucaaccacggauaagccagc

SEQ ID NO: 1762321 - RNA, 12 nt, Salmonella enterica enterica serovar Typhi Ty2
ucaacaucaucc

SEQ ID NO: 1762322 - RNA, 21 nt, Salmonella enterica enterica serovar Typhi Ty2
ucaacaucagcgcuaccagcg

SEQ ID NO: 1762323 - RNA, 16 nt, Salmonella enterica enterica serovar Typhi Ty2
ucaacauacgccgcca

SEQ ID NO: 1762324 - RNA, 16 nt, Salmonella enterica enterica serovar Typhi Ty2
ucaacauacugauuuc

SEQ ID NO: 1762325 - RNA, 17 nt, Salmonella enterica enterica serovar Typhi Ty2
ucaacagcgcggcagac

SEQ ID NO: 1762326 - RNA, 18 nt, Salmonella enterica enterica serovar Typhi Ty2
ucaacgcgaccggauaac

SEQ ID NO: 1762327 - RNA, 23 nt, Salmonella enterica enterica serovar Typhi Ty2
ucaacgcgccgcucacaaccguc

SEQ ID NO: 1762328 - RNA, 18 nt, Salmonella enterica enterica serovar Typhi Ty2
ucaacuucucgcaggcca

SEQ ID NO: 1762329 - RNA, 21 nt, Salmonella enterica enterica serovar Typhi Ty2
ucaacuauuaaagcacaagaa

SEQ ID NO: 1762330 - RNA, 19 nt, Salmonella enterica enterica serovar Typhi Ty2
ucaacuccugcaucgauuc

SEQ ID NO: 1762331 - RNA, 21 nt, Salmonella enterica enterica serovar Typhi Ty2
ucaacgaggugaauaaauccu

SEQ ID NO: 1762332 - RNA, 16 nt, Salmonella enterica enterica serovar Typhi Ty2
ucaacgcccugcuccc

SEQ ID NO: 1762333 - RNA, 20 nt, Salmonella enterica enterica serovar Typhi Ty2
ucaacgcccgcuuucaccau

SEQ ID NO: 1762334 - RNA, 17 nt, Salmonella enterica enterica serovar Typhi Ty2
ucaacgccuccaggcua

SEQ ID NO: 1762335 - RNA, 20 nt, Salmonella enterica enterica serovar Typhi Ty2
ucaacgccgcgcuucuggaa

SEQ ID NO: 1762336 - RNA, 18 nt, Salmonella enterica enterica serovar Typhi Ty2
ucaacccagcagcagaua

SEQ ID NO: 1762337 - RNA, 20 nt, Salmonella enterica enterica serovar Typhi Ty2
ucaacccgaucgccauccug

SEQ ID NO: 1762338 - RNA, 17 nt, Salmonella enterica enterica serovar Typhi Ty2
ucaacccagcagcagau

SEQ ID NO: 1762339 - RNA, 21 nt, Salmonella enterica enterica serovar Typhi Ty2
ucaaccagccgaucaucacga

SEQ ID NO: 1762340 - RNA, 18 nt, Salmonella enterica enterica serovar Typhi Ty2
ucaaaauggaaaauaaua

SEQ ID NO: 1762341 - RNA, 19 nt, Salmonella enterica enterica serovar Typhi Ty2
ucaaaauggaaaauaauaa

SEQ ID NO: 1762342 - RNA, 18 nt, Salmonella enterica enterica serovar Typhi Ty2
ucaaaagauugauuuauu

SEQ ID NO: 1762343 - RNA, 17 nt, Salmonella enterica enterica serovar Typhi Ty2
ucaaacacaaauuucga

SEQ ID NO: 1762344 - RNA, 14 nt, Salmonella enterica enterica serovar Typhi Ty2
ucaaacacuucuaa

SEQ ID NO: 1762345 - RNA, 21 nt, Salmonella enterica enterica serovar Typhi Ty2
ucaaacaggcugucugccaug

SEQ ID NO: 1762346 - RNA, 23 nt, Salmonella enterica enterica serovar Typhi Ty2
ucaaacucgcugccgaccuggcu

SEQ ID NO: 1762347 - RNA, 14 nt, Salmonella enterica enterica serovar Typhi Ty2
ucaaaugagaauag

SEQ ID NO: 1762348 - RNA, 17 nt, Salmonella enterica enterica serovar Typhi Ty2
ucaaaugaucguuuuuu

SEQ ID NO: 1762349 - RNA, 17 nt, Salmonella enterica enterica serovar Typhi Ty2
ucaaaugcgaaaaaaag

SEQ ID NO: 1762350 - RNA, 22 nt, Salmonella enterica enterica serovar Typhi Ty2
ucaaauguuguuugaaaaguga

SEQ ID NO: 1762351 - RNA, 20 nt, Salmonella enterica enterica serovar Typhi Ty2
ucaaauguuguuugaaaagu

SEQ ID NO: 1762352 - RNA, 12 nt, Salmonella enterica enterica serovar Typhi Ty2
ucaaaugggauc

SEQ ID NO: 1762353 - RNA, 17 nt, Salmonella enterica enterica serovar Typhi Ty2
ucaaauuccagcaauga

SEQ ID NO: 1762354 - RNA, 22 nt, Salmonella enterica enterica serovar Typhi Ty2
ucaaauagagaaaauaacaaua

SEQ ID NO: 1762355 - RNA, 17 nt, Salmonella enterica enterica serovar Typhi Ty2
ucaaauagagaaaauaa

SEQ ID NO: 1762356 - RNA, 14 nt, Salmonella enterica enterica serovar Typhi Ty2
ucaaauauauugaa

SEQ ID NO: 1762357 - RNA, 18 nt, Salmonella enterica enterica serovar Typhi Ty2
ucaaacuuuuaaauugaa

SEQ ID NO: 1762358 - RNA, 20 nt, Salmonella enterica enterica serovar Typhi Ty2
ucaaacuugcccagcgccuu

SEQ ID NO: 1762359 - RNA, 19 nt, Salmonella enterica enterica serovar Typhi Ty2
ucaaacucuuccgggcuga

SEQ ID NO: 1762360 - RNA, 18 nt, Salmonella enterica enterica serovar Typhi Ty2
ucaaagcguaccgucugg

SEQ ID NO: 1762361 - RNA, 14 nt, Salmonella enterica enterica serovar Typhi Ty2
ucacguuuuuacuc

SEQ ID NO: 1762362 - RNA, 13 nt, Salmonella enterica enterica serovar Typhi Ty2
ucacguuccccag

SEQ ID NO: 1762363 - RNA, 14 nt, Salmonella enterica enterica serovar Typhi Ty2
ucacguucgguacg

SEQ ID NO: 1762364 - RNA, 18 nt, Salmonella enterica enterica serovar Typhi Ty2
ucacgucgcgcgccgccu

SEQ ID NO: 1762365 - RNA, 19 nt, Salmonella enterica enterica serovar Typhi Ty2
ucacccggauacgcggcac

SEQ ID NO: 1762366 - RNA, 16 nt, Salmonella enterica enterica serovar Typhi Ty2
ucacccgcuuuuccug

SEQ ID NO: 1762367 - RNA, 23 nt, Salmonella enterica enterica serovar Typhi Ty2
ucacccguuauucauucacccaa

SEQ ID NO: 1762368 - RNA, 18 nt, Salmonella enterica enterica serovar Typhi Ty2
ucacccggauacgcggca

SEQ ID NO: 1762369 - RNA, 19 nt, Salmonella enterica enterica serovar Typhi Ty2
ucacgcauggcguugcugc

SEQ ID NO: 1762370 - RNA, 22 nt, Salmonella enterica enterica serovar Typhi Ty2
ucacgcauggcguugcugcaaa

SEQ ID NO: 1762371 - RNA, 22 nt, Salmonella enterica enterica serovar Typhi Ty2
ucacgcauugccacagccucag

SEQ ID NO: 1762372 - RNA, 14 nt, Salmonella enterica enterica serovar Typhi Ty2
ucacgcuuaucgcc

SEQ ID NO: 1762373 - RNA, 13 nt, Salmonella enterica enterica serovar Typhi Ty2
ucacgcuugcccg

SEQ ID NO: 1762374 - RNA, 18 nt, Salmonella enterica enterica serovar Typhi Ty2
ucacgccaucagggacga

SEQ ID NO: 1762375 - RNA, 21 nt, Salmonella enterica enterica serovar Typhi Ty2
ucacgccauuaucgaacugaa

SEQ ID NO: 1762376 - RNA, 21 nt, Salmonella enterica enterica serovar Typhi Ty2
ucacugguuauaugaauaaac

SEQ ID NO: 1762377 - RNA, 17 nt, Salmonella enterica enterica serovar Typhi Ty2
ucacuggcggcaagcug

SEQ ID NO: 1762378 - RNA, 19 nt, Salmonella enterica enterica serovar Typhi Ty2
ucacuuucagauuuuuaau

SEQ ID NO: 1762379 - RNA, 13 nt, Salmonella enterica enterica serovar Typhi Ty2
ucacuuguucaau

SEQ ID NO: 1762380 - RNA, 15 nt, Salmonella enterica enterica serovar Typhi Ty2
ucacuuguucaauau

SEQ ID NO: 1762381 - RNA, 17 nt, Salmonella enterica enterica serovar Typhi Ty2
ucacuuguucuucuguu

SEQ ID NO: 1762382 - RNA, 23 nt, Salmonella enterica enterica serovar Typhi Ty2
ucacuucugaguucggcaugggg

SEQ ID NO: 1762383 - RNA, 15 nt, Salmonella enterica enterica serovar Typhi Ty2
ucacuucaucaucau

SEQ ID NO: 1762384 - RNA, 16 nt, Salmonella enterica enterica serovar Typhi Ty2
ucagaaaaccuuugcu

SEQ ID NO: 1762385 - RNA, 22 nt, Salmonella enterica enterica serovar Typhi Ty2
ucacuuucccggaaaaguauuc

SEQ ID NO: 1762386 - RNA, 15 nt, Salmonella enterica enterica serovar Typhi Ty2
ucacuuucaucagag

SEQ ID NO: 1762387 - RNA, 19 nt, Salmonella enterica enterica serovar Typhi Ty2
ucagaaaucggcagcaccc

SEQ ID NO: 1762388 - RNA, 17 nt, Salmonella enterica enterica serovar Typhi Ty2
ucagaaccugcgauacc

SEQ ID NO: 1762389 - RNA, 15 nt, Salmonella enterica enterica serovar Typhi Ty2
ucagaagaagacaac

SEQ ID NO: 1762390 - RNA, 18 nt, Salmonella enterica enterica serovar Typhi Ty2
ucagaagcuucgcgaacu

SEQ ID NO: 1762391 - RNA, 16 nt, Salmonella enterica enterica serovar Typhi Ty2
ucagaauaugccaggg

SEQ ID NO: 1762392 - RNA, 15 nt, Salmonella enterica enterica serovar Typhi Ty2
ucagaauaugccagg

SEQ ID NO: 1762393 - RNA, 16 nt, Salmonella enterica enterica serovar Typhi Ty2
ucagaauaguuuugcc

SEQ ID NO: 1762394 - RNA, 12 nt, Salmonella enterica enterica serovar Typhi Ty2
ucagaauaaugc

SEQ ID NO: 1762395 - RNA, 13 nt, Salmonella enterica enterica serovar Typhi Ty2
ucagaauaaugcu

SEQ ID NO: 1762396 - RNA, 18 nt, Salmonella enterica enterica serovar Typhi Ty2
ucagaccgauaaauaccg

SEQ ID NO: 1762397 - RNA, 23 nt, Salmonella enterica enterica serovar Typhi Ty2
ucagaccagaaucccacggagaa

SEQ ID NO: 1762398 - RNA, 19 nt, Salmonella enterica enterica serovar Typhi Ty2
ucagaccauaguccaugcc

SEQ ID NO: 1762399 - RNA, 19 nt, Salmonella enterica enterica serovar Typhi Ty2
ucagaaucguccagauuga

SEQ ID NO: 1762400 - RNA, 22 nt, Salmonella enterica enterica serovar Typhi Ty2
ucagacacaauauugcugugcu

SEQ ID NO: 1762401 - RNA, 15 nt, Salmonella enterica enterica serovar Typhi Ty2
ucagacgcugguugu

SEQ ID NO: 1762402 - RNA, 15 nt, Salmonella enterica enterica serovar Typhi Ty2
ucagacggcugaccu

SEQ ID NO: 1762403 - RNA, 17 nt, Salmonella enterica enterica serovar Typhi Ty2
ucagacggacaucagag

SEQ ID NO: 1762404 - RNA, 13 nt, Salmonella enterica enterica serovar Typhi Ty2
ucagacgcugguu

SEQ ID NO: 1762405 - RNA, 17 nt, Salmonella enterica enterica serovar Typhi Ty2
ucagauugccacaggac

SEQ ID NO: 1762406 - RNA, 18 nt, Salmonella enterica enterica serovar Typhi Ty2
ucagauuacccucugcgu

SEQ ID NO: 1762407 - RNA, 19 nt, Salmonella enterica enterica serovar Typhi Ty2
ucagauguccaccgauuuc

SEQ ID NO: 1762408 - RNA, 20 nt, Salmonella enterica enterica serovar Typhi Ty2
ucagaucuuauaugagcggg

SEQ ID NO: 1762409 - RNA, 13 nt, Salmonella enterica enterica serovar Typhi Ty2
ucagauaaauaac

SEQ ID NO: 1762410 - RNA, 22 nt, Salmonella enterica enterica serovar Typhi Ty2
ucagauaacgaaccaucauuaa

SEQ ID NO: 1762411 - RNA, 14 nt, Salmonella enterica enterica serovar Typhi Ty2
ucagauaauucuaa

SEQ ID NO: 1762412 - RNA, 19 nt, Salmonella enterica enterica serovar Typhi Ty2
ucagauaucccaugaaacu

SEQ ID NO: 1762413 - RNA, 20 nt, Salmonella enterica enterica serovar Typhi Ty2
aaaucguuuucuaacgaggu

SEQ ID NO: 1762414 - RNA, 22 nt, Salmonella enterica enterica serovar Typhi Ty2
aaaucggucauuaauccccggc

SEQ ID NO: 1762415 - RNA, 15 nt, Salmonella enterica enterica serovar Typhi Ty2
aaaucgucaucagau

SEQ ID NO: 1762416 - RNA, 13 nt, Salmonella enterica enterica serovar Typhi Ty2
ucagcaaaugaac

SEQ ID NO: 1762417 - RNA, 18 nt, Salmonella enterica enterica serovar Typhi Ty2
ucagcaacggaagcugac

SEQ ID NO: 1762418 - RNA, 16 nt, Salmonella enterica enterica serovar Typhi Ty2
ucagcaacggaagcug

SEQ ID NO: 1762419 - RNA, 15 nt, Salmonella enterica enterica serovar Typhi Ty2
ucaguggaaaacagc

SEQ ID NO: 1762420 - RNA, 21 nt, Salmonella enterica enterica serovar Typhi Ty2
ucagugugguuucaagcggca

SEQ ID NO: 1762421 - RNA, 22 nt, Salmonella enterica enterica serovar Typhi Ty2
ucaguggcggcaaaaaauauag

SEQ ID NO: 1762422 - RNA, 16 nt, Salmonella enterica enterica serovar Typhi Ty2
ucaguaugaugaccug

SEQ ID NO: 1762423 - RNA, 23 nt, Salmonella enterica enterica serovar Typhi Ty2
ucaguaugaucaugcccggcaaa

SEQ ID NO: 1762424 - RNA, 17 nt, Salmonella enterica enterica serovar Typhi Ty2
ucaguacgucgcauacu

SEQ ID NO: 1762425 - RNA, 13 nt, Salmonella enterica enterica serovar Typhi Ty2
ucagugaacaccc

SEQ ID NO: 1762426 - RNA, 19 nt, Salmonella enterica enterica serovar Typhi Ty2
ucagguaucccgccagcgg

SEQ ID NO: 1762427 - RNA, 21 nt, Salmonella enterica enterica serovar Typhi Ty2
ucaguacgcuuuggcaggccu

SEQ ID NO: 1762428 - RNA, 19 nt, Salmonella enterica enterica serovar Typhi Ty2
ucaguacgcuuuggcaggc

SEQ ID NO: 1762429 - RNA, 20 nt, Salmonella enterica enterica serovar Typhi Ty2
ucaggugaauaccaaagccc

SEQ ID NO: 1762430 - RNA, 16 nt, Salmonella enterica enterica serovar Typhi Ty2
ucaggucuauugccua

SEQ ID NO: 1762431 - RNA, 12 nt, Salmonella enterica enterica serovar Typhi Ty2
ucaggcuuucca

SEQ ID NO: 1762432 - RNA, 21 nt, Salmonella enterica enterica serovar Typhi Ty2
ucaggcuguuguucuuuucuu

SEQ ID NO: 1762433 - RNA, 21 nt, Salmonella enterica enterica serovar Typhi Ty2
ucaggcucgucgccuuccagc

SEQ ID NO: 1762434 - RNA, 15 nt, Salmonella enterica enterica serovar Typhi Ty2
ucaggcggcugcgca

SEQ ID NO: 1762435 - RNA, 23 nt, Salmonella enterica enterica serovar Typhi Ty2
ucaggcuaucggcgggguuuaac

SEQ ID NO: 1762436 - RNA, 14 nt, Salmonella enterica enterica serovar Typhi Ty2
ucaggcggauauau

SEQ ID NO: 1762437 - RNA, 13 nt, Salmonella enterica enterica serovar Typhi Ty2
ucaggaggccuga

SEQ ID NO: 1762438 - RNA, 18 nt, Salmonella enterica enterica serovar Typhi Ty2
ucagcugacaaugugccg

SEQ ID NO: 1762439 - RNA, 22 nt, Salmonella enterica enterica serovar Typhi Ty2
ucaggaauuuaucaacaaauuc

SEQ ID NO: 1762440 - RNA, 13 nt, Salmonella enterica enterica serovar Typhi Ty2
ucagcucuucaau

SEQ ID NO: 1762441 - RNA, 14 nt, Salmonella enterica enterica serovar Typhi Ty2
ucaggcaaugucug

SEQ ID NO: 1762442 - RNA, 14 nt, Salmonella enterica enterica serovar Typhi Ty2
ucaggauauucgcc

SEQ ID NO: 1762443 - RNA, 16 nt, Salmonella enterica enterica serovar Typhi Ty2
ucaggcacgugcauaa

SEQ ID NO: 1762444 - RNA, 23 nt, Salmonella enterica enterica serovar Typhi Ty2
ucaggcacagaagcgccugucua

SEQ ID NO: 1762445 - RNA, 18 nt, Salmonella enterica enterica serovar Typhi Ty2
ucaggauaaaauccugca

SEQ ID NO: 1762446 - RNA, 15 nt, Salmonella enterica enterica serovar Typhi Ty2
ucaggcacuggcuua

SEQ ID NO: 1762447 - RNA, 14 nt, Salmonella enterica enterica serovar Typhi Ty2
ucaggcagaaauaa

SEQ ID NO: 1762448 - RNA, 13 nt, Salmonella enterica enterica serovar Typhi Ty2
ucaggcauguugc

SEQ ID NO: 1762449 - RNA, 18 nt, Salmonella enterica enterica serovar Typhi Ty2
ucaggcaucugaaaugcu

SEQ ID NO: 1762450 - RNA, 19 nt, Salmonella enterica enterica serovar Typhi Ty2
ucaggcaucugaaaugcuc

SEQ ID NO: 1762451 - RNA, 16 nt, Salmonella enterica enterica serovar Typhi Ty2
ucaggcaucugaaaug

SEQ ID NO: 1762452 - RNA, 13 nt, Salmonella enterica enterica serovar Typhi Ty2
ucaggccauuaac

SEQ ID NO: 1762453 - RNA, 17 nt, Salmonella enterica enterica serovar Typhi Ty2
ucaggcauuguugcguu

SEQ ID NO: 1762454 - RNA, 19 nt, Salmonella enterica enterica serovar Typhi Ty2
ucaggccuacacucugcgc

SEQ ID NO: 1762455 - RNA, 22 nt, Salmonella enterica enterica serovar Typhi Ty2
ucaggccuauagacaccuuaua

SEQ ID NO: 1762456 - RNA, 19 nt, Salmonella enterica enterica serovar Typhi Ty2
ucaggcgauagccguccau

SEQ ID NO: 1762457 - RNA, 12 nt, Salmonella enterica enterica serovar Typhi Ty2
ucaggccgccag

SEQ ID NO: 1762458 - RNA, 15 nt, Salmonella enterica enterica serovar Typhi Ty2
ucaggccgauuucau

SEQ ID NO: 1762459 - RNA, 17 nt, Salmonella enterica enterica serovar Typhi Ty2
ucagcagugcaaaggcc

SEQ ID NO: 1762460 - RNA, 14 nt, Salmonella enterica enterica serovar Typhi Ty2
ucagcaggcgggcu

SEQ ID NO: 1762461 - RNA, 11 nt, Salmonella enterica enterica serovar Typhi Ty2
ucagcaggagc

SEQ ID NO: 1762462 - RNA, 16 nt, Salmonella enterica enterica serovar Typhi Ty2
ucagcagcgauagacu

SEQ ID NO: 1762463 - RNA, 20 nt, Salmonella enterica enterica serovar Typhi Ty2
ucagcauauccagcgccugc

SEQ ID NO: 1762464 - RNA, 21 nt, Salmonella enterica enterica serovar Typhi Ty2
ucagcauguaccauugucaaa

SEQ ID NO: 1762465 - RNA, 20 nt, Salmonella enterica enterica serovar Typhi Ty2
ucagcaccucuuugcggccu

SEQ ID NO: 1762466 - RNA, 20 nt, Salmonella enterica enterica serovar Typhi Ty2
ucagcaccucaucgcuaccu

SEQ ID NO: 1762467 - RNA, 20 nt, Salmonella enterica enterica serovar Typhi Ty2
ucagcaauuuuguuaaaucc

SEQ ID NO: 1762468 - RNA, 18 nt, Salmonella enterica enterica serovar Typhi Ty2
ucagcaauuaacaaauaa

SEQ ID NO: 1762469 - RNA, 17 nt, Salmonella enterica enterica serovar Typhi Ty2
ucagcaauuaacaaaua

SEQ ID NO: 1762470 - RNA, 21 nt, Salmonella enterica enterica serovar Typhi Ty2
ucagcacaaaaucccacauac

SEQ ID NO: 1762471 - RNA, 16 nt, Salmonella enterica enterica serovar Typhi Ty2
ucagcacacuacacag

SEQ ID NO: 1762472 - RNA, 15 nt, Salmonella enterica enterica serovar Typhi Ty2
ucagcaauauuuugu

SEQ ID NO: 1762473 - RNA, 16 nt, Salmonella enterica enterica serovar Typhi Ty2
ucagcaagaaguuccg

SEQ ID NO: 1762474 - RNA, 13 nt, Salmonella enterica enterica serovar Typhi Ty2
ucagcaagaaguu

SEQ ID NO: 1762475 - RNA, 14 nt, Salmonella enterica enterica serovar Typhi Ty2
ucagcggcaauagc

SEQ ID NO: 1762476 - RNA, 20 nt, Salmonella enterica enterica serovar Typhi Ty2
ucagcgcguuuuccaucauc

SEQ ID NO: 1762477 - RNA, 16 nt, Salmonella enterica enterica serovar Typhi Ty2
ucagcggcagcucugc

SEQ ID NO: 1762478 - RNA, 15 nt, Salmonella enterica enterica serovar Typhi Ty2
ucagcggcagcucug

SEQ ID NO: 1762479 - RNA, 18 nt, Salmonella enterica enterica serovar Typhi Ty2
ucagcggcgcaggggcau

SEQ ID NO: 1762480 - RNA, 15 nt, Salmonella enterica enterica serovar Typhi Ty2
ucagcggccagggca

SEQ ID NO: 1762481 - RNA, 21 nt, Salmonella enterica enterica serovar Typhi Ty2
ucagcggcuugucauccugcu

SEQ ID NO: 1762482 - RNA, 13 nt, Salmonella enterica enterica serovar Typhi Ty2
ucagcgguuguuc

SEQ ID NO: 1762483 - RNA, 18 nt, Salmonella enterica enterica serovar Typhi Ty2
ucagcguaccgaagaaca

SEQ ID NO: 1762484 - RNA, 14 nt, Salmonella enterica enterica serovar Typhi Ty2
ucagcgucuuucuu

SEQ ID NO: 1762485 - RNA, 21 nt, Salmonella enterica enterica serovar Typhi Ty2
ucagcuccuuauuacauaccc

SEQ ID NO: 1762486 - RNA, 15 nt, Salmonella enterica enterica serovar Typhi Ty2
ucagcgccaccacaa

SEQ ID NO: 1762487 - RNA, 22 nt, Salmonella enterica enterica serovar Typhi Ty2
ucagcgccacgcccaacauaaa

SEQ ID NO: 1762488 - RNA, 21 nt, Salmonella enterica enterica serovar Typhi Ty2
ucagcgccacgcccaacauaa

SEQ ID NO: 1762489 - RNA, 18 nt, Salmonella enterica enterica serovar Typhi Ty2
ucagcgcuaccagcgcgg

SEQ ID NO: 1762490 - RNA, 22 nt, Salmonella enterica enterica serovar Typhi Ty2
ucagcgcguccuccaacgugca

SEQ ID NO: 1762491 - RNA, 16 nt, Salmonella enterica enterica serovar Typhi Ty2
ucagcgauucaaacuc

SEQ ID NO: 1762492 - RNA, 15 nt, Salmonella enterica enterica serovar Typhi Ty2
ucagcgcauguuagc

SEQ ID NO: 1762493 - RNA, 18 nt, Salmonella enterica enterica serovar Typhi Ty2
ucagcccggacaucaucc

SEQ ID NO: 1762494 - RNA, 21 nt, Salmonella enterica enterica serovar Typhi Ty2
ucagcccuaucgcugcgcugc

SEQ ID NO: 1762495 - RNA, 22 nt, Salmonella enterica enterica serovar Typhi Ty2
guggcgaucaguggcgccgcaa

SEQ ID NO: 1762496 - RNA, 14 nt, Salmonella enterica enterica serovar Typhi Ty2
guggcgucggcugu

SEQ ID NO: 1762497 - RNA, 15 nt, Salmonella enterica enterica serovar Typhi Ty2
guggcguuuucauua

SEQ ID NO: 1762498 - RNA, 17 nt, Salmonella enterica enterica serovar Typhi Ty2
guggcuaauuucaauuu

SEQ ID NO: 1762499 - RNA, 16 nt, Salmonella enterica enterica serovar Typhi Ty2
guggccaucuuccagc

SEQ ID NO: 1762500 - RNA, 13 nt, Salmonella enterica enterica serovar Typhi Ty2
guggccagggcag

SEQ ID NO: 1762501 - RNA, 14 nt, Salmonella enterica enterica serovar Typhi Ty2
guggccagggcagg

SEQ ID NO: 1762502 - RNA, 18 nt, Salmonella enterica enterica serovar Typhi Ty2
guggcgaacaggcucagc

SEQ ID NO: 1762503 - RNA, 19 nt, Salmonella enterica enterica serovar Typhi Ty2
guggaucucgucgccggug

SEQ ID NO: 1762504 - RNA, 15 nt, Salmonella enterica enterica serovar Typhi Ty2
guggcaaaauccaac

SEQ ID NO: 1762505 - RNA, 14 nt, Salmonella enterica enterica serovar Typhi Ty2
guggcaaaauccaa

SEQ ID NO: 1762506 - RNA, 14 nt, Salmonella enterica enterica serovar Typhi Ty2
guggcaaucagcaa

SEQ ID NO: 1762507 - RNA, 17 nt, Salmonella enterica enterica serovar Typhi Ty2
guggagggguauuuauc

SEQ ID NO: 1762508 - RNA, 18 nt, Salmonella enterica enterica serovar Typhi Ty2
guggagggguauuuaucc

SEQ ID NO: 1762509 - RNA, 23 nt, Salmonella enterica enterica serovar Typhi Ty2
gugcuggcggaaguagccuccgg

SEQ ID NO: 1762510 - RNA, 14 nt, Salmonella enterica enterica serovar Typhi Ty2
gugcuggcggccgu

SEQ ID NO: 1762511 - RNA, 14 nt, Salmonella enterica enterica serovar Typhi Ty2
gugcuggugguggg

SEQ ID NO: 1762512 - RNA, 18 nt, Salmonella enterica enterica serovar Typhi Ty2
gugcuguaccgcguccug

SEQ ID NO: 1762513 - RNA, 14 nt, Salmonella enterica enterica serovar Typhi Ty2
guggaaaacagcau

SEQ ID NO: 1762514 - RNA, 20 nt, Salmonella enterica enterica serovar Typhi Ty2
guggaaaacagcauaauaaa

SEQ ID NO: 1762515 - RNA, 17 nt, Salmonella enterica enterica serovar Typhi Ty2
gugcuggauggcagaca

SEQ ID NO: 1762516 - RNA, 21 nt, Salmonella enterica enterica serovar Typhi Ty2
guguuaccgccaccuuucugc

SEQ ID NO: 1762517 - RNA, 17 nt, Salmonella enterica enterica serovar Typhi Ty2
guguucucccugcucgg

SEQ ID NO: 1762518 - RNA, 18 nt, Salmonella enterica enterica serovar Typhi Ty2
guguggucgcggcucacc

SEQ ID NO: 1762519 - RNA, 15 nt, Salmonella enterica enterica serovar Typhi Ty2
guguggcuaucggcc

SEQ ID NO: 1762520 - RNA, 17 nt, Salmonella enterica enterica serovar Typhi Ty2
guguggcuaucggccug

SEQ ID NO: 1762521 - RNA, 14 nt, Salmonella enterica enterica serovar Typhi Ty2
guguguaccagcag

SEQ ID NO: 1762522 - RNA, 19 nt, Salmonella enterica enterica serovar Typhi Ty2
aaauauccuccgccgauaa

SEQ ID NO: 1762523 - RNA, 13 nt, Salmonella enterica enterica serovar Typhi Ty2
aaauauaugacaa

SEQ ID NO: 1762524 - RNA, 16 nt, Salmonella enterica enterica serovar Typhi Ty2
aaauauauaauuuaua

SEQ ID NO: 1762525 - RNA, 12 nt, Salmonella enterica enterica serovar Typhi Ty2
gugugaccagcg

SEQ ID NO: 1762526 - RNA, 21 nt, Salmonella enterica enterica serovar Typhi Ty2
gugguuaugaucgucaacgca

SEQ ID NO: 1762527 - RNA, 13 nt, Salmonella enterica enterica serovar Typhi Ty2
guguaccagcagc

SEQ ID NO: 1762528 - RNA, 14 nt, Salmonella enterica enterica serovar Typhi Ty2
guguaccagcagcg

SEQ ID NO: 1762529 - RNA, 14 nt, Salmonella enterica enterica serovar Typhi Ty2
gugguuucuuuuaa

SEQ ID NO: 1762530 - RNA, 21 nt, Salmonella enterica enterica serovar Typhi Ty2
gugguggucauccgcccggca

SEQ ID NO: 1762531 - RNA, 12 nt, Salmonella enterica enterica serovar Typhi Ty2
guggugugccug

SEQ ID NO: 1762532 - RNA, 17 nt, Salmonella enterica enterica serovar Typhi Ty2
guggggcuaagugagca

SEQ ID NO: 1762533 - RNA, 18 nt, Salmonella enterica enterica serovar Typhi Ty2
guggggccuaaugagcca

SEQ ID NO: 1762534 - RNA, 22 nt, Salmonella enterica enterica serovar Typhi Ty2
guggguaccucaugccggcugg

SEQ ID NO: 1762535 - RNA, 19 nt, Salmonella enterica enterica serovar Typhi Ty2
gugucguuuucacuuguuc

SEQ ID NO: 1762536 - RNA, 17 nt, Salmonella enterica enterica serovar Typhi Ty2
gugucgguacgcugguu

SEQ ID NO: 1762537 - RNA, 21 nt, Salmonella enterica enterica serovar Typhi Ty2
guguccaggucaucaccucca

SEQ ID NO: 1762538 - RNA, 19 nt, Salmonella enterica enterica serovar Typhi Ty2
gugucuuuuucaucuuuua

SEQ ID NO: 1762539 - RNA, 15 nt, Salmonella enterica enterica serovar Typhi Ty2
gugucucgucgccag

SEQ ID NO: 1762540 - RNA, 19 nt, Salmonella enterica enterica serovar Typhi Ty2
gugucaugcgguuaaacca

SEQ ID NO: 1762541 - RNA, 16 nt, Salmonella enterica enterica serovar Typhi Ty2
gugucagauccuucau

SEQ ID NO: 1762542 - RNA, 14 nt, Salmonella enterica enterica serovar Typhi Ty2
gugucacucaucgg

SEQ ID NO: 1762543 - RNA, 13 nt, Salmonella enterica enterica serovar Typhi Ty2
guucaucucuucc

SEQ ID NO: 1762544 - RNA, 16 nt, Salmonella enterica enterica serovar Typhi Ty2
guucauccugcgccau

SEQ ID NO: 1762545 - RNA, 20 nt, Salmonella enterica enterica serovar Typhi Ty2
guucaucgugaaauuauucc

SEQ ID NO: 1762546 - RNA, 21 nt, Salmonella enterica enterica serovar Typhi Ty2
guucaucgcuggcguacgcca

SEQ ID NO: 1762547 - RNA, 22 nt, Salmonella enterica enterica serovar Typhi Ty2
guucaucaggcaauaaacauca

SEQ ID NO: 1762548 - RNA, 19 nt, Salmonella enterica enterica serovar Typhi Ty2
guucaucaggccugcaaac

SEQ ID NO: 1762549 - RNA, 19 nt, Salmonella enterica enterica serovar Typhi Ty2
guucagcuacuucaggcug

SEQ ID NO: 1762550 - RNA, 20 nt, Salmonella enterica enterica serovar Typhi Ty2
guuccaccgccaauaaaaac

SEQ ID NO: 1762551 - RNA, 20 nt, Salmonella enterica enterica serovar Typhi Ty2
guuccaccgucuaucgugga

SEQ ID NO: 1762552 - RNA, 17 nt, Salmonella enterica enterica serovar Typhi Ty2
guucacgcgacggccca

SEQ ID NO: 1762553 - RNA, 20 nt, Salmonella enterica enterica serovar Typhi Ty2
guucacgccaaauaauguaa

SEQ ID NO: 1762554 - RNA, 21 nt, Salmonella enterica enterica serovar Typhi Ty2
guucaccguuuaaaaacauca

SEQ ID NO: 1762555 - RNA, 18 nt, Salmonella enterica enterica serovar Typhi Ty2
guucacgaucaccuggug

SEQ ID NO: 1762556 - RNA, 13 nt, Salmonella enterica enterica serovar Typhi Ty2
guucaccggcggc

SEQ ID NO: 1762557 - RNA, 16 nt, Salmonella enterica enterica serovar Typhi Ty2
guucagcgccugaaug

SEQ ID NO: 1762558 - RNA, 12 nt, Salmonella enterica enterica serovar Typhi Ty2
guucagccgcca

SEQ ID NO: 1762559 - RNA, 21 nt, Salmonella enterica enterica serovar Typhi Ty2
guuauugucaugcuaaaacag

SEQ ID NO: 1762560 - RNA, 22 nt, Salmonella enterica enterica serovar Typhi Ty2
guuauugugguguuccauugcu

SEQ ID NO: 1762561 - RNA, 22 nt, Salmonella enterica enterica serovar Typhi Ty2
guuauuuuccugaaaaaauucc

SEQ ID NO: 1762562 - RNA, 19 nt, Salmonella enterica enterica serovar Typhi Ty2
guuauuuucaaaaacaagg

SEQ ID NO: 1762563 - RNA, 22 nt, Salmonella enterica enterica serovar Typhi Ty2
guucaccaccacccagugccac

SEQ ID NO: 1762564 - RNA, 23 nt, Salmonella enterica enterica serovar Typhi Ty2
guucgcccggcaugacaucagaa

SEQ ID NO: 1762565 - RNA, 20 nt, Salmonella enterica enterica serovar Typhi Ty2
guucgcccuucaucuuccag

SEQ ID NO: 1762566 - RNA, 19 nt, Salmonella enterica enterica serovar Typhi Ty2
guucgcgaauuucacgcag

SEQ ID NO: 1762567 - RNA, 13 nt, Salmonella enterica enterica serovar Typhi Ty2
guucgcgacugau

SEQ ID NO: 1762568 - RNA, 24 nt, Salmonella enterica enterica serovar Typhi Ty2
guucgaaucccgucguagccacca

SEQ ID NO: 1762569 - RNA, 14 nt, Salmonella enterica enterica serovar Typhi Ty2
guucgccauccaga

SEQ ID NO: 1762570 - RNA, 23 nt, Salmonella enterica enterica serovar Typhi Ty2
guucgguauaugaaucaucagaa

SEQ ID NO: 1762571 - RNA, 18 nt, Salmonella enterica enterica serovar Typhi Ty2
guucuaaacguucaucuu

SEQ ID NO: 1762572 - RNA, 21 nt, Salmonella enterica enterica serovar Typhi Ty2
guuccugcgggaacagauaaa

SEQ ID NO: 1762573 - RNA, 22 nt, Salmonella enterica enterica serovar Typhi Ty2
guuccugcgggaacagauaaau

SEQ ID NO: 1762574 - RNA, 18 nt, Salmonella enterica enterica serovar Typhi Ty2
guuccgcuuuucuggcuu

SEQ ID NO: 1762575 - RNA, 18 nt, Salmonella enterica enterica serovar Typhi Ty2
guuccgcuaccugcgagc

SEQ ID NO: 1762576 - RNA, 23 nt, Salmonella enterica enterica serovar Typhi Ty2
guuccgcgacaaugauuugcaac

SEQ ID NO: 1762577 - RNA, 20 nt, Salmonella enterica enterica serovar Typhi Ty2
guuccgccaggcgagcacac

SEQ ID NO: 1762578 - RNA, 17 nt, Salmonella enterica enterica serovar Typhi Ty2
guuccaucacuuccugu

SEQ ID NO: 1762579 - RNA, 18 nt, Salmonella enterica enterica serovar Typhi Ty2
guuccauuccagaacgaa

SEQ ID NO: 1762580 - RNA, 14 nt, Salmonella enterica enterica serovar Typhi Ty2
guuccgaaauaaau

SEQ ID NO: 1762581 - RNA, 16 nt, Salmonella enterica enterica serovar Typhi Ty2
guuccgccagauacaa

SEQ ID NO: 1762582 - RNA, 21 nt, Salmonella enterica enterica serovar Typhi Ty2
guuagaaaauacugcuagaac

SEQ ID NO: 1762583 - RNA, 17 nt, Salmonella enterica enterica serovar Typhi Ty2
guuacucuucugaccau

SEQ ID NO: 1762584 - RNA, 17 nt, Salmonella enterica enterica serovar Typhi Ty2
guuagggcgcggcuggu

SEQ ID NO: 1762585 - RNA, 21 nt, Salmonella enterica enterica serovar Typhi Ty2
guuaccgccggcuucgucuuu

SEQ ID NO: 1762586 - RNA, 14 nt, Salmonella enterica enterica serovar Typhi Ty2
guuaccgccgagca

SEQ ID NO: 1762587 - RNA, 23 nt, Salmonella enterica enterica serovar Typhi Ty2
guuaccccuuuuucaauuuccag

SEQ ID NO: 1762588 - RNA, 19 nt, Salmonella enterica enterica serovar Typhi Ty2
guuaccccaucauugacuu

SEQ ID NO: 1762589 - RNA, 16 nt, Salmonella enterica enterica serovar Typhi Ty2
guuaccguuuaacgca

SEQ ID NO: 1762590 - RNA, 22 nt, Salmonella enterica enterica serovar Typhi Ty2
guuacucuuccuccccaggcgc

SEQ ID NO: 1762591 - RNA, 20 nt, Salmonella enterica enterica serovar Typhi Ty2
guuacucuuccuccccaggc

SEQ ID NO: 1762592 - RNA, 14 nt, Salmonella enterica enterica serovar Typhi Ty2
guuacucuuccucc

SEQ ID NO: 1762593 - RNA, 11 nt, Salmonella enterica enterica serovar Typhi Ty2
guuauaugaau

SEQ ID NO: 1762594 - RNA, 17 nt, Salmonella enterica enterica serovar Typhi Ty2
guuaucaaaaaaaacca

SEQ ID NO: 1762595 - RNA, 16 nt, Salmonella enterica enterica serovar Typhi Ty2
guuaugcauugcugau

SEQ ID NO: 1762596 - RNA, 21 nt, Salmonella enterica enterica serovar Typhi Ty2
guuaugccaucuaacacaaau

SEQ ID NO: 1762597 - RNA, 15 nt, Salmonella enterica enterica serovar Typhi Ty2
guuaucugaccuaca

SEQ ID NO: 1762598 - RNA, 21 nt, Salmonella enterica enterica serovar Typhi Ty2
guguugaaauaguuacuguuu

SEQ ID NO: 1762599 - RNA, 20 nt, Salmonella enterica enterica serovar Typhi Ty2
guuaaaccaggcgaacccca

SEQ ID NO: 1762600 - RNA, 17 nt, Salmonella enterica enterica serovar Typhi Ty2
guuaacaauauugcgcu

SEQ ID NO: 1762601 - RNA, 13 nt, Salmonella enterica enterica serovar Typhi Ty2
guuaacugcugcu

SEQ ID NO: 1762602 - RNA, 21 nt, Salmonella enterica enterica serovar Typhi Ty2
guuaacuggauauuccaguua

SEQ ID NO: 1762603 - RNA, 17 nt, Salmonella enterica enterica serovar Typhi Ty2
guuaacuggcgcaucug

SEQ ID NO: 1762604 - RNA, 16 nt, Salmonella enterica enterica serovar Typhi Ty2
guuaagaagucuguga

SEQ ID NO: 1762605 - RNA, 14 nt, Salmonella enterica enterica serovar Typhi Ty2
guuaacccaaaaac

SEQ ID NO: 1762606 - RNA, 22 nt, Salmonella enterica enterica serovar Typhi Ty2
guuaacgacccaucaauaacga

SEQ ID NO: 1762607 - RNA, 18 nt, Salmonella enterica enterica serovar Typhi Ty2
guuaacgcggccguaaua

SEQ ID NO: 1762608 - RNA, 23 nt, Salmonella enterica enterica serovar Typhi Ty2
guuaacucaagcgaauccagauc

SEQ ID NO: 1762609 - RNA, 14 nt, Salmonella enterica enterica serovar Typhi Ty2
guuaacucaaggua

SEQ ID NO: 1762610 - RNA, 21 nt, Salmonella enterica enterica serovar Typhi Ty2
guuaaugguaccaauagccuu

SEQ ID NO: 1762611 - RNA, 13 nt, Salmonella enterica enterica serovar Typhi Ty2
guuaauggaggca

SEQ ID NO: 1762612 - RNA, 16 nt, Salmonella enterica enterica serovar Typhi Ty2
guuaaugccaucauca

SEQ ID NO: 1762613 - RNA, 14 nt, Salmonella enterica enterica serovar Typhi Ty2
guuaagcauuucgc

SEQ ID NO: 1762614 - RNA, 11 nt, Salmonella enterica enterica serovar Typhi Ty2
guuaauuucuu

SEQ ID NO: 1762615 - RNA, 20 nt, Salmonella enterica enterica serovar Typhi Ty2
guuaccauccauuaaaaucu

SEQ ID NO: 1762616 - RNA, 15 nt, Salmonella enterica enterica serovar Typhi Ty2
guugagcgcauuugc

SEQ ID NO: 1762617 - RNA, 17 nt, Salmonella enterica enterica serovar Typhi Ty2
guugagcgcuugcugcg

SEQ ID NO: 1762618 - RNA, 16 nt, Salmonella enterica enterica serovar Typhi Ty2
guugaggaaauucuga

SEQ ID NO: 1762619 - RNA, 21 nt, Salmonella enterica enterica serovar Typhi Ty2
guucucgcgccaccugcacgg

SEQ ID NO: 1762620 - RNA, 14 nt, Salmonella enterica enterica serovar Typhi Ty2
guucuaucuuucag

SEQ ID NO: 1762621 - RNA, 13 nt, Salmonella enterica enterica serovar Typhi Ty2
guucucacccaug

SEQ ID NO: 1762622 - RNA, 19 nt, Salmonella enterica enterica serovar Typhi Ty2
guucuaaacguucaucuuc

SEQ ID NO: 1762623 - RNA, 14 nt, Salmonella enterica enterica serovar Typhi Ty2
guucuaacaggaag

SEQ ID NO: 1762624 - RNA, 14 nt, Salmonella enterica enterica serovar Typhi Ty2
guugauaccggagg

SEQ ID NO: 1762625 - RNA, 16 nt, Salmonella enterica enterica serovar Typhi Ty2
guugcagcccaccggc

SEQ ID NO: 1762626 - RNA, 21 nt, Salmonella enterica enterica serovar Typhi Ty2
guugcgcagcguuuccagacu

SEQ ID NO: 1762627 - RNA, 16 nt, Salmonella enterica enterica serovar Typhi Ty2
guugcgaauaaacaca

SEQ ID NO: 1762628 - RNA, 15 nt, Salmonella enterica enterica serovar Typhi Ty2
guuggcgauuuccag

SEQ ID NO: 1762629 - RNA, 18 nt, Salmonella enterica enterica serovar Typhi Ty2
guuggcgccaaaaccgcu

SEQ ID NO: 1762630 - RNA, 21 nt, Salmonella enterica enterica serovar Typhi Ty2
guugcuucuguccuuucugcu

SEQ ID NO: 1762631 - RNA, 17 nt, Salmonella enterica enterica serovar Typhi Ty2
guuggcguaccaucagc

SEQ ID NO: 1762632 - RNA, 14 nt, Salmonella enterica enterica serovar Typhi Ty2
guugcgcugguugg

SEQ ID NO: 1762633 - RNA, 14 nt, Salmonella enterica enterica serovar Typhi Ty2
guugcgcccaucau

SEQ ID NO: 1762634 - RNA, 16 nt, Salmonella enterica enterica serovar Typhi Ty2
guugcgcccaggccaa

SEQ ID NO: 1762635 - RNA, 21 nt, Salmonella enterica enterica serovar Typhi Ty2
guugcuuaccuuguucuucca

SEQ ID NO: 1762636 - RNA, 13 nt, Salmonella enterica enterica serovar Typhi Ty2
guugcuucugucc

SEQ ID NO: 1762637 - RNA, 18 nt, Salmonella enterica enterica serovar Typhi Ty2
guugcuguuccagccgcc

SEQ ID NO: 1762638 - RNA, 14 nt, Salmonella enterica enterica serovar Typhi Ty2
guugcugcaaaaga

SEQ ID NO: 1762639 - RNA, 20 nt, Salmonella enterica enterica serovar Typhi Ty2
guugcguucccuacgcccag

SEQ ID NO: 1762640 - RNA, 17 nt, Salmonella enterica enterica serovar Typhi Ty2
guugcgucaccgggcug

SEQ ID NO: 1762641 - RNA, 18 nt, Salmonella enterica enterica serovar Typhi Ty2
guuuacuaaaacgguuuu

SEQ ID NO: 1762642 - RNA, 12 nt, Salmonella enterica enterica serovar Typhi Ty2
guuuaaucgccc

SEQ ID NO: 1762643 - RNA, 19 nt, Salmonella enterica enterica serovar Typhi Ty2
guuuaauaccgcguaaaaa

SEQ ID NO: 1762644 - RNA, 19 nt, Salmonella enterica enterica serovar Typhi Ty2
guuuaaugcuuucaauacu

SEQ ID NO: 1762645 - RNA, 23 nt, Salmonella enterica enterica serovar Typhi Ty2
guuguccccucaugacuuuuuuc

SEQ ID NO: 1762646 - RNA, 14 nt, Salmonella enterica enterica serovar Typhi Ty2
guuuagaaaauaua

SEQ ID NO: 1762647 - RNA, 16 nt, Salmonella enterica enterica serovar Typhi Ty2
guuuaucaggccuaca

SEQ ID NO: 1762648 - RNA, 13 nt, Salmonella enterica enterica serovar Typhi Ty2
guuuauccagcac

SEQ ID NO: 1762649 - RNA, 21 nt, Salmonella enterica enterica serovar Typhi Ty2
guuucaacccccucagcaaug

SEQ ID NO: 1762650 - RNA, 22 nt, Salmonella enterica enterica serovar Typhi Ty2
guuucaacuuccaccaccuccu

SEQ ID NO: 1762651 - RNA, 23 nt, Salmonella enterica enterica serovar Typhi Ty2
guuucaauauagccguggcuggc

SEQ ID NO: 1762652 - RNA, 13 nt, Salmonella enterica enterica serovar Typhi Ty2
aaauaucucuccc

SEQ ID NO: 1762653 - RNA, 19 nt, Salmonella enterica enterica serovar Typhi Ty2
guuucagcaccuccagcgc

SEQ ID NO: 1762654 - RNA, 13 nt, Salmonella enterica enterica serovar Typhi Ty2
guuucaccagcac

SEQ ID NO: 1762655 - RNA, 18 nt, Salmonella enterica enterica serovar Typhi Ty2
guuucacaucgccaguua

SEQ ID NO: 1762656 - RNA, 12 nt, Salmonella enterica enterica serovar Typhi Ty2
guuucaccuucu

SEQ ID NO: 1762657 - RNA, 19 nt, Salmonella enterica enterica serovar Typhi Ty2
guuucaccguuuucgucaa

SEQ ID NO: 1762658 - RNA, 17 nt, Salmonella enterica enterica serovar Typhi Ty2
guuucacguccugguua

SEQ ID NO: 1762659 - RNA, 17 nt, Salmonella enterica enterica serovar Typhi Ty2
guuucacgcucuucgcc

SEQ ID NO: 1762660 - RNA, 14 nt, Salmonella enterica enterica serovar Typhi Ty2
guuucaucucuccg

SEQ ID NO: 1762661 - RNA, 19 nt, Salmonella enterica enterica serovar Typhi Ty2
guuucauggagauccagua

SEQ ID NO: 1762662 - RNA, 17 nt, Salmonella enterica enterica serovar Typhi Ty2
guuucaugccauacucc

SEQ ID NO: 1762663 - RNA, 14 nt, Salmonella enterica enterica serovar Typhi Ty2
guuucagugauaaa

SEQ ID NO: 1762664 - RNA, 20 nt, Salmonella enterica enterica serovar Typhi Ty2
aaauauuaaugaauaaauga

SEQ ID NO: 1762665 - RNA, 15 nt, Salmonella enterica enterica serovar Typhi Ty2
aaaucauaccagcga

SEQ ID NO: 1762666 - RNA, 12 nt, Salmonella enterica enterica serovar Typhi Ty2
aaaucagacuaa

SEQ ID NO: 1762667 - RNA, 13 nt, Salmonella enterica enterica serovar Typhi Ty2
aaaucaucaaugg

SEQ ID NO: 1762668 - RNA, 19 nt, Salmonella enterica enterica serovar Typhi Ty2
aaaucaucaauggcgauuu

SEQ ID NO: 1762669 - RNA, 24 nt, Salmonella enterica enterica serovar Typhi Ty2
aaaucaucaaucgcuaucugacag

SEQ ID NO: 1762670 - RNA, 22 nt, Salmonella enterica enterica serovar Typhi Ty2
aaaucauuacuuauauuuauuu

SEQ ID NO: 1762671 - RNA, 17 nt, Salmonella enterica enterica serovar Typhi Ty2
aaauccacaaccggcug

SEQ ID NO: 1762672 - RNA, 20 nt, Salmonella enterica enterica serovar Typhi Ty2
guuuuauugcuucagccaga

SEQ ID NO: 1762673 - RNA, 12 nt, Salmonella enterica enterica serovar Typhi Ty2
guuuugcucagu

SEQ ID NO: 1762674 - RNA, 14 nt, Salmonella enterica enterica serovar Typhi Ty2
guuuugcccauuuc

SEQ ID NO: 1762675 - RNA, 19 nt, Salmonella enterica enterica serovar Typhi Ty2
guuucucuugugcuuccag

SEQ ID NO: 1762676 - RNA, 19 nt, Salmonella enterica enterica serovar Typhi Ty2
guuucucuuccgccagcgc

SEQ ID NO: 1762677 - RNA, 13 nt, Salmonella enterica enterica serovar Typhi Ty2
guuucuucaucaa

SEQ ID NO: 1762678 - RNA, 18 nt, Salmonella enterica enterica serovar Typhi Ty2
guuucuggcaacagccau

SEQ ID NO: 1762679 - RNA, 19 nt, Salmonella enterica enterica serovar Typhi Ty2
guuugaggcuugcagcauu

SEQ ID NO: 1762680 - RNA, 21 nt, Salmonella enterica enterica serovar Typhi Ty2
guuugaggaaaccuuucuucu

SEQ ID NO: 1762681 - RNA, 15 nt, Salmonella enterica enterica serovar Typhi Ty2
guuugaucauggcuc

SEQ ID NO: 1762682 - RNA, 23 nt, Salmonella enterica enterica serovar Typhi Ty2
guuugaggaaaccuuucuucucu

SEQ ID NO: 1762683 - RNA, 15 nt, Salmonella enterica enterica serovar Typhi Ty2
guuucuucgcuggcg

SEQ ID NO: 1762684 - RNA, 18 nt, Salmonella enterica enterica serovar Typhi Ty2
guuugugguugguagccc

SEQ ID NO: 1762685 - RNA, 22 nt, Salmonella enterica enterica serovar Typhi Ty2
guuuuacuuuuuuaaauguuuu

SEQ ID NO: 1762686 - RNA, 20 nt, Salmonella enterica enterica serovar Typhi Ty2
guuuuagcagaguaugcugc

SEQ ID NO: 1762687 - RNA, 19 nt, Salmonella enterica enterica serovar Typhi Ty2
guuuuacgaugguugugug

SEQ ID NO: 1762688 - RNA, 18 nt, Salmonella enterica enterica serovar Typhi Ty2
guuugcggauuggauaaa

SEQ ID NO: 1762689 - RNA, 12 nt, Salmonella enterica enterica serovar Typhi Ty2
guuugcgcgucg

SEQ ID NO: 1762690 - RNA, 14 nt, Salmonella enterica enterica serovar Typhi Ty2
guuugucauccaga

SEQ ID NO: 1762691 - RNA, 14 nt, Salmonella enterica enterica serovar Typhi Ty2
guuucggcauccca

SEQ ID NO: 1762692 - RNA, 14 nt, Salmonella enterica enterica serovar Typhi Ty2
guuucgccagcgcg

SEQ ID NO: 1762693 - RNA, 13 nt, Salmonella enterica enterica serovar Typhi Ty2
guuucgccagcgc

SEQ ID NO: 1762694 - RNA, 15 nt, Salmonella enterica enterica serovar Typhi Ty2
guuucgccgcagggu

SEQ ID NO: 1762695 - RNA, 18 nt, Salmonella enterica enterica serovar Typhi Ty2
guuucgacaguuucuucu

SEQ ID NO: 1762696 - RNA, 17 nt, Salmonella enterica enterica serovar Typhi Ty2
guuucgacgggagguga

SEQ ID NO: 1762697 - RNA, 21 nt, Salmonella enterica enterica serovar Typhi Ty2
aaaucacagggggaacauuua

SEQ ID NO: 1762698 - RNA, 15 nt, Salmonella enterica enterica serovar Typhi Ty2
aaaucacgcuggaua

SEQ ID NO: 1762699 - RNA, 18 nt, Salmonella enterica enterica serovar Typhi Ty2
aaaucacccaacguucau

SEQ ID NO: 1762700 - RNA, 22 nt, Salmonella enterica enterica serovar Typhi Ty2
aaaucacuggagcgcauuuuac

SEQ ID NO: 1762701 - RNA, 14 nt, Salmonella enterica enterica serovar Typhi Ty2
guuucuacggccac

SEQ ID NO: 1762702 - RNA, 15 nt, Salmonella enterica enterica serovar Typhi Ty2
guuucuacaauagag

SEQ ID NO: 1762703 - RNA, 19 nt, Salmonella enterica enterica serovar Typhi Ty2
guuucucccgccagaugca

SEQ ID NO: 1762704 - RNA, 22 nt, Salmonella enterica enterica serovar Typhi Ty2
aaaucaacgaaaucagagacaa

SEQ ID NO: 1762705 - RNA, 16 nt, Salmonella enterica enterica serovar Typhi Ty2
aaaucaacauacugau

SEQ ID NO: 1762706 - RNA, 13 nt, Salmonella enterica enterica serovar Typhi Ty2
aaaucaaauaaga

SEQ ID NO: 1762707 - RNA, 16 nt, Salmonella enterica enterica serovar Typhi Ty2
aaaucaaacagaauau

SEQ ID NO: 1762708 - RNA, 19 nt, Salmonella enterica enterica serovar Typhi Ty2
guuuccgcuagggcaucag

SEQ ID NO: 1762709 - RNA, 14 nt, Salmonella enterica enterica serovar Typhi Ty2
guuuccggcgggag

SEQ ID NO: 1762710 - RNA, 22 nt, Salmonella enterica enterica serovar Typhi Ty2
guuuccguuuguaacauauuuu

SEQ ID NO: 1762711 - RNA, 19 nt, Salmonella enterica enterica serovar Typhi Ty2
guuuccggcauccagcgcu

SEQ ID NO: 1762712 - RNA, 21 nt, Salmonella enterica enterica serovar Typhi Ty2
guuuccguuuguaacauauuu

SEQ ID NO: 1762713 - RNA, 22 nt, Salmonella enterica enterica serovar Typhi Ty2
guuucccauugggccagcagcg

SEQ ID NO: 1762714 - RNA, 20 nt, Salmonella enterica enterica serovar Typhi Ty2
guuucccauugggccagcag

SEQ ID NO: 1762715 - RNA, 21 nt, Salmonella enterica enterica serovar Typhi Ty2
guuucccccuccauacccuau

SEQ ID NO: 1762716 - RNA, 12 nt, Salmonella enterica enterica serovar Typhi Ty2
guuucccugacc

SEQ ID NO: 1762717 - RNA, 16 nt, Salmonella enterica enterica serovar Typhi Ty2
guuucccucauauuug

SEQ ID NO: 1762718 - RNA, 21 nt, Salmonella enterica enterica serovar Typhi Ty2
aaauauuggcggcaaagaaaa

SEQ ID NO: 1762719 - RNA, 19 nt, Salmonella enterica enterica serovar Typhi Ty2
aaauauugcccguuuuaau

SEQ ID NO: 1762720 - RNA, 17 nt, Salmonella enterica enterica serovar Typhi Ty2
guuuccacugagcuuca

SEQ ID NO: 1762721 - RNA, 14 nt, Salmonella enterica enterica serovar Typhi Ty2
guuuccagugcagc

SEQ ID NO: 1762722 - RNA, 18 nt, Salmonella enterica enterica serovar Typhi Ty2
gugaacgccaaauacguc

SEQ ID NO: 1762723 - RNA, 17 nt, Salmonella enterica enterica serovar Typhi Ty2
gugaacgccuccauuuu

SEQ ID NO: 1762724 - RNA, 16 nt, Salmonella enterica enterica serovar Typhi Ty2
gugaagacgacgggaa

SEQ ID NO: 1762725 - RNA, 15 nt, Salmonella enterica enterica serovar Typhi Ty2
gugaagauuagcaga

SEQ ID NO: 1762726 - RNA, 19 nt, Salmonella enterica enterica serovar Typhi Ty2
gugaacgcacgcagccaac

SEQ ID NO: 1762727 - RNA, 12 nt, Salmonella enterica enterica serovar Typhi Ty2
gugaaccauggc

SEQ ID NO: 1762728 - RNA, 15 nt, Salmonella enterica enterica serovar Typhi Ty2
gugaaccauggcaac

SEQ ID NO: 1762729 - RNA, 20 nt, Salmonella enterica enterica serovar Typhi Ty2
gugaaccauggcaacaugga

SEQ ID NO: 1762730 - RNA, 14 nt, Salmonella enterica enterica serovar Typhi Ty2
gugaauauggaaag

SEQ ID NO: 1762731 - RNA, 16 nt, Salmonella enterica enterica serovar Typhi Ty2
gugaauaccagcggca

SEQ ID NO: 1762732 - RNA, 18 nt, Salmonella enterica enterica serovar Typhi Ty2
gugaauagguauguagua

SEQ ID NO: 1762733 - RNA, 13 nt, Salmonella enterica enterica serovar Typhi Ty2
gugaauaaauccu

SEQ ID NO: 1762734 - RNA, 12 nt, Salmonella enterica enterica serovar Typhi Ty2
gugaaggcaaaa

SEQ ID NO: 1762735 - RNA, 21 nt, Salmonella enterica enterica serovar Typhi Ty2
gugaaggcaaaacaccauauu

SEQ ID NO: 1762736 - RNA, 13 nt, Salmonella enterica enterica serovar Typhi Ty2
gugaauuucugcu

SEQ ID NO: 1762737 - RNA, 16 nt, Salmonella enterica enterica serovar Typhi Ty2
gugacaaucuccuccg

SEQ ID NO: 1762738 - RNA, 19 nt, Salmonella enterica enterica serovar Typhi Ty2
gugaaucgacggcaauauu

SEQ ID NO: 1762739 - RNA, 13 nt, Salmonella enterica enterica serovar Typhi Ty2
gugaauauucaga

SEQ ID NO: 1762740 - RNA, 17 nt, Salmonella enterica enterica serovar Typhi Ty2
gugaaugcacuguuucu

SEQ ID NO: 1762741 - RNA, 14 nt, Salmonella enterica enterica serovar Typhi Ty2
gugaauguccugcg

SEQ ID NO: 1762742 - RNA, 20 nt, Salmonella enterica enterica serovar Typhi Ty2
gugaccccggccucgcccgc

SEQ ID NO: 1762743 - RNA, 15 nt, Salmonella enterica enterica serovar Typhi Ty2
gugaccgauaaaaaa

SEQ ID NO: 1762744 - RNA, 21 nt, Salmonella enterica enterica serovar Typhi Ty2
gugaccgguaagcccauggca

SEQ ID NO: 1762745 - RNA, 17 nt, Salmonella enterica enterica serovar Typhi Ty2
gugaccgccuuaaaauu

SEQ ID NO: 1762746 - RNA, 22 nt, Salmonella enterica enterica serovar Typhi Ty2
gugacggcggaaauuagcccgc

SEQ ID NO: 1762747 - RNA, 13 nt, Salmonella enterica enterica serovar Typhi Ty2
gugacgccaggca

SEQ ID NO: 1762748 - RNA, 19 nt, Salmonella enterica enterica serovar Typhi Ty2
gugacgccgccauccggua

SEQ ID NO: 1762749 - RNA, 20 nt, Salmonella enterica enterica serovar Typhi Ty2
gugacgccaugcaaaaaaga

SEQ ID NO: 1762750 - RNA, 21 nt, Salmonella enterica enterica serovar Typhi Ty2
aaauaguauaacgaugauuau

SEQ ID NO: 1762751 - RNA, 17 nt, Salmonella enterica enterica serovar Typhi Ty2
aaauagugacuucugcu

SEQ ID NO: 1762752 - RNA, 18 nt, Salmonella enterica enterica serovar Typhi Ty2
aaauaguaaauagaaaau

SEQ ID NO: 1762753 - RNA, 14 nt, Salmonella enterica enterica serovar Typhi Ty2
gugauaaagcccgu

SEQ ID NO: 1762754 - RNA, 16 nt, Salmonella enterica enterica serovar Typhi Ty2
gugauaaagcagacca

SEQ ID NO: 1762755 - RNA, 12 nt, Salmonella enterica enterica serovar Typhi Ty2
gugauaauagug

SEQ ID NO: 1762756 - RNA, 16 nt, Salmonella enterica enterica serovar Typhi Ty2
gugaguuucgcaucag

SEQ ID NO: 1762757 - RNA, 19 nt, Salmonella enterica enterica serovar Typhi Ty2
gugaguguuacucuuccuc

SEQ ID NO: 1762758 - RNA, 20 nt, Salmonella enterica enterica serovar Typhi Ty2
gugaguggcggcgcgcaggc

SEQ ID NO: 1762759 - RNA, 15 nt, Salmonella enterica enterica serovar Typhi Ty2
gugaguacgcaggag

SEQ ID NO: 1762760 - RNA, 18 nt, Salmonella enterica enterica serovar Typhi Ty2
gugaguaauaacaaaaaa

SEQ ID NO: 1762761 - RNA, 16 nt, Salmonella enterica enterica serovar Typhi Ty2
gugaguaaagagauca

SEQ ID NO: 1762762 - RNA, 14 nt, Salmonella enterica enterica serovar Typhi Ty2
gugagcucuuucug

SEQ ID NO: 1762763 - RNA, 21 nt, Salmonella enterica enterica serovar Typhi Ty2
gugaggcaucgcccuguaaga

SEQ ID NO: 1762764 - RNA, 23 nt, Salmonella enterica enterica serovar Typhi Ty2
gugagaucguuauuaaacagaca

SEQ ID NO: 1762765 - RNA, 23 nt, Salmonella enterica enterica serovar Typhi Ty2
gugagcccuccuccagcgcgucc

SEQ ID NO: 1762766 - RNA, 14 nt, Salmonella enterica enterica serovar Typhi Ty2
gugagcgaacaggu

SEQ ID NO: 1762767 - RNA, 21 nt, Salmonella enterica enterica serovar Typhi Ty2
gugagacgcagccucucuucu

SEQ ID NO: 1762768 - RNA, 17 nt, Salmonella enterica enterica serovar Typhi Ty2
gugacuaauagccaaaa

SEQ ID NO: 1762769 - RNA, 18 nt, Salmonella enterica enterica serovar Typhi Ty2
gugauuuacuccaaaaau

SEQ ID NO: 1762770 - RNA, 18 nt, Salmonella enterica enterica serovar Typhi Ty2
gugcaagcccaacuauuu

SEQ ID NO: 1762771 - RNA, 18 nt, Salmonella enterica enterica serovar Typhi Ty2
gugaucggagaaauagac

SEQ ID NO: 1762772 - RNA, 22 nt, Salmonella enterica enterica serovar Typhi Ty2
gugauaaauacgcugcggccug

SEQ ID NO: 1762773 - RNA, 15 nt, Salmonella enterica enterica serovar Typhi Ty2
gugaucugguuuggu

SEQ ID NO: 1762774 - RNA, 20 nt, Salmonella enterica enterica serovar Typhi Ty2
gugcaaugucaugacugguu

SEQ ID NO: 1762775 - RNA, 23 nt, Salmonella enterica enterica serovar Typhi Ty2
gugcaaucccggaacagcggagc

SEQ ID NO: 1762776 - RNA, 14 nt, Salmonella enterica enterica serovar Typhi Ty2
gugcagaacaucaa

SEQ ID NO: 1762777 - RNA, 17 nt, Salmonella enterica enterica serovar Typhi Ty2
gugcagcguuuccagcc

SEQ ID NO: 1762778 - RNA, 15 nt, Salmonella enterica enterica serovar Typhi Ty2
gugcagaccucugca

SEQ ID NO: 1762779 - RNA, 16 nt, Salmonella enterica enterica serovar Typhi Ty2
gugcaggaucaaccgg

SEQ ID NO: 1762780 - RNA, 15 nt, Salmonella enterica enterica serovar Typhi Ty2
gugcaggagcaguga

SEQ ID NO: 1762781 - RNA, 20 nt, Salmonella enterica enterica serovar Typhi Ty2
gugcaggauuuguaucacaa

SEQ ID NO: 1762782 - RNA, 18 nt, Salmonella enterica enterica serovar Typhi Ty2
gugaaauuauuccuuauc

SEQ ID NO: 1762783 - RNA, 21 nt, Salmonella enterica enterica serovar Typhi Ty2
gugaaauuauuccuuaucaca

SEQ ID NO: 1762784 - RNA, 16 nt, Salmonella enterica enterica serovar Typhi Ty2
gugaacaccacugaaa

SEQ ID NO: 1762785 - RNA, 19 nt, Salmonella enterica enterica serovar Typhi Ty2
gugaacauuacaauguaca

SEQ ID NO: 1762786 - RNA, 14 nt, Salmonella enterica enterica serovar Typhi Ty2
gugaaaagcuuaga

SEQ ID NO: 1762787 - RNA, 19 nt, Salmonella enterica enterica serovar Typhi Ty2
gugaaacagguuuaaacga

SEQ ID NO: 1762788 - RNA, 17 nt, Salmonella enterica enterica serovar Typhi Ty2
gugaaagcgcuugauaa

SEQ ID NO: 1762789 - RNA, 14 nt, Salmonella enterica enterica serovar Typhi Ty2
gugaaacuguuuua

SEQ ID NO: 1762790 - RNA, 11 nt, Salmonella enterica enterica serovar Typhi Ty2
gugaaauaaau

SEQ ID NO: 1762791 - RNA, 12 nt, Salmonella enterica enterica serovar Typhi Ty2
gucuuuuauccc

SEQ ID NO: 1762792 - RNA, 18 nt, Salmonella enterica enterica serovar Typhi Ty2
gucuuuguugguauucau

SEQ ID NO: 1762793 - RNA, 16 nt, Salmonella enterica enterica serovar Typhi Ty2
gucuuuguugccuucg

SEQ ID NO: 1762794 - RNA, 15 nt, Salmonella enterica enterica serovar Typhi Ty2
gucuuuuucaucuuu

SEQ ID NO: 1762795 - RNA, 13 nt, Salmonella enterica enterica serovar Typhi Ty2
gucuuuuucucaa

SEQ ID NO: 1762796 - RNA, 21 nt, Salmonella enterica enterica serovar Typhi Ty2
gucuuuugaauaguaacuggc

SEQ ID NO: 1762797 - RNA, 23 nt, Salmonella enterica enterica serovar Typhi Ty2
gugaaaaagcggcuguagccagc

SEQ ID NO: 1762798 - RNA, 22 nt, Salmonella enterica enterica serovar Typhi Ty2
gucuuugcguuuacuuacaaau

SEQ ID NO: 1762799 - RNA, 23 nt, Salmonella enterica enterica serovar Typhi Ty2
gucuuuccgacccuuaugucauu

SEQ ID NO: 1762800 - RNA, 22 nt, Salmonella enterica enterica serovar Typhi Ty2
gucuugucaggcucuaauaacu

SEQ ID NO: 1762801 - RNA, 15 nt, Salmonella enterica enterica serovar Typhi Ty2
gucugucgguaaaga

SEQ ID NO: 1762802 - RNA, 13 nt, Salmonella enterica enterica serovar Typhi Ty2
gucuuaaauauga

SEQ ID NO: 1762803 - RNA, 22 nt, Salmonella enterica enterica serovar Typhi Ty2
gucuguuuugccuugccacgca

SEQ ID NO: 1762804 - RNA, 21 nt, Salmonella enterica enterica serovar Typhi Ty2
gucuguucguagcccauagca

SEQ ID NO: 1762805 - RNA, 21 nt, Salmonella enterica enterica serovar Typhi Ty2
gucuguuucaacgcauccagc

SEQ ID NO: 1762806 - RNA, 17 nt, Salmonella enterica enterica serovar Typhi Ty2
gucuuacacuuagcaca

SEQ ID NO: 1762807 - RNA, 18 nt, Salmonella enterica enterica serovar Typhi Ty2
gucuucaucagccagcau

SEQ ID NO: 1762808 - RNA, 14 nt, Salmonella enterica enterica serovar Typhi Ty2
gucuucaucagcca

SEQ ID NO: 1762809 - RNA, 11 nt, Salmonella enterica enterica serovar Typhi Ty2
gucuuccagca

SEQ ID NO: 1762810 - RNA, 23 nt, Salmonella enterica enterica serovar Typhi Ty2
gucuucuucuucgcgcauuucug

SEQ ID NO: 1762811 - RNA, 23 nt, Salmonella enterica enterica serovar Typhi Ty2
gucuugauuucaggugcuuaucu

SEQ ID NO: 1762812 - RNA, 12 nt, Salmonella enterica enterica serovar Typhi Ty2
gucuugccuguc

SEQ ID NO: 1762813 - RNA, 21 nt, Salmonella enterica enterica serovar Typhi Ty2
gucuugguauggauggcuggg

SEQ ID NO: 1762814 - RNA, 16 nt, Salmonella enterica enterica serovar Typhi Ty2
gucuuccuucguuacu

SEQ ID NO: 1762815 - RNA, 16 nt, Salmonella enterica enterica serovar Typhi Ty2
gucuucgaccgccaua

SEQ ID NO: 1762816 - RNA, 13 nt, Salmonella enterica enterica serovar Typhi Ty2
gucuuccugcggu

SEQ ID NO: 1762817 - RNA, 18 nt, Salmonella enterica enterica serovar Typhi Ty2
gucgugcaaccgccugca

SEQ ID NO: 1762818 - RNA, 14 nt, Salmonella enterica enterica serovar Typhi Ty2
gucgugccuuccgc

SEQ ID NO: 1762819 - RNA, 15 nt, Salmonella enterica enterica serovar Typhi Ty2
gucguuaccgggcug

SEQ ID NO: 1762820 - RNA, 16 nt, Salmonella enterica enterica serovar Typhi Ty2
gucguuccgccaggcg

SEQ ID NO: 1762821 - RNA, 20 nt, Salmonella enterica enterica serovar Typhi Ty2
gucucagauggaaaaaaaga

SEQ ID NO: 1762822 - RNA, 19 nt, Salmonella enterica enterica serovar Typhi Ty2
gucucagauggaaaaaaag

SEQ ID NO: 1762823 - RNA, 15 nt, Salmonella enterica enterica serovar Typhi Ty2
gucucagguucgaau

SEQ ID NO: 1762824 - RNA, 20 nt, Salmonella enterica enterica serovar Typhi Ty2
gucuccagcucauuuuuaca

SEQ ID NO: 1762825 - RNA, 19 nt, Salmonella enterica enterica serovar Typhi Ty2
gucuccugccaaugaaaua

SEQ ID NO: 1762826 - RNA, 15 nt, Salmonella enterica enterica serovar Typhi Ty2
gucuccucagcaggc

SEQ ID NO: 1762827 - RNA, 15 nt, Salmonella enterica enterica serovar Typhi Ty2
gucuccucaugccuc

SEQ ID NO: 1762828 - RNA, 13 nt, Salmonella enterica enterica serovar Typhi Ty2
gucucccuccugc

SEQ ID NO: 1762829 - RNA, 14 nt, Salmonella enterica enterica serovar Typhi Ty2
gucucggccuggcc

SEQ ID NO: 1762830 - RNA, 13 nt, Salmonella enterica enterica serovar Typhi Ty2
gucucucccucaa

SEQ ID NO: 1762831 - RNA, 18 nt, Salmonella enterica enterica serovar Typhi Ty2
gucucucccgaucuucug

SEQ ID NO: 1762832 - RNA, 13 nt, Salmonella enterica enterica serovar Typhi Ty2
gucugaaaauaau

SEQ ID NO: 1762833 - RNA, 14 nt, Salmonella enterica enterica serovar Typhi Ty2
gucucuucuuccgc

SEQ ID NO: 1762834 - RNA, 20 nt, Salmonella enterica enterica serovar Typhi Ty2
gucucuucaugcauaaccgc

SEQ ID NO: 1762835 - RNA, 18 nt, Salmonella enterica enterica serovar Typhi Ty2
gucugcgcccaccgggag

SEQ ID NO: 1762836 - RNA, 20 nt, Salmonella enterica enterica serovar Typhi Ty2
gucugaaggcguaugaauga

SEQ ID NO: 1762837 - RNA, 23 nt, Salmonella enterica enterica serovar Typhi Ty2
gucugaaucagugcaucuucacu

SEQ ID NO: 1762838 - RNA, 14 nt, Salmonella enterica enterica serovar Typhi Ty2
gucugaaucugcuc

SEQ ID NO: 1762839 - RNA, 18 nt, Salmonella enterica enterica serovar Typhi Ty2
gucugaagaaguucuucu

SEQ ID NO: 1762840 - RNA, 16 nt, Salmonella enterica enterica serovar Typhi Ty2
gucugagcgcaaacau

SEQ ID NO: 1762841 - RNA, 13 nt, Salmonella enterica enterica serovar Typhi Ty2
gucugaccgggcg

SEQ ID NO: 1762842 - RNA, 15 nt, Salmonella enterica enterica serovar Typhi Ty2
gucugaaucugcucc

SEQ ID NO: 1762843 - RNA, 13 nt, Salmonella enterica enterica serovar Typhi Ty2
gucuggggaacaa

SEQ ID NO: 1762844 - RNA, 19 nt, Salmonella enterica enterica serovar Typhi Ty2
gucuggcgugccgggcugg

SEQ ID NO: 1762845 - RNA, 16 nt, Salmonella enterica enterica serovar Typhi Ty2
gucuggcgcuaaaauc

SEQ ID NO: 1762846 - RNA, 20 nt, Salmonella enterica enterica serovar Typhi Ty2
gucugguacggccaccaggc

SEQ ID NO: 1762847 - RNA, 11 nt, Salmonella enterica enterica serovar Typhi Ty2
gucuggucagc

SEQ ID NO: 1762848 - RNA, 15 nt, Salmonella enterica enterica serovar Typhi Ty2
gucuggugauccagc

SEQ ID NO: 1762849 - RNA, 13 nt, Salmonella enterica enterica serovar Typhi Ty2
gucugguggucua

SEQ ID NO: 1762850 - RNA, 22 nt, Salmonella enterica enterica serovar Typhi Ty2
gucugcgcugggccgggccuga

SEQ ID NO: 1762851 - RNA, 15 nt, Salmonella enterica enterica serovar Typhi Ty2
gucugcgcugggccg

SEQ ID NO: 1762852 - RNA, 12 nt, Salmonella enterica enterica serovar Typhi Ty2
gucugcucagaa

SEQ ID NO: 1762853 - RNA, 13 nt, Salmonella enterica enterica serovar Typhi Ty2
gucuggauauaaa

SEQ ID NO: 1762854 - RNA, 20 nt, Salmonella enterica enterica serovar Typhi Ty2
gucgggaaagggcggcagcg

SEQ ID NO: 1762855 - RNA, 15 nt, Salmonella enterica enterica serovar Typhi Ty2
gucgggaacgcuguc

SEQ ID NO: 1762856 - RNA, 20 nt, Salmonella enterica enterica serovar Typhi Ty2
gucggcgucugcgcgcuggu

SEQ ID NO: 1762857 - RNA, 15 nt, Salmonella enterica enterica serovar Typhi Ty2
gucggcagcaccgga

SEQ ID NO: 1762858 - RNA, 13 nt, Salmonella enterica enterica serovar Typhi Ty2
gucggcagacugg

SEQ ID NO: 1762859 - RNA, 20 nt, Salmonella enterica enterica serovar Typhi Ty2
gucggcaucgugaaacucac

SEQ ID NO: 1762860 - RNA, 19 nt, Salmonella enterica enterica serovar Typhi Ty2
gucggcaccgaauguuccg

SEQ ID NO: 1762861 - RNA, 17 nt, Salmonella enterica enterica serovar Typhi Ty2
gucguaaaacugcacca

SEQ ID NO: 1762862 - RNA, 16 nt, Salmonella enterica enterica serovar Typhi Ty2
gucguaaaacugcacc

SEQ ID NO: 1762863 - RNA, 18 nt, Salmonella enterica enterica serovar Typhi Ty2
gucgccuuccugcaggcg

SEQ ID NO: 1762864 - RNA, 14 nt, Salmonella enterica enterica serovar Typhi Ty2
gucgccuuccagcg

SEQ ID NO: 1762865 - RNA, 22 nt, Salmonella enterica enterica serovar Typhi Ty2
gucgccugcuguugggcaggag

SEQ ID NO: 1762866 - RNA, 14 nt, Salmonella enterica enterica serovar Typhi Ty2
gucgcggccaccgc

SEQ ID NO: 1762867 - RNA, 15 nt, Salmonella enterica enterica serovar Typhi Ty2
gucgccgcgcccagc

SEQ ID NO: 1762868 - RNA, 11 nt, Salmonella enterica enterica serovar Typhi Ty2
gucgccgccgu

SEQ ID NO: 1762869 - RNA, 12 nt, Salmonella enterica enterica serovar Typhi Ty2
gucgccgcccgu

SEQ ID NO: 1762870 - RNA, 22 nt, Salmonella enterica enterica serovar Typhi Ty2
gucgcagccacccuggcauaug

SEQ ID NO: 1762871 - RNA, 17 nt, Salmonella enterica enterica serovar Typhi Ty2
gucgcaagacgaaaaau

SEQ ID NO: 1762872 - RNA, 17 nt, Salmonella enterica enterica serovar Typhi Ty2
guccuugcgaagaccgc

SEQ ID NO: 1762873 - RNA, 18 nt, Salmonella enterica enterica serovar Typhi Ty2
guccugccgcuacuccgc

SEQ ID NO: 1762874 - RNA, 23 nt, Salmonella enterica enterica serovar Typhi Ty2
gucgauacucacgacuuucacca

SEQ ID NO: 1762875 - RNA, 17 nt, Salmonella enterica enterica serovar Typhi Ty2
gucgauaaaauccucua

SEQ ID NO: 1762876 - RNA, 18 nt, Salmonella enterica enterica serovar Typhi Ty2
gucgagcucaguccagcc

SEQ ID NO: 1762877 - RNA, 17 nt, Salmonella enterica enterica serovar Typhi Ty2
guccggcgcuaaccagc

SEQ ID NO: 1762878 - RNA, 17 nt, Salmonella enterica enterica serovar Typhi Ty2
guccuccaacgugcaga

SEQ ID NO: 1762879 - RNA, 20 nt, Salmonella enterica enterica serovar Typhi Ty2
guccugcgggaacaugcaua

SEQ ID NO: 1762880 - RNA, 14 nt, Salmonella enterica enterica serovar Typhi Ty2
guccugauccggcu

SEQ ID NO: 1762881 - RNA, 16 nt, Salmonella enterica enterica serovar Typhi Ty2
guccggcacgcgcagc

SEQ ID NO: 1762882 - RNA, 17 nt, Salmonella enterica enterica serovar Typhi Ty2
guccggagcagcuuagc

SEQ ID NO: 1762883 - RNA, 17 nt, Salmonella enterica enterica serovar Typhi Ty2
gucccggcaauacugga

SEQ ID NO: 1762884 - RNA, 15 nt, Salmonella enterica enterica serovar Typhi Ty2
guccccguucugacc

SEQ ID NO: 1762885 - RNA, 22 nt, Salmonella enterica enterica serovar Typhi Ty2
guccccucaaacaggcugucug

SEQ ID NO: 1762886 - RNA, 16 nt, Salmonella enterica enterica serovar Typhi Ty2
gucccaggccagaugc

SEQ ID NO: 1762887 - RNA, 15 nt, Salmonella enterica enterica serovar Typhi Ty2
guccccuuuucaccc

SEQ ID NO: 1762888 - RNA, 22 nt, Salmonella enterica enterica serovar Typhi Ty2
gucacgcaugucguauccccag

SEQ ID NO: 1762889 - RNA, 20 nt, Salmonella enterica enterica serovar Typhi Ty2
gucacgccggguacauauac

SEQ ID NO: 1762890 - RNA, 17 nt, Salmonella enterica enterica serovar Typhi Ty2
gucacccgcguaucauu

SEQ ID NO: 1762891 - RNA, 19 nt, Salmonella enterica enterica serovar Typhi Ty2
gucacccgccggcagcagc

SEQ ID NO: 1762892 - RNA, 18 nt, Salmonella enterica enterica serovar Typhi Ty2
gucaccgacacgcauaug

SEQ ID NO: 1762893 - RNA, 15 nt, Salmonella enterica enterica serovar Typhi Ty2
gucaauggcgcuguc

SEQ ID NO: 1762894 - RNA, 17 nt, Salmonella enterica enterica serovar Typhi Ty2
gucaaugugaauccagg

SEQ ID NO: 1762895 - RNA, 22 nt, Salmonella enterica enterica serovar Typhi Ty2
ggugaagcauccgggauauaaa

SEQ ID NO: 1762896 - RNA, 15 nt, Salmonella enterica enterica serovar Typhi Ty2
gucaacguuuuucag

SEQ ID NO: 1762897 - RNA, 20 nt, Salmonella enterica enterica serovar Typhi Ty2
ggugaaggcaaaacaccaua

SEQ ID NO: 1762898 - RNA, 16 nt, Salmonella enterica enterica serovar Typhi Ty2
gucaagaucccucacc

SEQ ID NO: 1762899 - RNA, 17 nt, Salmonella enterica enterica serovar Typhi Ty2
gucaaucgccugcugua

SEQ ID NO: 1762900 - RNA, 12 nt, Salmonella enterica enterica serovar Typhi Ty2
gucaaucaucag

SEQ ID NO: 1762901 - RNA, 18 nt, Salmonella enterica enterica serovar Typhi Ty2
gucacuccggcugcacca

SEQ ID NO: 1762902 - RNA, 15 nt, Salmonella enterica enterica serovar Typhi Ty2
gucaggcucuaauaa

SEQ ID NO: 1762903 - RNA, 16 nt, Salmonella enterica enterica serovar Typhi Ty2
gucagggcgcggcgca

SEQ ID NO: 1762904 - RNA, 14 nt, Salmonella enterica enterica serovar Typhi Ty2
gucagggcaaggcg

SEQ ID NO: 1762905 - RNA, 16 nt, Salmonella enterica enterica serovar Typhi Ty2
gucaggcgagcgccuu

SEQ ID NO: 1762906 - RNA, 12 nt, Salmonella enterica enterica serovar Typhi Ty2
gucaggcuaaau

SEQ ID NO: 1762907 - RNA, 19 nt, Salmonella enterica enterica serovar Typhi Ty2
gucagggugaauaccagcg

SEQ ID NO: 1762908 - RNA, 23 nt, Salmonella enterica enterica serovar Typhi Ty2
gucagggcgcggcgcaacuuuuu

SEQ ID NO: 1762909 - RNA, 22 nt, Salmonella enterica enterica serovar Typhi Ty2
gucaggcuacccgcaauaccaa

SEQ ID NO: 1762910 - RNA, 15 nt, Salmonella enterica enterica serovar Typhi Ty2
gucagcgcggcuucc

SEQ ID NO: 1762911 - RNA, 23 nt, Salmonella enterica enterica serovar Typhi Ty2
gucagcgcauaccggccacgagc

SEQ ID NO: 1762912 - RNA, 12 nt, Salmonella enterica enterica serovar Typhi Ty2
gucagccuugac

SEQ ID NO: 1762913 - RNA, 18 nt, Salmonella enterica enterica serovar Typhi Ty2
gucagccccguacaaggu

SEQ ID NO: 1762914 - RNA, 16 nt, Salmonella enterica enterica serovar Typhi Ty2
gucaucgccuucaucc

SEQ ID NO: 1762915 - RNA, 16 nt, Salmonella enterica enterica serovar Typhi Ty2
gucaucgcaaauucug

SEQ ID NO: 1762916 - RNA, 21 nt, Salmonella enterica enterica serovar Typhi Ty2
gucaucgaaggcaucuucaga

SEQ ID NO: 1762917 - RNA, 16 nt, Salmonella enterica enterica serovar Typhi Ty2
gucauccgguucaccc

SEQ ID NO: 1762918 - RNA, 16 nt, Salmonella enterica enterica serovar Typhi Ty2
gucauccggcaaucag

SEQ ID NO: 1762919 - RNA, 17 nt, Salmonella enterica enterica serovar Typhi Ty2
gucaucccgaaccuggu

SEQ ID NO: 1762920 - RNA, 13 nt, Salmonella enterica enterica serovar Typhi Ty2
gucaucauaauuc

SEQ ID NO: 1762921 - RNA, 19 nt, Salmonella enterica enterica serovar Typhi Ty2
gucauaucgaugguaauaa

SEQ ID NO: 1762922 - RNA, 22 nt, Salmonella enterica enterica serovar Typhi Ty2
gucaucaaauuaucuguugaua

SEQ ID NO: 1762923 - RNA, 13 nt, Salmonella enterica enterica serovar Typhi Ty2
gucaugguaaaac

SEQ ID NO: 1762924 - RNA, 20 nt, Salmonella enterica enterica serovar Typhi Ty2
gucauuaacgggaaacuguu

SEQ ID NO: 1762925 - RNA, 24 nt, Salmonella enterica enterica serovar Typhi Ty2
gucaucgcuucuauuaccgcagcg

SEQ ID NO: 1762926 - RNA, 23 nt, Salmonella enterica enterica serovar Typhi Ty2
gucaucgcucaucucaagcccca

SEQ ID NO: 1762927 - RNA, 23 nt, Salmonella enterica enterica serovar Typhi Ty2
gucaucgcggaaagcaaugucgc

SEQ ID NO: 1762928 - RNA, 18 nt, Salmonella enterica enterica serovar Typhi Ty2
gucaucggcuuuuuucaa

SEQ ID NO: 1762929 - RNA, 21 nt, Salmonella enterica enterica serovar Typhi Ty2
gucaucggcuuuuuucaacca

SEQ ID NO: 1762930 - RNA, 20 nt, Salmonella enterica enterica serovar Typhi Ty2
gucaucggcacguaguaaug

SEQ ID NO: 1762931 - RNA, 16 nt, Salmonella enterica enterica serovar Typhi Ty2
gucauggguagccguu

SEQ ID NO: 1762932 - RNA, 17 nt, Salmonella enterica enterica serovar Typhi Ty2
gucauggguagccguuu

SEQ ID NO: 1762933 - RNA, 16 nt, Salmonella enterica enterica serovar Typhi Ty2
guccacauccagcgcc

SEQ ID NO: 1762934 - RNA, 21 nt, Salmonella enterica enterica serovar Typhi Ty2
guccacauccagcgccagcgc

SEQ ID NO: 1762935 - RNA, 19 nt, Salmonella enterica enterica serovar Typhi Ty2
guccauauucaguuuuacg

SEQ ID NO: 1762936 - RNA, 22 nt, Salmonella enterica enterica serovar Typhi Ty2
guccaggccugauaagcacagg

SEQ ID NO: 1762937 - RNA, 21 nt, Salmonella enterica enterica serovar Typhi Ty2
gucccaggauaguacugacca

SEQ ID NO: 1762938 - RNA, 12 nt, Salmonella enterica enterica serovar Typhi Ty2
gucccaggccag

SEQ ID NO: 1762939 - RNA, 11 nt, Salmonella enterica enterica serovar Typhi Ty2
gucccagccuu

SEQ ID NO: 1762940 - RNA, 15 nt, Salmonella enterica enterica serovar Typhi Ty2
guccaucagauucaa

SEQ ID NO: 1762941 - RNA, 13 nt, Salmonella enterica enterica serovar Typhi Ty2
guccauauucagu

SEQ ID NO: 1762942 - RNA, 21 nt, Salmonella enterica enterica serovar Typhi Ty2
guccaucaggcuuugcgccau

SEQ ID NO: 1762943 - RNA, 21 nt, Salmonella enterica enterica serovar Typhi Ty2
guccaugaugaagauauucac

SEQ ID NO: 1762944 - RNA, 17 nt, Salmonella enterica enterica serovar Typhi Ty2
guccaugacgaccacag

SEQ ID NO: 1762945 - RNA, 13 nt, Salmonella enterica enterica serovar Typhi Ty2
uacgccgccgccc

SEQ ID NO: 1762946 - RNA, 20 nt, Salmonella enterica enterica serovar Typhi Ty2
uacgccgccgcccagauguu

SEQ ID NO: 1762947 - RNA, 12 nt, Salmonella enterica enterica serovar Typhi Ty2
uacgccuuaucc

SEQ ID NO: 1762948 - RNA, 16 nt, Salmonella enterica enterica serovar Typhi Ty2
uacgccuuauccggcc

SEQ ID NO: 1762949 - RNA, 13 nt, Salmonella enterica enterica serovar Typhi Ty2
uacgccugccugg

SEQ ID NO: 1762950 - RNA, 14 nt, Salmonella enterica enterica serovar Typhi Ty2
uacgccucuuucag

SEQ ID NO: 1762951 - RNA, 15 nt, Salmonella enterica enterica serovar Typhi Ty2
uacgccccacuuuca

SEQ ID NO: 1762952 - RNA, 16 nt, Salmonella enterica enterica serovar Typhi Ty2
uacgccaucaggcaug

SEQ ID NO: 1762953 - RNA, 22 nt, Salmonella enterica enterica serovar Typhi Ty2
uacgcccagccgugaaugguca

SEQ ID NO: 1762954 - RNA, 17 nt, Salmonella enterica enterica serovar Typhi Ty2
uacgcagcuuaaagcca

SEQ ID NO: 1762955 - RNA, 19 nt, Salmonella enterica enterica serovar Typhi Ty2
uacgcagcuuaaagccaau

SEQ ID NO: 1762956 - RNA, 18 nt, Salmonella enterica enterica serovar Typhi Ty2
uacgcaggacuuucgcuu

SEQ ID NO: 1762957 - RNA, 20 nt, Salmonella enterica enterica serovar Typhi Ty2
uacgcagaucuuuuugcucc

SEQ ID NO: 1762958 - RNA, 21 nt, Salmonella enterica enterica serovar Typhi Ty2
uacgcaccagcucuacaucgc

SEQ ID NO: 1762959 - RNA, 19 nt, Salmonella enterica enterica serovar Typhi Ty2
uacgccagccgucaugaug

SEQ ID NO: 1762960 - RNA, 13 nt, Salmonella enterica enterica serovar Typhi Ty2
uacgcaucaccag

SEQ ID NO: 1762961 - RNA, 18 nt, Salmonella enterica enterica serovar Typhi Ty2
uacgcaucaccaggcaau

SEQ ID NO: 1762962 - RNA, 14 nt, Salmonella enterica enterica serovar Typhi Ty2
uacgagauaaaaac

SEQ ID NO: 1762963 - RNA, 13 nt, Salmonella enterica enterica serovar Typhi Ty2
uacgcaaggaaau

SEQ ID NO: 1762964 - RNA, 14 nt, Salmonella enterica enterica serovar Typhi Ty2
uacgaccgccgaca

SEQ ID NO: 1762965 - RNA, 16 nt, Salmonella enterica enterica serovar Typhi Ty2
uacgaccgcagaaaca

SEQ ID NO: 1762966 - RNA, 16 nt, Salmonella enterica enterica serovar Typhi Ty2
uacgacugcacccauc

SEQ ID NO: 1762967 - RNA, 19 nt, Salmonella enterica enterica serovar Typhi Ty2
uacgacacccgauacacgc

SEQ ID NO: 1762968 - RNA, 20 nt, Salmonella enterica enterica serovar Typhi Ty2
uaccgugugcagugacagag

SEQ ID NO: 1762969 - RNA, 17 nt, Salmonella enterica enterica serovar Typhi Ty2
uaccggcaccagcaaug

SEQ ID NO: 1762970 - RNA, 14 nt, Salmonella enterica enterica serovar Typhi Ty2
uaccggcaccagca

SEQ ID NO: 1762971 - RNA, 20 nt, Salmonella enterica enterica serovar Typhi Ty2
uaccggugcgccccagcaug

SEQ ID NO: 1762972 - RNA, 15 nt, Salmonella enterica enterica serovar Typhi Ty2
uaccguaaaaugcug

SEQ ID NO: 1762973 - RNA, 15 nt, Salmonella enterica enterica serovar Typhi Ty2
uacgcgccugccuga

SEQ ID NO: 1762974 - RNA, 15 nt, Salmonella enterica enterica serovar Typhi Ty2
uacgcgucaauuacc

SEQ ID NO: 1762975 - RNA, 17 nt, Salmonella enterica enterica serovar Typhi Ty2
uacgcuauaaaguuccc

SEQ ID NO: 1762976 - RNA, 15 nt, Salmonella enterica enterica serovar Typhi Ty2
uacguaacaugaccu

SEQ ID NO: 1762977 - RNA, 12 nt, Salmonella enterica enterica serovar Typhi Ty2
uacguaaauaua

SEQ ID NO: 1762978 - RNA, 16 nt, Salmonella enterica enterica serovar Typhi Ty2
uacggcuccagcacau

SEQ ID NO: 1762979 - RNA, 21 nt, Salmonella enterica enterica serovar Typhi Ty2
uacgggagagcguauccagca

SEQ ID NO: 1762980 - RNA, 13 nt, Salmonella enterica enterica serovar Typhi Ty2
uacggcuuccacu

SEQ ID NO: 1762981 - RNA, 17 nt, Salmonella enterica enterica serovar Typhi Ty2
uacuaauaaaauucacu

SEQ ID NO: 1762982 - RNA, 13 nt, Salmonella enterica enterica serovar Typhi Ty2
uacuaauaaauau

SEQ ID NO: 1762983 - RNA, 14 nt, Salmonella enterica enterica serovar Typhi Ty2
uacuaauaaauauu

SEQ ID NO: 1762984 - RNA, 20 nt, Salmonella enterica enterica serovar Typhi Ty2
uacuaaugaauuuaauauuu

SEQ ID NO: 1762985 - RNA, 16 nt, Salmonella enterica enterica serovar Typhi Ty2
uacuaaugaauuuaau

SEQ ID NO: 1762986 - RNA, 13 nt, Salmonella enterica enterica serovar Typhi Ty2
uacuacaacuguc

SEQ ID NO: 1762987 - RNA, 15 nt, Salmonella enterica enterica serovar Typhi Ty2
uacuacagaaagcca

SEQ ID NO: 1762988 - RNA, 19 nt, Salmonella enterica enterica serovar Typhi Ty2
uacgucucgaguaaucacu

SEQ ID NO: 1762989 - RNA, 17 nt, Salmonella enterica enterica serovar Typhi Ty2
uacgucauaucauccag

SEQ ID NO: 1762990 - RNA, 19 nt, Salmonella enterica enterica serovar Typhi Ty2
uacucuuugaacagccaga

SEQ ID NO: 1762991 - RNA, 15 nt, Salmonella enterica enterica serovar Typhi Ty2
uacucuuugaugguu

SEQ ID NO: 1762992 - RNA, 13 nt, Salmonella enterica enterica serovar Typhi Ty2
uacucuuuuuccg

SEQ ID NO: 1762993 - RNA, 20 nt, Salmonella enterica enterica serovar Typhi Ty2
uacugaaauuucuuuuccag

SEQ ID NO: 1762994 - RNA, 17 nt, Salmonella enterica enterica serovar Typhi Ty2
uacugaccagacagccc

SEQ ID NO: 1762995 - RNA, 20 nt, Salmonella enterica enterica serovar Typhi Ty2
uacugaccaagcgucagcau

SEQ ID NO: 1762996 - RNA, 15 nt, Salmonella enterica enterica serovar Typhi Ty2
uacugaccagacagc

SEQ ID NO: 1762997 - RNA, 13 nt, Salmonella enterica enterica serovar Typhi Ty2
uacugauuccugc

SEQ ID NO: 1762998 - RNA, 18 nt, Salmonella enterica enterica serovar Typhi Ty2
uacugauaaaggauaaua

SEQ ID NO: 1762999 - RNA, 17 nt, Salmonella enterica enterica serovar Typhi Ty2
uacugagcauccaccgg

SEQ ID NO: 1763000 - RNA, 13 nt, Salmonella enterica enterica serovar Typhi Ty2
uacucugcuuuuu

SEQ ID NO: 1763001 - RNA, 13 nt, Salmonella enterica enterica serovar Typhi Ty2
uacucuuccacca

SEQ ID NO: 1763002 - RNA, 21 nt, Salmonella enterica enterica serovar Typhi Ty2
uacucuuggagagcaucaucu

SEQ ID NO: 1763003 - RNA, 16 nt, Salmonella enterica enterica serovar Typhi Ty2
uacucugcggagcaag

SEQ ID NO: 1763004 - RNA, 22 nt, Salmonella enterica enterica serovar Typhi Ty2
uacucgggccagcucuuuucug

SEQ ID NO: 1763005 - RNA, 20 nt, Salmonella enterica enterica serovar Typhi Ty2
uacuacugguggaauaaaua

SEQ ID NO: 1763006 - RNA, 21 nt, Salmonella enterica enterica serovar Typhi Ty2
uacuacugguggaauaaauau

SEQ ID NO: 1763007 - RNA, 22 nt, Salmonella enterica enterica serovar Typhi Ty2
uacuucacaauaagaaauuuag

SEQ ID NO: 1763008 - RNA, 15 nt, Salmonella enterica enterica serovar Typhi Ty2
uacuuauauuuauuu

SEQ ID NO: 1763009 - RNA, 20 nt, Salmonella enterica enterica serovar Typhi Ty2
uacuguuuuugcuuuaauau

SEQ ID NO: 1763010 - RNA, 22 nt, Salmonella enterica enterica serovar Typhi Ty2
uacuguuuuugcuuuaauauuc

SEQ ID NO: 1763011 - RNA, 16 nt, Salmonella enterica enterica serovar Typhi Ty2
uacuucugacagugac

SEQ ID NO: 1763012 - RNA, 15 nt, Salmonella enterica enterica serovar Typhi Ty2
uacuucaggcugcca

SEQ ID NO: 1763013 - RNA, 17 nt, Salmonella enterica enterica serovar Typhi Ty2
uacuugcgccgccaucc

SEQ ID NO: 1763014 - RNA, 18 nt, Salmonella enterica enterica serovar Typhi Ty2
uacugcuguccgccagca

SEQ ID NO: 1763015 - RNA, 18 nt, Salmonella enterica enterica serovar Typhi Ty2
uacugcuuagcucaucag

SEQ ID NO: 1763016 - RNA, 20 nt, Salmonella enterica enterica serovar Typhi Ty2
uacugcuuagcucaucagcc

SEQ ID NO: 1763017 - RNA, 21 nt, Salmonella enterica enterica serovar Typhi Ty2
uacugcgcucuaucaccgccc

SEQ ID NO: 1763018 - RNA, 16 nt, Salmonella enterica enterica serovar Typhi Ty2
uacugcccguggcgga

SEQ ID NO: 1763019 - RNA, 13 nt, Salmonella enterica enterica serovar Typhi Ty2
uacugcuauuagc

SEQ ID NO: 1763020 - RNA, 23 nt, Salmonella enterica enterica serovar Typhi Ty2
uacuggccacggagugcgcggcg

SEQ ID NO: 1763021 - RNA, 17 nt, Salmonella enterica enterica serovar Typhi Ty2
uacuguggugugccugc

SEQ ID NO: 1763022 - RNA, 17 nt, Salmonella enterica enterica serovar Typhi Ty2
uacuggaucgcuccauu

SEQ ID NO: 1763023 - RNA, 22 nt, Salmonella enterica enterica serovar Typhi Ty2
uacuggaucgcuccauucuguc

SEQ ID NO: 1763024 - RNA, 14 nt, Salmonella enterica enterica serovar Typhi Ty2
uacuggaaaaaacg

SEQ ID NO: 1763025 - RNA, 15 nt, Salmonella enterica enterica serovar Typhi Ty2
uacuggaucauacau

SEQ ID NO: 1763026 - RNA, 21 nt, Salmonella enterica enterica serovar Typhi Ty2
uacugucgcgcggcgucccua

SEQ ID NO: 1763027 - RNA, 20 nt, Salmonella enterica enterica serovar Typhi Ty2
uaccgcuugggccaccugcc

SEQ ID NO: 1763028 - RNA, 22 nt, Salmonella enterica enterica serovar Typhi Ty2
uaccggacgacuguagauaccu

SEQ ID NO: 1763029 - RNA, 13 nt, Salmonella enterica enterica serovar Typhi Ty2
uaccgcacaucac

SEQ ID NO: 1763030 - RNA, 17 nt, Salmonella enterica enterica serovar Typhi Ty2
uaccgauagcgcggaau

SEQ ID NO: 1763031 - RNA, 13 nt, Salmonella enterica enterica serovar Typhi Ty2
uaccgcagcgcgg

SEQ ID NO: 1763032 - RNA, 18 nt, Salmonella enterica enterica serovar Typhi Ty2
uaccgcagcgaaugugcu

SEQ ID NO: 1763033 - RNA, 21 nt, Salmonella enterica enterica serovar Typhi Ty2
uaccgccaccuuucugcucca

SEQ ID NO: 1763034 - RNA, 17 nt, Salmonella enterica enterica serovar Typhi Ty2
uaccgaacagccaggcu

SEQ ID NO: 1763035 - RNA, 20 nt, Salmonella enterica enterica serovar Typhi Ty2
uaccgacaaaucaaacucac

SEQ ID NO: 1763036 - RNA, 19 nt, Salmonella enterica enterica serovar Typhi Ty2
uacccugauuuucaaauuu

SEQ ID NO: 1763037 - RNA, 21 nt, Salmonella enterica enterica serovar Typhi Ty2
uacccuuccccggcagccuca

SEQ ID NO: 1763038 - RNA, 14 nt, Salmonella enterica enterica serovar Typhi Ty2
uaccccgugguggg

SEQ ID NO: 1763039 - RNA, 15 nt, Salmonella enterica enterica serovar Typhi Ty2
uacccgguaauacuu

SEQ ID NO: 1763040 - RNA, 17 nt, Salmonella enterica enterica serovar Typhi Ty2
uaccagugcuaaaauua

SEQ ID NO: 1763041 - RNA, 21 nt, Salmonella enterica enterica serovar Typhi Ty2
uaccagugcuaaaauuauaca

SEQ ID NO: 1763042 - RNA, 20 nt, Salmonella enterica enterica serovar Typhi Ty2
uaccagucgacaguauagaa

SEQ ID NO: 1763043 - RNA, 10 nt, Salmonella enterica enterica serovar Typhi Ty2
uaccaggcac

SEQ ID NO: 1763044 - RNA, 19 nt, Salmonella enterica enterica serovar Typhi Ty2
uaccaggcggcuuuuucau

SEQ ID NO: 1763045 - RNA, 14 nt, Salmonella enterica enterica serovar Typhi Ty2
uaccauuccucacg

SEQ ID NO: 1763046 - RNA, 13 nt, Salmonella enterica enterica serovar Typhi Ty2
uaccauucagcuu

SEQ ID NO: 1763047 - RNA, 18 nt, Salmonella enterica enterica serovar Typhi Ty2
uacccaguaccauaccgg

SEQ ID NO: 1763048 - RNA, 15 nt, Salmonella enterica enterica serovar Typhi Ty2
uaccccggcgcggcg

SEQ ID NO: 1763049 - RNA, 15 nt, Salmonella enterica enterica serovar Typhi Ty2
uaccccgccagcagg

SEQ ID NO: 1763050 - RNA, 20 nt, Salmonella enterica enterica serovar Typhi Ty2
uaccccaucauugacuucaa

SEQ ID NO: 1763051 - RNA, 22 nt, Salmonella enterica enterica serovar Typhi Ty2
uaccccgcacaaacgcuuuuuu

SEQ ID NO: 1763052 - RNA, 22 nt, Salmonella enterica enterica serovar Typhi Ty2
uaccccgcagcgaaaauccagu

SEQ ID NO: 1763053 - RNA, 13 nt, Salmonella enterica enterica serovar Typhi Ty2
uaccccagcgcgc

SEQ ID NO: 1763054 - RNA, 16 nt, Salmonella enterica enterica serovar Typhi Ty2
uacccaacgcaaugcg

SEQ ID NO: 1763055 - RNA, 21 nt, Salmonella enterica enterica serovar Typhi Ty2
uacccaaauuaauuuauugac

SEQ ID NO: 1763056 - RNA, 19 nt, Salmonella enterica enterica serovar Typhi Ty2
uacccaacaccagacugau

SEQ ID NO: 1763057 - RNA, 15 nt, Salmonella enterica enterica serovar Typhi Ty2
uaccagcgcggcgcc

SEQ ID NO: 1763058 - RNA, 14 nt, Salmonella enterica enterica serovar Typhi Ty2
uaccagcggcagcu

SEQ ID NO: 1763059 - RNA, 19 nt, Salmonella enterica enterica serovar Typhi Ty2
uaccagcgcgaacauuaca

SEQ ID NO: 1763060 - RNA, 17 nt, Salmonella enterica enterica serovar Typhi Ty2
uaccagcgucaucggau

SEQ ID NO: 1763061 - RNA, 20 nt, Salmonella enterica enterica serovar Typhi Ty2
uaccagcggcagcuucagcc

SEQ ID NO: 1763062 - RNA, 20 nt, Salmonella enterica enterica serovar Typhi Ty2
uaccagccgcgcccuaacag

SEQ ID NO: 1763063 - RNA, 16 nt, Salmonella enterica enterica serovar Typhi Ty2
uaccagcagcgccagc

SEQ ID NO: 1763064 - RNA, 15 nt, Salmonella enterica enterica serovar Typhi Ty2
uaccagcaucgcguu

SEQ ID NO: 1763065 - RNA, 11 nt, Salmonella enterica enterica serovar Typhi Ty2
uaccacaucag

SEQ ID NO: 1763066 - RNA, 17 nt, Salmonella enterica enterica serovar Typhi Ty2
uaccacccagccagacg

SEQ ID NO: 1763067 - RNA, 20 nt, Salmonella enterica enterica serovar Typhi Ty2
uaccacuucggcagaaaaag

SEQ ID NO: 1763068 - RNA, 19 nt, Salmonella enterica enterica serovar Typhi Ty2
uaccacccgcuaugaagac

SEQ ID NO: 1763069 - RNA, 18 nt, Salmonella enterica enterica serovar Typhi Ty2
uaccagaaccacuugaac

SEQ ID NO: 1763070 - RNA, 21 nt, Salmonella enterica enterica serovar Typhi Ty2
uaccagacgcgccugcauacu

SEQ ID NO: 1763071 - RNA, 14 nt, Salmonella enterica enterica serovar Typhi Ty2
uaccagaaucaucg

SEQ ID NO: 1763072 - RNA, 14 nt, Salmonella enterica enterica serovar Typhi Ty2
uacaucuacuucag

SEQ ID NO: 1763073 - RNA, 18 nt, Salmonella enterica enterica serovar Typhi Ty2
uacauucuguuugucuuu

SEQ ID NO: 1763074 - RNA, 14 nt, Salmonella enterica enterica serovar Typhi Ty2
uacauucuguuuuc

SEQ ID NO: 1763075 - RNA, 18 nt, Salmonella enterica enterica serovar Typhi Ty2
uacauucgcucaggacag

SEQ ID NO: 1763076 - RNA, 17 nt, Salmonella enterica enterica serovar Typhi Ty2
uacauuauugcacauaa

SEQ ID NO: 1763077 - RNA, 18 nt, Salmonella enterica enterica serovar Typhi Ty2
uacauccggcucaagagu

SEQ ID NO: 1763078 - RNA, 21 nt, Salmonella enterica enterica serovar Typhi Ty2
uaccaaauauuucuuugucgc

SEQ ID NO: 1763079 - RNA, 15 nt, Salmonella enterica enterica serovar Typhi Ty2
uaccaaauauuucuu

SEQ ID NO: 1763080 - RNA, 14 nt, Salmonella enterica enterica serovar Typhi Ty2
uaccaacugagcua

SEQ ID NO: 1763081 - RNA, 16 nt, Salmonella enterica enterica serovar Typhi Ty2
uacauccaugccaucc

SEQ ID NO: 1763082 - RNA, 21 nt, Salmonella enterica enterica serovar Typhi Ty2
uacauccagaaggcaaaaugc

SEQ ID NO: 1763083 - RNA, 16 nt, Salmonella enterica enterica serovar Typhi Ty2
uacaucagaaaacagc

SEQ ID NO: 1763084 - RNA, 15 nt, Salmonella enterica enterica serovar Typhi Ty2
uacaauuuaucugcg

SEQ ID NO: 1763085 - RNA, 10 nt, Salmonella enterica enterica serovar Typhi Ty2
uacaauuucg

SEQ ID NO: 1763086 - RNA, 19 nt, Salmonella enterica enterica serovar Typhi Ty2
uacaaguaauaaaauaaua

SEQ ID NO: 1763087 - RNA, 20 nt, Salmonella enterica enterica serovar Typhi Ty2
uacaaggaaagaaaaugcca

SEQ ID NO: 1763088 - RNA, 16 nt, Salmonella enterica enterica serovar Typhi Ty2
uacaauucaacucacu

SEQ ID NO: 1763089 - RNA, 13 nt, Salmonella enterica enterica serovar Typhi Ty2
uacaguagcaggg

SEQ ID NO: 1763090 - RNA, 15 nt, Salmonella enterica enterica serovar Typhi Ty2
uaauuugcuccagaa

SEQ ID NO: 1763091 - RNA, 11 nt, Salmonella enterica enterica serovar Typhi Ty2
uaauuugauuu

SEQ ID NO: 1763092 - RNA, 15 nt, Salmonella enterica enterica serovar Typhi Ty2
uaauuugauuuauuu

SEQ ID NO: 1763093 - RNA, 17 nt, Salmonella enterica enterica serovar Typhi Ty2
uaauuucaauuuugccg

SEQ ID NO: 1763094 - RNA, 22 nt, Salmonella enterica enterica serovar Typhi Ty2
uaauuuaugauuuuaacaucac

SEQ ID NO: 1763095 - RNA, 22 nt, Salmonella enterica enterica serovar Typhi Ty2
uaauuuuuccagcauuucuuca

SEQ ID NO: 1763096 - RNA, 18 nt, Salmonella enterica enterica serovar Typhi Ty2
uacaaaacccauaucccc

SEQ ID NO: 1763097 - RNA, 12 nt, Salmonella enterica enterica serovar Typhi Ty2
uacaaaaaauac

SEQ ID NO: 1763098 - RNA, 19 nt, Salmonella enterica enterica serovar Typhi Ty2
uaauuuucccaguucaucc

SEQ ID NO: 1763099 - RNA, 13 nt, Salmonella enterica enterica serovar Typhi Ty2
uaauuuugcgaug

SEQ ID NO: 1763100 - RNA, 19 nt, Salmonella enterica enterica serovar Typhi Ty2
uacaaaccccacccacuga

SEQ ID NO: 1763101 - RNA, 23 nt, Salmonella enterica enterica serovar Typhi Ty2
uacaaacaguuuuuccuuucugc

SEQ ID NO: 1763102 - RNA, 23 nt, Salmonella enterica enterica serovar Typhi Ty2
uacaaaauaugggauuugaugcc

SEQ ID NO: 1763103 - RNA, 15 nt, Salmonella enterica enterica serovar Typhi Ty2
uacaaaauaagucau

SEQ ID NO: 1763104 - RNA, 21 nt, Salmonella enterica enterica serovar Typhi Ty2
uacaaaauaagucauaucaau

SEQ ID NO: 1763105 - RNA, 13 nt, Salmonella enterica enterica serovar Typhi Ty2
uacaaaucacugg

SEQ ID NO: 1763106 - RNA, 20 nt, Salmonella enterica enterica serovar Typhi Ty2
uacaaagggcaauauauuau

SEQ ID NO: 1763107 - RNA, 15 nt, Salmonella enterica enterica serovar Typhi Ty2
uacaaauuuaaacau

SEQ ID NO: 1763108 - RNA, 16 nt, Salmonella enterica enterica serovar Typhi Ty2
uacaaauuuaaacaug

SEQ ID NO: 1763109 - RNA, 17 nt, Salmonella enterica enterica serovar Typhi Ty2
uacaaaucucagggugu

SEQ ID NO: 1763110 - RNA, 20 nt, Salmonella enterica enterica serovar Typhi Ty2
uacaagaaaguaccugcacc

SEQ ID NO: 1763111 - RNA, 16 nt, Salmonella enterica enterica serovar Typhi Ty2
uacaaggaaagaaaau

SEQ ID NO: 1763112 - RNA, 16 nt, Salmonella enterica enterica serovar Typhi Ty2
uacaagcaguuaauac

SEQ ID NO: 1763113 - RNA, 18 nt, Salmonella enterica enterica serovar Typhi Ty2
uaauuacuccguuuuaau

SEQ ID NO: 1763114 - RNA, 21 nt, Salmonella enterica enterica serovar Typhi Ty2
uaauuacuccguuuuaaucuu

SEQ ID NO: 1763115 - RNA, 15 nt, Salmonella enterica enterica serovar Typhi Ty2
uaauuccgcaucauu

SEQ ID NO: 1763116 - RNA, 17 nt, Salmonella enterica enterica serovar Typhi Ty2
uaauuccgcaucauuca

SEQ ID NO: 1763117 - RNA, 17 nt, Salmonella enterica enterica serovar Typhi Ty2
uaauuccucagaauccg

SEQ ID NO: 1763118 - RNA, 16 nt, Salmonella enterica enterica serovar Typhi Ty2
uaauuccgaauauuua

SEQ ID NO: 1763119 - RNA, 18 nt, Salmonella enterica enterica serovar Typhi Ty2
uaauguucaguuuuucca

SEQ ID NO: 1763120 - RNA, 17 nt, Salmonella enterica enterica serovar Typhi Ty2
uaauguuuucugccagc

SEQ ID NO: 1763121 - RNA, 14 nt, Salmonella enterica enterica serovar Typhi Ty2
uaauguuugcgcca

SEQ ID NO: 1763122 - RNA, 20 nt, Salmonella enterica enterica serovar Typhi Ty2
uaauguugguaaauuuaugg

SEQ ID NO: 1763123 - RNA, 19 nt, Salmonella enterica enterica serovar Typhi Ty2
uaauguaaaggugagcucu

SEQ ID NO: 1763124 - RNA, 16 nt, Salmonella enterica enterica serovar Typhi Ty2
uaaugugauccgcccc

SEQ ID NO: 1763125 - RNA, 17 nt, Salmonella enterica enterica serovar Typhi Ty2
uaaugugccgguaagaa

SEQ ID NO: 1763126 - RNA, 13 nt, Salmonella enterica enterica serovar Typhi Ty2
uaaugugaaaaac

SEQ ID NO: 1763127 - RNA, 16 nt, Salmonella enterica enterica serovar Typhi Ty2
uaaugcgaugccgcac

SEQ ID NO: 1763128 - RNA, 18 nt, Salmonella enterica enterica serovar Typhi Ty2
uaaugcgccaggcagcac

SEQ ID NO: 1763129 - RNA, 17 nt, Salmonella enterica enterica serovar Typhi Ty2
uaaugcgcgcuucuuca

SEQ ID NO: 1763130 - RNA, 21 nt, Salmonella enterica enterica serovar Typhi Ty2
uaaugaucagcaaaauagugu

SEQ ID NO: 1763131 - RNA, 16 nt, Salmonella enterica enterica serovar Typhi Ty2
uaaugauccacaccgg

SEQ ID NO: 1763132 - RNA, 22 nt, Salmonella enterica enterica serovar Typhi Ty2
uaaugauucuguguuuuuucgu

SEQ ID NO: 1763133 - RNA, 16 nt, Salmonella enterica enterica serovar Typhi Ty2
uaaugauuaaaauaaa

SEQ ID NO: 1763134 - RNA, 23 nt, Salmonella enterica enterica serovar Typhi Ty2
uaaugauuaucuuuuuuagucuc

SEQ ID NO: 1763135 - RNA, 17 nt, Salmonella enterica enterica serovar Typhi Ty2
uaaucgauauaauuuua

SEQ ID NO: 1763136 - RNA, 18 nt, Salmonella enterica enterica serovar Typhi Ty2
uaaucgauauaauuuuau

SEQ ID NO: 1763137 - RNA, 22 nt, Salmonella enterica enterica serovar Typhi Ty2
uaaucgagcccagacuuuccag

SEQ ID NO: 1763138 - RNA, 16 nt, Salmonella enterica enterica serovar Typhi Ty2
uaaucgauaagccagc

SEQ ID NO: 1763139 - RNA, 21 nt, Salmonella enterica enterica serovar Typhi Ty2
uaaucgagacuguuugacacu

SEQ ID NO: 1763140 - RNA, 19 nt, Salmonella enterica enterica serovar Typhi Ty2
uaaucgacaacgcguuuau

SEQ ID NO: 1763141 - RNA, 23 nt, Salmonella enterica enterica serovar Typhi Ty2
uaaugagccagauggauaaccug

SEQ ID NO: 1763142 - RNA, 22 nt, Salmonella enterica enterica serovar Typhi Ty2
uaaugagcacuuuccacaucgg

SEQ ID NO: 1763143 - RNA, 17 nt, Salmonella enterica enterica serovar Typhi Ty2
uaauaugcgcaaucacc

SEQ ID NO: 1763144 - RNA, 15 nt, Salmonella enterica enterica serovar Typhi Ty2
uaauauccaggagca

SEQ ID NO: 1763145 - RNA, 16 nt, Salmonella enterica enterica serovar Typhi Ty2
uaauauagaguuguga

SEQ ID NO: 1763146 - RNA, 21 nt, Salmonella enterica enterica serovar Typhi Ty2
uaauauaugaaccaagauaag

SEQ ID NO: 1763147 - RNA, 16 nt, Salmonella enterica enterica serovar Typhi Ty2
uaauauuuaacacauu

SEQ ID NO: 1763148 - RNA, 20 nt, Salmonella enterica enterica serovar Typhi Ty2
uaauauuaagcagcuuaucg

SEQ ID NO: 1763149 - RNA, 15 nt, Salmonella enterica enterica serovar Typhi Ty2
uaauauucauucugu

SEQ ID NO: 1763150 - RNA, 21 nt, Salmonella enterica enterica serovar Typhi Ty2
uaaucaacugcgccacaucau

SEQ ID NO: 1763151 - RNA, 16 nt, Salmonella enterica enterica serovar Typhi Ty2
uaaucaaacccuuccg

SEQ ID NO: 1763152 - RNA, 18 nt, Salmonella enterica enterica serovar Typhi Ty2
uaauccaacauuaucaaa

SEQ ID NO: 1763153 - RNA, 14 nt, Salmonella enterica enterica serovar Typhi Ty2
uaaucgaaucgccu

SEQ ID NO: 1763154 - RNA, 16 nt, Salmonella enterica enterica serovar Typhi Ty2
uaaucacaucauuaaa

SEQ ID NO: 1763155 - RNA, 19 nt, Salmonella enterica enterica serovar Typhi Ty2
uaaucaauguauuuaaguc

SEQ ID NO: 1763156 - RNA, 12 nt, Salmonella enterica enterica serovar Typhi Ty2
uaaucaccagcc

SEQ ID NO: 1763157 - RNA, 14 nt, Salmonella enterica enterica serovar Typhi Ty2
uaaucaccagcccg

SEQ ID NO: 1763158 - RNA, 12 nt, Salmonella enterica enterica serovar Typhi Ty2
uaaucagcagcg

SEQ ID NO: 1763159 - RNA, 13 nt, Salmonella enterica enterica serovar Typhi Ty2
uaaucagcacauu

SEQ ID NO: 1763160 - RNA, 18 nt, Salmonella enterica enterica serovar Typhi Ty2
uaaucaggagggcugccc

SEQ ID NO: 1763161 - RNA, 17 nt, Salmonella enterica enterica serovar Typhi Ty2
uaaucaggcauccugcc

SEQ ID NO: 1763162 - RNA, 19 nt, Salmonella enterica enterica serovar Typhi Ty2
uaaucagcacauucagcag

SEQ ID NO: 1763163 - RNA, 16 nt, Salmonella enterica enterica serovar Typhi Ty2
uaaucaggacaucaaa

SEQ ID NO: 1763164 - RNA, 20 nt, Salmonella enterica enterica serovar Typhi Ty2
uaaucauauaagaaauaguu

SEQ ID NO: 1763165 - RNA, 23 nt, Salmonella enterica enterica serovar Typhi Ty2
uaauaagcggccuauauuagugu

SEQ ID NO: 1763166 - RNA, 20 nt, Salmonella enterica enterica serovar Typhi Ty2
uaauaaccccagcugcggca

SEQ ID NO: 1763167 - RNA, 21 nt, Salmonella enterica enterica serovar Typhi Ty2
uaauaaguccgcgggcaaaag

SEQ ID NO: 1763168 - RNA, 13 nt, Salmonella enterica enterica serovar Typhi Ty2
uaauaauauaaag

SEQ ID NO: 1763169 - RNA, 13 nt, Salmonella enterica enterica serovar Typhi Ty2
uaauaaucauaua

SEQ ID NO: 1763170 - RNA, 12 nt, Salmonella enterica enterica serovar Typhi Ty2
uaauacaggcca

SEQ ID NO: 1763171 - RNA, 13 nt, Salmonella enterica enterica serovar Typhi Ty2
uaauacaggguuu

SEQ ID NO: 1763172 - RNA, 20 nt, Salmonella enterica enterica serovar Typhi Ty2
uaauacacgguaaauucuuu

SEQ ID NO: 1763173 - RNA, 15 nt, Salmonella enterica enterica serovar Typhi Ty2
uaauacauugccgca

SEQ ID NO: 1763174 - RNA, 19 nt, Salmonella enterica enterica serovar Typhi Ty2
uaauacaucacuuuaugac

SEQ ID NO: 1763175 - RNA, 17 nt, Salmonella enterica enterica serovar Typhi Ty2
uaauacaucagaaaaca

SEQ ID NO: 1763176 - RNA, 21 nt, Salmonella enterica enterica serovar Typhi Ty2
uaauaauugcgguggcgcaaa

SEQ ID NO: 1763177 - RNA, 20 nt, Salmonella enterica enterica serovar Typhi Ty2
uaauauaaccaauuuaaaau

SEQ ID NO: 1763178 - RNA, 18 nt, Salmonella enterica enterica serovar Typhi Ty2
uaauacggagcaaaaaau

SEQ ID NO: 1763179 - RNA, 22 nt, Salmonella enterica enterica serovar Typhi Ty2
uaauacgcgaugagauaauaaa

SEQ ID NO: 1763180 - RNA, 19 nt, Salmonella enterica enterica serovar Typhi Ty2
uaauacguuuauucuuuuc

SEQ ID NO: 1763181 - RNA, 23 nt, Salmonella enterica enterica serovar Typhi Ty2
uaauacgucgugacccacacaua

SEQ ID NO: 1763182 - RNA, 20 nt, Salmonella enterica enterica serovar Typhi Ty2
uaacuauaauugcuuuuuuc

SEQ ID NO: 1763183 - RNA, 18 nt, Salmonella enterica enterica serovar Typhi Ty2
uaacuccaugcccacaca

SEQ ID NO: 1763184 - RNA, 21 nt, Salmonella enterica enterica serovar Typhi Ty2
uaacuccccgccccagcagca

SEQ ID NO: 1763185 - RNA, 13 nt, Salmonella enterica enterica serovar Typhi Ty2
uaacucuucaucg

SEQ ID NO: 1763186 - RNA, 14 nt, Salmonella enterica enterica serovar Typhi Ty2
uaacucguccuguu

SEQ ID NO: 1763187 - RNA, 17 nt, Salmonella enterica enterica serovar Typhi Ty2
uaacguuuuacgcugcc

SEQ ID NO: 1763188 - RNA, 22 nt, Salmonella enterica enterica serovar Typhi Ty2
uaacuaauuguuuguagaaagu

SEQ ID NO: 1763189 - RNA, 23 nt, Salmonella enterica enterica serovar Typhi Ty2
uaacuaauuguuuguagaaagug

SEQ ID NO: 1763190 - RNA, 13 nt, Salmonella enterica enterica serovar Typhi Ty2
uaacguuuucagu

SEQ ID NO: 1763191 - RNA, 15 nt, Salmonella enterica enterica serovar Typhi Ty2
uaacguuacauuuuc

SEQ ID NO: 1763192 - RNA, 22 nt, Salmonella enterica enterica serovar Typhi Ty2
uaacguguuuucgauuucauuc

SEQ ID NO: 1763193 - RNA, 22 nt, Salmonella enterica enterica serovar Typhi Ty2
uaacgucgcgguuacagucuuu

SEQ ID NO: 1763194 - RNA, 19 nt, Salmonella enterica enterica serovar Typhi Ty2
uaacguacagguugugcau

SEQ ID NO: 1763195 - RNA, 17 nt, Salmonella enterica enterica serovar Typhi Ty2
uaacguauuucuuuugc

SEQ ID NO: 1763196 - RNA, 22 nt, Salmonella enterica enterica serovar Typhi Ty2
uaacuucggcaaauucuuuuca

SEQ ID NO: 1763197 - RNA, 16 nt, Salmonella enterica enterica serovar Typhi Ty2
uaacuucggccagcga

SEQ ID NO: 1763198 - RNA, 23 nt, Salmonella enterica enterica serovar Typhi Ty2
uaacuuccuuugccuuucuuauu

SEQ ID NO: 1763199 - RNA, 19 nt, Salmonella enterica enterica serovar Typhi Ty2
uaacuuagcaacugccggc

SEQ ID NO: 1763200 - RNA, 22 nt, Salmonella enterica enterica serovar Typhi Ty2
uaacuuaaacgccggauuccag

SEQ ID NO: 1763201 - RNA, 17 nt, Salmonella enterica enterica serovar Typhi Ty2
aaaucccggcgauuaau

SEQ ID NO: 1763202 - RNA, 18 nt, Salmonella enterica enterica serovar Typhi Ty2
aaauccgccggaaacugg

SEQ ID NO: 1763203 - RNA, 12 nt, Salmonella enterica enterica serovar Typhi Ty2
uaacugcccguc

SEQ ID NO: 1763204 - RNA, 21 nt, Salmonella enterica enterica serovar Typhi Ty2
uaacugcaaaucuucggcaaa

SEQ ID NO: 1763205 - RNA, 17 nt, Salmonella enterica enterica serovar Typhi Ty2
aaauccggaucaucuuu

SEQ ID NO: 1763206 - RNA, 16 nt, Salmonella enterica enterica serovar Typhi Ty2
uaacugccagaacgcu

SEQ ID NO: 1763207 - RNA, 23 nt, Salmonella enterica enterica serovar Typhi Ty2
uaacugcaccuuuuuuuccagcg

SEQ ID NO: 1763208 - RNA, 21 nt, Salmonella enterica enterica serovar Typhi Ty2
aaauccaucucaggccgacaa

SEQ ID NO: 1763209 - RNA, 19 nt, Salmonella enterica enterica serovar Typhi Ty2
aaauccaugagaagaaaaa

SEQ ID NO: 1763210 - RNA, 16 nt, Salmonella enterica enterica serovar Typhi Ty2
uaacugacucugccuc

SEQ ID NO: 1763211 - RNA, 18 nt, Salmonella enterica enterica serovar Typhi Ty2
uaacugaagguuuuuccc

SEQ ID NO: 1763212 - RNA, 17 nt, Salmonella enterica enterica serovar Typhi Ty2
uaacugacaauuuccag

SEQ ID NO: 1763213 - RNA, 23 nt, Salmonella enterica enterica serovar Typhi Ty2
uaacugaacuuccguaaaaagaa

SEQ ID NO: 1763214 - RNA, 18 nt, Salmonella enterica enterica serovar Typhi Ty2
uaagauauccugcuugcc

SEQ ID NO: 1763215 - RNA, 22 nt, Salmonella enterica enterica serovar Typhi Ty2
uaagaccauacuuugcauugcc

SEQ ID NO: 1763216 - RNA, 14 nt, Salmonella enterica enterica serovar Typhi Ty2
uaagaccagcauca

SEQ ID NO: 1763217 - RNA, 17 nt, Salmonella enterica enterica serovar Typhi Ty2
uaagagccugucccacc

SEQ ID NO: 1763218 - RNA, 19 nt, Salmonella enterica enterica serovar Typhi Ty2
uaagagaccgguuauugag

SEQ ID NO: 1763219 - RNA, 21 nt, Salmonella enterica enterica serovar Typhi Ty2
uaacuugacuuugcucuccuu

SEQ ID NO: 1763220 - RNA, 23 nt, Salmonella enterica enterica serovar Typhi Ty2
uaacuucuugguaccaaacagca

SEQ ID NO: 1763221 - RNA, 14 nt, Salmonella enterica enterica serovar Typhi Ty2
uaacuucuccgcca

SEQ ID NO: 1763222 - RNA, 14 nt, Salmonella enterica enterica serovar Typhi Ty2
uaagaaaaaacugg

SEQ ID NO: 1763223 - RNA, 20 nt, Salmonella enterica enterica serovar Typhi Ty2
uaagaaaaaacuggugcagg

SEQ ID NO: 1763224 - RNA, 15 nt, Salmonella enterica enterica serovar Typhi Ty2
uaagaaguaaacaga

SEQ ID NO: 1763225 - RNA, 19 nt, Salmonella enterica enterica serovar Typhi Ty2
uaagaaguaaacagaauca

SEQ ID NO: 1763226 - RNA, 21 nt, Salmonella enterica enterica serovar Typhi Ty2
uaagaaucagaugcucaucaa

SEQ ID NO: 1763227 - RNA, 13 nt, Salmonella enterica enterica serovar Typhi Ty2
uaagaaucgaugu

SEQ ID NO: 1763228 - RNA, 19 nt, Salmonella enterica enterica serovar Typhi Ty2
uaagaauuauuaccaauga

SEQ ID NO: 1763229 - RNA, 21 nt, Salmonella enterica enterica serovar Typhi Ty2
uaagaaacugcuguagcacau

SEQ ID NO: 1763230 - RNA, 16 nt, Salmonella enterica enterica serovar Typhi Ty2
uaagaaagauaaaaua

SEQ ID NO: 1763231 - RNA, 13 nt, Salmonella enterica enterica serovar Typhi Ty2
uaagaacgagaac

SEQ ID NO: 1763232 - RNA, 12 nt, Salmonella enterica enterica serovar Typhi Ty2
uaagaagaacca

SEQ ID NO: 1763233 - RNA, 16 nt, Salmonella enterica enterica serovar Typhi Ty2
uaagcuauuccuguau

SEQ ID NO: 1763234 - RNA, 21 nt, Salmonella enterica enterica serovar Typhi Ty2
uaagcgucacccggcaauuca

SEQ ID NO: 1763235 - RNA, 14 nt, Salmonella enterica enterica serovar Typhi Ty2
uaagcgugcaaccc

SEQ ID NO: 1763236 - RNA, 14 nt, Salmonella enterica enterica serovar Typhi Ty2
uaagcgcuagcgcc

SEQ ID NO: 1763237 - RNA, 16 nt, Salmonella enterica enterica serovar Typhi Ty2
uaagcggcagcgccau

SEQ ID NO: 1763238 - RNA, 20 nt, Salmonella enterica enterica serovar Typhi Ty2
uaagcgcagcgccauugagc

SEQ ID NO: 1763239 - RNA, 14 nt, Salmonella enterica enterica serovar Typhi Ty2
uaagcgcccgucca

SEQ ID NO: 1763240 - RNA, 13 nt, Salmonella enterica enterica serovar Typhi Ty2
uaagcgccgcuga

SEQ ID NO: 1763241 - RNA, 19 nt, Salmonella enterica enterica serovar Typhi Ty2
uaagcuggaccgcagcuua

SEQ ID NO: 1763242 - RNA, 18 nt, Salmonella enterica enterica serovar Typhi Ty2
uaagcugagccuucaccg

SEQ ID NO: 1763243 - RNA, 12 nt, Salmonella enterica enterica serovar Typhi Ty2
uaaggcguucac

SEQ ID NO: 1763244 - RNA, 21 nt, Salmonella enterica enterica serovar Typhi Ty2
uaaggcgauaccuaaucccug

SEQ ID NO: 1763245 - RNA, 13 nt, Salmonella enterica enterica serovar Typhi Ty2
uaaggcgccuuuu

SEQ ID NO: 1763246 - RNA, 13 nt, Salmonella enterica enterica serovar Typhi Ty2
uaaggcaggcaaa

SEQ ID NO: 1763247 - RNA, 23 nt, Salmonella enterica enterica serovar Typhi Ty2
uaaggcaucguugagaaaaccau

SEQ ID NO: 1763248 - RNA, 17 nt, Salmonella enterica enterica serovar Typhi Ty2
uaagcuuugcaccacuu

SEQ ID NO: 1763249 - RNA, 18 nt, Salmonella enterica enterica serovar Typhi Ty2
uaaggaaacgaaagcuca

SEQ ID NO: 1763250 - RNA, 22 nt, Salmonella enterica enterica serovar Typhi Ty2
uaaggauaucuugaugauucac

SEQ ID NO: 1763251 - RNA, 14 nt, Salmonella enterica enterica serovar Typhi Ty2
uaaggaucggaaga

SEQ ID NO: 1763252 - RNA, 21 nt, Salmonella enterica enterica serovar Typhi Ty2
uaagcauccaggaaguaaauu

SEQ ID NO: 1763253 - RNA, 20 nt, Salmonella enterica enterica serovar Typhi Ty2
uaagcacgggcuugaauaac

SEQ ID NO: 1763254 - RNA, 19 nt, Salmonella enterica enterica serovar Typhi Ty2
uaagcacggggguuuugug

SEQ ID NO: 1763255 - RNA, 18 nt, Salmonella enterica enterica serovar Typhi Ty2
uaagauuuaaaacaagca

SEQ ID NO: 1763256 - RNA, 14 nt, Salmonella enterica enterica serovar Typhi Ty2
uaagcaauuaauau

SEQ ID NO: 1763257 - RNA, 12 nt, Salmonella enterica enterica serovar Typhi Ty2
uaagcaauuaau

SEQ ID NO: 1763258 - RNA, 20 nt, Salmonella enterica enterica serovar Typhi Ty2
uaagcaacuugaaguaugaa

SEQ ID NO: 1763259 - RNA, 21 nt, Salmonella enterica enterica serovar Typhi Ty2
uaagcaacugauuaaucugcc

SEQ ID NO: 1763260 - RNA, 23 nt, Salmonella enterica enterica serovar Typhi Ty2
uaagcaauccauuuuaaauacac

SEQ ID NO: 1763261 - RNA, 17 nt, Salmonella enterica enterica serovar Typhi Ty2
uaagccgguaaucacug

SEQ ID NO: 1763262 - RNA, 16 nt, Salmonella enterica enterica serovar Typhi Ty2
uaagccgucauaaaau

SEQ ID NO: 1763263 - RNA, 16 nt, Salmonella enterica enterica serovar Typhi Ty2
uaagccgauugaauaa

SEQ ID NO: 1763264 - RNA, 14 nt, Salmonella enterica enterica serovar Typhi Ty2
uaagcgcagcgcca

SEQ ID NO: 1763265 - RNA, 15 nt, Salmonella enterica enterica serovar Typhi Ty2
uaagcgcagcgccau

SEQ ID NO: 1763266 - RNA, 18 nt, Salmonella enterica enterica serovar Typhi Ty2
uaagcgcaaacuuccaca

SEQ ID NO: 1763267 - RNA, 15 nt, Salmonella enterica enterica serovar Typhi Ty2
uaagcauccaggaag

SEQ ID NO: 1763268 - RNA, 23 nt, Salmonella enterica enterica serovar Typhi Ty2
uaagcauuagcgccauccggcac

SEQ ID NO: 1763269 - RNA, 19 nt, Salmonella enterica enterica serovar Typhi Ty2
uaagccaugugacggcaug

SEQ ID NO: 1763270 - RNA, 21 nt, Salmonella enterica enterica serovar Typhi Ty2
uaaggucgcuauccagcagua

SEQ ID NO: 1763271 - RNA, 16 nt, Salmonella enterica enterica serovar Typhi Ty2
uaagguccagggaaaa

SEQ ID NO: 1763272 - RNA, 14 nt, Salmonella enterica enterica serovar Typhi Ty2
uaagggccuucauu

SEQ ID NO: 1763273 - RNA, 16 nt, Salmonella enterica enterica serovar Typhi Ty2
uaagggcuggaaaauc

SEQ ID NO: 1763274 - RNA, 22 nt, Salmonella enterica enterica serovar Typhi Ty2
uaaggggcaggcgucaaaacag

SEQ ID NO: 1763275 - RNA, 16 nt, Salmonella enterica enterica serovar Typhi Ty2
uaaguaaggaggaauc

SEQ ID NO: 1763276 - RNA, 15 nt, Salmonella enterica enterica serovar Typhi Ty2
uaagguucuggcauu

SEQ ID NO: 1763277 - RNA, 18 nt, Salmonella enterica enterica serovar Typhi Ty2
uaagguucgcuuaaucuc

SEQ ID NO: 1763278 - RNA, 19 nt, Salmonella enterica enterica serovar Typhi Ty2
uaagguuacaggugccugg

SEQ ID NO: 1763279 - RNA, 21 nt, Salmonella enterica enterica serovar Typhi Ty2
uaaguacaagagccgccgcca

SEQ ID NO: 1763280 - RNA, 20 nt, Salmonella enterica enterica serovar Typhi Ty2
uaaguacgccugaaaacaga

SEQ ID NO: 1763281 - RNA, 18 nt, Salmonella enterica enterica serovar Typhi Ty2
uaagucaaccaugaucac

SEQ ID NO: 1763282 - RNA, 20 nt, Salmonella enterica enterica serovar Typhi Ty2
uaagucaucuguucaacuuu

SEQ ID NO: 1763283 - RNA, 16 nt, Salmonella enterica enterica serovar Typhi Ty2
uaaguugaaaggaaag

SEQ ID NO: 1763284 - RNA, 14 nt, Salmonella enterica enterica serovar Typhi Ty2
uaauaaaauucacu

SEQ ID NO: 1763285 - RNA, 16 nt, Salmonella enterica enterica serovar Typhi Ty2
uaaguuuuucucuuau

SEQ ID NO: 1763286 - RNA, 20 nt, Salmonella enterica enterica serovar Typhi Ty2
uaaauuaaacagcuguaaau

SEQ ID NO: 1763287 - RNA, 20 nt, Salmonella enterica enterica serovar Typhi Ty2
uaaauuaaugauuaaaauaa

SEQ ID NO: 1763288 - RNA, 19 nt, Salmonella enterica enterica serovar Typhi Ty2
uaaauucauauuuaaauau

SEQ ID NO: 1763289 - RNA, 14 nt, Salmonella enterica enterica serovar Typhi Ty2
uaaauucauauuua

SEQ ID NO: 1763290 - RNA, 18 nt, Salmonella enterica enterica serovar Typhi Ty2
uaaauuccggcucgccuu

SEQ ID NO: 1763291 - RNA, 14 nt, Salmonella enterica enterica serovar Typhi Ty2
uaaauucucuauac

SEQ ID NO: 1763292 - RNA, 16 nt, Salmonella enterica enterica serovar Typhi Ty2
uaaauucugucucaau

SEQ ID NO: 1763293 - RNA, 16 nt, Salmonella enterica enterica serovar Typhi Ty2
uaaauccagccucucc

SEQ ID NO: 1763294 - RNA, 17 nt, Salmonella enterica enterica serovar Typhi Ty2
uaaauccacauuccaga

SEQ ID NO: 1763295 - RNA, 14 nt, Salmonella enterica enterica serovar Typhi Ty2
uaaauccauauucu

SEQ ID NO: 1763296 - RNA, 19 nt, Salmonella enterica enterica serovar Typhi Ty2
uaaaucccggcgauuaaua

SEQ ID NO: 1763297 - RNA, 21 nt, Salmonella enterica enterica serovar Typhi Ty2
uaaaucgcgcaaauauuacaa

SEQ ID NO: 1763298 - RNA, 21 nt, Salmonella enterica enterica serovar Typhi Ty2
uaaauccguuaagcccugaau

SEQ ID NO: 1763299 - RNA, 19 nt, Salmonella enterica enterica serovar Typhi Ty2
uaaauccguuaagcccuga

SEQ ID NO: 1763300 - RNA, 14 nt, Salmonella enterica enterica serovar Typhi Ty2
uaaaucgcggcgcu

SEQ ID NO: 1763301 - RNA, 18 nt, Salmonella enterica enterica serovar Typhi Ty2
uaacaauuuaucagacaa

SEQ ID NO: 1763302 - RNA, 14 nt, Salmonella enterica enterica serovar Typhi Ty2
uaacaauuuaucag

SEQ ID NO: 1763303 - RNA, 17 nt, Salmonella enterica enterica serovar Typhi Ty2
uaacacaaucaggcgca

SEQ ID NO: 1763304 - RNA, 19 nt, Salmonella enterica enterica serovar Typhi Ty2
uaacaccgcauggcuggca

SEQ ID NO: 1763305 - RNA, 15 nt, Salmonella enterica enterica serovar Typhi Ty2
uaaauugaguggaca

SEQ ID NO: 1763306 - RNA, 14 nt, Salmonella enterica enterica serovar Typhi Ty2
uaacaaaaaacaua

SEQ ID NO: 1763307 - RNA, 16 nt, Salmonella enterica enterica serovar Typhi Ty2
uaacaacuguuuuuca

SEQ ID NO: 1763308 - RNA, 20 nt, Salmonella enterica enterica serovar Typhi Ty2
uaacaaaccgguaaucccuu

SEQ ID NO: 1763309 - RNA, 23 nt, Salmonella enterica enterica serovar Typhi Ty2
uaacaaaccgguaaucccuucac

SEQ ID NO: 1763310 - RNA, 18 nt, Salmonella enterica enterica serovar Typhi Ty2
uaaccuauuuuacaaaau

SEQ ID NO: 1763311 - RNA, 14 nt, Salmonella enterica enterica serovar Typhi Ty2
uaaccuauuuugca

SEQ ID NO: 1763312 - RNA, 16 nt, Salmonella enterica enterica serovar Typhi Ty2
uaaccguucuuccugg

SEQ ID NO: 1763313 - RNA, 15 nt, Salmonella enterica enterica serovar Typhi Ty2
uaaccguucuuccug

SEQ ID NO: 1763314 - RNA, 19 nt, Salmonella enterica enterica serovar Typhi Ty2
uaaccguaacgcuccugga

SEQ ID NO: 1763315 - RNA, 16 nt, Salmonella enterica enterica serovar Typhi Ty2
uaacgcacuuuuccag

SEQ ID NO: 1763316 - RNA, 15 nt, Salmonella enterica enterica serovar Typhi Ty2
uaacgcaacaacagu

SEQ ID NO: 1763317 - RNA, 18 nt, Salmonella enterica enterica serovar Typhi Ty2
uaacgcacuuuuccagcc

SEQ ID NO: 1763318 - RNA, 19 nt, Salmonella enterica enterica serovar Typhi Ty2
uaacgcagaagacagaagc

SEQ ID NO: 1763319 - RNA, 17 nt, Salmonella enterica enterica serovar Typhi Ty2
uaacgcagcaucgccau

SEQ ID NO: 1763320 - RNA, 22 nt, Salmonella enterica enterica serovar Typhi Ty2
uaacgccgaacacgcauaauug

SEQ ID NO: 1763321 - RNA, 22 nt, Salmonella enterica enterica serovar Typhi Ty2
uaacgcacuaccagaaacaaca

SEQ ID NO: 1763322 - RNA, 23 nt, Salmonella enterica enterica serovar Typhi Ty2
uaacgcguguucuuuuucgccuu

SEQ ID NO: 1763323 - RNA, 14 nt, Salmonella enterica enterica serovar Typhi Ty2
uaacgcuaugcuua

SEQ ID NO: 1763324 - RNA, 17 nt, Salmonella enterica enterica serovar Typhi Ty2
uaacgcugcaaaguuau

SEQ ID NO: 1763325 - RNA, 18 nt, Salmonella enterica enterica serovar Typhi Ty2
uaacgcguaaucuuccac

SEQ ID NO: 1763326 - RNA, 16 nt, Salmonella enterica enterica serovar Typhi Ty2
uaacgcuuauccggcc

SEQ ID NO: 1763327 - RNA, 15 nt, Salmonella enterica enterica serovar Typhi Ty2
uaacgccgauuaaug

SEQ ID NO: 1763328 - RNA, 18 nt, Salmonella enterica enterica serovar Typhi Ty2
uaacgccgauuaaugcuc

SEQ ID NO: 1763329 - RNA, 16 nt, Salmonella enterica enterica serovar Typhi Ty2
uaacgcgccaucuuuc

SEQ ID NO: 1763330 - RNA, 23 nt, Salmonella enterica enterica serovar Typhi Ty2
uaacgcgcuggaugcgcaaaugc

SEQ ID NO: 1763331 - RNA, 13 nt, Salmonella enterica enterica serovar Typhi Ty2
uaacggaaucaga

SEQ ID NO: 1763332 - RNA, 16 nt, Salmonella enterica enterica serovar Typhi Ty2
uaacggcaaaaacguu

SEQ ID NO: 1763333 - RNA, 16 nt, Salmonella enterica enterica serovar Typhi Ty2
uaacgguaacggacau

SEQ ID NO: 1763334 - RNA, 14 nt, Salmonella enterica enterica serovar Typhi Ty2
uaacgggacacugc

SEQ ID NO: 1763335 - RNA, 15 nt, Salmonella enterica enterica serovar Typhi Ty2
uaacgggacacugcc

SEQ ID NO: 1763336 - RNA, 22 nt, Salmonella enterica enterica serovar Typhi Ty2
uaacccgcuuacaauuuaucug

SEQ ID NO: 1763337 - RNA, 16 nt, Salmonella enterica enterica serovar Typhi Ty2
uaacccgauacccuga

SEQ ID NO: 1763338 - RNA, 21 nt, Salmonella enterica enterica serovar Typhi Ty2
uaaccauacugacuuaauaac

SEQ ID NO: 1763339 - RNA, 17 nt, Salmonella enterica enterica serovar Typhi Ty2
uaaccagauaagccugu

SEQ ID NO: 1763340 - RNA, 17 nt, Salmonella enterica enterica serovar Typhi Ty2
uaaccacgaaaauuauu

SEQ ID NO: 1763341 - RNA, 22 nt, Salmonella enterica enterica serovar Typhi Ty2
uaaccacgaaaauuauuuucga

SEQ ID NO: 1763342 - RNA, 21 nt, Salmonella enterica enterica serovar Typhi Ty2
uaaccagggaggacgcaagag

SEQ ID NO: 1763343 - RNA, 21 nt, Salmonella enterica enterica serovar Typhi Ty2
uaacaucaccuuucauuuuau

SEQ ID NO: 1763344 - RNA, 18 nt, Salmonella enterica enterica serovar Typhi Ty2
uaacaucuuccaugccuu

SEQ ID NO: 1763345 - RNA, 21 nt, Salmonella enterica enterica serovar Typhi Ty2
uaacacuuugaacgagucuua

SEQ ID NO: 1763346 - RNA, 21 nt, Salmonella enterica enterica serovar Typhi Ty2
uaacagacgcaucuuuuuccc

SEQ ID NO: 1763347 - RNA, 19 nt, Salmonella enterica enterica serovar Typhi Ty2
uaacagagagggaaaaaaa

SEQ ID NO: 1763348 - RNA, 17 nt, Salmonella enterica enterica serovar Typhi Ty2
uaacaucaccuuucauu

SEQ ID NO: 1763349 - RNA, 13 nt, Salmonella enterica enterica serovar Typhi Ty2
uaacacuaacuaa

SEQ ID NO: 1763350 - RNA, 13 nt, Salmonella enterica enterica serovar Typhi Ty2
uaaaucauaauuu

SEQ ID NO: 1763351 - RNA, 23 nt, Salmonella enterica enterica serovar Typhi Ty2
uaaaucagcuuugcggccagcau

SEQ ID NO: 1763352 - RNA, 17 nt, Salmonella enterica enterica serovar Typhi Ty2
uaaaucagcacacgcca

SEQ ID NO: 1763353 - RNA, 10 nt, Salmonella enterica enterica serovar Typhi Ty2
uaaaucagcc

SEQ ID NO: 1763354 - RNA, 18 nt, Salmonella enterica enterica serovar Typhi Ty2
uaaaucagcgauaaccag

SEQ ID NO: 1763355 - RNA, 12 nt, Salmonella enterica enterica serovar Typhi Ty2
uaaaucagcgau

SEQ ID NO: 1763356 - RNA, 21 nt, Salmonella enterica enterica serovar Typhi Ty2
uaaaucauuacuuauauuuau

SEQ ID NO: 1763357 - RNA, 19 nt, Salmonella enterica enterica serovar Typhi Ty2
uaaaucauuacuuauauuu

SEQ ID NO: 1763358 - RNA, 21 nt, Salmonella enterica enterica serovar Typhi Ty2
uaaaucauuuguacaaaaaau

SEQ ID NO: 1763359 - RNA, 17 nt, Salmonella enterica enterica serovar Typhi Ty2
uaaaucauccugcggca

SEQ ID NO: 1763360 - RNA, 22 nt, Salmonella enterica enterica serovar Typhi Ty2
uaaauaugaaagagaaaucuca

SEQ ID NO: 1763361 - RNA, 17 nt, Salmonella enterica enterica serovar Typhi Ty2
uaaauaaccgguaacug

SEQ ID NO: 1763362 - RNA, 21 nt, Salmonella enterica enterica serovar Typhi Ty2
uaaauaagaagguuaauauac

SEQ ID NO: 1763363 - RNA, 20 nt, Salmonella enterica enterica serovar Typhi Ty2
uaaauaacauuucagucuaa

SEQ ID NO: 1763364 - RNA, 16 nt, Salmonella enterica enterica serovar Typhi Ty2
uaaauaacaaaugaag

SEQ ID NO: 1763365 - RNA, 17 nt, Salmonella enterica enterica serovar Typhi Ty2
uaaaguuuuucauaucc

SEQ ID NO: 1763366 - RNA, 18 nt, Salmonella enterica enterica serovar Typhi Ty2
uaaauauaagaucuauuu

SEQ ID NO: 1763367 - RNA, 15 nt, Salmonella enterica enterica serovar Typhi Ty2
uaaaguguuaucaug

SEQ ID NO: 1763368 - RNA, 21 nt, Salmonella enterica enterica serovar Typhi Ty2
uaaaguacggcgcgccaauaa

SEQ ID NO: 1763369 - RNA, 17 nt, Salmonella enterica enterica serovar Typhi Ty2
uaaaguaguuggugggu

SEQ ID NO: 1763370 - RNA, 14 nt, Salmonella enterica enterica serovar Typhi Ty2
uaaagcaucagacu

SEQ ID NO: 1763371 - RNA, 19 nt, Salmonella enterica enterica serovar Typhi Ty2
uaaagcauagcgucaucaa

SEQ ID NO: 1763372 - RNA, 17 nt, Salmonella enterica enterica serovar Typhi Ty2
uaaagcccagcacggca

SEQ ID NO: 1763373 - RNA, 21 nt, Salmonella enterica enterica serovar Typhi Ty2
uaaagccauccaucuccggca

SEQ ID NO: 1763374 - RNA, 14 nt, Salmonella enterica enterica serovar Typhi Ty2
uaaagauuggcauc

SEQ ID NO: 1763375 - RNA, 21 nt, Salmonella enterica enterica serovar Typhi Ty2
uaaagccgccauccggcauuu

SEQ ID NO: 1763376 - RNA, 15 nt, Salmonella enterica enterica serovar Typhi Ty2
uaaagcccugacaga

SEQ ID NO: 1763377 - RNA, 15 nt, Salmonella enterica enterica serovar Typhi Ty2
uaaagcccuguuauu

SEQ ID NO: 1763378 - RNA, 17 nt, Salmonella enterica enterica serovar Typhi Ty2
uaaacaacgccauaaua

SEQ ID NO: 1763379 - RNA, 13 nt, Salmonella enterica enterica serovar Typhi Ty2
guuuuucccggau

SEQ ID NO: 1763380 - RNA, 21 nt, Salmonella enterica enterica serovar Typhi Ty2
guuuuuagccuguuauucaau

SEQ ID NO: 1763381 - RNA, 15 nt, Salmonella enterica enterica serovar Typhi Ty2
uaaacacuaaaucau

SEQ ID NO: 1763382 - RNA, 17 nt, Salmonella enterica enterica serovar Typhi Ty2
uaaacacguuaucugac

SEQ ID NO: 1763383 - RNA, 15 nt, Salmonella enterica enterica serovar Typhi Ty2
uaaacacguuaucug

SEQ ID NO: 1763384 - RNA, 16 nt, Salmonella enterica enterica serovar Typhi Ty2
uaaacagcuccgcaaa

SEQ ID NO: 1763385 - RNA, 21 nt, Salmonella enterica enterica serovar Typhi Ty2
uaaaccacaugaccagcgccg

SEQ ID NO: 1763386 - RNA, 15 nt, Salmonella enterica enterica serovar Typhi Ty2
uaaaccaaagcagag

SEQ ID NO: 1763387 - RNA, 23 nt, Salmonella enterica enterica serovar Typhi Ty2
uaaaccgcugccacacucucucc

SEQ ID NO: 1763388 - RNA, 15 nt, Salmonella enterica enterica serovar Typhi Ty2
uaaacgcucaagcaa

SEQ ID NO: 1763389 - RNA, 12 nt, Salmonella enterica enterica serovar Typhi Ty2
uaaacgccggau

SEQ ID NO: 1763390 - RNA, 17 nt, Salmonella enterica enterica serovar Typhi Ty2
uaaacuccauuaaauua

SEQ ID NO: 1763391 - RNA, 17 nt, Salmonella enterica enterica serovar Typhi Ty2
uaaacucaaucaggcua

SEQ ID NO: 1763392 - RNA, 21 nt, Salmonella enterica enterica serovar Typhi Ty2
uaaacggcagccgccaccaca

SEQ ID NO: 1763393 - RNA, 22 nt, Salmonella enterica enterica serovar Typhi Ty2
uaaacggcucugcaucauuccu

SEQ ID NO: 1763394 - RNA, 11 nt, Salmonella enterica enterica serovar Typhi Ty2
uaaacugccuu

SEQ ID NO: 1763395 - RNA, 22 nt, Salmonella enterica enterica serovar Typhi Ty2
uaaacuguccaguuuuugcauu

SEQ ID NO: 1763396 - RNA, 22 nt, Salmonella enterica enterica serovar Typhi Ty2
uaaacuucacgucgcucacauu

SEQ ID NO: 1763397 - RNA, 15 nt, Salmonella enterica enterica serovar Typhi Ty2
uaaacuguuuccagu

SEQ ID NO: 1763398 - RNA, 16 nt, Salmonella enterica enterica serovar Typhi Ty2
gcugaucccgcgcgcc

SEQ ID NO: 1763399 - RNA, 17 nt, Salmonella enterica enterica serovar Typhi Ty2
gcugaucccgcgcgccu

SEQ ID NO: 1763400 - RNA, 14 nt, Salmonella enterica enterica serovar Typhi Ty2
gcugagaaaaauac

SEQ ID NO: 1763401 - RNA, 21 nt, Salmonella enterica enterica serovar Typhi Ty2
gcugaucgugauaggccagac

SEQ ID NO: 1763402 - RNA, 19 nt, Salmonella enterica enterica serovar Typhi Ty2
gcugauuccggcgcaucca

SEQ ID NO: 1763403 - RNA, 19 nt, Salmonella enterica enterica serovar Typhi Ty2
gcugccacacucucuccag

SEQ ID NO: 1763404 - RNA, 15 nt, Salmonella enterica enterica serovar Typhi Ty2
gcugauuuguuaucu

SEQ ID NO: 1763405 - RNA, 20 nt, Salmonella enterica enterica serovar Typhi Ty2
gcugauuuguuaucuacagu

SEQ ID NO: 1763406 - RNA, 15 nt, Salmonella enterica enterica serovar Typhi Ty2
gcugcaacucuccca

SEQ ID NO: 1763407 - RNA, 16 nt, Salmonella enterica enterica serovar Typhi Ty2
gcugacgcagcaguuc

SEQ ID NO: 1763408 - RNA, 15 nt, Salmonella enterica enterica serovar Typhi Ty2
gcugacgcccaucag

SEQ ID NO: 1763409 - RNA, 15 nt, Salmonella enterica enterica serovar Typhi Ty2
gcugacgacgccagc

SEQ ID NO: 1763410 - RNA, 13 nt, Salmonella enterica enterica serovar Typhi Ty2
gcugagaaaaaua

SEQ ID NO: 1763411 - RNA, 17 nt, Salmonella enterica enterica serovar Typhi Ty2
gcugaccuuaauccagc

SEQ ID NO: 1763412 - RNA, 19 nt, Salmonella enterica enterica serovar Typhi Ty2
gcugacgacauucagcaca

SEQ ID NO: 1763413 - RNA, 21 nt, Salmonella enterica enterica serovar Typhi Ty2
gcugacgacauucagcacaug

SEQ ID NO: 1763414 - RNA, 17 nt, Salmonella enterica enterica serovar Typhi Ty2
gcugacaaacccuguau

SEQ ID NO: 1763415 - RNA, 17 nt, Salmonella enterica enterica serovar Typhi Ty2
gcugacauccaucaucu

SEQ ID NO: 1763416 - RNA, 15 nt, Salmonella enterica enterica serovar Typhi Ty2
gcugacaaucugcug

SEQ ID NO: 1763417 - RNA, 18 nt, Salmonella enterica enterica serovar Typhi Ty2
gcugacacccucugcgcc

SEQ ID NO: 1763418 - RNA, 13 nt, Salmonella enterica enterica serovar Typhi Ty2
gcugaauaacccc

SEQ ID NO: 1763419 - RNA, 17 nt, Salmonella enterica enterica serovar Typhi Ty2
gcugaauagccagcccc

SEQ ID NO: 1763420 - RNA, 12 nt, Salmonella enterica enterica serovar Typhi Ty2
gcugaauguucu

SEQ ID NO: 1763421 - RNA, 22 nt, Salmonella enterica enterica serovar Typhi Ty2
gcugaaccacccugaaaaguua

SEQ ID NO: 1763422 - RNA, 18 nt, Salmonella enterica enterica serovar Typhi Ty2
gcugaagcuugaaccggg

SEQ ID NO: 1763423 - RNA, 21 nt, Salmonella enterica enterica serovar Typhi Ty2
gcucucgccgcgcuccaucau

SEQ ID NO: 1763424 - RNA, 15 nt, Salmonella enterica enterica serovar Typhi Ty2
gcugaaauagccccg

SEQ ID NO: 1763425 - RNA, 21 nt, Salmonella enterica enterica serovar Typhi Ty2
gcuggaaaaauaagagggcgc

SEQ ID NO: 1763426 - RNA, 22 nt, Salmonella enterica enterica serovar Typhi Ty2
gcugcuguaacagacgcaggcc

SEQ ID NO: 1763427 - RNA, 14 nt, Salmonella enterica enterica serovar Typhi Ty2
gcuggaugaggcgc

SEQ ID NO: 1763428 - RNA, 17 nt, Salmonella enterica enterica serovar Typhi Ty2
gcugcuauuuugcgcuu

SEQ ID NO: 1763429 - RNA, 18 nt, Salmonella enterica enterica serovar Typhi Ty2
gcugcuauuucaguggcu

SEQ ID NO: 1763430 - RNA, 17 nt, Salmonella enterica enterica serovar Typhi Ty2
gcugcgcuuaccgggcc

SEQ ID NO: 1763431 - RNA, 12 nt, Salmonella enterica enterica serovar Typhi Ty2
gcugcgccgcgc

SEQ ID NO: 1763432 - RNA, 23 nt, Salmonella enterica enterica serovar Typhi Ty2
gcugcgccauauccucgcugggc

SEQ ID NO: 1763433 - RNA, 22 nt, Salmonella enterica enterica serovar Typhi Ty2
gcugccgacaaagagcucccca

SEQ ID NO: 1763434 - RNA, 16 nt, Salmonella enterica enterica serovar Typhi Ty2
gcugccgaucagauug

SEQ ID NO: 1763435 - RNA, 19 nt, Salmonella enterica enterica serovar Typhi Ty2
gcugccgcaacggucgguc

SEQ ID NO: 1763436 - RNA, 22 nt, Salmonella enterica enterica serovar Typhi Ty2
gcugccgauagcaucgcugaug

SEQ ID NO: 1763437 - RNA, 21 nt, Salmonella enterica enterica serovar Typhi Ty2
gcugccgccauuugcgcggcu

SEQ ID NO: 1763438 - RNA, 15 nt, Salmonella enterica enterica serovar Typhi Ty2
gcugcgacagcgaac

SEQ ID NO: 1763439 - RNA, 18 nt, Salmonella enterica enterica serovar Typhi Ty2
gcugcgauaaugaagcau

SEQ ID NO: 1763440 - RNA, 13 nt, Salmonella enterica enterica serovar Typhi Ty2
gcugcgcauccgc

SEQ ID NO: 1763441 - RNA, 18 nt, Salmonella enterica enterica serovar Typhi Ty2
gcugccuuauccggccug

SEQ ID NO: 1763442 - RNA, 14 nt, Salmonella enterica enterica serovar Typhi Ty2
gcugccucuuuguu

SEQ ID NO: 1763443 - RNA, 20 nt, Salmonella enterica enterica serovar Typhi Ty2
gcucuaucgccgcccgcaug

SEQ ID NO: 1763444 - RNA, 22 nt, Salmonella enterica enterica serovar Typhi Ty2
gcucuaucgccuggagcugauc

SEQ ID NO: 1763445 - RNA, 13 nt, Salmonella enterica enterica serovar Typhi Ty2
gcucuccuggcau

SEQ ID NO: 1763446 - RNA, 22 nt, Salmonella enterica enterica serovar Typhi Ty2
gcucuccuccaaagguauggag

SEQ ID NO: 1763447 - RNA, 14 nt, Salmonella enterica enterica serovar Typhi Ty2
gcucuaucaccgcc

SEQ ID NO: 1763448 - RNA, 20 nt, Salmonella enterica enterica serovar Typhi Ty2
gcucuaucaccgcccgccgg

SEQ ID NO: 1763449 - RNA, 22 nt, Salmonella enterica enterica serovar Typhi Ty2
gcucuacguugaccucaucacc

SEQ ID NO: 1763450 - RNA, 13 nt, Salmonella enterica enterica serovar Typhi Ty2
gcucgguggcggu

SEQ ID NO: 1763451 - RNA, 15 nt, Salmonella enterica enterica serovar Typhi Ty2
gcucgcuuugccgcc

SEQ ID NO: 1763452 - RNA, 19 nt, Salmonella enterica enterica serovar Typhi Ty2
gcucgcuuacgcggcgcgc

SEQ ID NO: 1763453 - RNA, 22 nt, Salmonella enterica enterica serovar Typhi Ty2
gcucgcuaugaaaacgcagccc

SEQ ID NO: 1763454 - RNA, 23 nt, Salmonella enterica enterica serovar Typhi Ty2
gcucgcuaugaaaacgcagcccc

SEQ ID NO: 1763455 - RNA, 19 nt, Salmonella enterica enterica serovar Typhi Ty2
gcucgccgaccggcgcgcc

SEQ ID NO: 1763456 - RNA, 18 nt, Salmonella enterica enterica serovar Typhi Ty2
gcucgccgccucccccuc

SEQ ID NO: 1763457 - RNA, 14 nt, Salmonella enterica enterica serovar Typhi Ty2
gcucgcccgccgca

SEQ ID NO: 1763458 - RNA, 23 nt, Salmonella enterica enterica serovar Typhi Ty2
gcucgcccgccgcaaaaaauacc

SEQ ID NO: 1763459 - RNA, 13 nt, Salmonella enterica enterica serovar Typhi Ty2
gcucgcccgccgc

SEQ ID NO: 1763460 - RNA, 13 nt, Salmonella enterica enterica serovar Typhi Ty2
gcucgccagcgcu

SEQ ID NO: 1763461 - RNA, 22 nt, Salmonella enterica enterica serovar Typhi Ty2
gcucgccagcgcugucagugaa

SEQ ID NO: 1763462 - RNA, 16 nt, Salmonella enterica enterica serovar Typhi Ty2
gcucgcauucgcgagc

SEQ ID NO: 1763463 - RNA, 19 nt, Salmonella enterica enterica serovar Typhi Ty2
gcucgaucccgacccauac

SEQ ID NO: 1763464 - RNA, 20 nt, Salmonella enterica enterica serovar Typhi Ty2
gcucgacguccagcgcguga

SEQ ID NO: 1763465 - RNA, 15 nt, Salmonella enterica enterica serovar Typhi Ty2
gcuccugcgggcuua

SEQ ID NO: 1763466 - RNA, 12 nt, Salmonella enterica enterica serovar Typhi Ty2
gcuccuggaacc

SEQ ID NO: 1763467 - RNA, 18 nt, Salmonella enterica enterica serovar Typhi Ty2
gcgguaauaacugacaga

SEQ ID NO: 1763468 - RNA, 16 nt, Salmonella enterica enterica serovar Typhi Ty2
gcgguaaucugccagc

SEQ ID NO: 1763469 - RNA, 17 nt, Salmonella enterica enterica serovar Typhi Ty2
gcggucaccuucggucc

SEQ ID NO: 1763470 - RNA, 16 nt, Salmonella enterica enterica serovar Typhi Ty2
gcggucaaaagcugca

SEQ ID NO: 1763471 - RNA, 22 nt, Salmonella enterica enterica serovar Typhi Ty2
gcucaucaaacagcggcacuuc

SEQ ID NO: 1763472 - RNA, 15 nt, Salmonella enterica enterica serovar Typhi Ty2
gcucaguugguuaga

SEQ ID NO: 1763473 - RNA, 13 nt, Salmonella enterica enterica serovar Typhi Ty2
gcucaucucaagc

SEQ ID NO: 1763474 - RNA, 24 nt, Salmonella enterica enterica serovar Typhi Ty2
gcucaugacaucgcccugggucac

SEQ ID NO: 1763475 - RNA, 22 nt, Salmonella enterica enterica serovar Typhi Ty2
gcucauuugcggcgucgccugg

SEQ ID NO: 1763476 - RNA, 19 nt, Salmonella enterica enterica serovar Typhi Ty2
gcucaugauagggcagcag

SEQ ID NO: 1763477 - RNA, 17 nt, Salmonella enterica enterica serovar Typhi Ty2
gcucaugauagggcagc

SEQ ID NO: 1763478 - RNA, 13 nt, Salmonella enterica enterica serovar Typhi Ty2
gcuccaauaaaua

SEQ ID NO: 1763479 - RNA, 9 nt, Salmonella enterica enterica serovar Typhi Ty2
gcuccagca

SEQ ID NO: 1763480 - RNA, 18 nt, Salmonella enterica enterica serovar Typhi Ty2
gcuccagcgccagcucca

SEQ ID NO: 1763481 - RNA, 12 nt, Salmonella enterica enterica serovar Typhi Ty2
gcuccagccgcu

SEQ ID NO: 1763482 - RNA, 16 nt, Salmonella enterica enterica serovar Typhi Ty2
gcuccgggccaugauc

SEQ ID NO: 1763483 - RNA, 19 nt, Salmonella enterica enterica serovar Typhi Ty2
gcuccgcgccgaaauuuuc

SEQ ID NO: 1763484 - RNA, 20 nt, Salmonella enterica enterica serovar Typhi Ty2
gcuccguucccucgacaauu

SEQ ID NO: 1763485 - RNA, 21 nt, Salmonella enterica enterica serovar Typhi Ty2
gcucccuuauacaggcgcagg

SEQ ID NO: 1763486 - RNA, 19 nt, Salmonella enterica enterica serovar Typhi Ty2
gcuccgaauaauccuuccc

SEQ ID NO: 1763487 - RNA, 22 nt, Salmonella enterica enterica serovar Typhi Ty2
gcuccgagacucaaagaaaaca

SEQ ID NO: 1763488 - RNA, 15 nt, Salmonella enterica enterica serovar Typhi Ty2
gcuccgccagcaaug

SEQ ID NO: 1763489 - RNA, 14 nt, Salmonella enterica enterica serovar Typhi Ty2
gcuccgccagcaau

SEQ ID NO: 1763490 - RNA, 12 nt, Salmonella enterica enterica serovar Typhi Ty2
gcuccgcacggu

SEQ ID NO: 1763491 - RNA, 20 nt, Salmonella enterica enterica serovar Typhi Ty2
gcuccgcaaagcccaucagc

SEQ ID NO: 1763492 - RNA, 19 nt, Salmonella enterica enterica serovar Typhi Ty2
gcuccauagaaaucagcag

SEQ ID NO: 1763493 - RNA, 19 nt, Salmonella enterica enterica serovar Typhi Ty2
gcuccaucacgguaaaccu

SEQ ID NO: 1763494 - RNA, 20 nt, Salmonella enterica enterica serovar Typhi Ty2
gcuccaucacgguaaaccug

SEQ ID NO: 1763495 - RNA, 21 nt, Salmonella enterica enterica serovar Typhi Ty2
gcuccaguuguuccagcagcu

SEQ ID NO: 1763496 - RNA, 15 nt, Salmonella enterica enterica serovar Typhi Ty2
gcuccauagaaauca

SEQ ID NO: 1763497 - RNA, 18 nt, Salmonella enterica enterica serovar Typhi Ty2
gcuccauagaaaucagca

SEQ ID NO: 1763498 - RNA, 15 nt, Salmonella enterica enterica serovar Typhi Ty2
gcuccauccaccagc

SEQ ID NO: 1763499 - RNA, 16 nt, Salmonella enterica enterica serovar Typhi Ty2
gcuccaguuguuccag

SEQ ID NO: 1763500 - RNA, 15 nt, Salmonella enterica enterica serovar Typhi Ty2
gcuccaucuccggca

SEQ ID NO: 1763501 - RNA, 15 nt, Salmonella enterica enterica serovar Typhi Ty2
gcuuuagggcuuccu

SEQ ID NO: 1763502 - RNA, 16 nt, Salmonella enterica enterica serovar Typhi Ty2
gcuuuagcuuuacucu

SEQ ID NO: 1763503 - RNA, 20 nt, Salmonella enterica enterica serovar Typhi Ty2
gcuuuaggguaucauuucca

SEQ ID NO: 1763504 - RNA, 17 nt, Salmonella enterica enterica serovar Typhi Ty2
gcuuuaaucaccauggc

SEQ ID NO: 1763505 - RNA, 18 nt, Salmonella enterica enterica serovar Typhi Ty2
gcuuuaauauucauucug

SEQ ID NO: 1763506 - RNA, 17 nt, Salmonella enterica enterica serovar Typhi Ty2
gcuuuaacgcugcaaag

SEQ ID NO: 1763507 - RNA, 13 nt, Salmonella enterica enterica serovar Typhi Ty2
gcuuuaaguuuuu

SEQ ID NO: 1763508 - RNA, 16 nt, Salmonella enterica enterica serovar Typhi Ty2
gcuuuaaauucagcac

SEQ ID NO: 1763509 - RNA, 17 nt, Salmonella enterica enterica serovar Typhi Ty2
gcuuguuguaaagaaau

SEQ ID NO: 1763510 - RNA, 19 nt, Salmonella enterica enterica serovar Typhi Ty2
gcuuguuguuuauccugca

SEQ ID NO: 1763511 - RNA, 15 nt, Salmonella enterica enterica serovar Typhi Ty2
gcuuguuaucuggca

SEQ ID NO: 1763512 - RNA, 22 nt, Salmonella enterica enterica serovar Typhi Ty2
gcuuucccguuucagccccuug

SEQ ID NO: 1763513 - RNA, 15 nt, Salmonella enterica enterica serovar Typhi Ty2
gcuuucccuucagau

SEQ ID NO: 1763514 - RNA, 13 nt, Salmonella enterica enterica serovar Typhi Ty2
gcuuuccgccaug

SEQ ID NO: 1763515 - RNA, 16 nt, Salmonella enterica enterica serovar Typhi Ty2
gcuuuccgccaugaaa

SEQ ID NO: 1763516 - RNA, 12 nt, Salmonella enterica enterica serovar Typhi Ty2
gcuuuccagcuc

SEQ ID NO: 1763517 - RNA, 19 nt, Salmonella enterica enterica serovar Typhi Ty2
gcuuucaguaauaauauaa

SEQ ID NO: 1763518 - RNA, 17 nt, Salmonella enterica enterica serovar Typhi Ty2
gcuuucagauuagccag

SEQ ID NO: 1763519 - RNA, 22 nt, Salmonella enterica enterica serovar Typhi Ty2
gcuuucaucauaucuucccgau

SEQ ID NO: 1763520 - RNA, 13 nt, Salmonella enterica enterica serovar Typhi Ty2
gcuuuaugcacgc

SEQ ID NO: 1763521 - RNA, 16 nt, Salmonella enterica enterica serovar Typhi Ty2
gcuuuauuuuacaacu

SEQ ID NO: 1763522 - RNA, 18 nt, Salmonella enterica enterica serovar Typhi Ty2
gcuuucacgccauuggca

SEQ ID NO: 1763523 - RNA, 22 nt, Salmonella enterica enterica serovar Typhi Ty2
aaaggcguguguuuagauaaca

SEQ ID NO: 1763524 - RNA, 18 nt, Salmonella enterica enterica serovar Typhi Ty2
aaaggccuggcugagaaa

SEQ ID NO: 1763525 - RNA, 14 nt, Salmonella enterica enterica serovar Typhi Ty2
gcuugucacgaagc

SEQ ID NO: 1763526 - RNA, 16 nt, Salmonella enterica enterica serovar Typhi Ty2
gcuugucgccaugcac

SEQ ID NO: 1763527 - RNA, 15 nt, Salmonella enterica enterica serovar Typhi Ty2
gcuugucauccugcu

SEQ ID NO: 1763528 - RNA, 16 nt, Salmonella enterica enterica serovar Typhi Ty2
gcuugucauccugcuc

SEQ ID NO: 1763529 - RNA, 20 nt, Salmonella enterica enterica serovar Typhi Ty2
gcuuggcguauagccgcccc

SEQ ID NO: 1763530 - RNA, 19 nt, Salmonella enterica enterica serovar Typhi Ty2
gcuugcuuuucaucaccau

SEQ ID NO: 1763531 - RNA, 16 nt, Salmonella enterica enterica serovar Typhi Ty2
gcuugcugcguaaaag

SEQ ID NO: 1763532 - RNA, 17 nt, Salmonella enterica enterica serovar Typhi Ty2
aaaggcagacagagaaa

SEQ ID NO: 1763533 - RNA, 16 nt, Salmonella enterica enterica serovar Typhi Ty2
aaaggcauuaagucau

SEQ ID NO: 1763534 - RNA, 17 nt, Salmonella enterica enterica serovar Typhi Ty2
gcuugaauaacauaaag

SEQ ID NO: 1763535 - RNA, 20 nt, Salmonella enterica enterica serovar Typhi Ty2
gcuucuuugaaauugaucac

SEQ ID NO: 1763536 - RNA, 21 nt, Salmonella enterica enterica serovar Typhi Ty2
gcuucuuugaagcguuccagu

SEQ ID NO: 1763537 - RNA, 18 nt, Salmonella enterica enterica serovar Typhi Ty2
gcuucuucuuuagauaau

SEQ ID NO: 1763538 - RNA, 15 nt, Salmonella enterica enterica serovar Typhi Ty2
gcuucuucgccagcu

SEQ ID NO: 1763539 - RNA, 17 nt, Salmonella enterica enterica serovar Typhi Ty2
gcuugagacagaccaca

SEQ ID NO: 1763540 - RNA, 14 nt, Salmonella enterica enterica serovar Typhi Ty2
gcuugauaaauauc

SEQ ID NO: 1763541 - RNA, 19 nt, Salmonella enterica enterica serovar Typhi Ty2
gcuugaguuuuccgccauu

SEQ ID NO: 1763542 - RNA, 20 nt, Salmonella enterica enterica serovar Typhi Ty2
gcuugaucucucccuggcag

SEQ ID NO: 1763543 - RNA, 23 nt, Salmonella enterica enterica serovar Typhi Ty2
gcuugcagcguaauagucugcuc

SEQ ID NO: 1763544 - RNA, 19 nt, Salmonella enterica enterica serovar Typhi Ty2
gcuugcauugcuuuuaguu

SEQ ID NO: 1763545 - RNA, 20 nt, Salmonella enterica enterica serovar Typhi Ty2
gcuugccacuacgcagcucc

SEQ ID NO: 1763546 - RNA, 14 nt, Salmonella enterica enterica serovar Typhi Ty2
gcuugcccggccgu

SEQ ID NO: 1763547 - RNA, 21 nt, Salmonella enterica enterica serovar Typhi Ty2
gcuugcccggccuacauucau

SEQ ID NO: 1763548 - RNA, 16 nt, Salmonella enterica enterica serovar Typhi Ty2
gcuugccgaccgcaac

SEQ ID NO: 1763549 - RNA, 15 nt, Salmonella enterica enterica serovar Typhi Ty2
gcuugcgcuauccgc

SEQ ID NO: 1763550 - RNA, 16 nt, Salmonella enterica enterica serovar Typhi Ty2
gcuugcgccaucaucc

SEQ ID NO: 1763551 - RNA, 19 nt, Salmonella enterica enterica serovar Typhi Ty2
gcuugcgccaucauccggc

SEQ ID NO: 1763552 - RNA, 22 nt, Salmonella enterica enterica serovar Typhi Ty2
gcuugccgucacaggcggccag

SEQ ID NO: 1763553 - RNA, 12 nt, Salmonella enterica enterica serovar Typhi Ty2
gcuugccugcuu

SEQ ID NO: 1763554 - RNA, 19 nt, Salmonella enterica enterica serovar Typhi Ty2
gcuugccugugcccgcggu

SEQ ID NO: 1763555 - RNA, 20 nt, Salmonella enterica enterica serovar Typhi Ty2
gcuucuccaccauaucgcag

SEQ ID NO: 1763556 - RNA, 11 nt, Salmonella enterica enterica serovar Typhi Ty2
gcuucucccaa

SEQ ID NO: 1763557 - RNA, 16 nt, Salmonella enterica enterica serovar Typhi Ty2
gcuucuauuaccgcag

SEQ ID NO: 1763558 - RNA, 14 nt, Salmonella enterica enterica serovar Typhi Ty2
gcuucgucuuuauu

SEQ ID NO: 1763559 - RNA, 15 nt, Salmonella enterica enterica serovar Typhi Ty2
gcuucgugagaagua

SEQ ID NO: 1763560 - RNA, 21 nt, Salmonella enterica enterica serovar Typhi Ty2
gcuucguggcaaucagcaauu

SEQ ID NO: 1763561 - RNA, 16 nt, Salmonella enterica enterica serovar Typhi Ty2
gcuucugucugcguga

SEQ ID NO: 1763562 - RNA, 21 nt, Salmonella enterica enterica serovar Typhi Ty2
gcuucugcgccuuuggcagga

SEQ ID NO: 1763563 - RNA, 20 nt, Salmonella enterica enterica serovar Typhi Ty2
gcuucuguccuuucugcugc

SEQ ID NO: 1763564 - RNA, 16 nt, Salmonella enterica enterica serovar Typhi Ty2
gcuucugauacugcuc

SEQ ID NO: 1763565 - RNA, 19 nt, Salmonella enterica enterica serovar Typhi Ty2
gcuucucuucaaacucgcu

SEQ ID NO: 1763566 - RNA, 22 nt, Salmonella enterica enterica serovar Typhi Ty2
gcuucgccaauaaugccgccgu

SEQ ID NO: 1763567 - RNA, 24 nt, Salmonella enterica enterica serovar Typhi Ty2
gcuucgcgaacugcacucggaugu

SEQ ID NO: 1763568 - RNA, 20 nt, Salmonella enterica enterica serovar Typhi Ty2
gcuucgcgcagccagcgccc

SEQ ID NO: 1763569 - RNA, 15 nt, Salmonella enterica enterica serovar Typhi Ty2
gcuucggacuccuga

SEQ ID NO: 1763570 - RNA, 18 nt, Salmonella enterica enterica serovar Typhi Ty2
gcuucgucaggcggcugc

SEQ ID NO: 1763571 - RNA, 17 nt, Salmonella enterica enterica serovar Typhi Ty2
gcuucgucaggcggcug

SEQ ID NO: 1763572 - RNA, 19 nt, Salmonella enterica enterica serovar Typhi Ty2
gcuucagccugugcaacca

SEQ ID NO: 1763573 - RNA, 21 nt, Salmonella enterica enterica serovar Typhi Ty2
gcuucagucauaauccuuccu

SEQ ID NO: 1763574 - RNA, 21 nt, Salmonella enterica enterica serovar Typhi Ty2
gcuucaggcucaucagcgcca

SEQ ID NO: 1763575 - RNA, 19 nt, Salmonella enterica enterica serovar Typhi Ty2
gcuucauugguuaauucaa

SEQ ID NO: 1763576 - RNA, 22 nt, Salmonella enterica enterica serovar Typhi Ty2
gcuuccagcaaaccuuccgcca

SEQ ID NO: 1763577 - RNA, 19 nt, Salmonella enterica enterica serovar Typhi Ty2
gcuuccacgcacgccggcc

SEQ ID NO: 1763578 - RNA, 12 nt, Salmonella enterica enterica serovar Typhi Ty2
gcuucaugcugg

SEQ ID NO: 1763579 - RNA, 17 nt, Salmonella enterica enterica serovar Typhi Ty2
gcuucccgaaaggaagc

SEQ ID NO: 1763580 - RNA, 18 nt, Salmonella enterica enterica serovar Typhi Ty2
gcuucccgaugccagcaa

SEQ ID NO: 1763581 - RNA, 16 nt, Salmonella enterica enterica serovar Typhi Ty2
gcuucccgaugccagc

SEQ ID NO: 1763582 - RNA, 12 nt, Salmonella enterica enterica serovar Typhi Ty2
gcuuccagcaug

SEQ ID NO: 1763583 - RNA, 21 nt, Salmonella enterica enterica serovar Typhi Ty2
gcuuccagcgcgucggccggc

SEQ ID NO: 1763584 - RNA, 13 nt, Salmonella enterica enterica serovar Typhi Ty2
gcuuccagcucca

SEQ ID NO: 1763585 - RNA, 17 nt, Salmonella enterica enterica serovar Typhi Ty2
gcuuccagcuccaucca

SEQ ID NO: 1763586 - RNA, 22 nt, Salmonella enterica enterica serovar Typhi Ty2
gcuuccaguugaaaaccacaau

SEQ ID NO: 1763587 - RNA, 13 nt, Salmonella enterica enterica serovar Typhi Ty2
gcuuccuggaugu

SEQ ID NO: 1763588 - RNA, 19 nt, Salmonella enterica enterica serovar Typhi Ty2
gcuuccugcgcugucacca

SEQ ID NO: 1763589 - RNA, 15 nt, Salmonella enterica enterica serovar Typhi Ty2
gcuuccuguuuauga

SEQ ID NO: 1763590 - RNA, 20 nt, Salmonella enterica enterica serovar Typhi Ty2
gcuuccuguuuaugacccug

SEQ ID NO: 1763591 - RNA, 14 nt, Salmonella enterica enterica serovar Typhi Ty2
gcuuccgccgggaa

SEQ ID NO: 1763592 - RNA, 17 nt, Salmonella enterica enterica serovar Typhi Ty2
gcuuccggcacuuucag

SEQ ID NO: 1763593 - RNA, 15 nt, Salmonella enterica enterica serovar Typhi Ty2
gcuuacggcuauucc

SEQ ID NO: 1763594 - RNA, 21 nt, Salmonella enterica enterica serovar Typhi Ty2
gcuuacuuuuagaauuaucug

SEQ ID NO: 1763595 - RNA, 23 nt, Salmonella enterica enterica serovar Typhi Ty2
gcuuacuuuccaaaauccaggga

SEQ ID NO: 1763596 - RNA, 18 nt, Salmonella enterica enterica serovar Typhi Ty2
gcuuaccuuguucuucca

SEQ ID NO: 1763597 - RNA, 23 nt, Salmonella enterica enterica serovar Typhi Ty2
gcuuacggccauggaacauccuc

SEQ ID NO: 1763598 - RNA, 15 nt, Salmonella enterica enterica serovar Typhi Ty2
gcuuacggccaugga

SEQ ID NO: 1763599 - RNA, 17 nt, Salmonella enterica enterica serovar Typhi Ty2
gcuuacgcggcgcgcuc

SEQ ID NO: 1763600 - RNA, 22 nt, Salmonella enterica enterica serovar Typhi Ty2
gcuuacauuucaggcaaaaaaa

SEQ ID NO: 1763601 - RNA, 17 nt, Salmonella enterica enterica serovar Typhi Ty2
gcuuacaggcacgccug

SEQ ID NO: 1763602 - RNA, 18 nt, Salmonella enterica enterica serovar Typhi Ty2
gcuuaucaggccuaccag

SEQ ID NO: 1763603 - RNA, 20 nt, Salmonella enterica enterica serovar Typhi Ty2
gcuuaucacguagccagagc

SEQ ID NO: 1763604 - RNA, 23 nt, Salmonella enterica enterica serovar Typhi Ty2
gcuuaucgauaucugccugcaga

SEQ ID NO: 1763605 - RNA, 17 nt, Salmonella enterica enterica serovar Typhi Ty2
gcuuauccggccugcac

SEQ ID NO: 1763606 - RNA, 19 nt, Salmonella enterica enterica serovar Typhi Ty2
gcuuaucucuacuuuccug

SEQ ID NO: 1763607 - RNA, 16 nt, Salmonella enterica enterica serovar Typhi Ty2
gcuuaguaaccccagg

SEQ ID NO: 1763608 - RNA, 18 nt, Salmonella enterica enterica serovar Typhi Ty2
gcuuaucugaccaugcca

SEQ ID NO: 1763609 - RNA, 21 nt, Salmonella enterica enterica serovar Typhi Ty2
gcuuauuagaggcguaaguaa

SEQ ID NO: 1763610 - RNA, 17 nt, Salmonella enterica enterica serovar Typhi Ty2
gcuucaacagcggcggc

SEQ ID NO: 1763611 - RNA, 14 nt, Salmonella enterica enterica serovar Typhi Ty2
gcuucaacagcggc

SEQ ID NO: 1763612 - RNA, 18 nt, Salmonella enterica enterica serovar Typhi Ty2
gcuucaacagcggcggca

SEQ ID NO: 1763613 - RNA, 17 nt, Salmonella enterica enterica serovar Typhi Ty2
gcuucacgagcggucag

SEQ ID NO: 1763614 - RNA, 23 nt, Salmonella enterica enterica serovar Typhi Ty2
gcuucacgagcggucaggccagc

SEQ ID NO: 1763615 - RNA, 11 nt, Salmonella enterica enterica serovar Typhi Ty2
gcuucacgcca

SEQ ID NO: 1763616 - RNA, 14 nt, Salmonella enterica enterica serovar Typhi Ty2
gcuucacgccacag

SEQ ID NO: 1763617 - RNA, 22 nt, Salmonella enterica enterica serovar Typhi Ty2
gcuucacgcgcuguaacuucac

SEQ ID NO: 1763618 - RNA, 18 nt, Salmonella enterica enterica serovar Typhi Ty2
gcuucacguuuuccaggu

SEQ ID NO: 1763619 - RNA, 17 nt, Salmonella enterica enterica serovar Typhi Ty2
gcuucacuaacugguac

SEQ ID NO: 1763620 - RNA, 16 nt, Salmonella enterica enterica serovar Typhi Ty2
gcuucacgucagcgac

SEQ ID NO: 1763621 - RNA, 19 nt, Salmonella enterica enterica serovar Typhi Ty2
gcuucagacaacgccgccu

SEQ ID NO: 1763622 - RNA, 13 nt, Salmonella enterica enterica serovar Typhi Ty2
gcuucagagcagg

SEQ ID NO: 1763623 - RNA, 18 nt, Salmonella enterica enterica serovar Typhi Ty2
gcuucaccgauuuaaaau

SEQ ID NO: 1763624 - RNA, 19 nt, Salmonella enterica enterica serovar Typhi Ty2
gcuucaccgccagagcacg

SEQ ID NO: 1763625 - RNA, 20 nt, Salmonella enterica enterica serovar Typhi Ty2
gcuucaccggcgugcgcuua

SEQ ID NO: 1763626 - RNA, 13 nt, Salmonella enterica enterica serovar Typhi Ty2
gcuucaccucagc

SEQ ID NO: 1763627 - RNA, 22 nt, Salmonella enterica enterica serovar Typhi Ty2
gcuucaauaaguuagcuuuuuu

SEQ ID NO: 1763628 - RNA, 22 nt, Salmonella enterica enterica serovar Typhi Ty2
gcuguucaaucacugaugccac

SEQ ID NO: 1763629 - RNA, 13 nt, Salmonella enterica enterica serovar Typhi Ty2
gcuguuccacggg

SEQ ID NO: 1763630 - RNA, 19 nt, Salmonella enterica enterica serovar Typhi Ty2
gcuguuccuucagaaaauu

SEQ ID NO: 1763631 - RNA, 17 nt, Salmonella enterica enterica serovar Typhi Ty2
gcuguuaaucucauaaa

SEQ ID NO: 1763632 - RNA, 19 nt, Salmonella enterica enterica serovar Typhi Ty2
gcuguuaaucucauaaaug

SEQ ID NO: 1763633 - RNA, 15 nt, Salmonella enterica enterica serovar Typhi Ty2
gcuguguccgccaug

SEQ ID NO: 1763634 - RNA, 16 nt, Salmonella enterica enterica serovar Typhi Ty2
gcuguguccaggucau

SEQ ID NO: 1763635 - RNA, 14 nt, Salmonella enterica enterica serovar Typhi Ty2
gcugucccagaguu

SEQ ID NO: 1763636 - RNA, 15 nt, Salmonella enterica enterica serovar Typhi Ty2
gcugucccaguguca

SEQ ID NO: 1763637 - RNA, 14 nt, Salmonella enterica enterica serovar Typhi Ty2
gcuguccagccgcc

SEQ ID NO: 1763638 - RNA, 15 nt, Salmonella enterica enterica serovar Typhi Ty2
gcuguccagccgccc

SEQ ID NO: 1763639 - RNA, 20 nt, Salmonella enterica enterica serovar Typhi Ty2
gcuuaaacauauacugcugu

SEQ ID NO: 1763640 - RNA, 18 nt, Salmonella enterica enterica serovar Typhi Ty2
gcuuaacagaauugcgcc

SEQ ID NO: 1763641 - RNA, 19 nt, Salmonella enterica enterica serovar Typhi Ty2
gcuuaaacaguauuuaugu

SEQ ID NO: 1763642 - RNA, 23 nt, Salmonella enterica enterica serovar Typhi Ty2
gcuuaacccugccguuugcgcca

SEQ ID NO: 1763643 - RNA, 16 nt, Salmonella enterica enterica serovar Typhi Ty2
gcuuaaugcucugcug

SEQ ID NO: 1763644 - RNA, 18 nt, Salmonella enterica enterica serovar Typhi Ty2
gcuuaauggcgucaauca

SEQ ID NO: 1763645 - RNA, 18 nt, Salmonella enterica enterica serovar Typhi Ty2
gcuuacacagacugcuug

SEQ ID NO: 1763646 - RNA, 17 nt, Salmonella enterica enterica serovar Typhi Ty2
gcuuacaauuuaucugc

SEQ ID NO: 1763647 - RNA, 18 nt, Salmonella enterica enterica serovar Typhi Ty2
gcuguuuauccacaggcg

SEQ ID NO: 1763648 - RNA, 13 nt, Salmonella enterica enterica serovar Typhi Ty2
gcuguuucucgau

SEQ ID NO: 1763649 - RNA, 15 nt, Salmonella enterica enterica serovar Typhi Ty2
gcuuaaaaaauccug

SEQ ID NO: 1763650 - RNA, 13 nt, Salmonella enterica enterica serovar Typhi Ty2
gcuuaaaaaaucc

SEQ ID NO: 1763651 - RNA, 14 nt, Salmonella enterica enterica serovar Typhi Ty2
gcuguacuuuugcu

SEQ ID NO: 1763652 - RNA, 16 nt, Salmonella enterica enterica serovar Typhi Ty2
aaaggagccuuacggc

SEQ ID NO: 1763653 - RNA, 18 nt, Salmonella enterica enterica serovar Typhi Ty2
aaaggaaugccugcgcuu

SEQ ID NO: 1763654 - RNA, 22 nt, Salmonella enterica enterica serovar Typhi Ty2
gcuguagcguuucacgcgcgcc

SEQ ID NO: 1763655 - RNA, 13 nt, Salmonella enterica enterica serovar Typhi Ty2
gcuguagcugccc

SEQ ID NO: 1763656 - RNA, 22 nt, Salmonella enterica enterica serovar Typhi Ty2
gcuguaguuucagcccaaaagc

SEQ ID NO: 1763657 - RNA, 15 nt, Salmonella enterica enterica serovar Typhi Ty2
gcugucaccagcagc

SEQ ID NO: 1763658 - RNA, 15 nt, Salmonella enterica enterica serovar Typhi Ty2
gcuguauuucccucu

SEQ ID NO: 1763659 - RNA, 19 nt, Salmonella enterica enterica serovar Typhi Ty2
gcuggugccaaucuccagc

SEQ ID NO: 1763660 - RNA, 15 nt, Salmonella enterica enterica serovar Typhi Ty2
gcuggugaagacgcu

SEQ ID NO: 1763661 - RNA, 18 nt, Salmonella enterica enterica serovar Typhi Ty2
gcuggucugaaucugcuc

SEQ ID NO: 1763662 - RNA, 19 nt, Salmonella enterica enterica serovar Typhi Ty2
gcuggucgccgcccaucgg

SEQ ID NO: 1763663 - RNA, 17 nt, Salmonella enterica enterica serovar Typhi Ty2
gcuggucgccgcccauc

SEQ ID NO: 1763664 - RNA, 16 nt, Salmonella enterica enterica serovar Typhi Ty2
gcuggucaccuggcug

SEQ ID NO: 1763665 - RNA, 19 nt, Salmonella enterica enterica serovar Typhi Ty2
gcuggucaccuggcuggug

SEQ ID NO: 1763666 - RNA, 21 nt, Salmonella enterica enterica serovar Typhi Ty2
gcuggucagcgcaaucugcuc

SEQ ID NO: 1763667 - RNA, 15 nt, Salmonella enterica enterica serovar Typhi Ty2
gcuggucgccagcgc

SEQ ID NO: 1763668 - RNA, 13 nt, Salmonella enterica enterica serovar Typhi Ty2
gcuggucgagaua

SEQ ID NO: 1763669 - RNA, 18 nt, Salmonella enterica enterica serovar Typhi Ty2
gcuggcaaaacgcaucca

SEQ ID NO: 1763670 - RNA, 20 nt, Salmonella enterica enterica serovar Typhi Ty2
ggccagaaaccggucgccgu

SEQ ID NO: 1763671 - RNA, 20 nt, Salmonella enterica enterica serovar Typhi Ty2
ggccaauguacguaaaacca

SEQ ID NO: 1763672 - RNA, 22 nt, Salmonella enterica enterica serovar Typhi Ty2
ggccaaugccgccuuuaucgac

SEQ ID NO: 1763673 - RNA, 21 nt, Salmonella enterica enterica serovar Typhi Ty2
ggccaagcgccuguucaacau

SEQ ID NO: 1763674 - RNA, 21 nt, Salmonella enterica enterica serovar Typhi Ty2
ggccaauccagcuacuggcca

SEQ ID NO: 1763675 - RNA, 14 nt, Salmonella enterica enterica serovar Typhi Ty2
ggcauuauguuuug

SEQ ID NO: 1763676 - RNA, 17 nt, Salmonella enterica enterica serovar Typhi Ty2
ggcauuagccgccaucc

SEQ ID NO: 1763677 - RNA, 17 nt, Salmonella enterica enterica serovar Typhi Ty2
ggcauuaauauccagug

SEQ ID NO: 1763678 - RNA, 19 nt, Salmonella enterica enterica serovar Typhi Ty2
ggcauucgaauccuccugu

SEQ ID NO: 1763679 - RNA, 18 nt, Salmonella enterica enterica serovar Typhi Ty2
ggcauucgaauccuccug

SEQ ID NO: 1763680 - RNA, 22 nt, Salmonella enterica enterica serovar Typhi Ty2
ggcauucgcagaggacauuaaa

SEQ ID NO: 1763681 - RNA, 20 nt, Salmonella enterica enterica serovar Typhi Ty2
ggcauugccggaaaccaacc

SEQ ID NO: 1763682 - RNA, 18 nt, Salmonella enterica enterica serovar Typhi Ty2
ggcauuggcaucugucau

SEQ ID NO: 1763683 - RNA, 22 nt, Salmonella enterica enterica serovar Typhi Ty2
ggcauuucaccgucaauaacgg

SEQ ID NO: 1763684 - RNA, 11 nt, Salmonella enterica enterica serovar Typhi Ty2
ggcaucucaag

SEQ ID NO: 1763685 - RNA, 14 nt, Salmonella enterica enterica serovar Typhi Ty2
ggcaucgucggcga

SEQ ID NO: 1763686 - RNA, 18 nt, Salmonella enterica enterica serovar Typhi Ty2
ggcaucggaaccggggcg

SEQ ID NO: 1763687 - RNA, 21 nt, Salmonella enterica enterica serovar Typhi Ty2
ggcaucgggauuuacaaccgc

SEQ ID NO: 1763688 - RNA, 13 nt, Salmonella enterica enterica serovar Typhi Ty2
ggcaucucgccaa

SEQ ID NO: 1763689 - RNA, 19 nt, Salmonella enterica enterica serovar Typhi Ty2
aaagucaacugcucuacca

SEQ ID NO: 1763690 - RNA, 14 nt, Salmonella enterica enterica serovar Typhi Ty2
ggcaggggaaagcu

SEQ ID NO: 1763691 - RNA, 19 nt, Salmonella enterica enterica serovar Typhi Ty2
ggcauccagcgcucaauca

SEQ ID NO: 1763692 - RNA, 19 nt, Salmonella enterica enterica serovar Typhi Ty2
ggcaucagacgguggccga

SEQ ID NO: 1763693 - RNA, 13 nt, Salmonella enterica enterica serovar Typhi Ty2
ggcaucacgccgg

SEQ ID NO: 1763694 - RNA, 16 nt, Salmonella enterica enterica serovar Typhi Ty2
ggcaucauaaaaggca

SEQ ID NO: 1763695 - RNA, 16 nt, Salmonella enterica enterica serovar Typhi Ty2
ggcaucaauaaaauca

SEQ ID NO: 1763696 - RNA, 11 nt, Salmonella enterica enterica serovar Typhi Ty2
ggcaggcuggu

SEQ ID NO: 1763697 - RNA, 23 nt, Salmonella enterica enterica serovar Typhi Ty2
ggcagggaauacccgcccgguuu

SEQ ID NO: 1763698 - RNA, 15 nt, Salmonella enterica enterica serovar Typhi Ty2
ggcaggccuaacaca

SEQ ID NO: 1763699 - RNA, 19 nt, Salmonella enterica enterica serovar Typhi Ty2
ggcaggaaauccagcagaa

SEQ ID NO: 1763700 - RNA, 15 nt, Salmonella enterica enterica serovar Typhi Ty2
ggcagcucugccugu

SEQ ID NO: 1763701 - RNA, 15 nt, Salmonella enterica enterica serovar Typhi Ty2
ggcagcucuuucaac

SEQ ID NO: 1763702 - RNA, 11 nt, Salmonella enterica enterica serovar Typhi Ty2
ggcagcucucc

SEQ ID NO: 1763703 - RNA, 12 nt, Salmonella enterica enterica serovar Typhi Ty2
aaaguagccaau

SEQ ID NO: 1763704 - RNA, 19 nt, Salmonella enterica enterica serovar Typhi Ty2
aaaguaguuggugggugau

SEQ ID NO: 1763705 - RNA, 19 nt, Salmonella enterica enterica serovar Typhi Ty2
aaaguauaaagcugguuga

SEQ ID NO: 1763706 - RNA, 19 nt, Salmonella enterica enterica serovar Typhi Ty2
ggcagagcgcgcucugccu

SEQ ID NO: 1763707 - RNA, 12 nt, Salmonella enterica enterica serovar Typhi Ty2
ggcagagcgcgc

SEQ ID NO: 1763708 - RNA, 15 nt, Salmonella enterica enterica serovar Typhi Ty2
ggcagaccggcagcc

SEQ ID NO: 1763709 - RNA, 11 nt, Salmonella enterica enterica serovar Typhi Ty2
ggcagaauaaa

SEQ ID NO: 1763710 - RNA, 15 nt, Salmonella enterica enterica serovar Typhi Ty2
ggcaagcgaagcgcu

SEQ ID NO: 1763711 - RNA, 15 nt, Salmonella enterica enterica serovar Typhi Ty2
ggcaagcucagcggc

SEQ ID NO: 1763712 - RNA, 13 nt, Salmonella enterica enterica serovar Typhi Ty2
ggcagauucuucu

SEQ ID NO: 1763713 - RNA, 23 nt, Salmonella enterica enterica serovar Typhi Ty2
ggcagccaugcuauucagcaguu

SEQ ID NO: 1763714 - RNA, 16 nt, Salmonella enterica enterica serovar Typhi Ty2
ggcagaucgcgcuccc

SEQ ID NO: 1763715 - RNA, 16 nt, Salmonella enterica enterica serovar Typhi Ty2
ggcagaguccagcggc

SEQ ID NO: 1763716 - RNA, 16 nt, Salmonella enterica enterica serovar Typhi Ty2
ggcagccgccaccaca

SEQ ID NO: 1763717 - RNA, 15 nt, Salmonella enterica enterica serovar Typhi Ty2
ggcagccgacagcgu

SEQ ID NO: 1763718 - RNA, 22 nt, Salmonella enterica enterica serovar Typhi Ty2
ggcagccggauuuuaaauuggu

SEQ ID NO: 1763719 - RNA, 22 nt, Salmonella enterica enterica serovar Typhi Ty2
ggcccgguaagcacaacgcauu

SEQ ID NO: 1763720 - RNA, 17 nt, Salmonella enterica enterica serovar Typhi Ty2
ggcccgguaagcgcagc

SEQ ID NO: 1763721 - RNA, 15 nt, Salmonella enterica enterica serovar Typhi Ty2
ggcccgguggcgcca

SEQ ID NO: 1763722 - RNA, 16 nt, Salmonella enterica enterica serovar Typhi Ty2
ggcccguaucgcucag

SEQ ID NO: 1763723 - RNA, 17 nt, Salmonella enterica enterica serovar Typhi Ty2
ggcccuaacgggcucgu

SEQ ID NO: 1763724 - RNA, 17 nt, Salmonella enterica enterica serovar Typhi Ty2
ggcccguggcccaggcc

SEQ ID NO: 1763725 - RNA, 20 nt, Salmonella enterica enterica serovar Typhi Ty2
ggccgaaggaagauagcggg

SEQ ID NO: 1763726 - RNA, 22 nt, Salmonella enterica enterica serovar Typhi Ty2
ggcccgauacgcggaucggcac

SEQ ID NO: 1763727 - RNA, 18 nt, Salmonella enterica enterica serovar Typhi Ty2
aaagugaaggccagacuu

SEQ ID NO: 1763728 - RNA, 22 nt, Salmonella enterica enterica serovar Typhi Ty2
aaagucggggcguaaaaauuuu

SEQ ID NO: 1763729 - RNA, 17 nt, Salmonella enterica enterica serovar Typhi Ty2
aaagucggccauuuuuu

SEQ ID NO: 1763730 - RNA, 18 nt, Salmonella enterica enterica serovar Typhi Ty2
ggcccgccagcacagcaa

SEQ ID NO: 1763731 - RNA, 17 nt, Salmonella enterica enterica serovar Typhi Ty2
ggcccgccagcacagca

SEQ ID NO: 1763732 - RNA, 20 nt, Salmonella enterica enterica serovar Typhi Ty2
ggcccagcuaaaccacggaa

SEQ ID NO: 1763733 - RNA, 21 nt, Salmonella enterica enterica serovar Typhi Ty2
ggcccagcuuaguaaccccag

SEQ ID NO: 1763734 - RNA, 17 nt, Salmonella enterica enterica serovar Typhi Ty2
ggcccaguguacugcca

SEQ ID NO: 1763735 - RNA, 18 nt, Salmonella enterica enterica serovar Typhi Ty2
ggcccauaaacaggucac

SEQ ID NO: 1763736 - RNA, 15 nt, Salmonella enterica enterica serovar Typhi Ty2
ggccccaauuugcug

SEQ ID NO: 1763737 - RNA, 14 nt, Salmonella enterica enterica serovar Typhi Ty2
ggcccccuguucca

SEQ ID NO: 1763738 - RNA, 15 nt, Salmonella enterica enterica serovar Typhi Ty2
ggccagauggcaaac

SEQ ID NO: 1763739 - RNA, 14 nt, Salmonella enterica enterica serovar Typhi Ty2
ggccagauucuuag

SEQ ID NO: 1763740 - RNA, 20 nt, Salmonella enterica enterica serovar Typhi Ty2
ggccagggcaggcagugaac

SEQ ID NO: 1763741 - RNA, 23 nt, Salmonella enterica enterica serovar Typhi Ty2
ggccaugauccugguccggcagg

SEQ ID NO: 1763742 - RNA, 21 nt, Salmonella enterica enterica serovar Typhi Ty2
ggccaucaacuucucgcaggc

SEQ ID NO: 1763743 - RNA, 12 nt, Salmonella enterica enterica serovar Typhi Ty2
ggccaucaacuu

SEQ ID NO: 1763744 - RNA, 19 nt, Salmonella enterica enterica serovar Typhi Ty2
ggccaguuuccugacccgc

SEQ ID NO: 1763745 - RNA, 18 nt, Salmonella enterica enterica serovar Typhi Ty2
ggccaguuguucuuucac

SEQ ID NO: 1763746 - RNA, 17 nt, Salmonella enterica enterica serovar Typhi Ty2
ggccaguuguucuuuca

SEQ ID NO: 1763747 - RNA, 23 nt, Salmonella enterica enterica serovar Typhi Ty2
ggcaagagauucaggccgccagc

SEQ ID NO: 1763748 - RNA, 19 nt, Salmonella enterica enterica serovar Typhi Ty2
ggcaagauuaaccagcagu

SEQ ID NO: 1763749 - RNA, 17 nt, Salmonella enterica enterica serovar Typhi Ty2
ggcaacccgcuccagaa

SEQ ID NO: 1763750 - RNA, 16 nt, Salmonella enterica enterica serovar Typhi Ty2
ggcaaccaccagcagu

SEQ ID NO: 1763751 - RNA, 19 nt, Salmonella enterica enterica serovar Typhi Ty2
ggcaaaacgggcggcggcu

SEQ ID NO: 1763752 - RNA, 15 nt, Salmonella enterica enterica serovar Typhi Ty2
ggcaacacccgccga

SEQ ID NO: 1763753 - RNA, 20 nt, Salmonella enterica enterica serovar Typhi Ty2
ggcaaaaauccuucuuccau

SEQ ID NO: 1763754 - RNA, 16 nt, Salmonella enterica enterica serovar Typhi Ty2
ggauucugccaucgac

SEQ ID NO: 1763755 - RNA, 21 nt, Salmonella enterica enterica serovar Typhi Ty2
ggauucucuaacgucagcgcc

SEQ ID NO: 1763756 - RNA, 19 nt, Salmonella enterica enterica serovar Typhi Ty2
ggauucgacggccagcgcg

SEQ ID NO: 1763757 - RNA, 22 nt, Salmonella enterica enterica serovar Typhi Ty2
ggauuaucaggaugaauaugaa

SEQ ID NO: 1763758 - RNA, 12 nt, Salmonella enterica enterica serovar Typhi Ty2
ggauuaucagaa

SEQ ID NO: 1763759 - RNA, 16 nt, Salmonella enterica enterica serovar Typhi Ty2
ggauguggugcggcuu

SEQ ID NO: 1763760 - RNA, 17 nt, Salmonella enterica enterica serovar Typhi Ty2
ggauguugccacaggcu

SEQ ID NO: 1763761 - RNA, 19 nt, Salmonella enterica enterica serovar Typhi Ty2
ggauuacgcgccugccuga

SEQ ID NO: 1763762 - RNA, 17 nt, Salmonella enterica enterica serovar Typhi Ty2
ggauggcaguacagggc

SEQ ID NO: 1763763 - RNA, 14 nt, Salmonella enterica enterica serovar Typhi Ty2
ggauggccagcacc

SEQ ID NO: 1763764 - RNA, 12 nt, Salmonella enterica enterica serovar Typhi Ty2
ggauggcggcga

SEQ ID NO: 1763765 - RNA, 13 nt, Salmonella enterica enterica serovar Typhi Ty2
ggaugcagucugg

SEQ ID NO: 1763766 - RNA, 19 nt, Salmonella enterica enterica serovar Typhi Ty2
ggaugcaucaugcuaaaag

SEQ ID NO: 1763767 - RNA, 15 nt, Salmonella enterica enterica serovar Typhi Ty2
ggaugccaaccaccg

SEQ ID NO: 1763768 - RNA, 18 nt, Salmonella enterica enterica serovar Typhi Ty2
ggaugcgcagguaaaacc

SEQ ID NO: 1763769 - RNA, 21 nt, Salmonella enterica enterica serovar Typhi Ty2
ggaugugaccuuugugcagga

SEQ ID NO: 1763770 - RNA, 18 nt, Salmonella enterica enterica serovar Typhi Ty2
ggaugugcauugacuacu

SEQ ID NO: 1763771 - RNA, 13 nt, Salmonella enterica enterica serovar Typhi Ty2
ggauguggugcgg

SEQ ID NO: 1763772 - RNA, 23 nt, Salmonella enterica enterica serovar Typhi Ty2
aaaguaccagcgcgaacauuaca

SEQ ID NO: 1763773 - RNA, 22 nt, Salmonella enterica enterica serovar Typhi Ty2
aaaguacaucauuggcccggcg

SEQ ID NO: 1763774 - RNA, 12 nt, Salmonella enterica enterica serovar Typhi Ty2
ggaugucggcgu

SEQ ID NO: 1763775 - RNA, 17 nt, Salmonella enterica enterica serovar Typhi Ty2
ggaugaccaguuaagca

SEQ ID NO: 1763776 - RNA, 22 nt, Salmonella enterica enterica serovar Typhi Ty2
ggaugaacucuaugcaaaagaa

SEQ ID NO: 1763777 - RNA, 23 nt, Salmonella enterica enterica serovar Typhi Ty2
ggaugacggcgaacggggagaca

SEQ ID NO: 1763778 - RNA, 14 nt, Salmonella enterica enterica serovar Typhi Ty2
ggaucgguuuaucc

SEQ ID NO: 1763779 - RNA, 15 nt, Salmonella enterica enterica serovar Typhi Ty2
ggaucgguuuauccc

SEQ ID NO: 1763780 - RNA, 22 nt, Salmonella enterica enterica serovar Typhi Ty2
ggaucgucucugagaucaaaca

SEQ ID NO: 1763781 - RNA, 16 nt, Salmonella enterica enterica serovar Typhi Ty2
ggaucggccauaucca

SEQ ID NO: 1763782 - RNA, 15 nt, Salmonella enterica enterica serovar Typhi Ty2
ggaucaauaugccag

SEQ ID NO: 1763783 - RNA, 16 nt, Salmonella enterica enterica serovar Typhi Ty2
ggaucauguugagcuu

SEQ ID NO: 1763784 - RNA, 13 nt, Salmonella enterica enterica serovar Typhi Ty2
ggaucaucuuuua

SEQ ID NO: 1763785 - RNA, 15 nt, Salmonella enterica enterica serovar Typhi Ty2
ggaucaucggccaga

SEQ ID NO: 1763786 - RNA, 13 nt, Salmonella enterica enterica serovar Typhi Ty2
ggagcccaguagc

SEQ ID NO: 1763787 - RNA, 18 nt, Salmonella enterica enterica serovar Typhi Ty2
ggagccgccuggccuguc

SEQ ID NO: 1763788 - RNA, 20 nt, Salmonella enterica enterica serovar Typhi Ty2
ggauaacauguggcuggggc

SEQ ID NO: 1763789 - RNA, 12 nt, Salmonella enterica enterica serovar Typhi Ty2
ggauaaaacaga

SEQ ID NO: 1763790 - RNA, 20 nt, Salmonella enterica enterica serovar Typhi Ty2
ggauaacgcagaagacagaa

SEQ ID NO: 1763791 - RNA, 17 nt, Salmonella enterica enterica serovar Typhi Ty2
ggauaacguucuuuuga

SEQ ID NO: 1763792 - RNA, 19 nt, Salmonella enterica enterica serovar Typhi Ty2
ggauaacggcgcaaagaca

SEQ ID NO: 1763793 - RNA, 21 nt, Salmonella enterica enterica serovar Typhi Ty2
ggauaagcgaugcgcggaugc

SEQ ID NO: 1763794 - RNA, 19 nt, Salmonella enterica enterica serovar Typhi Ty2
ggauaagcggcagcgccau

SEQ ID NO: 1763795 - RNA, 20 nt, Salmonella enterica enterica serovar Typhi Ty2
ggauaaggcguuuacgcugc

SEQ ID NO: 1763796 - RNA, 18 nt, Salmonella enterica enterica serovar Typhi Ty2
ggauacguucauccuccu

SEQ ID NO: 1763797 - RNA, 21 nt, Salmonella enterica enterica serovar Typhi Ty2
ggauacuaaagggaucuuccu

SEQ ID NO: 1763798 - RNA, 15 nt, Salmonella enterica enterica serovar Typhi Ty2
ggauagaugaagaca

SEQ ID NO: 1763799 - RNA, 18 nt, Salmonella enterica enterica serovar Typhi Ty2
ggauacuguuuuugcuuu

SEQ ID NO: 1763800 - RNA, 17 nt, Salmonella enterica enterica serovar Typhi Ty2
ggauauguuugacaagc

SEQ ID NO: 1763801 - RNA, 16 nt, Salmonella enterica enterica serovar Typhi Ty2
ggauauguuugacaag

SEQ ID NO: 1763802 - RNA, 13 nt, Salmonella enterica enterica serovar Typhi Ty2
ggauauggcaaaa

SEQ ID NO: 1763803 - RNA, 19 nt, Salmonella enterica enterica serovar Typhi Ty2
ggauaugcgacgaaagcgg

SEQ ID NO: 1763804 - RNA, 12 nt, Salmonella enterica enterica serovar Typhi Ty2
ggauagcaaucu

SEQ ID NO: 1763805 - RNA, 21 nt, Salmonella enterica enterica serovar Typhi Ty2
ggaucaaaaaggugagcauug

SEQ ID NO: 1763806 - RNA, 17 nt, Salmonella enterica enterica serovar Typhi Ty2
ggauauucaucaguuua

SEQ ID NO: 1763807 - RNA, 16 nt, Salmonella enterica enterica serovar Typhi Ty2
ggauauuggcguuaga

SEQ ID NO: 1763808 - RNA, 19 nt, Salmonella enterica enterica serovar Typhi Ty2
ggauauguauuuguucucg

SEQ ID NO: 1763809 - RNA, 19 nt, Salmonella enterica enterica serovar Typhi Ty2
ggaucaaacgugccuggau

SEQ ID NO: 1763810 - RNA, 13 nt, Salmonella enterica enterica serovar Typhi Ty2
ggacggcaucagg

SEQ ID NO: 1763811 - RNA, 23 nt, Salmonella enterica enterica serovar Typhi Ty2
ggacugauacagccaaaucagca

SEQ ID NO: 1763812 - RNA, 21 nt, Salmonella enterica enterica serovar Typhi Ty2
ggacuggagguacauugccag

SEQ ID NO: 1763813 - RNA, 13 nt, Salmonella enterica enterica serovar Typhi Ty2
ggacugccuaacu

SEQ ID NO: 1763814 - RNA, 15 nt, Salmonella enterica enterica serovar Typhi Ty2
ggacuguacaagaag

SEQ ID NO: 1763815 - RNA, 17 nt, Salmonella enterica enterica serovar Typhi Ty2
ggagauuucauccucuu

SEQ ID NO: 1763816 - RNA, 15 nt, Salmonella enterica enterica serovar Typhi Ty2
ggagagccagaagaa

SEQ ID NO: 1763817 - RNA, 18 nt, Salmonella enterica enterica serovar Typhi Ty2
ggagaccccacacuacca

SEQ ID NO: 1763818 - RNA, 14 nt, Salmonella enterica enterica serovar Typhi Ty2
ggagaaaacgcggc

SEQ ID NO: 1763819 - RNA, 18 nt, Salmonella enterica enterica serovar Typhi Ty2
ggacgcugacgccaggcc

SEQ ID NO: 1763820 - RNA, 20 nt, Salmonella enterica enterica serovar Typhi Ty2
aaaggguaacgggacacugc

SEQ ID NO: 1763821 - RNA, 21 nt, Salmonella enterica enterica serovar Typhi Ty2
aaaggggccacaggcggcaug

SEQ ID NO: 1763822 - RNA, 21 nt, Salmonella enterica enterica serovar Typhi Ty2
ggacgaaugcgaaaaguaaag

SEQ ID NO: 1763823 - RNA, 20 nt, Salmonella enterica enterica serovar Typhi Ty2
ggacgaauuuccagcgggcg

SEQ ID NO: 1763824 - RNA, 16 nt, Salmonella enterica enterica serovar Typhi Ty2
aaaggcuuuaaagcag

SEQ ID NO: 1763825 - RNA, 15 nt, Salmonella enterica enterica serovar Typhi Ty2
aaaggcuuguuuagc

SEQ ID NO: 1763826 - RNA, 19 nt, Salmonella enterica enterica serovar Typhi Ty2
ggaccguguucaugcagcc

SEQ ID NO: 1763827 - RNA, 20 nt, Salmonella enterica enterica serovar Typhi Ty2
ggaccggcaaucgccugcaa

SEQ ID NO: 1763828 - RNA, 20 nt, Salmonella enterica enterica serovar Typhi Ty2
ggacagacuucauuuuccac

SEQ ID NO: 1763829 - RNA, 19 nt, Salmonella enterica enterica serovar Typhi Ty2
ggaauggcacagcgcagca

SEQ ID NO: 1763830 - RNA, 13 nt, Salmonella enterica enterica serovar Typhi Ty2
ggaaugcuuuaca

SEQ ID NO: 1763831 - RNA, 22 nt, Salmonella enterica enterica serovar Typhi Ty2
ggaaugccgugauaggagagca

SEQ ID NO: 1763832 - RNA, 23 nt, Salmonella enterica enterica serovar Typhi Ty2
ggaauguuccccguugagaaugg

SEQ ID NO: 1763833 - RNA, 18 nt, Salmonella enterica enterica serovar Typhi Ty2
ggaauaaaggucacauca

SEQ ID NO: 1763834 - RNA, 15 nt, Salmonella enterica enterica serovar Typhi Ty2
ggaauaaauauaaga

SEQ ID NO: 1763835 - RNA, 21 nt, Salmonella enterica enterica serovar Typhi Ty2
ggaauaacaucguaaaucaaa

SEQ ID NO: 1763836 - RNA, 18 nt, Salmonella enterica enterica serovar Typhi Ty2
ggaagucagcuuccugca

SEQ ID NO: 1763837 - RNA, 20 nt, Salmonella enterica enterica serovar Typhi Ty2
ggaagucagcuuccugcacg

SEQ ID NO: 1763838 - RNA, 15 nt, Salmonella enterica enterica serovar Typhi Ty2
ggaaguccuucuccu

SEQ ID NO: 1763839 - RNA, 16 nt, Salmonella enterica enterica serovar Typhi Ty2
ggacaacgcuccagca

SEQ ID NO: 1763840 - RNA, 14 nt, Salmonella enterica enterica serovar Typhi Ty2
ggacacccgcagcc

SEQ ID NO: 1763841 - RNA, 16 nt, Salmonella enterica enterica serovar Typhi Ty2
ggacacauuucuuuug

SEQ ID NO: 1763842 - RNA, 23 nt, Salmonella enterica enterica serovar Typhi Ty2
ggaaggucgcauccgcguuagca

SEQ ID NO: 1763843 - RNA, 18 nt, Salmonella enterica enterica serovar Typhi Ty2
ggaaguauacauccacug

SEQ ID NO: 1763844 - RNA, 21 nt, Salmonella enterica enterica serovar Typhi Ty2
ggaacucugcgacgccaggcg

SEQ ID NO: 1763845 - RNA, 14 nt, Salmonella enterica enterica serovar Typhi Ty2
ggaacugcggccag

SEQ ID NO: 1763846 - RNA, 21 nt, Salmonella enterica enterica serovar Typhi Ty2
ggaacugacuccagcugguau

SEQ ID NO: 1763847 - RNA, 13 nt, Salmonella enterica enterica serovar Typhi Ty2
ggaacccagcaaa

SEQ ID NO: 1763848 - RNA, 24 nt, Salmonella enterica enterica serovar Typhi Ty2
ggaacggcauacugucgcgcggcg

SEQ ID NO: 1763849 - RNA, 19 nt, Salmonella enterica enterica serovar Typhi Ty2
ggaacaucuuuuaccugug

SEQ ID NO: 1763850 - RNA, 13 nt, Salmonella enterica enterica serovar Typhi Ty2
ggaacaucuuuua

SEQ ID NO: 1763851 - RNA, 15 nt, Salmonella enterica enterica serovar Typhi Ty2
ggaacagggccgcau

SEQ ID NO: 1763852 - RNA, 12 nt, Salmonella enterica enterica serovar Typhi Ty2
ggaacagauaaa

SEQ ID NO: 1763853 - RNA, 13 nt, Salmonella enterica enterica serovar Typhi Ty2
ggaacaaaacgga

SEQ ID NO: 1763854 - RNA, 19 nt, Salmonella enterica enterica serovar Typhi Ty2
gcuuuccguuaccucaaaa

SEQ ID NO: 1763855 - RNA, 22 nt, Salmonella enterica enterica serovar Typhi Ty2
gcuuuccggcgcuuccugcagu

SEQ ID NO: 1763856 - RNA, 17 nt, Salmonella enterica enterica serovar Typhi Ty2
ggaacaagcaaaccuau

SEQ ID NO: 1763857 - RNA, 21 nt, Salmonella enterica enterica serovar Typhi Ty2
ggaacaacggcacacaggccg

SEQ ID NO: 1763858 - RNA, 17 nt, Salmonella enterica enterica serovar Typhi Ty2
ggucgaccaccugcugu

SEQ ID NO: 1763859 - RNA, 18 nt, Salmonella enterica enterica serovar Typhi Ty2
ggucgcgacggccagcau

SEQ ID NO: 1763860 - RNA, 17 nt, Salmonella enterica enterica serovar Typhi Ty2
ggucgcgacggccagca

SEQ ID NO: 1763861 - RNA, 16 nt, Salmonella enterica enterica serovar Typhi Ty2
ggucgcuauccagcag

SEQ ID NO: 1763862 - RNA, 20 nt, Salmonella enterica enterica serovar Typhi Ty2
ggucugcuucagccacuggc

SEQ ID NO: 1763863 - RNA, 22 nt, Salmonella enterica enterica serovar Typhi Ty2
ggucuggauuacaaaaauagac

SEQ ID NO: 1763864 - RNA, 19 nt, Salmonella enterica enterica serovar Typhi Ty2
ggucugcgcgccgcaggcc

SEQ ID NO: 1763865 - RNA, 19 nt, Salmonella enterica enterica serovar Typhi Ty2
ggugaaaaaucauuaucac

SEQ ID NO: 1763866 - RNA, 16 nt, Salmonella enterica enterica serovar Typhi Ty2
ggugaaaaaucauuau

SEQ ID NO: 1763867 - RNA, 20 nt, Salmonella enterica enterica serovar Typhi Ty2
ggucucuucaugcauaaccg

SEQ ID NO: 1763868 - RNA, 23 nt, Salmonella enterica enterica serovar Typhi Ty2
ggucugcauucaggccucugcuu

SEQ ID NO: 1763869 - RNA, 17 nt, Salmonella enterica enterica serovar Typhi Ty2
ggucucuuaaugccagc

SEQ ID NO: 1763870 - RNA, 16 nt, Salmonella enterica enterica serovar Typhi Ty2
ggucucuuaaugccag

SEQ ID NO: 1763871 - RNA, 19 nt, Salmonella enterica enterica serovar Typhi Ty2
ggucuaaguugaccacauc

SEQ ID NO: 1763872 - RNA, 20 nt, Salmonella enterica enterica serovar Typhi Ty2
ggucguacuaaagagcgccu

SEQ ID NO: 1763873 - RNA, 21 nt, Salmonella enterica enterica serovar Typhi Ty2
ggucguacuaaagagcgccug

SEQ ID NO: 1763874 - RNA, 17 nt, Salmonella enterica enterica serovar Typhi Ty2
ggucguaaugagcacuu

SEQ ID NO: 1763875 - RNA, 13 nt, Salmonella enterica enterica serovar Typhi Ty2
ggucgucagccgu

SEQ ID NO: 1763876 - RNA, 22 nt, Salmonella enterica enterica serovar Typhi Ty2
ggucgucuggaguacgggcaga

SEQ ID NO: 1763877 - RNA, 23 nt, Salmonella enterica enterica serovar Typhi Ty2
ggucaguaggcgaacuucaucca

SEQ ID NO: 1763878 - RNA, 13 nt, Salmonella enterica enterica serovar Typhi Ty2
ggucauacugugc

SEQ ID NO: 1763879 - RNA, 16 nt, Salmonella enterica enterica serovar Typhi Ty2
ggucaucaccuccagc

SEQ ID NO: 1763880 - RNA, 19 nt, Salmonella enterica enterica serovar Typhi Ty2
ggucaucaccuccagcacg

SEQ ID NO: 1763881 - RNA, 13 nt, Salmonella enterica enterica serovar Typhi Ty2
ggucaucugguca

SEQ ID NO: 1763882 - RNA, 17 nt, Salmonella enterica enterica serovar Typhi Ty2
ggucauuggggacgcgc

SEQ ID NO: 1763883 - RNA, 19 nt, Salmonella enterica enterica serovar Typhi Ty2
gguccggcgcuaaccagcg

SEQ ID NO: 1763884 - RNA, 21 nt, Salmonella enterica enterica serovar Typhi Ty2
ggucaggcucaggaaaacaaa

SEQ ID NO: 1763885 - RNA, 13 nt, Salmonella enterica enterica serovar Typhi Ty2
ggucaggcuaaau

SEQ ID NO: 1763886 - RNA, 21 nt, Salmonella enterica enterica serovar Typhi Ty2
ggucagcauuucauccauuaa

SEQ ID NO: 1763887 - RNA, 12 nt, Salmonella enterica enterica serovar Typhi Ty2
ggucagauccuu

SEQ ID NO: 1763888 - RNA, 17 nt, Salmonella enterica enterica serovar Typhi Ty2
ggucagcauuucaucca

SEQ ID NO: 1763889 - RNA, 19 nt, Salmonella enterica enterica serovar Typhi Ty2
ggucaaaugcgaaaaaaag

SEQ ID NO: 1763890 - RNA, 13 nt, Salmonella enterica enterica serovar Typhi Ty2
ggucaaucaucag

SEQ ID NO: 1763891 - RNA, 22 nt, Salmonella enterica enterica serovar Typhi Ty2
gguaucugggcggcaaaauuga

SEQ ID NO: 1763892 - RNA, 18 nt, Salmonella enterica enterica serovar Typhi Ty2
gguaucuaacccgcucag

SEQ ID NO: 1763893 - RNA, 18 nt, Salmonella enterica enterica serovar Typhi Ty2
gguauguuccuggauaga

SEQ ID NO: 1763894 - RNA, 23 nt, Salmonella enterica enterica serovar Typhi Ty2
gguauucaacgccaucuuccuca

SEQ ID NO: 1763895 - RNA, 21 nt, Salmonella enterica enterica serovar Typhi Ty2
gguauucaacgccaucuuccu

SEQ ID NO: 1763896 - RNA, 23 nt, Salmonella enterica enterica serovar Typhi Ty2
gguauuacaugccguuaauaaug

SEQ ID NO: 1763897 - RNA, 20 nt, Salmonella enterica enterica serovar Typhi Ty2
ggucaaaaaagcgacgcugu

SEQ ID NO: 1763898 - RNA, 14 nt, Salmonella enterica enterica serovar Typhi Ty2
ggucaacaggcuga

SEQ ID NO: 1763899 - RNA, 15 nt, Salmonella enterica enterica serovar Typhi Ty2
ggucaacaggcugaa

SEQ ID NO: 1763900 - RNA, 17 nt, Salmonella enterica enterica serovar Typhi Ty2
gguauuuauccagcagg

SEQ ID NO: 1763901 - RNA, 15 nt, Salmonella enterica enterica serovar Typhi Ty2
gguauugcuuucaau

SEQ ID NO: 1763902 - RNA, 19 nt, Salmonella enterica enterica serovar Typhi Ty2
gguauucgcggccagauaa

SEQ ID NO: 1763903 - RNA, 22 nt, Salmonella enterica enterica serovar Typhi Ty2
gguaggguugccagaggcagca

SEQ ID NO: 1763904 - RNA, 15 nt, Salmonella enterica enterica serovar Typhi Ty2
gguaguccugcucau

SEQ ID NO: 1763905 - RNA, 21 nt, Salmonella enterica enterica serovar Typhi Ty2
gguagucaaauuccagcaaug

SEQ ID NO: 1763906 - RNA, 14 nt, Salmonella enterica enterica serovar Typhi Ty2
gguagucacggaga

SEQ ID NO: 1763907 - RNA, 15 nt, Salmonella enterica enterica serovar Typhi Ty2
gguaguccaaauaag

SEQ ID NO: 1763908 - RNA, 15 nt, Salmonella enterica enterica serovar Typhi Ty2
gguauaggccaggcu

SEQ ID NO: 1763909 - RNA, 20 nt, Salmonella enterica enterica serovar Typhi Ty2
gguaucauuaugggcagcac

SEQ ID NO: 1763910 - RNA, 14 nt, Salmonella enterica enterica serovar Typhi Ty2
gguauccagcagaa

SEQ ID NO: 1763911 - RNA, 15 nt, Salmonella enterica enterica serovar Typhi Ty2
gguacagaugcugua

SEQ ID NO: 1763912 - RNA, 23 nt, Salmonella enterica enterica serovar Typhi Ty2
gguacucuuccagcugcucuccu

SEQ ID NO: 1763913 - RNA, 21 nt, Salmonella enterica enterica serovar Typhi Ty2
gguacccggucccuggcuggu

SEQ ID NO: 1763914 - RNA, 21 nt, Salmonella enterica enterica serovar Typhi Ty2
gguaccucaugccggcuggca

SEQ ID NO: 1763915 - RNA, 15 nt, Salmonella enterica enterica serovar Typhi Ty2
gguagacgcaccaga

SEQ ID NO: 1763916 - RNA, 22 nt, Salmonella enterica enterica serovar Typhi Ty2
gguagacgcgcuagcuucaggu

SEQ ID NO: 1763917 - RNA, 13 nt, Salmonella enterica enterica serovar Typhi Ty2
gguagccacagau

SEQ ID NO: 1763918 - RNA, 16 nt, Salmonella enterica enterica serovar Typhi Ty2
gguagagcaucgcggc

SEQ ID NO: 1763919 - RNA, 24 nt, Salmonella enterica enterica serovar Typhi Ty2
gguagcuccagacaggacgccagc

SEQ ID NO: 1763920 - RNA, 22 nt, Salmonella enterica enterica serovar Typhi Ty2
gguagcccggacaaggcgcgcc

SEQ ID NO: 1763921 - RNA, 18 nt, Salmonella enterica enterica serovar Typhi Ty2
gguagcccggcaggcugg

SEQ ID NO: 1763922 - RNA, 14 nt, Salmonella enterica enterica serovar Typhi Ty2
gguagccgacggcc

SEQ ID NO: 1763923 - RNA, 22 nt, Salmonella enterica enterica serovar Typhi Ty2
gggugcaaagaaacguucaucc

SEQ ID NO: 1763924 - RNA, 22 nt, Salmonella enterica enterica serovar Typhi Ty2
gggugagcgagcguagccaaca

SEQ ID NO: 1763925 - RNA, 21 nt, Salmonella enterica enterica serovar Typhi Ty2
ggguugagcgagucagacacc

SEQ ID NO: 1763926 - RNA, 15 nt, Salmonella enterica enterica serovar Typhi Ty2
ggguugccggaaagg

SEQ ID NO: 1763927 - RNA, 22 nt, Salmonella enterica enterica serovar Typhi Ty2
ggguugcacauuguugcaggga

SEQ ID NO: 1763928 - RNA, 23 nt, Salmonella enterica enterica serovar Typhi Ty2
ggguuacucuguuucgccgcagg

SEQ ID NO: 1763929 - RNA, 15 nt, Salmonella enterica enterica serovar Typhi Ty2
ggguuaaagcccuga

SEQ ID NO: 1763930 - RNA, 14 nt, Salmonella enterica enterica serovar Typhi Ty2
ggguuaauggcagc

SEQ ID NO: 1763931 - RNA, 13 nt, Salmonella enterica enterica serovar Typhi Ty2
ggguuaaaccagc

SEQ ID NO: 1763932 - RNA, 15 nt, Salmonella enterica enterica serovar Typhi Ty2
gguaaugcgugagca

SEQ ID NO: 1763933 - RNA, 15 nt, Salmonella enterica enterica serovar Typhi Ty2
gguaaugacuuuuaa

SEQ ID NO: 1763934 - RNA, 15 nt, Salmonella enterica enterica serovar Typhi Ty2
gguaauggucagcau

SEQ ID NO: 1763935 - RNA, 16 nt, Salmonella enterica enterica serovar Typhi Ty2
gguaauggcgacugug

SEQ ID NO: 1763936 - RNA, 16 nt, Salmonella enterica enterica serovar Typhi Ty2
gguaaugucauccagc

SEQ ID NO: 1763937 - RNA, 14 nt, Salmonella enterica enterica serovar Typhi Ty2
gguaauauggucgu

SEQ ID NO: 1763938 - RNA, 19 nt, Salmonella enterica enterica serovar Typhi Ty2
gguaauaacugacagacuc

SEQ ID NO: 1763939 - RNA, 14 nt, Salmonella enterica enterica serovar Typhi Ty2
gguaaguuuuucuc

SEQ ID NO: 1763940 - RNA, 23 nt, Salmonella enterica enterica serovar Typhi Ty2
gguaagcccauggcaggcagcac

SEQ ID NO: 1763941 - RNA, 21 nt, Salmonella enterica enterica serovar Typhi Ty2
gguaacguuacuugauggaaa

SEQ ID NO: 1763942 - RNA, 14 nt, Salmonella enterica enterica serovar Typhi Ty2
gguaagaauaauaa

SEQ ID NO: 1763943 - RNA, 13 nt, Salmonella enterica enterica serovar Typhi Ty2
gguaagauguucu

SEQ ID NO: 1763944 - RNA, 22 nt, Salmonella enterica enterica serovar Typhi Ty2
gguaagcccauggcaggcagca

SEQ ID NO: 1763945 - RNA, 14 nt, Salmonella enterica enterica serovar Typhi Ty2
gguaagcaauaugg

SEQ ID NO: 1763946 - RNA, 12 nt, Salmonella enterica enterica serovar Typhi Ty2
gguaaaauccuu

SEQ ID NO: 1763947 - RNA, 15 nt, Salmonella enterica enterica serovar Typhi Ty2
gguaaaccaggccag

SEQ ID NO: 1763948 - RNA, 22 nt, Salmonella enterica enterica serovar Typhi Ty2
gguaaaauccaccacguuaccg

SEQ ID NO: 1763949 - RNA, 17 nt, Salmonella enterica enterica serovar Typhi Ty2
gguaaacucacccaggc

SEQ ID NO: 1763950 - RNA, 16 nt, Salmonella enterica enterica serovar Typhi Ty2
gguaacgauaaaaugc

SEQ ID NO: 1763951 - RNA, 15 nt, Salmonella enterica enterica serovar Typhi Ty2
gguaacgaacgcugu

SEQ ID NO: 1763952 - RNA, 14 nt, Salmonella enterica enterica serovar Typhi Ty2
gguaacgcgaaaaa

SEQ ID NO: 1763953 - RNA, 13 nt, Salmonella enterica enterica serovar Typhi Ty2
gguaacaccgcgg

SEQ ID NO: 1763954 - RNA, 22 nt, Salmonella enterica enterica serovar Typhi Ty2
gggcguuugcgcgcgccacgca

SEQ ID NO: 1763955 - RNA, 19 nt, Salmonella enterica enterica serovar Typhi Ty2
gggcuaaaugcccacggcg

SEQ ID NO: 1763956 - RNA, 13 nt, Salmonella enterica enterica serovar Typhi Ty2
gggcgugucccug

SEQ ID NO: 1763957 - RNA, 21 nt, Salmonella enterica enterica serovar Typhi Ty2
gggcgugucgccggggcgcug

SEQ ID NO: 1763958 - RNA, 21 nt, Salmonella enterica enterica serovar Typhi Ty2
gggcgucaaaaucccggcugg

SEQ ID NO: 1763959 - RNA, 15 nt, Salmonella enterica enterica serovar Typhi Ty2
gggcgggcagcagca

SEQ ID NO: 1763960 - RNA, 15 nt, Salmonella enterica enterica serovar Typhi Ty2
gggcgcaugaggccu

SEQ ID NO: 1763961 - RNA, 14 nt, Salmonella enterica enterica serovar Typhi Ty2
gggcgcagaagcua

SEQ ID NO: 1763962 - RNA, 12 nt, Salmonella enterica enterica serovar Typhi Ty2
gggcgcgcgccg

SEQ ID NO: 1763963 - RNA, 12 nt, Salmonella enterica enterica serovar Typhi Ty2
gggcgcggcugg

SEQ ID NO: 1763964 - RNA, 18 nt, Salmonella enterica enterica serovar Typhi Ty2
gggcggacgaugaaccug

SEQ ID NO: 1763965 - RNA, 13 nt, Salmonella enterica enterica serovar Typhi Ty2
gggcgaugcgcga

SEQ ID NO: 1763966 - RNA, 13 nt, Salmonella enterica enterica serovar Typhi Ty2
gggcgauaaacca

SEQ ID NO: 1763967 - RNA, 23 nt, Salmonella enterica enterica serovar Typhi Ty2
gggcgaaaacggcgcaggcaaau

SEQ ID NO: 1763968 - RNA, 21 nt, Salmonella enterica enterica serovar Typhi Ty2
gggccuacggauucgcugcug

SEQ ID NO: 1763969 - RNA, 20 nt, Salmonella enterica enterica serovar Typhi Ty2
gggccugagcgcgcagcugg

SEQ ID NO: 1763970 - RNA, 14 nt, Salmonella enterica enterica serovar Typhi Ty2
gggccgacaggcgg

SEQ ID NO: 1763971 - RNA, 17 nt, Salmonella enterica enterica serovar Typhi Ty2
gggccgcuagcugcagc

SEQ ID NO: 1763972 - RNA, 24 nt, Salmonella enterica enterica serovar Typhi Ty2
gggccaguuuccugacccgcucgu

SEQ ID NO: 1763973 - RNA, 17 nt, Salmonella enterica enterica serovar Typhi Ty2
gggccagcucuuuucug

SEQ ID NO: 1763974 - RNA, 15 nt, Salmonella enterica enterica serovar Typhi Ty2
gggccagcagccagg

SEQ ID NO: 1763975 - RNA, 15 nt, Salmonella enterica enterica serovar Typhi Ty2
gggccagauucuuag

SEQ ID NO: 1763976 - RNA, 23 nt, Salmonella enterica enterica serovar Typhi Ty2
gggccagaaguagcagagaaaag

SEQ ID NO: 1763977 - RNA, 18 nt, Salmonella enterica enterica serovar Typhi Ty2
gggcaucccgucccacca

SEQ ID NO: 1763978 - RNA, 21 nt, Salmonella enterica enterica serovar Typhi Ty2
gggugaauauuuguuggaaau

SEQ ID NO: 1763979 - RNA, 11 nt, Salmonella enterica enterica serovar Typhi Ty2
gggucuuccag

SEQ ID NO: 1763980 - RNA, 18 nt, Salmonella enterica enterica serovar Typhi Ty2
gggucgccgcgcccagca

SEQ ID NO: 1763981 - RNA, 22 nt, Salmonella enterica enterica serovar Typhi Ty2
gggucgacguuguccggcgacc

SEQ ID NO: 1763982 - RNA, 17 nt, Salmonella enterica enterica serovar Typhi Ty2
gggucaguacgcgcgua

SEQ ID NO: 1763983 - RNA, 21 nt, Salmonella enterica enterica serovar Typhi Ty2
ggguaucuaacccgcucagac

SEQ ID NO: 1763984 - RNA, 16 nt, Salmonella enterica enterica serovar Typhi Ty2
ggguauugacgagcga

SEQ ID NO: 1763985 - RNA, 20 nt, Salmonella enterica enterica serovar Typhi Ty2
ggguauugcuucguggcaau

SEQ ID NO: 1763986 - RNA, 23 nt, Salmonella enterica enterica serovar Typhi Ty2
ggguauuuuagcgguaagagcgu

SEQ ID NO: 1763987 - RNA, 24 nt, Salmonella enterica enterica serovar Typhi Ty2
gggucacauccagacagccgacgg

SEQ ID NO: 1763988 - RNA, 22 nt, Salmonella enterica enterica serovar Typhi Ty2
gggucacauccagacagccgac

SEQ ID NO: 1763989 - RNA, 19 nt, Salmonella enterica enterica serovar Typhi Ty2
ggggucggcgcuaaugugg

SEQ ID NO: 1763990 - RNA, 16 nt, Salmonella enterica enterica serovar Typhi Ty2
gggguucagaccagaa

SEQ ID NO: 1763991 - RNA, 22 nt, Salmonella enterica enterica serovar Typhi Ty2
gggguucaauagcacaucagcc

SEQ ID NO: 1763992 - RNA, 24 nt, Salmonella enterica enterica serovar Typhi Ty2
gggguaaacaccggggcauuucca

SEQ ID NO: 1763993 - RNA, 18 nt, Salmonella enterica enterica serovar Typhi Ty2
gggguauucgcggccaga

SEQ ID NO: 1763994 - RNA, 14 nt, Salmonella enterica enterica serovar Typhi Ty2
ggguagaaaaaggu

SEQ ID NO: 1763995 - RNA, 15 nt, Salmonella enterica enterica serovar Typhi Ty2
ggguagaaaaaggua

SEQ ID NO: 1763996 - RNA, 18 nt, Salmonella enterica enterica serovar Typhi Ty2
ggguagaucacgccagcg

SEQ ID NO: 1763997 - RNA, 20 nt, Salmonella enterica enterica serovar Typhi Ty2
ggguaccucaugccggcugg

SEQ ID NO: 1763998 - RNA, 20 nt, Salmonella enterica enterica serovar Typhi Ty2
ggguagccguuuaaaagcgg

SEQ ID NO: 1763999 - RNA, 21 nt, Salmonella enterica enterica serovar Typhi Ty2
gggguuuuggccggaccugcg

SEQ ID NO: 1764000 - RNA, 19 nt, Salmonella enterica enterica serovar Typhi Ty2
ggguaaaaauauggcgggc

SEQ ID NO: 1764001 - RNA, 21 nt, Salmonella enterica enterica serovar Typhi Ty2
ggguaaacaccggggcauuuc

SEQ ID NO: 1764002 - RNA, 21 nt, Salmonella enterica enterica serovar Typhi Ty2
ggguaaauagacuguugaaag

SEQ ID NO: 1764003 - RNA, 19 nt, Salmonella enterica enterica serovar Typhi Ty2
gggcuuauccccauucugc

SEQ ID NO: 1764004 - RNA, 12 nt, Salmonella enterica enterica serovar Typhi Ty2
gggcuuaaucag

SEQ ID NO: 1764005 - RNA, 22 nt, Salmonella enterica enterica serovar Typhi Ty2
ggggaaaauauuagcggcggca

SEQ ID NO: 1764006 - RNA, 23 nt, Salmonella enterica enterica serovar Typhi Ty2
gggcuuucccguuucagccccuu

SEQ ID NO: 1764007 - RNA, 18 nt, Salmonella enterica enterica serovar Typhi Ty2
ggggaugauuuucaggca

SEQ ID NO: 1764008 - RNA, 15 nt, Salmonella enterica enterica serovar Typhi Ty2
ggggaucgguuuauc

SEQ ID NO: 1764009 - RNA, 14 nt, Salmonella enterica enterica serovar Typhi Ty2
ggggcgacagcccc

SEQ ID NO: 1764010 - RNA, 17 nt, Salmonella enterica enterica serovar Typhi Ty2
ggggcgacaaacagcgc

SEQ ID NO: 1764011 - RNA, 14 nt, Salmonella enterica enterica serovar Typhi Ty2
ggggccgggaaaga

SEQ ID NO: 1764012 - RNA, 21 nt, Salmonella enterica enterica serovar Typhi Ty2
gggggaaaugagaaaaggaag

SEQ ID NO: 1764013 - RNA, 19 nt, Salmonella enterica enterica serovar Typhi Ty2
gggggauagcgacggggcg

SEQ ID NO: 1764014 - RNA, 14 nt, Salmonella enterica enterica serovar Typhi Ty2
ggggcuccugcgcc

SEQ ID NO: 1764015 - RNA, 15 nt, Salmonella enterica enterica serovar Typhi Ty2
gggacucaccguuac

SEQ ID NO: 1764016 - RNA, 17 nt, Salmonella enterica enterica serovar Typhi Ty2
gggacgcugcgcggcga

SEQ ID NO: 1764017 - RNA, 15 nt, Salmonella enterica enterica serovar Typhi Ty2
gggaauaugauuuaa

SEQ ID NO: 1764018 - RNA, 16 nt, Salmonella enterica enterica serovar Typhi Ty2
ggcuuuuugccgggcg

SEQ ID NO: 1764019 - RNA, 20 nt, Salmonella enterica enterica serovar Typhi Ty2
ggcuuuuuuuuaugccucuu

SEQ ID NO: 1764020 - RNA, 20 nt, Salmonella enterica enterica serovar Typhi Ty2
gggaaaaauguguugcggcc

SEQ ID NO: 1764021 - RNA, 12 nt, Salmonella enterica enterica serovar Typhi Ty2
gggaaaagaagu

SEQ ID NO: 1764022 - RNA, 15 nt, Salmonella enterica enterica serovar Typhi Ty2
ggcuuucauccaaua

SEQ ID NO: 1764023 - RNA, 23 nt, Salmonella enterica enterica serovar Typhi Ty2
ggcuuuauccugaccgcuccagu

SEQ ID NO: 1764024 - RNA, 13 nt, Salmonella enterica enterica serovar Typhi Ty2
ggcuuuauauaaa

SEQ ID NO: 1764025 - RNA, 22 nt, Salmonella enterica enterica serovar Typhi Ty2
ggcuuucccguuucagccccuu

SEQ ID NO: 1764026 - RNA, 16 nt, Salmonella enterica enterica serovar Typhi Ty2
gggaagaugugccacu

SEQ ID NO: 1764027 - RNA, 22 nt, Salmonella enterica enterica serovar Typhi Ty2
gggaagaugugccacuccgcca

SEQ ID NO: 1764028 - RNA, 24 nt, Salmonella enterica enterica serovar Typhi Ty2
gggaagcacauccauguacuccug

SEQ ID NO: 1764029 - RNA, 22 nt, Salmonella enterica enterica serovar Typhi Ty2
gggaagacuauuaccaccguua

SEQ ID NO: 1764030 - RNA, 13 nt, Salmonella enterica enterica serovar Typhi Ty2
gggaagcuacgau

SEQ ID NO: 1764031 - RNA, 23 nt, Salmonella enterica enterica serovar Typhi Ty2
gggaaggggauucuccggcgcgg

SEQ ID NO: 1764032 - RNA, 14 nt, Salmonella enterica enterica serovar Typhi Ty2
gggaacacucuaaa

SEQ ID NO: 1764033 - RNA, 14 nt, Salmonella enterica enterica serovar Typhi Ty2
gggaacacauuaaa

SEQ ID NO: 1764034 - RNA, 16 nt, Salmonella enterica enterica serovar Typhi Ty2
gggaacaugcauauua

SEQ ID NO: 1764035 - RNA, 17 nt, Salmonella enterica enterica serovar Typhi Ty2
gggaaaugagaaaagga

SEQ ID NO: 1764036 - RNA, 15 nt, Salmonella enterica enterica serovar Typhi Ty2
gggaaagccccuacc

SEQ ID NO: 1764037 - RNA, 21 nt, Salmonella enterica enterica serovar Typhi Ty2
gggaguaugcggucaaaagcu

SEQ ID NO: 1764038 - RNA, 20 nt, Salmonella enterica enterica serovar Typhi Ty2
gggaguacauuuacaauaau

SEQ ID NO: 1764039 - RNA, 19 nt, Salmonella enterica enterica serovar Typhi Ty2
gggauaucuuccgggcggg

SEQ ID NO: 1764040 - RNA, 18 nt, Salmonella enterica enterica serovar Typhi Ty2
gggaucaauuuugcucuc

SEQ ID NO: 1764041 - RNA, 16 nt, Salmonella enterica enterica serovar Typhi Ty2
gggaucgguuuauccc

SEQ ID NO: 1764042 - RNA, 16 nt, Salmonella enterica enterica serovar Typhi Ty2
gggaugguuaaauuca

SEQ ID NO: 1764043 - RNA, 16 nt, Salmonella enterica enterica serovar Typhi Ty2
gggauuugaugcccaa

SEQ ID NO: 1764044 - RNA, 20 nt, Salmonella enterica enterica serovar Typhi Ty2
gggauugcaaaaaacacugg

SEQ ID NO: 1764045 - RNA, 13 nt, Salmonella enterica enterica serovar Typhi Ty2
gggcaagcucagc

SEQ ID NO: 1764046 - RNA, 14 nt, Salmonella enterica enterica serovar Typhi Ty2
gggcaauccauuaa

SEQ ID NO: 1764047 - RNA, 12 nt, Salmonella enterica enterica serovar Typhi Ty2
gggcagaaaaau

SEQ ID NO: 1764048 - RNA, 14 nt, Salmonella enterica enterica serovar Typhi Ty2
gggcagacuuucug

SEQ ID NO: 1764049 - RNA, 23 nt, Salmonella enterica enterica serovar Typhi Ty2
gggcacgcugaccacgccgccgc

SEQ ID NO: 1764050 - RNA, 11 nt, Salmonella enterica enterica serovar Typhi Ty2
gggcagcaucu

SEQ ID NO: 1764051 - RNA, 16 nt, Salmonella enterica enterica serovar Typhi Ty2
gggcagcagcaggcug

SEQ ID NO: 1764052 - RNA, 16 nt, Salmonella enterica enterica serovar Typhi Ty2
gggcauaaaugguacu

SEQ ID NO: 1764053 - RNA, 22 nt, Salmonella enterica enterica serovar Typhi Ty2
gggcaguaaauuaaacagcugu

SEQ ID NO: 1764054 - RNA, 12 nt, Salmonella enterica enterica serovar Typhi Ty2
gggcaggcgugu

SEQ ID NO: 1764055 - RNA, 14 nt, Salmonella enterica enterica serovar Typhi Ty2
ggcuggcgcaacug

SEQ ID NO: 1764056 - RNA, 14 nt, Salmonella enterica enterica serovar Typhi Ty2
ggcuggccagggca

SEQ ID NO: 1764057 - RNA, 14 nt, Salmonella enterica enterica serovar Typhi Ty2
ggcuggaugacggu

SEQ ID NO: 1764058 - RNA, 10 nt, Salmonella enterica enterica serovar Typhi Ty2
ggcuggcagc

SEQ ID NO: 1764059 - RNA, 12 nt, Salmonella enterica enterica serovar Typhi Ty2
ggcuggccacug

SEQ ID NO: 1764060 - RNA, 19 nt, Salmonella enterica enterica serovar Typhi Ty2
ggcuggauaaccguacggc

SEQ ID NO: 1764061 - RNA, 20 nt, Salmonella enterica enterica serovar Typhi Ty2
ggcuggcaaugcgcuguauu

SEQ ID NO: 1764062 - RNA, 22 nt, Salmonella enterica enterica serovar Typhi Ty2
ggcugcguaaaaucagcauccu

SEQ ID NO: 1764063 - RNA, 11 nt, Salmonella enterica enterica serovar Typhi Ty2
ggcugcucggg

SEQ ID NO: 1764064 - RNA, 18 nt, Salmonella enterica enterica serovar Typhi Ty2
ggcugugcgugacccaca

SEQ ID NO: 1764065 - RNA, 18 nt, Salmonella enterica enterica serovar Typhi Ty2
ggcugucggcagaaccug

SEQ ID NO: 1764066 - RNA, 13 nt, Salmonella enterica enterica serovar Typhi Ty2
ggcugucccagag

SEQ ID NO: 1764067 - RNA, 21 nt, Salmonella enterica enterica serovar Typhi Ty2
ggcuggucagcguacccgcgg

SEQ ID NO: 1764068 - RNA, 15 nt, Salmonella enterica enterica serovar Typhi Ty2
ggcugggcgaggcca

SEQ ID NO: 1764069 - RNA, 15 nt, Salmonella enterica enterica serovar Typhi Ty2
ggcuguguucauccc

SEQ ID NO: 1764070 - RNA, 23 nt, Salmonella enterica enterica serovar Typhi Ty2
ggcuucggcaauuuccggcgacg

SEQ ID NO: 1764071 - RNA, 16 nt, Salmonella enterica enterica serovar Typhi Ty2
ggcuucgauuacagga

SEQ ID NO: 1764072 - RNA, 23 nt, Salmonella enterica enterica serovar Typhi Ty2
ggcuuccauugcagaauauguuc

SEQ ID NO: 1764073 - RNA, 16 nt, Salmonella enterica enterica serovar Typhi Ty2
ggcuucaaccuccugc

SEQ ID NO: 1764074 - RNA, 22 nt, Salmonella enterica enterica serovar Typhi Ty2
ggcuucugcugugcauaaauaa

SEQ ID NO: 1764075 - RNA, 17 nt, Salmonella enterica enterica serovar Typhi Ty2
ggcuugaucgcgcagca

SEQ ID NO: 1764076 - RNA, 22 nt, Salmonella enterica enterica serovar Typhi Ty2
ggcuucguuaagcgguuuucaa

SEQ ID NO: 1764077 - RNA, 14 nt, Salmonella enterica enterica serovar Typhi Ty2
ggcuugccagcaga

SEQ ID NO: 1764078 - RNA, 15 nt, Salmonella enterica enterica serovar Typhi Ty2
ggcuugcaggauguc

SEQ ID NO: 1764079 - RNA, 13 nt, Salmonella enterica enterica serovar Typhi Ty2
ggcucuaaaaagg

SEQ ID NO: 1764080 - RNA, 20 nt, Salmonella enterica enterica serovar Typhi Ty2
ggcuccagcgccagcuccau

SEQ ID NO: 1764081 - RNA, 23 nt, Salmonella enterica enterica serovar Typhi Ty2
ggcucauuuuauccaacagcgca

SEQ ID NO: 1764082 - RNA, 13 nt, Salmonella enterica enterica serovar Typhi Ty2
ggcuccaaguauu

SEQ ID NO: 1764083 - RNA, 15 nt, Salmonella enterica enterica serovar Typhi Ty2
ggcuccuuuuuugua

SEQ ID NO: 1764084 - RNA, 16 nt, Salmonella enterica enterica serovar Typhi Ty2
ggcucaucagcgccau

SEQ ID NO: 1764085 - RNA, 17 nt, Salmonella enterica enterica serovar Typhi Ty2
ggcgucaaacagcuuaa

SEQ ID NO: 1764086 - RNA, 20 nt, Salmonella enterica enterica serovar Typhi Ty2
ggcgucaccaccgcaggcag

SEQ ID NO: 1764087 - RNA, 22 nt, Salmonella enterica enterica serovar Typhi Ty2
ggcgucaccaccgcaggcagcg

SEQ ID NO: 1764088 - RNA, 20 nt, Salmonella enterica enterica serovar Typhi Ty2
ggcguauucgcccggcagga

SEQ ID NO: 1764089 - RNA, 17 nt, Salmonella enterica enterica serovar Typhi Ty2
ggcguauagccaggcag

SEQ ID NO: 1764090 - RNA, 19 nt, Salmonella enterica enterica serovar Typhi Ty2
ggcguauagccaggcagau

SEQ ID NO: 1764091 - RNA, 16 nt, Salmonella enterica enterica serovar Typhi Ty2
ggcguauagccaggca

SEQ ID NO: 1764092 - RNA, 13 nt, Salmonella enterica enterica serovar Typhi Ty2
ggcguagccgccg

SEQ ID NO: 1764093 - RNA, 12 nt, Salmonella enterica enterica serovar Typhi Ty2
ggcugaagcccc

SEQ ID NO: 1764094 - RNA, 11 nt, Salmonella enterica enterica serovar Typhi Ty2
ggcugaagcgg

SEQ ID NO: 1764095 - RNA, 15 nt, Salmonella enterica enterica serovar Typhi Ty2
ggcugaaagcgccuu

SEQ ID NO: 1764096 - RNA, 15 nt, Salmonella enterica enterica serovar Typhi Ty2
ggcugagaaaaauac

SEQ ID NO: 1764097 - RNA, 13 nt, Salmonella enterica enterica serovar Typhi Ty2
ggcugagaaaaau

SEQ ID NO: 1764098 - RNA, 16 nt, Salmonella enterica enterica serovar Typhi Ty2
ggcugauaggccugga

SEQ ID NO: 1764099 - RNA, 20 nt, Salmonella enterica enterica serovar Typhi Ty2
ggcugagcguagaccgccca

SEQ ID NO: 1764100 - RNA, 21 nt, Salmonella enterica enterica serovar Typhi Ty2
ggcugcacccggagagaaaca

SEQ ID NO: 1764101 - RNA, 14 nt, Salmonella enterica enterica serovar Typhi Ty2
ggcugcggcaaacu

SEQ ID NO: 1764102 - RNA, 18 nt, Salmonella enterica enterica serovar Typhi Ty2
ggcugcgcgggagauggc

SEQ ID NO: 1764103 - RNA, 21 nt, Salmonella enterica enterica serovar Typhi Ty2
aaauaacaauauuaaauaaau

SEQ ID NO: 1764104 - RNA, 13 nt, Salmonella enterica enterica serovar Typhi Ty2
aaauaacagacga

SEQ ID NO: 1764105 - RNA, 17 nt, Salmonella enterica enterica serovar Typhi Ty2
aaauaacccgccuggcg

SEQ ID NO: 1764106 - RNA, 20 nt, Salmonella enterica enterica serovar Typhi Ty2
ggcgacgacgcuguuuaugc

SEQ ID NO: 1764107 - RNA, 21 nt, Salmonella enterica enterica serovar Typhi Ty2
aaauaacucuggaucaguucc

SEQ ID NO: 1764108 - RNA, 17 nt, Salmonella enterica enterica serovar Typhi Ty2
aaauaacgguagagaau

SEQ ID NO: 1764109 - RNA, 18 nt, Salmonella enterica enterica serovar Typhi Ty2
aaauaacuuuuaauuuuu

SEQ ID NO: 1764110 - RNA, 19 nt, Salmonella enterica enterica serovar Typhi Ty2
ggcgacgcgauagcgcagc

SEQ ID NO: 1764111 - RNA, 16 nt, Salmonella enterica enterica serovar Typhi Ty2
ggcgacgcuuucaccu

SEQ ID NO: 1764112 - RNA, 12 nt, Salmonella enterica enterica serovar Typhi Ty2
aaauaagaguca

SEQ ID NO: 1764113 - RNA, 21 nt, Salmonella enterica enterica serovar Typhi Ty2
aaauaacuuuuaauuuuuaug

SEQ ID NO: 1764114 - RNA, 19 nt, Salmonella enterica enterica serovar Typhi Ty2
aaauaacuuuuaauuuuua

SEQ ID NO: 1764115 - RNA, 15 nt, Salmonella enterica enterica serovar Typhi Ty2
ggccgacaggcggcc

SEQ ID NO: 1764116 - RNA, 14 nt, Salmonella enterica enterica serovar Typhi Ty2
ggccgacaaaaauu

SEQ ID NO: 1764117 - RNA, 15 nt, Salmonella enterica enterica serovar Typhi Ty2
ggccgacacaacaug

SEQ ID NO: 1764118 - RNA, 14 nt, Salmonella enterica enterica serovar Typhi Ty2
ggccgagaggcuga

SEQ ID NO: 1764119 - RNA, 13 nt, Salmonella enterica enterica serovar Typhi Ty2
ggcgaaagaaaau

SEQ ID NO: 1764120 - RNA, 14 nt, Salmonella enterica enterica serovar Typhi Ty2
ggcgaaagaaaauu

SEQ ID NO: 1764121 - RNA, 13 nt, Salmonella enterica enterica serovar Typhi Ty2
ggcgaaagaagcg

SEQ ID NO: 1764122 - RNA, 19 nt, Salmonella enterica enterica serovar Typhi Ty2
ggcgaaaaucggcaggccg

SEQ ID NO: 1764123 - RNA, 12 nt, Salmonella enterica enterica serovar Typhi Ty2
ggcgaaaaaccg

SEQ ID NO: 1764124 - RNA, 15 nt, Salmonella enterica enterica serovar Typhi Ty2
ggcgaaaauccuuuu

SEQ ID NO: 1764125 - RNA, 18 nt, Salmonella enterica enterica serovar Typhi Ty2
ggccuuuuuccgucagca

SEQ ID NO: 1764126 - RNA, 21 nt, Salmonella enterica enterica serovar Typhi Ty2
ggccuuguagcgcuguccaau

SEQ ID NO: 1764127 - RNA, 14 nt, Salmonella enterica enterica serovar Typhi Ty2
ggcgaacagcccgc

SEQ ID NO: 1764128 - RNA, 14 nt, Salmonella enterica enterica serovar Typhi Ty2
ggcgacagccgcgu

SEQ ID NO: 1764129 - RNA, 12 nt, Salmonella enterica enterica serovar Typhi Ty2
ggcgacaggcgc

SEQ ID NO: 1764130 - RNA, 13 nt, Salmonella enterica enterica serovar Typhi Ty2
aaauaauauuauu

SEQ ID NO: 1764131 - RNA, 22 nt, Salmonella enterica enterica serovar Typhi Ty2
aaauaauccgcugcaacucccg

SEQ ID NO: 1764132 - RNA, 22 nt, Salmonella enterica enterica serovar Typhi Ty2
aaauaaggcugcgcguuuucau

SEQ ID NO: 1764133 - RNA, 19 nt, Salmonella enterica enterica serovar Typhi Ty2
aaauaagccguacagccua

SEQ ID NO: 1764134 - RNA, 21 nt, Salmonella enterica enterica serovar Typhi Ty2
ggcgauaaggucgcuauccag

SEQ ID NO: 1764135 - RNA, 12 nt, Salmonella enterica enterica serovar Typhi Ty2
aaauaauuuuua

SEQ ID NO: 1764136 - RNA, 17 nt, Salmonella enterica enterica serovar Typhi Ty2
aaauaauuuuguuaaag

SEQ ID NO: 1764137 - RNA, 14 nt, Salmonella enterica enterica serovar Typhi Ty2
aaauaauucauauu

SEQ ID NO: 1764138 - RNA, 17 nt, Salmonella enterica enterica serovar Typhi Ty2
ggcgauacucugcccgc

SEQ ID NO: 1764139 - RNA, 21 nt, Salmonella enterica enterica serovar Typhi Ty2
ggcgauacugcuccgccggag

SEQ ID NO: 1764140 - RNA, 13 nt, Salmonella enterica enterica serovar Typhi Ty2
ggcgauaccagua

SEQ ID NO: 1764141 - RNA, 17 nt, Salmonella enterica enterica serovar Typhi Ty2
ggcgauagccccaguaa

SEQ ID NO: 1764142 - RNA, 16 nt, Salmonella enterica enterica serovar Typhi Ty2
ggcgauagugucgcca

SEQ ID NO: 1764143 - RNA, 21 nt, Salmonella enterica enterica serovar Typhi Ty2
ggcgauaucuucggcgcgccg

SEQ ID NO: 1764144 - RNA, 15 nt, Salmonella enterica enterica serovar Typhi Ty2
ggcgauuaauacauc

SEQ ID NO: 1764145 - RNA, 19 nt, Salmonella enterica enterica serovar Typhi Ty2
ggcgauuuauagagcagca

SEQ ID NO: 1764146 - RNA, 15 nt, Salmonella enterica enterica serovar Typhi Ty2
ggcgauguuggcgcc

SEQ ID NO: 1764147 - RNA, 17 nt, Salmonella enterica enterica serovar Typhi Ty2
ggcgcaaauggcugcga

SEQ ID NO: 1764148 - RNA, 19 nt, Salmonella enterica enterica serovar Typhi Ty2
ggcgcacauuuacgccagc

SEQ ID NO: 1764149 - RNA, 18 nt, Salmonella enterica enterica serovar Typhi Ty2
ggcgauuuucagcaccuu

SEQ ID NO: 1764150 - RNA, 19 nt, Salmonella enterica enterica serovar Typhi Ty2
ggcgcaaacaguacgcccg

SEQ ID NO: 1764151 - RNA, 22 nt, Salmonella enterica enterica serovar Typhi Ty2
ggcgauuuuuaggccaaacuua

SEQ ID NO: 1764152 - RNA, 13 nt, Salmonella enterica enterica serovar Typhi Ty2
aaauacaucgcca

SEQ ID NO: 1764153 - RNA, 13 nt, Salmonella enterica enterica serovar Typhi Ty2
aaauaccacauca

SEQ ID NO: 1764154 - RNA, 16 nt, Salmonella enterica enterica serovar Typhi Ty2
aaauaccagcaccuga

SEQ ID NO: 1764155 - RNA, 12 nt, Salmonella enterica enterica serovar Typhi Ty2
aaauaccacauc

SEQ ID NO: 1764156 - RNA, 19 nt, Salmonella enterica enterica serovar Typhi Ty2
aaauacccgaccccgccgu

SEQ ID NO: 1764157 - RNA, 22 nt, Salmonella enterica enterica serovar Typhi Ty2
ggcgguucccgggcgcucgcuu

SEQ ID NO: 1764158 - RNA, 18 nt, Salmonella enterica enterica serovar Typhi Ty2
ggcgguuauccgccagcg

SEQ ID NO: 1764159 - RNA, 20 nt, Salmonella enterica enterica serovar Typhi Ty2
ggcgguuaacagacccgcuu

SEQ ID NO: 1764160 - RNA, 17 nt, Salmonella enterica enterica serovar Typhi Ty2
ggcgguaaucgcgcugu

SEQ ID NO: 1764161 - RNA, 15 nt, Salmonella enterica enterica serovar Typhi Ty2
ggcgggugccgggaa

SEQ ID NO: 1764162 - RNA, 20 nt, Salmonella enterica enterica serovar Typhi Ty2
ggcggcgaaagagaaagcgc

SEQ ID NO: 1764163 - RNA, 16 nt, Salmonella enterica enterica serovar Typhi Ty2
ggcggcgaaaugccuu

SEQ ID NO: 1764164 - RNA, 17 nt, Salmonella enterica enterica serovar Typhi Ty2
ggcgggcagcagcaggc

SEQ ID NO: 1764165 - RNA, 15 nt, Salmonella enterica enterica serovar Typhi Ty2
ggcggauaaggcgcu

SEQ ID NO: 1764166 - RNA, 13 nt, Salmonella enterica enterica serovar Typhi Ty2
ggcggccagcauu

SEQ ID NO: 1764167 - RNA, 17 nt, Salmonella enterica enterica serovar Typhi Ty2
ggcggcauaaaugccuu

SEQ ID NO: 1764168 - RNA, 14 nt, Salmonella enterica enterica serovar Typhi Ty2
ggcgcugcgcggcg

SEQ ID NO: 1764169 - RNA, 23 nt, Salmonella enterica enterica serovar Typhi Ty2
ggcgcugcgcuuaccgggccuac

SEQ ID NO: 1764170 - RNA, 15 nt, Salmonella enterica enterica serovar Typhi Ty2
ggcgcugcgcgcauc

SEQ ID NO: 1764171 - RNA, 22 nt, Salmonella enterica enterica serovar Typhi Ty2
ggcggaagucaaagguaauauc

SEQ ID NO: 1764172 - RNA, 19 nt, Salmonella enterica enterica serovar Typhi Ty2
ggcgcgucacaacagccgg

SEQ ID NO: 1764173 - RNA, 16 nt, Salmonella enterica enterica serovar Typhi Ty2
ggcgcguagcuggccu

SEQ ID NO: 1764174 - RNA, 15 nt, Salmonella enterica enterica serovar Typhi Ty2
ggcgcgcguggcuuc

SEQ ID NO: 1764175 - RNA, 12 nt, Salmonella enterica enterica serovar Typhi Ty2
ggcgcgcccggc

SEQ ID NO: 1764176 - RNA, 21 nt, Salmonella enterica enterica serovar Typhi Ty2
ggcgcgcucauuuuauugaua

SEQ ID NO: 1764177 - RNA, 20 nt, Salmonella enterica enterica serovar Typhi Ty2
aaauacgcucaauauacuua

SEQ ID NO: 1764178 - RNA, 19 nt, Salmonella enterica enterica serovar Typhi Ty2
aaauacgccgccagcaaua

SEQ ID NO: 1764179 - RNA, 20 nt, Salmonella enterica enterica serovar Typhi Ty2
aaauacgcgauaaaaaccca

SEQ ID NO: 1764180 - RNA, 22 nt, Salmonella enterica enterica serovar Typhi Ty2
aaauacggcuuccacugcggca

SEQ ID NO: 1764181 - RNA, 18 nt, Salmonella enterica enterica serovar Typhi Ty2
ggcgccagcgacaacgcu

SEQ ID NO: 1764182 - RNA, 17 nt, Salmonella enterica enterica serovar Typhi Ty2
ggcgccggggcagcaau

SEQ ID NO: 1764183 - RNA, 15 nt, Salmonella enterica enterica serovar Typhi Ty2
ggcgccggggcagca

SEQ ID NO: 1764184 - RNA, 17 nt, Salmonella enterica enterica serovar Typhi Ty2
ggcgcgaaaacagcugg

SEQ ID NO: 1764185 - RNA, 13 nt, Salmonella enterica enterica serovar Typhi Ty2
ggcgcgaaagcgc

SEQ ID NO: 1764186 - RNA, 15 nt, Salmonella enterica enterica serovar Typhi Ty2
ggcgcgaaagcgccu

SEQ ID NO: 1764187 - RNA, 18 nt, Salmonella enterica enterica serovar Typhi Ty2
ggcgcgaaaacagcuggc

SEQ ID NO: 1764188 - RNA, 18 nt, Salmonella enterica enterica serovar Typhi Ty2
ggcgcgaaacugcugccg

SEQ ID NO: 1764189 - RNA, 17 nt, Salmonella enterica enterica serovar Typhi Ty2
gccuucgauuaacgcau

SEQ ID NO: 1764190 - RNA, 24 nt, Salmonella enterica enterica serovar Typhi Ty2
gccuucggccugaaucagcaucuu

SEQ ID NO: 1764191 - RNA, 15 nt, Salmonella enterica enterica serovar Typhi Ty2
gccuucggcgcuggg

SEQ ID NO: 1764192 - RNA, 20 nt, Salmonella enterica enterica serovar Typhi Ty2
gccuucgcggugaucccagg

SEQ ID NO: 1764193 - RNA, 22 nt, Salmonella enterica enterica serovar Typhi Ty2
gccuucuuuggugcgacgccag

SEQ ID NO: 1764194 - RNA, 14 nt, Salmonella enterica enterica serovar Typhi Ty2
gccuugcaaaccgg

SEQ ID NO: 1764195 - RNA, 17 nt, Salmonella enterica enterica serovar Typhi Ty2
gccuuucagaugguuug

SEQ ID NO: 1764196 - RNA, 17 nt, Salmonella enterica enterica serovar Typhi Ty2
gccuuucagaucggcaa

SEQ ID NO: 1764197 - RNA, 20 nt, Salmonella enterica enterica serovar Typhi Ty2
gccuuucacgcguucaauau

SEQ ID NO: 1764198 - RNA, 21 nt, Salmonella enterica enterica serovar Typhi Ty2
gccuuuuaucaaugcacugac

SEQ ID NO: 1764199 - RNA, 15 nt, Salmonella enterica enterica serovar Typhi Ty2
gccuuuggccuggag

SEQ ID NO: 1764200 - RNA, 19 nt, Salmonella enterica enterica serovar Typhi Ty2
gccuuugcguaccgcaaug

SEQ ID NO: 1764201 - RNA, 18 nt, Salmonella enterica enterica serovar Typhi Ty2
gccuuucuccauggucag

SEQ ID NO: 1764202 - RNA, 13 nt, Salmonella enterica enterica serovar Typhi Ty2
gccuuuauuucaa

SEQ ID NO: 1764203 - RNA, 14 nt, Salmonella enterica enterica serovar Typhi Ty2
gcgaacguccagcg

SEQ ID NO: 1764204 - RNA, 13 nt, Salmonella enterica enterica serovar Typhi Ty2
gcgaacuacaggc

SEQ ID NO: 1764205 - RNA, 22 nt, Salmonella enterica enterica serovar Typhi Ty2
gccuuuuucaacagcacccagg

SEQ ID NO: 1764206 - RNA, 15 nt, Salmonella enterica enterica serovar Typhi Ty2
gccuuuuucccacug

SEQ ID NO: 1764207 - RNA, 15 nt, Salmonella enterica enterica serovar Typhi Ty2
gccuuuuuccgggau

SEQ ID NO: 1764208 - RNA, 12 nt, Salmonella enterica enterica serovar Typhi Ty2
gcgaaagaaaau

SEQ ID NO: 1764209 - RNA, 21 nt, Salmonella enterica enterica serovar Typhi Ty2
gcgaaaugcgaauccggcggc

SEQ ID NO: 1764210 - RNA, 14 nt, Salmonella enterica enterica serovar Typhi Ty2
gcgaaauugguaga

SEQ ID NO: 1764211 - RNA, 22 nt, Salmonella enterica enterica serovar Typhi Ty2
gcgaacaguacggucaggcuca

SEQ ID NO: 1764212 - RNA, 19 nt, Salmonella enterica enterica serovar Typhi Ty2
gcgaacaaagccccgggcg

SEQ ID NO: 1764213 - RNA, 16 nt, Salmonella enterica enterica serovar Typhi Ty2
gccugggauaagcaga

SEQ ID NO: 1764214 - RNA, 13 nt, Salmonella enterica enterica serovar Typhi Ty2
gccuggcgcuggg

SEQ ID NO: 1764215 - RNA, 16 nt, Salmonella enterica enterica serovar Typhi Ty2
gccuggcugagaaaaa

SEQ ID NO: 1764216 - RNA, 19 nt, Salmonella enterica enterica serovar Typhi Ty2
gccuguucuucaguaauuu

SEQ ID NO: 1764217 - RNA, 16 nt, Salmonella enterica enterica serovar Typhi Ty2
gccuguuauucaauuc

SEQ ID NO: 1764218 - RNA, 23 nt, Salmonella enterica enterica serovar Typhi Ty2
gccuguuuaaugauucuguguuu

SEQ ID NO: 1764219 - RNA, 15 nt, Salmonella enterica enterica serovar Typhi Ty2
gccuguuuauauucu

SEQ ID NO: 1764220 - RNA, 19 nt, Salmonella enterica enterica serovar Typhi Ty2
gccuguuugucgguuccag

SEQ ID NO: 1764221 - RNA, 19 nt, Salmonella enterica enterica serovar Typhi Ty2
gccuuauuuuucagcgcca

SEQ ID NO: 1764222 - RNA, 16 nt, Salmonella enterica enterica serovar Typhi Ty2
gccuucaacgcucagu

SEQ ID NO: 1764223 - RNA, 18 nt, Salmonella enterica enterica serovar Typhi Ty2
gccuucaauuugaccuga

SEQ ID NO: 1764224 - RNA, 17 nt, Salmonella enterica enterica serovar Typhi Ty2
gccuucacacugcgccg

SEQ ID NO: 1764225 - RNA, 20 nt, Salmonella enterica enterica serovar Typhi Ty2
gccuucacacugcgccgcca

SEQ ID NO: 1764226 - RNA, 15 nt, Salmonella enterica enterica serovar Typhi Ty2
gccugcuguaaaaua

SEQ ID NO: 1764227 - RNA, 22 nt, Salmonella enterica enterica serovar Typhi Ty2
gccugcuguacuuuugcuucca

SEQ ID NO: 1764228 - RNA, 12 nt, Salmonella enterica enterica serovar Typhi Ty2
gccuggccuccg

SEQ ID NO: 1764229 - RNA, 14 nt, Salmonella enterica enterica serovar Typhi Ty2
gccuggcgcagcgc

SEQ ID NO: 1764230 - RNA, 15 nt, Salmonella enterica enterica serovar Typhi Ty2
gccuggcgcagcgcu

SEQ ID NO: 1764231 - RNA, 13 nt, Salmonella enterica enterica serovar Typhi Ty2
gccuggcccguuc

SEQ ID NO: 1764232 - RNA, 20 nt, Salmonella enterica enterica serovar Typhi Ty2
gccugcugcgguaaggcagc

SEQ ID NO: 1764233 - RNA, 21 nt, Salmonella enterica enterica serovar Typhi Ty2
gccugcggauucaggacgaga

SEQ ID NO: 1764234 - RNA, 16 nt, Salmonella enterica enterica serovar Typhi Ty2
gccugcccugcggcag

SEQ ID NO: 1764235 - RNA, 16 nt, Salmonella enterica enterica serovar Typhi Ty2
gccugccgcaucugac

SEQ ID NO: 1764236 - RNA, 19 nt, Salmonella enterica enterica serovar Typhi Ty2
gccugccgcauguccccag

SEQ ID NO: 1764237 - RNA, 12 nt, Salmonella enterica enterica serovar Typhi Ty2
gccugcgcggca

SEQ ID NO: 1764238 - RNA, 16 nt, Salmonella enterica enterica serovar Typhi Ty2
gccugccgucgcggcu

SEQ ID NO: 1764239 - RNA, 15 nt, Salmonella enterica enterica serovar Typhi Ty2
gccugccguuuuuaa

SEQ ID NO: 1764240 - RNA, 18 nt, Salmonella enterica enterica serovar Typhi Ty2
gccugccgggccugcggc

SEQ ID NO: 1764241 - RNA, 22 nt, Salmonella enterica enterica serovar Typhi Ty2
gccucuggccgcgcuuuuuuaa

SEQ ID NO: 1764242 - RNA, 16 nt, Salmonella enterica enterica serovar Typhi Ty2
gccucugauuuuucca

SEQ ID NO: 1764243 - RNA, 18 nt, Salmonella enterica enterica serovar Typhi Ty2
gccucucguaagagaggc

SEQ ID NO: 1764244 - RNA, 19 nt, Salmonella enterica enterica serovar Typhi Ty2
gccucuucacauaauggag

SEQ ID NO: 1764245 - RNA, 16 nt, Salmonella enterica enterica serovar Typhi Ty2
gccucuucaaauuugu

SEQ ID NO: 1764246 - RNA, 22 nt, Salmonella enterica enterica serovar Typhi Ty2
gccucuuccgccugauaaaacg

SEQ ID NO: 1764247 - RNA, 17 nt, Salmonella enterica enterica serovar Typhi Ty2
gccucguccugcaauuu

SEQ ID NO: 1764248 - RNA, 14 nt, Salmonella enterica enterica serovar Typhi Ty2
gccucuaucuucuc

SEQ ID NO: 1764249 - RNA, 21 nt, Salmonella enterica enterica serovar Typhi Ty2
gccucgcucucuuucaccagc

SEQ ID NO: 1764250 - RNA, 16 nt, Salmonella enterica enterica serovar Typhi Ty2
gccucgcgauccgcca

SEQ ID NO: 1764251 - RNA, 17 nt, Salmonella enterica enterica serovar Typhi Ty2
gccucgcgauccgccag

SEQ ID NO: 1764252 - RNA, 18 nt, Salmonella enterica enterica serovar Typhi Ty2
gccucgcgcauccgggcc

SEQ ID NO: 1764253 - RNA, 16 nt, Salmonella enterica enterica serovar Typhi Ty2
gccucgccaaagcgcu

SEQ ID NO: 1764254 - RNA, 16 nt, Salmonella enterica enterica serovar Typhi Ty2
gccucacguagaucuu

SEQ ID NO: 1764255 - RNA, 14 nt, Salmonella enterica enterica serovar Typhi Ty2
gccuaucaugcugc

SEQ ID NO: 1764256 - RNA, 21 nt, Salmonella enterica enterica serovar Typhi Ty2
gccuagcugcguuuccagcca

SEQ ID NO: 1764257 - RNA, 16 nt, Salmonella enterica enterica serovar Typhi Ty2
gccuccacaaagcgcg

SEQ ID NO: 1764258 - RNA, 20 nt, Salmonella enterica enterica serovar Typhi Ty2
gccucaucgggacggcgguc

SEQ ID NO: 1764259 - RNA, 21 nt, Salmonella enterica enterica serovar Typhi Ty2
gccucauccccugacgcgcgc

SEQ ID NO: 1764260 - RNA, 20 nt, Salmonella enterica enterica serovar Typhi Ty2
gccuccuggcuuaccugcuc

SEQ ID NO: 1764261 - RNA, 19 nt, Salmonella enterica enterica serovar Typhi Ty2
gccuccggcggugaagcag

SEQ ID NO: 1764262 - RNA, 20 nt, Salmonella enterica enterica serovar Typhi Ty2
gccuccggaugacgccgcuu

SEQ ID NO: 1764263 - RNA, 17 nt, Salmonella enterica enterica serovar Typhi Ty2
gccuccagcgggcuggc

SEQ ID NO: 1764264 - RNA, 18 nt, Salmonella enterica enterica serovar Typhi Ty2
gccuccgcguagcccagc

SEQ ID NO: 1764265 - RNA, 22 nt, Salmonella enterica enterica serovar Typhi Ty2
gccguggaccguauagcccaga

SEQ ID NO: 1764266 - RNA, 21 nt, Salmonella enterica enterica serovar Typhi Ty2
gccgugcguuuugugcggccu

SEQ ID NO: 1764267 - RNA, 17 nt, Salmonella enterica enterica serovar Typhi Ty2
gccgugaauuucugcug

SEQ ID NO: 1764268 - RNA, 22 nt, Salmonella enterica enterica serovar Typhi Ty2
gccgugacuguucacauccagc

SEQ ID NO: 1764269 - RNA, 13 nt, Salmonella enterica enterica serovar Typhi Ty2
gccguuccgcaac

SEQ ID NO: 1764270 - RNA, 13 nt, Salmonella enterica enterica serovar Typhi Ty2
gccguuacuguuu

SEQ ID NO: 1764271 - RNA, 15 nt, Salmonella enterica enterica serovar Typhi Ty2
gccguuagcgccuuu

SEQ ID NO: 1764272 - RNA, 19 nt, Salmonella enterica enterica serovar Typhi Ty2
gccguguugugugccgcgc

SEQ ID NO: 1764273 - RNA, 14 nt, Salmonella enterica enterica serovar Typhi Ty2
gccuagcgcgcgca

SEQ ID NO: 1764274 - RNA, 12 nt, Salmonella enterica enterica serovar Typhi Ty2
gccuacaagaau

SEQ ID NO: 1764275 - RNA, 18 nt, Salmonella enterica enterica serovar Typhi Ty2
gccuacaaggcauucagg

SEQ ID NO: 1764276 - RNA, 16 nt, Salmonella enterica enterica serovar Typhi Ty2
gccuacaaaaaccguu

SEQ ID NO: 1764277 - RNA, 12 nt, Salmonella enterica enterica serovar Typhi Ty2
gccuacaaagcc

SEQ ID NO: 1764278 - RNA, 15 nt, Salmonella enterica enterica serovar Typhi Ty2
gccuaaugagccaga

SEQ ID NO: 1764279 - RNA, 21 nt, Salmonella enterica enterica serovar Typhi Ty2
gccuacaacucagcguaauug

SEQ ID NO: 1764280 - RNA, 23 nt, Salmonella enterica enterica serovar Typhi Ty2
gccuaaugggccagauucuuagu

SEQ ID NO: 1764281 - RNA, 19 nt, Salmonella enterica enterica serovar Typhi Ty2
gccguuuuagguucuucaa

SEQ ID NO: 1764282 - RNA, 14 nt, Salmonella enterica enterica serovar Typhi Ty2
gccguccauccggc

SEQ ID NO: 1764283 - RNA, 12 nt, Salmonella enterica enterica serovar Typhi Ty2
gccgucccagcg

SEQ ID NO: 1764284 - RNA, 13 nt, Salmonella enterica enterica serovar Typhi Ty2
gccgucuucuucu

SEQ ID NO: 1764285 - RNA, 17 nt, Salmonella enterica enterica serovar Typhi Ty2
gccgcuuccggcaggua

SEQ ID NO: 1764286 - RNA, 15 nt, Salmonella enterica enterica serovar Typhi Ty2
gccgcuucgccacuc

SEQ ID NO: 1764287 - RNA, 18 nt, Salmonella enterica enterica serovar Typhi Ty2
gccgcuuuuuucagcggc

SEQ ID NO: 1764288 - RNA, 16 nt, Salmonella enterica enterica serovar Typhi Ty2
gccgcuuuugccgcga

SEQ ID NO: 1764289 - RNA, 20 nt, Salmonella enterica enterica serovar Typhi Ty2
gccgcuuugcgaacagcgca

SEQ ID NO: 1764290 - RNA, 16 nt, Salmonella enterica enterica serovar Typhi Ty2
gccgcuuuccgccgca

SEQ ID NO: 1764291 - RNA, 16 nt, Salmonella enterica enterica serovar Typhi Ty2
gccggaaaucgcggcg

SEQ ID NO: 1764292 - RNA, 16 nt, Salmonella enterica enterica serovar Typhi Ty2
gccggaaaucacccaa

SEQ ID NO: 1764293 - RNA, 22 nt, Salmonella enterica enterica serovar Typhi Ty2
gccggaaauagagagggccgca

SEQ ID NO: 1764294 - RNA, 22 nt, Salmonella enterica enterica serovar Typhi Ty2
gccggaaagaauaaucgccgcc

SEQ ID NO: 1764295 - RNA, 17 nt, Salmonella enterica enterica serovar Typhi Ty2
gccggaaagaauaaucg

SEQ ID NO: 1764296 - RNA, 23 nt, Salmonella enterica enterica serovar Typhi Ty2
gccggaaaggauauaagcgccau

SEQ ID NO: 1764297 - RNA, 15 nt, Salmonella enterica enterica serovar Typhi Ty2
gccgucacagagagc

SEQ ID NO: 1764298 - RNA, 17 nt, Salmonella enterica enterica serovar Typhi Ty2
gccgucacagagagcgu

SEQ ID NO: 1764299 - RNA, 12 nt, Salmonella enterica enterica serovar Typhi Ty2
gcgcauggaaga

SEQ ID NO: 1764300 - RNA, 22 nt, Salmonella enterica enterica serovar Typhi Ty2
gcgcauccgggccgcuagcugc

SEQ ID NO: 1764301 - RNA, 17 nt, Salmonella enterica enterica serovar Typhi Ty2
gcgcauccgcggcgcuu

SEQ ID NO: 1764302 - RNA, 12 nt, Salmonella enterica enterica serovar Typhi Ty2
gcgcauccggca

SEQ ID NO: 1764303 - RNA, 23 nt, Salmonella enterica enterica serovar Typhi Ty2
gcgcauacgcuguccagucaaaa

SEQ ID NO: 1764304 - RNA, 23 nt, Salmonella enterica enterica serovar Typhi Ty2
gcgcauacucauuaccggcugcc

SEQ ID NO: 1764305 - RNA, 19 nt, Salmonella enterica enterica serovar Typhi Ty2
gcgcauaccggccacgagc

SEQ ID NO: 1764306 - RNA, 20 nt, Salmonella enterica enterica serovar Typhi Ty2
gcgcauaaaaaaggccgcuu

SEQ ID NO: 1764307 - RNA, 15 nt, Salmonella enterica enterica serovar Typhi Ty2
gcgcaucagaaaaac

SEQ ID NO: 1764308 - RNA, 14 nt, Salmonella enterica enterica serovar Typhi Ty2
gcgcaucagaaaaa

SEQ ID NO: 1764309 - RNA, 17 nt, Salmonella enterica enterica serovar Typhi Ty2
gcgcauuaacgccaugc

SEQ ID NO: 1764310 - RNA, 21 nt, Salmonella enterica enterica serovar Typhi Ty2
gcgcauuaacgccaugcucau

SEQ ID NO: 1764311 - RNA, 15 nt, Salmonella enterica enterica serovar Typhi Ty2
gcgcauucaccccag

SEQ ID NO: 1764312 - RNA, 15 nt, Salmonella enterica enterica serovar Typhi Ty2
gcgcauguaaccaaa

SEQ ID NO: 1764313 - RNA, 11 nt, Salmonella enterica enterica serovar Typhi Ty2
gcgcauggcca

SEQ ID NO: 1764314 - RNA, 16 nt, Salmonella enterica enterica serovar Typhi Ty2
gcgcauuccagacccg

SEQ ID NO: 1764315 - RNA, 21 nt, Salmonella enterica enterica serovar Typhi Ty2
gcgcauucucugucgccgccc

SEQ ID NO: 1764316 - RNA, 18 nt, Salmonella enterica enterica serovar Typhi Ty2
gcgcauugcgccccagca

SEQ ID NO: 1764317 - RNA, 19 nt, Salmonella enterica enterica serovar Typhi Ty2
gcgcauugcgcuauuacuc

SEQ ID NO: 1764318 - RNA, 17 nt, Salmonella enterica enterica serovar Typhi Ty2
gcgcauuuuacugccgu

SEQ ID NO: 1764319 - RNA, 16 nt, Salmonella enterica enterica serovar Typhi Ty2
gcgcauuugcggcguc

SEQ ID NO: 1764320 - RNA, 20 nt, Salmonella enterica enterica serovar Typhi Ty2
gcgccaaagcaaucgccagc

SEQ ID NO: 1764321 - RNA, 18 nt, Salmonella enterica enterica serovar Typhi Ty2
gcgccaaacgggcaagcc

SEQ ID NO: 1764322 - RNA, 21 nt, Salmonella enterica enterica serovar Typhi Ty2
gcgccaaacgggcaagccagc

SEQ ID NO: 1764323 - RNA, 17 nt, Salmonella enterica enterica serovar Typhi Ty2
gcgccaaaagaggcagc

SEQ ID NO: 1764324 - RNA, 18 nt, Salmonella enterica enterica serovar Typhi Ty2
gcgccaaaagaggcagca

SEQ ID NO: 1764325 - RNA, 17 nt, Salmonella enterica enterica serovar Typhi Ty2
gcgccaaugcgaaaaua

SEQ ID NO: 1764326 - RNA, 19 nt, Salmonella enterica enterica serovar Typhi Ty2
gcgccaauccaugccggcu

SEQ ID NO: 1764327 - RNA, 20 nt, Salmonella enterica enterica serovar Typhi Ty2
gcgccagccagucgccaggc

SEQ ID NO: 1764328 - RNA, 13 nt, Salmonella enterica enterica serovar Typhi Ty2
gcgccagccagcu

SEQ ID NO: 1764329 - RNA, 14 nt, Salmonella enterica enterica serovar Typhi Ty2
gcgccagcaguggg

SEQ ID NO: 1764330 - RNA, 11 nt, Salmonella enterica enterica serovar Typhi Ty2
gcgccagcaug

SEQ ID NO: 1764331 - RNA, 14 nt, Salmonella enterica enterica serovar Typhi Ty2
gcgccagccuuccc

SEQ ID NO: 1764332 - RNA, 13 nt, Salmonella enterica enterica serovar Typhi Ty2
gcgccagcgccac

SEQ ID NO: 1764333 - RNA, 17 nt, Salmonella enterica enterica serovar Typhi Ty2
gcgccagccgcgccauc

SEQ ID NO: 1764334 - RNA, 18 nt, Salmonella enterica enterica serovar Typhi Ty2
gcgccagccagucgccag

SEQ ID NO: 1764335 - RNA, 15 nt, Salmonella enterica enterica serovar Typhi Ty2
gcgccagcccugcga

SEQ ID NO: 1764336 - RNA, 15 nt, Salmonella enterica enterica serovar Typhi Ty2
gcgccagcgccgccu

SEQ ID NO: 1764337 - RNA, 18 nt, Salmonella enterica enterica serovar Typhi Ty2
gcgccagcgcuacccgcu

SEQ ID NO: 1764338 - RNA, 15 nt, Salmonella enterica enterica serovar Typhi Ty2
gcgccagcggcggcu

SEQ ID NO: 1764339 - RNA, 14 nt, Salmonella enterica enterica serovar Typhi Ty2
gcgccagcggcugc

SEQ ID NO: 1764340 - RNA, 13 nt, Salmonella enterica enterica serovar Typhi Ty2
gcgccagaggcgu

SEQ ID NO: 1764341 - RNA, 14 nt, Salmonella enterica enterica serovar Typhi Ty2
gcgccagacgccau

SEQ ID NO: 1764342 - RNA, 22 nt, Salmonella enterica enterica serovar Typhi Ty2
gcgccacuuccagcgcgccguc

SEQ ID NO: 1764343 - RNA, 15 nt, Salmonella enterica enterica serovar Typhi Ty2
gcgccacuuccagcg

SEQ ID NO: 1764344 - RNA, 16 nt, Salmonella enterica enterica serovar Typhi Ty2
gcgccacuuccagcgc

SEQ ID NO: 1764345 - RNA, 18 nt, Salmonella enterica enterica serovar Typhi Ty2
gcgccacgcgccagccgu

SEQ ID NO: 1764346 - RNA, 15 nt, Salmonella enterica enterica serovar Typhi Ty2
gcgcacggcgcgucc

SEQ ID NO: 1764347 - RNA, 17 nt, Salmonella enterica enterica serovar Typhi Ty2
gcgcacggcgcguccuc

SEQ ID NO: 1764348 - RNA, 15 nt, Salmonella enterica enterica serovar Typhi Ty2
gcgcacucagaaaau

SEQ ID NO: 1764349 - RNA, 14 nt, Salmonella enterica enterica serovar Typhi Ty2
gcgcagacacugcc

SEQ ID NO: 1764350 - RNA, 22 nt, Salmonella enterica enterica serovar Typhi Ty2
gcgcaccuucaacagcucgcca

SEQ ID NO: 1764351 - RNA, 13 nt, Salmonella enterica enterica serovar Typhi Ty2
gcgcagccccagc

SEQ ID NO: 1764352 - RNA, 12 nt, Salmonella enterica enterica serovar Typhi Ty2
gcgcagagugac

SEQ ID NO: 1764353 - RNA, 19 nt, Salmonella enterica enterica serovar Typhi Ty2
gcgcagagugaccagcggu

SEQ ID NO: 1764354 - RNA, 21 nt, Salmonella enterica enterica serovar Typhi Ty2
gcgcagcugggccugcuccgu

SEQ ID NO: 1764355 - RNA, 21 nt, Salmonella enterica enterica serovar Typhi Ty2
gcgcagcgcgcgacccagcgc

SEQ ID NO: 1764356 - RNA, 18 nt, Salmonella enterica enterica serovar Typhi Ty2
gcgcagcgccauccggca

SEQ ID NO: 1764357 - RNA, 22 nt, Salmonella enterica enterica serovar Typhi Ty2
gcgcagcgaaacugcgcgccgg

SEQ ID NO: 1764358 - RNA, 17 nt, Salmonella enterica enterica serovar Typhi Ty2
gcgcagccccagcgcca

SEQ ID NO: 1764359 - RNA, 14 nt, Salmonella enterica enterica serovar Typhi Ty2
gcgcaggcgagcgg

SEQ ID NO: 1764360 - RNA, 17 nt, Salmonella enterica enterica serovar Typhi Ty2
gcgcaggccgcgccgcu

SEQ ID NO: 1764361 - RNA, 20 nt, Salmonella enterica enterica serovar Typhi Ty2
gcgcaggccgcgccgcugcu

SEQ ID NO: 1764362 - RNA, 23 nt, Salmonella enterica enterica serovar Typhi Ty2
gcgcaggcucucggugguggcag

SEQ ID NO: 1764363 - RNA, 17 nt, Salmonella enterica enterica serovar Typhi Ty2
gcgcagggucugguggu

SEQ ID NO: 1764364 - RNA, 14 nt, Salmonella enterica enterica serovar Typhi Ty2
gcgcaggggcuauu

SEQ ID NO: 1764365 - RNA, 14 nt, Salmonella enterica enterica serovar Typhi Ty2
gcgcagucacagau

SEQ ID NO: 1764366 - RNA, 17 nt, Salmonella enterica enterica serovar Typhi Ty2
gcgcagugaccagcauc

SEQ ID NO: 1764367 - RNA, 18 nt, Salmonella enterica enterica serovar Typhi Ty2
gcgcaaaucgccaucagc

SEQ ID NO: 1764368 - RNA, 21 nt, Salmonella enterica enterica serovar Typhi Ty2
gcgcaaacaguacgcccgccu

SEQ ID NO: 1764369 - RNA, 14 nt, Salmonella enterica enterica serovar Typhi Ty2
gcgcaaaugccggu

SEQ ID NO: 1764370 - RNA, 22 nt, Salmonella enterica enterica serovar Typhi Ty2
gcgcaaccuccgcggggaucgg

SEQ ID NO: 1764371 - RNA, 19 nt, Salmonella enterica enterica serovar Typhi Ty2
gcgcaacgcuuaaucccuu

SEQ ID NO: 1764372 - RNA, 18 nt, Salmonella enterica enterica serovar Typhi Ty2
gcgcaacgcuuccaccuc

SEQ ID NO: 1764373 - RNA, 20 nt, Salmonella enterica enterica serovar Typhi Ty2
gcgcaaucugcucgacgcgc

SEQ ID NO: 1764374 - RNA, 22 nt, Salmonella enterica enterica serovar Typhi Ty2
gcgcaaucgguaaaggucgccg

SEQ ID NO: 1764375 - RNA, 15 nt, Salmonella enterica enterica serovar Typhi Ty2
gcgcaaggccgagcg

SEQ ID NO: 1764376 - RNA, 17 nt, Salmonella enterica enterica serovar Typhi Ty2
gcgcaacuggcgccgga

SEQ ID NO: 1764377 - RNA, 17 nt, Salmonella enterica enterica serovar Typhi Ty2
gcgauucagcgcaggca

SEQ ID NO: 1764378 - RNA, 16 nt, Salmonella enterica enterica serovar Typhi Ty2
gcgauucgcccacgga

SEQ ID NO: 1764379 - RNA, 13 nt, Salmonella enterica enterica serovar Typhi Ty2
gcgauuacgccag

SEQ ID NO: 1764380 - RNA, 19 nt, Salmonella enterica enterica serovar Typhi Ty2
gcgauguuuacugcggcgc

SEQ ID NO: 1764381 - RNA, 19 nt, Salmonella enterica enterica serovar Typhi Ty2
gcgauuuauagagcagcac

SEQ ID NO: 1764382 - RNA, 17 nt, Salmonella enterica enterica serovar Typhi Ty2
gcgauuuucagcaccuu

SEQ ID NO: 1764383 - RNA, 13 nt, Salmonella enterica enterica serovar Typhi Ty2
gcgcaaaagcgcg

SEQ ID NO: 1764384 - RNA, 16 nt, Salmonella enterica enterica serovar Typhi Ty2
gcgcaaaagcgcgccc

SEQ ID NO: 1764385 - RNA, 18 nt, Salmonella enterica enterica serovar Typhi Ty2
gcgauggggcaagcucag

SEQ ID NO: 1764386 - RNA, 16 nt, Salmonella enterica enterica serovar Typhi Ty2
gcgauggugcggcgca

SEQ ID NO: 1764387 - RNA, 14 nt, Salmonella enterica enterica serovar Typhi Ty2
gcgaugagcgccag

SEQ ID NO: 1764388 - RNA, 12 nt, Salmonella enterica enterica serovar Typhi Ty2
gcgaugagcgcc

SEQ ID NO: 1764389 - RNA, 21 nt, Salmonella enterica enterica serovar Typhi Ty2
gcgaugaccaucaaauaauac

SEQ ID NO: 1764390 - RNA, 23 nt, Salmonella enterica enterica serovar Typhi Ty2
gcgaucuuuuguuuaccccaggc

SEQ ID NO: 1764391 - RNA, 15 nt, Salmonella enterica enterica serovar Typhi Ty2
gcgaucuggcggcga

SEQ ID NO: 1764392 - RNA, 23 nt, Salmonella enterica enterica serovar Typhi Ty2
gcgauauuucuccgcccauccag

SEQ ID NO: 1764393 - RNA, 21 nt, Salmonella enterica enterica serovar Typhi Ty2
gcgauaucaacgucuugccgu

SEQ ID NO: 1764394 - RNA, 14 nt, Salmonella enterica enterica serovar Typhi Ty2
gcgaucgcgccagc

SEQ ID NO: 1764395 - RNA, 22 nt, Salmonella enterica enterica serovar Typhi Ty2
gcgaucgcgccggucgccagca

SEQ ID NO: 1764396 - RNA, 19 nt, Salmonella enterica enterica serovar Typhi Ty2
gcgaucagacgcugguugu

SEQ ID NO: 1764397 - RNA, 16 nt, Salmonella enterica enterica serovar Typhi Ty2
gcgaucggcuguaccu

SEQ ID NO: 1764398 - RNA, 19 nt, Salmonella enterica enterica serovar Typhi Ty2
gcgagcguuuugaugucca

SEQ ID NO: 1764399 - RNA, 13 nt, Salmonella enterica enterica serovar Typhi Ty2
gcgauagcugcug

SEQ ID NO: 1764400 - RNA, 13 nt, Salmonella enterica enterica serovar Typhi Ty2
gcgauaaaccagc

SEQ ID NO: 1764401 - RNA, 14 nt, Salmonella enterica enterica serovar Typhi Ty2
gcgauaaaccagcc

SEQ ID NO: 1764402 - RNA, 17 nt, Salmonella enterica enterica serovar Typhi Ty2
gcgauaaaccaacagcc

SEQ ID NO: 1764403 - RNA, 16 nt, Salmonella enterica enterica serovar Typhi Ty2
gcgacggaccggcagc

SEQ ID NO: 1764404 - RNA, 20 nt, Salmonella enterica enterica serovar Typhi Ty2
gcgaauaaucaaccauacau

SEQ ID NO: 1764405 - RNA, 18 nt, Salmonella enterica enterica serovar Typhi Ty2
gcgaauaacauaauauuc

SEQ ID NO: 1764406 - RNA, 16 nt, Salmonella enterica enterica serovar Typhi Ty2
gcgaauaacaucaucc

SEQ ID NO: 1764407 - RNA, 14 nt, Salmonella enterica enterica serovar Typhi Ty2
gcgaauaaacacau

SEQ ID NO: 1764408 - RNA, 17 nt, Salmonella enterica enterica serovar Typhi Ty2
gcgacggcguaagcgcu

SEQ ID NO: 1764409 - RNA, 16 nt, Salmonella enterica enterica serovar Typhi Ty2
gcgacggcgcgccggc

SEQ ID NO: 1764410 - RNA, 15 nt, Salmonella enterica enterica serovar Typhi Ty2
gcgacggcgcuggcu

SEQ ID NO: 1764411 - RNA, 18 nt, Salmonella enterica enterica serovar Typhi Ty2
gcgacguuaucucgccag

SEQ ID NO: 1764412 - RNA, 14 nt, Salmonella enterica enterica serovar Typhi Ty2
gcgacuaaccugau

SEQ ID NO: 1764413 - RNA, 14 nt, Salmonella enterica enterica serovar Typhi Ty2
gcgaaggcggcggc

SEQ ID NO: 1764414 - RNA, 16 nt, Salmonella enterica enterica serovar Typhi Ty2
gcgaagugcagcguuu

SEQ ID NO: 1764415 - RNA, 18 nt, Salmonella enterica enterica serovar Typhi Ty2
gcgagcaguucagcagca

SEQ ID NO: 1764416 - RNA, 16 nt, Salmonella enterica enterica serovar Typhi Ty2
gcgagaguuugugaug

SEQ ID NO: 1764417 - RNA, 11 nt, Salmonella enterica enterica serovar Typhi Ty2
gcgagcccugu

SEQ ID NO: 1764418 - RNA, 18 nt, Salmonella enterica enterica serovar Typhi Ty2
gcgacuaacgucuuaucc

SEQ ID NO: 1764419 - RNA, 13 nt, Salmonella enterica enterica serovar Typhi Ty2
gcgacucauccac

SEQ ID NO: 1764420 - RNA, 15 nt, Salmonella enterica enterica serovar Typhi Ty2
gcgagaagcugggcg

SEQ ID NO: 1764421 - RNA, 16 nt, Salmonella enterica enterica serovar Typhi Ty2
gcgacucggugccgcu

SEQ ID NO: 1764422 - RNA, 18 nt, Salmonella enterica enterica serovar Typhi Ty2
gcgagaagcugggcguca

SEQ ID NO: 1764423 - RNA, 13 nt, Salmonella enterica enterica serovar Typhi Ty2
gcgagaccauauu

SEQ ID NO: 1764424 - RNA, 16 nt, Salmonella enterica enterica serovar Typhi Ty2
gcgagaauuuuaugga

SEQ ID NO: 1764425 - RNA, 21 nt, Salmonella enterica enterica serovar Typhi Ty2
gcgcccgccaccagcacagcc

SEQ ID NO: 1764426 - RNA, 17 nt, Salmonella enterica enterica serovar Typhi Ty2
gcgcccgagcgacgccc

SEQ ID NO: 1764427 - RNA, 23 nt, Salmonella enterica enterica serovar Typhi Ty2
gcgcccgccugcuguaaccccug

SEQ ID NO: 1764428 - RNA, 22 nt, Salmonella enterica enterica serovar Typhi Ty2
gcgcccgccugcuguaaccccu

SEQ ID NO: 1764429 - RNA, 16 nt, Salmonella enterica enterica serovar Typhi Ty2
gcgcccauccgcccac

SEQ ID NO: 1764430 - RNA, 16 nt, Salmonella enterica enterica serovar Typhi Ty2
gcgcccagccaaagcg

SEQ ID NO: 1764431 - RNA, 20 nt, Salmonella enterica enterica serovar Typhi Ty2
gcgcccauuccgccugccgc

SEQ ID NO: 1764432 - RNA, 12 nt, Salmonella enterica enterica serovar Typhi Ty2
gcgcccccagca

SEQ ID NO: 1764433 - RNA, 13 nt, Salmonella enterica enterica serovar Typhi Ty2
gcgccccggcggc

SEQ ID NO: 1764434 - RNA, 21 nt, Salmonella enterica enterica serovar Typhi Ty2
gcgccccucuugcagcaagaa

SEQ ID NO: 1764435 - RNA, 20 nt, Salmonella enterica enterica serovar Typhi Ty2
gcgcccgacgcgccacuucc

SEQ ID NO: 1764436 - RNA, 14 nt, Salmonella enterica enterica serovar Typhi Ty2
gcgccaguuuuucc

SEQ ID NO: 1764437 - RNA, 16 nt, Salmonella enterica enterica serovar Typhi Ty2
gcgccagugacgccag

SEQ ID NO: 1764438 - RNA, 16 nt, Salmonella enterica enterica serovar Typhi Ty2
gcgccaguaaucggcg

SEQ ID NO: 1764439 - RNA, 22 nt, Salmonella enterica enterica serovar Typhi Ty2
gcgccagcucaucgggcgaagc

SEQ ID NO: 1764440 - RNA, 15 nt, Salmonella enterica enterica serovar Typhi Ty2
gcgccagcucaugca

SEQ ID NO: 1764441 - RNA, 17 nt, Salmonella enterica enterica serovar Typhi Ty2
gcgccagcgugcuaagc

SEQ ID NO: 1764442 - RNA, 13 nt, Salmonella enterica enterica serovar Typhi Ty2
gcgccaggaaacu

SEQ ID NO: 1764443 - RNA, 19 nt, Salmonella enterica enterica serovar Typhi Ty2
gcgccagcuuucggcgagc

SEQ ID NO: 1764444 - RNA, 17 nt, Salmonella enterica enterica serovar Typhi Ty2
gcgccaggccauugcug

SEQ ID NO: 1764445 - RNA, 12 nt, Salmonella enterica enterica serovar Typhi Ty2
gcgccaggccau

SEQ ID NO: 1764446 - RNA, 18 nt, Salmonella enterica enterica serovar Typhi Ty2
gcgccauugaggucgcgg

SEQ ID NO: 1764447 - RNA, 23 nt, Salmonella enterica enterica serovar Typhi Ty2
gcgccauugaggucgcggucggc

SEQ ID NO: 1764448 - RNA, 23 nt, Salmonella enterica enterica serovar Typhi Ty2
gcgcccacgcgcggcaucauuua

SEQ ID NO: 1764449 - RNA, 15 nt, Salmonella enterica enterica serovar Typhi Ty2
gcgcccacgcgcggc

SEQ ID NO: 1764450 - RNA, 21 nt, Salmonella enterica enterica serovar Typhi Ty2
gcgccauccugccgcaccagu

SEQ ID NO: 1764451 - RNA, 13 nt, Salmonella enterica enterica serovar Typhi Ty2
gcgccaugaagau

SEQ ID NO: 1764452 - RNA, 17 nt, Salmonella enterica enterica serovar Typhi Ty2
gcgccaucuccuccuca

SEQ ID NO: 1764453 - RNA, 16 nt, Salmonella enterica enterica serovar Typhi Ty2
gcgccaucaggcacaa

SEQ ID NO: 1764454 - RNA, 18 nt, Salmonella enterica enterica serovar Typhi Ty2
gcgccaucaggcaucuga

SEQ ID NO: 1764455 - RNA, 19 nt, Salmonella enterica enterica serovar Typhi Ty2
gcgccauacuuacugcugu

SEQ ID NO: 1764456 - RNA, 12 nt, Salmonella enterica enterica serovar Typhi Ty2
gcgccauaaaaa

SEQ ID NO: 1764457 - RNA, 18 nt, Salmonella enterica enterica serovar Typhi Ty2
gcgccauccaccaggcau

SEQ ID NO: 1764458 - RNA, 20 nt, Salmonella enterica enterica serovar Typhi Ty2
gcgccauccaccaggcaugc

SEQ ID NO: 1764459 - RNA, 13 nt, Salmonella enterica enterica serovar Typhi Ty2
gcgccaucaggcc

SEQ ID NO: 1764460 - RNA, 15 nt, Salmonella enterica enterica serovar Typhi Ty2
gcgccauccggcgcu

SEQ ID NO: 1764461 - RNA, 16 nt, Salmonella enterica enterica serovar Typhi Ty2
gcgccauccggcacac

SEQ ID NO: 1764462 - RNA, 15 nt, Salmonella enterica enterica serovar Typhi Ty2
gcgcccugcgggccg

SEQ ID NO: 1764463 - RNA, 13 nt, Salmonella enterica enterica serovar Typhi Ty2
gcgcccuccucca

SEQ ID NO: 1764464 - RNA, 19 nt, Salmonella enterica enterica serovar Typhi Ty2
gcgccgacaucgccaccgc

SEQ ID NO: 1764465 - RNA, 16 nt, Salmonella enterica enterica serovar Typhi Ty2
gcgccgacaucgccac

SEQ ID NO: 1764466 - RNA, 20 nt, Salmonella enterica enterica serovar Typhi Ty2
gcgccgacauagcugaacaa

SEQ ID NO: 1764467 - RNA, 15 nt, Salmonella enterica enterica serovar Typhi Ty2
gcgccgccagcgaca

SEQ ID NO: 1764468 - RNA, 17 nt, Salmonella enterica enterica serovar Typhi Ty2
gcgccggaugacggcag

SEQ ID NO: 1764469 - RNA, 16 nt, Salmonella enterica enterica serovar Typhi Ty2
gcgccggacgccacgc

SEQ ID NO: 1764470 - RNA, 15 nt, Salmonella enterica enterica serovar Typhi Ty2
gcgccggacagcagc

SEQ ID NO: 1764471 - RNA, 21 nt, Salmonella enterica enterica serovar Typhi Ty2
gcgccgcuacguaccgcuucc

SEQ ID NO: 1764472 - RNA, 12 nt, Salmonella enterica enterica serovar Typhi Ty2
gcgccgcucaca

SEQ ID NO: 1764473 - RNA, 13 nt, Salmonella enterica enterica serovar Typhi Ty2
gcgccgcggccuc

SEQ ID NO: 1764474 - RNA, 13 nt, Salmonella enterica enterica serovar Typhi Ty2
gcgccgcgccacc

SEQ ID NO: 1764475 - RNA, 23 nt, Salmonella enterica enterica serovar Typhi Ty2
gcgccgccgaacagacggcggcu

SEQ ID NO: 1764476 - RNA, 12 nt, Salmonella enterica enterica serovar Typhi Ty2
gcgccgccgccu

SEQ ID NO: 1764477 - RNA, 13 nt, Salmonella enterica enterica serovar Typhi Ty2
gcgccguaaacaa

SEQ ID NO: 1764478 - RNA, 22 nt, Salmonella enterica enterica serovar Typhi Ty2
gcgccguaacgcgaugccuggc

SEQ ID NO: 1764479 - RNA, 17 nt, Salmonella enterica enterica serovar Typhi Ty2
gcgccguaaggcgccuu

SEQ ID NO: 1764480 - RNA, 15 nt, Salmonella enterica enterica serovar Typhi Ty2
gcgccguccauaaug

SEQ ID NO: 1764481 - RNA, 19 nt, Salmonella enterica enterica serovar Typhi Ty2
gcgccuccacaaagcgcga

SEQ ID NO: 1764482 - RNA, 21 nt, Salmonella enterica enterica serovar Typhi Ty2
gcgccuccgcguagcccagcg

SEQ ID NO: 1764483 - RNA, 17 nt, Salmonella enterica enterica serovar Typhi Ty2
gcgccuaccgccauaga

SEQ ID NO: 1764484 - RNA, 21 nt, Salmonella enterica enterica serovar Typhi Ty2
gcgccguucgggguugauggu

SEQ ID NO: 1764485 - RNA, 15 nt, Salmonella enterica enterica serovar Typhi Ty2
gcgccgugcccagca

SEQ ID NO: 1764486 - RNA, 19 nt, Salmonella enterica enterica serovar Typhi Ty2
gcgccugaagauacgccag

SEQ ID NO: 1764487 - RNA, 21 nt, Salmonella enterica enterica serovar Typhi Ty2
gcgccugacgcggacgccacc

SEQ ID NO: 1764488 - RNA, 14 nt, Salmonella enterica enterica serovar Typhi Ty2
gcgccugcgcugca

SEQ ID NO: 1764489 - RNA, 13 nt, Salmonella enterica enterica serovar Typhi Ty2
gcgccugcgcggc

SEQ ID NO: 1764490 - RNA, 18 nt, Salmonella enterica enterica serovar Typhi Ty2
gcgccugcauacucacau

SEQ ID NO: 1764491 - RNA, 14 nt, Salmonella enterica enterica serovar Typhi Ty2
gcgccugccauagc

SEQ ID NO: 1764492 - RNA, 17 nt, Salmonella enterica enterica serovar Typhi Ty2
gcgccugcauacucaca

SEQ ID NO: 1764493 - RNA, 21 nt, Salmonella enterica enterica serovar Typhi Ty2
gcgccugugaaacggcggacg

SEQ ID NO: 1764494 - RNA, 16 nt, Salmonella enterica enterica serovar Typhi Ty2
gcgccuguuagggcgc

SEQ ID NO: 1764495 - RNA, 20 nt, Salmonella enterica enterica serovar Typhi Ty2
gcgccugucgggccuacaga

SEQ ID NO: 1764496 - RNA, 22 nt, Salmonella enterica enterica serovar Typhi Ty2
gcgccuguaaggcucucuuacc

SEQ ID NO: 1764497 - RNA, 21 nt, Salmonella enterica enterica serovar Typhi Ty2
gcgccuggaugaagcagacau

SEQ ID NO: 1764498 - RNA, 20 nt, Salmonella enterica enterica serovar Typhi Ty2
gcgcggccuuugccuucgcc

SEQ ID NO: 1764499 - RNA, 21 nt, Salmonella enterica enterica serovar Typhi Ty2
gcgcggcaucgccgcccagug

SEQ ID NO: 1764500 - RNA, 14 nt, Salmonella enterica enterica serovar Typhi Ty2
gcgcggcagcgcgc

SEQ ID NO: 1764501 - RNA, 13 nt, Salmonella enterica enterica serovar Typhi Ty2
gcgcggcagaccg

SEQ ID NO: 1764502 - RNA, 18 nt, Salmonella enterica enterica serovar Typhi Ty2
gcgcgcuuucaccgccuc

SEQ ID NO: 1764503 - RNA, 13 nt, Salmonella enterica enterica serovar Typhi Ty2
gcgcgcuggcaag

SEQ ID NO: 1764504 - RNA, 13 nt, Salmonella enterica enterica serovar Typhi Ty2
gcgcgcgcgccug

SEQ ID NO: 1764505 - RNA, 14 nt, Salmonella enterica enterica serovar Typhi Ty2
gcgcgcgaugcugc

SEQ ID NO: 1764506 - RNA, 14 nt, Salmonella enterica enterica serovar Typhi Ty2
gcgcgcugccgccc

SEQ ID NO: 1764507 - RNA, 16 nt, Salmonella enterica enterica serovar Typhi Ty2
gcgcgcugcgccugga

SEQ ID NO: 1764508 - RNA, 12 nt, Salmonella enterica enterica serovar Typhi Ty2
gcgcgccgccuc

SEQ ID NO: 1764509 - RNA, 14 nt, Salmonella enterica enterica serovar Typhi Ty2
gcgcgccgcccugc

SEQ ID NO: 1764510 - RNA, 13 nt, Salmonella enterica enterica serovar Typhi Ty2
gcgcgccgcagcg

SEQ ID NO: 1764511 - RNA, 14 nt, Salmonella enterica enterica serovar Typhi Ty2
gcgcgccgcuggcg

SEQ ID NO: 1764512 - RNA, 19 nt, Salmonella enterica enterica serovar Typhi Ty2
gcgccuguuagggcgcggc

SEQ ID NO: 1764513 - RNA, 20 nt, Salmonella enterica enterica serovar Typhi Ty2
gcgccugucuccagcgccgc

SEQ ID NO: 1764514 - RNA, 22 nt, Salmonella enterica enterica serovar Typhi Ty2
gcgccugucuccagcgccgcuu

SEQ ID NO: 1764515 - RNA, 17 nt, Salmonella enterica enterica serovar Typhi Ty2
gcgccuguuagggcgcg

SEQ ID NO: 1764516 - RNA, 18 nt, Salmonella enterica enterica serovar Typhi Ty2
gcgccuguuagggcgcgg

SEQ ID NO: 1764517 - RNA, 23 nt, Salmonella enterica enterica serovar Typhi Ty2
gcgccuuaaaccgucgggcgucg

SEQ ID NO: 1764518 - RNA, 15 nt, Salmonella enterica enterica serovar Typhi Ty2
gcgccuuccagcaau

SEQ ID NO: 1764519 - RNA, 16 nt, Salmonella enterica enterica serovar Typhi Ty2
gcgcgaccaggaaacc

SEQ ID NO: 1764520 - RNA, 16 nt, Salmonella enterica enterica serovar Typhi Ty2
gcgcgaaaagaaacug

SEQ ID NO: 1764521 - RNA, 20 nt, Salmonella enterica enterica serovar Typhi Ty2
gcgccuuucgauaacccgcu

SEQ ID NO: 1764522 - RNA, 17 nt, Salmonella enterica enterica serovar Typhi Ty2
gcgcgaaaaauaggaug

SEQ ID NO: 1764523 - RNA, 20 nt, Salmonella enterica enterica serovar Typhi Ty2
gcgccuugucugaccgggcg

SEQ ID NO: 1764524 - RNA, 20 nt, Salmonella enterica enterica serovar Typhi Ty2
gcgcgaugccugccgggccu

SEQ ID NO: 1764525 - RNA, 18 nt, Salmonella enterica enterica serovar Typhi Ty2
gcgcgccaaacggcagcu

SEQ ID NO: 1764526 - RNA, 18 nt, Salmonella enterica enterica serovar Typhi Ty2
gcgcgacgguaaggcuau

SEQ ID NO: 1764527 - RNA, 12 nt, Salmonella enterica enterica serovar Typhi Ty2
gcgcgacgccga

SEQ ID NO: 1764528 - RNA, 21 nt, Salmonella enterica enterica serovar Typhi Ty2
gcggcguaaaagcgauaaaga

SEQ ID NO: 1764529 - RNA, 22 nt, Salmonella enterica enterica serovar Typhi Ty2
gcggcguaaacacguuaucuga

SEQ ID NO: 1764530 - RNA, 19 nt, Salmonella enterica enterica serovar Typhi Ty2
gcggcgguuauccgccagc

SEQ ID NO: 1764531 - RNA, 16 nt, Salmonella enterica enterica serovar Typhi Ty2
gcggcgguucauccug

SEQ ID NO: 1764532 - RNA, 22 nt, Salmonella enterica enterica serovar Typhi Ty2
gcggcgguuauccuccgggucg

SEQ ID NO: 1764533 - RNA, 21 nt, Salmonella enterica enterica serovar Typhi Ty2
gcggcgguuauccgccagcgc

SEQ ID NO: 1764534 - RNA, 17 nt, Salmonella enterica enterica serovar Typhi Ty2
gcggcggucugcgccug

SEQ ID NO: 1764535 - RNA, 21 nt, Salmonella enterica enterica serovar Typhi Ty2
gcggcggggauaaucagcagc

SEQ ID NO: 1764536 - RNA, 16 nt, Salmonella enterica enterica serovar Typhi Ty2
gcggcggguaaauaga

SEQ ID NO: 1764537 - RNA, 14 nt, Salmonella enterica enterica serovar Typhi Ty2
gcggcucaccagcu

SEQ ID NO: 1764538 - RNA, 14 nt, Salmonella enterica enterica serovar Typhi Ty2
gcggcguucaaaac

SEQ ID NO: 1764539 - RNA, 16 nt, Salmonella enterica enterica serovar Typhi Ty2
gcggcuaauacgccag

SEQ ID NO: 1764540 - RNA, 16 nt, Salmonella enterica enterica serovar Typhi Ty2
gcggcgugaccgccuu

SEQ ID NO: 1764541 - RNA, 17 nt, Salmonella enterica enterica serovar Typhi Ty2
gcggcgucugcaccggu

SEQ ID NO: 1764542 - RNA, 16 nt, Salmonella enterica enterica serovar Typhi Ty2
gcggcguagccgccga

SEQ ID NO: 1764543 - RNA, 14 nt, Salmonella enterica enterica serovar Typhi Ty2
gcggcgccaguacu

SEQ ID NO: 1764544 - RNA, 17 nt, Salmonella enterica enterica serovar Typhi Ty2
gcggcgccaacgcgcua

SEQ ID NO: 1764545 - RNA, 14 nt, Salmonella enterica enterica serovar Typhi Ty2
gcggcgcgcccggc

SEQ ID NO: 1764546 - RNA, 13 nt, Salmonella enterica enterica serovar Typhi Ty2
gcggcgcgcccgg

SEQ ID NO: 1764547 - RNA, 16 nt, Salmonella enterica enterica serovar Typhi Ty2
gcggcgcagcgcgcga

SEQ ID NO: 1764548 - RNA, 18 nt, Salmonella enterica enterica serovar Typhi Ty2
gcggcggcaagcuggcga

SEQ ID NO: 1764549 - RNA, 22 nt, Salmonella enterica enterica serovar Typhi Ty2
gcggcgcgucuucccggcgcuc

SEQ ID NO: 1764550 - RNA, 21 nt, Salmonella enterica enterica serovar Typhi Ty2
gcggcgcuuccagacuacgga

SEQ ID NO: 1764551 - RNA, 16 nt, Salmonella enterica enterica serovar Typhi Ty2
gcgguaagagagugag

SEQ ID NO: 1764552 - RNA, 13 nt, Salmonella enterica enterica serovar Typhi Ty2
gcgguaagcuguu

SEQ ID NO: 1764553 - RNA, 14 nt, Salmonella enterica enterica serovar Typhi Ty2
gcgguaacaggcac

SEQ ID NO: 1764554 - RNA, 19 nt, Salmonella enterica enterica serovar Typhi Ty2
gcgggcguauagccaggca

SEQ ID NO: 1764555 - RNA, 19 nt, Salmonella enterica enterica serovar Typhi Ty2
gcgggcguuugcgcgcgcc

SEQ ID NO: 1764556 - RNA, 14 nt, Salmonella enterica enterica serovar Typhi Ty2
gcggggaacaccca

SEQ ID NO: 1764557 - RNA, 13 nt, Salmonella enterica enterica serovar Typhi Ty2
gcgggcugaaauc

SEQ ID NO: 1764558 - RNA, 19 nt, Salmonella enterica enterica serovar Typhi Ty2
gcgggcugccccagacgcc

SEQ ID NO: 1764559 - RNA, 19 nt, Salmonella enterica enterica serovar Typhi Ty2
gcggggauaaucagcagcg

SEQ ID NO: 1764560 - RNA, 21 nt, Salmonella enterica enterica serovar Typhi Ty2
gcgggagauggcguggccaag

SEQ ID NO: 1764561 - RNA, 15 nt, Salmonella enterica enterica serovar Typhi Ty2
gcgggccaauccagc

SEQ ID NO: 1764562 - RNA, 20 nt, Salmonella enterica enterica serovar Typhi Ty2
gcgggcgauagagaccgcuu

SEQ ID NO: 1764563 - RNA, 22 nt, Salmonella enterica enterica serovar Typhi Ty2
gcggcugacgcgaugacggcgc

SEQ ID NO: 1764564 - RNA, 22 nt, Salmonella enterica enterica serovar Typhi Ty2
gcggcugaaccacccugaaaag

SEQ ID NO: 1764565 - RNA, 22 nt, Salmonella enterica enterica serovar Typhi Ty2
gcggcuuugcgccggcaguccu

SEQ ID NO: 1764566 - RNA, 23 nt, Salmonella enterica enterica serovar Typhi Ty2
gcggcccgugguuuuacugcaag

SEQ ID NO: 1764567 - RNA, 23 nt, Salmonella enterica enterica serovar Typhi Ty2
gcggcccgggagaacgccgggcc

SEQ ID NO: 1764568 - RNA, 13 nt, Salmonella enterica enterica serovar Typhi Ty2
gcggccagauaag

SEQ ID NO: 1764569 - RNA, 17 nt, Salmonella enterica enterica serovar Typhi Ty2
gcggcauuaaagccgcc

SEQ ID NO: 1764570 - RNA, 16 nt, Salmonella enterica enterica serovar Typhi Ty2
gcggcaugauccacca

SEQ ID NO: 1764571 - RNA, 19 nt, Salmonella enterica enterica serovar Typhi Ty2
gcggcaucucgccaaacca

SEQ ID NO: 1764572 - RNA, 16 nt, Salmonella enterica enterica serovar Typhi Ty2
gcggcaucaggcauag

SEQ ID NO: 1764573 - RNA, 18 nt, Salmonella enterica enterica serovar Typhi Ty2
gcggccaaagggagcaga

SEQ ID NO: 1764574 - RNA, 14 nt, Salmonella enterica enterica serovar Typhi Ty2
gcggauucuccagg

SEQ ID NO: 1764575 - RNA, 15 nt, Salmonella enterica enterica serovar Typhi Ty2
gcggaucggcgcaga

SEQ ID NO: 1764576 - RNA, 13 nt, Salmonella enterica enterica serovar Typhi Ty2
gcggacgggcggu

SEQ ID NO: 1764577 - RNA, 19 nt, Salmonella enterica enterica serovar Typhi Ty2
gcggacguagcggcgccgg

SEQ ID NO: 1764578 - RNA, 17 nt, Salmonella enterica enterica serovar Typhi Ty2
gcggacauuaacgccgc

SEQ ID NO: 1764579 - RNA, 19 nt, Salmonella enterica enterica serovar Typhi Ty2
gcggaaucacgcauauccc

SEQ ID NO: 1764580 - RNA, 13 nt, Salmonella enterica enterica serovar Typhi Ty2
gcggacgcagcuc

SEQ ID NO: 1764581 - RNA, 13 nt, Salmonella enterica enterica serovar Typhi Ty2
gcggcaggcaaaa

SEQ ID NO: 1764582 - RNA, 12 nt, Salmonella enterica enterica serovar Typhi Ty2
gcggcagcuuca

SEQ ID NO: 1764583 - RNA, 16 nt, Salmonella enterica enterica serovar Typhi Ty2
gcggcaaagauaaucu

SEQ ID NO: 1764584 - RNA, 20 nt, Salmonella enterica enterica serovar Typhi Ty2
gcggcaaagauaaucugaau

SEQ ID NO: 1764585 - RNA, 23 nt, Salmonella enterica enterica serovar Typhi Ty2
gcggcaacccuuuggccaccagc

SEQ ID NO: 1764586 - RNA, 16 nt, Salmonella enterica enterica serovar Typhi Ty2
gcggcaacucgugcag

SEQ ID NO: 1764587 - RNA, 12 nt, Salmonella enterica enterica serovar Typhi Ty2
gcgcuggcuggc

SEQ ID NO: 1764588 - RNA, 14 nt, Salmonella enterica enterica serovar Typhi Ty2
gcgcuggcgugguu

SEQ ID NO: 1764589 - RNA, 15 nt, Salmonella enterica enterica serovar Typhi Ty2
gcgcuggcggcgacg

SEQ ID NO: 1764590 - RNA, 14 nt, Salmonella enterica enterica serovar Typhi Ty2
gcgcuggcgcuguu

SEQ ID NO: 1764591 - RNA, 14 nt, Salmonella enterica enterica serovar Typhi Ty2
gcgcuggcgcgucu

SEQ ID NO: 1764592 - RNA, 14 nt, Salmonella enterica enterica serovar Typhi Ty2
gcgcuggcgagcga

SEQ ID NO: 1764593 - RNA, 15 nt, Salmonella enterica enterica serovar Typhi Ty2
gcgcugguggcgguc

SEQ ID NO: 1764594 - RNA, 23 nt, Salmonella enterica enterica serovar Typhi Ty2
gcgcuguauaaucccgcggcgga

SEQ ID NO: 1764595 - RNA, 17 nt, Salmonella enterica enterica serovar Typhi Ty2
gcgcugucaccagcagc

SEQ ID NO: 1764596 - RNA, 14 nt, Salmonella enterica enterica serovar Typhi Ty2
gcgcugggccgggc

SEQ ID NO: 1764597 - RNA, 17 nt, Salmonella enterica enterica serovar Typhi Ty2
gcgcuggguacguucgg

SEQ ID NO: 1764598 - RNA, 22 nt, Salmonella enterica enterica serovar Typhi Ty2
gcgcuggguacguucggacugg

SEQ ID NO: 1764599 - RNA, 13 nt, Salmonella enterica enterica serovar Typhi Ty2
gcgcuguuguucc

SEQ ID NO: 1764600 - RNA, 19 nt, Salmonella enterica enterica serovar Typhi Ty2
gcgcuguuggcauccugcg

SEQ ID NO: 1764601 - RNA, 16 nt, Salmonella enterica enterica serovar Typhi Ty2
gcgcugucagugaaaa

SEQ ID NO: 1764602 - RNA, 23 nt, Salmonella enterica enterica serovar Typhi Ty2
gcgcuguuuauccacaggcgacu

SEQ ID NO: 1764603 - RNA, 13 nt, Salmonella enterica enterica serovar Typhi Ty2
gcgcuuaucgccg

SEQ ID NO: 1764604 - RNA, 20 nt, Salmonella enterica enterica serovar Typhi Ty2
gcggaaaggacguucuucuc

SEQ ID NO: 1764605 - RNA, 22 nt, Salmonella enterica enterica serovar Typhi Ty2
gcggaaggcgccucgcgcggcg

SEQ ID NO: 1764606 - RNA, 13 nt, Salmonella enterica enterica serovar Typhi Ty2
gcggaagaggcgc

SEQ ID NO: 1764607 - RNA, 14 nt, Salmonella enterica enterica serovar Typhi Ty2
gcggaagaggcgcc

SEQ ID NO: 1764608 - RNA, 22 nt, Salmonella enterica enterica serovar Typhi Ty2
gcgcucuaucaccgcccgccgg

SEQ ID NO: 1764609 - RNA, 16 nt, Salmonella enterica enterica serovar Typhi Ty2
gcgcucugccaguagc

SEQ ID NO: 1764610 - RNA, 13 nt, Salmonella enterica enterica serovar Typhi Ty2
gcgcugaugaaaa

SEQ ID NO: 1764611 - RNA, 24 nt, Salmonella enterica enterica serovar Typhi Ty2
gcgcucgcucaucacaucgcgcag

SEQ ID NO: 1764612 - RNA, 18 nt, Salmonella enterica enterica serovar Typhi Ty2
gcgcugcauuugcugccg

SEQ ID NO: 1764613 - RNA, 16 nt, Salmonella enterica enterica serovar Typhi Ty2
gcgcugaugugcggcc

SEQ ID NO: 1764614 - RNA, 18 nt, Salmonella enterica enterica serovar Typhi Ty2
gcgcugcacaaucgccag

SEQ ID NO: 1764615 - RNA, 22 nt, Salmonella enterica enterica serovar Typhi Ty2
gcgcugcgcuuaccgggccuac

SEQ ID NO: 1764616 - RNA, 13 nt, Salmonella enterica enterica serovar Typhi Ty2
gcgcuggaggcgg

SEQ ID NO: 1764617 - RNA, 16 nt, Salmonella enterica enterica serovar Typhi Ty2
gcagugaccagcauca

SEQ ID NO: 1764618 - RNA, 21 nt, Salmonella enterica enterica serovar Typhi Ty2
gcagugaguaacguuaauaca

SEQ ID NO: 1764619 - RNA, 22 nt, Salmonella enterica enterica serovar Typhi Ty2
gcagugcaguauugcaccagga

SEQ ID NO: 1764620 - RNA, 18 nt, Salmonella enterica enterica serovar Typhi Ty2
gcagugauuaugcucccg

SEQ ID NO: 1764621 - RNA, 16 nt, Salmonella enterica enterica serovar Typhi Ty2
gcagucguuucuauua

SEQ ID NO: 1764622 - RNA, 21 nt, Salmonella enterica enterica serovar Typhi Ty2
gcagucacuuucagauuuuua

SEQ ID NO: 1764623 - RNA, 21 nt, Salmonella enterica enterica serovar Typhi Ty2
gcagucagccuugaccgccug

SEQ ID NO: 1764624 - RNA, 13 nt, Salmonella enterica enterica serovar Typhi Ty2
gcaguccaacaag

SEQ ID NO: 1764625 - RNA, 16 nt, Salmonella enterica enterica serovar Typhi Ty2
gcaguccaacaaggau

SEQ ID NO: 1764626 - RNA, 17 nt, Salmonella enterica enterica serovar Typhi Ty2
gcagucgcuacaaccag

SEQ ID NO: 1764627 - RNA, 12 nt, Salmonella enterica enterica serovar Typhi Ty2
gcagggcugcug

SEQ ID NO: 1764628 - RNA, 15 nt, Salmonella enterica enterica serovar Typhi Ty2
gcaggggcuccugcg

SEQ ID NO: 1764629 - RNA, 22 nt, Salmonella enterica enterica serovar Typhi Ty2
gcaggggcuccugcgccggacg

SEQ ID NO: 1764630 - RNA, 20 nt, Salmonella enterica enterica serovar Typhi Ty2
gcaggguauuugugcccgcg

SEQ ID NO: 1764631 - RNA, 20 nt, Salmonella enterica enterica serovar Typhi Ty2
gcagguuuuacuucuucagg

SEQ ID NO: 1764632 - RNA, 22 nt, Salmonella enterica enterica serovar Typhi Ty2
gcaguaacgcacuuuuccagcc

SEQ ID NO: 1764633 - RNA, 14 nt, Salmonella enterica enterica serovar Typhi Ty2
gcaguauuaccgaa

SEQ ID NO: 1764634 - RNA, 15 nt, Salmonella enterica enterica serovar Typhi Ty2
gcaguuuaaaucaca

SEQ ID NO: 1764635 - RNA, 17 nt, Salmonella enterica enterica serovar Typhi Ty2
gcaguuugguaauacua

SEQ ID NO: 1764636 - RNA, 23 nt, Salmonella enterica enterica serovar Typhi Ty2
gcaguuuuaccguaaaaugcugg

SEQ ID NO: 1764637 - RNA, 12 nt, Salmonella enterica enterica serovar Typhi Ty2
gcauaaaaaaac

SEQ ID NO: 1764638 - RNA, 17 nt, Salmonella enterica enterica serovar Typhi Ty2
gcauaaaaccgccgccc

SEQ ID NO: 1764639 - RNA, 15 nt, Salmonella enterica enterica serovar Typhi Ty2
gcauaaaaaaggcuc

SEQ ID NO: 1764640 - RNA, 17 nt, Salmonella enterica enterica serovar Typhi Ty2
gcauaaaaaacaucaug

SEQ ID NO: 1764641 - RNA, 23 nt, Salmonella enterica enterica serovar Typhi Ty2
gcauaaaugccuuauccggccug

SEQ ID NO: 1764642 - RNA, 15 nt, Salmonella enterica enterica serovar Typhi Ty2
gcauaaagaacgugu

SEQ ID NO: 1764643 - RNA, 17 nt, Salmonella enterica enterica serovar Typhi Ty2
gcauaaauuggcucaga

SEQ ID NO: 1764644 - RNA, 17 nt, Salmonella enterica enterica serovar Typhi Ty2
gcaguguaucgaagauc

SEQ ID NO: 1764645 - RNA, 14 nt, Salmonella enterica enterica serovar Typhi Ty2
gcaguguuaaucuc

SEQ ID NO: 1764646 - RNA, 15 nt, Salmonella enterica enterica serovar Typhi Ty2
gcaguuccccgccgc

SEQ ID NO: 1764647 - RNA, 18 nt, Salmonella enterica enterica serovar Typhi Ty2
gcaguggcauguucccau

SEQ ID NO: 1764648 - RNA, 20 nt, Salmonella enterica enterica serovar Typhi Ty2
gcaguggcauguucccaugu

SEQ ID NO: 1764649 - RNA, 16 nt, Salmonella enterica enterica serovar Typhi Ty2
gcagugcgcuaacugg

SEQ ID NO: 1764650 - RNA, 23 nt, Salmonella enterica enterica serovar Typhi Ty2
gcaggcucccuuauacaggcgca

SEQ ID NO: 1764651 - RNA, 13 nt, Salmonella enterica enterica serovar Typhi Ty2
gcaggcguuucaa

SEQ ID NO: 1764652 - RNA, 22 nt, Salmonella enterica enterica serovar Typhi Ty2
gcaggcgauagccccaguaaau

SEQ ID NO: 1764653 - RNA, 21 nt, Salmonella enterica enterica serovar Typhi Ty2
gcaggcgauagccccaguaaa

SEQ ID NO: 1764654 - RNA, 22 nt, Salmonella enterica enterica serovar Typhi Ty2
gcaggcgaaaccggccgccauc

SEQ ID NO: 1764655 - RNA, 18 nt, Salmonella enterica enterica serovar Typhi Ty2
gcaggccuggcuggauga

SEQ ID NO: 1764656 - RNA, 19 nt, Salmonella enterica enterica serovar Typhi Ty2
gcaggagagccagaagaau

SEQ ID NO: 1764657 - RNA, 19 nt, Salmonella enterica enterica serovar Typhi Ty2
gcaggaaauccagcagaau

SEQ ID NO: 1764658 - RNA, 18 nt, Salmonella enterica enterica serovar Typhi Ty2
gcagcuuggcggcuuccu

SEQ ID NO: 1764659 - RNA, 24 nt, Salmonella enterica enterica serovar Typhi Ty2
gcaggaaggaauuaugcagacgcu

SEQ ID NO: 1764660 - RNA, 15 nt, Salmonella enterica enterica serovar Typhi Ty2
gcaggaaggcgugca

SEQ ID NO: 1764661 - RNA, 15 nt, Salmonella enterica enterica serovar Typhi Ty2
gcaggaacggcagga

SEQ ID NO: 1764662 - RNA, 14 nt, Salmonella enterica enterica serovar Typhi Ty2
gcaggaacagauac

SEQ ID NO: 1764663 - RNA, 22 nt, Salmonella enterica enterica serovar Typhi Ty2
gcagcuucgccgcguaaucuuc

SEQ ID NO: 1764664 - RNA, 19 nt, Salmonella enterica enterica serovar Typhi Ty2
gcagcuucagcaucaucuc

SEQ ID NO: 1764665 - RNA, 15 nt, Salmonella enterica enterica serovar Typhi Ty2
gcagcuucugauacu

SEQ ID NO: 1764666 - RNA, 20 nt, Salmonella enterica enterica serovar Typhi Ty2
gcagcugcuuaacuucugca

SEQ ID NO: 1764667 - RNA, 12 nt, Salmonella enterica enterica serovar Typhi Ty2
gcagcugggccu

SEQ ID NO: 1764668 - RNA, 14 nt, Salmonella enterica enterica serovar Typhi Ty2
gcagcuuauuccag

SEQ ID NO: 1764669 - RNA, 19 nt, Salmonella enterica enterica serovar Typhi Ty2
gcagcguauugagcuggau

SEQ ID NO: 1764670 - RNA, 15 nt, Salmonella enterica enterica serovar Typhi Ty2
gcagcgucaucaggc

SEQ ID NO: 1764671 - RNA, 19 nt, Salmonella enterica enterica serovar Typhi Ty2
gcaaccgacgggcgcuggu

SEQ ID NO: 1764672 - RNA, 19 nt, Salmonella enterica enterica serovar Typhi Ty2
gcagcgucagcccaagcug

SEQ ID NO: 1764673 - RNA, 23 nt, Salmonella enterica enterica serovar Typhi Ty2
gcagcguuugacggauuuuuuuc

SEQ ID NO: 1764674 - RNA, 16 nt, Salmonella enterica enterica serovar Typhi Ty2
gcauccaccgcggagu

SEQ ID NO: 1764675 - RNA, 13 nt, Salmonella enterica enterica serovar Typhi Ty2
gcauccagcucau

SEQ ID NO: 1764676 - RNA, 15 nt, Salmonella enterica enterica serovar Typhi Ty2
gcaucauucugcagg

SEQ ID NO: 1764677 - RNA, 21 nt, Salmonella enterica enterica serovar Typhi Ty2
gcaucaucgguguucacaauu

SEQ ID NO: 1764678 - RNA, 23 nt, Salmonella enterica enterica serovar Typhi Ty2
gcauccugacuauugcugagcug

SEQ ID NO: 1764679 - RNA, 15 nt, Salmonella enterica enterica serovar Typhi Ty2
gcauccgugaccugc

SEQ ID NO: 1764680 - RNA, 19 nt, Salmonella enterica enterica serovar Typhi Ty2
gcaucgacguucagcauau

SEQ ID NO: 1764681 - RNA, 22 nt, Salmonella enterica enterica serovar Typhi Ty2
gcaucuacccguacauuauugc

SEQ ID NO: 1764682 - RNA, 20 nt, Salmonella enterica enterica serovar Typhi Ty2
gcaucucgccauaauuguuc

SEQ ID NO: 1764683 - RNA, 15 nt, Salmonella enterica enterica serovar Typhi Ty2
gcaucgauuccgccu

SEQ ID NO: 1764684 - RNA, 20 nt, Salmonella enterica enterica serovar Typhi Ty2
gcaucgauuccccaccagga

SEQ ID NO: 1764685 - RNA, 23 nt, Salmonella enterica enterica serovar Typhi Ty2
gcaucgauuuuucaucuucagua

SEQ ID NO: 1764686 - RNA, 22 nt, Salmonella enterica enterica serovar Typhi Ty2
gcaucguuugcaguuccgcaau

SEQ ID NO: 1764687 - RNA, 15 nt, Salmonella enterica enterica serovar Typhi Ty2
gcaucgugagcgcgu

SEQ ID NO: 1764688 - RNA, 12 nt, Salmonella enterica enterica serovar Typhi Ty2
gcaucgccgccc

SEQ ID NO: 1764689 - RNA, 14 nt, Salmonella enterica enterica serovar Typhi Ty2
gcaucgugagcgcg

SEQ ID NO: 1764690 - RNA, 21 nt, Salmonella enterica enterica serovar Typhi Ty2
gcaucaaacuuuuaaauugaa

SEQ ID NO: 1764691 - RNA, 15 nt, Salmonella enterica enterica serovar Typhi Ty2
gcaucaacguaaaua

SEQ ID NO: 1764692 - RNA, 14 nt, Salmonella enterica enterica serovar Typhi Ty2
gcaucauccccacc

SEQ ID NO: 1764693 - RNA, 23 nt, Salmonella enterica enterica serovar Typhi Ty2
gcaucauauaaccacgaaaauua

SEQ ID NO: 1764694 - RNA, 16 nt, Salmonella enterica enterica serovar Typhi Ty2
gcauaugcacagcgcu

SEQ ID NO: 1764695 - RNA, 15 nt, Salmonella enterica enterica serovar Typhi Ty2
gcauauuucuaauga

SEQ ID NO: 1764696 - RNA, 18 nt, Salmonella enterica enterica serovar Typhi Ty2
gcaucaaacuucguuacu

SEQ ID NO: 1764697 - RNA, 13 nt, Salmonella enterica enterica serovar Typhi Ty2
gcaucaaacuuuu

SEQ ID NO: 1764698 - RNA, 16 nt, Salmonella enterica enterica serovar Typhi Ty2
gcaucaaacuuuuaaa

SEQ ID NO: 1764699 - RNA, 13 nt, Salmonella enterica enterica serovar Typhi Ty2
gcaucaaauaccu

SEQ ID NO: 1764700 - RNA, 13 nt, Salmonella enterica enterica serovar Typhi Ty2
gcauaucgcccug

SEQ ID NO: 1764701 - RNA, 18 nt, Salmonella enterica enterica serovar Typhi Ty2
gcauagcgccuucaggca

SEQ ID NO: 1764702 - RNA, 20 nt, Salmonella enterica enterica serovar Typhi Ty2
gcauagcgcgaaugauuuua

SEQ ID NO: 1764703 - RNA, 21 nt, Salmonella enterica enterica serovar Typhi Ty2
gcauagauaacgaugugacug

SEQ ID NO: 1764704 - RNA, 16 nt, Salmonella enterica enterica serovar Typhi Ty2
gcauagacgugcggca

SEQ ID NO: 1764705 - RNA, 19 nt, Salmonella enterica enterica serovar Typhi Ty2
gcauaaugacguccaggcc

SEQ ID NO: 1764706 - RNA, 17 nt, Salmonella enterica enterica serovar Typhi Ty2
gcauaauauccaggagc

SEQ ID NO: 1764707 - RNA, 10 nt, Salmonella enterica enterica serovar Typhi Ty2
gcauaauaug

SEQ ID NO: 1764708 - RNA, 16 nt, Salmonella enterica enterica serovar Typhi Ty2
gcauaauaugcaacac

SEQ ID NO: 1764709 - RNA, 12 nt, Salmonella enterica enterica serovar Typhi Ty2
gcauaagccuca

SEQ ID NO: 1764710 - RNA, 13 nt, Salmonella enterica enterica serovar Typhi Ty2
gcauaacguacca

SEQ ID NO: 1764711 - RNA, 15 nt, Salmonella enterica enterica serovar Typhi Ty2
gcauggagcaucagc

SEQ ID NO: 1764712 - RNA, 20 nt, Salmonella enterica enterica serovar Typhi Ty2
gcauggaugcaugagcacgc

SEQ ID NO: 1764713 - RNA, 23 nt, Salmonella enterica enterica serovar Typhi Ty2
gcauggcagauaaaccacgccgu

SEQ ID NO: 1764714 - RNA, 14 nt, Salmonella enterica enterica serovar Typhi Ty2
gcauguaguaagcc

SEQ ID NO: 1764715 - RNA, 14 nt, Salmonella enterica enterica serovar Typhi Ty2
gcaugguccggugc

SEQ ID NO: 1764716 - RNA, 13 nt, Salmonella enterica enterica serovar Typhi Ty2
gcauuaauuucuu

SEQ ID NO: 1764717 - RNA, 14 nt, Salmonella enterica enterica serovar Typhi Ty2
gcauuaagcugaua

SEQ ID NO: 1764718 - RNA, 17 nt, Salmonella enterica enterica serovar Typhi Ty2
gcauuaacguccauacc

SEQ ID NO: 1764719 - RNA, 14 nt, Salmonella enterica enterica serovar Typhi Ty2
gcaucuuuaaccgc

SEQ ID NO: 1764720 - RNA, 13 nt, Salmonella enterica enterica serovar Typhi Ty2
gcaucuucagaca

SEQ ID NO: 1764721 - RNA, 17 nt, Salmonella enterica enterica serovar Typhi Ty2
gcaucuuacugaccggc

SEQ ID NO: 1764722 - RNA, 19 nt, Salmonella enterica enterica serovar Typhi Ty2
gcaucugggcugagaaaaa

SEQ ID NO: 1764723 - RNA, 16 nt, Salmonella enterica enterica serovar Typhi Ty2
gcaugcaucucuucaa

SEQ ID NO: 1764724 - RNA, 18 nt, Salmonella enterica enterica serovar Typhi Ty2
gcaugauguccagcgcgc

SEQ ID NO: 1764725 - RNA, 13 nt, Salmonella enterica enterica serovar Typhi Ty2
gcaucuuuguucu

SEQ ID NO: 1764726 - RNA, 18 nt, Salmonella enterica enterica serovar Typhi Ty2
gcaucuuccucugugccg

SEQ ID NO: 1764727 - RNA, 15 nt, Salmonella enterica enterica serovar Typhi Ty2
gcaucuuuccggaac

SEQ ID NO: 1764728 - RNA, 15 nt, Salmonella enterica enterica serovar Typhi Ty2
gcaugaucggcuggg

SEQ ID NO: 1764729 - RNA, 17 nt, Salmonella enterica enterica serovar Typhi Ty2
gcauucgaauccuccug

SEQ ID NO: 1764730 - RNA, 16 nt, Salmonella enterica enterica serovar Typhi Ty2
gcauuccccaucgcga

SEQ ID NO: 1764731 - RNA, 14 nt, Salmonella enterica enterica serovar Typhi Ty2
gcauuacgcuggcc

SEQ ID NO: 1764732 - RNA, 13 nt, Salmonella enterica enterica serovar Typhi Ty2
gcauuacauucau

SEQ ID NO: 1764733 - RNA, 19 nt, Salmonella enterica enterica serovar Typhi Ty2
gcauuacgcuggccccuuu

SEQ ID NO: 1764734 - RNA, 22 nt, Salmonella enterica enterica serovar Typhi Ty2
gcauuugcgucguuaacugcau

SEQ ID NO: 1764735 - RNA, 12 nt, Salmonella enterica enterica serovar Typhi Ty2
gcauuucuucaa

SEQ ID NO: 1764736 - RNA, 16 nt, Salmonella enterica enterica serovar Typhi Ty2
gcauuucaaucgccac

SEQ ID NO: 1764737 - RNA, 14 nt, Salmonella enterica enterica serovar Typhi Ty2
gcauuuaggucuug

SEQ ID NO: 1764738 - RNA, 20 nt, Salmonella enterica enterica serovar Typhi Ty2
gccaaagaaacgcugaucua

SEQ ID NO: 1764739 - RNA, 22 nt, Salmonella enterica enterica serovar Typhi Ty2
gccaaacuggcaaauaaaauag

SEQ ID NO: 1764740 - RNA, 13 nt, Salmonella enterica enterica serovar Typhi Ty2
gccaaagauuagc

SEQ ID NO: 1764741 - RNA, 17 nt, Salmonella enterica enterica serovar Typhi Ty2
gcauuuucuuauuuauu

SEQ ID NO: 1764742 - RNA, 17 nt, Salmonella enterica enterica serovar Typhi Ty2
gccaaacuccaccugau

SEQ ID NO: 1764743 - RNA, 16 nt, Salmonella enterica enterica serovar Typhi Ty2
gcauuuucaaugucgc

SEQ ID NO: 1764744 - RNA, 19 nt, Salmonella enterica enterica serovar Typhi Ty2
gccagcgcguuuuccauuu

SEQ ID NO: 1764745 - RNA, 19 nt, Salmonella enterica enterica serovar Typhi Ty2
gccagcggcugcuccccca

SEQ ID NO: 1764746 - RNA, 13 nt, Salmonella enterica enterica serovar Typhi Ty2
gccagcggcggcu

SEQ ID NO: 1764747 - RNA, 16 nt, Salmonella enterica enterica serovar Typhi Ty2
gccagcggccagccau

SEQ ID NO: 1764748 - RNA, 18 nt, Salmonella enterica enterica serovar Typhi Ty2
gccagcgcugagaugacc

SEQ ID NO: 1764749 - RNA, 18 nt, Salmonella enterica enterica serovar Typhi Ty2
gccagcggaucgcgucca

SEQ ID NO: 1764750 - RNA, 20 nt, Salmonella enterica enterica serovar Typhi Ty2
gccagcuacgacaagcuguu

SEQ ID NO: 1764751 - RNA, 23 nt, Salmonella enterica enterica serovar Typhi Ty2
gccagcucaugcaagacaucuaa

SEQ ID NO: 1764752 - RNA, 18 nt, Salmonella enterica enterica serovar Typhi Ty2
gccagcucaugcgcggcg

SEQ ID NO: 1764753 - RNA, 16 nt, Salmonella enterica enterica serovar Typhi Ty2
gccagcuaauuuuacu

SEQ ID NO: 1764754 - RNA, 18 nt, Salmonella enterica enterica serovar Typhi Ty2
gccagcuaccgcucaggc

SEQ ID NO: 1764755 - RNA, 18 nt, Salmonella enterica enterica serovar Typhi Ty2
gccagcuacaccugggcu

SEQ ID NO: 1764756 - RNA, 20 nt, Salmonella enterica enterica serovar Typhi Ty2
gccagcuacaccugggcuug

SEQ ID NO: 1764757 - RNA, 13 nt, Salmonella enterica enterica serovar Typhi Ty2
gccagcgggcgca

SEQ ID NO: 1764758 - RNA, 15 nt, Salmonella enterica enterica serovar Typhi Ty2
gccagcgggcgcagu

SEQ ID NO: 1764759 - RNA, 22 nt, Salmonella enterica enterica serovar Typhi Ty2
gccagcggucgcggagaucauc

SEQ ID NO: 1764760 - RNA, 13 nt, Salmonella enterica enterica serovar Typhi Ty2
gccagcguauuuu

SEQ ID NO: 1764761 - RNA, 18 nt, Salmonella enterica enterica serovar Typhi Ty2
gccagcgucucagcaggc

SEQ ID NO: 1764762 - RNA, 17 nt, Salmonella enterica enterica serovar Typhi Ty2
gccagcgugcgcagcgc

SEQ ID NO: 1764763 - RNA, 18 nt, Salmonella enterica enterica serovar Typhi Ty2
gccagcgugacccagaca

SEQ ID NO: 1764764 - RNA, 17 nt, Salmonella enterica enterica serovar Typhi Ty2
gccaggaucgccgccgc

SEQ ID NO: 1764765 - RNA, 16 nt, Salmonella enterica enterica serovar Typhi Ty2
gccaggaucgccgccg

SEQ ID NO: 1764766 - RNA, 15 nt, Salmonella enterica enterica serovar Typhi Ty2
gccaggauaauaaug

SEQ ID NO: 1764767 - RNA, 16 nt, Salmonella enterica enterica serovar Typhi Ty2
gccaggcaaucagcag

SEQ ID NO: 1764768 - RNA, 16 nt, Salmonella enterica enterica serovar Typhi Ty2
gccaggccauugcuga

SEQ ID NO: 1764769 - RNA, 19 nt, Salmonella enterica enterica serovar Typhi Ty2
gccaggccauugcugagga

SEQ ID NO: 1764770 - RNA, 19 nt, Salmonella enterica enterica serovar Typhi Ty2
gccaggccagauggcuuua

SEQ ID NO: 1764771 - RNA, 22 nt, Salmonella enterica enterica serovar Typhi Ty2
gccaggccguugugucccugga

SEQ ID NO: 1764772 - RNA, 18 nt, Salmonella enterica enterica serovar Typhi Ty2
gccagcuuucggcgagcu

SEQ ID NO: 1764773 - RNA, 15 nt, Salmonella enterica enterica serovar Typhi Ty2
gccaggaacgagcug

SEQ ID NO: 1764774 - RNA, 22 nt, Salmonella enterica enterica serovar Typhi Ty2
gccaggaaccgccgaugcacaa

SEQ ID NO: 1764775 - RNA, 16 nt, Salmonella enterica enterica serovar Typhi Ty2
gccagcuuaaaucgcg

SEQ ID NO: 1764776 - RNA, 20 nt, Salmonella enterica enterica serovar Typhi Ty2
gccagcuuaaaucgcggcgc

SEQ ID NO: 1764777 - RNA, 15 nt, Salmonella enterica enterica serovar Typhi Ty2
gccagcagcucgccg

SEQ ID NO: 1764778 - RNA, 14 nt, Salmonella enterica enterica serovar Typhi Ty2
gccagcagcauaaa

SEQ ID NO: 1764779 - RNA, 20 nt, Salmonella enterica enterica serovar Typhi Ty2
gccagcagcauaaaaccgcc

SEQ ID NO: 1764780 - RNA, 22 nt, Salmonella enterica enterica serovar Typhi Ty2
gccagcauuucaaucgcgcccg

SEQ ID NO: 1764781 - RNA, 13 nt, Salmonella enterica enterica serovar Typhi Ty2
gccagccauuaaa

SEQ ID NO: 1764782 - RNA, 20 nt, Salmonella enterica enterica serovar Typhi Ty2
gccagccauugaugcaggcg

SEQ ID NO: 1764783 - RNA, 16 nt, Salmonella enterica enterica serovar Typhi Ty2
gccagccauucaccac

SEQ ID NO: 1764784 - RNA, 17 nt, Salmonella enterica enterica serovar Typhi Ty2
gccagccauucaccacu

SEQ ID NO: 1764785 - RNA, 13 nt, Salmonella enterica enterica serovar Typhi Ty2
gccagcauauaaa

SEQ ID NO: 1764786 - RNA, 16 nt, Salmonella enterica enterica serovar Typhi Ty2
gccagcauaccgccca

SEQ ID NO: 1764787 - RNA, 21 nt, Salmonella enterica enterica serovar Typhi Ty2
gccagcaucaugggcucauca

SEQ ID NO: 1764788 - RNA, 15 nt, Salmonella enterica enterica serovar Typhi Ty2
gccagcauacagcuu

SEQ ID NO: 1764789 - RNA, 20 nt, Salmonella enterica enterica serovar Typhi Ty2
gccagcaguuuuucaaucuu

SEQ ID NO: 1764790 - RNA, 16 nt, Salmonella enterica enterica serovar Typhi Ty2
gccagcaugguuaaaa

SEQ ID NO: 1764791 - RNA, 18 nt, Salmonella enterica enterica serovar Typhi Ty2
gccagcauuuccagcugg

SEQ ID NO: 1764792 - RNA, 16 nt, Salmonella enterica enterica serovar Typhi Ty2
gccagcauuuuuccac

SEQ ID NO: 1764793 - RNA, 23 nt, Salmonella enterica enterica serovar Typhi Ty2
gccagcgccaccaaagccaggcc

SEQ ID NO: 1764794 - RNA, 19 nt, Salmonella enterica enterica serovar Typhi Ty2
gccagcgauggggcaagcu

SEQ ID NO: 1764795 - RNA, 22 nt, Salmonella enterica enterica serovar Typhi Ty2
gccagcgauccugcggcauuag

SEQ ID NO: 1764796 - RNA, 15 nt, Salmonella enterica enterica serovar Typhi Ty2
gccagcgaaguaauc

SEQ ID NO: 1764797 - RNA, 19 nt, Salmonella enterica enterica serovar Typhi Ty2
gccagcgacaacgcuuccg

SEQ ID NO: 1764798 - RNA, 17 nt, Salmonella enterica enterica serovar Typhi Ty2
gccagcgacaucccaga

SEQ ID NO: 1764799 - RNA, 16 nt, Salmonella enterica enterica serovar Typhi Ty2
gccagcgccgccgcuu

SEQ ID NO: 1764800 - RNA, 13 nt, Salmonella enterica enterica serovar Typhi Ty2
gccagcgccgccg

SEQ ID NO: 1764801 - RNA, 18 nt, Salmonella enterica enterica serovar Typhi Ty2
gccagcgccguuguccgu

SEQ ID NO: 1764802 - RNA, 14 nt, Salmonella enterica enterica serovar Typhi Ty2
gccagcgccuuagg

SEQ ID NO: 1764803 - RNA, 18 nt, Salmonella enterica enterica serovar Typhi Ty2
gccagccgccaaaaauau

SEQ ID NO: 1764804 - RNA, 13 nt, Salmonella enterica enterica serovar Typhi Ty2
gccagccgccgcc

SEQ ID NO: 1764805 - RNA, 22 nt, Salmonella enterica enterica serovar Typhi Ty2
gccagccgacgcucuuccucaa

SEQ ID NO: 1764806 - RNA, 22 nt, Salmonella enterica enterica serovar Typhi Ty2
gccagcccgaucaucuccugua

SEQ ID NO: 1764807 - RNA, 20 nt, Salmonella enterica enterica serovar Typhi Ty2
gccagcccgaucaucuccug

SEQ ID NO: 1764808 - RNA, 13 nt, Salmonella enterica enterica serovar Typhi Ty2
gccacaucgccag

SEQ ID NO: 1764809 - RNA, 12 nt, Salmonella enterica enterica serovar Typhi Ty2
gccaccaaaaac

SEQ ID NO: 1764810 - RNA, 19 nt, Salmonella enterica enterica serovar Typhi Ty2
gccacauuguaugcaagaa

SEQ ID NO: 1764811 - RNA, 22 nt, Salmonella enterica enterica serovar Typhi Ty2
gccacauuucccgagccggguu

SEQ ID NO: 1764812 - RNA, 16 nt, Salmonella enterica enterica serovar Typhi Ty2
gccacaugcggcaggc

SEQ ID NO: 1764813 - RNA, 22 nt, Salmonella enterica enterica serovar Typhi Ty2
gccacaugauguuguucgucuu

SEQ ID NO: 1764814 - RNA, 19 nt, Salmonella enterica enterica serovar Typhi Ty2
gccaccacaaacgccguca

SEQ ID NO: 1764815 - RNA, 13 nt, Salmonella enterica enterica serovar Typhi Ty2
gccaccacaaagc

SEQ ID NO: 1764816 - RNA, 14 nt, Salmonella enterica enterica serovar Typhi Ty2
gccaccacaaagcg

SEQ ID NO: 1764817 - RNA, 17 nt, Salmonella enterica enterica serovar Typhi Ty2
gccaccacgccgagaaa

SEQ ID NO: 1764818 - RNA, 13 nt, Salmonella enterica enterica serovar Typhi Ty2
gccaccacucggc

SEQ ID NO: 1764819 - RNA, 16 nt, Salmonella enterica enterica serovar Typhi Ty2
gccaccagaucuucaa

SEQ ID NO: 1764820 - RNA, 18 nt, Salmonella enterica enterica serovar Typhi Ty2
gccacaccacaugcgagc

SEQ ID NO: 1764821 - RNA, 13 nt, Salmonella enterica enterica serovar Typhi Ty2
gccacaauauccg

SEQ ID NO: 1764822 - RNA, 18 nt, Salmonella enterica enterica serovar Typhi Ty2
gccacaauugccagcagg

SEQ ID NO: 1764823 - RNA, 14 nt, Salmonella enterica enterica serovar Typhi Ty2
gccacaacgccuga

SEQ ID NO: 1764824 - RNA, 20 nt, Salmonella enterica enterica serovar Typhi Ty2
gccaaauacgucgcacggau

SEQ ID NO: 1764825 - RNA, 18 nt, Salmonella enterica enterica serovar Typhi Ty2
gccaaagucauugcugcc

SEQ ID NO: 1764826 - RNA, 12 nt, Salmonella enterica enterica serovar Typhi Ty2
gccaaagggagc

SEQ ID NO: 1764827 - RNA, 14 nt, Salmonella enterica enterica serovar Typhi Ty2
gccacgccgccauc

SEQ ID NO: 1764828 - RNA, 18 nt, Salmonella enterica enterica serovar Typhi Ty2
gccacgccgccauccggc

SEQ ID NO: 1764829 - RNA, 12 nt, Salmonella enterica enterica serovar Typhi Ty2
gccacgccgccc

SEQ ID NO: 1764830 - RNA, 13 nt, Salmonella enterica enterica serovar Typhi Ty2
gccacgccgccau

SEQ ID NO: 1764831 - RNA, 21 nt, Salmonella enterica enterica serovar Typhi Ty2
gccacgccaucggcuaagcca

SEQ ID NO: 1764832 - RNA, 16 nt, Salmonella enterica enterica serovar Typhi Ty2
gccacgccgcuccaca

SEQ ID NO: 1764833 - RNA, 22 nt, Salmonella enterica enterica serovar Typhi Ty2
gccacgcgaugcaaccccugac

SEQ ID NO: 1764834 - RNA, 22 nt, Salmonella enterica enterica serovar Typhi Ty2
gccaccugcacggcgucauuca

SEQ ID NO: 1764835 - RNA, 23 nt, Salmonella enterica enterica serovar Typhi Ty2
gccaccugcacggcgucauucac

SEQ ID NO: 1764836 - RNA, 15 nt, Salmonella enterica enterica serovar Typhi Ty2
gccaccagcacagcc

SEQ ID NO: 1764837 - RNA, 17 nt, Salmonella enterica enterica serovar Typhi Ty2
gccaccaucgucgccag

SEQ ID NO: 1764838 - RNA, 21 nt, Salmonella enterica enterica serovar Typhi Ty2
gccagauaaucgccgccagcu

SEQ ID NO: 1764839 - RNA, 16 nt, Salmonella enterica enterica serovar Typhi Ty2
gccagagcgcgcuggc

SEQ ID NO: 1764840 - RNA, 14 nt, Salmonella enterica enterica serovar Typhi Ty2
gccagaggcgugca

SEQ ID NO: 1764841 - RNA, 18 nt, Salmonella enterica enterica serovar Typhi Ty2
gccagauggauaaccugc

SEQ ID NO: 1764842 - RNA, 15 nt, Salmonella enterica enterica serovar Typhi Ty2
gccagaugcagcggc

SEQ ID NO: 1764843 - RNA, 19 nt, Salmonella enterica enterica serovar Typhi Ty2
gccagauggauaaccugcc

SEQ ID NO: 1764844 - RNA, 19 nt, Salmonella enterica enterica serovar Typhi Ty2
gccagaugguaagcauagc

SEQ ID NO: 1764845 - RNA, 21 nt, Salmonella enterica enterica serovar Typhi Ty2
gccagauggauaaccugccgg

SEQ ID NO: 1764846 - RNA, 17 nt, Salmonella enterica enterica serovar Typhi Ty2
gccagcaccugauagug

SEQ ID NO: 1764847 - RNA, 15 nt, Salmonella enterica enterica serovar Typhi Ty2
gccagcaccagcagu

SEQ ID NO: 1764848 - RNA, 17 nt, Salmonella enterica enterica serovar Typhi Ty2
gccagcagagcgaacag

SEQ ID NO: 1764849 - RNA, 17 nt, Salmonella enterica enterica serovar Typhi Ty2
gccagcaauacccagaa

SEQ ID NO: 1764850 - RNA, 16 nt, Salmonella enterica enterica serovar Typhi Ty2
gccagcaaugccgccg

SEQ ID NO: 1764851 - RNA, 16 nt, Salmonella enterica enterica serovar Typhi Ty2
gccagcaacccaccug

SEQ ID NO: 1764852 - RNA, 20 nt, Salmonella enterica enterica serovar Typhi Ty2
gccagcaacguuaaggccgc

SEQ ID NO: 1764853 - RNA, 19 nt, Salmonella enterica enterica serovar Typhi Ty2
gccagcaccagcagcgcau

SEQ ID NO: 1764854 - RNA, 14 nt, Salmonella enterica enterica serovar Typhi Ty2
gccagcaccacuac

SEQ ID NO: 1764855 - RNA, 19 nt, Salmonella enterica enterica serovar Typhi Ty2
gccagcaaugccgccgcca

SEQ ID NO: 1764856 - RNA, 18 nt, Salmonella enterica enterica serovar Typhi Ty2
gccacuucuuccagcggc

SEQ ID NO: 1764857 - RNA, 13 nt, Salmonella enterica enterica serovar Typhi Ty2
gccacgcgcguca

SEQ ID NO: 1764858 - RNA, 14 nt, Salmonella enterica enterica serovar Typhi Ty2
gccacgcgccagcc

SEQ ID NO: 1764859 - RNA, 17 nt, Salmonella enterica enterica serovar Typhi Ty2
gccacgcucgcuggugc

SEQ ID NO: 1764860 - RNA, 22 nt, Salmonella enterica enterica serovar Typhi Ty2
gccagaagagaauggccagcac

SEQ ID NO: 1764861 - RNA, 18 nt, Salmonella enterica enterica serovar Typhi Ty2
gccagaaaaaaaagcgcc

SEQ ID NO: 1764862 - RNA, 16 nt, Salmonella enterica enterica serovar Typhi Ty2
gccacuugaaguauga

SEQ ID NO: 1764863 - RNA, 22 nt, Salmonella enterica enterica serovar Typhi Ty2
gccagacagcauuuuucacagu

SEQ ID NO: 1764864 - RNA, 13 nt, Salmonella enterica enterica serovar Typhi Ty2
gccagacccgcgc

SEQ ID NO: 1764865 - RNA, 16 nt, Salmonella enterica enterica serovar Typhi Ty2
gccagaccaauagaga

SEQ ID NO: 1764866 - RNA, 17 nt, Salmonella enterica enterica serovar Typhi Ty2
gccagaaucaccucuuu

SEQ ID NO: 1764867 - RNA, 14 nt, Salmonella enterica enterica serovar Typhi Ty2
gccagagagcguuu

SEQ ID NO: 1764868 - RNA, 13 nt, Salmonella enterica enterica serovar Typhi Ty2
gccagagcgcgcu

SEQ ID NO: 1764869 - RNA, 20 nt, Salmonella enterica enterica serovar Typhi Ty2
gccagacggcgcccagccug

SEQ ID NO: 1764870 - RNA, 18 nt, Salmonella enterica enterica serovar Typhi Ty2
gccagaccgcuuaacucc

SEQ ID NO: 1764871 - RNA, 16 nt, Salmonella enterica enterica serovar Typhi Ty2
gccagaccgaaaagcc

SEQ ID NO: 1764872 - RNA, 16 nt, Salmonella enterica enterica serovar Typhi Ty2
gccagacgccagccac

SEQ ID NO: 1764873 - RNA, 11 nt, Salmonella enterica enterica serovar Typhi Ty2
gccgccgggca

SEQ ID NO: 1764874 - RNA, 24 nt, Salmonella enterica enterica serovar Typhi Ty2
gccgcgauacauugucgcagcgcu

SEQ ID NO: 1764875 - RNA, 22 nt, Salmonella enterica enterica serovar Typhi Ty2
gccgcgaacguucaaaaucaaa

SEQ ID NO: 1764876 - RNA, 13 nt, Salmonella enterica enterica serovar Typhi Ty2
gccgccuggccug

SEQ ID NO: 1764877 - RNA, 20 nt, Salmonella enterica enterica serovar Typhi Ty2
gccgcgauguuugcucgcca

SEQ ID NO: 1764878 - RNA, 16 nt, Salmonella enterica enterica serovar Typhi Ty2
gccgccgcaggacagc

SEQ ID NO: 1764879 - RNA, 20 nt, Salmonella enterica enterica serovar Typhi Ty2
aaagcugcaccaggagcaaa

SEQ ID NO: 1764880 - RNA, 19 nt, Salmonella enterica enterica serovar Typhi Ty2
gccgccgcaacgcgcacgg

SEQ ID NO: 1764881 - RNA, 17 nt, Salmonella enterica enterica serovar Typhi Ty2
aaagcugcgaucaaguu

SEQ ID NO: 1764882 - RNA, 20 nt, Salmonella enterica enterica serovar Typhi Ty2
gccgccagauuauccagucc

SEQ ID NO: 1764883 - RNA, 15 nt, Salmonella enterica enterica serovar Typhi Ty2
gccgcccgccugagc

SEQ ID NO: 1764884 - RNA, 21 nt, Salmonella enterica enterica serovar Typhi Ty2
gccgcgggaaauaccaaauau

SEQ ID NO: 1764885 - RNA, 19 nt, Salmonella enterica enterica serovar Typhi Ty2
gccgcgcuuucaguaauaa

SEQ ID NO: 1764886 - RNA, 15 nt, Salmonella enterica enterica serovar Typhi Ty2
gccgcggucgagcau

SEQ ID NO: 1764887 - RNA, 16 nt, Salmonella enterica enterica serovar Typhi Ty2
gccgcgugcucgcggc

SEQ ID NO: 1764888 - RNA, 16 nt, Salmonella enterica enterica serovar Typhi Ty2
gccgcguuuugccgcu

SEQ ID NO: 1764889 - RNA, 21 nt, Salmonella enterica enterica serovar Typhi Ty2
gccgcuaucgaccagcaccug

SEQ ID NO: 1764890 - RNA, 19 nt, Salmonella enterica enterica serovar Typhi Ty2
gccgcuaugcaauuguucc

SEQ ID NO: 1764891 - RNA, 15 nt, Salmonella enterica enterica serovar Typhi Ty2
gccgcuaucugcucc

SEQ ID NO: 1764892 - RNA, 18 nt, Salmonella enterica enterica serovar Typhi Ty2
gccgcuagcugcagcgcu

SEQ ID NO: 1764893 - RNA, 14 nt, Salmonella enterica enterica serovar Typhi Ty2
gccgcucccgcaug

SEQ ID NO: 1764894 - RNA, 14 nt, Salmonella enterica enterica serovar Typhi Ty2
gccgcuccagggau

SEQ ID NO: 1764895 - RNA, 14 nt, Salmonella enterica enterica serovar Typhi Ty2
gccgcucacaaccg

SEQ ID NO: 1764896 - RNA, 23 nt, Salmonella enterica enterica serovar Typhi Ty2
gccgcuccggguuuucaauaauc

SEQ ID NO: 1764897 - RNA, 16 nt, Salmonella enterica enterica serovar Typhi Ty2
gccgcucccgcaugga

SEQ ID NO: 1764898 - RNA, 16 nt, Salmonella enterica enterica serovar Typhi Ty2
gccgcugauauucacc

SEQ ID NO: 1764899 - RNA, 13 nt, Salmonella enterica enterica serovar Typhi Ty2
gccgcuggcuggc

SEQ ID NO: 1764900 - RNA, 17 nt, Salmonella enterica enterica serovar Typhi Ty2
gccgcuggcgaccagcc

SEQ ID NO: 1764901 - RNA, 22 nt, Salmonella enterica enterica serovar Typhi Ty2
gccgcuggauaauugcucugcc

SEQ ID NO: 1764902 - RNA, 15 nt, Salmonella enterica enterica serovar Typhi Ty2
gccgcuggcgaugga

SEQ ID NO: 1764903 - RNA, 17 nt, Salmonella enterica enterica serovar Typhi Ty2
gccgcugucgccagaau

SEQ ID NO: 1764904 - RNA, 19 nt, Salmonella enterica enterica serovar Typhi Ty2
gccgacaccggccugccua

SEQ ID NO: 1764905 - RNA, 14 nt, Salmonella enterica enterica serovar Typhi Ty2
gccgacaaccagcg

SEQ ID NO: 1764906 - RNA, 16 nt, Salmonella enterica enterica serovar Typhi Ty2
gccgaauggcgggccu

SEQ ID NO: 1764907 - RNA, 14 nt, Salmonella enterica enterica serovar Typhi Ty2
gccgaccauccaga

SEQ ID NO: 1764908 - RNA, 22 nt, Salmonella enterica enterica serovar Typhi Ty2
gccgaccgccaggucggcuuuu

SEQ ID NO: 1764909 - RNA, 16 nt, Salmonella enterica enterica serovar Typhi Ty2
gccgaccgccagcaga

SEQ ID NO: 1764910 - RNA, 19 nt, Salmonella enterica enterica serovar Typhi Ty2
gccgacguuaucgccgaca

SEQ ID NO: 1764911 - RNA, 22 nt, Salmonella enterica enterica serovar Typhi Ty2
gccgacuuuacggccuagcugc

SEQ ID NO: 1764912 - RNA, 16 nt, Salmonella enterica enterica serovar Typhi Ty2
gccgaccgugauuuuu

SEQ ID NO: 1764913 - RNA, 20 nt, Salmonella enterica enterica serovar Typhi Ty2
gcccuggguugcccaaaugc

SEQ ID NO: 1764914 - RNA, 16 nt, Salmonella enterica enterica serovar Typhi Ty2
gcccugcuguuccagu

SEQ ID NO: 1764915 - RNA, 16 nt, Salmonella enterica enterica serovar Typhi Ty2
gcccugcucccacagc

SEQ ID NO: 1764916 - RNA, 19 nt, Salmonella enterica enterica serovar Typhi Ty2
gcccugcggaaccgcccau

SEQ ID NO: 1764917 - RNA, 17 nt, Salmonella enterica enterica serovar Typhi Ty2
gcccugcggacaggcga

SEQ ID NO: 1764918 - RNA, 20 nt, Salmonella enterica enterica serovar Typhi Ty2
gcccugcgccagcauggcgu

SEQ ID NO: 1764919 - RNA, 17 nt, Salmonella enterica enterica serovar Typhi Ty2
gcccugcgccucaagcg

SEQ ID NO: 1764920 - RNA, 18 nt, Salmonella enterica enterica serovar Typhi Ty2
gcccugccggaaaaugcg

SEQ ID NO: 1764921 - RNA, 22 nt, Salmonella enterica enterica serovar Typhi Ty2
gcccuggugagcuccagcccgc

SEQ ID NO: 1764922 - RNA, 21 nt, Salmonella enterica enterica serovar Typhi Ty2
gcccuguaaaggauugccgcc

SEQ ID NO: 1764923 - RNA, 14 nt, Salmonella enterica enterica serovar Typhi Ty2
gcccuguccuccau

SEQ ID NO: 1764924 - RNA, 18 nt, Salmonella enterica enterica serovar Typhi Ty2
gcccugugccgcuggugc

SEQ ID NO: 1764925 - RNA, 13 nt, Salmonella enterica enterica serovar Typhi Ty2
gcccugugccgcu

SEQ ID NO: 1764926 - RNA, 21 nt, Salmonella enterica enterica serovar Typhi Ty2
gccgaacaacacggcggccau

SEQ ID NO: 1764927 - RNA, 18 nt, Salmonella enterica enterica serovar Typhi Ty2
gcccuugccgcuuccagu

SEQ ID NO: 1764928 - RNA, 13 nt, Salmonella enterica enterica serovar Typhi Ty2
gccgcauccggca

SEQ ID NO: 1764929 - RNA, 18 nt, Salmonella enterica enterica serovar Typhi Ty2
gccgcauccuguuuuuuc

SEQ ID NO: 1764930 - RNA, 20 nt, Salmonella enterica enterica serovar Typhi Ty2
gccgaugaaagagcgcgcgc

SEQ ID NO: 1764931 - RNA, 13 nt, Salmonella enterica enterica serovar Typhi Ty2
gccgcaaaagccg

SEQ ID NO: 1764932 - RNA, 14 nt, Salmonella enterica enterica serovar Typhi Ty2
gccgauuuuucggc

SEQ ID NO: 1764933 - RNA, 13 nt, Salmonella enterica enterica serovar Typhi Ty2
gccgaugagcuga

SEQ ID NO: 1764934 - RNA, 13 nt, Salmonella enterica enterica serovar Typhi Ty2
gccgauuucauuc

SEQ ID NO: 1764935 - RNA, 18 nt, Salmonella enterica enterica serovar Typhi Ty2
gccgaugacucccagucc

SEQ ID NO: 1764936 - RNA, 18 nt, Salmonella enterica enterica serovar Typhi Ty2
gccgcaaccgccaauaau

SEQ ID NO: 1764937 - RNA, 22 nt, Salmonella enterica enterica serovar Typhi Ty2
gccgcagaaaauggucugccag

SEQ ID NO: 1764938 - RNA, 16 nt, Salmonella enterica enterica serovar Typhi Ty2
gccgcacuccccagaa

SEQ ID NO: 1764939 - RNA, 15 nt, Salmonella enterica enterica serovar Typhi Ty2
gccgcaaggacgcca

SEQ ID NO: 1764940 - RNA, 18 nt, Salmonella enterica enterica serovar Typhi Ty2
gccgagcauuuccgcagc

SEQ ID NO: 1764941 - RNA, 22 nt, Salmonella enterica enterica serovar Typhi Ty2
gccgagacgcugcacacgcugg

SEQ ID NO: 1764942 - RNA, 16 nt, Salmonella enterica enterica serovar Typhi Ty2
gccgauauugccuuca

SEQ ID NO: 1764943 - RNA, 20 nt, Salmonella enterica enterica serovar Typhi Ty2
gccgauauugcggccuuccu

SEQ ID NO: 1764944 - RNA, 22 nt, Salmonella enterica enterica serovar Typhi Ty2
gccgauauugcggccuuccuga

SEQ ID NO: 1764945 - RNA, 20 nt, Salmonella enterica enterica serovar Typhi Ty2
gccgauaguggucgccacgc

SEQ ID NO: 1764946 - RNA, 23 nt, Salmonella enterica enterica serovar Typhi Ty2
gccauccugccgcaccagucggc

SEQ ID NO: 1764947 - RNA, 22 nt, Salmonella enterica enterica serovar Typhi Ty2
gccaucgacagcgccauauaaa

SEQ ID NO: 1764948 - RNA, 17 nt, Salmonella enterica enterica serovar Typhi Ty2
gccaucuggccuggcga

SEQ ID NO: 1764949 - RNA, 15 nt, Salmonella enterica enterica serovar Typhi Ty2
gccaucuccggcagc

SEQ ID NO: 1764950 - RNA, 23 nt, Salmonella enterica enterica serovar Typhi Ty2
gccaucaggccccccuuguuauc

SEQ ID NO: 1764951 - RNA, 12 nt, Salmonella enterica enterica serovar Typhi Ty2
gccaucaggcag

SEQ ID NO: 1764952 - RNA, 23 nt, Salmonella enterica enterica serovar Typhi Ty2
gccaucaggcaguuuauccggcg

SEQ ID NO: 1764953 - RNA, 14 nt, Salmonella enterica enterica serovar Typhi Ty2
gccaucagcaccuu

SEQ ID NO: 1764954 - RNA, 17 nt, Salmonella enterica enterica serovar Typhi Ty2
gccaucaggcaaugucu

SEQ ID NO: 1764955 - RNA, 18 nt, Salmonella enterica enterica serovar Typhi Ty2
gccauccugaguauaaaa

SEQ ID NO: 1764956 - RNA, 14 nt, Salmonella enterica enterica serovar Typhi Ty2
gccaucaugcccac

SEQ ID NO: 1764957 - RNA, 15 nt, Salmonella enterica enterica serovar Typhi Ty2
gccaucaucaguaac

SEQ ID NO: 1764958 - RNA, 14 nt, Salmonella enterica enterica serovar Typhi Ty2
gccauauacgccac

SEQ ID NO: 1764959 - RNA, 21 nt, Salmonella enterica enterica serovar Typhi Ty2
gccauaucaccgcugacugaa

SEQ ID NO: 1764960 - RNA, 15 nt, Salmonella enterica enterica serovar Typhi Ty2
gccauaucgccgcca

SEQ ID NO: 1764961 - RNA, 20 nt, Salmonella enterica enterica serovar Typhi Ty2
gccauauauuuacugaauaa

SEQ ID NO: 1764962 - RNA, 15 nt, Salmonella enterica enterica serovar Typhi Ty2
gccauauguuccacc

SEQ ID NO: 1764963 - RNA, 21 nt, Salmonella enterica enterica serovar Typhi Ty2
gccauauggcauucgcagagg

SEQ ID NO: 1764964 - RNA, 20 nt, Salmonella enterica enterica serovar Typhi Ty2
gccauauuaugcuggccugc

SEQ ID NO: 1764965 - RNA, 18 nt, Salmonella enterica enterica serovar Typhi Ty2
gccauauuuaccuuuucc

SEQ ID NO: 1764966 - RNA, 20 nt, Salmonella enterica enterica serovar Typhi Ty2
gccauauuguucaguuucaa

SEQ ID NO: 1764967 - RNA, 19 nt, Salmonella enterica enterica serovar Typhi Ty2
gccauauuuuuucaggaag

SEQ ID NO: 1764968 - RNA, 13 nt, Salmonella enterica enterica serovar Typhi Ty2
gccaggcgccacg

SEQ ID NO: 1764969 - RNA, 16 nt, Salmonella enterica enterica serovar Typhi Ty2
gcccaaauaguccagc

SEQ ID NO: 1764970 - RNA, 20 nt, Salmonella enterica enterica serovar Typhi Ty2
gcccaaauaguccagcagcc

SEQ ID NO: 1764971 - RNA, 20 nt, Salmonella enterica enterica serovar Typhi Ty2
gccauuucaauaauauguuc

SEQ ID NO: 1764972 - RNA, 21 nt, Salmonella enterica enterica serovar Typhi Ty2
gccauugccaggacugacgga

SEQ ID NO: 1764973 - RNA, 21 nt, Salmonella enterica enterica serovar Typhi Ty2
gccauugcuaggaacagugac

SEQ ID NO: 1764974 - RNA, 15 nt, Salmonella enterica enterica serovar Typhi Ty2
gccauuggcaaucag

SEQ ID NO: 1764975 - RNA, 22 nt, Salmonella enterica enterica serovar Typhi Ty2
gccauuggcuauuuuuugcugg

SEQ ID NO: 1764976 - RNA, 20 nt, Salmonella enterica enterica serovar Typhi Ty2
gcccaaugcuuagucagccu

SEQ ID NO: 1764977 - RNA, 14 nt, Salmonella enterica enterica serovar Typhi Ty2
gcccaaugccccca

SEQ ID NO: 1764978 - RNA, 23 nt, Salmonella enterica enterica serovar Typhi Ty2
gcccaacgcggcuuuaaguuuuu

SEQ ID NO: 1764979 - RNA, 19 nt, Salmonella enterica enterica serovar Typhi Ty2
gccaucuuuacccugagcc

SEQ ID NO: 1764980 - RNA, 15 nt, Salmonella enterica enterica serovar Typhi Ty2
gccaucuuccucaca

SEQ ID NO: 1764981 - RNA, 13 nt, Salmonella enterica enterica serovar Typhi Ty2
gccaucuuccuca

SEQ ID NO: 1764982 - RNA, 14 nt, Salmonella enterica enterica serovar Typhi Ty2
gccaugaaaaaaac

SEQ ID NO: 1764983 - RNA, 18 nt, Salmonella enterica enterica serovar Typhi Ty2
gccaucuuuacccugagc

SEQ ID NO: 1764984 - RNA, 16 nt, Salmonella enterica enterica serovar Typhi Ty2
gccauuaugcaggccg

SEQ ID NO: 1764985 - RNA, 15 nt, Salmonella enterica enterica serovar Typhi Ty2
gccauuauucugaau

SEQ ID NO: 1764986 - RNA, 13 nt, Salmonella enterica enterica serovar Typhi Ty2
gccauucaccacu

SEQ ID NO: 1764987 - RNA, 13 nt, Salmonella enterica enterica serovar Typhi Ty2
gccauuaaccaga

SEQ ID NO: 1764988 - RNA, 20 nt, Salmonella enterica enterica serovar Typhi Ty2
gccauguuaauaccagcgcc

SEQ ID NO: 1764989 - RNA, 15 nt, Salmonella enterica enterica serovar Typhi Ty2
gccauguuccucaca

SEQ ID NO: 1764990 - RNA, 20 nt, Salmonella enterica enterica serovar Typhi Ty2
gccauuaaugcaggcagcac

SEQ ID NO: 1764991 - RNA, 19 nt, Salmonella enterica enterica serovar Typhi Ty2
gccauguugcguaaauaaa

SEQ ID NO: 1764992 - RNA, 20 nt, Salmonella enterica enterica serovar Typhi Ty2
gcccaucagcaucccaccgg

SEQ ID NO: 1764993 - RNA, 21 nt, Salmonella enterica enterica serovar Typhi Ty2
gcccagguuagcagccacaca

SEQ ID NO: 1764994 - RNA, 16 nt, Salmonella enterica enterica serovar Typhi Ty2
gcccagguuagcagcc

SEQ ID NO: 1764995 - RNA, 13 nt, Salmonella enterica enterica serovar Typhi Ty2
gcccauaaagaaa

SEQ ID NO: 1764996 - RNA, 15 nt, Salmonella enterica enterica serovar Typhi Ty2
gcccaucgccacagc

SEQ ID NO: 1764997 - RNA, 13 nt, Salmonella enterica enterica serovar Typhi Ty2
gcccauccgucag

SEQ ID NO: 1764998 - RNA, 16 nt, Salmonella enterica enterica serovar Typhi Ty2
gcccaucgcgccauga

SEQ ID NO: 1764999 - RNA, 20 nt, Salmonella enterica enterica serovar Typhi Ty2
gcccaucagcgccagcccug

SEQ ID NO: 1765000 - RNA, 18 nt, Salmonella enterica enterica serovar Typhi Ty2
gcccaucagcgccagccc

SEQ ID NO: 1765001 - RNA, 13 nt, Salmonella enterica enterica serovar Typhi Ty2
gcccagcauuacu

SEQ ID NO: 1765002 - RNA, 20 nt, Salmonella enterica enterica serovar Typhi Ty2
gcccagcuaaaccacggaau

SEQ ID NO: 1765003 - RNA, 12 nt, Salmonella enterica enterica serovar Typhi Ty2
gcccagcuuagu

SEQ ID NO: 1765004 - RNA, 20 nt, Salmonella enterica enterica serovar Typhi Ty2
gcccagguagaaucccacca

SEQ ID NO: 1765005 - RNA, 23 nt, Salmonella enterica enterica serovar Typhi Ty2
gcccaccggagcggcguccgcca

SEQ ID NO: 1765006 - RNA, 18 nt, Salmonella enterica enterica serovar Typhi Ty2
gcccaccgcgcgcgcggc

SEQ ID NO: 1765007 - RNA, 15 nt, Salmonella enterica enterica serovar Typhi Ty2
gcccaccaucagacc

SEQ ID NO: 1765008 - RNA, 14 nt, Salmonella enterica enterica serovar Typhi Ty2
gcccacaggcaggg

SEQ ID NO: 1765009 - RNA, 15 nt, Salmonella enterica enterica serovar Typhi Ty2
gcccacgcccagagc

SEQ ID NO: 1765010 - RNA, 20 nt, Salmonella enterica enterica serovar Typhi Ty2
gcccacgcaaaauggccugc

SEQ ID NO: 1765011 - RNA, 16 nt, Salmonella enterica enterica serovar Typhi Ty2
gcccccggccauagcg

SEQ ID NO: 1765012 - RNA, 16 nt, Salmonella enterica enterica serovar Typhi Ty2
gccccaucagcacaug

SEQ ID NO: 1765013 - RNA, 12 nt, Salmonella enterica enterica serovar Typhi Ty2
gccccaucagca

SEQ ID NO: 1765014 - RNA, 15 nt, Salmonella enterica enterica serovar Typhi Ty2
gcccauugaaaucgc

SEQ ID NO: 1765015 - RNA, 21 nt, Salmonella enterica enterica serovar Typhi Ty2
gcccauucuucgucgucauca

SEQ ID NO: 1765016 - RNA, 16 nt, Salmonella enterica enterica serovar Typhi Ty2
gcccauugccacccau

SEQ ID NO: 1765017 - RNA, 14 nt, Salmonella enterica enterica serovar Typhi Ty2
gcccauuccgccug

SEQ ID NO: 1765018 - RNA, 20 nt, Salmonella enterica enterica serovar Typhi Ty2
gccccgccgcgcggccccau

SEQ ID NO: 1765019 - RNA, 16 nt, Salmonella enterica enterica serovar Typhi Ty2
gcccccugccagcgcu

SEQ ID NO: 1765020 - RNA, 13 nt, Salmonella enterica enterica serovar Typhi Ty2
gcccccucggcag

SEQ ID NO: 1765021 - RNA, 14 nt, Salmonella enterica enterica serovar Typhi Ty2
gccccggcgcgcgc

SEQ ID NO: 1765022 - RNA, 23 nt, Salmonella enterica enterica serovar Typhi Ty2
gccccgggcgaccacccgcgacc

SEQ ID NO: 1765023 - RNA, 16 nt, Salmonella enterica enterica serovar Typhi Ty2
gccccggugagcgccg

SEQ ID NO: 1765024 - RNA, 17 nt, Salmonella enterica enterica serovar Typhi Ty2
gccccggugagcgccgc

SEQ ID NO: 1765025 - RNA, 20 nt, Salmonella enterica enterica serovar Typhi Ty2
gccccggucaacgcgccgcc

SEQ ID NO: 1765026 - RNA, 19 nt, Salmonella enterica enterica serovar Typhi Ty2
gccccuguggaaucagucg

SEQ ID NO: 1765027 - RNA, 18 nt, Salmonella enterica enterica serovar Typhi Ty2
gccccuguuucgcccgcu

SEQ ID NO: 1765028 - RNA, 23 nt, Salmonella enterica enterica serovar Typhi Ty2
gccccgucagucgccagaaggca

SEQ ID NO: 1765029 - RNA, 19 nt, Salmonella enterica enterica serovar Typhi Ty2
gcccgccgcgaccagcagc

SEQ ID NO: 1765030 - RNA, 13 nt, Salmonella enterica enterica serovar Typhi Ty2
gcccgauaaacaa

SEQ ID NO: 1765031 - RNA, 19 nt, Salmonella enterica enterica serovar Typhi Ty2
gcccgauagcguaaagaaa

SEQ ID NO: 1765032 - RNA, 14 nt, Salmonella enterica enterica serovar Typhi Ty2
gcccggccggugcu

SEQ ID NO: 1765033 - RNA, 14 nt, Salmonella enterica enterica serovar Typhi Ty2
gcccggcaaacggg

SEQ ID NO: 1765034 - RNA, 22 nt, Salmonella enterica enterica serovar Typhi Ty2
gcccggauaaccgcccgcggcg

SEQ ID NO: 1765035 - RNA, 15 nt, Salmonella enterica enterica serovar Typhi Ty2
gcccggcguugaaau

SEQ ID NO: 1765036 - RNA, 21 nt, Salmonella enterica enterica serovar Typhi Ty2
gcccggcggcgcgaugccugc

SEQ ID NO: 1765037 - RNA, 17 nt, Salmonella enterica enterica serovar Typhi Ty2
gcccggcgcgacgccgc

SEQ ID NO: 1765038 - RNA, 20 nt, Salmonella enterica enterica serovar Typhi Ty2
gcccggcgcgacgccgcaua

SEQ ID NO: 1765039 - RNA, 18 nt, Salmonella enterica enterica serovar Typhi Ty2
gcccggcgcgcuggaggc

SEQ ID NO: 1765040 - RNA, 18 nt, Salmonella enterica enterica serovar Typhi Ty2
gcccggcggcacggcgcu

SEQ ID NO: 1765041 - RNA, 11 nt, Salmonella enterica enterica serovar Typhi Ty2
gcccggcggcg

SEQ ID NO: 1765042 - RNA, 21 nt, Salmonella enterica enterica serovar Typhi Ty2
gcccgggagaacgccgggccu

SEQ ID NO: 1765043 - RNA, 13 nt, Salmonella enterica enterica serovar Typhi Ty2
gcccgcgcguuca

SEQ ID NO: 1765044 - RNA, 15 nt, Salmonella enterica enterica serovar Typhi Ty2
gcccgcgcuaagcac

SEQ ID NO: 1765045 - RNA, 11 nt, Salmonella enterica enterica serovar Typhi Ty2
gcccgcggcga

SEQ ID NO: 1765046 - RNA, 18 nt, Salmonella enterica enterica serovar Typhi Ty2
gcccggacgaaccuggcg

SEQ ID NO: 1765047 - RNA, 21 nt, Salmonella enterica enterica serovar Typhi Ty2
gcccggacaaggcgcgccagc

SEQ ID NO: 1765048 - RNA, 19 nt, Salmonella enterica enterica serovar Typhi Ty2
gcccggacgccguccaggc

SEQ ID NO: 1765049 - RNA, 20 nt, Salmonella enterica enterica serovar Typhi Ty2
gcccggacgaaccuggcggu

SEQ ID NO: 1765050 - RNA, 22 nt, Salmonella enterica enterica serovar Typhi Ty2
gcccggaaauggguaucuucau

SEQ ID NO: 1765051 - RNA, 22 nt, Salmonella enterica enterica serovar Typhi Ty2
gcccgcuucacgcgcggcuacu

SEQ ID NO: 1765052 - RNA, 21 nt, Salmonella enterica enterica serovar Typhi Ty2
gcaacacgacaaaagcaucaa

SEQ ID NO: 1765053 - RNA, 13 nt, Salmonella enterica enterica serovar Typhi Ty2
gcaacaccauccc

SEQ ID NO: 1765054 - RNA, 22 nt, Salmonella enterica enterica serovar Typhi Ty2
gcaacaaacauaagcaaauccu

SEQ ID NO: 1765055 - RNA, 20 nt, Salmonella enterica enterica serovar Typhi Ty2
gcaacaacaaacacaaucac

SEQ ID NO: 1765056 - RNA, 12 nt, Salmonella enterica enterica serovar Typhi Ty2
gcaacagcacca

SEQ ID NO: 1765057 - RNA, 16 nt, Salmonella enterica enterica serovar Typhi Ty2
gcaacagcaccagcag

SEQ ID NO: 1765058 - RNA, 13 nt, Salmonella enterica enterica serovar Typhi Ty2
gcaacagucagcu

SEQ ID NO: 1765059 - RNA, 16 nt, Salmonella enterica enterica serovar Typhi Ty2
gcaacagucagcuccu

SEQ ID NO: 1765060 - RNA, 23 nt, Salmonella enterica enterica serovar Typhi Ty2
gcaacaguaccugauaaaauucc

SEQ ID NO: 1765061 - RNA, 15 nt, Salmonella enterica enterica serovar Typhi Ty2
gcaacaguugcugga

SEQ ID NO: 1765062 - RNA, 17 nt, Salmonella enterica enterica serovar Typhi Ty2
gcaacagcaccagcagg

SEQ ID NO: 1765063 - RNA, 23 nt, Salmonella enterica enterica serovar Typhi Ty2
gcaacagcaccagcaggugguac

SEQ ID NO: 1765064 - RNA, 21 nt, Salmonella enterica enterica serovar Typhi Ty2
gcaacccguaccuccagcgac

SEQ ID NO: 1765065 - RNA, 13 nt, Salmonella enterica enterica serovar Typhi Ty2
gcaaccaggucac

SEQ ID NO: 1765066 - RNA, 21 nt, Salmonella enterica enterica serovar Typhi Ty2
gcaacagugggcuaugaagag

SEQ ID NO: 1765067 - RNA, 14 nt, Salmonella enterica enterica serovar Typhi Ty2
gcaacauagcaucg

SEQ ID NO: 1765068 - RNA, 12 nt, Salmonella enterica enterica serovar Typhi Ty2
gcaacaaagccu

SEQ ID NO: 1765069 - RNA, 13 nt, Salmonella enterica enterica serovar Typhi Ty2
gcaaauucuuuuc

SEQ ID NO: 1765070 - RNA, 22 nt, Salmonella enterica enterica serovar Typhi Ty2
gcaaauuccaacauauuugccc

SEQ ID NO: 1765071 - RNA, 16 nt, Salmonella enterica enterica serovar Typhi Ty2
gcaaaugccaucccau

SEQ ID NO: 1765072 - RNA, 19 nt, Salmonella enterica enterica serovar Typhi Ty2
gcaaaugaccagaucaaca

SEQ ID NO: 1765073 - RNA, 12 nt, Salmonella enterica enterica serovar Typhi Ty2
gcaaaugucaga

SEQ ID NO: 1765074 - RNA, 17 nt, Salmonella enterica enterica serovar Typhi Ty2
gcaaaucgcgguaaaaa

SEQ ID NO: 1765075 - RNA, 17 nt, Salmonella enterica enterica serovar Typhi Ty2
gcaaaguggguauauuu

SEQ ID NO: 1765076 - RNA, 15 nt, Salmonella enterica enterica serovar Typhi Ty2
gcaaauaccacauca

SEQ ID NO: 1765077 - RNA, 17 nt, Salmonella enterica enterica serovar Typhi Ty2
gcaaauacuggaaaaaa

SEQ ID NO: 1765078 - RNA, 15 nt, Salmonella enterica enterica serovar Typhi Ty2
gcaaaucaacauuau

SEQ ID NO: 1765079 - RNA, 14 nt, Salmonella enterica enterica serovar Typhi Ty2
gcaaacagcuucau

SEQ ID NO: 1765080 - RNA, 13 nt, Salmonella enterica enterica serovar Typhi Ty2
gcaaacagcacgc

SEQ ID NO: 1765081 - RNA, 17 nt, Salmonella enterica enterica serovar Typhi Ty2
gcaaacaguacgcccgc

SEQ ID NO: 1765082 - RNA, 22 nt, Salmonella enterica enterica serovar Typhi Ty2
gcaaacagugggaagcacaucc

SEQ ID NO: 1765083 - RNA, 16 nt, Salmonella enterica enterica serovar Typhi Ty2
gcaaacaccucagcca

SEQ ID NO: 1765084 - RNA, 18 nt, Salmonella enterica enterica serovar Typhi Ty2
gcaaacagagcgccggca

SEQ ID NO: 1765085 - RNA, 21 nt, Salmonella enterica enterica serovar Typhi Ty2
gcaaaccgaauucguccacac

SEQ ID NO: 1765086 - RNA, 12 nt, Salmonella enterica enterica serovar Typhi Ty2
gcaaacccucau

SEQ ID NO: 1765087 - RNA, 14 nt, Salmonella enterica enterica serovar Typhi Ty2
gcaaacccucaucg

SEQ ID NO: 1765088 - RNA, 12 nt, Salmonella enterica enterica serovar Typhi Ty2
gcaaacaucccc

SEQ ID NO: 1765089 - RNA, 18 nt, Salmonella enterica enterica serovar Typhi Ty2
gcaaacucagcggcucug

SEQ ID NO: 1765090 - RNA, 14 nt, Salmonella enterica enterica serovar Typhi Ty2
gcaaacucagcggc

SEQ ID NO: 1765091 - RNA, 14 nt, Salmonella enterica enterica serovar Typhi Ty2
gcaaacgggauucc

SEQ ID NO: 1765092 - RNA, 20 nt, Salmonella enterica enterica serovar Typhi Ty2
gcaaaccggguaacaacauu

SEQ ID NO: 1765093 - RNA, 14 nt, Salmonella enterica enterica serovar Typhi Ty2
gcaaacgccugcuc

SEQ ID NO: 1765094 - RNA, 20 nt, Salmonella enterica enterica serovar Typhi Ty2
gcaaagccgccguagcguuu

SEQ ID NO: 1765095 - RNA, 15 nt, Salmonella enterica enterica serovar Typhi Ty2
gcaaagcucaacgca

SEQ ID NO: 1765096 - RNA, 17 nt, Salmonella enterica enterica serovar Typhi Ty2
gcaaagcgacgcgcggu

SEQ ID NO: 1765097 - RNA, 14 nt, Salmonella enterica enterica serovar Typhi Ty2
gcaaacuuugcgcc

SEQ ID NO: 1765098 - RNA, 22 nt, Salmonella enterica enterica serovar Typhi Ty2
gcaaaagaggcuaauuaucugc

SEQ ID NO: 1765099 - RNA, 12 nt, Salmonella enterica enterica serovar Typhi Ty2
gcaaaagaaaaa

SEQ ID NO: 1765100 - RNA, 13 nt, Salmonella enterica enterica serovar Typhi Ty2
gcaaaagaaaaaa

SEQ ID NO: 1765101 - RNA, 15 nt, Salmonella enterica enterica serovar Typhi Ty2
gcaaaacgccgcaga

SEQ ID NO: 1765102 - RNA, 21 nt, Salmonella enterica enterica serovar Typhi Ty2
gcaaaacucucaccgaccugc

SEQ ID NO: 1765103 - RNA, 13 nt, Salmonella enterica enterica serovar Typhi Ty2
gcaaaaauuugcg

SEQ ID NO: 1765104 - RNA, 12 nt, Salmonella enterica enterica serovar Typhi Ty2
gcaaaacauggc

SEQ ID NO: 1765105 - RNA, 18 nt, Salmonella enterica enterica serovar Typhi Ty2
gcaaaaccuucauaaaua

SEQ ID NO: 1765106 - RNA, 15 nt, Salmonella enterica enterica serovar Typhi Ty2
gcaaaaccagacgcc

SEQ ID NO: 1765107 - RNA, 18 nt, Salmonella enterica enterica serovar Typhi Ty2
gcaaaagcgguaauaacu

SEQ ID NO: 1765108 - RNA, 16 nt, Salmonella enterica enterica serovar Typhi Ty2
gcaaaauuccggcuga

SEQ ID NO: 1765109 - RNA, 15 nt, Salmonella enterica enterica serovar Typhi Ty2
gcaaacaacccggcu

SEQ ID NO: 1765110 - RNA, 19 nt, Salmonella enterica enterica serovar Typhi Ty2
gcaaaaauaggcuuuugau

SEQ ID NO: 1765111 - RNA, 19 nt, Salmonella enterica enterica serovar Typhi Ty2
gcaaaaacaccuaacccac

SEQ ID NO: 1765112 - RNA, 22 nt, Salmonella enterica enterica serovar Typhi Ty2
gauuuuucgcgucaaaacuuau

SEQ ID NO: 1765113 - RNA, 13 nt, Salmonella enterica enterica serovar Typhi Ty2
gauuuucuuuaau

SEQ ID NO: 1765114 - RNA, 13 nt, Salmonella enterica enterica serovar Typhi Ty2
gauuuugaaggug

SEQ ID NO: 1765115 - RNA, 15 nt, Salmonella enterica enterica serovar Typhi Ty2
gauuuugagcacugu

SEQ ID NO: 1765116 - RNA, 20 nt, Salmonella enterica enterica serovar Typhi Ty2
gauuuucuuauuacaagaaa

SEQ ID NO: 1765117 - RNA, 21 nt, Salmonella enterica enterica serovar Typhi Ty2
gauuuuaagcauccaggaagu

SEQ ID NO: 1765118 - RNA, 12 nt, Salmonella enterica enterica serovar Typhi Ty2
gauuuuaaauug

SEQ ID NO: 1765119 - RNA, 19 nt, Salmonella enterica enterica serovar Typhi Ty2
gauuuuagcgcaucgcucc

SEQ ID NO: 1765120 - RNA, 12 nt, Salmonella enterica enterica serovar Typhi Ty2
gauuuguuaucu

SEQ ID NO: 1765121 - RNA, 16 nt, Salmonella enterica enterica serovar Typhi Ty2
gauuuguuucaucgcc

SEQ ID NO: 1765122 - RNA, 20 nt, Salmonella enterica enterica serovar Typhi Ty2
gauuuguuuuuuauauuuuu

SEQ ID NO: 1765123 - RNA, 15 nt, Salmonella enterica enterica serovar Typhi Ty2
gauuucuuaauuccu

SEQ ID NO: 1765124 - RNA, 17 nt, Salmonella enterica enterica serovar Typhi Ty2
gauuucuugagcggcau

SEQ ID NO: 1765125 - RNA, 17 nt, Salmonella enterica enterica serovar Typhi Ty2
gauuucgccccacuggc

SEQ ID NO: 1765126 - RNA, 18 nt, Salmonella enterica enterica serovar Typhi Ty2
gauuugcaaccgcucuuu

SEQ ID NO: 1765127 - RNA, 12 nt, Salmonella enterica enterica serovar Typhi Ty2
gauuuaugaaua

SEQ ID NO: 1765128 - RNA, 15 nt, Salmonella enterica enterica serovar Typhi Ty2
gauuuauagagcagc

SEQ ID NO: 1765129 - RNA, 14 nt, Salmonella enterica enterica serovar Typhi Ty2
gauuuaucuucucu

SEQ ID NO: 1765130 - RNA, 22 nt, Salmonella enterica enterica serovar Typhi Ty2
gauuuaucuucucuaucagcgc

SEQ ID NO: 1765131 - RNA, 21 nt, Salmonella enterica enterica serovar Typhi Ty2
gauuuauguaccgucaucgcc

SEQ ID NO: 1765132 - RNA, 18 nt, Salmonella enterica enterica serovar Typhi Ty2
gauuuauuuugaauuuuu

SEQ ID NO: 1765133 - RNA, 14 nt, Salmonella enterica enterica serovar Typhi Ty2
gauuucauccucuu

SEQ ID NO: 1765134 - RNA, 22 nt, Salmonella enterica enterica serovar Typhi Ty2
gauuucaugcggugcaugaaua

SEQ ID NO: 1765135 - RNA, 20 nt, Salmonella enterica enterica serovar Typhi Ty2
gauuuccggaaugguauaaa

SEQ ID NO: 1765136 - RNA, 13 nt, Salmonella enterica enterica serovar Typhi Ty2
gauuuccagcgcc

SEQ ID NO: 1765137 - RNA, 18 nt, Salmonella enterica enterica serovar Typhi Ty2
gauuuaaaacaagcagua

SEQ ID NO: 1765138 - RNA, 14 nt, Salmonella enterica enterica serovar Typhi Ty2
gauuuaaaacaagc

SEQ ID NO: 1765139 - RNA, 16 nt, Salmonella enterica enterica serovar Typhi Ty2
gauuuaagcuuaauuu

SEQ ID NO: 1765140 - RNA, 23 nt, Salmonella enterica enterica serovar Typhi Ty2
gauuguuucggauaauucugacu

SEQ ID NO: 1765141 - RNA, 14 nt, Salmonella enterica enterica serovar Typhi Ty2
gauucaagcgggug

SEQ ID NO: 1765142 - RNA, 22 nt, Salmonella enterica enterica serovar Typhi Ty2
gauucaacgcgugauccacagc

SEQ ID NO: 1765143 - RNA, 16 nt, Salmonella enterica enterica serovar Typhi Ty2
gauucaccaacugcug

SEQ ID NO: 1765144 - RNA, 14 nt, Salmonella enterica enterica serovar Typhi Ty2
gauucaccaccacc

SEQ ID NO: 1765145 - RNA, 18 nt, Salmonella enterica enterica serovar Typhi Ty2
gauucagcgcaggcaguu

SEQ ID NO: 1765146 - RNA, 19 nt, Salmonella enterica enterica serovar Typhi Ty2
gauucacuuucgacgacaa

SEQ ID NO: 1765147 - RNA, 17 nt, Salmonella enterica enterica serovar Typhi Ty2
gauucaugaucuuuccu

SEQ ID NO: 1765148 - RNA, 20 nt, Salmonella enterica enterica serovar Typhi Ty2
gauucguuuuuacacugaag

SEQ ID NO: 1765149 - RNA, 14 nt, Salmonella enterica enterica serovar Typhi Ty2
gauucgaaccugcg

SEQ ID NO: 1765150 - RNA, 14 nt, Salmonella enterica enterica serovar Typhi Ty2
gauucgcccacgga

SEQ ID NO: 1765151 - RNA, 12 nt, Salmonella enterica enterica serovar Typhi Ty2
gauuggcaaaau

SEQ ID NO: 1765152 - RNA, 16 nt, Salmonella enterica enterica serovar Typhi Ty2
gauugagacaaauaac

SEQ ID NO: 1765153 - RNA, 14 nt, Salmonella enterica enterica serovar Typhi Ty2
gauugcaagaauau

SEQ ID NO: 1765154 - RNA, 13 nt, Salmonella enterica enterica serovar Typhi Ty2
gauugaauaaugc

SEQ ID NO: 1765155 - RNA, 16 nt, Salmonella enterica enterica serovar Typhi Ty2
gauugacgguuugucu

SEQ ID NO: 1765156 - RNA, 20 nt, Salmonella enterica enterica serovar Typhi Ty2
gauugaggcggguaauuugc

SEQ ID NO: 1765157 - RNA, 15 nt, Salmonella enterica enterica serovar Typhi Ty2
gauucugccaguuca

SEQ ID NO: 1765158 - RNA, 22 nt, Salmonella enterica enterica serovar Typhi Ty2
gauucuaucuguuuuaauuccu

SEQ ID NO: 1765159 - RNA, 20 nt, Salmonella enterica enterica serovar Typhi Ty2
gauucucuaacgucagcgcc

SEQ ID NO: 1765160 - RNA, 17 nt, Salmonella enterica enterica serovar Typhi Ty2
gauuaagcgaauccagc

SEQ ID NO: 1765161 - RNA, 17 nt, Salmonella enterica enterica serovar Typhi Ty2
gauuaauaaccaauaau

SEQ ID NO: 1765162 - RNA, 15 nt, Salmonella enterica enterica serovar Typhi Ty2
gauuaacaagcagau

SEQ ID NO: 1765163 - RNA, 19 nt, Salmonella enterica enterica serovar Typhi Ty2
gauuaacaagcagauaccg

SEQ ID NO: 1765164 - RNA, 14 nt, Salmonella enterica enterica serovar Typhi Ty2
gauguuuuuaaaag

SEQ ID NO: 1765165 - RNA, 20 nt, Salmonella enterica enterica serovar Typhi Ty2
gauguuuuuaucaugcugac

SEQ ID NO: 1765166 - RNA, 22 nt, Salmonella enterica enterica serovar Typhi Ty2
gauguugguuaauauaucgcag

SEQ ID NO: 1765167 - RNA, 23 nt, Salmonella enterica enterica serovar Typhi Ty2
gaugugucuauuuauugaagaug

SEQ ID NO: 1765168 - RNA, 20 nt, Salmonella enterica enterica serovar Typhi Ty2
gaugucggcguaaauccagc

SEQ ID NO: 1765169 - RNA, 13 nt, Salmonella enterica enterica serovar Typhi Ty2
gaugugauaaaug

SEQ ID NO: 1765170 - RNA, 20 nt, Salmonella enterica enterica serovar Typhi Ty2
gaugugaccuuugugcagga

SEQ ID NO: 1765171 - RNA, 12 nt, Salmonella enterica enterica serovar Typhi Ty2
gauuauagagag

SEQ ID NO: 1765172 - RNA, 21 nt, Salmonella enterica enterica serovar Typhi Ty2
gauuacucucuugccagcgca

SEQ ID NO: 1765173 - RNA, 16 nt, Salmonella enterica enterica serovar Typhi Ty2
gauuagacuucuucca

SEQ ID NO: 1765174 - RNA, 18 nt, Salmonella enterica enterica serovar Typhi Ty2
gauuaaugcuccaauaaa

SEQ ID NO: 1765175 - RNA, 16 nt, Salmonella enterica enterica serovar Typhi Ty2
gauuaaucgucauccc

SEQ ID NO: 1765176 - RNA, 16 nt, Salmonella enterica enterica serovar Typhi Ty2
gauuaauacaucacuu

SEQ ID NO: 1765177 - RNA, 17 nt, Salmonella enterica enterica serovar Typhi Ty2
gauuaaugauuugcuuu

SEQ ID NO: 1765178 - RNA, 23 nt, Salmonella enterica enterica serovar Typhi Ty2
gauuaccauugaucaggcaaaaa

SEQ ID NO: 1765179 - RNA, 16 nt, Salmonella enterica enterica serovar Typhi Ty2
gaugguuauuuucaga

SEQ ID NO: 1765180 - RNA, 21 nt, Salmonella enterica enterica serovar Typhi Ty2
gaugguuucggcaugccacug

SEQ ID NO: 1765181 - RNA, 15 nt, Salmonella enterica enterica serovar Typhi Ty2
gauguaaaaccuggc

SEQ ID NO: 1765182 - RNA, 14 nt, Salmonella enterica enterica serovar Typhi Ty2
gauguaaucugaca

SEQ ID NO: 1765183 - RNA, 23 nt, Salmonella enterica enterica serovar Typhi Ty2
gaugguuaaauucauauuuaaau

SEQ ID NO: 1765184 - RNA, 17 nt, Salmonella enterica enterica serovar Typhi Ty2
gaugguggugcaagcac

SEQ ID NO: 1765185 - RNA, 20 nt, Salmonella enterica enterica serovar Typhi Ty2
gauggugcggcgcacugccu

SEQ ID NO: 1765186 - RNA, 21 nt, Salmonella enterica enterica serovar Typhi Ty2
gauguccaccgauuucaucgc

SEQ ID NO: 1765187 - RNA, 16 nt, Salmonella enterica enterica serovar Typhi Ty2
gauguccgcagccgca

SEQ ID NO: 1765188 - RNA, 20 nt, Salmonella enterica enterica serovar Typhi Ty2
gauguccaggcgacaugaca

SEQ ID NO: 1765189 - RNA, 16 nt, Salmonella enterica enterica serovar Typhi Ty2
gauguaguuguucuuu

SEQ ID NO: 1765190 - RNA, 22 nt, Salmonella enterica enterica serovar Typhi Ty2
gauggugcagccccggcggcgu

SEQ ID NO: 1765191 - RNA, 16 nt, Salmonella enterica enterica serovar Typhi Ty2
gauggucaauaacagc

SEQ ID NO: 1765192 - RNA, 14 nt, Salmonella enterica enterica serovar Typhi Ty2
gaugggcaaugcca

SEQ ID NO: 1765193 - RNA, 19 nt, Salmonella enterica enterica serovar Typhi Ty2
gauggcuuugcugucagaa

SEQ ID NO: 1765194 - RNA, 19 nt, Salmonella enterica enterica serovar Typhi Ty2
gauggcuaugaagcuggag

SEQ ID NO: 1765195 - RNA, 20 nt, Salmonella enterica enterica serovar Typhi Ty2
gauggcuaugaagcuggagc

SEQ ID NO: 1765196 - RNA, 17 nt, Salmonella enterica enterica serovar Typhi Ty2
gaugggcuucagauguu

SEQ ID NO: 1765197 - RNA, 14 nt, Salmonella enterica enterica serovar Typhi Ty2
gaugggcuucagau

SEQ ID NO: 1765198 - RNA, 23 nt, Salmonella enterica enterica serovar Typhi Ty2
gaugggcagauagaaugcuucuu

SEQ ID NO: 1765199 - RNA, 17 nt, Salmonella enterica enterica serovar Typhi Ty2
gauggaacgcauccagc

SEQ ID NO: 1765200 - RNA, 17 nt, Salmonella enterica enterica serovar Typhi Ty2
gauggacuugugcagug

SEQ ID NO: 1765201 - RNA, 19 nt, Salmonella enterica enterica serovar Typhi Ty2
gauggacggauuggcgcuc

SEQ ID NO: 1765202 - RNA, 13 nt, Salmonella enterica enterica serovar Typhi Ty2
gauggcaaauaau

SEQ ID NO: 1765203 - RNA, 15 nt, Salmonella enterica enterica serovar Typhi Ty2
gauggaacagacgcc

SEQ ID NO: 1765204 - RNA, 21 nt, Salmonella enterica enterica serovar Typhi Ty2
gaugcugucuuagugaaagac

SEQ ID NO: 1765205 - RNA, 16 nt, Salmonella enterica enterica serovar Typhi Ty2
gaugcugcguuuuuuc

SEQ ID NO: 1765206 - RNA, 21 nt, Salmonella enterica enterica serovar Typhi Ty2
gaugcugcgcauccgcggcgc

SEQ ID NO: 1765207 - RNA, 18 nt, Salmonella enterica enterica serovar Typhi Ty2
gauggccgccgagcugug

SEQ ID NO: 1765208 - RNA, 11 nt, Salmonella enterica enterica serovar Typhi Ty2
gauggcacugc

SEQ ID NO: 1765209 - RNA, 23 nt, Salmonella enterica enterica serovar Typhi Ty2
gauggcacugcgcuuauccggcc

SEQ ID NO: 1765210 - RNA, 17 nt, Salmonella enterica enterica serovar Typhi Ty2
gauggccaaauaaccca

SEQ ID NO: 1765211 - RNA, 20 nt, Salmonella enterica enterica serovar Typhi Ty2
gauggcgcugcguuuccugu

SEQ ID NO: 1765212 - RNA, 15 nt, Salmonella enterica enterica serovar Typhi Ty2
gauggcggcugcgcc

SEQ ID NO: 1765213 - RNA, 17 nt, Salmonella enterica enterica serovar Typhi Ty2
gauggcguuuagcuggc

SEQ ID NO: 1765214 - RNA, 19 nt, Salmonella enterica enterica serovar Typhi Ty2
gauggcgagaagcugggcg

SEQ ID NO: 1765215 - RNA, 13 nt, Salmonella enterica enterica serovar Typhi Ty2
gauggcgcgcuua

SEQ ID NO: 1765216 - RNA, 18 nt, Salmonella enterica enterica serovar Typhi Ty2
gauggcgcuaagccagcc

SEQ ID NO: 1765217 - RNA, 13 nt, Salmonella enterica enterica serovar Typhi Ty2
gauggcgccagcc

SEQ ID NO: 1765218 - RNA, 13 nt, Salmonella enterica enterica serovar Typhi Ty2
aaagcgaauaauu

SEQ ID NO: 1765219 - RNA, 19 nt, Salmonella enterica enterica serovar Typhi Ty2
aaagccuguuuaccaagca

SEQ ID NO: 1765220 - RNA, 16 nt, Salmonella enterica enterica serovar Typhi Ty2
gaugauuauuguuaaa

SEQ ID NO: 1765221 - RNA, 13 nt, Salmonella enterica enterica serovar Typhi Ty2
gaugauucacccu

SEQ ID NO: 1765222 - RNA, 14 nt, Salmonella enterica enterica serovar Typhi Ty2
gaugauguacaggu

SEQ ID NO: 1765223 - RNA, 14 nt, Salmonella enterica enterica serovar Typhi Ty2
aaagcgaccucuug

SEQ ID NO: 1765224 - RNA, 15 nt, Salmonella enterica enterica serovar Typhi Ty2
gaugcaaugcagaug

SEQ ID NO: 1765225 - RNA, 13 nt, Salmonella enterica enterica serovar Typhi Ty2
gaugcaaauguca

SEQ ID NO: 1765226 - RNA, 11 nt, Salmonella enterica enterica serovar Typhi Ty2
gaugcagcacc

SEQ ID NO: 1765227 - RNA, 16 nt, Salmonella enterica enterica serovar Typhi Ty2
gaugcagcuugcaggc

SEQ ID NO: 1765228 - RNA, 15 nt, Salmonella enterica enterica serovar Typhi Ty2
gaugcccguaaagcu

SEQ ID NO: 1765229 - RNA, 18 nt, Salmonella enterica enterica serovar Typhi Ty2
gaugccgaucaccagcgc

SEQ ID NO: 1765230 - RNA, 19 nt, Salmonella enterica enterica serovar Typhi Ty2
gaugcccagguuagcagcc

SEQ ID NO: 1765231 - RNA, 21 nt, Salmonella enterica enterica serovar Typhi Ty2
gaugccccaucucuuucagaa

SEQ ID NO: 1765232 - RNA, 16 nt, Salmonella enterica enterica serovar Typhi Ty2
gaugcaucagaacaaa

SEQ ID NO: 1765233 - RNA, 13 nt, Salmonella enterica enterica serovar Typhi Ty2
gaugcauuugauu

SEQ ID NO: 1765234 - RNA, 18 nt, Salmonella enterica enterica serovar Typhi Ty2
gaugccggauaauacgaa

SEQ ID NO: 1765235 - RNA, 17 nt, Salmonella enterica enterica serovar Typhi Ty2
gaugccgcuucgccacu

SEQ ID NO: 1765236 - RNA, 18 nt, Salmonella enterica enterica serovar Typhi Ty2
gaugccgccgacaaccag

SEQ ID NO: 1765237 - RNA, 16 nt, Salmonella enterica enterica serovar Typhi Ty2
gaugccgugaggcuga

SEQ ID NO: 1765238 - RNA, 13 nt, Salmonella enterica enterica serovar Typhi Ty2
gaugcgccaguac

SEQ ID NO: 1765239 - RNA, 21 nt, Salmonella enterica enterica serovar Typhi Ty2
gaugcgccugucuccagcgcc

SEQ ID NO: 1765240 - RNA, 13 nt, Salmonella enterica enterica serovar Typhi Ty2
gaugcgccuguaa

SEQ ID NO: 1765241 - RNA, 14 nt, Salmonella enterica enterica serovar Typhi Ty2
gaugcggaagagaa

SEQ ID NO: 1765242 - RNA, 21 nt, Salmonella enterica enterica serovar Typhi Ty2
gaugcggcaaaaauccuucuu

SEQ ID NO: 1765243 - RNA, 22 nt, Salmonella enterica enterica serovar Typhi Ty2
gaugcgcguuuagcgccagcag

SEQ ID NO: 1765244 - RNA, 19 nt, Salmonella enterica enterica serovar Typhi Ty2
gaugcgggcgaucggcugu

SEQ ID NO: 1765245 - RNA, 18 nt, Salmonella enterica enterica serovar Typhi Ty2
gaugcgggccgacaaaaa

SEQ ID NO: 1765246 - RNA, 23 nt, Salmonella enterica enterica serovar Typhi Ty2
gaugcuaaccucuauaguaaauu

SEQ ID NO: 1765247 - RNA, 16 nt, Salmonella enterica enterica serovar Typhi Ty2
gaugcuauaccgcccg

SEQ ID NO: 1765248 - RNA, 21 nt, Salmonella enterica enterica serovar Typhi Ty2
gaugcuaucgcggauaagccc

SEQ ID NO: 1765249 - RNA, 18 nt, Salmonella enterica enterica serovar Typhi Ty2
gaugcugaauagccagcc

SEQ ID NO: 1765250 - RNA, 18 nt, Salmonella enterica enterica serovar Typhi Ty2
gaugcugauuaaugauuu

SEQ ID NO: 1765251 - RNA, 18 nt, Salmonella enterica enterica serovar Typhi Ty2
gaugcugauguccgcagc

SEQ ID NO: 1765252 - RNA, 22 nt, Salmonella enterica enterica serovar Typhi Ty2
gaugaaauaaacgaccacucuu

SEQ ID NO: 1765253 - RNA, 23 nt, Salmonella enterica enterica serovar Typhi Ty2
gaugaaacugcauaucgccgcuu

SEQ ID NO: 1765254 - RNA, 22 nt, Salmonella enterica enterica serovar Typhi Ty2
gaugaacgacgcugauuugcca

SEQ ID NO: 1765255 - RNA, 19 nt, Salmonella enterica enterica serovar Typhi Ty2
gaugaauuccugcggcggu

SEQ ID NO: 1765256 - RNA, 12 nt, Salmonella enterica enterica serovar Typhi Ty2
gaucuuccacua

SEQ ID NO: 1765257 - RNA, 12 nt, Salmonella enterica enterica serovar Typhi Ty2
gaucuucauccc

SEQ ID NO: 1765258 - RNA, 23 nt, Salmonella enterica enterica serovar Typhi Ty2
gaucuuccugcgcgccaaaccgu

SEQ ID NO: 1765259 - RNA, 12 nt, Salmonella enterica enterica serovar Typhi Ty2
gaucuuccugcg

SEQ ID NO: 1765260 - RNA, 11 nt, Salmonella enterica enterica serovar Typhi Ty2
gaugaaaaaga

SEQ ID NO: 1765261 - RNA, 14 nt, Salmonella enterica enterica serovar Typhi Ty2
gaucuuuuugcucc

SEQ ID NO: 1765262 - RNA, 13 nt, Salmonella enterica enterica serovar Typhi Ty2
gaucuuugccgcg

SEQ ID NO: 1765263 - RNA, 21 nt, Salmonella enterica enterica serovar Typhi Ty2
gaucuuuccuuuuucaggcac

SEQ ID NO: 1765264 - RNA, 19 nt, Salmonella enterica enterica serovar Typhi Ty2
gaucuugucacaauaacgc

SEQ ID NO: 1765265 - RNA, 19 nt, Salmonella enterica enterica serovar Typhi Ty2
gaugacucccaguccggua

SEQ ID NO: 1765266 - RNA, 16 nt, Salmonella enterica enterica serovar Typhi Ty2
gaugacggcaggggcg

SEQ ID NO: 1765267 - RNA, 16 nt, Salmonella enterica enterica serovar Typhi Ty2
gaugaccauaaaugaa

SEQ ID NO: 1765268 - RNA, 22 nt, Salmonella enterica enterica serovar Typhi Ty2
gaugacaucgcaaugccaccac

SEQ ID NO: 1765269 - RNA, 19 nt, Salmonella enterica enterica serovar Typhi Ty2
gaugaggcgcagccgccau

SEQ ID NO: 1765270 - RNA, 14 nt, Salmonella enterica enterica serovar Typhi Ty2
gaugagcaggccag

SEQ ID NO: 1765271 - RNA, 19 nt, Salmonella enterica enterica serovar Typhi Ty2
gaugagauccgggcuggca

SEQ ID NO: 1765272 - RNA, 13 nt, Salmonella enterica enterica serovar Typhi Ty2
gaugauggcggcu

SEQ ID NO: 1765273 - RNA, 17 nt, Salmonella enterica enterica serovar Typhi Ty2
aaagccggcggaaaaaa

SEQ ID NO: 1765274 - RNA, 21 nt, Salmonella enterica enterica serovar Typhi Ty2
aaagccggcggaaaaaagcag

SEQ ID NO: 1765275 - RNA, 22 nt, Salmonella enterica enterica serovar Typhi Ty2
gaugaugcguuuguuggagauc

SEQ ID NO: 1765276 - RNA, 20 nt, Salmonella enterica enterica serovar Typhi Ty2
aaagccugcacauugcaggc

SEQ ID NO: 1765277 - RNA, 17 nt, Salmonella enterica enterica serovar Typhi Ty2
aaagccucuuuugcauu

SEQ ID NO: 1765278 - RNA, 15 nt, Salmonella enterica enterica serovar Typhi Ty2
gaugaugaaaaagaa

SEQ ID NO: 1765279 - RNA, 13 nt, Salmonella enterica enterica serovar Typhi Ty2
gaugauauccagc

SEQ ID NO: 1765280 - RNA, 24 nt, Salmonella enterica enterica serovar Typhi Ty2
gaugauagccguugucauggcgcc

SEQ ID NO: 1765281 - RNA, 17 nt, Salmonella enterica enterica serovar Typhi Ty2
gaugaguauauagcgcu

SEQ ID NO: 1765282 - RNA, 17 nt, Salmonella enterica enterica serovar Typhi Ty2
gagauucugcaggccaa

SEQ ID NO: 1765283 - RNA, 14 nt, Salmonella enterica enterica serovar Typhi Ty2
gagauucugcaggc

SEQ ID NO: 1765284 - RNA, 15 nt, Salmonella enterica enterica serovar Typhi Ty2
gagauuuaucuucuc

SEQ ID NO: 1765285 - RNA, 21 nt, Salmonella enterica enterica serovar Typhi Ty2
gagaucgguaauuuccacgcc

SEQ ID NO: 1765286 - RNA, 18 nt, Salmonella enterica enterica serovar Typhi Ty2
gagaucgguaauuuccac

SEQ ID NO: 1765287 - RNA, 22 nt, Salmonella enterica enterica serovar Typhi Ty2
gagauccgggcuggcaaacagg

SEQ ID NO: 1765288 - RNA, 21 nt, Salmonella enterica enterica serovar Typhi Ty2
gagaucguuauuaaacagaca

SEQ ID NO: 1765289 - RNA, 13 nt, Salmonella enterica enterica serovar Typhi Ty2
gacucaaagaaaa

SEQ ID NO: 1765290 - RNA, 22 nt, Salmonella enterica enterica serovar Typhi Ty2
gacucacauaacaaaaccagca

SEQ ID NO: 1765291 - RNA, 13 nt, Salmonella enterica enterica serovar Typhi Ty2
gacucagggugac

SEQ ID NO: 1765292 - RNA, 19 nt, Salmonella enterica enterica serovar Typhi Ty2
gacucaucgccgcaaugac

SEQ ID NO: 1765293 - RNA, 16 nt, Salmonella enterica enterica serovar Typhi Ty2
gacucauccagcaucg

SEQ ID NO: 1765294 - RNA, 20 nt, Salmonella enterica enterica serovar Typhi Ty2
gacucauucagcaacugcgu

SEQ ID NO: 1765295 - RNA, 18 nt, Salmonella enterica enterica serovar Typhi Ty2
gacucauuaaaaaaacau

SEQ ID NO: 1765296 - RNA, 14 nt, Salmonella enterica enterica serovar Typhi Ty2
gacucauggacaaa

SEQ ID NO: 1765297 - RNA, 16 nt, Salmonella enterica enterica serovar Typhi Ty2
gacucauggacaaaaa

SEQ ID NO: 1765298 - RNA, 22 nt, Salmonella enterica enterica serovar Typhi Ty2
gacucauggacaaaaaaggaaa

SEQ ID NO: 1765299 - RNA, 20 nt, Salmonella enterica enterica serovar Typhi Ty2
gagaguaaaaccggcacauc

SEQ ID NO: 1765300 - RNA, 13 nt, Salmonella enterica enterica serovar Typhi Ty2
gagagucgccagg

SEQ ID NO: 1765301 - RNA, 20 nt, Salmonella enterica enterica serovar Typhi Ty2
gagagucgccaggaucgccg

SEQ ID NO: 1765302 - RNA, 22 nt, Salmonella enterica enterica serovar Typhi Ty2
gagaggcugaaggcgcuccccu

SEQ ID NO: 1765303 - RNA, 22 nt, Salmonella enterica enterica serovar Typhi Ty2
gacuccagcaacgcugcauccu

SEQ ID NO: 1765304 - RNA, 18 nt, Salmonella enterica enterica serovar Typhi Ty2
gagcagauuuuucgccag

SEQ ID NO: 1765305 - RNA, 16 nt, Salmonella enterica enterica serovar Typhi Ty2
gagcagcaacccugcc

SEQ ID NO: 1765306 - RNA, 20 nt, Salmonella enterica enterica serovar Typhi Ty2
gagcaacguuuugcacagug

SEQ ID NO: 1765307 - RNA, 19 nt, Salmonella enterica enterica serovar Typhi Ty2
gagcaacgccaucagcaaa

SEQ ID NO: 1765308 - RNA, 15 nt, Salmonella enterica enterica serovar Typhi Ty2
gagcaagcgcauugc

SEQ ID NO: 1765309 - RNA, 22 nt, Salmonella enterica enterica serovar Typhi Ty2
gagcaaauacuggaaaaaacgg

SEQ ID NO: 1765310 - RNA, 20 nt, Salmonella enterica enterica serovar Typhi Ty2
gagcaaauacuggaaaaaac

SEQ ID NO: 1765311 - RNA, 20 nt, Salmonella enterica enterica serovar Typhi Ty2
gagcaacagaaaccauaaac

SEQ ID NO: 1765312 - RNA, 21 nt, Salmonella enterica enterica serovar Typhi Ty2
aaagcacaucagcaaaugaac

SEQ ID NO: 1765313 - RNA, 18 nt, Salmonella enterica enterica serovar Typhi Ty2
aaagcacagccccagcac

SEQ ID NO: 1765314 - RNA, 16 nt, Salmonella enterica enterica serovar Typhi Ty2
gagcagcuuggcggcu

SEQ ID NO: 1765315 - RNA, 19 nt, Salmonella enterica enterica serovar Typhi Ty2
gagcagcgccagcgacaga

SEQ ID NO: 1765316 - RNA, 17 nt, Salmonella enterica enterica serovar Typhi Ty2
gagcaggacgcgcgcga

SEQ ID NO: 1765317 - RNA, 21 nt, Salmonella enterica enterica serovar Typhi Ty2
gagcguuacgggaacagaauu

SEQ ID NO: 1765318 - RNA, 18 nt, Salmonella enterica enterica serovar Typhi Ty2
gagcgucuuuuaucccca

SEQ ID NO: 1765319 - RNA, 17 nt, Salmonella enterica enterica serovar Typhi Ty2
gagcgugaucucauugg

SEQ ID NO: 1765320 - RNA, 18 nt, Salmonella enterica enterica serovar Typhi Ty2
gagcgugaucucauugga

SEQ ID NO: 1765321 - RNA, 21 nt, Salmonella enterica enterica serovar Typhi Ty2
gagcgguuuuuuuguggccug

SEQ ID NO: 1765322 - RNA, 13 nt, Salmonella enterica enterica serovar Typhi Ty2
gagcguauccagc

SEQ ID NO: 1765323 - RNA, 19 nt, Salmonella enterica enterica serovar Typhi Ty2
gagcguagaccgcccagga

SEQ ID NO: 1765324 - RNA, 17 nt, Salmonella enterica enterica serovar Typhi Ty2
gagcgucucauccggca

SEQ ID NO: 1765325 - RNA, 17 nt, Salmonella enterica enterica serovar Typhi Ty2
gagcguccagucgggcg

SEQ ID NO: 1765326 - RNA, 18 nt, Salmonella enterica enterica serovar Typhi Ty2
gagcuaaucacccacuuc

SEQ ID NO: 1765327 - RNA, 18 nt, Salmonella enterica enterica serovar Typhi Ty2
gagcucccgguucgccgc

SEQ ID NO: 1765328 - RNA, 17 nt, Salmonella enterica enterica serovar Typhi Ty2
gagcgcguccagacguu

SEQ ID NO: 1765329 - RNA, 13 nt, Salmonella enterica enterica serovar Typhi Ty2
gagcgcuugcugc

SEQ ID NO: 1765330 - RNA, 19 nt, Salmonella enterica enterica serovar Typhi Ty2
gagcggauaauccgccacu

SEQ ID NO: 1765331 - RNA, 12 nt, Salmonella enterica enterica serovar Typhi Ty2
gagcgcgcuggc

SEQ ID NO: 1765332 - RNA, 17 nt, Salmonella enterica enterica serovar Typhi Ty2
gagcgcgcucugccuuu

SEQ ID NO: 1765333 - RNA, 15 nt, Salmonella enterica enterica serovar Typhi Ty2
gagcgcgucagcgcc

SEQ ID NO: 1765334 - RNA, 22 nt, Salmonella enterica enterica serovar Typhi Ty2
gagcggcgacuagucgcccgcu

SEQ ID NO: 1765335 - RNA, 15 nt, Salmonella enterica enterica serovar Typhi Ty2
gagcggucaggccag

SEQ ID NO: 1765336 - RNA, 20 nt, Salmonella enterica enterica serovar Typhi Ty2
gagcgggccguggccaggaa

SEQ ID NO: 1765337 - RNA, 14 nt, Salmonella enterica enterica serovar Typhi Ty2
gagcgcauccggca

SEQ ID NO: 1765338 - RNA, 13 nt, Salmonella enterica enterica serovar Typhi Ty2
gagcgccagcccc

SEQ ID NO: 1765339 - RNA, 15 nt, Salmonella enterica enterica serovar Typhi Ty2
gagcgcgaaaucaaa

SEQ ID NO: 1765340 - RNA, 15 nt, Salmonella enterica enterica serovar Typhi Ty2
gagcgcgauaaccgg

SEQ ID NO: 1765341 - RNA, 15 nt, Salmonella enterica enterica serovar Typhi Ty2
gagcgacgcccugcc

SEQ ID NO: 1765342 - RNA, 20 nt, Salmonella enterica enterica serovar Typhi Ty2
gagcgaguacguaaugugaa

SEQ ID NO: 1765343 - RNA, 22 nt, Salmonella enterica enterica serovar Typhi Ty2
gagcgcauacgcuguccaguca

SEQ ID NO: 1765344 - RNA, 13 nt, Salmonella enterica enterica serovar Typhi Ty2
gagcgccaaaaag

SEQ ID NO: 1765345 - RNA, 17 nt, Salmonella enterica enterica serovar Typhi Ty2
gagccgucgcuaucaau

SEQ ID NO: 1765346 - RNA, 14 nt, Salmonella enterica enterica serovar Typhi Ty2
gagccacuauccag

SEQ ID NO: 1765347 - RNA, 18 nt, Salmonella enterica enterica serovar Typhi Ty2
gagucaaggcauccagca

SEQ ID NO: 1765348 - RNA, 16 nt, Salmonella enterica enterica serovar Typhi Ty2
gaguccugccggacug

SEQ ID NO: 1765349 - RNA, 21 nt, Salmonella enterica enterica serovar Typhi Ty2
gagucgacugguaggccugau

SEQ ID NO: 1765350 - RNA, 16 nt, Salmonella enterica enterica serovar Typhi Ty2
gagucgcagcggcggu

SEQ ID NO: 1765351 - RNA, 21 nt, Salmonella enterica enterica serovar Typhi Ty2
gaguauuuaccuacuguggug

SEQ ID NO: 1765352 - RNA, 12 nt, Salmonella enterica enterica serovar Typhi Ty2
gaguagauguag

SEQ ID NO: 1765353 - RNA, 17 nt, Salmonella enterica enterica serovar Typhi Ty2
gaguggcgaaauuggua

SEQ ID NO: 1765354 - RNA, 19 nt, Salmonella enterica enterica serovar Typhi Ty2
gaguguggaaaacagcgcc

SEQ ID NO: 1765355 - RNA, 11 nt, Salmonella enterica enterica serovar Typhi Ty2
gagugaacacg

SEQ ID NO: 1765356 - RNA, 14 nt, Salmonella enterica enterica serovar Typhi Ty2
gagugaaaugguug

SEQ ID NO: 1765357 - RNA, 18 nt, Salmonella enterica enterica serovar Typhi Ty2
gagugacgguuuucacug

SEQ ID NO: 1765358 - RNA, 16 nt, Salmonella enterica enterica serovar Typhi Ty2
gauaaccuucuucguu

SEQ ID NO: 1765359 - RNA, 15 nt, Salmonella enterica enterica serovar Typhi Ty2
gauaacgaaaagggu

SEQ ID NO: 1765360 - RNA, 14 nt, Salmonella enterica enterica serovar Typhi Ty2
gauaacgaaccauc

SEQ ID NO: 1765361 - RNA, 16 nt, Salmonella enterica enterica serovar Typhi Ty2
gauaaccuuccggcac

SEQ ID NO: 1765362 - RNA, 23 nt, Salmonella enterica enterica serovar Typhi Ty2
gauaaccuauuuugcaaaacuga

SEQ ID NO: 1765363 - RNA, 13 nt, Salmonella enterica enterica serovar Typhi Ty2
gauaaccugcugu

SEQ ID NO: 1765364 - RNA, 22 nt, Salmonella enterica enterica serovar Typhi Ty2
gauaacgcuaugcuuauccggc

SEQ ID NO: 1765365 - RNA, 11 nt, Salmonella enterica enterica serovar Typhi Ty2
gauaacgugcg

SEQ ID NO: 1765366 - RNA, 18 nt, Salmonella enterica enterica serovar Typhi Ty2
gauaaagauauucuccuc

SEQ ID NO: 1765367 - RNA, 12 nt, Salmonella enterica enterica serovar Typhi Ty2
gauaaccagguc

SEQ ID NO: 1765368 - RNA, 16 nt, Salmonella enterica enterica serovar Typhi Ty2
gauaaccgcccgcggc

SEQ ID NO: 1765369 - RNA, 14 nt, Salmonella enterica enterica serovar Typhi Ty2
gauaaacagcagcg

SEQ ID NO: 1765370 - RNA, 18 nt, Salmonella enterica enterica serovar Typhi Ty2
gauaaacagguaaaacaa

SEQ ID NO: 1765371 - RNA, 16 nt, Salmonella enterica enterica serovar Typhi Ty2
gauaaacaccggaauu

SEQ ID NO: 1765372 - RNA, 15 nt, Salmonella enterica enterica serovar Typhi Ty2
gauaaaccaacagcc

SEQ ID NO: 1765373 - RNA, 15 nt, Salmonella enterica enterica serovar Typhi Ty2
gauaaaccaggcagc

SEQ ID NO: 1765374 - RNA, 21 nt, Salmonella enterica enterica serovar Typhi Ty2
gauaaacccguaaagcauucc

SEQ ID NO: 1765375 - RNA, 19 nt, Salmonella enterica enterica serovar Typhi Ty2
gauaaacgcgucuucauca

SEQ ID NO: 1765376 - RNA, 16 nt, Salmonella enterica enterica serovar Typhi Ty2
gauaaaacgcaggcag

SEQ ID NO: 1765377 - RNA, 19 nt, Salmonella enterica enterica serovar Typhi Ty2
gauaaaauccgaaaugacc

SEQ ID NO: 1765378 - RNA, 23 nt, Salmonella enterica enterica serovar Typhi Ty2
gaggcgcagccgccauccggcaa

SEQ ID NO: 1765379 - RNA, 14 nt, Salmonella enterica enterica serovar Typhi Ty2
gaggccuuuugcag

SEQ ID NO: 1765380 - RNA, 23 nt, Salmonella enterica enterica serovar Typhi Ty2
gaggggcacgcccgcauucauaa

SEQ ID NO: 1765381 - RNA, 17 nt, Salmonella enterica enterica serovar Typhi Ty2
gagggucaacaggcuga

SEQ ID NO: 1765382 - RNA, 22 nt, Salmonella enterica enterica serovar Typhi Ty2
gaggggcuuugugccgcacaga

SEQ ID NO: 1765383 - RNA, 20 nt, Salmonella enterica enterica serovar Typhi Ty2
gagggggaggugcugguggu

SEQ ID NO: 1765384 - RNA, 22 nt, Salmonella enterica enterica serovar Typhi Ty2
gaggguuuucaauuccacaggc

SEQ ID NO: 1765385 - RNA, 16 nt, Salmonella enterica enterica serovar Typhi Ty2
gaguaaugaccacacc

SEQ ID NO: 1765386 - RNA, 20 nt, Salmonella enterica enterica serovar Typhi Ty2
gaguaaucacuaacugacca

SEQ ID NO: 1765387 - RNA, 20 nt, Salmonella enterica enterica serovar Typhi Ty2
gaggaagcugcgcagcacuu

SEQ ID NO: 1765388 - RNA, 14 nt, Salmonella enterica enterica serovar Typhi Ty2
gagcuuuuuuuugc

SEQ ID NO: 1765389 - RNA, 16 nt, Salmonella enterica enterica serovar Typhi Ty2
gagcuuuuuuuugcau

SEQ ID NO: 1765390 - RNA, 20 nt, Salmonella enterica enterica serovar Typhi Ty2
gaggcauaccgcccagaacg

SEQ ID NO: 1765391 - RNA, 16 nt, Salmonella enterica enterica serovar Typhi Ty2
gaggccggcccugcgg

SEQ ID NO: 1765392 - RNA, 18 nt, Salmonella enterica enterica serovar Typhi Ty2
gaggccagauucaccacc

SEQ ID NO: 1765393 - RNA, 14 nt, Salmonella enterica enterica serovar Typhi Ty2
gaucccuaauaaaa

SEQ ID NO: 1765394 - RNA, 20 nt, Salmonella enterica enterica serovar Typhi Ty2
gauccccucuuccaucagcc

SEQ ID NO: 1765395 - RNA, 15 nt, Salmonella enterica enterica serovar Typhi Ty2
gaucccgcgcgccuc

SEQ ID NO: 1765396 - RNA, 21 nt, Salmonella enterica enterica serovar Typhi Ty2
gauccgacaugaugccaaaua

SEQ ID NO: 1765397 - RNA, 19 nt, Salmonella enterica enterica serovar Typhi Ty2
gauccgacaugaugccaaa

SEQ ID NO: 1765398 - RNA, 21 nt, Salmonella enterica enterica serovar Typhi Ty2
gauccggcauccaaccgaaca

SEQ ID NO: 1765399 - RNA, 18 nt, Salmonella enterica enterica serovar Typhi Ty2
gauccggcuguuccagua

SEQ ID NO: 1765400 - RNA, 22 nt, Salmonella enterica enterica serovar Typhi Ty2
gauccagcgauugacgguuugu

SEQ ID NO: 1765401 - RNA, 12 nt, Salmonella enterica enterica serovar Typhi Ty2
gauccagaaccg

SEQ ID NO: 1765402 - RNA, 16 nt, Salmonella enterica enterica serovar Typhi Ty2
gauccaggucuuccgc

SEQ ID NO: 1765403 - RNA, 22 nt, Salmonella enterica enterica serovar Typhi Ty2
gaucccagcgaacugauaaaag

SEQ ID NO: 1765404 - RNA, 19 nt, Salmonella enterica enterica serovar Typhi Ty2
gaucauuggggaaccuggc

SEQ ID NO: 1765405 - RNA, 22 nt, Salmonella enterica enterica serovar Typhi Ty2
aaagccgcccugcggacaggcg

SEQ ID NO: 1765406 - RNA, 24 nt, Salmonella enterica enterica serovar Typhi Ty2
aaagccgcgucgcaccugcucuuu

SEQ ID NO: 1765407 - RNA, 15 nt, Salmonella enterica enterica serovar Typhi Ty2
gauccuucauucaga

SEQ ID NO: 1765408 - RNA, 19 nt, Salmonella enterica enterica serovar Typhi Ty2
gauccuguucaaacaucag

SEQ ID NO: 1765409 - RNA, 15 nt, Salmonella enterica enterica serovar Typhi Ty2
gaucgacaaugauca

SEQ ID NO: 1765410 - RNA, 17 nt, Salmonella enterica enterica serovar Typhi Ty2
gaucgacaaugaucaga

SEQ ID NO: 1765411 - RNA, 14 nt, Salmonella enterica enterica serovar Typhi Ty2
gaucgacaucuuca

SEQ ID NO: 1765412 - RNA, 15 nt, Salmonella enterica enterica serovar Typhi Ty2
gaucgacaucuucau

SEQ ID NO: 1765413 - RNA, 18 nt, Salmonella enterica enterica serovar Typhi Ty2
gaucgaaugaaaauguau

SEQ ID NO: 1765414 - RNA, 18 nt, Salmonella enterica enterica serovar Typhi Ty2
gaucgacaaaccacugcu

SEQ ID NO: 1765415 - RNA, 13 nt, Salmonella enterica enterica serovar Typhi Ty2
gaucgacaaugau

SEQ ID NO: 1765416 - RNA, 20 nt, Salmonella enterica enterica serovar Typhi Ty2
gaucgaucucgauauucaca

SEQ ID NO: 1765417 - RNA, 20 nt, Salmonella enterica enterica serovar Typhi Ty2
gaucgauagcgacggcgcgc

SEQ ID NO: 1765418 - RNA, 16 nt, Salmonella enterica enterica serovar Typhi Ty2
gaucgaggucagcauu

SEQ ID NO: 1765419 - RNA, 20 nt, Salmonella enterica enterica serovar Typhi Ty2
gaucgacuaauuuuaggaag

SEQ ID NO: 1765420 - RNA, 20 nt, Salmonella enterica enterica serovar Typhi Ty2
gaucgcaagauccugauauu

SEQ ID NO: 1765421 - RNA, 22 nt, Salmonella enterica enterica serovar Typhi Ty2
gauccguucgaucagcuggcuu

SEQ ID NO: 1765422 - RNA, 16 nt, Salmonella enterica enterica serovar Typhi Ty2
gauccugcaacagcac

SEQ ID NO: 1765423 - RNA, 18 nt, Salmonella enterica enterica serovar Typhi Ty2
gauccugcggcauuagca

SEQ ID NO: 1765424 - RNA, 17 nt, Salmonella enterica enterica serovar Typhi Ty2
aaagccacgcaagcagc

SEQ ID NO: 1765425 - RNA, 23 nt, Salmonella enterica enterica serovar Typhi Ty2
aaagccaucuucgguaauacaau

SEQ ID NO: 1765426 - RNA, 19 nt, Salmonella enterica enterica serovar Typhi Ty2
aaagccaguuucucuucuu

SEQ ID NO: 1765427 - RNA, 20 nt, Salmonella enterica enterica serovar Typhi Ty2
aaagccaguuucucuucuuu

SEQ ID NO: 1765428 - RNA, 13 nt, Salmonella enterica enterica serovar Typhi Ty2
aaagcccaucagc

SEQ ID NO: 1765429 - RNA, 23 nt, Salmonella enterica enterica serovar Typhi Ty2
aaagccccuuccucgggaggggc

SEQ ID NO: 1765430 - RNA, 17 nt, Salmonella enterica enterica serovar Typhi Ty2
gaucgccauccugcacc

SEQ ID NO: 1765431 - RNA, 23 nt, Salmonella enterica enterica serovar Typhi Ty2
gaucgccgccgcgagcagcgaaa

SEQ ID NO: 1765432 - RNA, 21 nt, Salmonella enterica enterica serovar Typhi Ty2
gaucgcgcucccggccaauca

SEQ ID NO: 1765433 - RNA, 16 nt, Salmonella enterica enterica serovar Typhi Ty2
gaucgcguacagcgcc

SEQ ID NO: 1765434 - RNA, 14 nt, Salmonella enterica enterica serovar Typhi Ty2
gaucgguuuauccc

SEQ ID NO: 1765435 - RNA, 17 nt, Salmonella enterica enterica serovar Typhi Ty2
gaucggcuuuaucuuua

SEQ ID NO: 1765436 - RNA, 21 nt, Salmonella enterica enterica serovar Typhi Ty2
gaucggccagauaguggcuga

SEQ ID NO: 1765437 - RNA, 16 nt, Salmonella enterica enterica serovar Typhi Ty2
gaucguaggcggcgga

SEQ ID NO: 1765438 - RNA, 22 nt, Salmonella enterica enterica serovar Typhi Ty2
gaucguaaagcgcauccagcuc

SEQ ID NO: 1765439 - RNA, 21 nt, Salmonella enterica enterica serovar Typhi Ty2
gaucguaugcagccaggccau

SEQ ID NO: 1765440 - RNA, 16 nt, Salmonella enterica enterica serovar Typhi Ty2
gaucguagccauguuc

SEQ ID NO: 1765441 - RNA, 20 nt, Salmonella enterica enterica serovar Typhi Ty2
gaucgucauauguugcgcuu

SEQ ID NO: 1765442 - RNA, 19 nt, Salmonella enterica enterica serovar Typhi Ty2
gaucguuauuaaacagaca

SEQ ID NO: 1765443 - RNA, 20 nt, Salmonella enterica enterica serovar Typhi Ty2
gaucuggcgcuuuuccagca

SEQ ID NO: 1765444 - RNA, 16 nt, Salmonella enterica enterica serovar Typhi Ty2
gaucuggcggcgaaag

SEQ ID NO: 1765445 - RNA, 15 nt, Salmonella enterica enterica serovar Typhi Ty2
gaucuggccgucugg

SEQ ID NO: 1765446 - RNA, 18 nt, Salmonella enterica enterica serovar Typhi Ty2
gaucugcuuaugaucgcc

SEQ ID NO: 1765447 - RNA, 20 nt, Salmonella enterica enterica serovar Typhi Ty2
gaucugcuugagcaggcaga

SEQ ID NO: 1765448 - RNA, 22 nt, Salmonella enterica enterica serovar Typhi Ty2
gaucucuugcauaauauccagg

SEQ ID NO: 1765449 - RNA, 17 nt, Salmonella enterica enterica serovar Typhi Ty2
gaucucgauauucacac

SEQ ID NO: 1765450 - RNA, 12 nt, Salmonella enterica enterica serovar Typhi Ty2
gaucuccagaag

SEQ ID NO: 1765451 - RNA, 15 nt, Salmonella enterica enterica serovar Typhi Ty2
gaucuacaaucgucu

SEQ ID NO: 1765452 - RNA, 21 nt, Salmonella enterica enterica serovar Typhi Ty2
gaucuacgcuauuuccagaaa

SEQ ID NO: 1765453 - RNA, 14 nt, Salmonella enterica enterica serovar Typhi Ty2
gaucuaaagccagu

SEQ ID NO: 1765454 - RNA, 17 nt, Salmonella enterica enterica serovar Typhi Ty2
gaucuaaagccaguuuc

SEQ ID NO: 1765455 - RNA, 15 nt, Salmonella enterica enterica serovar Typhi Ty2
gaucucauaaacgcc

SEQ ID NO: 1765456 - RNA, 14 nt, Salmonella enterica enterica serovar Typhi Ty2
gaucauggcucaga

SEQ ID NO: 1765457 - RNA, 20 nt, Salmonella enterica enterica serovar Typhi Ty2
gaucaugccgcccaggccau

SEQ ID NO: 1765458 - RNA, 23 nt, Salmonella enterica enterica serovar Typhi Ty2
gaucaucuucacuucacaaacaa

SEQ ID NO: 1765459 - RNA, 12 nt, Salmonella enterica enterica serovar Typhi Ty2
gaucaucuuuua

SEQ ID NO: 1765460 - RNA, 17 nt, Salmonella enterica enterica serovar Typhi Ty2
gaucaugaaaaauauaa

SEQ ID NO: 1765461 - RNA, 20 nt, Salmonella enterica enterica serovar Typhi Ty2
gaucaucuucacuucacaaa

SEQ ID NO: 1765462 - RNA, 19 nt, Salmonella enterica enterica serovar Typhi Ty2
gaucauuaccugucgccca

SEQ ID NO: 1765463 - RNA, 21 nt, Salmonella enterica enterica serovar Typhi Ty2
gaucauaccggcagcagugag

SEQ ID NO: 1765464 - RNA, 15 nt, Salmonella enterica enterica serovar Typhi Ty2
gaucaucauggcuga

SEQ ID NO: 1765465 - RNA, 15 nt, Salmonella enterica enterica serovar Typhi Ty2
gaucagcgccacgca

SEQ ID NO: 1765466 - RNA, 18 nt, Salmonella enterica enterica serovar Typhi Ty2
gaucaggaaaucuuccag

SEQ ID NO: 1765467 - RNA, 20 nt, Salmonella enterica enterica serovar Typhi Ty2
gaucaggccgcagacggaga

SEQ ID NO: 1765468 - RNA, 19 nt, Salmonella enterica enterica serovar Typhi Ty2
gaucauaagggagcugacu

SEQ ID NO: 1765469 - RNA, 14 nt, Salmonella enterica enterica serovar Typhi Ty2
gaucaggucugaga

SEQ ID NO: 1765470 - RNA, 16 nt, Salmonella enterica enterica serovar Typhi Ty2
gaucaggcgucagcgg

SEQ ID NO: 1765471 - RNA, 13 nt, Salmonella enterica enterica serovar Typhi Ty2
gaucaggcuaaag

SEQ ID NO: 1765472 - RNA, 18 nt, Salmonella enterica enterica serovar Typhi Ty2
gaucaauaaaauuaucca

SEQ ID NO: 1765473 - RNA, 16 nt, Salmonella enterica enterica serovar Typhi Ty2
gaucacccacaucagc

SEQ ID NO: 1765474 - RNA, 17 nt, Salmonella enterica enterica serovar Typhi Ty2
gaucacccacaccacag

SEQ ID NO: 1765475 - RNA, 17 nt, Salmonella enterica enterica serovar Typhi Ty2
gaucaccaucuucacau

SEQ ID NO: 1765476 - RNA, 18 nt, Salmonella enterica enterica serovar Typhi Ty2
gaucacccacaucagcgg

SEQ ID NO: 1765477 - RNA, 14 nt, Salmonella enterica enterica serovar Typhi Ty2
gauauggcggcggc

SEQ ID NO: 1765478 - RNA, 20 nt, Salmonella enterica enterica serovar Typhi Ty2
gauauguauuuguucucgag

SEQ ID NO: 1765479 - RNA, 13 nt, Salmonella enterica enterica serovar Typhi Ty2
gauauuacagauc

SEQ ID NO: 1765480 - RNA, 21 nt, Salmonella enterica enterica serovar Typhi Ty2
gaucacuuccgccaccacgcc

SEQ ID NO: 1765481 - RNA, 20 nt, Salmonella enterica enterica serovar Typhi Ty2
gaucacuaccgccaucaaac

SEQ ID NO: 1765482 - RNA, 12 nt, Salmonella enterica enterica serovar Typhi Ty2
gaucacuuguuu

SEQ ID NO: 1765483 - RNA, 13 nt, Salmonella enterica enterica serovar Typhi Ty2
gaucagcaaaaua

SEQ ID NO: 1765484 - RNA, 21 nt, Salmonella enterica enterica serovar Typhi Ty2
gaucagcaccacgcccggauc

SEQ ID NO: 1765485 - RNA, 20 nt, Salmonella enterica enterica serovar Typhi Ty2
gaucagauauuccagcgaca

SEQ ID NO: 1765486 - RNA, 19 nt, Salmonella enterica enterica serovar Typhi Ty2
gaucagacuuuggauaaag

SEQ ID NO: 1765487 - RNA, 15 nt, Salmonella enterica enterica serovar Typhi Ty2
gaucagcagaacaaa

SEQ ID NO: 1765488 - RNA, 21 nt, Salmonella enterica enterica serovar Typhi Ty2
gauacugcaacgccagaugcg

SEQ ID NO: 1765489 - RNA, 17 nt, Salmonella enterica enterica serovar Typhi Ty2
gauacugcaacgccaga

SEQ ID NO: 1765490 - RNA, 12 nt, Salmonella enterica enterica serovar Typhi Ty2
gauacugcaacg

SEQ ID NO: 1765491 - RNA, 21 nt, Salmonella enterica enterica serovar Typhi Ty2
gauagacagcaccaucaugca

SEQ ID NO: 1765492 - RNA, 16 nt, Salmonella enterica enterica serovar Typhi Ty2
gauagagguuaccggg

SEQ ID NO: 1765493 - RNA, 19 nt, Salmonella enterica enterica serovar Typhi Ty2
gauagagaguuccuccugg

SEQ ID NO: 1765494 - RNA, 20 nt, Salmonella enterica enterica serovar Typhi Ty2
gauaagcgugcgccauccgg

SEQ ID NO: 1765495 - RNA, 21 nt, Salmonella enterica enterica serovar Typhi Ty2
gauaagccugugcgccugcug

SEQ ID NO: 1765496 - RNA, 21 nt, Salmonella enterica enterica serovar Typhi Ty2
gauaagcgcagcgccaucagg

SEQ ID NO: 1765497 - RNA, 19 nt, Salmonella enterica enterica serovar Typhi Ty2
gauaagaaagauaaaauac

SEQ ID NO: 1765498 - RNA, 23 nt, Salmonella enterica enterica serovar Typhi Ty2
gauaacuuccuuugccuuucuua

SEQ ID NO: 1765499 - RNA, 20 nt, Salmonella enterica enterica serovar Typhi Ty2
gauaacugaagguuuuuccc

SEQ ID NO: 1765500 - RNA, 13 nt, Salmonella enterica enterica serovar Typhi Ty2
gauaagagaaaau

SEQ ID NO: 1765501 - RNA, 15 nt, Salmonella enterica enterica serovar Typhi Ty2
gauaagagaaaauac

SEQ ID NO: 1765502 - RNA, 21 nt, Salmonella enterica enterica serovar Typhi Ty2
gauagcaaucauccugauuuu

SEQ ID NO: 1765503 - RNA, 22 nt, Salmonella enterica enterica serovar Typhi Ty2
gauagagguuaccgggcuaaac

SEQ ID NO: 1765504 - RNA, 13 nt, Salmonella enterica enterica serovar Typhi Ty2
gauagggcagcag

SEQ ID NO: 1765505 - RNA, 14 nt, Salmonella enterica enterica serovar Typhi Ty2
gauagggcagcagu

SEQ ID NO: 1765506 - RNA, 16 nt, Salmonella enterica enterica serovar Typhi Ty2
gauagggcagcaguuc

SEQ ID NO: 1765507 - RNA, 22 nt, Salmonella enterica enterica serovar Typhi Ty2
gauagguucaauaugccaggca

SEQ ID NO: 1765508 - RNA, 18 nt, Salmonella enterica enterica serovar Typhi Ty2
gauagucauugacagcaa

SEQ ID NO: 1765509 - RNA, 20 nt, Salmonella enterica enterica serovar Typhi Ty2
gauagugucgccauaaauca

SEQ ID NO: 1765510 - RNA, 22 nt, Salmonella enterica enterica serovar Typhi Ty2
gauauaccaugcugccauuuua

SEQ ID NO: 1765511 - RNA, 21 nt, Salmonella enterica enterica serovar Typhi Ty2
gauauagcugcgauccagguc

SEQ ID NO: 1765512 - RNA, 18 nt, Salmonella enterica enterica serovar Typhi Ty2
gauauaucgcgucaucaa

SEQ ID NO: 1765513 - RNA, 13 nt, Salmonella enterica enterica serovar Typhi Ty2
gauauaugcaaaa

SEQ ID NO: 1765514 - RNA, 13 nt, Salmonella enterica enterica serovar Typhi Ty2
gauaucugccgcg

SEQ ID NO: 1765515 - RNA, 14 nt, Salmonella enterica enterica serovar Typhi Ty2
gauaugaauaauuu

SEQ ID NO: 1765516 - RNA, 18 nt, Salmonella enterica enterica serovar Typhi Ty2
gauaugaccaguacaggc

SEQ ID NO: 1765517 - RNA, 18 nt, Salmonella enterica enterica serovar Typhi Ty2
gauaugcgacgaaagcgg

SEQ ID NO: 1765518 - RNA, 21 nt, Salmonella enterica enterica serovar Typhi Ty2
gauaugcggucguauuaccaa

SEQ ID NO: 1765519 - RNA, 17 nt, Salmonella enterica enterica serovar Typhi Ty2
gauauggaugcgcugcu

SEQ ID NO: 1765520 - RNA, 13 nt, Salmonella enterica enterica serovar Typhi Ty2
gauauggcaaacg

SEQ ID NO: 1765521 - RNA, 13 nt, Salmonella enterica enterica serovar Typhi Ty2
gauaugcagcagc

SEQ ID NO: 1765522 - RNA, 18 nt, Salmonella enterica enterica serovar Typhi Ty2
cuuucccuuuuuaaaaug

SEQ ID NO: 1765523 - RNA, 17 nt, Salmonella enterica enterica serovar Typhi Ty2
cuuucccguuucagccc

SEQ ID NO: 1765524 - RNA, 17 nt, Salmonella enterica enterica serovar Typhi Ty2
cuuuccgccaugaaaaa

SEQ ID NO: 1765525 - RNA, 19 nt, Salmonella enterica enterica serovar Typhi Ty2
cuuuccgccaugaaaaaaa

SEQ ID NO: 1765526 - RNA, 18 nt, Salmonella enterica enterica serovar Typhi Ty2
cuuucauuacgcuuccug

SEQ ID NO: 1765527 - RNA, 12 nt, Salmonella enterica enterica serovar Typhi Ty2
cuuucaucuuua

SEQ ID NO: 1765528 - RNA, 13 nt, Salmonella enterica enterica serovar Typhi Ty2
cuuucaucaaacg

SEQ ID NO: 1765529 - RNA, 16 nt, Salmonella enterica enterica serovar Typhi Ty2
cuuucauuucuuuaau

SEQ ID NO: 1765530 - RNA, 21 nt, Salmonella enterica enterica serovar Typhi Ty2
cuuucauuggauaaaguuuuc

SEQ ID NO: 1765531 - RNA, 13 nt, Salmonella enterica enterica serovar Typhi Ty2
cuuucauuucacu

SEQ ID NO: 1765532 - RNA, 18 nt, Salmonella enterica enterica serovar Typhi Ty2
cuuuccccaaagguguua

SEQ ID NO: 1765533 - RNA, 20 nt, Salmonella enterica enterica serovar Typhi Ty2
cuuucuuuuuauauuccccu

SEQ ID NO: 1765534 - RNA, 14 nt, Salmonella enterica enterica serovar Typhi Ty2
cuuugaaaaucaca

SEQ ID NO: 1765535 - RNA, 12 nt, Salmonella enterica enterica serovar Typhi Ty2
cuuucuugccac

SEQ ID NO: 1765536 - RNA, 18 nt, Salmonella enterica enterica serovar Typhi Ty2
cuuucuugccacuggccu

SEQ ID NO: 1765537 - RNA, 11 nt, Salmonella enterica enterica serovar Typhi Ty2
cuuucuuucuc

SEQ ID NO: 1765538 - RNA, 16 nt, Salmonella enterica enterica serovar Typhi Ty2
cuuucuuuacaugacc

SEQ ID NO: 1765539 - RNA, 19 nt, Salmonella enterica enterica serovar Typhi Ty2
cuuucuuccagguuaaccc

SEQ ID NO: 1765540 - RNA, 15 nt, Salmonella enterica enterica serovar Typhi Ty2
cuuucuucccggcag

SEQ ID NO: 1765541 - RNA, 18 nt, Salmonella enterica enterica serovar Typhi Ty2
cuuucucgggccuguucc

SEQ ID NO: 1765542 - RNA, 13 nt, Salmonella enterica enterica serovar Typhi Ty2
cuuucucgggccu

SEQ ID NO: 1765543 - RNA, 20 nt, Salmonella enterica enterica serovar Typhi Ty2
cuuucucgaauccacuuuug

SEQ ID NO: 1765544 - RNA, 22 nt, Salmonella enterica enterica serovar Typhi Ty2
cuuugucgcgguuaaggaugua

SEQ ID NO: 1765545 - RNA, 18 nt, Salmonella enterica enterica serovar Typhi Ty2
cuuugucauccaccagaa

SEQ ID NO: 1765546 - RNA, 14 nt, Salmonella enterica enterica serovar Typhi Ty2
cuuugucaccggag

SEQ ID NO: 1765547 - RNA, 11 nt, Salmonella enterica enterica serovar Typhi Ty2
cuuugcugcug

SEQ ID NO: 1765548 - RNA, 20 nt, Salmonella enterica enterica serovar Typhi Ty2
cuuugacgccgggaaauuuu

SEQ ID NO: 1765549 - RNA, 21 nt, Salmonella enterica enterica serovar Typhi Ty2
cuuugacccacgccagcagcu

SEQ ID NO: 1765550 - RNA, 22 nt, Salmonella enterica enterica serovar Typhi Ty2
cuuugaccagcaucgccgguag

SEQ ID NO: 1765551 - RNA, 21 nt, Salmonella enterica enterica serovar Typhi Ty2
cuuugaccauuaccauuccuc

SEQ ID NO: 1765552 - RNA, 18 nt, Salmonella enterica enterica serovar Typhi Ty2
cuuugacgacccgcuucc

SEQ ID NO: 1765553 - RNA, 17 nt, Salmonella enterica enterica serovar Typhi Ty2
cuuugcguaaaaaacau

SEQ ID NO: 1765554 - RNA, 12 nt, Salmonella enterica enterica serovar Typhi Ty2
cuuugcucuccu

SEQ ID NO: 1765555 - RNA, 20 nt, Salmonella enterica enterica serovar Typhi Ty2
cuuugcacagucugcagacc

SEQ ID NO: 1765556 - RNA, 13 nt, Salmonella enterica enterica serovar Typhi Ty2
cuuuauucauuuc

SEQ ID NO: 1765557 - RNA, 21 nt, Salmonella enterica enterica serovar Typhi Ty2
cuuuauccagcggcgcgcggu

SEQ ID NO: 1765558 - RNA, 13 nt, Salmonella enterica enterica serovar Typhi Ty2
cuuuauauaaaaa

SEQ ID NO: 1765559 - RNA, 16 nt, Salmonella enterica enterica serovar Typhi Ty2
cuuuauauaaaaaaug

SEQ ID NO: 1765560 - RNA, 21 nt, Salmonella enterica enterica serovar Typhi Ty2
cuuuaggguaucauuuccaca

SEQ ID NO: 1765561 - RNA, 21 nt, Salmonella enterica enterica serovar Typhi Ty2
cuuuagauaauuucgcauaau

SEQ ID NO: 1765562 - RNA, 20 nt, Salmonella enterica enterica serovar Typhi Ty2
cuuucaguuucggccccccc

SEQ ID NO: 1765563 - RNA, 20 nt, Salmonella enterica enterica serovar Typhi Ty2
cuuucagccgacuaucuucu

SEQ ID NO: 1765564 - RNA, 13 nt, Salmonella enterica enterica serovar Typhi Ty2
cuuucaccgccuc

SEQ ID NO: 1765565 - RNA, 22 nt, Salmonella enterica enterica serovar Typhi Ty2
cuuucagccgacuaucuucuuc

SEQ ID NO: 1765566 - RNA, 12 nt, Salmonella enterica enterica serovar Typhi Ty2
cuuucagcucuu

SEQ ID NO: 1765567 - RNA, 17 nt, Salmonella enterica enterica serovar Typhi Ty2
cuuucaggaauuuauca

SEQ ID NO: 1765568 - RNA, 24 nt, Salmonella enterica enterica serovar Typhi Ty2
cuuucaccagugauuggcuggaca

SEQ ID NO: 1765569 - RNA, 18 nt, Salmonella enterica enterica serovar Typhi Ty2
cuucggacuccugacgcu

SEQ ID NO: 1765570 - RNA, 19 nt, Salmonella enterica enterica serovar Typhi Ty2
cuucgcuuaucaggccuac

SEQ ID NO: 1765571 - RNA, 14 nt, Salmonella enterica enterica serovar Typhi Ty2
cuucgcucugaauc

SEQ ID NO: 1765572 - RNA, 18 nt, Salmonella enterica enterica serovar Typhi Ty2
cuucgcguuuaucaccaa

SEQ ID NO: 1765573 - RNA, 19 nt, Salmonella enterica enterica serovar Typhi Ty2
aaagaccauccgguuuuaa

SEQ ID NO: 1765574 - RNA, 16 nt, Salmonella enterica enterica serovar Typhi Ty2
cuuuaaaugccuguuu

SEQ ID NO: 1765575 - RNA, 15 nt, Salmonella enterica enterica serovar Typhi Ty2
aaagaccaauacuga

SEQ ID NO: 1765576 - RNA, 23 nt, Salmonella enterica enterica serovar Typhi Ty2
cuucggcgggaucuccagaagca

SEQ ID NO: 1765577 - RNA, 14 nt, Salmonella enterica enterica serovar Typhi Ty2
cuucggccuccgcu

SEQ ID NO: 1765578 - RNA, 13 nt, Salmonella enterica enterica serovar Typhi Ty2
cuuuaauauucau

SEQ ID NO: 1765579 - RNA, 18 nt, Salmonella enterica enterica serovar Typhi Ty2
cuuuaaugauguccagaa

SEQ ID NO: 1765580 - RNA, 15 nt, Salmonella enterica enterica serovar Typhi Ty2
cuuuaacaauuuauc

SEQ ID NO: 1765581 - RNA, 17 nt, Salmonella enterica enterica serovar Typhi Ty2
cuuuacccuuacggcca

SEQ ID NO: 1765582 - RNA, 22 nt, Salmonella enterica enterica serovar Typhi Ty2
cuuuaaugcccgguauuuuuuc

SEQ ID NO: 1765583 - RNA, 18 nt, Salmonella enterica enterica serovar Typhi Ty2
gaaaaccacaaucacagc

SEQ ID NO: 1765584 - RNA, 11 nt, Salmonella enterica enterica serovar Typhi Ty2
gaaaacaucac

SEQ ID NO: 1765585 - RNA, 16 nt, Salmonella enterica enterica serovar Typhi Ty2
gaaaacagcgccggca

SEQ ID NO: 1765586 - RNA, 22 nt, Salmonella enterica enterica serovar Typhi Ty2
gaaaacggccagugaaauaaau

SEQ ID NO: 1765587 - RNA, 17 nt, Salmonella enterica enterica serovar Typhi Ty2
gaaaauaccgcacauca

SEQ ID NO: 1765588 - RNA, 13 nt, Salmonella enterica enterica serovar Typhi Ty2
gaaaauacucccg

SEQ ID NO: 1765589 - RNA, 22 nt, Salmonella enterica enterica serovar Typhi Ty2
gaaaaucacuaucaguuuuggc

SEQ ID NO: 1765590 - RNA, 16 nt, Salmonella enterica enterica serovar Typhi Ty2
gaaaagcagccagacc

SEQ ID NO: 1765591 - RNA, 19 nt, Salmonella enterica enterica serovar Typhi Ty2
gaaaauaacaauauuaaau

SEQ ID NO: 1765592 - RNA, 12 nt, Salmonella enterica enterica serovar Typhi Ty2
gaaaacugcgcc

SEQ ID NO: 1765593 - RNA, 12 nt, Salmonella enterica enterica serovar Typhi Ty2
gaaaagcagagg

SEQ ID NO: 1765594 - RNA, 12 nt, Salmonella enterica enterica serovar Typhi Ty2
cuuuuuuaaacg

SEQ ID NO: 1765595 - RNA, 13 nt, Salmonella enterica enterica serovar Typhi Ty2
cuuuuuuaacgau

SEQ ID NO: 1765596 - RNA, 19 nt, Salmonella enterica enterica serovar Typhi Ty2
cuuuuuuaacgauuucccc

SEQ ID NO: 1765597 - RNA, 16 nt, Salmonella enterica enterica serovar Typhi Ty2
cuuuuuccugccauug

SEQ ID NO: 1765598 - RNA, 15 nt, Salmonella enterica enterica serovar Typhi Ty2
cuuuuucggcuggca

SEQ ID NO: 1765599 - RNA, 15 nt, Salmonella enterica enterica serovar Typhi Ty2
cuuuuuuauugccug

SEQ ID NO: 1765600 - RNA, 14 nt, Salmonella enterica enterica serovar Typhi Ty2
cuuuuuuaugcugu

SEQ ID NO: 1765601 - RNA, 17 nt, Salmonella enterica enterica serovar Typhi Ty2
gaaaaaacucaggaaau

SEQ ID NO: 1765602 - RNA, 14 nt, Salmonella enterica enterica serovar Typhi Ty2
gaaaaaaauccagu

SEQ ID NO: 1765603 - RNA, 14 nt, Salmonella enterica enterica serovar Typhi Ty2
gaaaaagcaauaau

SEQ ID NO: 1765604 - RNA, 14 nt, Salmonella enterica enterica serovar Typhi Ty2
gaaaaagggaaaag

SEQ ID NO: 1765605 - RNA, 16 nt, Salmonella enterica enterica serovar Typhi Ty2
gaaaaagggaauaaua

SEQ ID NO: 1765606 - RNA, 14 nt, Salmonella enterica enterica serovar Typhi Ty2
gaaaacaaauugca

SEQ ID NO: 1765607 - RNA, 22 nt, Salmonella enterica enterica serovar Typhi Ty2
cuuuuaacaaaucgacagccag

SEQ ID NO: 1765608 - RNA, 14 nt, Salmonella enterica enterica serovar Typhi Ty2
cuuuuaacaaaucg

SEQ ID NO: 1765609 - RNA, 23 nt, Salmonella enterica enterica serovar Typhi Ty2
cuuuuaaacgugcggcggccucu

SEQ ID NO: 1765610 - RNA, 23 nt, Salmonella enterica enterica serovar Typhi Ty2
cuuuuaacauaagugauacaugc

SEQ ID NO: 1765611 - RNA, 23 nt, Salmonella enterica enterica serovar Typhi Ty2
cuuuuacaggccggacaggcgac

SEQ ID NO: 1765612 - RNA, 19 nt, Salmonella enterica enterica serovar Typhi Ty2
cuuuuagaauuaucugaaa

SEQ ID NO: 1765613 - RNA, 21 nt, Salmonella enterica enterica serovar Typhi Ty2
cuuuuacucuuccugcugcgc

SEQ ID NO: 1765614 - RNA, 23 nt, Salmonella enterica enterica serovar Typhi Ty2
cuuuuccaguaagaucaccuucu

SEQ ID NO: 1765615 - RNA, 17 nt, Salmonella enterica enterica serovar Typhi Ty2
cuuuuccaggcgaccag

SEQ ID NO: 1765616 - RNA, 15 nt, Salmonella enterica enterica serovar Typhi Ty2
cuuuuccugcugcca

SEQ ID NO: 1765617 - RNA, 12 nt, Salmonella enterica enterica serovar Typhi Ty2
cuuuuccuucca

SEQ ID NO: 1765618 - RNA, 22 nt, Salmonella enterica enterica serovar Typhi Ty2
cuuuucauccacagcgccagaa

SEQ ID NO: 1765619 - RNA, 18 nt, Salmonella enterica enterica serovar Typhi Ty2
cuuuucaggcgcugucug

SEQ ID NO: 1765620 - RNA, 22 nt, Salmonella enterica enterica serovar Typhi Ty2
cuuuucugucguguccuugcca

SEQ ID NO: 1765621 - RNA, 15 nt, Salmonella enterica enterica serovar Typhi Ty2
cuuuucuggcuucag

SEQ ID NO: 1765622 - RNA, 14 nt, Salmonella enterica enterica serovar Typhi Ty2
aaagaccuucuugc

SEQ ID NO: 1765623 - RNA, 13 nt, Salmonella enterica enterica serovar Typhi Ty2
aaagacgccaugg

SEQ ID NO: 1765624 - RNA, 16 nt, Salmonella enterica enterica serovar Typhi Ty2
cuuuucgggcacuggc

SEQ ID NO: 1765625 - RNA, 16 nt, Salmonella enterica enterica serovar Typhi Ty2
cuuuucggguaaauca

SEQ ID NO: 1765626 - RNA, 18 nt, Salmonella enterica enterica serovar Typhi Ty2
cuuuucggguguccacuc

SEQ ID NO: 1765627 - RNA, 22 nt, Salmonella enterica enterica serovar Typhi Ty2
cuuuucgcaauagggggugaca

SEQ ID NO: 1765628 - RNA, 14 nt, Salmonella enterica enterica serovar Typhi Ty2
cuuuucuagccaau

SEQ ID NO: 1765629 - RNA, 23 nt, Salmonella enterica enterica serovar Typhi Ty2
cuuuucucucucguucccgccug

SEQ ID NO: 1765630 - RNA, 20 nt, Salmonella enterica enterica serovar Typhi Ty2
cuuuugcgcguuccccaaca

SEQ ID NO: 1765631 - RNA, 19 nt, Salmonella enterica enterica serovar Typhi Ty2
cuuuugcgccuuccaguuc

SEQ ID NO: 1765632 - RNA, 14 nt, Salmonella enterica enterica serovar Typhi Ty2
cuuuugcuuccagu

SEQ ID NO: 1765633 - RNA, 15 nt, Salmonella enterica enterica serovar Typhi Ty2
cuuuugucggccugu

SEQ ID NO: 1765634 - RNA, 19 nt, Salmonella enterica enterica serovar Typhi Ty2
cuuuugucggccuguucuu

SEQ ID NO: 1765635 - RNA, 11 nt, Salmonella enterica enterica serovar Typhi Ty2
cuuuugcagcg

SEQ ID NO: 1765636 - RNA, 13 nt, Salmonella enterica enterica serovar Typhi Ty2
cuuuugccgcgcc

SEQ ID NO: 1765637 - RNA, 18 nt, Salmonella enterica enterica serovar Typhi Ty2
cuuuugccgucaggucau

SEQ ID NO: 1765638 - RNA, 23 nt, Salmonella enterica enterica serovar Typhi Ty2
cuuuugccgcgacuuccgucucc

SEQ ID NO: 1765639 - RNA, 16 nt, Salmonella enterica enterica serovar Typhi Ty2
cuuuugcgccuuccag

SEQ ID NO: 1765640 - RNA, 15 nt, Salmonella enterica enterica serovar Typhi Ty2
gaaccuuacggcuca

SEQ ID NO: 1765641 - RNA, 15 nt, Salmonella enterica enterica serovar Typhi Ty2
gaacgagaggaggag

SEQ ID NO: 1765642 - RNA, 18 nt, Salmonella enterica enterica serovar Typhi Ty2
gaaccguggccuccggca

SEQ ID NO: 1765643 - RNA, 15 nt, Salmonella enterica enterica serovar Typhi Ty2
gaaccguggccuccg

SEQ ID NO: 1765644 - RNA, 18 nt, Salmonella enterica enterica serovar Typhi Ty2
gaaccguaaacgccugca

SEQ ID NO: 1765645 - RNA, 20 nt, Salmonella enterica enterica serovar Typhi Ty2
gaaccguaaacgccugcacc

SEQ ID NO: 1765646 - RNA, 20 nt, Salmonella enterica enterica serovar Typhi Ty2
gaaccggguauugaauccau

SEQ ID NO: 1765647 - RNA, 18 nt, Salmonella enterica enterica serovar Typhi Ty2
gaaccgccgacccccucc

SEQ ID NO: 1765648 - RNA, 13 nt, Salmonella enterica enterica serovar Typhi Ty2
gaaccgccgaccc

SEQ ID NO: 1765649 - RNA, 19 nt, Salmonella enterica enterica serovar Typhi Ty2
gaaccgaauaacgccaggu

SEQ ID NO: 1765650 - RNA, 17 nt, Salmonella enterica enterica serovar Typhi Ty2
gaacccucgaaugugaa

SEQ ID NO: 1765651 - RNA, 14 nt, Salmonella enterica enterica serovar Typhi Ty2
gaacccugccugcc

SEQ ID NO: 1765652 - RNA, 16 nt, Salmonella enterica enterica serovar Typhi Ty2
gaaccaucauuaauau

SEQ ID NO: 1765653 - RNA, 22 nt, Salmonella enterica enterica serovar Typhi Ty2
gaaccaucauuaauauaauccu

SEQ ID NO: 1765654 - RNA, 23 nt, Salmonella enterica enterica serovar Typhi Ty2
gaaccauuuccucugcggacggc

SEQ ID NO: 1765655 - RNA, 16 nt, Salmonella enterica enterica serovar Typhi Ty2
gaaccauuuuccccag

SEQ ID NO: 1765656 - RNA, 20 nt, Salmonella enterica enterica serovar Typhi Ty2
gaacccaucagggaaaaaug

SEQ ID NO: 1765657 - RNA, 15 nt, Salmonella enterica enterica serovar Typhi Ty2
gaaccaacagcuggg

SEQ ID NO: 1765658 - RNA, 21 nt, Salmonella enterica enterica serovar Typhi Ty2
gaaccaauaguauggagcagg

SEQ ID NO: 1765659 - RNA, 18 nt, Salmonella enterica enterica serovar Typhi Ty2
gaaccaacugccaaacca

SEQ ID NO: 1765660 - RNA, 21 nt, Salmonella enterica enterica serovar Typhi Ty2
gaaccaacgcauaaaaacgug

SEQ ID NO: 1765661 - RNA, 19 nt, Salmonella enterica enterica serovar Typhi Ty2
gaacauugccccucccuga

SEQ ID NO: 1765662 - RNA, 16 nt, Salmonella enterica enterica serovar Typhi Ty2
gaaccacauagaguga

SEQ ID NO: 1765663 - RNA, 22 nt, Salmonella enterica enterica serovar Typhi Ty2
gaacauugccccucccugaauc

SEQ ID NO: 1765664 - RNA, 16 nt, Salmonella enterica enterica serovar Typhi Ty2
gaacauuuaagauuua

SEQ ID NO: 1765665 - RNA, 18 nt, Salmonella enterica enterica serovar Typhi Ty2
gaacaucacgaugaaagg

SEQ ID NO: 1765666 - RNA, 17 nt, Salmonella enterica enterica serovar Typhi Ty2
gaacaucacgaugaaag

SEQ ID NO: 1765667 - RNA, 18 nt, Salmonella enterica enterica serovar Typhi Ty2
gaacaucaagcgguagcg

SEQ ID NO: 1765668 - RNA, 15 nt, Salmonella enterica enterica serovar Typhi Ty2
gaacaucagccagca

SEQ ID NO: 1765669 - RNA, 20 nt, Salmonella enterica enterica serovar Typhi Ty2
gaacugaauagucggcugcu

SEQ ID NO: 1765670 - RNA, 21 nt, Salmonella enterica enterica serovar Typhi Ty2
gaacucuaugcaaaagaaaaa

SEQ ID NO: 1765671 - RNA, 18 nt, Salmonella enterica enterica serovar Typhi Ty2
gaacuggguaugcagugg

SEQ ID NO: 1765672 - RNA, 13 nt, Salmonella enterica enterica serovar Typhi Ty2
gaacuccagcgcg

SEQ ID NO: 1765673 - RNA, 19 nt, Salmonella enterica enterica serovar Typhi Ty2
gaacucccuguuccuguau

SEQ ID NO: 1765674 - RNA, 18 nt, Salmonella enterica enterica serovar Typhi Ty2
gaacuacugauuccugcc

SEQ ID NO: 1765675 - RNA, 22 nt, Salmonella enterica enterica serovar Typhi Ty2
gaacuacccuucaaggagaaaa

SEQ ID NO: 1765676 - RNA, 12 nt, Salmonella enterica enterica serovar Typhi Ty2
gaacgccaggcc

SEQ ID NO: 1765677 - RNA, 20 nt, Salmonella enterica enterica serovar Typhi Ty2
gaacgccgcuagcggcggcc

SEQ ID NO: 1765678 - RNA, 17 nt, Salmonella enterica enterica serovar Typhi Ty2
gaacgccuuauccggcc

SEQ ID NO: 1765679 - RNA, 15 nt, Salmonella enterica enterica serovar Typhi Ty2
gaacguuggcugggu

SEQ ID NO: 1765680 - RNA, 20 nt, Salmonella enterica enterica serovar Typhi Ty2
gaacgguucauccagcagca

SEQ ID NO: 1765681 - RNA, 22 nt, Salmonella enterica enterica serovar Typhi Ty2
gaacguccagcggccaguguac

SEQ ID NO: 1765682 - RNA, 19 nt, Salmonella enterica enterica serovar Typhi Ty2
gaacggcuuuccagcagcc

SEQ ID NO: 1765683 - RNA, 18 nt, Salmonella enterica enterica serovar Typhi Ty2
gaacggcuaggguggcgc

SEQ ID NO: 1765684 - RNA, 14 nt, Salmonella enterica enterica serovar Typhi Ty2
gaacgggugguuuc

SEQ ID NO: 1765685 - RNA, 15 nt, Salmonella enterica enterica serovar Typhi Ty2
gaacggcauaaucug

SEQ ID NO: 1765686 - RNA, 20 nt, Salmonella enterica enterica serovar Typhi Ty2
gaacaaugccauuauugcau

SEQ ID NO: 1765687 - RNA, 14 nt, Salmonella enterica enterica serovar Typhi Ty2
gaacacuaaaacac

SEQ ID NO: 1765688 - RNA, 17 nt, Salmonella enterica enterica serovar Typhi Ty2
gaacacucuaaaucuac

SEQ ID NO: 1765689 - RNA, 23 nt, Salmonella enterica enterica serovar Typhi Ty2
gaacacggacucgccuuucucca

SEQ ID NO: 1765690 - RNA, 14 nt, Salmonella enterica enterica serovar Typhi Ty2
gaacaaaagaaagc

SEQ ID NO: 1765691 - RNA, 19 nt, Salmonella enterica enterica serovar Typhi Ty2
gaacaaacagaccgccaug

SEQ ID NO: 1765692 - RNA, 20 nt, Salmonella enterica enterica serovar Typhi Ty2
gaacaaguucuucgaagcac

SEQ ID NO: 1765693 - RNA, 21 nt, Salmonella enterica enterica serovar Typhi Ty2
gaacaaguucuucgaagcacu

SEQ ID NO: 1765694 - RNA, 19 nt, Salmonella enterica enterica serovar Typhi Ty2
gaacaauagacgcuacugu

SEQ ID NO: 1765695 - RNA, 17 nt, Salmonella enterica enterica serovar Typhi Ty2
gaacagcgucauccagu

SEQ ID NO: 1765696 - RNA, 13 nt, Salmonella enterica enterica serovar Typhi Ty2
gaacagccaggcu

SEQ ID NO: 1765697 - RNA, 17 nt, Salmonella enterica enterica serovar Typhi Ty2
gaacauaaaaacgcgcu

SEQ ID NO: 1765698 - RNA, 17 nt, Salmonella enterica enterica serovar Typhi Ty2
gaacauaacgggaauaa

SEQ ID NO: 1765699 - RNA, 13 nt, Salmonella enterica enterica serovar Typhi Ty2
gaacauaugaagg

SEQ ID NO: 1765700 - RNA, 13 nt, Salmonella enterica enterica serovar Typhi Ty2
gaacaguuucucg

SEQ ID NO: 1765701 - RNA, 22 nt, Salmonella enterica enterica serovar Typhi Ty2
gaacauaccggagccugggauu

SEQ ID NO: 1765702 - RNA, 19 nt, Salmonella enterica enterica serovar Typhi Ty2
gaacaggccaaacccugcg

SEQ ID NO: 1765703 - RNA, 20 nt, Salmonella enterica enterica serovar Typhi Ty2
gaacagcuggugcggcauau

SEQ ID NO: 1765704 - RNA, 22 nt, Salmonella enterica enterica serovar Typhi Ty2
gaaaugagcgcgccaaccugcu

SEQ ID NO: 1765705 - RNA, 15 nt, Salmonella enterica enterica serovar Typhi Ty2
gaaaugagaaaagga

SEQ ID NO: 1765706 - RNA, 19 nt, Salmonella enterica enterica serovar Typhi Ty2
gaaaucuuucuccugguuu

SEQ ID NO: 1765707 - RNA, 16 nt, Salmonella enterica enterica serovar Typhi Ty2
gaaaugaaaaagauag

SEQ ID NO: 1765708 - RNA, 14 nt, Salmonella enterica enterica serovar Typhi Ty2
gaaaugaaaacucg

SEQ ID NO: 1765709 - RNA, 22 nt, Salmonella enterica enterica serovar Typhi Ty2
gaaaucgccgggcuauccggcu

SEQ ID NO: 1765710 - RNA, 16 nt, Salmonella enterica enterica serovar Typhi Ty2
gaaaucggcagcaccc

SEQ ID NO: 1765711 - RNA, 21 nt, Salmonella enterica enterica serovar Typhi Ty2
gaaaucgccgggcuauccggc

SEQ ID NO: 1765712 - RNA, 18 nt, Salmonella enterica enterica serovar Typhi Ty2
aaagagagcgccaaaaag

SEQ ID NO: 1765713 - RNA, 16 nt, Salmonella enterica enterica serovar Typhi Ty2
gaaaugauaagugaua

SEQ ID NO: 1765714 - RNA, 14 nt, Salmonella enterica enterica serovar Typhi Ty2
gaaauucucagaaa

SEQ ID NO: 1765715 - RNA, 17 nt, Salmonella enterica enterica serovar Typhi Ty2
gaaauucucagaaacaa

SEQ ID NO: 1765716 - RNA, 13 nt, Salmonella enterica enterica serovar Typhi Ty2
gaaauuugcagcg

SEQ ID NO: 1765717 - RNA, 13 nt, Salmonella enterica enterica serovar Typhi Ty2
gaaauugcagggu

SEQ ID NO: 1765718 - RNA, 17 nt, Salmonella enterica enterica serovar Typhi Ty2
gaaauuauccacaaacu

SEQ ID NO: 1765719 - RNA, 20 nt, Salmonella enterica enterica serovar Typhi Ty2
gaaauuauuccuuaucacau

SEQ ID NO: 1765720 - RNA, 13 nt, Salmonella enterica enterica serovar Typhi Ty2
gaaagcacuucuc

SEQ ID NO: 1765721 - RNA, 15 nt, Salmonella enterica enterica serovar Typhi Ty2
gaaagcaauacugua

SEQ ID NO: 1765722 - RNA, 15 nt, Salmonella enterica enterica serovar Typhi Ty2
gaaacugcugccgca

SEQ ID NO: 1765723 - RNA, 15 nt, Salmonella enterica enterica serovar Typhi Ty2
gaaacugccuaaauu

SEQ ID NO: 1765724 - RNA, 23 nt, Salmonella enterica enterica serovar Typhi Ty2
gaaacugauaguuuaaauccagc

SEQ ID NO: 1765725 - RNA, 21 nt, Salmonella enterica enterica serovar Typhi Ty2
gaaacugaaccaacagcuggg

SEQ ID NO: 1765726 - RNA, 19 nt, Salmonella enterica enterica serovar Typhi Ty2
gaaacuccuccgggaaaac

SEQ ID NO: 1765727 - RNA, 22 nt, Salmonella enterica enterica serovar Typhi Ty2
gaaacuccuccgggaaaacauc

SEQ ID NO: 1765728 - RNA, 21 nt, Salmonella enterica enterica serovar Typhi Ty2
gaaacuccuccgggaaaacau

SEQ ID NO: 1765729 - RNA, 14 nt, Salmonella enterica enterica serovar Typhi Ty2
gaaacucagcggcc

SEQ ID NO: 1765730 - RNA, 18 nt, Salmonella enterica enterica serovar Typhi Ty2
gaaacuccagcggcagga

SEQ ID NO: 1765731 - RNA, 18 nt, Salmonella enterica enterica serovar Typhi Ty2
gaaaaugcgccaggaaac

SEQ ID NO: 1765732 - RNA, 19 nt, Salmonella enterica enterica serovar Typhi Ty2
gaaaaugcguccagaggau

SEQ ID NO: 1765733 - RNA, 17 nt, Salmonella enterica enterica serovar Typhi Ty2
gaaaaugguuuugccca

SEQ ID NO: 1765734 - RNA, 13 nt, Salmonella enterica enterica serovar Typhi Ty2
gaaaaucggcggc

SEQ ID NO: 1765735 - RNA, 18 nt, Salmonella enterica enterica serovar Typhi Ty2
gaaaaucgcugcgcccga

SEQ ID NO: 1765736 - RNA, 18 nt, Salmonella enterica enterica serovar Typhi Ty2
gaaauauuauuccgguuc

SEQ ID NO: 1765737 - RNA, 23 nt, Salmonella enterica enterica serovar Typhi Ty2
gaaauagacgagcgaaaaacugu

SEQ ID NO: 1765738 - RNA, 23 nt, Salmonella enterica enterica serovar Typhi Ty2
gaaauaccaggcggcuuuuucau

SEQ ID NO: 1765739 - RNA, 19 nt, Salmonella enterica enterica serovar Typhi Ty2
gaaaucacaaacaccacca

SEQ ID NO: 1765740 - RNA, 13 nt, Salmonella enterica enterica serovar Typhi Ty2
gaaauauuugauc

SEQ ID NO: 1765741 - RNA, 19 nt, Salmonella enterica enterica serovar Typhi Ty2
gaaaucagagacaaauaca

SEQ ID NO: 1765742 - RNA, 17 nt, Salmonella enterica enterica serovar Typhi Ty2
gaaauccgcgucccagc

SEQ ID NO: 1765743 - RNA, 22 nt, Salmonella enterica enterica serovar Typhi Ty2
gaaaguaccaaaacagaaaaga

SEQ ID NO: 1765744 - RNA, 13 nt, Salmonella enterica enterica serovar Typhi Ty2
gaaauaacagacu

SEQ ID NO: 1765745 - RNA, 22 nt, Salmonella enterica enterica serovar Typhi Ty2
gaaauaaauauguuauuuacaa

SEQ ID NO: 1765746 - RNA, 17 nt, Salmonella enterica enterica serovar Typhi Ty2
gaaauaacgcacuacca

SEQ ID NO: 1765747 - RNA, 23 nt, Salmonella enterica enterica serovar Typhi Ty2
gaaauaacguuacauuuuccaug

SEQ ID NO: 1765748 - RNA, 20 nt, Salmonella enterica enterica serovar Typhi Ty2
gaaagcuguacuuugccggg

SEQ ID NO: 1765749 - RNA, 21 nt, Salmonella enterica enterica serovar Typhi Ty2
gaaagcuguacuuugccgggg

SEQ ID NO: 1765750 - RNA, 17 nt, Salmonella enterica enterica serovar Typhi Ty2
gaaagcggcgaauauag

SEQ ID NO: 1765751 - RNA, 18 nt, Salmonella enterica enterica serovar Typhi Ty2
gacaguauagaaauagcc

SEQ ID NO: 1765752 - RNA, 20 nt, Salmonella enterica enterica serovar Typhi Ty2
gacaggugcgcuguggucgu

SEQ ID NO: 1765753 - RNA, 20 nt, Salmonella enterica enterica serovar Typhi Ty2
gacagggcgugaaccagcau

SEQ ID NO: 1765754 - RNA, 22 nt, Salmonella enterica enterica serovar Typhi Ty2
gacagggcgugaaccagcaucc

SEQ ID NO: 1765755 - RNA, 18 nt, Salmonella enterica enterica serovar Typhi Ty2
gacaggggggaacagcaa

SEQ ID NO: 1765756 - RNA, 20 nt, Salmonella enterica enterica serovar Typhi Ty2
gacaggguuugccagcacca

SEQ ID NO: 1765757 - RNA, 16 nt, Salmonella enterica enterica serovar Typhi Ty2
gacaggcgcagaguga

SEQ ID NO: 1765758 - RNA, 20 nt, Salmonella enterica enterica serovar Typhi Ty2
gacaggcggccgcuuacugu

SEQ ID NO: 1765759 - RNA, 19 nt, Salmonella enterica enterica serovar Typhi Ty2
gacagcccccauaaauaau

SEQ ID NO: 1765760 - RNA, 23 nt, Salmonella enterica enterica serovar Typhi Ty2
gacacccgcagccagaacagaag

SEQ ID NO: 1765761 - RNA, 16 nt, Salmonella enterica enterica serovar Typhi Ty2
gacagagaaccugaac

SEQ ID NO: 1765762 - RNA, 17 nt, Salmonella enterica enterica serovar Typhi Ty2
gacagauaacaccagcg

SEQ ID NO: 1765763 - RNA, 14 nt, Salmonella enterica enterica serovar Typhi Ty2
gacauuguucuaaa

SEQ ID NO: 1765764 - RNA, 17 nt, Salmonella enterica enterica serovar Typhi Ty2
gacauuugcaucaaacu

SEQ ID NO: 1765765 - RNA, 22 nt, Salmonella enterica enterica serovar Typhi Ty2
gaccaauaaaggucggcugccc

SEQ ID NO: 1765766 - RNA, 20 nt, Salmonella enterica enterica serovar Typhi Ty2
gaccaaugacgcuauccgca

SEQ ID NO: 1765767 - RNA, 20 nt, Salmonella enterica enterica serovar Typhi Ty2
gaccaaugcuggcaggcgcg

SEQ ID NO: 1765768 - RNA, 23 nt, Salmonella enterica enterica serovar Typhi Ty2
gacauccucuucauaacgacauu

SEQ ID NO: 1765769 - RNA, 12 nt, Salmonella enterica enterica serovar Typhi Ty2
gacaugcagauc

SEQ ID NO: 1765770 - RNA, 19 nt, Salmonella enterica enterica serovar Typhi Ty2
gacauggucgaacaucugc

SEQ ID NO: 1765771 - RNA, 15 nt, Salmonella enterica enterica serovar Typhi Ty2
gacauggaguuccag

SEQ ID NO: 1765772 - RNA, 17 nt, Salmonella enterica enterica serovar Typhi Ty2
gacaugcuguugaaacg

SEQ ID NO: 1765773 - RNA, 14 nt, Salmonella enterica enterica serovar Typhi Ty2
gacaugcucaugaa

SEQ ID NO: 1765774 - RNA, 15 nt, Salmonella enterica enterica serovar Typhi Ty2
gacaugcucaugaag

SEQ ID NO: 1765775 - RNA, 16 nt, Salmonella enterica enterica serovar Typhi Ty2
gacaucccagacaaaa

SEQ ID NO: 1765776 - RNA, 13 nt, Salmonella enterica enterica serovar Typhi Ty2
gacauccccgccg

SEQ ID NO: 1765777 - RNA, 18 nt, Salmonella enterica enterica serovar Typhi Ty2
gacauccagcauuucgac

SEQ ID NO: 1765778 - RNA, 21 nt, Salmonella enterica enterica serovar Typhi Ty2
gacauccaugauaaucagcac

SEQ ID NO: 1765779 - RNA, 17 nt, Salmonella enterica enterica serovar Typhi Ty2
gacaucagccagccgcc

SEQ ID NO: 1765780 - RNA, 20 nt, Salmonella enterica enterica serovar Typhi Ty2
gacaucauccccggcaggcu

SEQ ID NO: 1765781 - RNA, 11 nt, Salmonella enterica enterica serovar Typhi Ty2
gacagugcuau

SEQ ID NO: 1765782 - RNA, 12 nt, Salmonella enterica enterica serovar Typhi Ty2
gacagugcuaua

SEQ ID NO: 1765783 - RNA, 15 nt, Salmonella enterica enterica serovar Typhi Ty2
gacagugaaacgggu

SEQ ID NO: 1765784 - RNA, 15 nt, Salmonella enterica enterica serovar Typhi Ty2
gaccacgccaccgcc

SEQ ID NO: 1765785 - RNA, 22 nt, Salmonella enterica enterica serovar Typhi Ty2
gaccagcugacgacgccagccc

SEQ ID NO: 1765786 - RNA, 20 nt, Salmonella enterica enterica serovar Typhi Ty2
gaccagcugacgacgccagc

SEQ ID NO: 1765787 - RNA, 14 nt, Salmonella enterica enterica serovar Typhi Ty2
gaccagcgucagcc

SEQ ID NO: 1765788 - RNA, 18 nt, Salmonella enterica enterica serovar Typhi Ty2
gaccacgacgccggagac

SEQ ID NO: 1765789 - RNA, 15 nt, Salmonella enterica enterica serovar Typhi Ty2
gaccacgaaucagga

SEQ ID NO: 1765790 - RNA, 22 nt, Salmonella enterica enterica serovar Typhi Ty2
gaccaccgcgcuagugccgcca

SEQ ID NO: 1765791 - RNA, 13 nt, Salmonella enterica enterica serovar Typhi Ty2
gaccaccgcgcua

SEQ ID NO: 1765792 - RNA, 16 nt, Salmonella enterica enterica serovar Typhi Ty2
gaccaccgcaucggca

SEQ ID NO: 1765793 - RNA, 16 nt, Salmonella enterica enterica serovar Typhi Ty2
gaccaccauccggcaa

SEQ ID NO: 1765794 - RNA, 15 nt, Salmonella enterica enterica serovar Typhi Ty2
gaccaucuuccaacu

SEQ ID NO: 1765795 - RNA, 22 nt, Salmonella enterica enterica serovar Typhi Ty2
gaccaugcauauaagagacgcc

SEQ ID NO: 1765796 - RNA, 20 nt, Salmonella enterica enterica serovar Typhi Ty2
gaccauuaccauuccucacg

SEQ ID NO: 1765797 - RNA, 20 nt, Salmonella enterica enterica serovar Typhi Ty2
gaccauuggcaccaccagga

SEQ ID NO: 1765798 - RNA, 16 nt, Salmonella enterica enterica serovar Typhi Ty2
gaccauaaaugaaaug

SEQ ID NO: 1765799 - RNA, 19 nt, Salmonella enterica enterica serovar Typhi Ty2
gaccauaaauagccgaccg

SEQ ID NO: 1765800 - RNA, 17 nt, Salmonella enterica enterica serovar Typhi Ty2
gaccaucaagcauauca

SEQ ID NO: 1765801 - RNA, 14 nt, Salmonella enterica enterica serovar Typhi Ty2
gaccauaugcggca

SEQ ID NO: 1765802 - RNA, 19 nt, Salmonella enterica enterica serovar Typhi Ty2
gaccauacgcagcauuucg

SEQ ID NO: 1765803 - RNA, 12 nt, Salmonella enterica enterica serovar Typhi Ty2
gaccauacuaau

SEQ ID NO: 1765804 - RNA, 15 nt, Salmonella enterica enterica serovar Typhi Ty2
gaccaucucuuccgc

SEQ ID NO: 1765805 - RNA, 14 nt, Salmonella enterica enterica serovar Typhi Ty2
gaccaucggccgcu

SEQ ID NO: 1765806 - RNA, 12 nt, Salmonella enterica enterica serovar Typhi Ty2
gaccauccacca

SEQ ID NO: 1765807 - RNA, 13 nt, Salmonella enterica enterica serovar Typhi Ty2
gaccgccagcaga

SEQ ID NO: 1765808 - RNA, 15 nt, Salmonella enterica enterica serovar Typhi Ty2
gaccgcgcuguauca

SEQ ID NO: 1765809 - RNA, 16 nt, Salmonella enterica enterica serovar Typhi Ty2
gaccgcugauggaccu

SEQ ID NO: 1765810 - RNA, 18 nt, Salmonella enterica enterica serovar Typhi Ty2
gaccgagacccagcgcga

SEQ ID NO: 1765811 - RNA, 23 nt, Salmonella enterica enterica serovar Typhi Ty2
gaccgacgcguuuuccagcacca

SEQ ID NO: 1765812 - RNA, 21 nt, Salmonella enterica enterica serovar Typhi Ty2
gaccccguccguucacuaacg

SEQ ID NO: 1765813 - RNA, 19 nt, Salmonella enterica enterica serovar Typhi Ty2
gaccccuccggccagcgcc

SEQ ID NO: 1765814 - RNA, 14 nt, Salmonella enterica enterica serovar Typhi Ty2
gaccccucuucuuu

SEQ ID NO: 1765815 - RNA, 12 nt, Salmonella enterica enterica serovar Typhi Ty2
gacccccuccuu

SEQ ID NO: 1765816 - RNA, 13 nt, Salmonella enterica enterica serovar Typhi Ty2
gaccccagauaau

SEQ ID NO: 1765817 - RNA, 22 nt, Salmonella enterica enterica serovar Typhi Ty2
gaccccgccgucagacaggccu

SEQ ID NO: 1765818 - RNA, 17 nt, Salmonella enterica enterica serovar Typhi Ty2
gacgccauaucgccgcc

SEQ ID NO: 1765819 - RNA, 22 nt, Salmonella enterica enterica serovar Typhi Ty2
gacgccauccguacguauuauc

SEQ ID NO: 1765820 - RNA, 15 nt, Salmonella enterica enterica serovar Typhi Ty2
gacgccaugggguga

SEQ ID NO: 1765821 - RNA, 14 nt, Salmonella enterica enterica serovar Typhi Ty2
gacgcccaucagca

SEQ ID NO: 1765822 - RNA, 17 nt, Salmonella enterica enterica serovar Typhi Ty2
gacgcaucuuuuucccg

SEQ ID NO: 1765823 - RNA, 22 nt, Salmonella enterica enterica serovar Typhi Ty2
gacgcauugagacaugccgcca

SEQ ID NO: 1765824 - RNA, 23 nt, Salmonella enterica enterica serovar Typhi Ty2
gacgccaccggguuaaagcccug

SEQ ID NO: 1765825 - RNA, 22 nt, Salmonella enterica enterica serovar Typhi Ty2
gacgccgaaccuggcgggcagc

SEQ ID NO: 1765826 - RNA, 16 nt, Salmonella enterica enterica serovar Typhi Ty2
gacgccgauaaagccc

SEQ ID NO: 1765827 - RNA, 17 nt, Salmonella enterica enterica serovar Typhi Ty2
gacgccgacauaagcug

SEQ ID NO: 1765828 - RNA, 17 nt, Salmonella enterica enterica serovar Typhi Ty2
gacgacgccagccagcc

SEQ ID NO: 1765829 - RNA, 17 nt, Salmonella enterica enterica serovar Typhi Ty2
gacgacgccaggcgguc

SEQ ID NO: 1765830 - RNA, 21 nt, Salmonella enterica enterica serovar Typhi Ty2
gacgacguucgauacuauaac

SEQ ID NO: 1765831 - RNA, 20 nt, Salmonella enterica enterica serovar Typhi Ty2
gacgacuucacccgcgggcg

SEQ ID NO: 1765832 - RNA, 13 nt, Salmonella enterica enterica serovar Typhi Ty2
gacgauaaaaaaa

SEQ ID NO: 1765833 - RNA, 14 nt, Salmonella enterica enterica serovar Typhi Ty2
gacgauaaaaaaag

SEQ ID NO: 1765834 - RNA, 22 nt, Salmonella enterica enterica serovar Typhi Ty2
gacgauaaccggacgauuuaag

SEQ ID NO: 1765835 - RNA, 21 nt, Salmonella enterica enterica serovar Typhi Ty2
gacgcagcaguuccccgccgc

SEQ ID NO: 1765836 - RNA, 15 nt, Salmonella enterica enterica serovar Typhi Ty2
gacgcagcuucgccg

SEQ ID NO: 1765837 - RNA, 12 nt, Salmonella enterica enterica serovar Typhi Ty2
gacgcagcuucu

SEQ ID NO: 1765838 - RNA, 15 nt, Salmonella enterica enterica serovar Typhi Ty2
gacgcagcucauacc

SEQ ID NO: 1765839 - RNA, 13 nt, Salmonella enterica enterica serovar Typhi Ty2
gacgaacaacauc

SEQ ID NO: 1765840 - RNA, 21 nt, Salmonella enterica enterica serovar Typhi Ty2
gacgacgcagcuucgccgcgu

SEQ ID NO: 1765841 - RNA, 23 nt, Salmonella enterica enterica serovar Typhi Ty2
gaccgcuuuagccaguagcuggu

SEQ ID NO: 1765842 - RNA, 14 nt, Salmonella enterica enterica serovar Typhi Ty2
gaccgcuucgcugg

SEQ ID NO: 1765843 - RNA, 16 nt, Salmonella enterica enterica serovar Typhi Ty2
gaccggacguugaaaa

SEQ ID NO: 1765844 - RNA, 19 nt, Salmonella enterica enterica serovar Typhi Ty2
gaccggcagccguuuuccg

SEQ ID NO: 1765845 - RNA, 20 nt, Salmonella enterica enterica serovar Typhi Ty2
gaccggaugauggccuggcg

SEQ ID NO: 1765846 - RNA, 18 nt, Salmonella enterica enterica serovar Typhi Ty2
gaccucuuuaucuuuuag

SEQ ID NO: 1765847 - RNA, 21 nt, Salmonella enterica enterica serovar Typhi Ty2
gaccucuucuuugagcucccg

SEQ ID NO: 1765848 - RNA, 22 nt, Salmonella enterica enterica serovar Typhi Ty2
gaccugaauauucggcuccagg

SEQ ID NO: 1765849 - RNA, 18 nt, Salmonella enterica enterica serovar Typhi Ty2
gaccugagcgugcaaugu

SEQ ID NO: 1765850 - RNA, 22 nt, Salmonella enterica enterica serovar Typhi Ty2
gaccugccuuucccauccgccg

SEQ ID NO: 1765851 - RNA, 21 nt, Salmonella enterica enterica serovar Typhi Ty2
gaccugccgcgccugauucau

SEQ ID NO: 1765852 - RNA, 20 nt, Salmonella enterica enterica serovar Typhi Ty2
gaccugcagcuccgcaauuu

SEQ ID NO: 1765853 - RNA, 12 nt, Salmonella enterica enterica serovar Typhi Ty2
gacggagaaaaa

SEQ ID NO: 1765854 - RNA, 18 nt, Salmonella enterica enterica serovar Typhi Ty2
gacggagaugaucguuuc

SEQ ID NO: 1765855 - RNA, 11 nt, Salmonella enterica enterica serovar Typhi Ty2
gacggagaaaa

SEQ ID NO: 1765856 - RNA, 16 nt, Salmonella enterica enterica serovar Typhi Ty2
gacggcccuuuugcag

SEQ ID NO: 1765857 - RNA, 13 nt, Salmonella enterica enterica serovar Typhi Ty2
gacggccaccagc

SEQ ID NO: 1765858 - RNA, 13 nt, Salmonella enterica enterica serovar Typhi Ty2
gacggaaaccagc

SEQ ID NO: 1765859 - RNA, 14 nt, Salmonella enterica enterica serovar Typhi Ty2
gacggaaaccagca

SEQ ID NO: 1765860 - RNA, 14 nt, Salmonella enterica enterica serovar Typhi Ty2
gacggaaaccagau

SEQ ID NO: 1765861 - RNA, 21 nt, Salmonella enterica enterica serovar Typhi Ty2
gacgcuuugcauuaucgaugc

SEQ ID NO: 1765862 - RNA, 20 nt, Salmonella enterica enterica serovar Typhi Ty2
gacgcuguucaaagccgcca

SEQ ID NO: 1765863 - RNA, 14 nt, Salmonella enterica enterica serovar Typhi Ty2
gacggugagcugaa

SEQ ID NO: 1765864 - RNA, 15 nt, Salmonella enterica enterica serovar Typhi Ty2
gacgguccuggccag

SEQ ID NO: 1765865 - RNA, 19 nt, Salmonella enterica enterica serovar Typhi Ty2
gacguaggccgaauaagac

SEQ ID NO: 1765866 - RNA, 15 nt, Salmonella enterica enterica serovar Typhi Ty2
gacggugcucaugac

SEQ ID NO: 1765867 - RNA, 12 nt, Salmonella enterica enterica serovar Typhi Ty2
gacguacaaaca

SEQ ID NO: 1765868 - RNA, 20 nt, Salmonella enterica enterica serovar Typhi Ty2
gacggcuaauaugccaggcu

SEQ ID NO: 1765869 - RNA, 15 nt, Salmonella enterica enterica serovar Typhi Ty2
gacggcuaagcugau

SEQ ID NO: 1765870 - RNA, 14 nt, Salmonella enterica enterica serovar Typhi Ty2
gacggcggaccccu

SEQ ID NO: 1765871 - RNA, 19 nt, Salmonella enterica enterica serovar Typhi Ty2
gacggcguaagucgcgcau

SEQ ID NO: 1765872 - RNA, 15 nt, Salmonella enterica enterica serovar Typhi Ty2
gacggccugucuccu

SEQ ID NO: 1765873 - RNA, 16 nt, Salmonella enterica enterica serovar Typhi Ty2
gacuaauggcauuucc

SEQ ID NO: 1765874 - RNA, 15 nt, Salmonella enterica enterica serovar Typhi Ty2
gacguucgacccgca

SEQ ID NO: 1765875 - RNA, 14 nt, Salmonella enterica enterica serovar Typhi Ty2
gacuaaaacgugcu

SEQ ID NO: 1765876 - RNA, 17 nt, Salmonella enterica enterica serovar Typhi Ty2
gacguucaauucauaga

SEQ ID NO: 1765877 - RNA, 20 nt, Salmonella enterica enterica serovar Typhi Ty2
gacguuaucucgccaggaac

SEQ ID NO: 1765878 - RNA, 22 nt, Salmonella enterica enterica serovar Typhi Ty2
gacuaucgaaagagcaaauacu

SEQ ID NO: 1765879 - RNA, 18 nt, Salmonella enterica enterica serovar Typhi Ty2
gacuauccagccagggau

SEQ ID NO: 1765880 - RNA, 15 nt, Salmonella enterica enterica serovar Typhi Ty2
gacuauugcugagcu

SEQ ID NO: 1765881 - RNA, 18 nt, Salmonella enterica enterica serovar Typhi Ty2
gacuauuccgcaaacgcc

SEQ ID NO: 1765882 - RNA, 19 nt, Salmonella enterica enterica serovar Typhi Ty2
gacuacgguaaaccaggcc

SEQ ID NO: 1765883 - RNA, 16 nt, Salmonella enterica enterica serovar Typhi Ty2
gacuauacccaaaaua

SEQ ID NO: 1765884 - RNA, 21 nt, Salmonella enterica enterica serovar Typhi Ty2
gacuauacccaaaauaauucg

SEQ ID NO: 1765885 - RNA, 22 nt, Salmonella enterica enterica serovar Typhi Ty2
gacaauuuugauaagagaaaau

SEQ ID NO: 1765886 - RNA, 15 nt, Salmonella enterica enterica serovar Typhi Ty2
gacaauuuucuucau

SEQ ID NO: 1765887 - RNA, 15 nt, Salmonella enterica enterica serovar Typhi Ty2
gacacauuugauacu

SEQ ID NO: 1765888 - RNA, 16 nt, Salmonella enterica enterica serovar Typhi Ty2
gacacccaauccggcu

SEQ ID NO: 1765889 - RNA, 19 nt, Salmonella enterica enterica serovar Typhi Ty2
gacaauacuuaaaccugcg

SEQ ID NO: 1765890 - RNA, 15 nt, Salmonella enterica enterica serovar Typhi Ty2
gacaaugaucagacg

SEQ ID NO: 1765891 - RNA, 18 nt, Salmonella enterica enterica serovar Typhi Ty2
gacaacgcuccagcaguu

SEQ ID NO: 1765892 - RNA, 14 nt, Salmonella enterica enterica serovar Typhi Ty2
gacaaccugcccuu

SEQ ID NO: 1765893 - RNA, 21 nt, Salmonella enterica enterica serovar Typhi Ty2
gacaaggccgauaaagcguuu

SEQ ID NO: 1765894 - RNA, 21 nt, Salmonella enterica enterica serovar Typhi Ty2
gacaacgcguuuauuauaaac

SEQ ID NO: 1765895 - RNA, 21 nt, Salmonella enterica enterica serovar Typhi Ty2
gacaaaaucuuuccagcucca

SEQ ID NO: 1765896 - RNA, 17 nt, Salmonella enterica enterica serovar Typhi Ty2
gacaaacagcuauccau

SEQ ID NO: 1765897 - RNA, 15 nt, Salmonella enterica enterica serovar Typhi Ty2
gacaaccagcgaaau

SEQ ID NO: 1765898 - RNA, 11 nt, Salmonella enterica enterica serovar Typhi Ty2
gacaaccagcg

SEQ ID NO: 1765899 - RNA, 20 nt, Salmonella enterica enterica serovar Typhi Ty2
gacaaacucacguuccccag

SEQ ID NO: 1765900 - RNA, 13 nt, Salmonella enterica enterica serovar Typhi Ty2
gaauuucaggaag

SEQ ID NO: 1765901 - RNA, 14 nt, Salmonella enterica enterica serovar Typhi Ty2
gacaaaaauaccac

SEQ ID NO: 1765902 - RNA, 14 nt, Salmonella enterica enterica serovar Typhi Ty2
gacaaaaauuaaaa

SEQ ID NO: 1765903 - RNA, 16 nt, Salmonella enterica enterica serovar Typhi Ty2
gaauuuaaauagcaau

SEQ ID NO: 1765904 - RNA, 23 nt, Salmonella enterica enterica serovar Typhi Ty2
gaauuacgggcgauacaccuuca

SEQ ID NO: 1765905 - RNA, 14 nt, Salmonella enterica enterica serovar Typhi Ty2
gaauuauuucagga

SEQ ID NO: 1765906 - RNA, 20 nt, Salmonella enterica enterica serovar Typhi Ty2
gaauuauuuaggguuaagag

SEQ ID NO: 1765907 - RNA, 16 nt, Salmonella enterica enterica serovar Typhi Ty2
gaauugauaaagaucu

SEQ ID NO: 1765908 - RNA, 13 nt, Salmonella enterica enterica serovar Typhi Ty2
gaauugcaaggcg

SEQ ID NO: 1765909 - RNA, 15 nt, Salmonella enterica enterica serovar Typhi Ty2
gaauuaucaggguua

SEQ ID NO: 1765910 - RNA, 16 nt, Salmonella enterica enterica serovar Typhi Ty2
gaaugcccuuuuccag

SEQ ID NO: 1765911 - RNA, 24 nt, Salmonella enterica enterica serovar Typhi Ty2
gaaugccccagguuauagaccugc

SEQ ID NO: 1765912 - RNA, 23 nt, Salmonella enterica enterica serovar Typhi Ty2
gaaugccauauuuuuccagcgcc

SEQ ID NO: 1765913 - RNA, 20 nt, Salmonella enterica enterica serovar Typhi Ty2
gaaugagggcgcgaauacuc

SEQ ID NO: 1765914 - RNA, 14 nt, Salmonella enterica enterica serovar Typhi Ty2
gaaugaggugcggu

SEQ ID NO: 1765915 - RNA, 11 nt, Salmonella enterica enterica serovar Typhi Ty2
gaaugcgaaua

SEQ ID NO: 1765916 - RNA, 17 nt, Salmonella enterica enterica serovar Typhi Ty2
gaauguauaauccaaca

SEQ ID NO: 1765917 - RNA, 23 nt, Salmonella enterica enterica serovar Typhi Ty2
gaauggugcggccuuacccauac

SEQ ID NO: 1765918 - RNA, 13 nt, Salmonella enterica enterica serovar Typhi Ty2
gaaucgccagcau

SEQ ID NO: 1765919 - RNA, 12 nt, Salmonella enterica enterica serovar Typhi Ty2
gaaucgccagca

SEQ ID NO: 1765920 - RNA, 16 nt, Salmonella enterica enterica serovar Typhi Ty2
gaaucugguuguuucg

SEQ ID NO: 1765921 - RNA, 16 nt, Salmonella enterica enterica serovar Typhi Ty2
gaaucuguauaaaaua

SEQ ID NO: 1765922 - RNA, 21 nt, Salmonella enterica enterica serovar Typhi Ty2
gaaucuggauagucaggcgau

SEQ ID NO: 1765923 - RNA, 12 nt, Salmonella enterica enterica serovar Typhi Ty2
gaaugaaacagu

SEQ ID NO: 1765924 - RNA, 14 nt, Salmonella enterica enterica serovar Typhi Ty2
gaaugaagccuuag

SEQ ID NO: 1765925 - RNA, 18 nt, Salmonella enterica enterica serovar Typhi Ty2
gaaugaccgaggaaauca

SEQ ID NO: 1765926 - RNA, 23 nt, Salmonella enterica enterica serovar Typhi Ty2
gaaugacacauuucuauagagag

SEQ ID NO: 1765927 - RNA, 15 nt, Salmonella enterica enterica serovar Typhi Ty2
gaaucacauccgcca

SEQ ID NO: 1765928 - RNA, 18 nt, Salmonella enterica enterica serovar Typhi Ty2
gaaucaguaacacaauca

SEQ ID NO: 1765929 - RNA, 20 nt, Salmonella enterica enterica serovar Typhi Ty2
gaaucacauccgccagcgcc

SEQ ID NO: 1765930 - RNA, 16 nt, Salmonella enterica enterica serovar Typhi Ty2
gaaucagugcaucuuc

SEQ ID NO: 1765931 - RNA, 20 nt, Salmonella enterica enterica serovar Typhi Ty2
gaaucagugcaucuucacug

SEQ ID NO: 1765932 - RNA, 16 nt, Salmonella enterica enterica serovar Typhi Ty2
gaauccagguacccca

SEQ ID NO: 1765933 - RNA, 19 nt, Salmonella enterica enterica serovar Typhi Ty2
gaaucccauuagccacccc

SEQ ID NO: 1765934 - RNA, 14 nt, Salmonella enterica enterica serovar Typhi Ty2
gaauccccaucucc

SEQ ID NO: 1765935 - RNA, 22 nt, Salmonella enterica enterica serovar Typhi Ty2
aaagauuauuuuaucaucagca

SEQ ID NO: 1765936 - RNA, 16 nt, Salmonella enterica enterica serovar Typhi Ty2
aaagauuagccccagc

SEQ ID NO: 1765937 - RNA, 14 nt, Salmonella enterica enterica serovar Typhi Ty2
aaagauuggcaucu

SEQ ID NO: 1765938 - RNA, 22 nt, Salmonella enterica enterica serovar Typhi Ty2
aaagauuuaucaauuuuuaaaa

SEQ ID NO: 1765939 - RNA, 22 nt, Salmonella enterica enterica serovar Typhi Ty2
gaauagcguauuuuuguacuuu

SEQ ID NO: 1765940 - RNA, 15 nt, Salmonella enterica enterica serovar Typhi Ty2
gaauagcguauuuuu

SEQ ID NO: 1765941 - RNA, 20 nt, Salmonella enterica enterica serovar Typhi Ty2
gaauagcggcuaaucaccac

SEQ ID NO: 1765942 - RNA, 23 nt, Salmonella enterica enterica serovar Typhi Ty2
gaauagccccucaauuauguauu

SEQ ID NO: 1765943 - RNA, 16 nt, Salmonella enterica enterica serovar Typhi Ty2
gaauagaggcgcuggc

SEQ ID NO: 1765944 - RNA, 19 nt, Salmonella enterica enterica serovar Typhi Ty2
gaauagaguaauacaucca

SEQ ID NO: 1765945 - RNA, 15 nt, Salmonella enterica enterica serovar Typhi Ty2
gaauagccagccccc

SEQ ID NO: 1765946 - RNA, 20 nt, Salmonella enterica enterica serovar Typhi Ty2
gaauagccagcccccugcca

SEQ ID NO: 1765947 - RNA, 13 nt, Salmonella enterica enterica serovar Typhi Ty2
gaauaaacucccg

SEQ ID NO: 1765948 - RNA, 19 nt, Salmonella enterica enterica serovar Typhi Ty2
gaauaagggugagagggga

SEQ ID NO: 1765949 - RNA, 13 nt, Salmonella enterica enterica serovar Typhi Ty2
gaauaccuucccg

SEQ ID NO: 1765950 - RNA, 15 nt, Salmonella enterica enterica serovar Typhi Ty2
gaauacccaacugua

SEQ ID NO: 1765951 - RNA, 19 nt, Salmonella enterica enterica serovar Typhi Ty2
gaauaauaauacaccgcca

SEQ ID NO: 1765952 - RNA, 12 nt, Salmonella enterica enterica serovar Typhi Ty2
gaauaccacugu

SEQ ID NO: 1765953 - RNA, 16 nt, Salmonella enterica enterica serovar Typhi Ty2
gaaguuuugcuggaau

SEQ ID NO: 1765954 - RNA, 15 nt, Salmonella enterica enterica serovar Typhi Ty2
aaagaucgcugcaau

SEQ ID NO: 1765955 - RNA, 12 nt, Salmonella enterica enterica serovar Typhi Ty2
gaaggacaagcu

SEQ ID NO: 1765956 - RNA, 14 nt, Salmonella enterica enterica serovar Typhi Ty2
gaaggagaaaacgg

SEQ ID NO: 1765957 - RNA, 20 nt, Salmonella enterica enterica serovar Typhi Ty2
gaaggagcaaugagauccac

SEQ ID NO: 1765958 - RNA, 21 nt, Salmonella enterica enterica serovar Typhi Ty2
gaaggagcaaugagauccacu

SEQ ID NO: 1765959 - RNA, 16 nt, Salmonella enterica enterica serovar Typhi Ty2
gaagcguuccgccacu

SEQ ID NO: 1765960 - RNA, 15 nt, Salmonella enterica enterica serovar Typhi Ty2
gaaggcaacgccgcc

SEQ ID NO: 1765961 - RNA, 19 nt, Salmonella enterica enterica serovar Typhi Ty2
gaaggauuauuggcaucau

SEQ ID NO: 1765962 - RNA, 15 nt, Salmonella enterica enterica serovar Typhi Ty2
gaaggcgaaaacauu

SEQ ID NO: 1765963 - RNA, 19 nt, Salmonella enterica enterica serovar Typhi Ty2
gaagggugacgugccgcag

SEQ ID NO: 1765964 - RNA, 14 nt, Salmonella enterica enterica serovar Typhi Ty2
gaaguacuggauca

SEQ ID NO: 1765965 - RNA, 17 nt, Salmonella enterica enterica serovar Typhi Ty2
gaaguagcagagaaaag

SEQ ID NO: 1765966 - RNA, 12 nt, Salmonella enterica enterica serovar Typhi Ty2
gaaguaaaaaaa

SEQ ID NO: 1765967 - RNA, 17 nt, Salmonella enterica enterica serovar Typhi Ty2
gaagcgauuuauccacc

SEQ ID NO: 1765968 - RNA, 22 nt, Salmonella enterica enterica serovar Typhi Ty2
gaagcgcaaacggaucuuccac

SEQ ID NO: 1765969 - RNA, 17 nt, Salmonella enterica enterica serovar Typhi Ty2
gaagcccggccacagcg

SEQ ID NO: 1765970 - RNA, 23 nt, Salmonella enterica enterica serovar Typhi Ty2
gaagcccggccacagcgccagac

SEQ ID NO: 1765971 - RNA, 14 nt, Salmonella enterica enterica serovar Typhi Ty2
gaagcgcaguguua

SEQ ID NO: 1765972 - RNA, 21 nt, Salmonella enterica enterica serovar Typhi Ty2
gaagcggaaaggacguucuuc

SEQ ID NO: 1765973 - RNA, 14 nt, Salmonella enterica enterica serovar Typhi Ty2
gaagcggacgggcg

SEQ ID NO: 1765974 - RNA, 20 nt, Salmonella enterica enterica serovar Typhi Ty2
gaagauagcgggcaaugcca

SEQ ID NO: 1765975 - RNA, 19 nt, Salmonella enterica enterica serovar Typhi Ty2
gaagagugaauaacaaccg

SEQ ID NO: 1765976 - RNA, 15 nt, Salmonella enterica enterica serovar Typhi Ty2
gaagcacgacacaaa

SEQ ID NO: 1765977 - RNA, 18 nt, Salmonella enterica enterica serovar Typhi Ty2
gaagcacgacacaaaagc

SEQ ID NO: 1765978 - RNA, 20 nt, Salmonella enterica enterica serovar Typhi Ty2
gaagcccaacuacacucuua

SEQ ID NO: 1765979 - RNA, 12 nt, Salmonella enterica enterica serovar Typhi Ty2
gaagcccaacua

SEQ ID NO: 1765980 - RNA, 22 nt, Salmonella enterica enterica serovar Typhi Ty2
aaagagguugacgcuucaaggc

SEQ ID NO: 1765981 - RNA, 14 nt, Salmonella enterica enterica serovar Typhi Ty2
gaacuguucagcca

SEQ ID NO: 1765982 - RNA, 14 nt, Salmonella enterica enterica serovar Typhi Ty2
gaacuggugaaaca

SEQ ID NO: 1765983 - RNA, 13 nt, Salmonella enterica enterica serovar Typhi Ty2
gaacugggugccg

SEQ ID NO: 1765984 - RNA, 23 nt, Salmonella enterica enterica serovar Typhi Ty2
gaacuuacacuuaccugauuaua

SEQ ID NO: 1765985 - RNA, 17 nt, Salmonella enterica enterica serovar Typhi Ty2
gaacuuaggauaauucc

SEQ ID NO: 1765986 - RNA, 19 nt, Salmonella enterica enterica serovar Typhi Ty2
gaagaaaccgcagaaaaag

SEQ ID NO: 1765987 - RNA, 20 nt, Salmonella enterica enterica serovar Typhi Ty2
gaagaaaaaggcaauaaagu

SEQ ID NO: 1765988 - RNA, 17 nt, Salmonella enterica enterica serovar Typhi Ty2
gaacuuguaaaaaugcc

SEQ ID NO: 1765989 - RNA, 18 nt, Salmonella enterica enterica serovar Typhi Ty2
cuguaggaucaaccaccu

SEQ ID NO: 1765990 - RNA, 20 nt, Salmonella enterica enterica serovar Typhi Ty2
cuguagcgucucaucaaaaa

SEQ ID NO: 1765991 - RNA, 23 nt, Salmonella enterica enterica serovar Typhi Ty2
cuguagcgucucaucaaaaaggc

SEQ ID NO: 1765992 - RNA, 22 nt, Salmonella enterica enterica serovar Typhi Ty2
cuguagggcacugggcgauacc

SEQ ID NO: 1765993 - RNA, 20 nt, Salmonella enterica enterica serovar Typhi Ty2
cuguagcaguggagaggcca

SEQ ID NO: 1765994 - RNA, 13 nt, Salmonella enterica enterica serovar Typhi Ty2
cuguagccagccu

SEQ ID NO: 1765995 - RNA, 17 nt, Salmonella enterica enterica serovar Typhi Ty2
cuguagauaccuacuuu

SEQ ID NO: 1765996 - RNA, 23 nt, Salmonella enterica enterica serovar Typhi Ty2
cuguauaaauaaccgguaacugu

SEQ ID NO: 1765997 - RNA, 15 nt, Salmonella enterica enterica serovar Typhi Ty2
cuguaucaaaccaac

SEQ ID NO: 1765998 - RNA, 21 nt, Salmonella enterica enterica serovar Typhi Ty2
cuguaucuucgccguauucuu

SEQ ID NO: 1765999 - RNA, 19 nt, Salmonella enterica enterica serovar Typhi Ty2
aaacucuguguuaugaaug

SEQ ID NO: 1766000 - RNA, 17 nt, Salmonella enterica enterica serovar Typhi Ty2
cuguauucgguggaaac

SEQ ID NO: 1766001 - RNA, 23 nt, Salmonella enterica enterica serovar Typhi Ty2
cugucaucgaaggcgauaccggu

SEQ ID NO: 1766002 - RNA, 12 nt, Salmonella enterica enterica serovar Typhi Ty2
cugucaucauca

SEQ ID NO: 1766003 - RNA, 13 nt, Salmonella enterica enterica serovar Typhi Ty2
cugucagccgcac

SEQ ID NO: 1766004 - RNA, 18 nt, Salmonella enterica enterica serovar Typhi Ty2
cugucagaaaucugaaug

SEQ ID NO: 1766005 - RNA, 14 nt, Salmonella enterica enterica serovar Typhi Ty2
cugucaccagcagc

SEQ ID NO: 1766006 - RNA, 13 nt, Salmonella enterica enterica serovar Typhi Ty2
cugucaccagcag

SEQ ID NO: 1766007 - RNA, 19 nt, Salmonella enterica enterica serovar Typhi Ty2
aaacugcauccccugcagg

SEQ ID NO: 1766008 - RNA, 11 nt, Salmonella enterica enterica serovar Typhi Ty2
aaacugccuuc

SEQ ID NO: 1766009 - RNA, 18 nt, Salmonella enterica enterica serovar Typhi Ty2
cuguccgcccaguaccag

SEQ ID NO: 1766010 - RNA, 19 nt, Salmonella enterica enterica serovar Typhi Ty2
cuguccggguaucugggcg

SEQ ID NO: 1766011 - RNA, 21 nt, Salmonella enterica enterica serovar Typhi Ty2
cuguccgccuuaucaggccug

SEQ ID NO: 1766012 - RNA, 16 nt, Salmonella enterica enterica serovar Typhi Ty2
cugucccugccagcgu

SEQ ID NO: 1766013 - RNA, 19 nt, Salmonella enterica enterica serovar Typhi Ty2
cugucccagccuuccuggu

SEQ ID NO: 1766014 - RNA, 18 nt, Salmonella enterica enterica serovar Typhi Ty2
cuguccaugacgaccaca

SEQ ID NO: 1766015 - RNA, 17 nt, Salmonella enterica enterica serovar Typhi Ty2
cugucccagccuuccug

SEQ ID NO: 1766016 - RNA, 23 nt, Salmonella enterica enterica serovar Typhi Ty2
cuguccagccgcccuucuccggu

SEQ ID NO: 1766017 - RNA, 19 nt, Salmonella enterica enterica serovar Typhi Ty2
cugucguauuuauuuucug

SEQ ID NO: 1766018 - RNA, 13 nt, Salmonella enterica enterica serovar Typhi Ty2
cugucguauuuau

SEQ ID NO: 1766019 - RNA, 15 nt, Salmonella enterica enterica serovar Typhi Ty2
cugucggucagauuc

SEQ ID NO: 1766020 - RNA, 15 nt, Salmonella enterica enterica serovar Typhi Ty2
cugucggucuuuuuc

SEQ ID NO: 1766021 - RNA, 14 nt, Salmonella enterica enterica serovar Typhi Ty2
cugucuccagcgcc

SEQ ID NO: 1766022 - RNA, 23 nt, Salmonella enterica enterica serovar Typhi Ty2
cugucguuucauguaaaugacgc

SEQ ID NO: 1766023 - RNA, 14 nt, Salmonella enterica enterica serovar Typhi Ty2
cugugaaguaauuc

SEQ ID NO: 1766024 - RNA, 14 nt, Salmonella enterica enterica serovar Typhi Ty2
cugucuuguggaac

SEQ ID NO: 1766025 - RNA, 14 nt, Salmonella enterica enterica serovar Typhi Ty2
cugucuuguuuuuc

SEQ ID NO: 1766026 - RNA, 20 nt, Salmonella enterica enterica serovar Typhi Ty2
cugucugcaagagaaauaac

SEQ ID NO: 1766027 - RNA, 20 nt, Salmonella enterica enterica serovar Typhi Ty2
cugucucuuuagaaaaagaa

SEQ ID NO: 1766028 - RNA, 15 nt, Salmonella enterica enterica serovar Typhi Ty2
cugucugccaugccu

SEQ ID NO: 1766029 - RNA, 18 nt, Salmonella enterica enterica serovar Typhi Ty2
cugucugucgcgggcgaa

SEQ ID NO: 1766030 - RNA, 22 nt, Salmonella enterica enterica serovar Typhi Ty2
cugucuuacacugauaccccag

SEQ ID NO: 1766031 - RNA, 16 nt, Salmonella enterica enterica serovar Typhi Ty2
cugucgauaaacucau

SEQ ID NO: 1766032 - RNA, 19 nt, Salmonella enterica enterica serovar Typhi Ty2
cuguccugaguaaagccug

SEQ ID NO: 1766033 - RNA, 14 nt, Salmonella enterica enterica serovar Typhi Ty2
cugucgaugauauc

SEQ ID NO: 1766034 - RNA, 21 nt, Salmonella enterica enterica serovar Typhi Ty2
cugucgaugauauccagcacg

SEQ ID NO: 1766035 - RNA, 19 nt, Salmonella enterica enterica serovar Typhi Ty2
cugucggcagaaccugacc

SEQ ID NO: 1766036 - RNA, 22 nt, Salmonella enterica enterica serovar Typhi Ty2
cugucggcgagguacugcauaa

SEQ ID NO: 1766037 - RNA, 16 nt, Salmonella enterica enterica serovar Typhi Ty2
cugucgggagccucuu

SEQ ID NO: 1766038 - RNA, 13 nt, Salmonella enterica enterica serovar Typhi Ty2
cugucgccaccac

SEQ ID NO: 1766039 - RNA, 14 nt, Salmonella enterica enterica serovar Typhi Ty2
cugucgccgcccgu

SEQ ID NO: 1766040 - RNA, 15 nt, Salmonella enterica enterica serovar Typhi Ty2
cugucgccaccacuc

SEQ ID NO: 1766041 - RNA, 23 nt, Salmonella enterica enterica serovar Typhi Ty2
cugucgcuaaagcacuccccggc

SEQ ID NO: 1766042 - RNA, 16 nt, Salmonella enterica enterica serovar Typhi Ty2
cugucgcucgcggcag

SEQ ID NO: 1766043 - RNA, 16 nt, Salmonella enterica enterica serovar Typhi Ty2
cugugauugaauucac

SEQ ID NO: 1766044 - RNA, 22 nt, Salmonella enterica enterica serovar Typhi Ty2
cugugauaaaaacgccuugccc

SEQ ID NO: 1766045 - RNA, 23 nt, Salmonella enterica enterica serovar Typhi Ty2
cugugacaucgccccggccuuau

SEQ ID NO: 1766046 - RNA, 22 nt, Salmonella enterica enterica serovar Typhi Ty2
cugugacggcaacugaaaacag

SEQ ID NO: 1766047 - RNA, 16 nt, Salmonella enterica enterica serovar Typhi Ty2
cugugagccuaaaaca

SEQ ID NO: 1766048 - RNA, 20 nt, Salmonella enterica enterica serovar Typhi Ty2
cugugacaucgccccggccu

SEQ ID NO: 1766049 - RNA, 18 nt, Salmonella enterica enterica serovar Typhi Ty2
cugugcauaucuggcgag

SEQ ID NO: 1766050 - RNA, 23 nt, Salmonella enterica enterica serovar Typhi Ty2
cugugcaacaucuuaccggugcg

SEQ ID NO: 1766051 - RNA, 17 nt, Salmonella enterica enterica serovar Typhi Ty2
cugugcaaaauuacuuc

SEQ ID NO: 1766052 - RNA, 17 nt, Salmonella enterica enterica serovar Typhi Ty2
cuguggaggguaagaaa

SEQ ID NO: 1766053 - RNA, 14 nt, Salmonella enterica enterica serovar Typhi Ty2
cuguggaaacugug

SEQ ID NO: 1766054 - RNA, 15 nt, Salmonella enterica enterica serovar Typhi Ty2
cuguggaaaaucugg

SEQ ID NO: 1766055 - RNA, 18 nt, Salmonella enterica enterica serovar Typhi Ty2
cuguggcaauuuucaguu

SEQ ID NO: 1766056 - RNA, 19 nt, Salmonella enterica enterica serovar Typhi Ty2
cugugcucgauauauuuuc

SEQ ID NO: 1766057 - RNA, 17 nt, Salmonella enterica enterica serovar Typhi Ty2
cugugcuaucaggccua

SEQ ID NO: 1766058 - RNA, 15 nt, Salmonella enterica enterica serovar Typhi Ty2
cugugcggaauagcc

SEQ ID NO: 1766059 - RNA, 13 nt, Salmonella enterica enterica serovar Typhi Ty2
cugugcgagacca

SEQ ID NO: 1766060 - RNA, 13 nt, Salmonella enterica enterica serovar Typhi Ty2
cugugcgccugcu

SEQ ID NO: 1766061 - RNA, 13 nt, Salmonella enterica enterica serovar Typhi Ty2
cugugccugccug

SEQ ID NO: 1766062 - RNA, 18 nt, Salmonella enterica enterica serovar Typhi Ty2
cuggugacgaugauaaca

SEQ ID NO: 1766063 - RNA, 20 nt, Salmonella enterica enterica serovar Typhi Ty2
cuggugaaacguguuuaucc

SEQ ID NO: 1766064 - RNA, 21 nt, Salmonella enterica enterica serovar Typhi Ty2
cuggugaaacguguuuauccc

SEQ ID NO: 1766065 - RNA, 17 nt, Salmonella enterica enterica serovar Typhi Ty2
cuggucugaaucugcuc

SEQ ID NO: 1766066 - RNA, 18 nt, Salmonella enterica enterica serovar Typhi Ty2
cuggucggugauugucca

SEQ ID NO: 1766067 - RNA, 15 nt, Salmonella enterica enterica serovar Typhi Ty2
cuggucgggcaggcu

SEQ ID NO: 1766068 - RNA, 22 nt, Salmonella enterica enterica serovar Typhi Ty2
cuggucgcgguuuacuucuuca

SEQ ID NO: 1766069 - RNA, 15 nt, Salmonella enterica enterica serovar Typhi Ty2
cuggucgccagcgcc

SEQ ID NO: 1766070 - RNA, 14 nt, Salmonella enterica enterica serovar Typhi Ty2
cugguacguccauc

SEQ ID NO: 1766071 - RNA, 16 nt, Salmonella enterica enterica serovar Typhi Ty2
cugguaaggcaaauau

SEQ ID NO: 1766072 - RNA, 20 nt, Salmonella enterica enterica serovar Typhi Ty2
cugguaaguguuagcucuua

SEQ ID NO: 1766073 - RNA, 17 nt, Salmonella enterica enterica serovar Typhi Ty2
cugguaagagagccuua

SEQ ID NO: 1766074 - RNA, 13 nt, Salmonella enterica enterica serovar Typhi Ty2
cugguaagagagc

SEQ ID NO: 1766075 - RNA, 19 nt, Salmonella enterica enterica serovar Typhi Ty2
cuggucaacacgcggucgu

SEQ ID NO: 1766076 - RNA, 12 nt, Salmonella enterica enterica serovar Typhi Ty2
cugguaguccuc

SEQ ID NO: 1766077 - RNA, 15 nt, Salmonella enterica enterica serovar Typhi Ty2
cugguaggccugaua

SEQ ID NO: 1766078 - RNA, 17 nt, Salmonella enterica enterica serovar Typhi Ty2
cuggucaaguauuucug

SEQ ID NO: 1766079 - RNA, 18 nt, Salmonella enterica enterica serovar Typhi Ty2
cuggucauaacgcuuugu

SEQ ID NO: 1766080 - RNA, 17 nt, Salmonella enterica enterica serovar Typhi Ty2
cugggcugagaaaaauu

SEQ ID NO: 1766081 - RNA, 21 nt, Salmonella enterica enterica serovar Typhi Ty2
cugggcuuuauccugaccgcu

SEQ ID NO: 1766082 - RNA, 18 nt, Salmonella enterica enterica serovar Typhi Ty2
cuggguuccgggcgcacc

SEQ ID NO: 1766083 - RNA, 14 nt, Salmonella enterica enterica serovar Typhi Ty2
cuggguugcccaaa

SEQ ID NO: 1766084 - RNA, 20 nt, Salmonella enterica enterica serovar Typhi Ty2
cuggguuagccaaacucuga

SEQ ID NO: 1766085 - RNA, 22 nt, Salmonella enterica enterica serovar Typhi Ty2
cuggguuagcuguauccacccg

SEQ ID NO: 1766086 - RNA, 19 nt, Salmonella enterica enterica serovar Typhi Ty2
cugguaaccguaacgcucc

SEQ ID NO: 1766087 - RNA, 16 nt, Salmonella enterica enterica serovar Typhi Ty2
cuggguuugcugaauc

SEQ ID NO: 1766088 - RNA, 17 nt, Salmonella enterica enterica serovar Typhi Ty2
cuggguuuauuugguac

SEQ ID NO: 1766089 - RNA, 18 nt, Salmonella enterica enterica serovar Typhi Ty2
cuggguagcuucugucug

SEQ ID NO: 1766090 - RNA, 13 nt, Salmonella enterica enterica serovar Typhi Ty2
cuggguaauagau

SEQ ID NO: 1766091 - RNA, 23 nt, Salmonella enterica enterica serovar Typhi Ty2
cugggugaugcgggacugcugcu

SEQ ID NO: 1766092 - RNA, 18 nt, Salmonella enterica enterica serovar Typhi Ty2
cugggucugcugggcgau

SEQ ID NO: 1766093 - RNA, 20 nt, Salmonella enterica enterica serovar Typhi Ty2
cuggguaugcagugggccgg

SEQ ID NO: 1766094 - RNA, 17 nt, Salmonella enterica enterica serovar Typhi Ty2
cugggucacgauaacca

SEQ ID NO: 1766095 - RNA, 23 nt, Salmonella enterica enterica serovar Typhi Ty2
cuguaauuauaaauauuaaugaa

SEQ ID NO: 1766096 - RNA, 20 nt, Salmonella enterica enterica serovar Typhi Ty2
cuguaauuauaaauauuaau

SEQ ID NO: 1766097 - RNA, 13 nt, Salmonella enterica enterica serovar Typhi Ty2
cuguaauuuauaa

SEQ ID NO: 1766098 - RNA, 13 nt, Salmonella enterica enterica serovar Typhi Ty2
cuguaccaccaga

SEQ ID NO: 1766099 - RNA, 22 nt, Salmonella enterica enterica serovar Typhi Ty2
cuguaccaccagaaucgccagc

SEQ ID NO: 1766100 - RNA, 15 nt, Salmonella enterica enterica serovar Typhi Ty2
cuguaccaggacgca

SEQ ID NO: 1766101 - RNA, 17 nt, Salmonella enterica enterica serovar Typhi Ty2
cuguaccgcguccugac

SEQ ID NO: 1766102 - RNA, 13 nt, Salmonella enterica enterica serovar Typhi Ty2
cuguacgccucuu

SEQ ID NO: 1766103 - RNA, 15 nt, Salmonella enterica enterica serovar Typhi Ty2
cuguacgcccagccg

SEQ ID NO: 1766104 - RNA, 15 nt, Salmonella enterica enterica serovar Typhi Ty2
cuguacgccacggcu

SEQ ID NO: 1766105 - RNA, 21 nt, Salmonella enterica enterica serovar Typhi Ty2
cuguacgccacggcuuaaauc

SEQ ID NO: 1766106 - RNA, 19 nt, Salmonella enterica enterica serovar Typhi Ty2
cuguacgcgggaaauaccu

SEQ ID NO: 1766107 - RNA, 14 nt, Salmonella enterica enterica serovar Typhi Ty2
cuguaaaccgccuc

SEQ ID NO: 1766108 - RNA, 17 nt, Salmonella enterica enterica serovar Typhi Ty2
cuguaaacguuccugcc

SEQ ID NO: 1766109 - RNA, 20 nt, Salmonella enterica enterica serovar Typhi Ty2
cuguaaccccagcaucugca

SEQ ID NO: 1766110 - RNA, 20 nt, Salmonella enterica enterica serovar Typhi Ty2
cuguaacaacuguuuuucac

SEQ ID NO: 1766111 - RNA, 15 nt, Salmonella enterica enterica serovar Typhi Ty2
cuguaacacacuggu

SEQ ID NO: 1766112 - RNA, 17 nt, Salmonella enterica enterica serovar Typhi Ty2
cuguaauagugcgcggg

SEQ ID NO: 1766113 - RNA, 17 nt, Salmonella enterica enterica serovar Typhi Ty2
cuguaacuucggccagc

SEQ ID NO: 1766114 - RNA, 14 nt, Salmonella enterica enterica serovar Typhi Ty2
cugguugaccggaa

SEQ ID NO: 1766115 - RNA, 14 nt, Salmonella enterica enterica serovar Typhi Ty2
cugguucgaaucca

SEQ ID NO: 1766116 - RNA, 13 nt, Salmonella enterica enterica serovar Typhi Ty2
cugguuauaugaa

SEQ ID NO: 1766117 - RNA, 13 nt, Salmonella enterica enterica serovar Typhi Ty2
cugguucaacauc

SEQ ID NO: 1766118 - RNA, 24 nt, Salmonella enterica enterica serovar Typhi Ty2
cugguuaaugccuucgccgccgcu

SEQ ID NO: 1766119 - RNA, 15 nt, Salmonella enterica enterica serovar Typhi Ty2
cugguuaauaauuuu

SEQ ID NO: 1766120 - RNA, 16 nt, Salmonella enterica enterica serovar Typhi Ty2
cugguuaacgccgcca

SEQ ID NO: 1766121 - RNA, 14 nt, Salmonella enterica enterica serovar Typhi Ty2
cugguuucaauacu

SEQ ID NO: 1766122 - RNA, 18 nt, Salmonella enterica enterica serovar Typhi Ty2
cugguuuugcguaaucca

SEQ ID NO: 1766123 - RNA, 18 nt, Salmonella enterica enterica serovar Typhi Ty2
cuggugcugugccugccu

SEQ ID NO: 1766124 - RNA, 12 nt, Salmonella enterica enterica serovar Typhi Ty2
cuggugcccggu

SEQ ID NO: 1766125 - RNA, 18 nt, Salmonella enterica enterica serovar Typhi Ty2
cuggugccaaucuccagc

SEQ ID NO: 1766126 - RNA, 18 nt, Salmonella enterica enterica serovar Typhi Ty2
cuggugcagcaagcggcu

SEQ ID NO: 1766127 - RNA, 23 nt, Salmonella enterica enterica serovar Typhi Ty2
cuggugcagcaagcggcugucau

SEQ ID NO: 1766128 - RNA, 14 nt, Salmonella enterica enterica serovar Typhi Ty2
cuggugucuuuuuc

SEQ ID NO: 1766129 - RNA, 18 nt, Salmonella enterica enterica serovar Typhi Ty2
cuggugugguuauuucug

SEQ ID NO: 1766130 - RNA, 20 nt, Salmonella enterica enterica serovar Typhi Ty2
cugguggugccgacgccagc

SEQ ID NO: 1766131 - RNA, 15 nt, Salmonella enterica enterica serovar Typhi Ty2
cuucgaacagcucau

SEQ ID NO: 1766132 - RNA, 13 nt, Salmonella enterica enterica serovar Typhi Ty2
cuucgcaaccggu

SEQ ID NO: 1766133 - RNA, 18 nt, Salmonella enterica enterica serovar Typhi Ty2
cuucgcagaucgccugga

SEQ ID NO: 1766134 - RNA, 19 nt, Salmonella enterica enterica serovar Typhi Ty2
cuucgcagcgauauuucuc

SEQ ID NO: 1766135 - RNA, 13 nt, Salmonella enterica enterica serovar Typhi Ty2
cuucgcacugccc

SEQ ID NO: 1766136 - RNA, 21 nt, Salmonella enterica enterica serovar Typhi Ty2
cuucgccaacuuuuugcgcaa

SEQ ID NO: 1766137 - RNA, 19 nt, Salmonella enterica enterica serovar Typhi Ty2
cuucgccauuacaggacag

SEQ ID NO: 1766138 - RNA, 20 nt, Salmonella enterica enterica serovar Typhi Ty2
cuucgccccggcgagugccu

SEQ ID NO: 1766139 - RNA, 20 nt, Salmonella enterica enterica serovar Typhi Ty2
cuuccgcacgcgcgcccugc

SEQ ID NO: 1766140 - RNA, 18 nt, Salmonella enterica enterica serovar Typhi Ty2
cuuccgccacggcuuuca

SEQ ID NO: 1766141 - RNA, 22 nt, Salmonella enterica enterica serovar Typhi Ty2
cuuccgccauacccggcuccca

SEQ ID NO: 1766142 - RNA, 19 nt, Salmonella enterica enterica serovar Typhi Ty2
cuuccgccauacccggcuc

SEQ ID NO: 1766143 - RNA, 17 nt, Salmonella enterica enterica serovar Typhi Ty2
cuuccuuugccuuucuu

SEQ ID NO: 1766144 - RNA, 18 nt, Salmonella enterica enterica serovar Typhi Ty2
cuuccuucguuacuuuca

SEQ ID NO: 1766145 - RNA, 16 nt, Salmonella enterica enterica serovar Typhi Ty2
cuuccuuuucaucugg

SEQ ID NO: 1766146 - RNA, 23 nt, Salmonella enterica enterica serovar Typhi Ty2
cuucccccagaaugccgcccauc

SEQ ID NO: 1766147 - RNA, 23 nt, Salmonella enterica enterica serovar Typhi Ty2
cuucccccuggcuaucaauguuu

SEQ ID NO: 1766148 - RNA, 22 nt, Salmonella enterica enterica serovar Typhi Ty2
cuuccagcgcgccgucaucgcu

SEQ ID NO: 1766149 - RNA, 12 nt, Salmonella enterica enterica serovar Typhi Ty2
cuuccagcgcca

SEQ ID NO: 1766150 - RNA, 15 nt, Salmonella enterica enterica serovar Typhi Ty2
cuuccauccauguga

SEQ ID NO: 1766151 - RNA, 13 nt, Salmonella enterica enterica serovar Typhi Ty2
aaacuuaucucuu

SEQ ID NO: 1766152 - RNA, 21 nt, Salmonella enterica enterica serovar Typhi Ty2
aaacuuaucaguaacagaaca

SEQ ID NO: 1766153 - RNA, 13 nt, Salmonella enterica enterica serovar Typhi Ty2
cuuccagcaaacc

SEQ ID NO: 1766154 - RNA, 19 nt, Salmonella enterica enterica serovar Typhi Ty2
cuuccagcauucuauuguu

SEQ ID NO: 1766155 - RNA, 14 nt, Salmonella enterica enterica serovar Typhi Ty2
cuuccagcagaucc

SEQ ID NO: 1766156 - RNA, 18 nt, Salmonella enterica enterica serovar Typhi Ty2
cuuccaccaccuccugcu

SEQ ID NO: 1766157 - RNA, 21 nt, Salmonella enterica enterica serovar Typhi Ty2
cuuccagauacauggcuauuc

SEQ ID NO: 1766158 - RNA, 18 nt, Salmonella enterica enterica serovar Typhi Ty2
cuuccacacggcauucac

SEQ ID NO: 1766159 - RNA, 14 nt, Salmonella enterica enterica serovar Typhi Ty2
cuucaccggcgugc

SEQ ID NO: 1766160 - RNA, 14 nt, Salmonella enterica enterica serovar Typhi Ty2
cuucaccuugcugc

SEQ ID NO: 1766161 - RNA, 19 nt, Salmonella enterica enterica serovar Typhi Ty2
cuucacgccauccaguuua

SEQ ID NO: 1766162 - RNA, 17 nt, Salmonella enterica enterica serovar Typhi Ty2
cuucacuucacaaacaa

SEQ ID NO: 1766163 - RNA, 21 nt, Salmonella enterica enterica serovar Typhi Ty2
cuucaauuugaccugaccugg

SEQ ID NO: 1766164 - RNA, 23 nt, Salmonella enterica enterica serovar Typhi Ty2
cuucaauuugccggaacucagcu

SEQ ID NO: 1766165 - RNA, 19 nt, Salmonella enterica enterica serovar Typhi Ty2
cuucaauuuuccagauagc

SEQ ID NO: 1766166 - RNA, 14 nt, Salmonella enterica enterica serovar Typhi Ty2
cuucaauauugaug

SEQ ID NO: 1766167 - RNA, 18 nt, Salmonella enterica enterica serovar Typhi Ty2
cuucacauaucccagacc

SEQ ID NO: 1766168 - RNA, 17 nt, Salmonella enterica enterica serovar Typhi Ty2
cuuauugaugacgcuua

SEQ ID NO: 1766169 - RNA, 12 nt, Salmonella enterica enterica serovar Typhi Ty2
cuuauuccaguc

SEQ ID NO: 1766170 - RNA, 18 nt, Salmonella enterica enterica serovar Typhi Ty2
cuucaaagccacacugca

SEQ ID NO: 1766171 - RNA, 22 nt, Salmonella enterica enterica serovar Typhi Ty2
cuucaagcuggugcuuuaugua

SEQ ID NO: 1766172 - RNA, 23 nt, Salmonella enterica enterica serovar Typhi Ty2
cuucaagcuggugcuuuauguag

SEQ ID NO: 1766173 - RNA, 14 nt, Salmonella enterica enterica serovar Typhi Ty2
cuucaacagcggcg

SEQ ID NO: 1766174 - RNA, 23 nt, Salmonella enterica enterica serovar Typhi Ty2
cuucaaggcucaauacgcauaau

SEQ ID NO: 1766175 - RNA, 17 nt, Salmonella enterica enterica serovar Typhi Ty2
cuucauccgcucccgcu

SEQ ID NO: 1766176 - RNA, 23 nt, Salmonella enterica enterica serovar Typhi Ty2
cuucauauuaaauuccggcucgc

SEQ ID NO: 1766177 - RNA, 18 nt, Salmonella enterica enterica serovar Typhi Ty2
cuucaucggauagaugaa

SEQ ID NO: 1766178 - RNA, 14 nt, Salmonella enterica enterica serovar Typhi Ty2
cuucaucgcgccuc

SEQ ID NO: 1766179 - RNA, 14 nt, Salmonella enterica enterica serovar Typhi Ty2
cuucaucuucaccu

SEQ ID NO: 1766180 - RNA, 14 nt, Salmonella enterica enterica serovar Typhi Ty2
cuucaugcagcccg

SEQ ID NO: 1766181 - RNA, 19 nt, Salmonella enterica enterica serovar Typhi Ty2
cuucaugugguaggcuuca

SEQ ID NO: 1766182 - RNA, 20 nt, Salmonella enterica enterica serovar Typhi Ty2
cuucaugguaaaauccuuuu

SEQ ID NO: 1766183 - RNA, 13 nt, Salmonella enterica enterica serovar Typhi Ty2
cuucagcgcgccc

SEQ ID NO: 1766184 - RNA, 20 nt, Salmonella enterica enterica serovar Typhi Ty2
cuucauaaauagccagcauc

SEQ ID NO: 1766185 - RNA, 12 nt, Salmonella enterica enterica serovar Typhi Ty2
cuucauaaauac

SEQ ID NO: 1766186 - RNA, 18 nt, Salmonella enterica enterica serovar Typhi Ty2
cuucauaggugaacauga

SEQ ID NO: 1766187 - RNA, 17 nt, Salmonella enterica enterica serovar Typhi Ty2
cuucauaggugaacaug

SEQ ID NO: 1766188 - RNA, 17 nt, Salmonella enterica enterica serovar Typhi Ty2
cuucauacuccgaaugu

SEQ ID NO: 1766189 - RNA, 12 nt, Salmonella enterica enterica serovar Typhi Ty2
cuucagccagac

SEQ ID NO: 1766190 - RNA, 19 nt, Salmonella enterica enterica serovar Typhi Ty2
cuuaauuugcuguuuuuug

SEQ ID NO: 1766191 - RNA, 18 nt, Salmonella enterica enterica serovar Typhi Ty2
cuuaagaauguccaucuc

SEQ ID NO: 1766192 - RNA, 21 nt, Salmonella enterica enterica serovar Typhi Ty2
cuuaagaauguccaucucuuu

SEQ ID NO: 1766193 - RNA, 13 nt, Salmonella enterica enterica serovar Typhi Ty2
cuuaauaacagcg

SEQ ID NO: 1766194 - RNA, 16 nt, Salmonella enterica enterica serovar Typhi Ty2
cuuaagggccauguuu

SEQ ID NO: 1766195 - RNA, 21 nt, Salmonella enterica enterica serovar Typhi Ty2
cuuacguucgaugacuuguuc

SEQ ID NO: 1766196 - RNA, 18 nt, Salmonella enterica enterica serovar Typhi Ty2
cuuacuuguaggccuggu

SEQ ID NO: 1766197 - RNA, 14 nt, Salmonella enterica enterica serovar Typhi Ty2
cuuacgcuccugcg

SEQ ID NO: 1766198 - RNA, 13 nt, Salmonella enterica enterica serovar Typhi Ty2
cuuacaaaaaaua

SEQ ID NO: 1766199 - RNA, 23 nt, Salmonella enterica enterica serovar Typhi Ty2
cuuacgcaguugggcgcgcgacu

SEQ ID NO: 1766200 - RNA, 23 nt, Salmonella enterica enterica serovar Typhi Ty2
cuuauuagaggcguaaguaaaag

SEQ ID NO: 1766201 - RNA, 15 nt, Salmonella enterica enterica serovar Typhi Ty2
cuuaucugcaauaaa

SEQ ID NO: 1766202 - RNA, 14 nt, Salmonella enterica enterica serovar Typhi Ty2
cuuaucugcugcug

SEQ ID NO: 1766203 - RNA, 19 nt, Salmonella enterica enterica serovar Typhi Ty2
cuuaucucuacuuuccuga

SEQ ID NO: 1766204 - RNA, 20 nt, Salmonella enterica enterica serovar Typhi Ty2
cuuauccccauucugcugau

SEQ ID NO: 1766205 - RNA, 13 nt, Salmonella enterica enterica serovar Typhi Ty2
cuuaucccagccg

SEQ ID NO: 1766206 - RNA, 19 nt, Salmonella enterica enterica serovar Typhi Ty2
cuuaucccacaacuguucu

SEQ ID NO: 1766207 - RNA, 20 nt, Salmonella enterica enterica serovar Typhi Ty2
cuuauccaaauccuuaauca

SEQ ID NO: 1766208 - RNA, 22 nt, Salmonella enterica enterica serovar Typhi Ty2
cuuaucaggccgacaaaugacg

SEQ ID NO: 1766209 - RNA, 17 nt, Salmonella enterica enterica serovar Typhi Ty2
cuuauacugauaaacua

SEQ ID NO: 1766210 - RNA, 16 nt, Salmonella enterica enterica serovar Typhi Ty2
cuuauacaggcgcagg

SEQ ID NO: 1766211 - RNA, 23 nt, Salmonella enterica enterica serovar Typhi Ty2
cuuauaaaucagcuuugcggcca

SEQ ID NO: 1766212 - RNA, 15 nt, Salmonella enterica enterica serovar Typhi Ty2
cuuaguccucagcga

SEQ ID NO: 1766213 - RNA, 21 nt, Salmonella enterica enterica serovar Typhi Ty2
cuuaaacaucgcccuccagcu

SEQ ID NO: 1766214 - RNA, 16 nt, Salmonella enterica enterica serovar Typhi Ty2
cuuaaacaguauuuau

SEQ ID NO: 1766215 - RNA, 20 nt, Salmonella enterica enterica serovar Typhi Ty2
cuuaaacagcgaucacgccg

SEQ ID NO: 1766216 - RNA, 15 nt, Salmonella enterica enterica serovar Typhi Ty2
cuuaaaccugcgccg

SEQ ID NO: 1766217 - RNA, 14 nt, Salmonella enterica enterica serovar Typhi Ty2
cuguuuuccgcuuu

SEQ ID NO: 1766218 - RNA, 19 nt, Salmonella enterica enterica serovar Typhi Ty2
cuuaaaagggaguauuuac

SEQ ID NO: 1766219 - RNA, 21 nt, Salmonella enterica enterica serovar Typhi Ty2
cuuaaaagggaguauuuaccu

SEQ ID NO: 1766220 - RNA, 14 nt, Salmonella enterica enterica serovar Typhi Ty2
cuguuuuauuuccu

SEQ ID NO: 1766221 - RNA, 18 nt, Salmonella enterica enterica serovar Typhi Ty2
cuguuuuauuuccucaga

SEQ ID NO: 1766222 - RNA, 15 nt, Salmonella enterica enterica serovar Typhi Ty2
cuguuugugguuggu

SEQ ID NO: 1766223 - RNA, 18 nt, Salmonella enterica enterica serovar Typhi Ty2
cuguugcgcauucaggcg

SEQ ID NO: 1766224 - RNA, 20 nt, Salmonella enterica enterica serovar Typhi Ty2
cuguugaugauaaccgccgc

SEQ ID NO: 1766225 - RNA, 18 nt, Salmonella enterica enterica serovar Typhi Ty2
cuguugcugugcauaucu

SEQ ID NO: 1766226 - RNA, 14 nt, Salmonella enterica enterica serovar Typhi Ty2
cuguugcugugcau

SEQ ID NO: 1766227 - RNA, 13 nt, Salmonella enterica enterica serovar Typhi Ty2
cuguuggcauccu

SEQ ID NO: 1766228 - RNA, 19 nt, Salmonella enterica enterica serovar Typhi Ty2
cugugggcgugucgccggg

SEQ ID NO: 1766229 - RNA, 20 nt, Salmonella enterica enterica serovar Typhi Ty2
cuguguacgcguucugaaua

SEQ ID NO: 1766230 - RNA, 18 nt, Salmonella enterica enterica serovar Typhi Ty2
cuguguaccucuacauaa

SEQ ID NO: 1766231 - RNA, 17 nt, Salmonella enterica enterica serovar Typhi Ty2
cuguuaaaaccggcugc

SEQ ID NO: 1766232 - RNA, 17 nt, Salmonella enterica enterica serovar Typhi Ty2
cugugugggcacucgaa

SEQ ID NO: 1766233 - RNA, 16 nt, Salmonella enterica enterica serovar Typhi Ty2
cugugugggcacucga

SEQ ID NO: 1766234 - RNA, 19 nt, Salmonella enterica enterica serovar Typhi Ty2
cugugugagcgcccgccgc

SEQ ID NO: 1766235 - RNA, 17 nt, Salmonella enterica enterica serovar Typhi Ty2
cuguguugcucaaaaaa

SEQ ID NO: 1766236 - RNA, 16 nt, Salmonella enterica enterica serovar Typhi Ty2
cuguucuacuacagaa

SEQ ID NO: 1766237 - RNA, 20 nt, Salmonella enterica enterica serovar Typhi Ty2
cuguucuggcucggccuguc

SEQ ID NO: 1766238 - RNA, 21 nt, Salmonella enterica enterica serovar Typhi Ty2
cuguugaauaucgcuuuuucu

SEQ ID NO: 1766239 - RNA, 12 nt, Salmonella enterica enterica serovar Typhi Ty2
cuguucuuuuuc

SEQ ID NO: 1766240 - RNA, 19 nt, Salmonella enterica enterica serovar Typhi Ty2
cuguucuuuuucggcuggc

SEQ ID NO: 1766241 - RNA, 22 nt, Salmonella enterica enterica serovar Typhi Ty2
cuguugaguucccuucuccuca

SEQ ID NO: 1766242 - RNA, 20 nt, Salmonella enterica enterica serovar Typhi Ty2
cuguugauacaguaccuuua

SEQ ID NO: 1766243 - RNA, 13 nt, Salmonella enterica enterica serovar Typhi Ty2
cuguucacaucca

SEQ ID NO: 1766244 - RNA, 20 nt, Salmonella enterica enterica serovar Typhi Ty2
cuguucaaguggcaaucgac

SEQ ID NO: 1766245 - RNA, 23 nt, Salmonella enterica enterica serovar Typhi Ty2
cuguucagaaaucggcagcaccc

SEQ ID NO: 1766246 - RNA, 14 nt, Salmonella enterica enterica serovar Typhi Ty2
cuguucacauccag

SEQ ID NO: 1766247 - RNA, 14 nt, Salmonella enterica enterica serovar Typhi Ty2
cuguuccaggcgaa

SEQ ID NO: 1766248 - RNA, 17 nt, Salmonella enterica enterica serovar Typhi Ty2
cuguuccagccgcccgc

SEQ ID NO: 1766249 - RNA, 12 nt, Salmonella enterica enterica serovar Typhi Ty2
cuggcgccggag

SEQ ID NO: 1766250 - RNA, 23 nt, Salmonella enterica enterica serovar Typhi Ty2
cuggcgcgcgcgccuaccgccau

SEQ ID NO: 1766251 - RNA, 22 nt, Salmonella enterica enterica serovar Typhi Ty2
cuggcgcacgcgucaucggcgc

SEQ ID NO: 1766252 - RNA, 19 nt, Salmonella enterica enterica serovar Typhi Ty2
aaacucacguuccccagca

SEQ ID NO: 1766253 - RNA, 18 nt, Salmonella enterica enterica serovar Typhi Ty2
cuggcggccccucuucca

SEQ ID NO: 1766254 - RNA, 13 nt, Salmonella enterica enterica serovar Typhi Ty2
cuggcggccccuc

SEQ ID NO: 1766255 - RNA, 14 nt, Salmonella enterica enterica serovar Typhi Ty2
cuggcggcaaaaac

SEQ ID NO: 1766256 - RNA, 19 nt, Salmonella enterica enterica serovar Typhi Ty2
cuggcgcggggaacacauu

SEQ ID NO: 1766257 - RNA, 18 nt, Salmonella enterica enterica serovar Typhi Ty2
cuggcgcggggaacacac

SEQ ID NO: 1766258 - RNA, 19 nt, Salmonella enterica enterica serovar Typhi Ty2
cuggcgcggggaacaccca

SEQ ID NO: 1766259 - RNA, 17 nt, Salmonella enterica enterica serovar Typhi Ty2
cuggcgcggggaacacc

SEQ ID NO: 1766260 - RNA, 22 nt, Salmonella enterica enterica serovar Typhi Ty2
cuggcgcggggaacacggacag

SEQ ID NO: 1766261 - RNA, 18 nt, Salmonella enterica enterica serovar Typhi Ty2
cuggcgcucaaucagaau

SEQ ID NO: 1766262 - RNA, 16 nt, Salmonella enterica enterica serovar Typhi Ty2
cuggcgcgugcccagu

SEQ ID NO: 1766263 - RNA, 17 nt, Salmonella enterica enterica serovar Typhi Ty2
cuggcggagcugcgcuu

SEQ ID NO: 1766264 - RNA, 19 nt, Salmonella enterica enterica serovar Typhi Ty2
cuggcagcgccugacggcg

SEQ ID NO: 1766265 - RNA, 23 nt, Salmonella enterica enterica serovar Typhi Ty2
cuggcagcagugacauuuaucuu

SEQ ID NO: 1766266 - RNA, 14 nt, Salmonella enterica enterica serovar Typhi Ty2
cuggcacuggcagc

SEQ ID NO: 1766267 - RNA, 18 nt, Salmonella enterica enterica serovar Typhi Ty2
cuggccgcgcuuuuuuaa

SEQ ID NO: 1766268 - RNA, 20 nt, Salmonella enterica enterica serovar Typhi Ty2
cuggccuacggaaagcuguu

SEQ ID NO: 1766269 - RNA, 18 nt, Salmonella enterica enterica serovar Typhi Ty2
cuggccugcagaccuaua

SEQ ID NO: 1766270 - RNA, 16 nt, Salmonella enterica enterica serovar Typhi Ty2
cuggccucccaguucc

SEQ ID NO: 1766271 - RNA, 17 nt, Salmonella enterica enterica serovar Typhi Ty2
cuggccucccaguuccc

SEQ ID NO: 1766272 - RNA, 19 nt, Salmonella enterica enterica serovar Typhi Ty2
cuggcgagaaagugguggg

SEQ ID NO: 1766273 - RNA, 18 nt, Salmonella enterica enterica serovar Typhi Ty2
cuggcgagaaaguggugg

SEQ ID NO: 1766274 - RNA, 15 nt, Salmonella enterica enterica serovar Typhi Ty2
cuggcgaauccggga

SEQ ID NO: 1766275 - RNA, 20 nt, Salmonella enterica enterica serovar Typhi Ty2
cuggcgaauccgggaaaugg

SEQ ID NO: 1766276 - RNA, 22 nt, Salmonella enterica enterica serovar Typhi Ty2
cugggcacgcuaugguacggcg

SEQ ID NO: 1766277 - RNA, 15 nt, Salmonella enterica enterica serovar Typhi Ty2
cugggauuugugcga

SEQ ID NO: 1766278 - RNA, 12 nt, Salmonella enterica enterica serovar Typhi Ty2
cugggccugcuc

SEQ ID NO: 1766279 - RNA, 16 nt, Salmonella enterica enterica serovar Typhi Ty2
cuggcugugccaauaa

SEQ ID NO: 1766280 - RNA, 16 nt, Salmonella enterica enterica serovar Typhi Ty2
cuggcuucagccugug

SEQ ID NO: 1766281 - RNA, 13 nt, Salmonella enterica enterica serovar Typhi Ty2
cuggcuucagccu

SEQ ID NO: 1766282 - RNA, 14 nt, Salmonella enterica enterica serovar Typhi Ty2
cuggcuucagccug

SEQ ID NO: 1766283 - RNA, 22 nt, Salmonella enterica enterica serovar Typhi Ty2
cuggcuucaaccuccugcaauc

SEQ ID NO: 1766284 - RNA, 18 nt, Salmonella enterica enterica serovar Typhi Ty2
cuggcuuacaggcacgcc

SEQ ID NO: 1766285 - RNA, 19 nt, Salmonella enterica enterica serovar Typhi Ty2
cuggcuuugcgccacuuca

SEQ ID NO: 1766286 - RNA, 13 nt, Salmonella enterica enterica serovar Typhi Ty2
cuggcguuaucau

SEQ ID NO: 1766287 - RNA, 17 nt, Salmonella enterica enterica serovar Typhi Ty2
cuggcguuaucguccgu

SEQ ID NO: 1766288 - RNA, 13 nt, Salmonella enterica enterica serovar Typhi Ty2
cuggcguuaaaua

SEQ ID NO: 1766289 - RNA, 15 nt, Salmonella enterica enterica serovar Typhi Ty2
cuggcuaucgccgua

SEQ ID NO: 1766290 - RNA, 13 nt, Salmonella enterica enterica serovar Typhi Ty2
cuggcucagacca

SEQ ID NO: 1766291 - RNA, 13 nt, Salmonella enterica enterica serovar Typhi Ty2
aaacucaucuuua

SEQ ID NO: 1766292 - RNA, 22 nt, Salmonella enterica enterica serovar Typhi Ty2
aaacuccauuaaauuacuuguu

SEQ ID NO: 1766293 - RNA, 12 nt, Salmonella enterica enterica serovar Typhi Ty2
aaacuccagcag

SEQ ID NO: 1766294 - RNA, 19 nt, Salmonella enterica enterica serovar Typhi Ty2
cuggcguccagcccgucca

SEQ ID NO: 1766295 - RNA, 23 nt, Salmonella enterica enterica serovar Typhi Ty2
cuggcgucccuuucccuuccagc

SEQ ID NO: 1766296 - RNA, 23 nt, Salmonella enterica enterica serovar Typhi Ty2
cuggcguagucucccuccugcuc

SEQ ID NO: 1766297 - RNA, 19 nt, Salmonella enterica enterica serovar Typhi Ty2
cuggcgugacguguggcgc

SEQ ID NO: 1766298 - RNA, 16 nt, Salmonella enterica enterica serovar Typhi Ty2
cuggcgucuguccggc

SEQ ID NO: 1766299 - RNA, 14 nt, Salmonella enterica enterica serovar Typhi Ty2
cuggcgucgccaaa

SEQ ID NO: 1766300 - RNA, 20 nt, Salmonella enterica enterica serovar Typhi Ty2
cuggcgguaaauacgcggca

SEQ ID NO: 1766301 - RNA, 22 nt, Salmonella enterica enterica serovar Typhi Ty2
cuggcgguaugaaagccaucgc

SEQ ID NO: 1766302 - RNA, 21 nt, Salmonella enterica enterica serovar Typhi Ty2
cuggcgggcagccuucaaguu

SEQ ID NO: 1766303 - RNA, 20 nt, Salmonella enterica enterica serovar Typhi Ty2
cuggcggucgggaacgcugu

SEQ ID NO: 1766304 - RNA, 23 nt, Salmonella enterica enterica serovar Typhi Ty2
cuggcggugcggucacaggcaua

SEQ ID NO: 1766305 - RNA, 21 nt, Salmonella enterica enterica serovar Typhi Ty2
cuggagcgcauuuuacugccg

SEQ ID NO: 1766306 - RNA, 16 nt, Salmonella enterica enterica serovar Typhi Ty2
cuggagggguuucccc

SEQ ID NO: 1766307 - RNA, 20 nt, Salmonella enterica enterica serovar Typhi Ty2
cuggagugacuaaaagacgc

SEQ ID NO: 1766308 - RNA, 22 nt, Salmonella enterica enterica serovar Typhi Ty2
cuggaagcgcccaggccgggcg

SEQ ID NO: 1766309 - RNA, 14 nt, Salmonella enterica enterica serovar Typhi Ty2
cuggaagccuucaa

SEQ ID NO: 1766310 - RNA, 19 nt, Salmonella enterica enterica serovar Typhi Ty2
cuggaagccccucuuauug

SEQ ID NO: 1766311 - RNA, 18 nt, Salmonella enterica enterica serovar Typhi Ty2
cuggaaguuuugcuggaa

SEQ ID NO: 1766312 - RNA, 14 nt, Salmonella enterica enterica serovar Typhi Ty2
cuggauuaucaaua

SEQ ID NO: 1766313 - RNA, 18 nt, Salmonella enterica enterica serovar Typhi Ty2
cuggauuacaaaaauaga

SEQ ID NO: 1766314 - RNA, 16 nt, Salmonella enterica enterica serovar Typhi Ty2
cuggcacagggcaaua

SEQ ID NO: 1766315 - RNA, 16 nt, Salmonella enterica enterica serovar Typhi Ty2
cuggauagucuucaag

SEQ ID NO: 1766316 - RNA, 22 nt, Salmonella enterica enterica serovar Typhi Ty2
cuggaacaguaaucgcacggcu

SEQ ID NO: 1766317 - RNA, 18 nt, Salmonella enterica enterica serovar Typhi Ty2
cuggaacaggccaaaccc

SEQ ID NO: 1766318 - RNA, 20 nt, Salmonella enterica enterica serovar Typhi Ty2
cugcuuguuuaauggcagaa

SEQ ID NO: 1766319 - RNA, 22 nt, Salmonella enterica enterica serovar Typhi Ty2
cuggaagaaaucguugccuuug

SEQ ID NO: 1766320 - RNA, 16 nt, Salmonella enterica enterica serovar Typhi Ty2
cugcuugccugugccc

SEQ ID NO: 1766321 - RNA, 13 nt, Salmonella enterica enterica serovar Typhi Ty2
cugcugaugccag

SEQ ID NO: 1766322 - RNA, 17 nt, Salmonella enterica enterica serovar Typhi Ty2
cugcuggccuaucuguu

SEQ ID NO: 1766323 - RNA, 17 nt, Salmonella enterica enterica serovar Typhi Ty2
cugcuggucauaacgcu

SEQ ID NO: 1766324 - RNA, 15 nt, Salmonella enterica enterica serovar Typhi Ty2
cugcugguagagcau

SEQ ID NO: 1766325 - RNA, 22 nt, Salmonella enterica enterica serovar Typhi Ty2
cugcuguuaaccuugcgccucu

SEQ ID NO: 1766326 - RNA, 22 nt, Salmonella enterica enterica serovar Typhi Ty2
cugcuguguccaggucaucacc

SEQ ID NO: 1766327 - RNA, 14 nt, Salmonella enterica enterica serovar Typhi Ty2
cugcuuccugccgc

SEQ ID NO: 1766328 - RNA, 20 nt, Salmonella enterica enterica serovar Typhi Ty2
cugcuguagcgucucaucaa

SEQ ID NO: 1766329 - RNA, 16 nt, Salmonella enterica enterica serovar Typhi Ty2
cugcuguaccucuugc

SEQ ID NO: 1766330 - RNA, 12 nt, Salmonella enterica enterica serovar Typhi Ty2
cugcugugcaua

SEQ ID NO: 1766331 - RNA, 15 nt, Salmonella enterica enterica serovar Typhi Ty2
aaacuauccuggccu

SEQ ID NO: 1766332 - RNA, 15 nt, Salmonella enterica enterica serovar Typhi Ty2
cugcugauaauacug

SEQ ID NO: 1766333 - RNA, 22 nt, Salmonella enterica enterica serovar Typhi Ty2
cugcugauaguccaguacccgc

SEQ ID NO: 1766334 - RNA, 15 nt, Salmonella enterica enterica serovar Typhi Ty2
cugcugacguuugca

SEQ ID NO: 1766335 - RNA, 20 nt, Salmonella enterica enterica serovar Typhi Ty2
cugcuagaacauuucccgaa

SEQ ID NO: 1766336 - RNA, 17 nt, Salmonella enterica enterica serovar Typhi Ty2
cugcucccccaguugcu

SEQ ID NO: 1766337 - RNA, 18 nt, Salmonella enterica enterica serovar Typhi Ty2
cugcucauuuaugcgcug

SEQ ID NO: 1766338 - RNA, 21 nt, Salmonella enterica enterica serovar Typhi Ty2
cugcucauuuaugcgcugggc

SEQ ID NO: 1766339 - RNA, 22 nt, Salmonella enterica enterica serovar Typhi Ty2
cugcucauuuaugcgcugggca

SEQ ID NO: 1766340 - RNA, 14 nt, Salmonella enterica enterica serovar Typhi Ty2
cugcgucgcgcgcg

SEQ ID NO: 1766341 - RNA, 16 nt, Salmonella enterica enterica serovar Typhi Ty2
cugcgugaagacacaa

SEQ ID NO: 1766342 - RNA, 15 nt, Salmonella enterica enterica serovar Typhi Ty2
cugcgugaagacaca

SEQ ID NO: 1766343 - RNA, 13 nt, Salmonella enterica enterica serovar Typhi Ty2
cugcgugaaaagg

SEQ ID NO: 1766344 - RNA, 14 nt, Salmonella enterica enterica serovar Typhi Ty2
cugcguccugcuua

SEQ ID NO: 1766345 - RNA, 17 nt, Salmonella enterica enterica serovar Typhi Ty2
cugcggccuugccgcca

SEQ ID NO: 1766346 - RNA, 21 nt, Salmonella enterica enterica serovar Typhi Ty2
cugcggcacgaaaaauaaaaa

SEQ ID NO: 1766347 - RNA, 21 nt, Salmonella enterica enterica serovar Typhi Ty2
cugcggccaugaucgccgcca

SEQ ID NO: 1766348 - RNA, 17 nt, Salmonella enterica enterica serovar Typhi Ty2
cugcgaacagcgcucca

SEQ ID NO: 1766349 - RNA, 22 nt, Salmonella enterica enterica serovar Typhi Ty2
cugcgacgccaggcgccacgau

SEQ ID NO: 1766350 - RNA, 22 nt, Salmonella enterica enterica serovar Typhi Ty2
cugcgaccgagugucgcccgcu

SEQ ID NO: 1766351 - RNA, 23 nt, Salmonella enterica enterica serovar Typhi Ty2
cugcgaccgagugucgcccgcuc

SEQ ID NO: 1766352 - RNA, 11 nt, Salmonella enterica enterica serovar Typhi Ty2
cugcgcuuugu

SEQ ID NO: 1766353 - RNA, 23 nt, Salmonella enterica enterica serovar Typhi Ty2
cugcgaggucaccgggcgaaagc

SEQ ID NO: 1766354 - RNA, 19 nt, Salmonella enterica enterica serovar Typhi Ty2
cugcggaacuaacccgcag

SEQ ID NO: 1766355 - RNA, 15 nt, Salmonella enterica enterica serovar Typhi Ty2
cugcggaacaccagc

SEQ ID NO: 1766356 - RNA, 19 nt, Salmonella enterica enterica serovar Typhi Ty2
cugccaugccuuugacucu

SEQ ID NO: 1766357 - RNA, 24 nt, Salmonella enterica enterica serovar Typhi Ty2
cugccaguagcggaauaucuuccc

SEQ ID NO: 1766358 - RNA, 22 nt, Salmonella enterica enterica serovar Typhi Ty2
cugccagguuauuucgcgcagu

SEQ ID NO: 1766359 - RNA, 18 nt, Salmonella enterica enterica serovar Typhi Ty2
cugccaggcguguggcca

SEQ ID NO: 1766360 - RNA, 13 nt, Salmonella enterica enterica serovar Typhi Ty2
cugccagccgcuc

SEQ ID NO: 1766361 - RNA, 22 nt, Salmonella enterica enterica serovar Typhi Ty2
cugccagcuuaaaucgcggcgc

SEQ ID NO: 1766362 - RNA, 16 nt, Salmonella enterica enterica serovar Typhi Ty2
cugccaccagcguacc

SEQ ID NO: 1766363 - RNA, 14 nt, Salmonella enterica enterica serovar Typhi Ty2
cugccacaucgcca

SEQ ID NO: 1766364 - RNA, 15 nt, Salmonella enterica enterica serovar Typhi Ty2
cugcaucaccucaga

SEQ ID NO: 1766365 - RNA, 16 nt, Salmonella enterica enterica serovar Typhi Ty2
cugcaucaccucagaa

SEQ ID NO: 1766366 - RNA, 13 nt, Salmonella enterica enterica serovar Typhi Ty2
cugcaucagcucg

SEQ ID NO: 1766367 - RNA, 16 nt, Salmonella enterica enterica serovar Typhi Ty2
cugccauuaucaccau

SEQ ID NO: 1766368 - RNA, 14 nt, Salmonella enterica enterica serovar Typhi Ty2
cugccauuucugcu

SEQ ID NO: 1766369 - RNA, 16 nt, Salmonella enterica enterica serovar Typhi Ty2
cugcccacccgggccg

SEQ ID NO: 1766370 - RNA, 18 nt, Salmonella enterica enterica serovar Typhi Ty2
cugccccgccacagccgc

SEQ ID NO: 1766371 - RNA, 17 nt, Salmonella enterica enterica serovar Typhi Ty2
cugccccggugagcgcc

SEQ ID NO: 1766372 - RNA, 14 nt, Salmonella enterica enterica serovar Typhi Ty2
cugccccggcgccu

SEQ ID NO: 1766373 - RNA, 18 nt, Salmonella enterica enterica serovar Typhi Ty2
cugccccggugagcgccg

SEQ ID NO: 1766374 - RNA, 14 nt, Salmonella enterica enterica serovar Typhi Ty2
cugccgacaggcag

SEQ ID NO: 1766375 - RNA, 19 nt, Salmonella enterica enterica serovar Typhi Ty2
cugccgacaaagagcuccc

SEQ ID NO: 1766376 - RNA, 17 nt, Salmonella enterica enterica serovar Typhi Ty2
cugcccuuuuagcacuu

SEQ ID NO: 1766377 - RNA, 18 nt, Salmonella enterica enterica serovar Typhi Ty2
cugcccuuucagagcguc

SEQ ID NO: 1766378 - RNA, 13 nt, Salmonella enterica enterica serovar Typhi Ty2
cugcccugcggua

SEQ ID NO: 1766379 - RNA, 17 nt, Salmonella enterica enterica serovar Typhi Ty2
cugccgcgcccgcgccg

SEQ ID NO: 1766380 - RNA, 17 nt, Salmonella enterica enterica serovar Typhi Ty2
cugccgcgccugauuca

SEQ ID NO: 1766381 - RNA, 18 nt, Salmonella enterica enterica serovar Typhi Ty2
cugccgucccagcggaug

SEQ ID NO: 1766382 - RNA, 14 nt, Salmonella enterica enterica serovar Typhi Ty2
cugccguccgcucu

SEQ ID NO: 1766383 - RNA, 21 nt, Salmonella enterica enterica serovar Typhi Ty2
cugccgucaaugccuggcaga

SEQ ID NO: 1766384 - RNA, 15 nt, Salmonella enterica enterica serovar Typhi Ty2
cugccgucaauuuua

SEQ ID NO: 1766385 - RNA, 13 nt, Salmonella enterica enterica serovar Typhi Ty2
cugccgucaucga

SEQ ID NO: 1766386 - RNA, 14 nt, Salmonella enterica enterica serovar Typhi Ty2
cugccgucgcggcu

SEQ ID NO: 1766387 - RNA, 12 nt, Salmonella enterica enterica serovar Typhi Ty2
cugccguccuga

SEQ ID NO: 1766388 - RNA, 21 nt, Salmonella enterica enterica serovar Typhi Ty2
cugccguaaacaggcaggccc

SEQ ID NO: 1766389 - RNA, 13 nt, Salmonella enterica enterica serovar Typhi Ty2
cugcagggccgcg

SEQ ID NO: 1766390 - RNA, 21 nt, Salmonella enterica enterica serovar Typhi Ty2
cugcauaauggcgacggccac

SEQ ID NO: 1766391 - RNA, 23 nt, Salmonella enterica enterica serovar Typhi Ty2
cugcaggcgggugcgcagcccca

SEQ ID NO: 1766392 - RNA, 15 nt, Salmonella enterica enterica serovar Typhi Ty2
cugcauauuuuucau

SEQ ID NO: 1766393 - RNA, 11 nt, Salmonella enterica enterica serovar Typhi Ty2
cugcaggccaa

SEQ ID NO: 1766394 - RNA, 13 nt, Salmonella enterica enterica serovar Typhi Ty2
cugcagcgccaga

SEQ ID NO: 1766395 - RNA, 16 nt, Salmonella enterica enterica serovar Typhi Ty2
cugcagccauacauug

SEQ ID NO: 1766396 - RNA, 22 nt, Salmonella enterica enterica serovar Typhi Ty2
cugcagaaucccgauaaucaau

SEQ ID NO: 1766397 - RNA, 23 nt, Salmonella enterica enterica serovar Typhi Ty2
cugcagacccacuuucagcuccg

SEQ ID NO: 1766398 - RNA, 22 nt, Salmonella enterica enterica serovar Typhi Ty2
cugcacuuuaaaccacaccuga

SEQ ID NO: 1766399 - RNA, 22 nt, Salmonella enterica enterica serovar Typhi Ty2
cugcagauuuugcucccuggug

SEQ ID NO: 1766400 - RNA, 22 nt, Salmonella enterica enterica serovar Typhi Ty2
cugcacguuuugcucuucuucc

SEQ ID NO: 1766401 - RNA, 15 nt, Salmonella enterica enterica serovar Typhi Ty2
cugcacuaaaccaga

SEQ ID NO: 1766402 - RNA, 14 nt, Salmonella enterica enterica serovar Typhi Ty2
cugcacucggaugu

SEQ ID NO: 1766403 - RNA, 19 nt, Salmonella enterica enterica serovar Typhi Ty2
cugcacuuuaagcggcagc

SEQ ID NO: 1766404 - RNA, 14 nt, Salmonella enterica enterica serovar Typhi Ty2
cugcacuuccugcg

SEQ ID NO: 1766405 - RNA, 17 nt, Salmonella enterica enterica serovar Typhi Ty2
cugcacuuccagccacg

SEQ ID NO: 1766406 - RNA, 23 nt, Salmonella enterica enterica serovar Typhi Ty2
cugcacauugcaggcuuuuucau

SEQ ID NO: 1766407 - RNA, 12 nt, Salmonella enterica enterica serovar Typhi Ty2
cugcacaucccg

SEQ ID NO: 1766408 - RNA, 23 nt, Salmonella enterica enterica serovar Typhi Ty2
cugcaccaggagcaaaccgaccc

SEQ ID NO: 1766409 - RNA, 18 nt, Salmonella enterica enterica serovar Typhi Ty2
cugcaaaucuucggcaaa

SEQ ID NO: 1766410 - RNA, 16 nt, Salmonella enterica enterica serovar Typhi Ty2
cugcaacagcaccagc

SEQ ID NO: 1766411 - RNA, 18 nt, Salmonella enterica enterica serovar Typhi Ty2
cugcaacagcaccagcag

SEQ ID NO: 1766412 - RNA, 19 nt, Salmonella enterica enterica serovar Typhi Ty2
cugcaacauuacugaccga

SEQ ID NO: 1766413 - RNA, 15 nt, Salmonella enterica enterica serovar Typhi Ty2
cugcacccaucuuua

SEQ ID NO: 1766414 - RNA, 24 nt, Salmonella enterica enterica serovar Typhi Ty2
cugcaccuuuuuuuccagcgucug

SEQ ID NO: 1766415 - RNA, 14 nt, Salmonella enterica enterica serovar Typhi Ty2
cugcaccuggucga

SEQ ID NO: 1766416 - RNA, 14 nt, Salmonella enterica enterica serovar Typhi Ty2
cugcaccucagacc

SEQ ID NO: 1766417 - RNA, 15 nt, Salmonella enterica enterica serovar Typhi Ty2
cugcacggcauacuc

SEQ ID NO: 1766418 - RNA, 17 nt, Salmonella enterica enterica serovar Typhi Ty2
cugcacgaaauguagag

SEQ ID NO: 1766419 - RNA, 19 nt, Salmonella enterica enterica serovar Typhi Ty2
cugauagggacacauuucu

SEQ ID NO: 1766420 - RNA, 20 nt, Salmonella enterica enterica serovar Typhi Ty2
cugauagggacacauuucuu

SEQ ID NO: 1766421 - RNA, 16 nt, Salmonella enterica enterica serovar Typhi Ty2
cugauagccgccagug

SEQ ID NO: 1766422 - RNA, 13 nt, Salmonella enterica enterica serovar Typhi Ty2
cugauagcgggua

SEQ ID NO: 1766423 - RNA, 19 nt, Salmonella enterica enterica serovar Typhi Ty2
cugauagcccauccagcac

SEQ ID NO: 1766424 - RNA, 18 nt, Salmonella enterica enterica serovar Typhi Ty2
cugauaagcgcagcgcca

SEQ ID NO: 1766425 - RNA, 14 nt, Salmonella enterica enterica serovar Typhi Ty2
cugauacugcuccg

SEQ ID NO: 1766426 - RNA, 20 nt, Salmonella enterica enterica serovar Typhi Ty2
cugauaagacugauauccau

SEQ ID NO: 1766427 - RNA, 18 nt, Salmonella enterica enterica serovar Typhi Ty2
cugauaaccuauuuugca

SEQ ID NO: 1766428 - RNA, 20 nt, Salmonella enterica enterica serovar Typhi Ty2
cugauaaagcuuucaucuuu

SEQ ID NO: 1766429 - RNA, 22 nt, Salmonella enterica enterica serovar Typhi Ty2
cugaguauaaaacucgccgcga

SEQ ID NO: 1766430 - RNA, 18 nt, Salmonella enterica enterica serovar Typhi Ty2
cugauaaaacgcaggcag

SEQ ID NO: 1766431 - RNA, 17 nt, Salmonella enterica enterica serovar Typhi Ty2
cugagcuaaucacccac

SEQ ID NO: 1766432 - RNA, 14 nt, Salmonella enterica enterica serovar Typhi Ty2
cugagcuaacgacc

SEQ ID NO: 1766433 - RNA, 16 nt, Salmonella enterica enterica serovar Typhi Ty2
cugagcucacuuuuug

SEQ ID NO: 1766434 - RNA, 20 nt, Salmonella enterica enterica serovar Typhi Ty2
cugaggaguauuauccauug

SEQ ID NO: 1766435 - RNA, 12 nt, Salmonella enterica enterica serovar Typhi Ty2
cugagcgcgcag

SEQ ID NO: 1766436 - RNA, 17 nt, Salmonella enterica enterica serovar Typhi Ty2
cugagcgccgccaagau

SEQ ID NO: 1766437 - RNA, 19 nt, Salmonella enterica enterica serovar Typhi Ty2
cugagaaaaauacgccaga

SEQ ID NO: 1766438 - RNA, 22 nt, Salmonella enterica enterica serovar Typhi Ty2
cugagcgaauccccgggaacau

SEQ ID NO: 1766439 - RNA, 16 nt, Salmonella enterica enterica serovar Typhi Ty2
cugaugacgcgccgga

SEQ ID NO: 1766440 - RNA, 21 nt, Salmonella enterica enterica serovar Typhi Ty2
cugauggcguggcgcaguaaa

SEQ ID NO: 1766441 - RNA, 21 nt, Salmonella enterica enterica serovar Typhi Ty2
cugauggcgaaaaugguuuug

SEQ ID NO: 1766442 - RNA, 14 nt, Salmonella enterica enterica serovar Typhi Ty2
cugauggcguucca

SEQ ID NO: 1766443 - RNA, 18 nt, Salmonella enterica enterica serovar Typhi Ty2
cugauggcgcuacguuua

SEQ ID NO: 1766444 - RNA, 17 nt, Salmonella enterica enterica serovar Typhi Ty2
cugauggcuuugcuguc

SEQ ID NO: 1766445 - RNA, 17 nt, Salmonella enterica enterica serovar Typhi Ty2
cugaugagcaggccagg

SEQ ID NO: 1766446 - RNA, 19 nt, Salmonella enterica enterica serovar Typhi Ty2
cugaugcuggcagaaggca

SEQ ID NO: 1766447 - RNA, 21 nt, Salmonella enterica enterica serovar Typhi Ty2
cugauguuugcgcucuuuuuu

SEQ ID NO: 1766448 - RNA, 22 nt, Salmonella enterica enterica serovar Typhi Ty2
cugauuacguugauuaucaccc

SEQ ID NO: 1766449 - RNA, 21 nt, Salmonella enterica enterica serovar Typhi Ty2
cugauuaaugauuugcuuuau

SEQ ID NO: 1766450 - RNA, 20 nt, Salmonella enterica enterica serovar Typhi Ty2
cugauuucgacgauaaaaaa

SEQ ID NO: 1766451 - RNA, 19 nt, Salmonella enterica enterica serovar Typhi Ty2
cugauuucgccccacuggc

SEQ ID NO: 1766452 - RNA, 13 nt, Salmonella enterica enterica serovar Typhi Ty2
cugauuugccaaa

SEQ ID NO: 1766453 - RNA, 14 nt, Salmonella enterica enterica serovar Typhi Ty2
cugauuuucuccag

SEQ ID NO: 1766454 - RNA, 13 nt, Salmonella enterica enterica serovar Typhi Ty2
cugauucaauuaa

SEQ ID NO: 1766455 - RNA, 15 nt, Salmonella enterica enterica serovar Typhi Ty2
cugauuauucaguac

SEQ ID NO: 1766456 - RNA, 22 nt, Salmonella enterica enterica serovar Typhi Ty2
cugauuauucaguaccgccuuc

SEQ ID NO: 1766457 - RNA, 15 nt, Salmonella enterica enterica serovar Typhi Ty2
cugaauagccagccc

SEQ ID NO: 1766458 - RNA, 18 nt, Salmonella enterica enterica serovar Typhi Ty2
cugaauaacccgcagccc

SEQ ID NO: 1766459 - RNA, 22 nt, Salmonella enterica enterica serovar Typhi Ty2
cugaauaaucggcgucauuuuc

SEQ ID NO: 1766460 - RNA, 21 nt, Salmonella enterica enterica serovar Typhi Ty2
cugaauaaauaguauaacgau

SEQ ID NO: 1766461 - RNA, 17 nt, Salmonella enterica enterica serovar Typhi Ty2
cugaaguaucgacgcag

SEQ ID NO: 1766462 - RNA, 19 nt, Salmonella enterica enterica serovar Typhi Ty2
cucuacuuuccugaaggua

SEQ ID NO: 1766463 - RNA, 15 nt, Salmonella enterica enterica serovar Typhi Ty2
cugaagguuuuuccc

SEQ ID NO: 1766464 - RNA, 15 nt, Salmonella enterica enterica serovar Typhi Ty2
cucuacuuuccugaa

SEQ ID NO: 1766465 - RNA, 12 nt, Salmonella enterica enterica serovar Typhi Ty2
cucuacauuucg

SEQ ID NO: 1766466 - RNA, 23 nt, Salmonella enterica enterica serovar Typhi Ty2
cugaaucagauacggcuccagca

SEQ ID NO: 1766467 - RNA, 20 nt, Salmonella enterica enterica serovar Typhi Ty2
cugaauaugcgucagauguu

SEQ ID NO: 1766468 - RNA, 13 nt, Salmonella enterica enterica serovar Typhi Ty2
cugaauaucuucg

SEQ ID NO: 1766469 - RNA, 20 nt, Salmonella enterica enterica serovar Typhi Ty2
cugaaucuugcgcagcauau

SEQ ID NO: 1766470 - RNA, 16 nt, Salmonella enterica enterica serovar Typhi Ty2
cugaaucucuucccag

SEQ ID NO: 1766471 - RNA, 14 nt, Salmonella enterica enterica serovar Typhi Ty2
cugaaucugcuccg

SEQ ID NO: 1766472 - RNA, 16 nt, Salmonella enterica enterica serovar Typhi Ty2
cugaauuaucaggguu

SEQ ID NO: 1766473 - RNA, 14 nt, Salmonella enterica enterica serovar Typhi Ty2
cugaaugcucucau

SEQ ID NO: 1766474 - RNA, 21 nt, Salmonella enterica enterica serovar Typhi Ty2
cugaaugccuuuuacaauaac

SEQ ID NO: 1766475 - RNA, 22 nt, Salmonella enterica enterica serovar Typhi Ty2
cugaaugcugacgcguuuuuuc

SEQ ID NO: 1766476 - RNA, 12 nt, Salmonella enterica enterica serovar Typhi Ty2
cugaaugguucc

SEQ ID NO: 1766477 - RNA, 17 nt, Salmonella enterica enterica serovar Typhi Ty2
cugacgacgccagcccu

SEQ ID NO: 1766478 - RNA, 16 nt, Salmonella enterica enterica serovar Typhi Ty2
cugacgauaucgucac

SEQ ID NO: 1766479 - RNA, 12 nt, Salmonella enterica enterica serovar Typhi Ty2
cugacgcagcag

SEQ ID NO: 1766480 - RNA, 15 nt, Salmonella enterica enterica serovar Typhi Ty2
cugacgcaaucuguu

SEQ ID NO: 1766481 - RNA, 21 nt, Salmonella enterica enterica serovar Typhi Ty2
cugacgggcauuguuaaucca

SEQ ID NO: 1766482 - RNA, 19 nt, Salmonella enterica enterica serovar Typhi Ty2
cugacgggcauuguuaauc

SEQ ID NO: 1766483 - RNA, 16 nt, Salmonella enterica enterica serovar Typhi Ty2
cugacgccaggccauc

SEQ ID NO: 1766484 - RNA, 18 nt, Salmonella enterica enterica serovar Typhi Ty2
cugacgcccaucagcauc

SEQ ID NO: 1766485 - RNA, 16 nt, Salmonella enterica enterica serovar Typhi Ty2
cugacguugcgggccu

SEQ ID NO: 1766486 - RNA, 19 nt, Salmonella enterica enterica serovar Typhi Ty2
cugacugcgugagugugga

SEQ ID NO: 1766487 - RNA, 13 nt, Salmonella enterica enterica serovar Typhi Ty2
cugacuguaauuu

SEQ ID NO: 1766488 - RNA, 14 nt, Salmonella enterica enterica serovar Typhi Ty2
cugacugcugucau

SEQ ID NO: 1766489 - RNA, 18 nt, Salmonella enterica enterica serovar Typhi Ty2
cugacggugguaaaucag

SEQ ID NO: 1766490 - RNA, 13 nt, Salmonella enterica enterica serovar Typhi Ty2
cugaccgcuccag

SEQ ID NO: 1766491 - RNA, 20 nt, Salmonella enterica enterica serovar Typhi Ty2
cugaccgcgaucgcuggacg

SEQ ID NO: 1766492 - RNA, 19 nt, Salmonella enterica enterica serovar Typhi Ty2
cugaccgguaaauuucacu

SEQ ID NO: 1766493 - RNA, 14 nt, Salmonella enterica enterica serovar Typhi Ty2
cugaccgagaucag

SEQ ID NO: 1766494 - RNA, 23 nt, Salmonella enterica enterica serovar Typhi Ty2
cugaauuuacgccguccggcgaa

SEQ ID NO: 1766495 - RNA, 18 nt, Salmonella enterica enterica serovar Typhi Ty2
cugacaaaaacggcuuua

SEQ ID NO: 1766496 - RNA, 21 nt, Salmonella enterica enterica serovar Typhi Ty2
cugacagaauauaggagagcg

SEQ ID NO: 1766497 - RNA, 16 nt, Salmonella enterica enterica serovar Typhi Ty2
cugacauaaucaugaa

SEQ ID NO: 1766498 - RNA, 15 nt, Salmonella enterica enterica serovar Typhi Ty2
cugacagugacggca

SEQ ID NO: 1766499 - RNA, 23 nt, Salmonella enterica enterica serovar Typhi Ty2
cugacaggccggauuagcgacag

SEQ ID NO: 1766500 - RNA, 22 nt, Salmonella enterica enterica serovar Typhi Ty2
cguugaguauugacgaaaagau

SEQ ID NO: 1766501 - RNA, 15 nt, Salmonella enterica enterica serovar Typhi Ty2
cguucucauugcugu

SEQ ID NO: 1766502 - RNA, 22 nt, Salmonella enterica enterica serovar Typhi Ty2
cguucuauugucaccgggcgcu

SEQ ID NO: 1766503 - RNA, 13 nt, Salmonella enterica enterica serovar Typhi Ty2
cguucggguuuuc

SEQ ID NO: 1766504 - RNA, 16 nt, Salmonella enterica enterica serovar Typhi Ty2
cguucggguuuuccug

SEQ ID NO: 1766505 - RNA, 17 nt, Salmonella enterica enterica serovar Typhi Ty2
cguucagcauauccagc

SEQ ID NO: 1766506 - RNA, 12 nt, Salmonella enterica enterica serovar Typhi Ty2
cguucagccagc

SEQ ID NO: 1766507 - RNA, 14 nt, Salmonella enterica enterica serovar Typhi Ty2
cguucauccgacca

SEQ ID NO: 1766508 - RNA, 12 nt, Salmonella enterica enterica serovar Typhi Ty2
cguucauccucc

SEQ ID NO: 1766509 - RNA, 16 nt, Salmonella enterica enterica serovar Typhi Ty2
cguucaucggcauaca

SEQ ID NO: 1766510 - RNA, 14 nt, Salmonella enterica enterica serovar Typhi Ty2
cguucaucaggcaa

SEQ ID NO: 1766511 - RNA, 21 nt, Salmonella enterica enterica serovar Typhi Ty2
cguucagauaggcgcgaaaug

SEQ ID NO: 1766512 - RNA, 23 nt, Salmonella enterica enterica serovar Typhi Ty2
cguucacuaacgcggcaucaagc

SEQ ID NO: 1766513 - RNA, 21 nt, Salmonella enterica enterica serovar Typhi Ty2
cguucacaccgccgccagcca

SEQ ID NO: 1766514 - RNA, 19 nt, Salmonella enterica enterica serovar Typhi Ty2
cguucaccagccacugcgc

SEQ ID NO: 1766515 - RNA, 18 nt, Salmonella enterica enterica serovar Typhi Ty2
cguucaaaaucaaacaga

SEQ ID NO: 1766516 - RNA, 20 nt, Salmonella enterica enterica serovar Typhi Ty2
cguuauugaccaucgccagc

SEQ ID NO: 1766517 - RNA, 12 nt, Salmonella enterica enterica serovar Typhi Ty2
cguuauggaagu

SEQ ID NO: 1766518 - RNA, 18 nt, Salmonella enterica enterica serovar Typhi Ty2
cguuauccagcagccaca

SEQ ID NO: 1766519 - RNA, 20 nt, Salmonella enterica enterica serovar Typhi Ty2
cguuaucaaaaaaaaccaga

SEQ ID NO: 1766520 - RNA, 19 nt, Salmonella enterica enterica serovar Typhi Ty2
cguuacuuucauaauguuc

SEQ ID NO: 1766521 - RNA, 15 nt, Salmonella enterica enterica serovar Typhi Ty2
cguuaggccacuuca

SEQ ID NO: 1766522 - RNA, 19 nt, Salmonella enterica enterica serovar Typhi Ty2
cguuagcgacggcgcgccg

SEQ ID NO: 1766523 - RNA, 22 nt, Salmonella enterica enterica serovar Typhi Ty2
cguuagcgccauccggcauuuc

SEQ ID NO: 1766524 - RNA, 15 nt, Salmonella enterica enterica serovar Typhi Ty2
cguuaccggcaggcu

SEQ ID NO: 1766525 - RNA, 16 nt, Salmonella enterica enterica serovar Typhi Ty2
cguuaccgggcaaacg

SEQ ID NO: 1766526 - RNA, 15 nt, Salmonella enterica enterica serovar Typhi Ty2
cguuacccggccagc

SEQ ID NO: 1766527 - RNA, 20 nt, Salmonella enterica enterica serovar Typhi Ty2
cguuacggcugaagcugccg

SEQ ID NO: 1766528 - RNA, 15 nt, Salmonella enterica enterica serovar Typhi Ty2
cguuacuucccccau

SEQ ID NO: 1766529 - RNA, 22 nt, Salmonella enterica enterica serovar Typhi Ty2
cguuacgcgccacgccauugcu

SEQ ID NO: 1766530 - RNA, 12 nt, Salmonella enterica enterica serovar Typhi Ty2
cguggcaucuua

SEQ ID NO: 1766531 - RNA, 15 nt, Salmonella enterica enterica serovar Typhi Ty2
cguggccaaaaaauc

SEQ ID NO: 1766532 - RNA, 16 nt, Salmonella enterica enterica serovar Typhi Ty2
cguggcaaggaacagu

SEQ ID NO: 1766533 - RNA, 23 nt, Salmonella enterica enterica serovar Typhi Ty2
cguuaauugauggcaccaccugg

SEQ ID NO: 1766534 - RNA, 22 nt, Salmonella enterica enterica serovar Typhi Ty2
cguuaaugcgcgcuucuucaug

SEQ ID NO: 1766535 - RNA, 17 nt, Salmonella enterica enterica serovar Typhi Ty2
cguuaauucauggccau

SEQ ID NO: 1766536 - RNA, 22 nt, Salmonella enterica enterica serovar Typhi Ty2
cguggccagcaugcccgccagc

SEQ ID NO: 1766537 - RNA, 22 nt, Salmonella enterica enterica serovar Typhi Ty2
cguuaauccaaauccgcauuuc

SEQ ID NO: 1766538 - RNA, 15 nt, Salmonella enterica enterica serovar Typhi Ty2
cguuaauaccgugca

SEQ ID NO: 1766539 - RNA, 23 nt, Salmonella enterica enterica serovar Typhi Ty2
cguuaccccgcagcgaaaaucca

SEQ ID NO: 1766540 - RNA, 17 nt, Salmonella enterica enterica serovar Typhi Ty2
cguuaccccuuuuucaa

SEQ ID NO: 1766541 - RNA, 20 nt, Salmonella enterica enterica serovar Typhi Ty2
cguuacccgauaccgccagc

SEQ ID NO: 1766542 - RNA, 12 nt, Salmonella enterica enterica serovar Typhi Ty2
cguuaccagcau

SEQ ID NO: 1766543 - RNA, 19 nt, Salmonella enterica enterica serovar Typhi Ty2
cuaaaauuauuuuuacuua

SEQ ID NO: 1766544 - RNA, 14 nt, Salmonella enterica enterica serovar Typhi Ty2
cuaaaaaccagaau

SEQ ID NO: 1766545 - RNA, 20 nt, Salmonella enterica enterica serovar Typhi Ty2
cguuuugcucuucuuccggc

SEQ ID NO: 1766546 - RNA, 17 nt, Salmonella enterica enterica serovar Typhi Ty2
cguuuuggcagcgcccg

SEQ ID NO: 1766547 - RNA, 15 nt, Salmonella enterica enterica serovar Typhi Ty2
cguuuucaugcacga

SEQ ID NO: 1766548 - RNA, 18 nt, Salmonella enterica enterica serovar Typhi Ty2
cguuuucauuagccgcca

SEQ ID NO: 1766549 - RNA, 19 nt, Salmonella enterica enterica serovar Typhi Ty2
cguuuucauuagccgccag

SEQ ID NO: 1766550 - RNA, 15 nt, Salmonella enterica enterica serovar Typhi Ty2
cguuuuccagcucac

SEQ ID NO: 1766551 - RNA, 21 nt, Salmonella enterica enterica serovar Typhi Ty2
cguuuuccagcaccaguugcg

SEQ ID NO: 1766552 - RNA, 14 nt, Salmonella enterica enterica serovar Typhi Ty2
cguuuuccagcauc

SEQ ID NO: 1766553 - RNA, 18 nt, Salmonella enterica enterica serovar Typhi Ty2
cguuuuagguucuucaau

SEQ ID NO: 1766554 - RNA, 18 nt, Salmonella enterica enterica serovar Typhi Ty2
cguuuuucccgcuggcug

SEQ ID NO: 1766555 - RNA, 17 nt, Salmonella enterica enterica serovar Typhi Ty2
cguuuuucagccgcgca

SEQ ID NO: 1766556 - RNA, 19 nt, Salmonella enterica enterica serovar Typhi Ty2
cguuuuuucgcacgccucu

SEQ ID NO: 1766557 - RNA, 16 nt, Salmonella enterica enterica serovar Typhi Ty2
cguuuaaaaagcugca

SEQ ID NO: 1766558 - RNA, 16 nt, Salmonella enterica enterica serovar Typhi Ty2
cguuuaaacucccggc

SEQ ID NO: 1766559 - RNA, 16 nt, Salmonella enterica enterica serovar Typhi Ty2
cguuucgccaguuuac

SEQ ID NO: 1766560 - RNA, 22 nt, Salmonella enterica enterica serovar Typhi Ty2
cguuucgauaaccaccagcgga

SEQ ID NO: 1766561 - RNA, 16 nt, Salmonella enterica enterica serovar Typhi Ty2
cguuuccgcaauaagu

SEQ ID NO: 1766562 - RNA, 21 nt, Salmonella enterica enterica serovar Typhi Ty2
cguuuguaacagcaggacccg

SEQ ID NO: 1766563 - RNA, 13 nt, Salmonella enterica enterica serovar Typhi Ty2
cguuuguaacagc

SEQ ID NO: 1766564 - RNA, 16 nt, Salmonella enterica enterica serovar Typhi Ty2
cguuuggucaacucuu

SEQ ID NO: 1766565 - RNA, 21 nt, Salmonella enterica enterica serovar Typhi Ty2
cguugauguuuuuaaaagaag

SEQ ID NO: 1766566 - RNA, 22 nt, Salmonella enterica enterica serovar Typhi Ty2
cguugaugugcccguuccaggc

SEQ ID NO: 1766567 - RNA, 18 nt, Salmonella enterica enterica serovar Typhi Ty2
cguugauuaucacccaca

SEQ ID NO: 1766568 - RNA, 16 nt, Salmonella enterica enterica serovar Typhi Ty2
cguugccagcggccag

SEQ ID NO: 1766569 - RNA, 17 nt, Salmonella enterica enterica serovar Typhi Ty2
cguuguguccagggugu

SEQ ID NO: 1766570 - RNA, 15 nt, Salmonella enterica enterica serovar Typhi Ty2
cguugugcugcggca

SEQ ID NO: 1766571 - RNA, 15 nt, Salmonella enterica enterica serovar Typhi Ty2
cguugugcaagcuca

SEQ ID NO: 1766572 - RNA, 17 nt, Salmonella enterica enterica serovar Typhi Ty2
cguugugcagaaucauu

SEQ ID NO: 1766573 - RNA, 18 nt, Salmonella enterica enterica serovar Typhi Ty2
cguugucuucaucuaucc

SEQ ID NO: 1766574 - RNA, 13 nt, Salmonella enterica enterica serovar Typhi Ty2
cguuguauaaaca

SEQ ID NO: 1766575 - RNA, 21 nt, Salmonella enterica enterica serovar Typhi Ty2
cguugucauggcgccaccagc

SEQ ID NO: 1766576 - RNA, 22 nt, Salmonella enterica enterica serovar Typhi Ty2
cuaauccccauuuuuuucagcc

SEQ ID NO: 1766577 - RNA, 16 nt, Salmonella enterica enterica serovar Typhi Ty2
cuaauccccagcgcuc

SEQ ID NO: 1766578 - RNA, 16 nt, Salmonella enterica enterica serovar Typhi Ty2
cuaauccccauuuuuu

SEQ ID NO: 1766579 - RNA, 22 nt, Salmonella enterica enterica serovar Typhi Ty2
cuaauccucuucucugaaaaga

SEQ ID NO: 1766580 - RNA, 16 nt, Salmonella enterica enterica serovar Typhi Ty2
cuaaugauuaucuuuu

SEQ ID NO: 1766581 - RNA, 21 nt, Salmonella enterica enterica serovar Typhi Ty2
cuaaugauuaucuuuuuuagu

SEQ ID NO: 1766582 - RNA, 19 nt, Salmonella enterica enterica serovar Typhi Ty2
cuaaugggccagauucuua

SEQ ID NO: 1766583 - RNA, 16 nt, Salmonella enterica enterica serovar Typhi Ty2
cuaauaaaauucacuu

SEQ ID NO: 1766584 - RNA, 21 nt, Salmonella enterica enterica serovar Typhi Ty2
cuaaucaauaaguuuuuucuu

SEQ ID NO: 1766585 - RNA, 13 nt, Salmonella enterica enterica serovar Typhi Ty2
cuaauuuuacuuu

SEQ ID NO: 1766586 - RNA, 12 nt, Salmonella enterica enterica serovar Typhi Ty2
cuaauuccagga

SEQ ID NO: 1766587 - RNA, 15 nt, Salmonella enterica enterica serovar Typhi Ty2
cuaauuauuuuucaa

SEQ ID NO: 1766588 - RNA, 19 nt, Salmonella enterica enterica serovar Typhi Ty2
cuaauuauuuuucaaauga

SEQ ID NO: 1766589 - RNA, 19 nt, Salmonella enterica enterica serovar Typhi Ty2
cuaauuaaucugucgaugc

SEQ ID NO: 1766590 - RNA, 14 nt, Salmonella enterica enterica serovar Typhi Ty2
cuaagaccagcauc

SEQ ID NO: 1766591 - RNA, 13 nt, Salmonella enterica enterica serovar Typhi Ty2
cuaagaccagcau

SEQ ID NO: 1766592 - RNA, 12 nt, Salmonella enterica enterica serovar Typhi Ty2
cuaagccagaag

SEQ ID NO: 1766593 - RNA, 17 nt, Salmonella enterica enterica serovar Typhi Ty2
cuaagccaguucucaau

SEQ ID NO: 1766594 - RNA, 21 nt, Salmonella enterica enterica serovar Typhi Ty2
cuaagcagaacggcgauacuc

SEQ ID NO: 1766595 - RNA, 16 nt, Salmonella enterica enterica serovar Typhi Ty2
cuaagccggcaggcag

SEQ ID NO: 1766596 - RNA, 19 nt, Salmonella enterica enterica serovar Typhi Ty2
cuaagccggacgcccgucc

SEQ ID NO: 1766597 - RNA, 20 nt, Salmonella enterica enterica serovar Typhi Ty2
cuaagggguugaugccgacc

SEQ ID NO: 1766598 - RNA, 15 nt, Salmonella enterica enterica serovar Typhi Ty2
cuaaggccuuauugu

SEQ ID NO: 1766599 - RNA, 18 nt, Salmonella enterica enterica serovar Typhi Ty2
cuaauaaaauaacuauaa

SEQ ID NO: 1766600 - RNA, 16 nt, Salmonella enterica enterica serovar Typhi Ty2
cuaauaaaauaacuau

SEQ ID NO: 1766601 - RNA, 16 nt, Salmonella enterica enterica serovar Typhi Ty2
cuaaaccuucgcuuuu

SEQ ID NO: 1766602 - RNA, 21 nt, Salmonella enterica enterica serovar Typhi Ty2
cuaaaccacaugaccagcgcc

SEQ ID NO: 1766603 - RNA, 14 nt, Salmonella enterica enterica serovar Typhi Ty2
cuaaaccacggaau

SEQ ID NO: 1766604 - RNA, 17 nt, Salmonella enterica enterica serovar Typhi Ty2
cuaaacccaccauaggc

SEQ ID NO: 1766605 - RNA, 12 nt, Salmonella enterica enterica serovar Typhi Ty2
cuaacagcagca

SEQ ID NO: 1766606 - RNA, 17 nt, Salmonella enterica enterica serovar Typhi Ty2
cuaacucaauaacgacu

SEQ ID NO: 1766607 - RNA, 20 nt, Salmonella enterica enterica serovar Typhi Ty2
cuaacugguacguccauccg

SEQ ID NO: 1766608 - RNA, 20 nt, Salmonella enterica enterica serovar Typhi Ty2
cuaacugcggcuuacccuga

SEQ ID NO: 1766609 - RNA, 15 nt, Salmonella enterica enterica serovar Typhi Ty2
cuaacgcucuucucc

SEQ ID NO: 1766610 - RNA, 15 nt, Salmonella enterica enterica serovar Typhi Ty2
cuaacgucagcgcca

SEQ ID NO: 1766611 - RNA, 18 nt, Salmonella enterica enterica serovar Typhi Ty2
cuaacgcgaagauuaacc

SEQ ID NO: 1766612 - RNA, 18 nt, Salmonella enterica enterica serovar Typhi Ty2
cuaacgcggcaucaagca

SEQ ID NO: 1766613 - RNA, 15 nt, Salmonella enterica enterica serovar Typhi Ty2
cuaacgaggccacca

SEQ ID NO: 1766614 - RNA, 14 nt, Salmonella enterica enterica serovar Typhi Ty2
cgucggccaccauu

SEQ ID NO: 1766615 - RNA, 20 nt, Salmonella enterica enterica serovar Typhi Ty2
cgucgccaaagcagcugcug

SEQ ID NO: 1766616 - RNA, 19 nt, Salmonella enterica enterica serovar Typhi Ty2
cgucgccagacccagcgcu

SEQ ID NO: 1766617 - RNA, 14 nt, Salmonella enterica enterica serovar Typhi Ty2
cgucgccaaagcag

SEQ ID NO: 1766618 - RNA, 22 nt, Salmonella enterica enterica serovar Typhi Ty2
cgucgccauauccaagccccuc

SEQ ID NO: 1766619 - RNA, 16 nt, Salmonella enterica enterica serovar Typhi Ty2
cgucgcgcgccgccug

SEQ ID NO: 1766620 - RNA, 12 nt, Salmonella enterica enterica serovar Typhi Ty2
cgucgcgcgccg

SEQ ID NO: 1766621 - RNA, 14 nt, Salmonella enterica enterica serovar Typhi Ty2
cgucgcgcgccgcc

SEQ ID NO: 1766622 - RNA, 17 nt, Salmonella enterica enterica serovar Typhi Ty2
cgucguuucguguuguc

SEQ ID NO: 1766623 - RNA, 14 nt, Salmonella enterica enterica serovar Typhi Ty2
cgucguugccuuug

SEQ ID NO: 1766624 - RNA, 21 nt, Salmonella enterica enterica serovar Typhi Ty2
cgucgugaguggcggcgcgca

SEQ ID NO: 1766625 - RNA, 19 nt, Salmonella enterica enterica serovar Typhi Ty2
cgucgugcagcgccgccug

SEQ ID NO: 1766626 - RNA, 18 nt, Salmonella enterica enterica serovar Typhi Ty2
cgucgugcugggcgcgcc

SEQ ID NO: 1766627 - RNA, 19 nt, Salmonella enterica enterica serovar Typhi Ty2
cgucgugcugggcgcgccu

SEQ ID NO: 1766628 - RNA, 17 nt, Salmonella enterica enterica serovar Typhi Ty2
cgucguccacucuuccg

SEQ ID NO: 1766629 - RNA, 22 nt, Salmonella enterica enterica serovar Typhi Ty2
cgucgucccgcgaguacgcaca

SEQ ID NO: 1766630 - RNA, 15 nt, Salmonella enterica enterica serovar Typhi Ty2
cgucgucggugggcu

SEQ ID NO: 1766631 - RNA, 14 nt, Salmonella enterica enterica serovar Typhi Ty2
cgucggucgcguag

SEQ ID NO: 1766632 - RNA, 23 nt, Salmonella enterica enterica serovar Typhi Ty2
cgucgggccgcgcugcgccugcu

SEQ ID NO: 1766633 - RNA, 16 nt, Salmonella enterica enterica serovar Typhi Ty2
cgucggugcugccgcu

SEQ ID NO: 1766634 - RNA, 16 nt, Salmonella enterica enterica serovar Typhi Ty2
cgucggugcccggcug

SEQ ID NO: 1766635 - RNA, 14 nt, Salmonella enterica enterica serovar Typhi Ty2
cgucguaaaaccug

SEQ ID NO: 1766636 - RNA, 15 nt, Salmonella enterica enterica serovar Typhi Ty2
cgucguaaaaccugc

SEQ ID NO: 1766637 - RNA, 13 nt, Salmonella enterica enterica serovar Typhi Ty2
cgucugcucagaa

SEQ ID NO: 1766638 - RNA, 14 nt, Salmonella enterica enterica serovar Typhi Ty2
cgucuggugaucca

SEQ ID NO: 1766639 - RNA, 19 nt, Salmonella enterica enterica serovar Typhi Ty2
cgucugguacggccaccag

SEQ ID NO: 1766640 - RNA, 20 nt, Salmonella enterica enterica serovar Typhi Ty2
cgucugguaauaggccggag

SEQ ID NO: 1766641 - RNA, 13 nt, Salmonella enterica enterica serovar Typhi Ty2
cgucuauagauga

SEQ ID NO: 1766642 - RNA, 17 nt, Salmonella enterica enterica serovar Typhi Ty2
cgucuacgucaggaaac

SEQ ID NO: 1766643 - RNA, 20 nt, Salmonella enterica enterica serovar Typhi Ty2
cgugaauugcgguuuauccc

SEQ ID NO: 1766644 - RNA, 17 nt, Salmonella enterica enterica serovar Typhi Ty2
cgugaauuucugcugcc

SEQ ID NO: 1766645 - RNA, 17 nt, Salmonella enterica enterica serovar Typhi Ty2
cgugagccggacacugc

SEQ ID NO: 1766646 - RNA, 22 nt, Salmonella enterica enterica serovar Typhi Ty2
cgugagccgaaauccaccagcg

SEQ ID NO: 1766647 - RNA, 22 nt, Salmonella enterica enterica serovar Typhi Ty2
cgugagccacuauccagucagc

SEQ ID NO: 1766648 - RNA, 19 nt, Salmonella enterica enterica serovar Typhi Ty2
cgugaauguccugcggcac

SEQ ID NO: 1766649 - RNA, 19 nt, Salmonella enterica enterica serovar Typhi Ty2
cgugaaugguuucccaggu

SEQ ID NO: 1766650 - RNA, 14 nt, Salmonella enterica enterica serovar Typhi Ty2
cgugaauauggaaa

SEQ ID NO: 1766651 - RNA, 20 nt, Salmonella enterica enterica serovar Typhi Ty2
cgugaagauuagcagagcgg

SEQ ID NO: 1766652 - RNA, 12 nt, Salmonella enterica enterica serovar Typhi Ty2
cgucuugccgug

SEQ ID NO: 1766653 - RNA, 17 nt, Salmonella enterica enterica serovar Typhi Ty2
cgugcaguuuugcuuca

SEQ ID NO: 1766654 - RNA, 22 nt, Salmonella enterica enterica serovar Typhi Ty2
cgugcaguuuugcuucaugcac

SEQ ID NO: 1766655 - RNA, 15 nt, Salmonella enterica enterica serovar Typhi Ty2
cgugcagcgccgccu

SEQ ID NO: 1766656 - RNA, 17 nt, Salmonella enterica enterica serovar Typhi Ty2
cgugagcgcgucaucau

SEQ ID NO: 1766657 - RNA, 19 nt, Salmonella enterica enterica serovar Typhi Ty2
cgugaauugcgguuuaucc

SEQ ID NO: 1766658 - RNA, 14 nt, Salmonella enterica enterica serovar Typhi Ty2
cgugagcgcgccgc

SEQ ID NO: 1766659 - RNA, 21 nt, Salmonella enterica enterica serovar Typhi Ty2
cgugauugagcagaucagcac

SEQ ID NO: 1766660 - RNA, 14 nt, Salmonella enterica enterica serovar Typhi Ty2
cgugauugagcaga

SEQ ID NO: 1766661 - RNA, 19 nt, Salmonella enterica enterica serovar Typhi Ty2
cgugaugcgacgcgcucac

SEQ ID NO: 1766662 - RNA, 16 nt, Salmonella enterica enterica serovar Typhi Ty2
cgugccgaccagcggu

SEQ ID NO: 1766663 - RNA, 20 nt, Salmonella enterica enterica serovar Typhi Ty2
cgugcugaucccgcgcgccu

SEQ ID NO: 1766664 - RNA, 13 nt, Salmonella enterica enterica serovar Typhi Ty2
cgugcgcagcgcg

SEQ ID NO: 1766665 - RNA, 15 nt, Salmonella enterica enterica serovar Typhi Ty2
cgugccuucaaauau

SEQ ID NO: 1766666 - RNA, 13 nt, Salmonella enterica enterica serovar Typhi Ty2
cgugccuuccgca

SEQ ID NO: 1766667 - RNA, 18 nt, Salmonella enterica enterica serovar Typhi Ty2
cgucaccgggcugcagcc

SEQ ID NO: 1766668 - RNA, 13 nt, Salmonella enterica enterica serovar Typhi Ty2
cgucaccgcgcac

SEQ ID NO: 1766669 - RNA, 18 nt, Salmonella enterica enterica serovar Typhi Ty2
cgucacugaaccugccuu

SEQ ID NO: 1766670 - RNA, 20 nt, Salmonella enterica enterica serovar Typhi Ty2
cgucacccuauuuugcgccu

SEQ ID NO: 1766671 - RNA, 17 nt, Salmonella enterica enterica serovar Typhi Ty2
cguauuuuauuuuucaa

SEQ ID NO: 1766672 - RNA, 15 nt, Salmonella enterica enterica serovar Typhi Ty2
cguauucuuacccac

SEQ ID NO: 1766673 - RNA, 19 nt, Salmonella enterica enterica serovar Typhi Ty2
cguauucucaaccagccga

SEQ ID NO: 1766674 - RNA, 12 nt, Salmonella enterica enterica serovar Typhi Ty2
cguauugccauc

SEQ ID NO: 1766675 - RNA, 20 nt, Salmonella enterica enterica serovar Typhi Ty2
cguaucggugcguuuaaaga

SEQ ID NO: 1766676 - RNA, 13 nt, Salmonella enterica enterica serovar Typhi Ty2
cgucauccugcaa

SEQ ID NO: 1766677 - RNA, 21 nt, Salmonella enterica enterica serovar Typhi Ty2
cgucaucgcucaucucaagcc

SEQ ID NO: 1766678 - RNA, 20 nt, Salmonella enterica enterica serovar Typhi Ty2
cgucaucgcuccagacggcg

SEQ ID NO: 1766679 - RNA, 21 nt, Salmonella enterica enterica serovar Typhi Ty2
cgucaucgcuccagacggcgc

SEQ ID NO: 1766680 - RNA, 15 nt, Salmonella enterica enterica serovar Typhi Ty2
cgucaucgcuucuau

SEQ ID NO: 1766681 - RNA, 18 nt, Salmonella enterica enterica serovar Typhi Ty2
cgucaggccgccgcacag

SEQ ID NO: 1766682 - RNA, 20 nt, Salmonella enterica enterica serovar Typhi Ty2
cgucaggccgccgcaaaagc

SEQ ID NO: 1766683 - RNA, 12 nt, Salmonella enterica enterica serovar Typhi Ty2
cgucaucauugc

SEQ ID NO: 1766684 - RNA, 19 nt, Salmonella enterica enterica serovar Typhi Ty2
cgucagacggcuccagcgc

SEQ ID NO: 1766685 - RNA, 18 nt, Salmonella enterica enterica serovar Typhi Ty2
cgucagaccggcaaucaa

SEQ ID NO: 1766686 - RNA, 17 nt, Salmonella enterica enterica serovar Typhi Ty2
cgucagacggcuccagc

SEQ ID NO: 1766687 - RNA, 18 nt, Salmonella enterica enterica serovar Typhi Ty2
cgucaggaucguaacagg

SEQ ID NO: 1766688 - RNA, 11 nt, Salmonella enterica enterica serovar Typhi Ty2
cgucagauucu

SEQ ID NO: 1766689 - RNA, 18 nt, Salmonella enterica enterica serovar Typhi Ty2
cguccacauccagcgcca

SEQ ID NO: 1766690 - RNA, 12 nt, Salmonella enterica enterica serovar Typhi Ty2
cguccacucuuc

SEQ ID NO: 1766691 - RNA, 23 nt, Salmonella enterica enterica serovar Typhi Ty2
cgucaugauguuugucuuuucca

SEQ ID NO: 1766692 - RNA, 13 nt, Salmonella enterica enterica serovar Typhi Ty2
cgucauuuaccag

SEQ ID NO: 1766693 - RNA, 13 nt, Salmonella enterica enterica serovar Typhi Ty2
cgucauuuacugc

SEQ ID NO: 1766694 - RNA, 22 nt, Salmonella enterica enterica serovar Typhi Ty2
cguccaacuggcuuucauccaa

SEQ ID NO: 1766695 - RNA, 16 nt, Salmonella enterica enterica serovar Typhi Ty2
cguccccguucugacc

SEQ ID NO: 1766696 - RNA, 17 nt, Salmonella enterica enterica serovar Typhi Ty2
cguccccuauacgccau

SEQ ID NO: 1766697 - RNA, 22 nt, Salmonella enterica enterica serovar Typhi Ty2
cguccccugcgguuucuaccac

SEQ ID NO: 1766698 - RNA, 22 nt, Salmonella enterica enterica serovar Typhi Ty2
cguccagccagcguuucuggaa

SEQ ID NO: 1766699 - RNA, 19 nt, Salmonella enterica enterica serovar Typhi Ty2
cgucccguuuuucccgcug

SEQ ID NO: 1766700 - RNA, 15 nt, Salmonella enterica enterica serovar Typhi Ty2
cgucccuuccgccac

SEQ ID NO: 1766701 - RNA, 19 nt, Salmonella enterica enterica serovar Typhi Ty2
cgucccuuucccuuccagc

SEQ ID NO: 1766702 - RNA, 17 nt, Salmonella enterica enterica serovar Typhi Ty2
cguccgccaggcccaug

SEQ ID NO: 1766703 - RNA, 16 nt, Salmonella enterica enterica serovar Typhi Ty2
cguccgccagaugcac

SEQ ID NO: 1766704 - RNA, 18 nt, Salmonella enterica enterica serovar Typhi Ty2
cguccgcagccgacgcau

SEQ ID NO: 1766705 - RNA, 12 nt, Salmonella enterica enterica serovar Typhi Ty2
cguagccgcgcg

SEQ ID NO: 1766706 - RNA, 13 nt, Salmonella enterica enterica serovar Typhi Ty2
cguagcuccagac

SEQ ID NO: 1766707 - RNA, 12 nt, Salmonella enterica enterica serovar Typhi Ty2
cguagcaaauag

SEQ ID NO: 1766708 - RNA, 12 nt, Salmonella enterica enterica serovar Typhi Ty2
cguagcagcgcg

SEQ ID NO: 1766709 - RNA, 13 nt, Salmonella enterica enterica serovar Typhi Ty2
cguagccagagcg

SEQ ID NO: 1766710 - RNA, 17 nt, Salmonella enterica enterica serovar Typhi Ty2
cguagccgaacaguuuc

SEQ ID NO: 1766711 - RNA, 15 nt, Salmonella enterica enterica serovar Typhi Ty2
cguagaucuuuugcg

SEQ ID NO: 1766712 - RNA, 17 nt, Salmonella enterica enterica serovar Typhi Ty2
cguagaacagcaugaau

SEQ ID NO: 1766713 - RNA, 19 nt, Salmonella enterica enterica serovar Typhi Ty2
cguaggguagaucacgcca

SEQ ID NO: 1766714 - RNA, 24 nt, Salmonella enterica enterica serovar Typhi Ty2
cguaggguagaucacgccagcgcu

SEQ ID NO: 1766715 - RNA, 22 nt, Salmonella enterica enterica serovar Typhi Ty2
cguaggccugauaagcgcagcg

SEQ ID NO: 1766716 - RNA, 15 nt, Salmonella enterica enterica serovar Typhi Ty2
cguaucgcucugcuu

SEQ ID NO: 1766717 - RNA, 20 nt, Salmonella enterica enterica serovar Typhi Ty2
cguauccccagucuuccugc

SEQ ID NO: 1766718 - RNA, 19 nt, Salmonella enterica enterica serovar Typhi Ty2
cguauccccagucuuccug

SEQ ID NO: 1766719 - RNA, 13 nt, Salmonella enterica enterica serovar Typhi Ty2
cguauccagcgcg

SEQ ID NO: 1766720 - RNA, 22 nt, Salmonella enterica enterica serovar Typhi Ty2
cguaaugugaaaaacgggagau

SEQ ID NO: 1766721 - RNA, 18 nt, Salmonella enterica enterica serovar Typhi Ty2
cguaauuugcgacauggc

SEQ ID NO: 1766722 - RNA, 20 nt, Salmonella enterica enterica serovar Typhi Ty2
cguaauuguugccccgcuuu

SEQ ID NO: 1766723 - RNA, 22 nt, Salmonella enterica enterica serovar Typhi Ty2
cguaaucuuuucauauuauuug

SEQ ID NO: 1766724 - RNA, 20 nt, Salmonella enterica enterica serovar Typhi Ty2
cguaaugcgccccggcggcg

SEQ ID NO: 1766725 - RNA, 17 nt, Salmonella enterica enterica serovar Typhi Ty2
cguacauaacagcagca

SEQ ID NO: 1766726 - RNA, 18 nt, Salmonella enterica enterica serovar Typhi Ty2
cguacauaacagcagcag

SEQ ID NO: 1766727 - RNA, 12 nt, Salmonella enterica enterica serovar Typhi Ty2
cguacagcgcca

SEQ ID NO: 1766728 - RNA, 17 nt, Salmonella enterica enterica serovar Typhi Ty2
cguaccaggcagcgcgc

SEQ ID NO: 1766729 - RNA, 16 nt, Salmonella enterica enterica serovar Typhi Ty2
cguaccauauucaacu

SEQ ID NO: 1766730 - RNA, 23 nt, Salmonella enterica enterica serovar Typhi Ty2
cguaccaauacccagcgccaacg

SEQ ID NO: 1766731 - RNA, 14 nt, Salmonella enterica enterica serovar Typhi Ty2
cguacggcuucaau

SEQ ID NO: 1766732 - RNA, 21 nt, Salmonella enterica enterica serovar Typhi Ty2
cguacucuaggcgcugcuggc

SEQ ID NO: 1766733 - RNA, 19 nt, Salmonella enterica enterica serovar Typhi Ty2
cguacucggauagcuacga

SEQ ID NO: 1766734 - RNA, 19 nt, Salmonella enterica enterica serovar Typhi Ty2
cguacuaaagagcgccuga

SEQ ID NO: 1766735 - RNA, 16 nt, Salmonella enterica enterica serovar Typhi Ty2
cguaccugcgcgcagg

SEQ ID NO: 1766736 - RNA, 20 nt, Salmonella enterica enterica serovar Typhi Ty2
cguaccgucuggcgaggcgc

SEQ ID NO: 1766737 - RNA, 21 nt, Salmonella enterica enterica serovar Typhi Ty2
cguacgcagaucguauccagc

SEQ ID NO: 1766738 - RNA, 20 nt, Salmonella enterica enterica serovar Typhi Ty2
cguaccggcgcucagccaga

SEQ ID NO: 1766739 - RNA, 18 nt, Salmonella enterica enterica serovar Typhi Ty2
cguaccgcguuuaacgca

SEQ ID NO: 1766740 - RNA, 16 nt, Salmonella enterica enterica serovar Typhi Ty2
cguaccgaagaacaua

SEQ ID NO: 1766741 - RNA, 20 nt, Salmonella enterica enterica serovar Typhi Ty2
cguaccgaagaacauaaaca

SEQ ID NO: 1766742 - RNA, 13 nt, Salmonella enterica enterica serovar Typhi Ty2
cguaccccaaucu

SEQ ID NO: 1766743 - RNA, 20 nt, Salmonella enterica enterica serovar Typhi Ty2
cguacccggcuuacaacauu

SEQ ID NO: 1766744 - RNA, 13 nt, Salmonella enterica enterica serovar Typhi Ty2
cguaccagcgccc

SEQ ID NO: 1766745 - RNA, 19 nt, Salmonella enterica enterica serovar Typhi Ty2
cguaccaucgcgcaagacc

SEQ ID NO: 1766746 - RNA, 17 nt, Salmonella enterica enterica serovar Typhi Ty2
cuaccaacaaaucauuu

SEQ ID NO: 1766747 - RNA, 16 nt, Salmonella enterica enterica serovar Typhi Ty2
cuaccaacaaaucauu

SEQ ID NO: 1766748 - RNA, 19 nt, Salmonella enterica enterica serovar Typhi Ty2
cuaccagcgcuauccaggc

SEQ ID NO: 1766749 - RNA, 21 nt, Salmonella enterica enterica serovar Typhi Ty2
cuaccagcgcuauccaggccg

SEQ ID NO: 1766750 - RNA, 15 nt, Salmonella enterica enterica serovar Typhi Ty2
cuaccaucgcgcgca

SEQ ID NO: 1766751 - RNA, 11 nt, Salmonella enterica enterica serovar Typhi Ty2
cuaccaucggc

SEQ ID NO: 1766752 - RNA, 23 nt, Salmonella enterica enterica serovar Typhi Ty2
cuacccagacaagcacauaacug

SEQ ID NO: 1766753 - RNA, 16 nt, Salmonella enterica enterica serovar Typhi Ty2
cuacccgcaauaccaa

SEQ ID NO: 1766754 - RNA, 19 nt, Salmonella enterica enterica serovar Typhi Ty2
cuacccgguguaaaaaaug

SEQ ID NO: 1766755 - RNA, 14 nt, Salmonella enterica enterica serovar Typhi Ty2
cuaccggaaaacag

SEQ ID NO: 1766756 - RNA, 17 nt, Salmonella enterica enterica serovar Typhi Ty2
cuaccgcuucgcgcgcc

SEQ ID NO: 1766757 - RNA, 16 nt, Salmonella enterica enterica serovar Typhi Ty2
cuaccgggcagcaucu

SEQ ID NO: 1766758 - RNA, 19 nt, Salmonella enterica enterica serovar Typhi Ty2
cuaccgucgacgucuuucu

SEQ ID NO: 1766759 - RNA, 17 nt, Salmonella enterica enterica serovar Typhi Ty2
cuaccguucacggcgau

SEQ ID NO: 1766760 - RNA, 22 nt, Salmonella enterica enterica serovar Typhi Ty2
cuaccgucgacgucuuucuuaa

SEQ ID NO: 1766761 - RNA, 18 nt, Salmonella enterica enterica serovar Typhi Ty2
cuaccugcagggugaaga

SEQ ID NO: 1766762 - RNA, 20 nt, Salmonella enterica enterica serovar Typhi Ty2
cuacaauggaaaaaucugua

SEQ ID NO: 1766763 - RNA, 19 nt, Salmonella enterica enterica serovar Typhi Ty2
cuacaccguauccggccug

SEQ ID NO: 1766764 - RNA, 16 nt, Salmonella enterica enterica serovar Typhi Ty2
cuacacgucuccucag

SEQ ID NO: 1766765 - RNA, 22 nt, Salmonella enterica enterica serovar Typhi Ty2
cuacaccugggcuugcuuuucu

SEQ ID NO: 1766766 - RNA, 19 nt, Salmonella enterica enterica serovar Typhi Ty2
cuacaccccuucuggagaa

SEQ ID NO: 1766767 - RNA, 16 nt, Salmonella enterica enterica serovar Typhi Ty2
cuacacgaauaccucu

SEQ ID NO: 1766768 - RNA, 13 nt, Salmonella enterica enterica serovar Typhi Ty2
cuacacucaauac

SEQ ID NO: 1766769 - RNA, 21 nt, Salmonella enterica enterica serovar Typhi Ty2
cuagccaauaaucgaaauaaa

SEQ ID NO: 1766770 - RNA, 22 nt, Salmonella enterica enterica serovar Typhi Ty2
cuagccgccguguugugugccg

SEQ ID NO: 1766771 - RNA, 18 nt, Salmonella enterica enterica serovar Typhi Ty2
cuacguuugaacagcagu

SEQ ID NO: 1766772 - RNA, 19 nt, Salmonella enterica enterica serovar Typhi Ty2
cuacguugaccucaucacc

SEQ ID NO: 1766773 - RNA, 14 nt, Salmonella enterica enterica serovar Typhi Ty2
cuacguuccaugcg

SEQ ID NO: 1766774 - RNA, 16 nt, Salmonella enterica enterica serovar Typhi Ty2
cuacggcccuggcuca

SEQ ID NO: 1766775 - RNA, 14 nt, Salmonella enterica enterica serovar Typhi Ty2
cuacggcccuggcu

SEQ ID NO: 1766776 - RNA, 13 nt, Salmonella enterica enterica serovar Typhi Ty2
cuacggcaaacac

SEQ ID NO: 1766777 - RNA, 14 nt, Salmonella enterica enterica serovar Typhi Ty2
cuacgcuucucucc

SEQ ID NO: 1766778 - RNA, 18 nt, Salmonella enterica enterica serovar Typhi Ty2
cuacgcuucguauuucuu

SEQ ID NO: 1766779 - RNA, 17 nt, Salmonella enterica enterica serovar Typhi Ty2
cuacgcuuauccggcuu

SEQ ID NO: 1766780 - RNA, 19 nt, Salmonella enterica enterica serovar Typhi Ty2
cuacgcgauaaaaaacgcc

SEQ ID NO: 1766781 - RNA, 21 nt, Salmonella enterica enterica serovar Typhi Ty2
cuacgcugccauccucauuuu

SEQ ID NO: 1766782 - RNA, 19 nt, Salmonella enterica enterica serovar Typhi Ty2
cuacgcuauccggcgcgcu

SEQ ID NO: 1766783 - RNA, 13 nt, Salmonella enterica enterica serovar Typhi Ty2
cuacgcuauuucc

SEQ ID NO: 1766784 - RNA, 22 nt, Salmonella enterica enterica serovar Typhi Ty2
cuacgcuauuuccagaaaucag

SEQ ID NO: 1766785 - RNA, 18 nt, Salmonella enterica enterica serovar Typhi Ty2
cuauaaaguucccaugcu

SEQ ID NO: 1766786 - RNA, 23 nt, Salmonella enterica enterica serovar Typhi Ty2
cuauaaaauugccgauauggaug

SEQ ID NO: 1766787 - RNA, 22 nt, Salmonella enterica enterica serovar Typhi Ty2
cuauaaguacgcggucgccugc

SEQ ID NO: 1766788 - RNA, 14 nt, Salmonella enterica enterica serovar Typhi Ty2
cuauaaaccacggu

SEQ ID NO: 1766789 - RNA, 14 nt, Salmonella enterica enterica serovar Typhi Ty2
cuaggaacagugac

SEQ ID NO: 1766790 - RNA, 22 nt, Salmonella enterica enterica serovar Typhi Ty2
cucagcaggcgggcuuuuuuug

SEQ ID NO: 1766791 - RNA, 13 nt, Salmonella enterica enterica serovar Typhi Ty2
cucagccacccac

SEQ ID NO: 1766792 - RNA, 18 nt, Salmonella enterica enterica serovar Typhi Ty2
cucagcauuggugagaga

SEQ ID NO: 1766793 - RNA, 20 nt, Salmonella enterica enterica serovar Typhi Ty2
cucagaaaauuauuuuaaau

SEQ ID NO: 1766794 - RNA, 14 nt, Salmonella enterica enterica serovar Typhi Ty2
cucacggucuccug

SEQ ID NO: 1766795 - RNA, 18 nt, Salmonella enterica enterica serovar Typhi Ty2
cucacgcucauagccgcu

SEQ ID NO: 1766796 - RNA, 21 nt, Salmonella enterica enterica serovar Typhi Ty2
cucacgcuuaucgccaaacca

SEQ ID NO: 1766797 - RNA, 19 nt, Salmonella enterica enterica serovar Typhi Ty2
cucacggcacgcccuucgu

SEQ ID NO: 1766798 - RNA, 13 nt, Salmonella enterica enterica serovar Typhi Ty2
cucagcggcggcg

SEQ ID NO: 1766799 - RNA, 21 nt, Salmonella enterica enterica serovar Typhi Ty2
cucagcgucggugaagaaaau

SEQ ID NO: 1766800 - RNA, 14 nt, Salmonella enterica enterica serovar Typhi Ty2
cucagcuugcgcug

SEQ ID NO: 1766801 - RNA, 16 nt, Salmonella enterica enterica serovar Typhi Ty2
cucagccagaaacggu

SEQ ID NO: 1766802 - RNA, 14 nt, Salmonella enterica enterica serovar Typhi Ty2
cucagccccaggcc

SEQ ID NO: 1766803 - RNA, 18 nt, Salmonella enterica enterica serovar Typhi Ty2
cucacaaaacuauuuucc

SEQ ID NO: 1766804 - RNA, 22 nt, Salmonella enterica enterica serovar Typhi Ty2
cucaccaguagcgcgacgccaa

SEQ ID NO: 1766805 - RNA, 18 nt, Salmonella enterica enterica serovar Typhi Ty2
cucaccaguccggcagaa

SEQ ID NO: 1766806 - RNA, 14 nt, Salmonella enterica enterica serovar Typhi Ty2
cucaccaguagcgc

SEQ ID NO: 1766807 - RNA, 21 nt, Salmonella enterica enterica serovar Typhi Ty2
cucacccauuuuauccucuuc

SEQ ID NO: 1766808 - RNA, 13 nt, Salmonella enterica enterica serovar Typhi Ty2
cucacccaggcga

SEQ ID NO: 1766809 - RNA, 22 nt, Salmonella enterica enterica serovar Typhi Ty2
cucaauccuucuaccuucaccc

SEQ ID NO: 1766810 - RNA, 18 nt, Salmonella enterica enterica serovar Typhi Ty2
cucaaagcguuauuugca

SEQ ID NO: 1766811 - RNA, 17 nt, Salmonella enterica enterica serovar Typhi Ty2
cuauuaguucugaggcu

SEQ ID NO: 1766812 - RNA, 13 nt, Salmonella enterica enterica serovar Typhi Ty2
cuauuaucagaau

SEQ ID NO: 1766813 - RNA, 12 nt, Salmonella enterica enterica serovar Typhi Ty2
cuauucagcagu

SEQ ID NO: 1766814 - RNA, 18 nt, Salmonella enterica enterica serovar Typhi Ty2
cuauuccaaaauaauaaa

SEQ ID NO: 1766815 - RNA, 20 nt, Salmonella enterica enterica serovar Typhi Ty2
cuauuccaacuaugugggcg

SEQ ID NO: 1766816 - RNA, 15 nt, Salmonella enterica enterica serovar Typhi Ty2
cuauucagcaguuca

SEQ ID NO: 1766817 - RNA, 16 nt, Salmonella enterica enterica serovar Typhi Ty2
cuauuccaguuuuuau

SEQ ID NO: 1766818 - RNA, 20 nt, Salmonella enterica enterica serovar Typhi Ty2
cuauucauuauuuuuaaaua

SEQ ID NO: 1766819 - RNA, 23 nt, Salmonella enterica enterica serovar Typhi Ty2
cuauggcggagggauuuuaaacc

SEQ ID NO: 1766820 - RNA, 12 nt, Salmonella enterica enterica serovar Typhi Ty2
cuaugacaaguc

SEQ ID NO: 1766821 - RNA, 21 nt, Salmonella enterica enterica serovar Typhi Ty2
cuaugcuuauccggccugcac

SEQ ID NO: 1766822 - RNA, 20 nt, Salmonella enterica enterica serovar Typhi Ty2
cuaugaagagaaacauacug

SEQ ID NO: 1766823 - RNA, 23 nt, Salmonella enterica enterica serovar Typhi Ty2
cuaucuguauaucuuucuuaucc

SEQ ID NO: 1766824 - RNA, 19 nt, Salmonella enterica enterica serovar Typhi Ty2
cuauagauuucgcgucagg

SEQ ID NO: 1766825 - RNA, 22 nt, Salmonella enterica enterica serovar Typhi Ty2
cuaucugacagccaaacugcug

SEQ ID NO: 1766826 - RNA, 20 nt, Salmonella enterica enterica serovar Typhi Ty2
cuauugagguaguccugcuc

SEQ ID NO: 1766827 - RNA, 21 nt, Salmonella enterica enterica serovar Typhi Ty2
cuauuccuguauaauuauuug

SEQ ID NO: 1766828 - RNA, 15 nt, Salmonella enterica enterica serovar Typhi Ty2
cuauucguucucuga

SEQ ID NO: 1766829 - RNA, 15 nt, Salmonella enterica enterica serovar Typhi Ty2
cuauuuauugaagau

SEQ ID NO: 1766830 - RNA, 17 nt, Salmonella enterica enterica serovar Typhi Ty2
cuauuuauugaagaugu

SEQ ID NO: 1766831 - RNA, 19 nt, Salmonella enterica enterica serovar Typhi Ty2
cuauuuucucuuccacaaa

SEQ ID NO: 1766832 - RNA, 13 nt, Salmonella enterica enterica serovar Typhi Ty2
cuauuuucucuuc

SEQ ID NO: 1766833 - RNA, 19 nt, Salmonella enterica enterica serovar Typhi Ty2
cucgucuguuuugccuugc

SEQ ID NO: 1766834 - RNA, 21 nt, Salmonella enterica enterica serovar Typhi Ty2
cucguguaaggcuuccggcag

SEQ ID NO: 1766835 - RNA, 13 nt, Salmonella enterica enterica serovar Typhi Ty2
cucuaaaaaggaa

SEQ ID NO: 1766836 - RNA, 19 nt, Salmonella enterica enterica serovar Typhi Ty2
cucguucgauagcguuuuc

SEQ ID NO: 1766837 - RNA, 23 nt, Salmonella enterica enterica serovar Typhi Ty2
cucguugauguuuuuaaaagaag

SEQ ID NO: 1766838 - RNA, 18 nt, Salmonella enterica enterica serovar Typhi Ty2
cucguugccauugguuca

SEQ ID NO: 1766839 - RNA, 24 nt, Salmonella enterica enterica serovar Typhi Ty2
cucuaacgucagcgccacccauuu

SEQ ID NO: 1766840 - RNA, 22 nt, Salmonella enterica enterica serovar Typhi Ty2
cucuaaaucuuuuugugcaauc

SEQ ID NO: 1766841 - RNA, 18 nt, Salmonella enterica enterica serovar Typhi Ty2
cucuaaaugggcaggaga

SEQ ID NO: 1766842 - RNA, 18 nt, Salmonella enterica enterica serovar Typhi Ty2
cucuaauugaauauggug

SEQ ID NO: 1766843 - RNA, 23 nt, Salmonella enterica enterica serovar Typhi Ty2
cucgcuuaaaccaccauacccag

SEQ ID NO: 1766844 - RNA, 19 nt, Salmonella enterica enterica serovar Typhi Ty2
cucgcuguggccaggcacg

SEQ ID NO: 1766845 - RNA, 19 nt, Salmonella enterica enterica serovar Typhi Ty2
cucgcuguauuucccucuc

SEQ ID NO: 1766846 - RNA, 18 nt, Salmonella enterica enterica serovar Typhi Ty2
cucgcugccgaccuggcu

SEQ ID NO: 1766847 - RNA, 22 nt, Salmonella enterica enterica serovar Typhi Ty2
cucgcugauacgcuggcacagg

SEQ ID NO: 1766848 - RNA, 20 nt, Salmonella enterica enterica serovar Typhi Ty2
cucgcugauacgcaccagcu

SEQ ID NO: 1766849 - RNA, 18 nt, Salmonella enterica enterica serovar Typhi Ty2
cucgcgggcauacucucc

SEQ ID NO: 1766850 - RNA, 18 nt, Salmonella enterica enterica serovar Typhi Ty2
cucggcggucagccacau

SEQ ID NO: 1766851 - RNA, 15 nt, Salmonella enterica enterica serovar Typhi Ty2
cucggugccgcugcu

SEQ ID NO: 1766852 - RNA, 17 nt, Salmonella enterica enterica serovar Typhi Ty2
cucgaccaguuuuuccg

SEQ ID NO: 1766853 - RNA, 22 nt, Salmonella enterica enterica serovar Typhi Ty2
cuccuccgguuucaacugucga

SEQ ID NO: 1766854 - RNA, 22 nt, Salmonella enterica enterica serovar Typhi Ty2
cucgauuccugacgcacagugu

SEQ ID NO: 1766855 - RNA, 15 nt, Salmonella enterica enterica serovar Typhi Ty2
cucgacgcacuccag

SEQ ID NO: 1766856 - RNA, 13 nt, Salmonella enterica enterica serovar Typhi Ty2
cucgcaaaacaug

SEQ ID NO: 1766857 - RNA, 15 nt, Salmonella enterica enterica serovar Typhi Ty2
cucgcaagauuccag

SEQ ID NO: 1766858 - RNA, 14 nt, Salmonella enterica enterica serovar Typhi Ty2
cucgcaauauucau

SEQ ID NO: 1766859 - RNA, 17 nt, Salmonella enterica enterica serovar Typhi Ty2
cucgcacuggcgagcgg

SEQ ID NO: 1766860 - RNA, 14 nt, Salmonella enterica enterica serovar Typhi Ty2
cucgcauccuccau

SEQ ID NO: 1766861 - RNA, 20 nt, Salmonella enterica enterica serovar Typhi Ty2
cucgcaugcauagccgcugc

SEQ ID NO: 1766862 - RNA, 20 nt, Salmonella enterica enterica serovar Typhi Ty2
cucgccaaagcgcugcugcu

SEQ ID NO: 1766863 - RNA, 12 nt, Salmonella enterica enterica serovar Typhi Ty2
cucgccagugcg

SEQ ID NO: 1766864 - RNA, 17 nt, Salmonella enterica enterica serovar Typhi Ty2
cucgccaaugccgcagc

SEQ ID NO: 1766865 - RNA, 19 nt, Salmonella enterica enterica serovar Typhi Ty2
cucgccaccggcacaucca

SEQ ID NO: 1766866 - RNA, 12 nt, Salmonella enterica enterica serovar Typhi Ty2
cucgcccagcac

SEQ ID NO: 1766867 - RNA, 11 nt, Salmonella enterica enterica serovar Typhi Ty2
cucgccgccgg

SEQ ID NO: 1766868 - RNA, 13 nt, Salmonella enterica enterica serovar Typhi Ty2
cucgccgccuccc

SEQ ID NO: 1766869 - RNA, 23 nt, Salmonella enterica enterica serovar Typhi Ty2
cucgccggauggcgacgcguagc

SEQ ID NO: 1766870 - RNA, 14 nt, Salmonella enterica enterica serovar Typhi Ty2
cucgccgcgcucca

SEQ ID NO: 1766871 - RNA, 19 nt, Salmonella enterica enterica serovar Typhi Ty2
cucgccgacaugcuccugc

SEQ ID NO: 1766872 - RNA, 17 nt, Salmonella enterica enterica serovar Typhi Ty2
cucgccgaccggcgcgc

SEQ ID NO: 1766873 - RNA, 18 nt, Salmonella enterica enterica serovar Typhi Ty2
cucgccgauuggcaaaau

SEQ ID NO: 1766874 - RNA, 14 nt, Salmonella enterica enterica serovar Typhi Ty2
cucgcccgccagau

SEQ ID NO: 1766875 - RNA, 12 nt, Salmonella enterica enterica serovar Typhi Ty2
cucgcgcaugac

SEQ ID NO: 1766876 - RNA, 16 nt, Salmonella enterica enterica serovar Typhi Ty2
cucgcgauaggccucg

SEQ ID NO: 1766877 - RNA, 21 nt, Salmonella enterica enterica serovar Typhi Ty2
cucgccgguuuuuuuacucug

SEQ ID NO: 1766878 - RNA, 15 nt, Salmonella enterica enterica serovar Typhi Ty2
cucgccuucggccug

SEQ ID NO: 1766879 - RNA, 21 nt, Salmonella enterica enterica serovar Typhi Ty2
cuccgaauaauccuucccgcu

SEQ ID NO: 1766880 - RNA, 18 nt, Salmonella enterica enterica serovar Typhi Ty2
cuccgacaaacuucaucg

SEQ ID NO: 1766881 - RNA, 12 nt, Salmonella enterica enterica serovar Typhi Ty2
cuccgacaacaa

SEQ ID NO: 1766882 - RNA, 15 nt, Salmonella enterica enterica serovar Typhi Ty2
cuccgaccaucgccg

SEQ ID NO: 1766883 - RNA, 16 nt, Salmonella enterica enterica serovar Typhi Ty2
cuccgcggggaucggu

SEQ ID NO: 1766884 - RNA, 19 nt, Salmonella enterica enterica serovar Typhi Ty2
cuccgcguaccucagcaug

SEQ ID NO: 1766885 - RNA, 14 nt, Salmonella enterica enterica serovar Typhi Ty2
cuccggacguaccc

SEQ ID NO: 1766886 - RNA, 17 nt, Salmonella enterica enterica serovar Typhi Ty2
cuccggcgcgcgcgcca

SEQ ID NO: 1766887 - RNA, 15 nt, Salmonella enterica enterica serovar Typhi Ty2
cuccggcguaaaggc

SEQ ID NO: 1766888 - RNA, 23 nt, Salmonella enterica enterica serovar Typhi Ty2
cuccgggauagcaaucucgccaa

SEQ ID NO: 1766889 - RNA, 19 nt, Salmonella enterica enterica serovar Typhi Ty2
cuccgggauagcaaucucg

SEQ ID NO: 1766890 - RNA, 15 nt, Salmonella enterica enterica serovar Typhi Ty2
cuccucaacagacau

SEQ ID NO: 1766891 - RNA, 16 nt, Salmonella enterica enterica serovar Typhi Ty2
cuccuaagagaaaacc

SEQ ID NO: 1766892 - RNA, 12 nt, Salmonella enterica enterica serovar Typhi Ty2
cuccgucaaaga

SEQ ID NO: 1766893 - RNA, 14 nt, Salmonella enterica enterica serovar Typhi Ty2
cuccgguaaucacc

SEQ ID NO: 1766894 - RNA, 23 nt, Salmonella enterica enterica serovar Typhi Ty2
cuccggguaacggacucaggccu

SEQ ID NO: 1766895 - RNA, 21 nt, Salmonella enterica enterica serovar Typhi Ty2
cuccccaggcgcuauucccag

SEQ ID NO: 1766896 - RNA, 18 nt, Salmonella enterica enterica serovar Typhi Ty2
cucccccaccgacacaaa

SEQ ID NO: 1766897 - RNA, 22 nt, Salmonella enterica enterica serovar Typhi Ty2
cuccccaggcgcuauucccagg

SEQ ID NO: 1766898 - RNA, 20 nt, Salmonella enterica enterica serovar Typhi Ty2
cuccccacaaucccgccaga

SEQ ID NO: 1766899 - RNA, 16 nt, Salmonella enterica enterica serovar Typhi Ty2
cuccccaaccgccagc

SEQ ID NO: 1766900 - RNA, 14 nt, Salmonella enterica enterica serovar Typhi Ty2
cucccccggcacca

SEQ ID NO: 1766901 - RNA, 18 nt, Salmonella enterica enterica serovar Typhi Ty2
cucccccggcaccacgca

SEQ ID NO: 1766902 - RNA, 22 nt, Salmonella enterica enterica serovar Typhi Ty2
cuccccgccccagcagcagccg

SEQ ID NO: 1766903 - RNA, 13 nt, Salmonella enterica enterica serovar Typhi Ty2
cucccucaaccag

SEQ ID NO: 1766904 - RNA, 16 nt, Salmonella enterica enterica serovar Typhi Ty2
cucccucacccuucac

SEQ ID NO: 1766905 - RNA, 19 nt, Salmonella enterica enterica serovar Typhi Ty2
cuccccguuccaccgccaa

SEQ ID NO: 1766906 - RNA, 15 nt, Salmonella enterica enterica serovar Typhi Ty2
cuccagccgcugccu

SEQ ID NO: 1766907 - RNA, 13 nt, Salmonella enterica enterica serovar Typhi Ty2
cuccaugcccaca

SEQ ID NO: 1766908 - RNA, 15 nt, Salmonella enterica enterica serovar Typhi Ty2
cuccagcgauaaacg

SEQ ID NO: 1766909 - RNA, 15 nt, Salmonella enterica enterica serovar Typhi Ty2
cuccauuaaauuacu

SEQ ID NO: 1766910 - RNA, 13 nt, Salmonella enterica enterica serovar Typhi Ty2
cuccauucccagc

SEQ ID NO: 1766911 - RNA, 17 nt, Salmonella enterica enterica serovar Typhi Ty2
cucccaggcgcgcagcu

SEQ ID NO: 1766912 - RNA, 23 nt, Salmonella enterica enterica serovar Typhi Ty2
cucauuauuaaauuaacacccaa

SEQ ID NO: 1766913 - RNA, 18 nt, Salmonella enterica enterica serovar Typhi Ty2
cucauuaugccucccguu

SEQ ID NO: 1766914 - RNA, 19 nt, Salmonella enterica enterica serovar Typhi Ty2
cucauuaccgaccuguacc

SEQ ID NO: 1766915 - RNA, 23 nt, Salmonella enterica enterica serovar Typhi Ty2
cucauuaccggcugccgauagca

SEQ ID NO: 1766916 - RNA, 21 nt, Salmonella enterica enterica serovar Typhi Ty2
cucauucgggcacuccggcuc

SEQ ID NO: 1766917 - RNA, 19 nt, Salmonella enterica enterica serovar Typhi Ty2
cucauucugauuuuacuaa

SEQ ID NO: 1766918 - RNA, 14 nt, Salmonella enterica enterica serovar Typhi Ty2
cucauuaaaaaaac

SEQ ID NO: 1766919 - RNA, 13 nt, Salmonella enterica enterica serovar Typhi Ty2
cucaggcgagccc

SEQ ID NO: 1766920 - RNA, 11 nt, Salmonella enterica enterica serovar Typhi Ty2
cucaggacgcc

SEQ ID NO: 1766921 - RNA, 22 nt, Salmonella enterica enterica serovar Typhi Ty2
cucaggcaacacgacaaaagca

SEQ ID NO: 1766922 - RNA, 22 nt, Salmonella enterica enterica serovar Typhi Ty2
cucauuuugccguugcuguucc

SEQ ID NO: 1766923 - RNA, 13 nt, Salmonella enterica enterica serovar Typhi Ty2
cucauuuucuuua

SEQ ID NO: 1766924 - RNA, 15 nt, Salmonella enterica enterica serovar Typhi Ty2
cuccagaccaccagc

SEQ ID NO: 1766925 - RNA, 16 nt, Salmonella enterica enterica serovar Typhi Ty2
cuccagcacauccuca

SEQ ID NO: 1766926 - RNA, 19 nt, Salmonella enterica enterica serovar Typhi Ty2
cuccagaagcacuucucca

SEQ ID NO: 1766927 - RNA, 17 nt, Salmonella enterica enterica serovar Typhi Ty2
cuccagaccgcugcgga

SEQ ID NO: 1766928 - RNA, 18 nt, Salmonella enterica enterica serovar Typhi Ty2
cuccagaccgcugcggaa

SEQ ID NO: 1766929 - RNA, 18 nt, Salmonella enterica enterica serovar Typhi Ty2
cuccagaccucguucggc

SEQ ID NO: 1766930 - RNA, 16 nt, Salmonella enterica enterica serovar Typhi Ty2
cuccaccauaucgcag

SEQ ID NO: 1766931 - RNA, 19 nt, Salmonella enterica enterica serovar Typhi Ty2
cuccaccaaaucccccaac

SEQ ID NO: 1766932 - RNA, 13 nt, Salmonella enterica enterica serovar Typhi Ty2
cuccaccaaccag

SEQ ID NO: 1766933 - RNA, 13 nt, Salmonella enterica enterica serovar Typhi Ty2
aaaaaaacgccgc

SEQ ID NO: 1766934 - RNA, 15 nt, Salmonella enterica enterica serovar Typhi Ty2
aaaaaacauauaauu

SEQ ID NO: 1766935 - RNA, 21 nt, Salmonella enterica enterica serovar Typhi Ty2
aaaaaacauauaauuaacauu

SEQ ID NO: 1766936 - RNA, 13 nt, Salmonella enterica enterica serovar Typhi Ty2
aaaaaacaucaug

SEQ ID NO: 1766937 - RNA, 11 nt, Salmonella enterica enterica serovar Typhi Ty2
aaaaaagagaa

SEQ ID NO: 1766938 - RNA, 20 nt, Salmonella enterica enterica serovar Typhi Ty2
aaaaaacgcccagaucgacc

SEQ ID NO: 1766939 - RNA, 17 nt, Salmonella enterica enterica serovar Typhi Ty2
aaaaaacggaaccaaaa

SEQ ID NO: 1766940 - RNA, 12 nt, Salmonella enterica enterica serovar Typhi Ty2
aaaaaauuacga

SEQ ID NO: 1766941 - RNA, 11 nt, Salmonella enterica enterica serovar Typhi Ty2
aaaaaagccau

SEQ ID NO: 1766942 - RNA, 11 nt, Salmonella enterica enterica serovar Typhi Ty2
aaaaaagaggg

SEQ ID NO: 1766943 - RNA, 13 nt, Salmonella enterica enterica serovar Typhi Ty2
aaaaaagagaagc

SEQ ID NO: 1766944 - RNA, 19 nt, Salmonella enterica enterica serovar Typhi Ty2
aaaaagccacgcaagcagc

SEQ ID NO: 1766945 - RNA, 19 nt, Salmonella enterica enterica serovar Typhi Ty2
aaaaagccaagcacaaaaa

SEQ ID NO: 1766946 - RNA, 22 nt, Salmonella enterica enterica serovar Typhi Ty2
aaaaacuuauuucuaucgcuau

SEQ ID NO: 1766947 - RNA, 21 nt, Salmonella enterica enterica serovar Typhi Ty2
aaaaaggccgcuuaauaauaa

SEQ ID NO: 1766948 - RNA, 22 nt, Salmonella enterica enterica serovar Typhi Ty2
aaaaaggguaacgggacacugc

SEQ ID NO: 1766949 - RNA, 19 nt, Salmonella enterica enterica serovar Typhi Ty2
aaaaagcgucaguaaaagc

SEQ ID NO: 1766950 - RNA, 17 nt, Salmonella enterica enterica serovar Typhi Ty2
aaaaagccucugauuuc

SEQ ID NO: 1766951 - RNA, 16 nt, Salmonella enterica enterica serovar Typhi Ty2
aaaaagccucugauuu

SEQ ID NO: 1766952 - RNA, 17 nt, Salmonella enterica enterica serovar Typhi Ty2
aaaaagcguacaaaaaa

SEQ ID NO: 1766953 - RNA, 22 nt, Salmonella enterica enterica serovar Typhi Ty2
aaaaagcccgacccgcugcgug

SEQ ID NO: 1766954 - RNA, 14 nt, Salmonella enterica enterica serovar Typhi Ty2
aaaaacccaccagc

SEQ ID NO: 1766955 - RNA, 15 nt, Salmonella enterica enterica serovar Typhi Ty2
aaaaacccaccaacu

SEQ ID NO: 1766956 - RNA, 18 nt, Salmonella enterica enterica serovar Typhi Ty2
aaaaacugcuaaaagaag

SEQ ID NO: 1766957 - RNA, 20 nt, Salmonella enterica enterica serovar Typhi Ty2
aaaaacgcgcucgccagcgc

SEQ ID NO: 1766958 - RNA, 16 nt, Salmonella enterica enterica serovar Typhi Ty2
aaaaacucaaagcguu

SEQ ID NO: 1766959 - RNA, 15 nt, Salmonella enterica enterica serovar Typhi Ty2
aaaaacucaggaaau

SEQ ID NO: 1766960 - RNA, 18 nt, Salmonella enterica enterica serovar Typhi Ty2
aaaaacucaggaaaucgu

SEQ ID NO: 1766961 - RNA, 13 nt, Salmonella enterica enterica serovar Typhi Ty2
aaaaaccugcucu

SEQ ID NO: 1766962 - RNA, 21 nt, Salmonella enterica enterica serovar Typhi Ty2
aaaaaccucuaccuacacauu

SEQ ID NO: 1766963 - RNA, 14 nt, Salmonella enterica enterica serovar Typhi Ty2
aaaaaccgggaaau

SEQ ID NO: 1766964 - RNA, 16 nt, Salmonella enterica enterica serovar Typhi Ty2
aaaaaccgccucaauu

SEQ ID NO: 1766965 - RNA, 16 nt, Salmonella enterica enterica serovar Typhi Ty2
aaaaaccuccggcuau

SEQ ID NO: 1766966 - RNA, 15 nt, Salmonella enterica enterica serovar Typhi Ty2
aaaaccgaucuccca

SEQ ID NO: 1766967 - RNA, 16 nt, Salmonella enterica enterica serovar Typhi Ty2
aaaaccgagcaacaga

SEQ ID NO: 1766968 - RNA, 16 nt, Salmonella enterica enterica serovar Typhi Ty2
aaaaccgacagcaaua

SEQ ID NO: 1766969 - RNA, 18 nt, Salmonella enterica enterica serovar Typhi Ty2
aaaacccguuaaauacca

SEQ ID NO: 1766970 - RNA, 21 nt, Salmonella enterica enterica serovar Typhi Ty2
aaaaccauagcccguacgauc

SEQ ID NO: 1766971 - RNA, 12 nt, Salmonella enterica enterica serovar Typhi Ty2
aaaaccauauaa

SEQ ID NO: 1766972 - RNA, 18 nt, Salmonella enterica enterica serovar Typhi Ty2
aaaaccuccggcuaugcc

SEQ ID NO: 1766973 - RNA, 18 nt, Salmonella enterica enterica serovar Typhi Ty2
aaaaccgucggcaauaca

SEQ ID NO: 1766974 - RNA, 22 nt, Salmonella enterica enterica serovar Typhi Ty2
aaaaccguccacauccagcgcc

SEQ ID NO: 1766975 - RNA, 20 nt, Salmonella enterica enterica serovar Typhi Ty2
aaaaccggccagcgucauca

SEQ ID NO: 1766976 - RNA, 11 nt, Salmonella enterica enterica serovar Typhi Ty2
aaaacagccag

SEQ ID NO: 1766977 - RNA, 20 nt, Salmonella enterica enterica serovar Typhi Ty2
aaaacaguuuugucaucaga

SEQ ID NO: 1766978 - RNA, 22 nt, Salmonella enterica enterica serovar Typhi Ty2
aaaaccagcaucaaccaccaaa

SEQ ID NO: 1766979 - RNA, 13 nt, Salmonella enterica enterica serovar Typhi Ty2
aaaaaucagcaau

SEQ ID NO: 1766980 - RNA, 13 nt, Salmonella enterica enterica serovar Typhi Ty2
aaaaaucagcauu

SEQ ID NO: 1766981 - RNA, 13 nt, Salmonella enterica enterica serovar Typhi Ty2
aaaaauucuuuua

SEQ ID NO: 1766982 - RNA, 16 nt, Salmonella enterica enterica serovar Typhi Ty2
aaaaauggaccagcca

SEQ ID NO: 1766983 - RNA, 15 nt, Salmonella enterica enterica serovar Typhi Ty2
aaaaaugauguguuu

SEQ ID NO: 1766984 - RNA, 15 nt, Salmonella enterica enterica serovar Typhi Ty2
aaaccaugaucguca

SEQ ID NO: 1766985 - RNA, 20 nt, Salmonella enterica enterica serovar Typhi Ty2
aaaccauguugaucguaaaa

SEQ ID NO: 1766986 - RNA, 18 nt, Salmonella enterica enterica serovar Typhi Ty2
aaaccauaaacaaaacaa

SEQ ID NO: 1766987 - RNA, 19 nt, Salmonella enterica enterica serovar Typhi Ty2
aaaccaucccagguuauuc

SEQ ID NO: 1766988 - RNA, 16 nt, Salmonella enterica enterica serovar Typhi Ty2
aaaccagcauaauauu

SEQ ID NO: 1766989 - RNA, 14 nt, Salmonella enterica enterica serovar Typhi Ty2
aaaccagcauaaua

SEQ ID NO: 1766990 - RNA, 16 nt, Salmonella enterica enterica serovar Typhi Ty2
aaaccgacagcaauau

SEQ ID NO: 1766991 - RNA, 16 nt, Salmonella enterica enterica serovar Typhi Ty2
aaaccgaucucccagc

SEQ ID NO: 1766992 - RNA, 13 nt, Salmonella enterica enterica serovar Typhi Ty2
aaaccgauaauca

SEQ ID NO: 1766993 - RNA, 15 nt, Salmonella enterica enterica serovar Typhi Ty2
aaaccgcagaaaaag

SEQ ID NO: 1766994 - RNA, 15 nt, Salmonella enterica enterica serovar Typhi Ty2
aaaccgaauucgucc

SEQ ID NO: 1766995 - RNA, 18 nt, Salmonella enterica enterica serovar Typhi Ty2
aaacccguuaaauaccag

SEQ ID NO: 1766996 - RNA, 22 nt, Salmonella enterica enterica serovar Typhi Ty2
aaaccguagauuuucaucauau

SEQ ID NO: 1766997 - RNA, 20 nt, Salmonella enterica enterica serovar Typhi Ty2
aaaccgguaaugauaccaau

SEQ ID NO: 1766998 - RNA, 15 nt, Salmonella enterica enterica serovar Typhi Ty2
aaaccggggagcuau

SEQ ID NO: 1766999 - RNA, 23 nt, Salmonella enterica enterica serovar Typhi Ty2
aaaccggcgcgccuuccagcaau

SEQ ID NO: 1767000 - RNA, 19 nt, Salmonella enterica enterica serovar Typhi Ty2
aaaccgccgcuuugauuug

SEQ ID NO: 1767001 - RNA, 21 nt, Salmonella enterica enterica serovar Typhi Ty2
aaaccaacaucgcugaauuuc

SEQ ID NO: 1767002 - RNA, 13 nt, Salmonella enterica enterica serovar Typhi Ty2
aaaccaacagccg

SEQ ID NO: 1767003 - RNA, 14 nt, Salmonella enterica enterica serovar Typhi Ty2
aaaccaaacagcga

SEQ ID NO: 1767004 - RNA, 23 nt, Salmonella enterica enterica serovar Typhi Ty2
aaaccaaacagcgacacauccug

SEQ ID NO: 1767005 - RNA, 16 nt, Salmonella enterica enterica serovar Typhi Ty2
aaaccacgcugaggcg

SEQ ID NO: 1767006 - RNA, 14 nt, Salmonella enterica enterica serovar Typhi Ty2
aaaccacaaucaca

SEQ ID NO: 1767007 - RNA, 19 nt, Salmonella enterica enterica serovar Typhi Ty2
aaaccacaugaccagcgcc

SEQ ID NO: 1767008 - RNA, 16 nt, Salmonella enterica enterica serovar Typhi Ty2
aaaccaccgagacuac

SEQ ID NO: 1767009 - RNA, 20 nt, Salmonella enterica enterica serovar Typhi Ty2
aaacaugguggagucugaaa

SEQ ID NO: 1767010 - RNA, 17 nt, Salmonella enterica enterica serovar Typhi Ty2
aaacaucgcccuccagc

SEQ ID NO: 1767011 - RNA, 24 nt, Salmonella enterica enterica serovar Typhi Ty2
aaacaucauggcuuaaaacgauuu

SEQ ID NO: 1767012 - RNA, 14 nt, Salmonella enterica enterica serovar Typhi Ty2
aaacaucccgauaa

SEQ ID NO: 1767013 - RNA, 16 nt, Salmonella enterica enterica serovar Typhi Ty2
aaacaucauaauaauu

SEQ ID NO: 1767014 - RNA, 13 nt, Salmonella enterica enterica serovar Typhi Ty2
aaaauugaauuaa

SEQ ID NO: 1767015 - RNA, 22 nt, Salmonella enterica enterica serovar Typhi Ty2
aaacacaaucacaacgucaucc

SEQ ID NO: 1767016 - RNA, 11 nt, Salmonella enterica enterica serovar Typhi Ty2
aaacaccagaa

SEQ ID NO: 1767017 - RNA, 13 nt, Salmonella enterica enterica serovar Typhi Ty2
aaacaccagaaug

SEQ ID NO: 1767018 - RNA, 23 nt, Salmonella enterica enterica serovar Typhi Ty2
aaacaccugucugucaaaaccca

SEQ ID NO: 1767019 - RNA, 19 nt, Salmonella enterica enterica serovar Typhi Ty2
aaacaccggggcauuucca

SEQ ID NO: 1767020 - RNA, 22 nt, Salmonella enterica enterica serovar Typhi Ty2
aaacaccaccgguuugucgcuu

SEQ ID NO: 1767021 - RNA, 16 nt, Salmonella enterica enterica serovar Typhi Ty2
aaacagugauuacaaa

SEQ ID NO: 1767022 - RNA, 19 nt, Salmonella enterica enterica serovar Typhi Ty2
aaacagguaaaacaaaaaa

SEQ ID NO: 1767023 - RNA, 15 nt, Salmonella enterica enterica serovar Typhi Ty2
aaacaggcugcccgg

SEQ ID NO: 1767024 - RNA, 15 nt, Salmonella enterica enterica serovar Typhi Ty2
aaacagguaaaacaa

SEQ ID NO: 1767025 - RNA, 19 nt, Salmonella enterica enterica serovar Typhi Ty2
aaacagguacuuacccaga

SEQ ID NO: 1767026 - RNA, 16 nt, Salmonella enterica enterica serovar Typhi Ty2
aaacauauaauuaaca

SEQ ID NO: 1767027 - RNA, 18 nt, Salmonella enterica enterica serovar Typhi Ty2
aaacaguuuugucaucag

SEQ ID NO: 1767028 - RNA, 13 nt, Salmonella enterica enterica serovar Typhi Ty2
aaacauaagcaaa

SEQ ID NO: 1767029 - RNA, 16 nt, Salmonella enterica enterica serovar Typhi Ty2
aaacagcuguaaaucg

SEQ ID NO: 1767030 - RNA, 15 nt, Salmonella enterica enterica serovar Typhi Ty2
aaacaggaaaaacau

SEQ ID NO: 1767031 - RNA, 18 nt, Salmonella enterica enterica serovar Typhi Ty2
aaacagcgccaguuuuuc

SEQ ID NO: 1767032 - RNA, 20 nt, Salmonella enterica enterica serovar Typhi Ty2
aaacagcgccccgacaaaac

SEQ ID NO: 1767033 - RNA, 14 nt, Salmonella enterica enterica serovar Typhi Ty2
aaacagccagcagc

SEQ ID NO: 1767034 - RNA, 15 nt, Salmonella enterica enterica serovar Typhi Ty2
aaacagcagaacaac

SEQ ID NO: 1767035 - RNA, 18 nt, Salmonella enterica enterica serovar Typhi Ty2
aaacacuuccccugccag

SEQ ID NO: 1767036 - RNA, 14 nt, Salmonella enterica enterica serovar Typhi Ty2
aaacagacaauuag

SEQ ID NO: 1767037 - RNA, 14 nt, Salmonella enterica enterica serovar Typhi Ty2
aaacagcaaaucgg

SEQ ID NO: 1767038 - RNA, 20 nt, Salmonella enterica enterica serovar Typhi Ty2
aaaagcuguagcauaaaugc

SEQ ID NO: 1767039 - RNA, 19 nt, Salmonella enterica enterica serovar Typhi Ty2
aaaagcuguagcauaaaug

SEQ ID NO: 1767040 - RNA, 19 nt, Salmonella enterica enterica serovar Typhi Ty2
aaaagcugcgaucaaguuu

SEQ ID NO: 1767041 - RNA, 13 nt, Salmonella enterica enterica serovar Typhi Ty2
aaaagcugauuaa

SEQ ID NO: 1767042 - RNA, 12 nt, Salmonella enterica enterica serovar Typhi Ty2
aaaagcugguau

SEQ ID NO: 1767043 - RNA, 22 nt, Salmonella enterica enterica serovar Typhi Ty2
aaaagcugguauugaauauuug

SEQ ID NO: 1767044 - RNA, 20 nt, Salmonella enterica enterica serovar Typhi Ty2
aaaaagaacggcaaauugag

SEQ ID NO: 1767045 - RNA, 12 nt, Salmonella enterica enterica serovar Typhi Ty2
aaaaagaaaaaa

SEQ ID NO: 1767046 - RNA, 21 nt, Salmonella enterica enterica serovar Typhi Ty2
aaaacgccgccuugcggcggc

SEQ ID NO: 1767047 - RNA, 20 nt, Salmonella enterica enterica serovar Typhi Ty2
aaaacgcccccugccagcgc

SEQ ID NO: 1767048 - RNA, 19 nt, Salmonella enterica enterica serovar Typhi Ty2
aaaagcgauuuauucuuug

SEQ ID NO: 1767049 - RNA, 15 nt, Salmonella enterica enterica serovar Typhi Ty2
aaaagcgcgggcugg

SEQ ID NO: 1767050 - RNA, 15 nt, Salmonella enterica enterica serovar Typhi Ty2
aaaagcgcccagcgc

SEQ ID NO: 1767051 - RNA, 22 nt, Salmonella enterica enterica serovar Typhi Ty2
aaaacgcgcucgccagcgcugu

SEQ ID NO: 1767052 - RNA, 13 nt, Salmonella enterica enterica serovar Typhi Ty2
aaaacgccuguaa

SEQ ID NO: 1767053 - RNA, 21 nt, Salmonella enterica enterica serovar Typhi Ty2
aaaauaacaauauuaaauaaa

SEQ ID NO: 1767054 - RNA, 13 nt, Salmonella enterica enterica serovar Typhi Ty2
aaaauaacaggca

SEQ ID NO: 1767055 - RNA, 17 nt, Salmonella enterica enterica serovar Typhi Ty2
aaaagucguucagacau

SEQ ID NO: 1767056 - RNA, 21 nt, Salmonella enterica enterica serovar Typhi Ty2
aaaagugaacgguugagcuuu

SEQ ID NO: 1767057 - RNA, 15 nt, Salmonella enterica enterica serovar Typhi Ty2
aaaaggcaauaaagu

SEQ ID NO: 1767058 - RNA, 15 nt, Salmonella enterica enterica serovar Typhi Ty2
aaaaggaaagauuac

SEQ ID NO: 1767059 - RNA, 16 nt, Salmonella enterica enterica serovar Typhi Ty2
aaaagggaaaagccau

SEQ ID NO: 1767060 - RNA, 15 nt, Salmonella enterica enterica serovar Typhi Ty2
aaaagucauuuucau

SEQ ID NO: 1767061 - RNA, 21 nt, Salmonella enterica enterica serovar Typhi Ty2
aaaauggaugcgcccacaaug

SEQ ID NO: 1767062 - RNA, 16 nt, Salmonella enterica enterica serovar Typhi Ty2
aaaaugggcuggaaau

SEQ ID NO: 1767063 - RNA, 23 nt, Salmonella enterica enterica serovar Typhi Ty2
aaaauggggaucgucugcaaaac

SEQ ID NO: 1767064 - RNA, 14 nt, Salmonella enterica enterica serovar Typhi Ty2
aaaaugaauaccaa

SEQ ID NO: 1767065 - RNA, 21 nt, Salmonella enterica enterica serovar Typhi Ty2
aaaaugugagccauaacaacu

SEQ ID NO: 1767066 - RNA, 20 nt, Salmonella enterica enterica serovar Typhi Ty2
aaaaugugcaaagagaccgg

SEQ ID NO: 1767067 - RNA, 13 nt, Salmonella enterica enterica serovar Typhi Ty2
aaaauuaccaggc

SEQ ID NO: 1767068 - RNA, 22 nt, Salmonella enterica enterica serovar Typhi Ty2
aaaauuaacgacaaaaauacca

SEQ ID NO: 1767069 - RNA, 18 nt, Salmonella enterica enterica serovar Typhi Ty2
aaaauuacuucguagacu

SEQ ID NO: 1767070 - RNA, 23 nt, Salmonella enterica enterica serovar Typhi Ty2
aaaauuacuucguagacucaggc

SEQ ID NO: 1767071 - RNA, 22 nt, Salmonella enterica enterica serovar Typhi Ty2
aaaaucagcccggacaucaucc

SEQ ID NO: 1767072 - RNA, 21 nt, Salmonella enterica enterica serovar Typhi Ty2
aaaaucugguggccggaggag

SEQ ID NO: 1767073 - RNA, 22 nt, Salmonella enterica enterica serovar Typhi Ty2
aaagcgcucguuauaauugccc

SEQ ID NO: 1767074 - RNA, 14 nt, Salmonella enterica enterica serovar Typhi Ty2
aaagcggacacugu

SEQ ID NO: 1767075 - RNA, 22 nt, Salmonella enterica enterica serovar Typhi Ty2
aaagcggauaagauagcaggcg

SEQ ID NO: 1767076 - RNA, 14 nt, Salmonella enterica enterica serovar Typhi Ty2
aaagcggcuguagc

SEQ ID NO: 1767077 - RNA, 16 nt, Salmonella enterica enterica serovar Typhi Ty2
aaagcggcacaaauaa

SEQ ID NO: 1767078 - RNA, 21 nt, Salmonella enterica enterica serovar Typhi Ty2
aaagcggauggccugcucaau

SEQ ID NO: 1767079 - RNA, 21 nt, Salmonella enterica enterica serovar Typhi Ty2
aaagcuccggacgcaccagcc

SEQ ID NO: 1767080 - RNA, 20 nt, Salmonella enterica enterica serovar Typhi Ty2
aaagccguauuuuauuuuuc

SEQ ID NO: 1767081 - RNA, 14 nt, Salmonella enterica enterica serovar Typhi Ty2
aaagcauaaccaaa

SEQ ID NO: 1767082 - RNA, 12 nt, Salmonella enterica enterica serovar Typhi Ty2
aaagcagugcag

SEQ ID NO: 1767083 - RNA, 19 nt, Salmonella enterica enterica serovar Typhi Ty2
aaagcgacucauccacaua

SEQ ID NO: 1767084 - RNA, 23 nt, Salmonella enterica enterica serovar Typhi Ty2
aaagcgaccggcacucaccucuu

SEQ ID NO: 1767085 - RNA, 19 nt, Salmonella enterica enterica serovar Typhi Ty2
aaagcgaauaacauaauau

SEQ ID NO: 1767086 - RNA, 12 nt, Salmonella enterica enterica serovar Typhi Ty2
aaaggaucgauu

SEQ ID NO: 1767087 - RNA, 23 nt, Salmonella enterica enterica serovar Typhi Ty2
aaaggccuggcugagaaaaauac

SEQ ID NO: 1767088 - RNA, 15 nt, Salmonella enterica enterica serovar Typhi Ty2
aaaggaaagggacga

SEQ ID NO: 1767089 - RNA, 21 nt, Salmonella enterica enterica serovar Typhi Ty2
aaaggaaagauuacuucaggc

SEQ ID NO: 1767090 - RNA, 12 nt, Salmonella enterica enterica serovar Typhi Ty2
aaagcugccuuu

SEQ ID NO: 1767091 - RNA, 15 nt, Salmonella enterica enterica serovar Typhi Ty2
aaagcugcaccagga

SEQ ID NO: 1767092 - RNA, 12 nt, Salmonella enterica enterica serovar Typhi Ty2
aaaggcuuuaaa

SEQ ID NO: 1767093 - RNA, 20 nt, Salmonella enterica enterica serovar Typhi Ty2
aaaggcgccgcuucccccgg

SEQ ID NO: 1767094 - RNA, 14 nt, Salmonella enterica enterica serovar Typhi Ty2
aaaggcuaccgguu

SEQ ID NO: 1767095 - RNA, 20 nt, Salmonella enterica enterica serovar Typhi Ty2
aaaggccuggcugagaaaaa

SEQ ID NO: 1767096 - RNA, 22 nt, Salmonella enterica enterica serovar Typhi Ty2
aaaggucuuucuguguugcuca

SEQ ID NO: 1767097 - RNA, 15 nt, Salmonella enterica enterica serovar Typhi Ty2
aaaggucgacauuua

SEQ ID NO: 1767098 - RNA, 16 nt, Salmonella enterica enterica serovar Typhi Ty2
aaagaaucgccagucg

SEQ ID NO: 1767099 - RNA, 12 nt, Salmonella enterica enterica serovar Typhi Ty2
aaagaagaauaa

SEQ ID NO: 1767100 - RNA, 22 nt, Salmonella enterica enterica serovar Typhi Ty2
aaagaacgacgaauaagcugaa

SEQ ID NO: 1767101 - RNA, 23 nt, Salmonella enterica enterica serovar Typhi Ty2
aaagaacguguuuuuccagcaac

SEQ ID NO: 1767102 - RNA, 21 nt, Salmonella enterica enterica serovar Typhi Ty2
aaagaagaaaccgcagaaaaa

SEQ ID NO: 1767103 - RNA, 12 nt, Salmonella enterica enterica serovar Typhi Ty2
aaagaaaucacc

SEQ ID NO: 1767104 - RNA, 12 nt, Salmonella enterica enterica serovar Typhi Ty2
aaagaaauuuaa

SEQ ID NO: 1767105 - RNA, 14 nt, Salmonella enterica enterica serovar Typhi Ty2
aaagaaaacaucag

SEQ ID NO: 1767106 - RNA, 10 nt, Salmonella enterica enterica serovar Typhi Ty2
aaagaaaaac

SEQ ID NO: 1767107 - RNA, 18 nt, Salmonella enterica enterica serovar Typhi Ty2
aaagaaaacuuucauuuc

SEQ ID NO: 1767108 - RNA, 14 nt, Salmonella enterica enterica serovar Typhi Ty2
aaagaaaaugccag

SEQ ID NO: 1767109 - RNA, 18 nt, Salmonella enterica enterica serovar Typhi Ty2
aaagauuagccccagcgc

SEQ ID NO: 1767110 - RNA, 18 nt, Salmonella enterica enterica serovar Typhi Ty2
aaagcaaucgccagcgcc

SEQ ID NO: 1767111 - RNA, 17 nt, Salmonella enterica enterica serovar Typhi Ty2
aaagacauaggccggcg

SEQ ID NO: 1767112 - RNA, 18 nt, Salmonella enterica enterica serovar Typhi Ty2
aaagacaugaucuuaccu

SEQ ID NO: 1767113 - RNA, 16 nt, Salmonella enterica enterica serovar Typhi Ty2
aaagacagcaggcuuu

SEQ ID NO: 1767114 - RNA, 16 nt, Salmonella enterica enterica serovar Typhi Ty2
aaagaggaauguccag

SEQ ID NO: 1767115 - RNA, 23 nt, Salmonella enterica enterica serovar Typhi Ty2
aaauagaucaucuauaauaccuc

SEQ ID NO: 1767116 - RNA, 15 nt, Salmonella enterica enterica serovar Typhi Ty2
aaauagagaaaauaa

SEQ ID NO: 1767117 - RNA, 16 nt, Salmonella enterica enterica serovar Typhi Ty2
aaauagagaaaauaac

SEQ ID NO: 1767118 - RNA, 13 nt, Salmonella enterica enterica serovar Typhi Ty2
aaauagagaaaau

SEQ ID NO: 1767119 - RNA, 14 nt, Salmonella enterica enterica serovar Typhi Ty2
aaauagagaaaaua

SEQ ID NO: 1767120 - RNA, 15 nt, Salmonella enterica enterica serovar Typhi Ty2
aaauagcaauuauau

SEQ ID NO: 1767121 - RNA, 18 nt, Salmonella enterica enterica serovar Typhi Ty2
aaauagcaagagaugagc

SEQ ID NO: 1767122 - RNA, 21 nt, Salmonella enterica enterica serovar Typhi Ty2
aaauauagccauuuaaugaug

SEQ ID NO: 1767123 - RNA, 16 nt, Salmonella enterica enterica serovar Typhi Ty2
aaauauagcuuuucau

SEQ ID NO: 1767124 - RNA, 22 nt, Salmonella enterica enterica serovar Typhi Ty2
aaauaguucaucgugaaauuau

SEQ ID NO: 1767125 - RNA, 10 nt, Salmonella enterica enterica serovar Typhi Ty2
aaauauccua

SEQ ID NO: 1767126 - RNA, 21 nt, Salmonella enterica enterica serovar Typhi Ty2
aaauaucauucgcgucauacu

SEQ ID NO: 1767127 - RNA, 17 nt, Salmonella enterica enterica serovar Typhi Ty2
aaauaucgcugcccaga

SEQ ID NO: 1767128 - RNA, 17 nt, Salmonella enterica enterica serovar Typhi Ty2
aaauaucucucccuccc

SEQ ID NO: 1767129 - RNA, 13 nt, Salmonella enterica enterica serovar Typhi Ty2
aaauagaaaauaa

SEQ ID NO: 1767130 - RNA, 14 nt, Salmonella enterica enterica serovar Typhi Ty2
aaauagaaaauaau

SEQ ID NO: 1767131 - RNA, 17 nt, Salmonella enterica enterica serovar Typhi Ty2
aaauagaaauugcaggg

SEQ ID NO: 1767132 - RNA, 12 nt, Salmonella enterica enterica serovar Typhi Ty2
aaauaccuaacu

SEQ ID NO: 1767133 - RNA, 23 nt, Salmonella enterica enterica serovar Typhi Ty2
aaauaccggcagcggucaucaau

SEQ ID NO: 1767134 - RNA, 15 nt, Salmonella enterica enterica serovar Typhi Ty2
aaauaccgcacauca

SEQ ID NO: 1767135 - RNA, 14 nt, Salmonella enterica enterica serovar Typhi Ty2
aaauaccaaauauu

SEQ ID NO: 1767136 - RNA, 9 nt, Salmonella enterica enterica serovar Typhi Ty2
aaauaccag

SEQ ID NO: 1767137 - RNA, 12 nt, Salmonella enterica enterica serovar Typhi Ty2
aaauaccagcac

SEQ ID NO: 1767138 - RNA, 22 nt, Salmonella enterica enterica serovar Typhi Ty2
aaauacaccaaacgaauuuaaa

SEQ ID NO: 1767139 - RNA, 23 nt, Salmonella enterica enterica serovar Typhi Ty2
aaauacagagucgcuuaucugcu

SEQ ID NO: 1767140 - RNA, 21 nt, Salmonella enterica enterica serovar Typhi Ty2
aaauaaauauguuauuuacaa

SEQ ID NO: 1767141 - RNA, 18 nt, Salmonella enterica enterica serovar Typhi Ty2
aaauaaauauguuauuua

SEQ ID NO: 1767142 - RNA, 14 nt, Salmonella enterica enterica serovar Typhi Ty2
aaauaauuguguaa

SEQ ID NO: 1767143 - RNA, 13 nt, Salmonella enterica enterica serovar Typhi Ty2
aaauaauugauaa

SEQ ID NO: 1767144 - RNA, 16 nt, Salmonella enterica enterica serovar Typhi Ty2
aaaguuacuuuccaua

SEQ ID NO: 1767145 - RNA, 13 nt, Salmonella enterica enterica serovar Typhi Ty2
aaaguuauucacg

SEQ ID NO: 1767146 - RNA, 12 nt, Salmonella enterica enterica serovar Typhi Ty2
aaaguuugaagu

SEQ ID NO: 1767147 - RNA, 13 nt, Salmonella enterica enterica serovar Typhi Ty2
aaaguuuuucaua

SEQ ID NO: 1767148 - RNA, 19 nt, Salmonella enterica enterica serovar Typhi Ty2
aaauaaagugcugaacaau

SEQ ID NO: 1767149 - RNA, 21 nt, Salmonella enterica enterica serovar Typhi Ty2
aaauaaagugcugaacaauaa

SEQ ID NO: 1767150 - RNA, 17 nt, Salmonella enterica enterica serovar Typhi Ty2
aaauaaagguucauauu

SEQ ID NO: 1767151 - RNA, 12 nt, Salmonella enterica enterica serovar Typhi Ty2
aaauaaaaccag

SEQ ID NO: 1767152 - RNA, 13 nt, Salmonella enterica enterica serovar Typhi Ty2
aaauaaaaaaacc

SEQ ID NO: 1767153 - RNA, 23 nt, Salmonella enterica enterica serovar Typhi Ty2
aaauaaaaaccgccucaggcgca

SEQ ID NO: 1767154 - RNA, 15 nt, Salmonella enterica enterica serovar Typhi Ty2
aaauaaaaaaggcag

SEQ ID NO: 1767155 - RNA, 19 nt, Salmonella enterica enterica serovar Typhi Ty2
aaaguggcauccgaagaac

SEQ ID NO: 1767156 - RNA, 15 nt, Salmonella enterica enterica serovar Typhi Ty2
aaaguggugggugau

SEQ ID NO: 1767157 - RNA, 23 nt, Salmonella enterica enterica serovar Typhi Ty2
aaagugccagggcggaagcagau

SEQ ID NO: 1767158 - RNA, 21 nt, Salmonella enterica enterica serovar Typhi Ty2
aaagugauuauaaaucaauag

SEQ ID NO: 1767159 - RNA, 18 nt, Salmonella enterica enterica serovar Typhi Ty2
aaaguacuucacaaucag

SEQ ID NO: 1767160 - RNA, 21 nt, Salmonella enterica enterica serovar Typhi Ty2
aaauuauuuuuacuuaaaauu

SEQ ID NO: 1767161 - RNA, 18 nt, Salmonella enterica enterica serovar Typhi Ty2
aaauucaaaaaagcagua

SEQ ID NO: 1767162 - RNA, 23 nt, Salmonella enterica enterica serovar Typhi Ty2
aaauuauugugagaaaagcagag

SEQ ID NO: 1767163 - RNA, 22 nt, Salmonella enterica enterica serovar Typhi Ty2
aaauuagcucccgcgauagguu

SEQ ID NO: 1767164 - RNA, 17 nt, Salmonella enterica enterica serovar Typhi Ty2
aaauuacuuaugauaua

SEQ ID NO: 1767165 - RNA, 11 nt, Salmonella enterica enterica serovar Typhi Ty2
aaaaagagaag

SEQ ID NO: 1767166 - RNA, 15 nt, Salmonella enterica enterica serovar Typhi Ty2
aaaaagauaaccauu

SEQ ID NO: 1767167 - RNA, 13 nt, Salmonella enterica enterica serovar Typhi Ty2
aaauuaaaaauac

SEQ ID NO: 1767168 - RNA, 20 nt, Salmonella enterica enterica serovar Typhi Ty2
aaauuaaugauuaaaauaaa

SEQ ID NO: 1767169 - RNA, 19 nt, Salmonella enterica enterica serovar Typhi Ty2
aaauuaaugauuaaaauaa

SEQ ID NO: 1767170 - RNA, 18 nt, Salmonella enterica enterica serovar Typhi Ty2
aaauuaaugauuaaaaua

SEQ ID NO: 1767171 - RNA, 15 nt, Salmonella enterica enterica serovar Typhi Ty2
aaauuaaugauuaaa

SEQ ID NO: 1767172 - RNA, 18 nt, Salmonella enterica enterica serovar Typhi Ty2
aaauuaaucgccagcagc

SEQ ID NO: 1767173 - RNA, 12 nt, Salmonella enterica enterica serovar Typhi Ty2
aaauuaaucagg

SEQ ID NO: 1767174 - RNA, 13 nt, Salmonella enterica enterica serovar Typhi Ty2
aaauuaaucaggc

SEQ ID NO: 1767175 - RNA, 15 nt, Salmonella enterica enterica serovar Typhi Ty2
aaaaagcaaagaggu

SEQ ID NO: 1767176 - RNA, 16 nt, Salmonella enterica enterica serovar Typhi Ty2
aaaugguuuugcccau

SEQ ID NO: 1767177 - RNA, 17 nt, Salmonella enterica enterica serovar Typhi Ty2
aaaugguuuugcccauu

SEQ ID NO: 1767178 - RNA, 17 nt, Salmonella enterica enterica serovar Typhi Ty2
aaauguauacuccccuu

SEQ ID NO: 1767179 - RNA, 23 nt, Salmonella enterica enterica serovar Typhi Ty2
aaauggucagccauaaccuccuu

SEQ ID NO: 1767180 - RNA, 16 nt, Salmonella enterica enterica serovar Typhi Ty2
aaauggucggucacgc

SEQ ID NO: 1767181 - RNA, 19 nt, Salmonella enterica enterica serovar Typhi Ty2
aaauggucccugauauaca

SEQ ID NO: 1767182 - RNA, 18 nt, Salmonella enterica enterica serovar Typhi Ty2
aaaugucccgauauuggu

SEQ ID NO: 1767183 - RNA, 13 nt, Salmonella enterica enterica serovar Typhi Ty2
aaauguuuuuguu

SEQ ID NO: 1767184 - RNA, 9 nt, Salmonella enterica enterica serovar Typhi Ty2
aaauguuuu

SEQ ID NO: 1767185 - RNA, 21 nt, Salmonella enterica enterica serovar Typhi Ty2
aaauguuguuugaaaagugaa

SEQ ID NO: 1767186 - RNA, 18 nt, Salmonella enterica enterica serovar Typhi Ty2
aaauggccccaaaucaga

SEQ ID NO: 1767187 - RNA, 12 nt, Salmonella enterica enterica serovar Typhi Ty2
aaauggcgcugu

SEQ ID NO: 1767188 - RNA, 21 nt, Salmonella enterica enterica serovar Typhi Ty2
aaaugcacugcaauuucugcu

SEQ ID NO: 1767189 - RNA, 22 nt, Salmonella enterica enterica serovar Typhi Ty2
aaaucguauuggggaucgggca

SEQ ID NO: 1767190 - RNA, 22 nt, Salmonella enterica enterica serovar Typhi Ty2
aaaucgguaaucaugucguaga

SEQ ID NO: 1767191 - RNA, 21 nt, Salmonella enterica enterica serovar Typhi Ty2
aaaucggggucuuccagcaga

SEQ ID NO: 1767192 - RNA, 20 nt, Salmonella enterica enterica serovar Typhi Ty2
aaaucgguaacaucaaguac

SEQ ID NO: 1767193 - RNA, 19 nt, Salmonella enterica enterica serovar Typhi Ty2
aaaucugccgucaucgacu

SEQ ID NO: 1767194 - RNA, 23 nt, Salmonella enterica enterica serovar Typhi Ty2
aaaucuuucuccugguuuuucca

SEQ ID NO: 1767195 - RNA, 13 nt, Salmonella enterica enterica serovar Typhi Ty2
aaaugaauaccaa

SEQ ID NO: 1767196 - RNA, 13 nt, Salmonella enterica enterica serovar Typhi Ty2
aaaugacgccugu

SEQ ID NO: 1767197 - RNA, 18 nt, Salmonella enterica enterica serovar Typhi Ty2
aaaugacgcccugcgcca

SEQ ID NO: 1767198 - RNA, 13 nt, Salmonella enterica enterica serovar Typhi Ty2
aaaugaggugaaa

SEQ ID NO: 1767199 - RNA, 21 nt, Salmonella enterica enterica serovar Typhi Ty2
aaaugagaaaaggaagaauaa

SEQ ID NO: 1767200 - RNA, 15 nt, Salmonella enterica enterica serovar Typhi Ty2
aaauccagcucaguu

SEQ ID NO: 1767201 - RNA, 17 nt, Salmonella enterica enterica serovar Typhi Ty2
aaauccagggaaaccau

SEQ ID NO: 1767202 - RNA, 22 nt, Salmonella enterica enterica serovar Typhi Ty2
aaauccagggaaaccauguuga

SEQ ID NO: 1767203 - RNA, 23 nt, Salmonella enterica enterica serovar Typhi Ty2
aaaucccccaacgucaccaucaa

SEQ ID NO: 1767204 - RNA, 20 nt, Salmonella enterica enterica serovar Typhi Ty2
aaauccccaccugacuauac

SEQ ID NO: 1767205 - RNA, 22 nt, Salmonella enterica enterica serovar Typhi Ty2
aaaucccggcgauuaauaaaau

SEQ ID NO: 1767206 - RNA, 14 nt, Salmonella enterica enterica serovar Typhi Ty2
aaaucccggcuggg

SEQ ID NO: 1767207 - RNA, 19 nt, Salmonella enterica enterica serovar Typhi Ty2
aaauauuacaacauguccu

SEQ ID NO: 1767208 - RNA, 14 nt, Salmonella enterica enterica serovar Typhi Ty2
aaauauuaauuaag

SEQ ID NO: 1767209 - RNA, 22 nt, Salmonella enterica enterica serovar Typhi Ty2
aaaucauuuguacaaaaaaugu

SEQ ID NO: 1767210 - RNA, 12 nt, Salmonella enterica enterica serovar Typhi Ty2
aaauccaauaga

SEQ ID NO: 1767211 - RNA, 13 nt, Salmonella enterica enterica serovar Typhi Ty2
aaauccugcucca

SEQ ID NO: 1767212 - RNA, 16 nt, Salmonella enterica enterica serovar Typhi Ty2
aaauccugcacuucca

SEQ ID NO: 1767213 - RNA, 21 nt, Salmonella enterica enterica serovar Typhi Ty2
aaauccgcgcucggucacuuc

SEQ ID NO: 1767214 - RNA, 22 nt, Salmonella enterica enterica serovar Typhi Ty2
aaauccgcgcucggucacuuca

SEQ ID NO: 1767215 - RNA, 16 nt, Salmonella enterica enterica serovar Typhi Ty2
aaaucccgguuuuuuu

SEQ ID NO: 1767216 - RNA, 19 nt, Salmonella enterica enterica serovar Typhi Ty2
aaaucccggcgauuaauaa

SEQ ID NO: 1767217 - RNA, 14 nt, Salmonella enterica enterica serovar Typhi Ty2
aaauccggccucca

SEQ ID NO: 1767218 - RNA, 22 nt, Salmonella enterica enterica serovar Typhi Ty2
aaauuuagcuauuccaaaauaa

SEQ ID NO: 1767219 - RNA, 16 nt, Salmonella enterica enterica serovar Typhi Ty2
aaauuuaauauaugaa

SEQ ID NO: 1767220 - RNA, 23 nt, Salmonella enterica enterica serovar Typhi Ty2
aaauuucacgucacguucauccu

SEQ ID NO: 1767221 - RNA, 22 nt, Salmonella enterica enterica serovar Typhi Ty2
aaauuucaacccgaucgccauc

SEQ ID NO: 1767222 - RNA, 20 nt, Salmonella enterica enterica serovar Typhi Ty2
aaauuucaucguagucguag

SEQ ID NO: 1767223 - RNA, 20 nt, Salmonella enterica enterica serovar Typhi Ty2
aaauuuucaaccacggauaa

SEQ ID NO: 1767224 - RNA, 16 nt, Salmonella enterica enterica serovar Typhi Ty2
aaauuugcagcgcugu

SEQ ID NO: 1767225 - RNA, 17 nt, Salmonella enterica enterica serovar Typhi Ty2
aaauuggaguuaucauu

SEQ ID NO: 1767226 - RNA, 17 nt, Salmonella enterica enterica serovar Typhi Ty2
aaauuggcucagaauuu

SEQ ID NO: 1767227 - RNA, 15 nt, Salmonella enterica enterica serovar Typhi Ty2
aaauuggugauauaa

SEQ ID NO: 1767228 - RNA, 19 nt, Salmonella enterica enterica serovar Typhi Ty2
aaauuggugauauaaacgg

SEQ ID NO: 1767229 - RNA, 18 nt, Salmonella enterica enterica serovar Typhi Ty2
aaauugguuauauuacug

SEQ ID NO: 1767230 - RNA, 21 nt, Salmonella enterica enterica serovar Typhi Ty2
aaauugccgcgcccugcggaa

SEQ ID NO: 1767231 - RNA, 12 nt, Salmonella enterica enterica serovar Typhi Ty2
aaauugcagggu

SEQ ID NO: 1767232 - RNA, 24 nt, Salmonella enterica enterica serovar Typhi Ty2
aaauugccacgaacgauauaaaaa

SEQ ID NO: 1767233 - RNA, 16 nt, Salmonella enterica enterica serovar Typhi Ty2
aaauuccaauauuuau

SEQ ID NO: 1767234 - RNA, 14 nt, Salmonella enterica enterica serovar Typhi Ty2
aaauugaauuauaa

SEQ ID NO: 1767235 - RNA, 19 nt, Salmonella enterica enterica serovar Typhi Ty2
aaauugaauuauaauaaag

SEQ ID NO: 1767236 - RNA, 22 nt, Salmonella enterica enterica serovar Typhi Ty2
aaauugaauuaagcaauccauu

SEQ ID NO: 1767237 - RNA, 23 nt, Salmonella enterica enterica serovar Typhi Ty2
aaauugaauuaagcaauccauuu

SEQ ID NO: 1767238 - RNA, 22 nt, Salmonella enterica enterica serovar Typhi Ty2
aaauuuucaauacgucauauca

SEQ ID NO: 1767239 - RNA, 15 nt, Salmonella enterica enterica serovar Typhi Ty2
aacaaaaccagcauc

SEQ ID NO: 1767240 - RNA, 23 nt, Salmonella enterica enterica serovar Typhi Ty2
aacaaagguuuguuuaauuuugu

SEQ ID NO: 1767241 - RNA, 14 nt, Salmonella enterica enterica serovar Typhi Ty2
aacaaaccaaacug

SEQ ID NO: 1767242 - RNA, 14 nt, Salmonella enterica enterica serovar Typhi Ty2
aacaaaagaaagca

SEQ ID NO: 1767243 - RNA, 14 nt, Salmonella enterica enterica serovar Typhi Ty2
aacaaacacagcca

SEQ ID NO: 1767244 - RNA, 11 nt, Salmonella enterica enterica serovar Typhi Ty2
aacaaaugaag

SEQ ID NO: 1767245 - RNA, 14 nt, Salmonella enterica enterica serovar Typhi Ty2
aacaaauaaaucca

SEQ ID NO: 1767246 - RNA, 16 nt, Salmonella enterica enterica serovar Typhi Ty2
aacaaaucgacagcca

SEQ ID NO: 1767247 - RNA, 15 nt, Salmonella enterica enterica serovar Typhi Ty2
aacaaccagaauaau

SEQ ID NO: 1767248 - RNA, 22 nt, Salmonella enterica enterica serovar Typhi Ty2
aacaacauugaggcuacccaga

SEQ ID NO: 1767249 - RNA, 15 nt, Salmonella enterica enterica serovar Typhi Ty2
caacuguauuuugaa

SEQ ID NO: 1767250 - RNA, 17 nt, Salmonella enterica enterica serovar Typhi Ty2
caacuguaccugaucca

SEQ ID NO: 1767251 - RNA, 17 nt, Salmonella enterica enterica serovar Typhi Ty2
caacuguacgccacggc

SEQ ID NO: 1767252 - RNA, 21 nt, Salmonella enterica enterica serovar Typhi Ty2
caacugccaggcguguggcca

SEQ ID NO: 1767253 - RNA, 17 nt, Salmonella enterica enterica serovar Typhi Ty2
caacuguucuucgguuu

SEQ ID NO: 1767254 - RNA, 21 nt, Salmonella enterica enterica serovar Typhi Ty2
caacuucuaauuuuuccagca

SEQ ID NO: 1767255 - RNA, 16 nt, Salmonella enterica enterica serovar Typhi Ty2
caacuucguucaguuc

SEQ ID NO: 1767256 - RNA, 22 nt, Salmonella enterica enterica serovar Typhi Ty2
caacucgcacaguacaccugca

SEQ ID NO: 1767257 - RNA, 22 nt, Salmonella enterica enterica serovar Typhi Ty2
caacucgccgguuuuuuuacuc

SEQ ID NO: 1767258 - RNA, 18 nt, Salmonella enterica enterica serovar Typhi Ty2
caacugauuaaucugccg

SEQ ID NO: 1767259 - RNA, 14 nt, Salmonella enterica enterica serovar Typhi Ty2
caacuacacucuua

SEQ ID NO: 1767260 - RNA, 19 nt, Salmonella enterica enterica serovar Typhi Ty2
caacguuuucagcagugca

SEQ ID NO: 1767261 - RNA, 21 nt, Salmonella enterica enterica serovar Typhi Ty2
caacguuuguaacagcaggac

SEQ ID NO: 1767262 - RNA, 17 nt, Salmonella enterica enterica serovar Typhi Ty2
caacguuuguaacagca

SEQ ID NO: 1767263 - RNA, 14 nt, Salmonella enterica enterica serovar Typhi Ty2
caacgccuccaggc

SEQ ID NO: 1767264 - RNA, 13 nt, Salmonella enterica enterica serovar Typhi Ty2
caacgccuccugc

SEQ ID NO: 1767265 - RNA, 14 nt, Salmonella enterica enterica serovar Typhi Ty2
caacgccgccuggc

SEQ ID NO: 1767266 - RNA, 13 nt, Salmonella enterica enterica serovar Typhi Ty2
caacgccggcaac

SEQ ID NO: 1767267 - RNA, 17 nt, Salmonella enterica enterica serovar Typhi Ty2
caagacgaaaaaugaau

SEQ ID NO: 1767268 - RNA, 17 nt, Salmonella enterica enterica serovar Typhi Ty2
caagaccgccuaacagc

SEQ ID NO: 1767269 - RNA, 22 nt, Salmonella enterica enterica serovar Typhi Ty2
caagaccgauagagacugccgc

SEQ ID NO: 1767270 - RNA, 19 nt, Salmonella enterica enterica serovar Typhi Ty2
caagaagauuucuuaauuc

SEQ ID NO: 1767271 - RNA, 23 nt, Salmonella enterica enterica serovar Typhi Ty2
caagaaaugcaggcguuuuauug

SEQ ID NO: 1767272 - RNA, 16 nt, Salmonella enterica enterica serovar Typhi Ty2
caacuuuuucuuaagc

SEQ ID NO: 1767273 - RNA, 20 nt, Salmonella enterica enterica serovar Typhi Ty2
caacuugaaguaugaagggu

SEQ ID NO: 1767274 - RNA, 13 nt, Salmonella enterica enterica serovar Typhi Ty2
caagcacaaaaag

SEQ ID NO: 1767275 - RNA, 17 nt, Salmonella enterica enterica serovar Typhi Ty2
caagcaaugccagaaau

SEQ ID NO: 1767276 - RNA, 19 nt, Salmonella enterica enterica serovar Typhi Ty2
caagcaacuguagaaugcu

SEQ ID NO: 1767277 - RNA, 16 nt, Salmonella enterica enterica serovar Typhi Ty2
caagauuucaaaaccc

SEQ ID NO: 1767278 - RNA, 14 nt, Salmonella enterica enterica serovar Typhi Ty2
caagcccaacuauu

SEQ ID NO: 1767279 - RNA, 11 nt, Salmonella enterica enterica serovar Typhi Ty2
caagcccagcu

SEQ ID NO: 1767280 - RNA, 14 nt, Salmonella enterica enterica serovar Typhi Ty2
caagcccagcucag

SEQ ID NO: 1767281 - RNA, 21 nt, Salmonella enterica enterica serovar Typhi Ty2
caagccccccgcacagcacau

SEQ ID NO: 1767282 - RNA, 15 nt, Salmonella enterica enterica serovar Typhi Ty2
caagcagcauaauga

SEQ ID NO: 1767283 - RNA, 22 nt, Salmonella enterica enterica serovar Typhi Ty2
caagccaggcccgguggcgcca

SEQ ID NO: 1767284 - RNA, 18 nt, Salmonella enterica enterica serovar Typhi Ty2
caagcgcggacagcagaa

SEQ ID NO: 1767285 - RNA, 15 nt, Salmonella enterica enterica serovar Typhi Ty2
caagcgcuucguuga

SEQ ID NO: 1767286 - RNA, 20 nt, Salmonella enterica enterica serovar Typhi Ty2
caagcgguuugaaaauggcg

SEQ ID NO: 1767287 - RNA, 19 nt, Salmonella enterica enterica serovar Typhi Ty2
caaggcgcaaaaccauacu

SEQ ID NO: 1767288 - RNA, 15 nt, Salmonella enterica enterica serovar Typhi Ty2
caaggcgcaaaacca

SEQ ID NO: 1767289 - RNA, 16 nt, Salmonella enterica enterica serovar Typhi Ty2
caaggcgacgcuucac

SEQ ID NO: 1767290 - RNA, 12 nt, Salmonella enterica enterica serovar Typhi Ty2
caaggaaggaaa

SEQ ID NO: 1767291 - RNA, 16 nt, Salmonella enterica enterica serovar Typhi Ty2
caaggaaaaccaguaa

SEQ ID NO: 1767292 - RNA, 12 nt, Salmonella enterica enterica serovar Typhi Ty2
caaggaaagaaa

SEQ ID NO: 1767293 - RNA, 17 nt, Salmonella enterica enterica serovar Typhi Ty2
caagggagugagucccc

SEQ ID NO: 1767294 - RNA, 13 nt, Salmonella enterica enterica serovar Typhi Ty2
caaggucggcucc

SEQ ID NO: 1767295 - RNA, 14 nt, Salmonella enterica enterica serovar Typhi Ty2
caauaccacgcccg

SEQ ID NO: 1767296 - RNA, 21 nt, Salmonella enterica enterica serovar Typhi Ty2
caauagagugcgauuugacau

SEQ ID NO: 1767297 - RNA, 16 nt, Salmonella enterica enterica serovar Typhi Ty2
caauagcaaucuguaa

SEQ ID NO: 1767298 - RNA, 16 nt, Salmonella enterica enterica serovar Typhi Ty2
caauagacuucacuuu

SEQ ID NO: 1767299 - RNA, 19 nt, Salmonella enterica enterica serovar Typhi Ty2
caauagccaauaacgucug

SEQ ID NO: 1767300 - RNA, 18 nt, Salmonella enterica enterica serovar Typhi Ty2
caauagcgagaggcaauu

SEQ ID NO: 1767301 - RNA, 15 nt, Salmonella enterica enterica serovar Typhi Ty2
caauagcgcuaaaca

SEQ ID NO: 1767302 - RNA, 15 nt, Salmonella enterica enterica serovar Typhi Ty2
caauauguuuaaaga

SEQ ID NO: 1767303 - RNA, 18 nt, Salmonella enterica enterica serovar Typhi Ty2
caauaugucuuaaacagc

SEQ ID NO: 1767304 - RNA, 14 nt, Salmonella enterica enterica serovar Typhi Ty2
caauauuaaauaaa

SEQ ID NO: 1767305 - RNA, 20 nt, Salmonella enterica enterica serovar Typhi Ty2
caauauuaaugcugcguuua

SEQ ID NO: 1767306 - RNA, 20 nt, Salmonella enterica enterica serovar Typhi Ty2
caauauuacaaagcaguaaa

SEQ ID NO: 1767307 - RNA, 19 nt, Salmonella enterica enterica serovar Typhi Ty2
caauaugcagaucgacggu

SEQ ID NO: 1767308 - RNA, 18 nt, Salmonella enterica enterica serovar Typhi Ty2
caauaaucccuucuuuua

SEQ ID NO: 1767309 - RNA, 13 nt, Salmonella enterica enterica serovar Typhi Ty2
caauaagaacuuu

SEQ ID NO: 1767310 - RNA, 21 nt, Salmonella enterica enterica serovar Typhi Ty2
caauaauauguuccacaauca

SEQ ID NO: 1767311 - RNA, 17 nt, Salmonella enterica enterica serovar Typhi Ty2
caauaacagccagcggg

SEQ ID NO: 1767312 - RNA, 14 nt, Salmonella enterica enterica serovar Typhi Ty2
caauaacagccagc

SEQ ID NO: 1767313 - RNA, 15 nt, Salmonella enterica enterica serovar Typhi Ty2
caauaacaccacaac

SEQ ID NO: 1767314 - RNA, 20 nt, Salmonella enterica enterica serovar Typhi Ty2
caauaacgaccccaauagcg

SEQ ID NO: 1767315 - RNA, 23 nt, Salmonella enterica enterica serovar Typhi Ty2
caauaacgccggauauguuugac

SEQ ID NO: 1767316 - RNA, 12 nt, Salmonella enterica enterica serovar Typhi Ty2
caauaaauaaua

SEQ ID NO: 1767317 - RNA, 23 nt, Salmonella enterica enterica serovar Typhi Ty2
caauaaauaauaucguuaagccu

SEQ ID NO: 1767318 - RNA, 17 nt, Salmonella enterica enterica serovar Typhi Ty2
caaguuuagaaaaaauu

SEQ ID NO: 1767319 - RNA, 19 nt, Salmonella enterica enterica serovar Typhi Ty2
caauaaaucaacauacuga

SEQ ID NO: 1767320 - RNA, 16 nt, Salmonella enterica enterica serovar Typhi Ty2
caaguugcgccacugc

SEQ ID NO: 1767321 - RNA, 15 nt, Salmonella enterica enterica serovar Typhi Ty2
caaguaauaaaauaa

SEQ ID NO: 1767322 - RNA, 21 nt, Salmonella enterica enterica serovar Typhi Ty2
caaguacagcuuaaucaccag

SEQ ID NO: 1767323 - RNA, 17 nt, Salmonella enterica enterica serovar Typhi Ty2
caaugccggacgccacc

SEQ ID NO: 1767324 - RNA, 21 nt, Salmonella enterica enterica serovar Typhi Ty2
caaugccgcgggaaauaccaa

SEQ ID NO: 1767325 - RNA, 14 nt, Salmonella enterica enterica serovar Typhi Ty2
caaugcccuuaaau

SEQ ID NO: 1767326 - RNA, 21 nt, Salmonella enterica enterica serovar Typhi Ty2
caaugcccccaucacuuuacc

SEQ ID NO: 1767327 - RNA, 16 nt, Salmonella enterica enterica serovar Typhi Ty2
caaugccuaacccuuu

SEQ ID NO: 1767328 - RNA, 15 nt, Salmonella enterica enterica serovar Typhi Ty2
caaugcccuuaaauc

SEQ ID NO: 1767329 - RNA, 18 nt, Salmonella enterica enterica serovar Typhi Ty2
caaugccuuaugcccggc

SEQ ID NO: 1767330 - RNA, 14 nt, Salmonella enterica enterica serovar Typhi Ty2
caaugcgcuuuuuu

SEQ ID NO: 1767331 - RNA, 13 nt, Salmonella enterica enterica serovar Typhi Ty2
caaugcccagcgc

SEQ ID NO: 1767332 - RNA, 13 nt, Salmonella enterica enterica serovar Typhi Ty2
caaugcccaaaau

SEQ ID NO: 1767333 - RNA, 20 nt, Salmonella enterica enterica serovar Typhi Ty2
caaugcacuacgaaaagagg

SEQ ID NO: 1767334 - RNA, 20 nt, Salmonella enterica enterica serovar Typhi Ty2
caaugagauccacugagcgc

SEQ ID NO: 1767335 - RNA, 14 nt, Salmonella enterica enterica serovar Typhi Ty2
caaugaaauaauug

SEQ ID NO: 1767336 - RNA, 15 nt, Salmonella enterica enterica serovar Typhi Ty2
caaugauuuuuagcc

SEQ ID NO: 1767337 - RNA, 18 nt, Salmonella enterica enterica serovar Typhi Ty2
caauccguuauuucacag

SEQ ID NO: 1767338 - RNA, 15 nt, Salmonella enterica enterica serovar Typhi Ty2
caauccgcggcaaac

SEQ ID NO: 1767339 - RNA, 13 nt, Salmonella enterica enterica serovar Typhi Ty2
caauccuggcuuc

SEQ ID NO: 1767340 - RNA, 15 nt, Salmonella enterica enterica serovar Typhi Ty2
caaucgccugcugua

SEQ ID NO: 1767341 - RNA, 13 nt, Salmonella enterica enterica serovar Typhi Ty2
caaucgccugcaa

SEQ ID NO: 1767342 - RNA, 16 nt, Salmonella enterica enterica serovar Typhi Ty2
caaucgcguuuuccag

SEQ ID NO: 1767343 - RNA, 18 nt, Salmonella enterica enterica serovar Typhi Ty2
caaucgcuaucugacagc

SEQ ID NO: 1767344 - RNA, 21 nt, Salmonella enterica enterica serovar Typhi Ty2
caaucggcgucuggagcgugc

SEQ ID NO: 1767345 - RNA, 14 nt, Salmonella enterica enterica serovar Typhi Ty2
caaucgcguuuucc

SEQ ID NO: 1767346 - RNA, 13 nt, Salmonella enterica enterica serovar Typhi Ty2
caaucucuauacc

SEQ ID NO: 1767347 - RNA, 15 nt, Salmonella enterica enterica serovar Typhi Ty2
caaucucuuccgccc

SEQ ID NO: 1767348 - RNA, 12 nt, Salmonella enterica enterica serovar Typhi Ty2
caaucucuuuau

SEQ ID NO: 1767349 - RNA, 22 nt, Salmonella enterica enterica serovar Typhi Ty2
caaucuccuccggcuucagcaa

SEQ ID NO: 1767350 - RNA, 21 nt, Salmonella enterica enterica serovar Typhi Ty2
caaucaucagaccgauaaaua

SEQ ID NO: 1767351 - RNA, 15 nt, Salmonella enterica enterica serovar Typhi Ty2
caauauuuauuuaau

SEQ ID NO: 1767352 - RNA, 23 nt, Salmonella enterica enterica serovar Typhi Ty2
caauauugaacauuuuuucagcc

SEQ ID NO: 1767353 - RNA, 20 nt, Salmonella enterica enterica serovar Typhi Ty2
caauauucacgcgaauuccu

SEQ ID NO: 1767354 - RNA, 20 nt, Salmonella enterica enterica serovar Typhi Ty2
caauauuccgaaagaaagac

SEQ ID NO: 1767355 - RNA, 15 nt, Salmonella enterica enterica serovar Typhi Ty2
caaucccuuaaagcc

SEQ ID NO: 1767356 - RNA, 14 nt, Salmonella enterica enterica serovar Typhi Ty2
caaucaucagaaga

SEQ ID NO: 1767357 - RNA, 21 nt, Salmonella enterica enterica serovar Typhi Ty2
caacccgcuccagaagcacuu

SEQ ID NO: 1767358 - RNA, 13 nt, Salmonella enterica enterica serovar Typhi Ty2
caaccgacgcauu

SEQ ID NO: 1767359 - RNA, 15 nt, Salmonella enterica enterica serovar Typhi Ty2
caaccccguggugac

SEQ ID NO: 1767360 - RNA, 12 nt, Salmonella enterica enterica serovar Typhi Ty2
caaccccugacg

SEQ ID NO: 1767361 - RNA, 18 nt, Salmonella enterica enterica serovar Typhi Ty2
caaccagcaaugagacaa

SEQ ID NO: 1767362 - RNA, 14 nt, Salmonella enterica enterica serovar Typhi Ty2
caaccaccagcagu

SEQ ID NO: 1767363 - RNA, 18 nt, Salmonella enterica enterica serovar Typhi Ty2
caacagggcggccuccug

SEQ ID NO: 1767364 - RNA, 13 nt, Salmonella enterica enterica serovar Typhi Ty2
caacauacaugcc

SEQ ID NO: 1767365 - RNA, 17 nt, Salmonella enterica enterica serovar Typhi Ty2
caacagguuaaucagca

SEQ ID NO: 1767366 - RNA, 14 nt, Salmonella enterica enterica serovar Typhi Ty2
caacagguaccccg

SEQ ID NO: 1767367 - RNA, 23 nt, Salmonella enterica enterica serovar Typhi Ty2
caacauagcggcaaggaaaacca

SEQ ID NO: 1767368 - RNA, 20 nt, Salmonella enterica enterica serovar Typhi Ty2
caacauagcuaaauaaaaau

SEQ ID NO: 1767369 - RNA, 16 nt, Salmonella enterica enterica serovar Typhi Ty2
caacauauuugcccug

SEQ ID NO: 1767370 - RNA, 18 nt, Salmonella enterica enterica serovar Typhi Ty2
caaccaaccaacccaaaa

SEQ ID NO: 1767371 - RNA, 14 nt, Salmonella enterica enterica serovar Typhi Ty2
caaccaaugcaacg

SEQ ID NO: 1767372 - RNA, 18 nt, Salmonella enterica enterica serovar Typhi Ty2
caaccaaugcaacgccuu

SEQ ID NO: 1767373 - RNA, 20 nt, Salmonella enterica enterica serovar Typhi Ty2
caaccugaggaaaaagcgca

SEQ ID NO: 1767374 - RNA, 22 nt, Salmonella enterica enterica serovar Typhi Ty2
caaccugcgcagaauuuguuua

SEQ ID NO: 1767375 - RNA, 19 nt, Salmonella enterica enterica serovar Typhi Ty2
caaccugccgaugaaagag

SEQ ID NO: 1767376 - RNA, 22 nt, Salmonella enterica enterica serovar Typhi Ty2
caaccgccagucacccugcccu

SEQ ID NO: 1767377 - RNA, 14 nt, Salmonella enterica enterica serovar Typhi Ty2
caaccgccugcacu

SEQ ID NO: 1767378 - RNA, 18 nt, Salmonella enterica enterica serovar Typhi Ty2
caaccgcgccaaagauaa

SEQ ID NO: 1767379 - RNA, 14 nt, Salmonella enterica enterica serovar Typhi Ty2
caaccgccacaaua

SEQ ID NO: 1767380 - RNA, 23 nt, Salmonella enterica enterica serovar Typhi Ty2
caaccuguaggccggauaagcau

SEQ ID NO: 1767381 - RNA, 15 nt, Salmonella enterica enterica serovar Typhi Ty2
caaccuuugggcaga

SEQ ID NO: 1767382 - RNA, 18 nt, Salmonella enterica enterica serovar Typhi Ty2
caacgaagagaccugugu

SEQ ID NO: 1767383 - RNA, 19 nt, Salmonella enterica enterica serovar Typhi Ty2
caacgcaggcuggagagcg

SEQ ID NO: 1767384 - RNA, 14 nt, Salmonella enterica enterica serovar Typhi Ty2
caacgcaucaaaua

SEQ ID NO: 1767385 - RNA, 16 nt, Salmonella enterica enterica serovar Typhi Ty2
caacgcaggcuggaga

SEQ ID NO: 1767386 - RNA, 17 nt, Salmonella enterica enterica serovar Typhi Ty2
caacgccaagcgcggca

SEQ ID NO: 1767387 - RNA, 19 nt, Salmonella enterica enterica serovar Typhi Ty2
caacgccaagcgcggcagc

SEQ ID NO: 1767388 - RNA, 20 nt, Salmonella enterica enterica serovar Typhi Ty2
caacgcagacaacguccugc

SEQ ID NO: 1767389 - RNA, 22 nt, Salmonella enterica enterica serovar Typhi Ty2
caacgcaaugcgauaagcgucu

SEQ ID NO: 1767390 - RNA, 20 nt, Salmonella enterica enterica serovar Typhi Ty2
caacgaccggcgcagcgccc

SEQ ID NO: 1767391 - RNA, 14 nt, Salmonella enterica enterica serovar Typhi Ty2
caacaccugcuggu

SEQ ID NO: 1767392 - RNA, 16 nt, Salmonella enterica enterica serovar Typhi Ty2
caacacgacaaaagca

SEQ ID NO: 1767393 - RNA, 14 nt, Salmonella enterica enterica serovar Typhi Ty2
caacacgcagaccc

SEQ ID NO: 1767394 - RNA, 24 nt, Salmonella enterica enterica serovar Typhi Ty2
caacacgccgaacaacacggcggc

SEQ ID NO: 1767395 - RNA, 16 nt, Salmonella enterica enterica serovar Typhi Ty2
caacagcuugcgccca

SEQ ID NO: 1767396 - RNA, 21 nt, Salmonella enterica enterica serovar Typhi Ty2
caacacuuugcgcugcgcauu

SEQ ID NO: 1767397 - RNA, 15 nt, Salmonella enterica enterica serovar Typhi Ty2
caacacuuugcgcug

SEQ ID NO: 1767398 - RNA, 20 nt, Salmonella enterica enterica serovar Typhi Ty2
caacacuuagaacgcggaag

SEQ ID NO: 1767399 - RNA, 15 nt, Salmonella enterica enterica serovar Typhi Ty2
caacaaugccacgcc

SEQ ID NO: 1767400 - RNA, 23 nt, Salmonella enterica enterica serovar Typhi Ty2
caacaaucccuuaaagccgcccu

SEQ ID NO: 1767401 - RNA, 15 nt, Salmonella enterica enterica serovar Typhi Ty2
caacaaugcuuucac

SEQ ID NO: 1767402 - RNA, 19 nt, Salmonella enterica enterica serovar Typhi Ty2
caacaaucagaagaaauau

SEQ ID NO: 1767403 - RNA, 21 nt, Salmonella enterica enterica serovar Typhi Ty2
caacaaguccuucuucccccu

SEQ ID NO: 1767404 - RNA, 23 nt, Salmonella enterica enterica serovar Typhi Ty2
caacaacuucaaaauagguguug

SEQ ID NO: 1767405 - RNA, 18 nt, Salmonella enterica enterica serovar Typhi Ty2
caaauucuuuucacgcau

SEQ ID NO: 1767406 - RNA, 18 nt, Salmonella enterica enterica serovar Typhi Ty2
caacaacaggccgccgag

SEQ ID NO: 1767407 - RNA, 19 nt, Salmonella enterica enterica serovar Typhi Ty2
caacaaccucuuuuuccgc

SEQ ID NO: 1767408 - RNA, 18 nt, Salmonella enterica enterica serovar Typhi Ty2
caaauuaugauucaaucg

SEQ ID NO: 1767409 - RNA, 14 nt, Salmonella enterica enterica serovar Typhi Ty2
caaaugccauccca

SEQ ID NO: 1767410 - RNA, 21 nt, Salmonella enterica enterica serovar Typhi Ty2
caaaugcagcggaauucccac

SEQ ID NO: 1767411 - RNA, 20 nt, Salmonella enterica enterica serovar Typhi Ty2
caaauagagaaaauaacaau

SEQ ID NO: 1767412 - RNA, 15 nt, Salmonella enterica enterica serovar Typhi Ty2
caaauagagaaaaua

SEQ ID NO: 1767413 - RNA, 16 nt, Salmonella enterica enterica serovar Typhi Ty2
caaauagcggcacaga

SEQ ID NO: 1767414 - RNA, 19 nt, Salmonella enterica enterica serovar Typhi Ty2
caaauagcguguguuuucc

SEQ ID NO: 1767415 - RNA, 21 nt, Salmonella enterica enterica serovar Typhi Ty2
caaauagccguuaccgccgag

SEQ ID NO: 1767416 - RNA, 15 nt, Salmonella enterica enterica serovar Typhi Ty2
caaagcccacgcccu

SEQ ID NO: 1767417 - RNA, 16 nt, Salmonella enterica enterica serovar Typhi Ty2
caaagccaggccgcca

SEQ ID NO: 1767418 - RNA, 23 nt, Salmonella enterica enterica serovar Typhi Ty2
caaagauauaguuuauugaagug

SEQ ID NO: 1767419 - RNA, 20 nt, Salmonella enterica enterica serovar Typhi Ty2
caaagguaauaucacacccg

SEQ ID NO: 1767420 - RNA, 20 nt, Salmonella enterica enterica serovar Typhi Ty2
caaaggggccacaggcggca

SEQ ID NO: 1767421 - RNA, 23 nt, Salmonella enterica enterica serovar Typhi Ty2
caaagggcccguggaaaaacuca

SEQ ID NO: 1767422 - RNA, 22 nt, Salmonella enterica enterica serovar Typhi Ty2
caaacugcgcuagccgccgugu

SEQ ID NO: 1767423 - RNA, 16 nt, Salmonella enterica enterica serovar Typhi Ty2
caaacugcgcgccgcc

SEQ ID NO: 1767424 - RNA, 15 nt, Salmonella enterica enterica serovar Typhi Ty2
caaacuggccacagc

SEQ ID NO: 1767425 - RNA, 21 nt, Salmonella enterica enterica serovar Typhi Ty2
caaacuccucacugcguaaaa

SEQ ID NO: 1767426 - RNA, 23 nt, Salmonella enterica enterica serovar Typhi Ty2
caaacuauguacgccaagcugca

SEQ ID NO: 1767427 - RNA, 15 nt, Salmonella enterica enterica serovar Typhi Ty2
caaacuauuuuuagc

SEQ ID NO: 1767428 - RNA, 14 nt, Salmonella enterica enterica serovar Typhi Ty2
caaacuauuuuuag

SEQ ID NO: 1767429 - RNA, 21 nt, Salmonella enterica enterica serovar Typhi Ty2
caaacuccagcucgcaugcau

SEQ ID NO: 1767430 - RNA, 12 nt, Salmonella enterica enterica serovar Typhi Ty2
caaacuccagcu

SEQ ID NO: 1767431 - RNA, 15 nt, Salmonella enterica enterica serovar Typhi Ty2
caaauacugcuuuuc

SEQ ID NO: 1767432 - RNA, 16 nt, Salmonella enterica enterica serovar Typhi Ty2
caaauacuggaaaaaa

SEQ ID NO: 1767433 - RNA, 21 nt, Salmonella enterica enterica serovar Typhi Ty2
caaauacgcgauaaaaaccca

SEQ ID NO: 1767434 - RNA, 18 nt, Salmonella enterica enterica serovar Typhi Ty2
caaauaccggacagacuu

SEQ ID NO: 1767435 - RNA, 14 nt, Salmonella enterica enterica serovar Typhi Ty2
caaauacauggugc

SEQ ID NO: 1767436 - RNA, 17 nt, Salmonella enterica enterica serovar Typhi Ty2
caaauaaagccagauac

SEQ ID NO: 1767437 - RNA, 22 nt, Salmonella enterica enterica serovar Typhi Ty2
caaauaaagcggucuuucaaca

SEQ ID NO: 1767438 - RNA, 17 nt, Salmonella enterica enterica serovar Typhi Ty2
caaauaaauccaugaga

SEQ ID NO: 1767439 - RNA, 21 nt, Salmonella enterica enterica serovar Typhi Ty2
caaauaaauccaugagaagaa

SEQ ID NO: 1767440 - RNA, 18 nt, Salmonella enterica enterica serovar Typhi Ty2
caaauaaggacuuuaucu

SEQ ID NO: 1767441 - RNA, 18 nt, Salmonella enterica enterica serovar Typhi Ty2
caaaguugguucccagca

SEQ ID NO: 1767442 - RNA, 15 nt, Salmonella enterica enterica serovar Typhi Ty2
caaaguugcaucaag

SEQ ID NO: 1767443 - RNA, 19 nt, Salmonella enterica enterica serovar Typhi Ty2
caaaguuaccggcauuaau

SEQ ID NO: 1767444 - RNA, 23 nt, Salmonella enterica enterica serovar Typhi Ty2
caaagguuuguuuaauuuuguug

SEQ ID NO: 1767445 - RNA, 15 nt, Salmonella enterica enterica serovar Typhi Ty2
caaagguguuauuuc

SEQ ID NO: 1767446 - RNA, 24 nt, Salmonella enterica enterica serovar Typhi Ty2
caaagguguuauuucucuugcaga

SEQ ID NO: 1767447 - RNA, 14 nt, Salmonella enterica enterica serovar Typhi Ty2
caaaguuaaucagc

SEQ ID NO: 1767448 - RNA, 23 nt, Salmonella enterica enterica serovar Typhi Ty2
caaagugguuccaggcgcgcacc

SEQ ID NO: 1767449 - RNA, 18 nt, Salmonella enterica enterica serovar Typhi Ty2
caaagugcgcccuuuuuu

SEQ ID NO: 1767450 - RNA, 17 nt, Salmonella enterica enterica serovar Typhi Ty2
caaaacccagaaucagu

SEQ ID NO: 1767451 - RNA, 18 nt, Salmonella enterica enterica serovar Typhi Ty2
caaaacccaccagcaggg

SEQ ID NO: 1767452 - RNA, 15 nt, Salmonella enterica enterica serovar Typhi Ty2
caaaacccaccagca

SEQ ID NO: 1767453 - RNA, 20 nt, Salmonella enterica enterica serovar Typhi Ty2
caaaacccagaaucaguaac

SEQ ID NO: 1767454 - RNA, 16 nt, Salmonella enterica enterica serovar Typhi Ty2
caaaauaauaaaaauc

SEQ ID NO: 1767455 - RNA, 17 nt, Salmonella enterica enterica serovar Typhi Ty2
caaaauaagucauauca

SEQ ID NO: 1767456 - RNA, 15 nt, Salmonella enterica enterica serovar Typhi Ty2
caaaauauauaauuu

SEQ ID NO: 1767457 - RNA, 18 nt, Salmonella enterica enterica serovar Typhi Ty2
caaaauaaauauccuccg

SEQ ID NO: 1767458 - RNA, 18 nt, Salmonella enterica enterica serovar Typhi Ty2
caaaauauauaauuuaua

SEQ ID NO: 1767459 - RNA, 16 nt, Salmonella enterica enterica serovar Typhi Ty2
caaaauaauacguuua

SEQ ID NO: 1767460 - RNA, 13 nt, Salmonella enterica enterica serovar Typhi Ty2
caaaaucauucgg

SEQ ID NO: 1767461 - RNA, 12 nt, Salmonella enterica enterica serovar Typhi Ty2
caaaaugaggac

SEQ ID NO: 1767462 - RNA, 15 nt, Salmonella enterica enterica serovar Typhi Ty2
caaaaugaggacaca

SEQ ID NO: 1767463 - RNA, 15 nt, Salmonella enterica enterica serovar Typhi Ty2
caaaaucuuuuucgc

SEQ ID NO: 1767464 - RNA, 14 nt, Salmonella enterica enterica serovar Typhi Ty2
caaaaucaucauca

SEQ ID NO: 1767465 - RNA, 17 nt, Salmonella enterica enterica serovar Typhi Ty2
caaaaucaggcaucccg

SEQ ID NO: 1767466 - RNA, 21 nt, Salmonella enterica enterica serovar Typhi Ty2
caaaauuugugguggucaucc

SEQ ID NO: 1767467 - RNA, 14 nt, Salmonella enterica enterica serovar Typhi Ty2
caaaauuuucaaua

SEQ ID NO: 1767468 - RNA, 20 nt, Salmonella enterica enterica serovar Typhi Ty2
caaaauuugugguggucauc

SEQ ID NO: 1767469 - RNA, 17 nt, Salmonella enterica enterica serovar Typhi Ty2
caaacacaaucacaacg

SEQ ID NO: 1767470 - RNA, 20 nt, Salmonella enterica enterica serovar Typhi Ty2
caaacgccauagcaucgacc

SEQ ID NO: 1767471 - RNA, 12 nt, Salmonella enterica enterica serovar Typhi Ty2
caaacgccaccg

SEQ ID NO: 1767472 - RNA, 23 nt, Salmonella enterica enterica serovar Typhi Ty2
caaacgcuaucaccgccgcccgu

SEQ ID NO: 1767473 - RNA, 15 nt, Salmonella enterica enterica serovar Typhi Ty2
caaacgccugcuccg

SEQ ID NO: 1767474 - RNA, 23 nt, Salmonella enterica enterica serovar Typhi Ty2
caaacuaauggcgcagcgguugc

SEQ ID NO: 1767475 - RNA, 18 nt, Salmonella enterica enterica serovar Typhi Ty2
caaaccgaauucguccac

SEQ ID NO: 1767476 - RNA, 22 nt, Salmonella enterica enterica serovar Typhi Ty2
caaaccgauaaucaccagcccg

SEQ ID NO: 1767477 - RNA, 18 nt, Salmonella enterica enterica serovar Typhi Ty2
caaaccgauaaucaccag

SEQ ID NO: 1767478 - RNA, 23 nt, Salmonella enterica enterica serovar Typhi Ty2
caaaccccggacacaugaccuga

SEQ ID NO: 1767479 - RNA, 20 nt, Salmonella enterica enterica serovar Typhi Ty2
caaacccgaccucuucuuug

SEQ ID NO: 1767480 - RNA, 13 nt, Salmonella enterica enterica serovar Typhi Ty2
caaacaccagauc

SEQ ID NO: 1767481 - RNA, 12 nt, Salmonella enterica enterica serovar Typhi Ty2
caaacaccacca

SEQ ID NO: 1767482 - RNA, 14 nt, Salmonella enterica enterica serovar Typhi Ty2
caaacaccaccagu

SEQ ID NO: 1767483 - RNA, 14 nt, Salmonella enterica enterica serovar Typhi Ty2
caaacaccagauca

SEQ ID NO: 1767484 - RNA, 21 nt, Salmonella enterica enterica serovar Typhi Ty2
caaacacuaccgggcagcauc

SEQ ID NO: 1767485 - RNA, 18 nt, Salmonella enterica enterica serovar Typhi Ty2
caaacaccucagccaccc

SEQ ID NO: 1767486 - RNA, 22 nt, Salmonella enterica enterica serovar Typhi Ty2
caaacacuaccgggcagcaucu

SEQ ID NO: 1767487 - RNA, 14 nt, Salmonella enterica enterica serovar Typhi Ty2
caaacaucgcgcuc

SEQ ID NO: 1767488 - RNA, 15 nt, Salmonella enterica enterica serovar Typhi Ty2
caaacagugaaaaaa

SEQ ID NO: 1767489 - RNA, 16 nt, Salmonella enterica enterica serovar Typhi Ty2
caaacagugaaaaaac

SEQ ID NO: 1767490 - RNA, 22 nt, Salmonella enterica enterica serovar Typhi Ty2
caaacaguucauuucaggcaaa

SEQ ID NO: 1767491 - RNA, 13 nt, Salmonella enterica enterica serovar Typhi Ty2
cacggcucgccuu

SEQ ID NO: 1767492 - RNA, 16 nt, Salmonella enterica enterica serovar Typhi Ty2
cacgguaaaacacgcc

SEQ ID NO: 1767493 - RNA, 17 nt, Salmonella enterica enterica serovar Typhi Ty2
cacgguguaccccgccu

SEQ ID NO: 1767494 - RNA, 15 nt, Salmonella enterica enterica serovar Typhi Ty2
cacgguuggcccagc

SEQ ID NO: 1767495 - RNA, 17 nt, Salmonella enterica enterica serovar Typhi Ty2
cacgguuucugcgcgcu

SEQ ID NO: 1767496 - RNA, 15 nt, Salmonella enterica enterica serovar Typhi Ty2
cacggugugccgcca

SEQ ID NO: 1767497 - RNA, 15 nt, Salmonella enterica enterica serovar Typhi Ty2
cacguaguaaugcau

SEQ ID NO: 1767498 - RNA, 14 nt, Salmonella enterica enterica serovar Typhi Ty2
cacgucauccuccu

SEQ ID NO: 1767499 - RNA, 19 nt, Salmonella enterica enterica serovar Typhi Ty2
cacgucacgcaacaggccg

SEQ ID NO: 1767500 - RNA, 19 nt, Salmonella enterica enterica serovar Typhi Ty2
cacgcucgcggaagcgacc

SEQ ID NO: 1767501 - RNA, 15 nt, Salmonella enterica enterica serovar Typhi Ty2
cacgcucgcuggugc

SEQ ID NO: 1767502 - RNA, 14 nt, Salmonella enterica enterica serovar Typhi Ty2
cacgcucgcggaag

SEQ ID NO: 1767503 - RNA, 18 nt, Salmonella enterica enterica serovar Typhi Ty2
cacgcucgaguucuucac

SEQ ID NO: 1767504 - RNA, 18 nt, Salmonella enterica enterica serovar Typhi Ty2
cacgccggaaagaauaau

SEQ ID NO: 1767505 - RNA, 20 nt, Salmonella enterica enterica serovar Typhi Ty2
cacgcugaccacgccgccgc

SEQ ID NO: 1767506 - RNA, 18 nt, Salmonella enterica enterica serovar Typhi Ty2
cacgcugaccacgccgcc

SEQ ID NO: 1767507 - RNA, 17 nt, Salmonella enterica enterica serovar Typhi Ty2
cacgcugaggcgccguc

SEQ ID NO: 1767508 - RNA, 18 nt, Salmonella enterica enterica serovar Typhi Ty2
cacgcugaugcugugcag

SEQ ID NO: 1767509 - RNA, 14 nt, Salmonella enterica enterica serovar Typhi Ty2
cacgcugccgccgc

SEQ ID NO: 1767510 - RNA, 15 nt, Salmonella enterica enterica serovar Typhi Ty2
cacggacagcgcgca

SEQ ID NO: 1767511 - RNA, 20 nt, Salmonella enterica enterica serovar Typhi Ty2
cacggaauccccggcuucca

SEQ ID NO: 1767512 - RNA, 23 nt, Salmonella enterica enterica serovar Typhi Ty2
cacggaauccccggcuuccagcg

SEQ ID NO: 1767513 - RNA, 19 nt, Salmonella enterica enterica serovar Typhi Ty2
cacggaacaacggcacaca

SEQ ID NO: 1767514 - RNA, 16 nt, Salmonella enterica enterica serovar Typhi Ty2
cacggcaguacacgca

SEQ ID NO: 1767515 - RNA, 17 nt, Salmonella enterica enterica serovar Typhi Ty2
cacggcauaagccucau

SEQ ID NO: 1767516 - RNA, 13 nt, Salmonella enterica enterica serovar Typhi Ty2
cacggcauucagu

SEQ ID NO: 1767517 - RNA, 13 nt, Salmonella enterica enterica serovar Typhi Ty2
cacggccaccaua

SEQ ID NO: 1767518 - RNA, 14 nt, Salmonella enterica enterica serovar Typhi Ty2
cacggccagcagcc

SEQ ID NO: 1767519 - RNA, 19 nt, Salmonella enterica enterica serovar Typhi Ty2
cacggcguacuccacuguc

SEQ ID NO: 1767520 - RNA, 13 nt, Salmonella enterica enterica serovar Typhi Ty2
cacgagugauccc

SEQ ID NO: 1767521 - RNA, 21 nt, Salmonella enterica enterica serovar Typhi Ty2
cacgauaaccagaucggcuau

SEQ ID NO: 1767522 - RNA, 13 nt, Salmonella enterica enterica serovar Typhi Ty2
cacgacgccgccg

SEQ ID NO: 1767523 - RNA, 22 nt, Salmonella enterica enterica serovar Typhi Ty2
aaaauacugcuagaacauuucc

SEQ ID NO: 1767524 - RNA, 17 nt, Salmonella enterica enterica serovar Typhi Ty2
aaaauacuuccauuccc

SEQ ID NO: 1767525 - RNA, 15 nt, Salmonella enterica enterica serovar Typhi Ty2
cacgaagcuccagua

SEQ ID NO: 1767526 - RNA, 23 nt, Salmonella enterica enterica serovar Typhi Ty2
caccugcccuuucagagcgucuu

SEQ ID NO: 1767527 - RNA, 22 nt, Salmonella enterica enterica serovar Typhi Ty2
caccuucggucccaucgcgcca

SEQ ID NO: 1767528 - RNA, 21 nt, Salmonella enterica enterica serovar Typhi Ty2
caccuuugaaaaucacaucgc

SEQ ID NO: 1767529 - RNA, 22 nt, Salmonella enterica enterica serovar Typhi Ty2
caccuuugaacgucgcugauag

SEQ ID NO: 1767530 - RNA, 14 nt, Salmonella enterica enterica serovar Typhi Ty2
cacgccgcuccaca

SEQ ID NO: 1767531 - RNA, 21 nt, Salmonella enterica enterica serovar Typhi Ty2
cacgccgcuaucgaccagcac

SEQ ID NO: 1767532 - RNA, 16 nt, Salmonella enterica enterica serovar Typhi Ty2
cacgccgccgccgacc

SEQ ID NO: 1767533 - RNA, 18 nt, Salmonella enterica enterica serovar Typhi Ty2
cacgccgcccgccugagc

SEQ ID NO: 1767534 - RNA, 22 nt, Salmonella enterica enterica serovar Typhi Ty2
cacgccccccgguagccacacc

SEQ ID NO: 1767535 - RNA, 13 nt, Salmonella enterica enterica serovar Typhi Ty2
cacgcccgcagca

SEQ ID NO: 1767536 - RNA, 17 nt, Salmonella enterica enterica serovar Typhi Ty2
cacgcccauauccagcu

SEQ ID NO: 1767537 - RNA, 20 nt, Salmonella enterica enterica serovar Typhi Ty2
cacgccaucgacaaaggcaa

SEQ ID NO: 1767538 - RNA, 20 nt, Salmonella enterica enterica serovar Typhi Ty2
cacgccagggagggccaacc

SEQ ID NO: 1767539 - RNA, 18 nt, Salmonella enterica enterica serovar Typhi Ty2
cacgccagauaaaucagc

SEQ ID NO: 1767540 - RNA, 23 nt, Salmonella enterica enterica serovar Typhi Ty2
cacgcacacgucugagcaggcgg

SEQ ID NO: 1767541 - RNA, 16 nt, Salmonella enterica enterica serovar Typhi Ty2
cacgcaaugcguccgu

SEQ ID NO: 1767542 - RNA, 17 nt, Salmonella enterica enterica serovar Typhi Ty2
cacgauacgccccugcu

SEQ ID NO: 1767543 - RNA, 19 nt, Salmonella enterica enterica serovar Typhi Ty2
cacgcagggggucgcgggu

SEQ ID NO: 1767544 - RNA, 17 nt, Salmonella enterica enterica serovar Typhi Ty2
cacgccaaaaagugaau

SEQ ID NO: 1767545 - RNA, 13 nt, Salmonella enterica enterica serovar Typhi Ty2
cacgcagccaugu

SEQ ID NO: 1767546 - RNA, 15 nt, Salmonella enterica enterica serovar Typhi Ty2
cacgcagacccaggc

SEQ ID NO: 1767547 - RNA, 15 nt, Salmonella enterica enterica serovar Typhi Ty2
caccguaaacggcuc

SEQ ID NO: 1767548 - RNA, 21 nt, Salmonella enterica enterica serovar Typhi Ty2
caccgguuuuuccgcuucacc

SEQ ID NO: 1767549 - RNA, 20 nt, Salmonella enterica enterica serovar Typhi Ty2
caccggguccagucgcgccg

SEQ ID NO: 1767550 - RNA, 22 nt, Salmonella enterica enterica serovar Typhi Ty2
caccgguacacacgcgcugacc

SEQ ID NO: 1767551 - RNA, 14 nt, Salmonella enterica enterica serovar Typhi Ty2
caccggcgcgccag

SEQ ID NO: 1767552 - RNA, 16 nt, Salmonella enterica enterica serovar Typhi Ty2
caccgcgcgcgcggca

SEQ ID NO: 1767553 - RNA, 13 nt, Salmonella enterica enterica serovar Typhi Ty2
caccggacauccc

SEQ ID NO: 1767554 - RNA, 14 nt, Salmonella enterica enterica serovar Typhi Ty2
caccggaugcgcag

SEQ ID NO: 1767555 - RNA, 15 nt, Salmonella enterica enterica serovar Typhi Ty2
caccggaguuaccau

SEQ ID NO: 1767556 - RNA, 23 nt, Salmonella enterica enterica serovar Typhi Ty2
aaaauaagagggcgccaugcuga

SEQ ID NO: 1767557 - RNA, 23 nt, Salmonella enterica enterica serovar Typhi Ty2
aaaauaauagguacggggcaucu

SEQ ID NO: 1767558 - RNA, 17 nt, Salmonella enterica enterica serovar Typhi Ty2
aaaauaauaaucguuuu

SEQ ID NO: 1767559 - RNA, 15 nt, Salmonella enterica enterica serovar Typhi Ty2
caccggcccccggcc

SEQ ID NO: 1767560 - RNA, 22 nt, Salmonella enterica enterica serovar Typhi Ty2
caccugcaaacguagcgcguca

SEQ ID NO: 1767561 - RNA, 16 nt, Salmonella enterica enterica serovar Typhi Ty2
caccugcaacuccugg

SEQ ID NO: 1767562 - RNA, 13 nt, Salmonella enterica enterica serovar Typhi Ty2
caccugauucugc

SEQ ID NO: 1767563 - RNA, 18 nt, Salmonella enterica enterica serovar Typhi Ty2
caccugaugguuauuuuc

SEQ ID NO: 1767564 - RNA, 16 nt, Salmonella enterica enterica serovar Typhi Ty2
caccucuuuaugcggc

SEQ ID NO: 1767565 - RNA, 23 nt, Salmonella enterica enterica serovar Typhi Ty2
caccucuuuaugcggcgcuucca

SEQ ID NO: 1767566 - RNA, 17 nt, Salmonella enterica enterica serovar Typhi Ty2
caccucguucaaacaga

SEQ ID NO: 1767567 - RNA, 16 nt, Salmonella enterica enterica serovar Typhi Ty2
caccucuuccgccagg

SEQ ID NO: 1767568 - RNA, 19 nt, Salmonella enterica enterica serovar Typhi Ty2
caccguaggccugauaaga

SEQ ID NO: 1767569 - RNA, 13 nt, Salmonella enterica enterica serovar Typhi Ty2
caccucgcaauau

SEQ ID NO: 1767570 - RNA, 13 nt, Salmonella enterica enterica serovar Typhi Ty2
caccgacacaaau

SEQ ID NO: 1767571 - RNA, 14 nt, Salmonella enterica enterica serovar Typhi Ty2
caccgauccgaaga

SEQ ID NO: 1767572 - RNA, 22 nt, Salmonella enterica enterica serovar Typhi Ty2
caccgcaaauucgucgccgcca

SEQ ID NO: 1767573 - RNA, 15 nt, Salmonella enterica enterica serovar Typhi Ty2
caccgccacuuccgc

SEQ ID NO: 1767574 - RNA, 18 nt, Salmonella enterica enterica serovar Typhi Ty2
caccgccaccugcccuuu

SEQ ID NO: 1767575 - RNA, 15 nt, Salmonella enterica enterica serovar Typhi Ty2
caccgccagagcacg

SEQ ID NO: 1767576 - RNA, 16 nt, Salmonella enterica enterica serovar Typhi Ty2
caccgccagcgucugu

SEQ ID NO: 1767577 - RNA, 16 nt, Salmonella enterica enterica serovar Typhi Ty2
caccgccagcgccgcg

SEQ ID NO: 1767578 - RNA, 15 nt, Salmonella enterica enterica serovar Typhi Ty2
caccgcccagagaau

SEQ ID NO: 1767579 - RNA, 15 nt, Salmonella enterica enterica serovar Typhi Ty2
caccgccauauauuu

SEQ ID NO: 1767580 - RNA, 18 nt, Salmonella enterica enterica serovar Typhi Ty2
caccgccagucccagcac

SEQ ID NO: 1767581 - RNA, 16 nt, Salmonella enterica enterica serovar Typhi Ty2
caccgcccgccgggcg

SEQ ID NO: 1767582 - RNA, 12 nt, Salmonella enterica enterica serovar Typhi Ty2
caccgccgcgcu

SEQ ID NO: 1767583 - RNA, 17 nt, Salmonella enterica enterica serovar Typhi Ty2
caccgccgcgauagacc

SEQ ID NO: 1767584 - RNA, 14 nt, Salmonella enterica enterica serovar Typhi Ty2
caccgcgaugcugc

SEQ ID NO: 1767585 - RNA, 20 nt, Salmonella enterica enterica serovar Typhi Ty2
caccgcgaugaccaucaaau

SEQ ID NO: 1767586 - RNA, 22 nt, Salmonella enterica enterica serovar Typhi Ty2
caccgcgaugcugcucuccacg

SEQ ID NO: 1767587 - RNA, 13 nt, Salmonella enterica enterica serovar Typhi Ty2
caccgcgaugacc

SEQ ID NO: 1767588 - RNA, 20 nt, Salmonella enterica enterica serovar Typhi Ty2
cacccaauauagaguccuga

SEQ ID NO: 1767589 - RNA, 20 nt, Salmonella enterica enterica serovar Typhi Ty2
cacccgauacacgccgacgc

SEQ ID NO: 1767590 - RNA, 13 nt, Salmonella enterica enterica serovar Typhi Ty2
caccauucccagc

SEQ ID NO: 1767591 - RNA, 15 nt, Salmonella enterica enterica serovar Typhi Ty2
cacccaauaaauaau

SEQ ID NO: 1767592 - RNA, 14 nt, Salmonella enterica enterica serovar Typhi Ty2
cacccggagagaaa

SEQ ID NO: 1767593 - RNA, 17 nt, Salmonella enterica enterica serovar Typhi Ty2
cacccgcucgcugcauu

SEQ ID NO: 1767594 - RNA, 20 nt, Salmonella enterica enterica serovar Typhi Ty2
cacccuauuuugcgccuggg

SEQ ID NO: 1767595 - RNA, 15 nt, Salmonella enterica enterica serovar Typhi Ty2
cacccuauccgccag

SEQ ID NO: 1767596 - RNA, 19 nt, Salmonella enterica enterica serovar Typhi Ty2
cacccuauuuugcgccugg

SEQ ID NO: 1767597 - RNA, 20 nt, Salmonella enterica enterica serovar Typhi Ty2
caccagaaucgccagcaucg

SEQ ID NO: 1767598 - RNA, 19 nt, Salmonella enterica enterica serovar Typhi Ty2
caccagaaucgccagcauc

SEQ ID NO: 1767599 - RNA, 17 nt, Salmonella enterica enterica serovar Typhi Ty2
caccagaaucgccagca

SEQ ID NO: 1767600 - RNA, 12 nt, Salmonella enterica enterica serovar Typhi Ty2
caccagacgcug

SEQ ID NO: 1767601 - RNA, 21 nt, Salmonella enterica enterica serovar Typhi Ty2
caccagacgcuggcacuggca

SEQ ID NO: 1767602 - RNA, 14 nt, Salmonella enterica enterica serovar Typhi Ty2
caccagccguucac

SEQ ID NO: 1767603 - RNA, 15 nt, Salmonella enterica enterica serovar Typhi Ty2
caccagcuuaucuga

SEQ ID NO: 1767604 - RNA, 20 nt, Salmonella enterica enterica serovar Typhi Ty2
caccaggaagacuauccagc

SEQ ID NO: 1767605 - RNA, 23 nt, Salmonella enterica enterica serovar Typhi Ty2
caccaggauacguucauccuccu

SEQ ID NO: 1767606 - RNA, 17 nt, Salmonella enterica enterica serovar Typhi Ty2
caccagggauuuugcuu

SEQ ID NO: 1767607 - RNA, 13 nt, Salmonella enterica enterica serovar Typhi Ty2
aaaauaaaaaagg

SEQ ID NO: 1767608 - RNA, 11 nt, Salmonella enterica enterica serovar Typhi Ty2
aaaauaaaaaa

SEQ ID NO: 1767609 - RNA, 22 nt, Salmonella enterica enterica serovar Typhi Ty2
caccauaauuaccggcacaccg

SEQ ID NO: 1767610 - RNA, 18 nt, Salmonella enterica enterica serovar Typhi Ty2
caccauaccuauaaaaau

SEQ ID NO: 1767611 - RNA, 20 nt, Salmonella enterica enterica serovar Typhi Ty2
caccauaaagcgaauaauua

SEQ ID NO: 1767612 - RNA, 15 nt, Salmonella enterica enterica serovar Typhi Ty2
caccauaaaaccauu

SEQ ID NO: 1767613 - RNA, 14 nt, Salmonella enterica enterica serovar Typhi Ty2
caccauaucuuuca

SEQ ID NO: 1767614 - RNA, 22 nt, Salmonella enterica enterica serovar Typhi Ty2
caccauauagacauacaggaau

SEQ ID NO: 1767615 - RNA, 15 nt, Salmonella enterica enterica serovar Typhi Ty2
caccaguucacuccu

SEQ ID NO: 1767616 - RNA, 21 nt, Salmonella enterica enterica serovar Typhi Ty2
caccaguucacuccuaagaga

SEQ ID NO: 1767617 - RNA, 13 nt, Salmonella enterica enterica serovar Typhi Ty2
caccaucacuucc

SEQ ID NO: 1767618 - RNA, 23 nt, Salmonella enterica enterica serovar Typhi Ty2
caccauccggcgcugcgcggcgu

SEQ ID NO: 1767619 - RNA, 16 nt, Salmonella enterica enterica serovar Typhi Ty2
caccaucguugccagc

SEQ ID NO: 1767620 - RNA, 19 nt, Salmonella enterica enterica serovar Typhi Ty2
caccaucgucgccagaccc

SEQ ID NO: 1767621 - RNA, 15 nt, Salmonella enterica enterica serovar Typhi Ty2
caccaucuuuuugcu

SEQ ID NO: 1767622 - RNA, 16 nt, Salmonella enterica enterica serovar Typhi Ty2
caccaucuuuuccggc

SEQ ID NO: 1767623 - RNA, 13 nt, Salmonella enterica enterica serovar Typhi Ty2
caccaucuuuuug

SEQ ID NO: 1767624 - RNA, 18 nt, Salmonella enterica enterica serovar Typhi Ty2
caccauguugaccagguc

SEQ ID NO: 1767625 - RNA, 18 nt, Salmonella enterica enterica serovar Typhi Ty2
caccacguaaugcgcccc

SEQ ID NO: 1767626 - RNA, 19 nt, Salmonella enterica enterica serovar Typhi Ty2
caccacguaaugcgccccg

SEQ ID NO: 1767627 - RNA, 22 nt, Salmonella enterica enterica serovar Typhi Ty2
caccacguaacucggcagcgcg

SEQ ID NO: 1767628 - RNA, 22 nt, Salmonella enterica enterica serovar Typhi Ty2
caccacgguguaccccgccuga

SEQ ID NO: 1767629 - RNA, 19 nt, Salmonella enterica enterica serovar Typhi Ty2
caccacgguguaccccgcc

SEQ ID NO: 1767630 - RNA, 12 nt, Salmonella enterica enterica serovar Typhi Ty2
caccaccgccgc

SEQ ID NO: 1767631 - RNA, 16 nt, Salmonella enterica enterica serovar Typhi Ty2
caccaccgccacuucc

SEQ ID NO: 1767632 - RNA, 16 nt, Salmonella enterica enterica serovar Typhi Ty2
caccaccgcaggcagc

SEQ ID NO: 1767633 - RNA, 13 nt, Salmonella enterica enterica serovar Typhi Ty2
caccaccgccacu

SEQ ID NO: 1767634 - RNA, 22 nt, Salmonella enterica enterica serovar Typhi Ty2
caccaauacgugagcgaaguuc

SEQ ID NO: 1767635 - RNA, 14 nt, Salmonella enterica enterica serovar Typhi Ty2
cacauugcgcgccg

SEQ ID NO: 1767636 - RNA, 14 nt, Salmonella enterica enterica serovar Typhi Ty2
cacauuggccccug

SEQ ID NO: 1767637 - RNA, 16 nt, Salmonella enterica enterica serovar Typhi Ty2
cacauuguaugcaaga

SEQ ID NO: 1767638 - RNA, 13 nt, Salmonella enterica enterica serovar Typhi Ty2
caccaacugcuga

SEQ ID NO: 1767639 - RNA, 16 nt, Salmonella enterica enterica serovar Typhi Ty2
caccaaguagacagag

SEQ ID NO: 1767640 - RNA, 20 nt, Salmonella enterica enterica serovar Typhi Ty2
cacaugcaaaaaagcccauc

SEQ ID NO: 1767641 - RNA, 23 nt, Salmonella enterica enterica serovar Typhi Ty2
cacaucuguuugagaaaaacauc

SEQ ID NO: 1767642 - RNA, 15 nt, Salmonella enterica enterica serovar Typhi Ty2
cacaugaccugaaua

SEQ ID NO: 1767643 - RNA, 14 nt, Salmonella enterica enterica serovar Typhi Ty2
cacaugagaagggc

SEQ ID NO: 1767644 - RNA, 17 nt, Salmonella enterica enterica serovar Typhi Ty2
cacauaagcacaccauu

SEQ ID NO: 1767645 - RNA, 18 nt, Salmonella enterica enterica serovar Typhi Ty2
cacauaacaaaaccagca

SEQ ID NO: 1767646 - RNA, 15 nt, Salmonella enterica enterica serovar Typhi Ty2
cacauaacaaaacca

SEQ ID NO: 1767647 - RNA, 16 nt, Salmonella enterica enterica serovar Typhi Ty2
cacaucgugcgccauu

SEQ ID NO: 1767648 - RNA, 15 nt, Salmonella enterica enterica serovar Typhi Ty2
cacaguuuuuccccg

SEQ ID NO: 1767649 - RNA, 23 nt, Salmonella enterica enterica serovar Typhi Ty2
caauuauguauuucucgccgccg

SEQ ID NO: 1767650 - RNA, 22 nt, Salmonella enterica enterica serovar Typhi Ty2
caauuauauugcguaaaaaccc

SEQ ID NO: 1767651 - RNA, 14 nt, Salmonella enterica enterica serovar Typhi Ty2
caauucaaucacuu

SEQ ID NO: 1767652 - RNA, 12 nt, Salmonella enterica enterica serovar Typhi Ty2
caauuaacauuu

SEQ ID NO: 1767653 - RNA, 14 nt, Salmonella enterica enterica serovar Typhi Ty2
caauuaacaaauaa

SEQ ID NO: 1767654 - RNA, 20 nt, Salmonella enterica enterica serovar Typhi Ty2
caauguucugggaauaggcc

SEQ ID NO: 1767655 - RNA, 21 nt, Salmonella enterica enterica serovar Typhi Ty2
caauguugaaucccacgccgc

SEQ ID NO: 1767656 - RNA, 23 nt, Salmonella enterica enterica serovar Typhi Ty2
caauguugaaucccacgccgcug

SEQ ID NO: 1767657 - RNA, 18 nt, Salmonella enterica enterica serovar Typhi Ty2
caauguucauacaccgca

SEQ ID NO: 1767658 - RNA, 13 nt, Salmonella enterica enterica serovar Typhi Ty2
caauuuucuucau

SEQ ID NO: 1767659 - RNA, 15 nt, Salmonella enterica enterica serovar Typhi Ty2
caauuuucaguuuua

SEQ ID NO: 1767660 - RNA, 22 nt, Salmonella enterica enterica serovar Typhi Ty2
caauuuugcucucgguguggcu

SEQ ID NO: 1767661 - RNA, 21 nt, Salmonella enterica enterica serovar Typhi Ty2
caauuuuuacaaauuuaaaca

SEQ ID NO: 1767662 - RNA, 23 nt, Salmonella enterica enterica serovar Typhi Ty2
caauuugugagauaaaaaagcug

SEQ ID NO: 1767663 - RNA, 16 nt, Salmonella enterica enterica serovar Typhi Ty2
caauuuaccuauuucg

SEQ ID NO: 1767664 - RNA, 15 nt, Salmonella enterica enterica serovar Typhi Ty2
cacaaacuggaccca

SEQ ID NO: 1767665 - RNA, 16 nt, Salmonella enterica enterica serovar Typhi Ty2
cacaaacuggacccac

SEQ ID NO: 1767666 - RNA, 14 nt, Salmonella enterica enterica serovar Typhi Ty2
cacaaagaauucuu

SEQ ID NO: 1767667 - RNA, 17 nt, Salmonella enterica enterica serovar Typhi Ty2
cacaaagacgaauaagg

SEQ ID NO: 1767668 - RNA, 16 nt, Salmonella enterica enterica serovar Typhi Ty2
cacaaaauggcugaua

SEQ ID NO: 1767669 - RNA, 21 nt, Salmonella enterica enterica serovar Typhi Ty2
cacaaacaauuuacgcagccc

SEQ ID NO: 1767670 - RNA, 13 nt, Salmonella enterica enterica serovar Typhi Ty2
cacaaaacaggau

SEQ ID NO: 1767671 - RNA, 16 nt, Salmonella enterica enterica serovar Typhi Ty2
cacaaaacccgcagcc

SEQ ID NO: 1767672 - RNA, 20 nt, Salmonella enterica enterica serovar Typhi Ty2
cacaaaaggauacagcgccg

SEQ ID NO: 1767673 - RNA, 20 nt, Salmonella enterica enterica serovar Typhi Ty2
cacaaaaacacccgcagccg

SEQ ID NO: 1767674 - RNA, 13 nt, Salmonella enterica enterica serovar Typhi Ty2
cacaggcuuauac

SEQ ID NO: 1767675 - RNA, 12 nt, Salmonella enterica enterica serovar Typhi Ty2
cacaggcggcca

SEQ ID NO: 1767676 - RNA, 19 nt, Salmonella enterica enterica serovar Typhi Ty2
cacaggcggcgguucaacc

SEQ ID NO: 1767677 - RNA, 16 nt, Salmonella enterica enterica serovar Typhi Ty2
cacaggccuucaugau

SEQ ID NO: 1767678 - RNA, 14 nt, Salmonella enterica enterica serovar Typhi Ty2
cacagguacaggcc

SEQ ID NO: 1767679 - RNA, 23 nt, Salmonella enterica enterica serovar Typhi Ty2
cacaggcuucgacaaacagcuau

SEQ ID NO: 1767680 - RNA, 18 nt, Salmonella enterica enterica serovar Typhi Ty2
cacagggacuauaggcaa

SEQ ID NO: 1767681 - RNA, 16 nt, Salmonella enterica enterica serovar Typhi Ty2
cacagucaucgcgcca

SEQ ID NO: 1767682 - RNA, 15 nt, Salmonella enterica enterica serovar Typhi Ty2
cacaguacgcccggc

SEQ ID NO: 1767683 - RNA, 19 nt, Salmonella enterica enterica serovar Typhi Ty2
cacaguaauggacagguaa

SEQ ID NO: 1767684 - RNA, 19 nt, Salmonella enterica enterica serovar Typhi Ty2
cacaguacaccugcagguu

SEQ ID NO: 1767685 - RNA, 19 nt, Salmonella enterica enterica serovar Typhi Ty2
cacaguaaccccauacagu

SEQ ID NO: 1767686 - RNA, 19 nt, Salmonella enterica enterica serovar Typhi Ty2
cacagcgcuuuaguacgcg

SEQ ID NO: 1767687 - RNA, 14 nt, Salmonella enterica enterica serovar Typhi Ty2
cacagcgcgcgaca

SEQ ID NO: 1767688 - RNA, 16 nt, Salmonella enterica enterica serovar Typhi Ty2
cacagcgccagacacu

SEQ ID NO: 1767689 - RNA, 19 nt, Salmonella enterica enterica serovar Typhi Ty2
cacagccuuauaagaacca

SEQ ID NO: 1767690 - RNA, 19 nt, Salmonella enterica enterica serovar Typhi Ty2
cacagacccaguacaaaca

SEQ ID NO: 1767691 - RNA, 19 nt, Salmonella enterica enterica serovar Typhi Ty2
cacacaaucgguuaugcga

SEQ ID NO: 1767692 - RNA, 18 nt, Salmonella enterica enterica serovar Typhi Ty2
cacaccacaugcgagcag

SEQ ID NO: 1767693 - RNA, 19 nt, Salmonella enterica enterica serovar Typhi Ty2
cacaccaaugucauauuug

SEQ ID NO: 1767694 - RNA, 20 nt, Salmonella enterica enterica serovar Typhi Ty2
cacaauugccagcagguauc

SEQ ID NO: 1767695 - RNA, 17 nt, Salmonella enterica enterica serovar Typhi Ty2
cacaaauuuugauaaaa

SEQ ID NO: 1767696 - RNA, 20 nt, Salmonella enterica enterica serovar Typhi Ty2
cacaaauuuugauaaaaaca

SEQ ID NO: 1767697 - RNA, 17 nt, Salmonella enterica enterica serovar Typhi Ty2
cacaacagaagcggccu

SEQ ID NO: 1767698 - RNA, 21 nt, Salmonella enterica enterica serovar Typhi Ty2
cacaccggguucguaauaagg

SEQ ID NO: 1767699 - RNA, 18 nt, Salmonella enterica enterica serovar Typhi Ty2
cacaccauuucacaaauu

SEQ ID NO: 1767700 - RNA, 15 nt, Salmonella enterica enterica serovar Typhi Ty2
cacaccauuucacaa

SEQ ID NO: 1767701 - RNA, 17 nt, Salmonella enterica enterica serovar Typhi Ty2
cacacccgcacgccugg

SEQ ID NO: 1767702 - RNA, 14 nt, Salmonella enterica enterica serovar Typhi Ty2
cacacccauagcag

SEQ ID NO: 1767703 - RNA, 14 nt, Salmonella enterica enterica serovar Typhi Ty2
cacacugcaucgaa

SEQ ID NO: 1767704 - RNA, 21 nt, Salmonella enterica enterica serovar Typhi Ty2
auuucgccccacuggcccccu

SEQ ID NO: 1767705 - RNA, 17 nt, Salmonella enterica enterica serovar Typhi Ty2
auuucgccccacuggcc

SEQ ID NO: 1767706 - RNA, 18 nt, Salmonella enterica enterica serovar Typhi Ty2
auuucgcaacgccgccga

SEQ ID NO: 1767707 - RNA, 20 nt, Salmonella enterica enterica serovar Typhi Ty2
auuucgacgucaacgguaaa

SEQ ID NO: 1767708 - RNA, 22 nt, Salmonella enterica enterica serovar Typhi Ty2
auuucgacgucaacgguaaaau

SEQ ID NO: 1767709 - RNA, 21 nt, Salmonella enterica enterica serovar Typhi Ty2
auuucgacgauaaaaaaagua

SEQ ID NO: 1767710 - RNA, 20 nt, Salmonella enterica enterica serovar Typhi Ty2
auuucgaaacaggaaaaaca

SEQ ID NO: 1767711 - RNA, 17 nt, Salmonella enterica enterica serovar Typhi Ty2
auuuccagugccaguua

SEQ ID NO: 1767712 - RNA, 21 nt, Salmonella enterica enterica serovar Typhi Ty2
auuuccagugccaguuaagca

SEQ ID NO: 1767713 - RNA, 23 nt, Salmonella enterica enterica serovar Typhi Ty2
auuucaugcggugcaugaauauc

SEQ ID NO: 1767714 - RNA, 18 nt, Salmonella enterica enterica serovar Typhi Ty2
auuucagaccgugcuuuu

SEQ ID NO: 1767715 - RNA, 15 nt, Salmonella enterica enterica serovar Typhi Ty2
auuucagaccgugcu

SEQ ID NO: 1767716 - RNA, 22 nt, Salmonella enterica enterica serovar Typhi Ty2
auuucaauaauauguuccacaa

SEQ ID NO: 1767717 - RNA, 15 nt, Salmonella enterica enterica serovar Typhi Ty2
auuucaacccggcau

SEQ ID NO: 1767718 - RNA, 14 nt, Salmonella enterica enterica serovar Typhi Ty2
auuuaggauuuguc

SEQ ID NO: 1767719 - RNA, 16 nt, Salmonella enterica enterica serovar Typhi Ty2
auuugcgugucaucaa

SEQ ID NO: 1767720 - RNA, 15 nt, Salmonella enterica enterica serovar Typhi Ty2
auuugcgugucauca

SEQ ID NO: 1767721 - RNA, 17 nt, Salmonella enterica enterica serovar Typhi Ty2
auuugcggcgucgccug

SEQ ID NO: 1767722 - RNA, 13 nt, Salmonella enterica enterica serovar Typhi Ty2
auuugcgcaguuu

SEQ ID NO: 1767723 - RNA, 16 nt, Salmonella enterica enterica serovar Typhi Ty2
auuugcgcuuuuaauu

SEQ ID NO: 1767724 - RNA, 22 nt, Salmonella enterica enterica serovar Typhi Ty2
auuugcgacaucagccagccgc

SEQ ID NO: 1767725 - RNA, 18 nt, Salmonella enterica enterica serovar Typhi Ty2
auuugcccuuccagcagc

SEQ ID NO: 1767726 - RNA, 17 nt, Salmonella enterica enterica serovar Typhi Ty2
auuugauuuauuuugaa

SEQ ID NO: 1767727 - RNA, 15 nt, Salmonella enterica enterica serovar Typhi Ty2
auuugcaucaaacuu

SEQ ID NO: 1767728 - RNA, 14 nt, Salmonella enterica enterica serovar Typhi Ty2
auuugacguuaucc

SEQ ID NO: 1767729 - RNA, 17 nt, Salmonella enterica enterica serovar Typhi Ty2
auuucuccgcccaucca

SEQ ID NO: 1767730 - RNA, 18 nt, Salmonella enterica enterica serovar Typhi Ty2
auuucuccugcgccagcc

SEQ ID NO: 1767731 - RNA, 20 nt, Salmonella enterica enterica serovar Typhi Ty2
auuucuccugcgccagccgg

SEQ ID NO: 1767732 - RNA, 23 nt, Salmonella enterica enterica serovar Typhi Ty2
auuugguuagggaucaucuucac

SEQ ID NO: 1767733 - RNA, 13 nt, Salmonella enterica enterica serovar Typhi Ty2
auuugcugcaacg

SEQ ID NO: 1767734 - RNA, 15 nt, Salmonella enterica enterica serovar Typhi Ty2
auuugcugcauuucu

SEQ ID NO: 1767735 - RNA, 22 nt, Salmonella enterica enterica serovar Typhi Ty2
auuugcugcauuucuuguugac

SEQ ID NO: 1767736 - RNA, 21 nt, Salmonella enterica enterica serovar Typhi Ty2
auuugcuguuuuuuguugauu

SEQ ID NO: 1767737 - RNA, 22 nt, Salmonella enterica enterica serovar Typhi Ty2
auuuggcguaaucgauaagcuc

SEQ ID NO: 1767738 - RNA, 15 nt, Salmonella enterica enterica serovar Typhi Ty2
auuuguuaucuacag

SEQ ID NO: 1767739 - RNA, 15 nt, Salmonella enterica enterica serovar Typhi Ty2
auuuguugacugucu

SEQ ID NO: 1767740 - RNA, 13 nt, Salmonella enterica enterica serovar Typhi Ty2
auuuguuaucuac

SEQ ID NO: 1767741 - RNA, 13 nt, Salmonella enterica enterica serovar Typhi Ty2
auuugugauaaag

SEQ ID NO: 1767742 - RNA, 19 nt, Salmonella enterica enterica serovar Typhi Ty2
auuugugauugcagauaau

SEQ ID NO: 1767743 - RNA, 19 nt, Salmonella enterica enterica serovar Typhi Ty2
auuugucgucaugcgccag

SEQ ID NO: 1767744 - RNA, 16 nt, Salmonella enterica enterica serovar Typhi Ty2
auuugugagauaaaaa

SEQ ID NO: 1767745 - RNA, 17 nt, Salmonella enterica enterica serovar Typhi Ty2
auuugugagcuauacgg

SEQ ID NO: 1767746 - RNA, 17 nt, Salmonella enterica enterica serovar Typhi Ty2
auuuguagcugcgccug

SEQ ID NO: 1767747 - RNA, 16 nt, Salmonella enterica enterica serovar Typhi Ty2
auuugucagacaugau

SEQ ID NO: 1767748 - RNA, 17 nt, Salmonella enterica enterica serovar Typhi Ty2
auuuuuaugucauuuau

SEQ ID NO: 1767749 - RNA, 12 nt, Salmonella enterica enterica serovar Typhi Ty2
auuuuuucugcu

SEQ ID NO: 1767750 - RNA, 16 nt, Salmonella enterica enterica serovar Typhi Ty2
caaaaaagcaguauau

SEQ ID NO: 1767751 - RNA, 13 nt, Salmonella enterica enterica serovar Typhi Ty2
caaaaaagagaag

SEQ ID NO: 1767752 - RNA, 15 nt, Salmonella enterica enterica serovar Typhi Ty2
auuuuuuugcuggcc

SEQ ID NO: 1767753 - RNA, 15 nt, Salmonella enterica enterica serovar Typhi Ty2
auuuuuuucagccuu

SEQ ID NO: 1767754 - RNA, 23 nt, Salmonella enterica enterica serovar Typhi Ty2
auuuuuuucucgauaucuucccc

SEQ ID NO: 1767755 - RNA, 13 nt, Salmonella enterica enterica serovar Typhi Ty2
auuuuuuuacauu

SEQ ID NO: 1767756 - RNA, 15 nt, Salmonella enterica enterica serovar Typhi Ty2
auuuuuugucuguau

SEQ ID NO: 1767757 - RNA, 16 nt, Salmonella enterica enterica serovar Typhi Ty2
auuuuuugcugggaua

SEQ ID NO: 1767758 - RNA, 15 nt, Salmonella enterica enterica serovar Typhi Ty2
caaaacaacaaagua

SEQ ID NO: 1767759 - RNA, 16 nt, Salmonella enterica enterica serovar Typhi Ty2
caaaacaacaaaguau

SEQ ID NO: 1767760 - RNA, 16 nt, Salmonella enterica enterica serovar Typhi Ty2
caaaaaucgucaucag

SEQ ID NO: 1767761 - RNA, 14 nt, Salmonella enterica enterica serovar Typhi Ty2
caaaaauccuucuu

SEQ ID NO: 1767762 - RNA, 21 nt, Salmonella enterica enterica serovar Typhi Ty2
caaaaauuucgaccucuucgu

SEQ ID NO: 1767763 - RNA, 23 nt, Salmonella enterica enterica serovar Typhi Ty2
caaaaauggcuucggcaauuucc

SEQ ID NO: 1767764 - RNA, 12 nt, Salmonella enterica enterica serovar Typhi Ty2
caaaaauaauuc

SEQ ID NO: 1767765 - RNA, 14 nt, Salmonella enterica enterica serovar Typhi Ty2
caaaaauaaaaacc

SEQ ID NO: 1767766 - RNA, 21 nt, Salmonella enterica enterica serovar Typhi Ty2
caaaaaccccgacauucccag

SEQ ID NO: 1767767 - RNA, 14 nt, Salmonella enterica enterica serovar Typhi Ty2
caaaaaucaccaca

SEQ ID NO: 1767768 - RNA, 12 nt, Salmonella enterica enterica serovar Typhi Ty2
caaaaauaccac

SEQ ID NO: 1767769 - RNA, 15 nt, Salmonella enterica enterica serovar Typhi Ty2
caaaaauagcauuaa

SEQ ID NO: 1767770 - RNA, 20 nt, Salmonella enterica enterica serovar Typhi Ty2
caaaaacauccacauaggcg

SEQ ID NO: 1767771 - RNA, 12 nt, Salmonella enterica enterica serovar Typhi Ty2
caaaaacgccag

SEQ ID NO: 1767772 - RNA, 18 nt, Salmonella enterica enterica serovar Typhi Ty2
caaaaaguaguuccagca

SEQ ID NO: 1767773 - RNA, 13 nt, Salmonella enterica enterica serovar Typhi Ty2
caaaaacgccaga

SEQ ID NO: 1767774 - RNA, 21 nt, Salmonella enterica enterica serovar Typhi Ty2
auuuucagccauuuuuuauug

SEQ ID NO: 1767775 - RNA, 20 nt, Salmonella enterica enterica serovar Typhi Ty2
auuuucucguguagccagua

SEQ ID NO: 1767776 - RNA, 19 nt, Salmonella enterica enterica serovar Typhi Ty2
auuuucucguguagccagu

SEQ ID NO: 1767777 - RNA, 19 nt, Salmonella enterica enterica serovar Typhi Ty2
auuuucuccggaagcauaa

SEQ ID NO: 1767778 - RNA, 22 nt, Salmonella enterica enterica serovar Typhi Ty2
auuuucacgccauugccaggac

SEQ ID NO: 1767779 - RNA, 22 nt, Salmonella enterica enterica serovar Typhi Ty2
auuuucacgcucgaguucuuca

SEQ ID NO: 1767780 - RNA, 21 nt, Salmonella enterica enterica serovar Typhi Ty2
auuuucaccuggaugcugccu

SEQ ID NO: 1767781 - RNA, 17 nt, Salmonella enterica enterica serovar Typhi Ty2
auuuucacuuauaaaua

SEQ ID NO: 1767782 - RNA, 16 nt, Salmonella enterica enterica serovar Typhi Ty2
auuuuaugaugcauuu

SEQ ID NO: 1767783 - RNA, 21 nt, Salmonella enterica enterica serovar Typhi Ty2
auuuuauggaggauauaaaaa

SEQ ID NO: 1767784 - RNA, 18 nt, Salmonella enterica enterica serovar Typhi Ty2
auuuuauuauauuuaaaa

SEQ ID NO: 1767785 - RNA, 14 nt, Salmonella enterica enterica serovar Typhi Ty2
auuuuaaauacacc

SEQ ID NO: 1767786 - RNA, 21 nt, Salmonella enterica enterica serovar Typhi Ty2
auuuuguaguuguuuuaugug

SEQ ID NO: 1767787 - RNA, 17 nt, Salmonella enterica enterica serovar Typhi Ty2
auuuugcgguuuuaauu

SEQ ID NO: 1767788 - RNA, 13 nt, Salmonella enterica enterica serovar Typhi Ty2
auuuugccuucaa

SEQ ID NO: 1767789 - RNA, 14 nt, Salmonella enterica enterica serovar Typhi Ty2
auuuuuaauugcug

SEQ ID NO: 1767790 - RNA, 15 nt, Salmonella enterica enterica serovar Typhi Ty2
auuuuuaguaacuua

SEQ ID NO: 1767791 - RNA, 21 nt, Salmonella enterica enterica serovar Typhi Ty2
auuuugcacuuuugccaggcg

SEQ ID NO: 1767792 - RNA, 16 nt, Salmonella enterica enterica serovar Typhi Ty2
auuuugcacuguuuuu

SEQ ID NO: 1767793 - RNA, 16 nt, Salmonella enterica enterica serovar Typhi Ty2
auuuugauacucauca

SEQ ID NO: 1767794 - RNA, 20 nt, Salmonella enterica enterica serovar Typhi Ty2
auuuucuuucaucaaacgga

SEQ ID NO: 1767795 - RNA, 17 nt, Salmonella enterica enterica serovar Typhi Ty2
auuuucuuucaucaaac

SEQ ID NO: 1767796 - RNA, 18 nt, Salmonella enterica enterica serovar Typhi Ty2
auuuucuuucaucaaacg

SEQ ID NO: 1767797 - RNA, 15 nt, Salmonella enterica enterica serovar Typhi Ty2
auuuucuuucaucaa

SEQ ID NO: 1767798 - RNA, 17 nt, Salmonella enterica enterica serovar Typhi Ty2
auuuucuucuggccauu

SEQ ID NO: 1767799 - RNA, 12 nt, Salmonella enterica enterica serovar Typhi Ty2
auuccagucauu

SEQ ID NO: 1767800 - RNA, 14 nt, Salmonella enterica enterica serovar Typhi Ty2
auuccaguccuuuc

SEQ ID NO: 1767801 - RNA, 18 nt, Salmonella enterica enterica serovar Typhi Ty2
auuccagggcauuuuuuc

SEQ ID NO: 1767802 - RNA, 22 nt, Salmonella enterica enterica serovar Typhi Ty2
auuccagggcauuuuuuccagu

SEQ ID NO: 1767803 - RNA, 23 nt, Salmonella enterica enterica serovar Typhi Ty2
auuccagggcauuuuuuccagua

SEQ ID NO: 1767804 - RNA, 18 nt, Salmonella enterica enterica serovar Typhi Ty2
auuccagcgugccgagca

SEQ ID NO: 1767805 - RNA, 15 nt, Salmonella enterica enterica serovar Typhi Ty2
auuccagucgcucca

SEQ ID NO: 1767806 - RNA, 12 nt, Salmonella enterica enterica serovar Typhi Ty2
auucccaggcaa

SEQ ID NO: 1767807 - RNA, 16 nt, Salmonella enterica enterica serovar Typhi Ty2
auucccauuccugcaa

SEQ ID NO: 1767808 - RNA, 22 nt, Salmonella enterica enterica serovar Typhi Ty2
auuccagccgguguuaaccaga

SEQ ID NO: 1767809 - RNA, 16 nt, Salmonella enterica enterica serovar Typhi Ty2
auucauaccuuuaagc

SEQ ID NO: 1767810 - RNA, 15 nt, Salmonella enterica enterica serovar Typhi Ty2
auuccagaaucuggc

SEQ ID NO: 1767811 - RNA, 20 nt, Salmonella enterica enterica serovar Typhi Ty2
auuccggcaucguacgggca

SEQ ID NO: 1767812 - RNA, 14 nt, Salmonella enterica enterica serovar Typhi Ty2
auuccggcacaacc

SEQ ID NO: 1767813 - RNA, 14 nt, Salmonella enterica enterica serovar Typhi Ty2
auuccggcgcuggc

SEQ ID NO: 1767814 - RNA, 13 nt, Salmonella enterica enterica serovar Typhi Ty2
auuccggcacaac

SEQ ID NO: 1767815 - RNA, 16 nt, Salmonella enterica enterica serovar Typhi Ty2
auuccgcuucuuccau

SEQ ID NO: 1767816 - RNA, 22 nt, Salmonella enterica enterica serovar Typhi Ty2
auuccgaaagaaagacgcugaa

SEQ ID NO: 1767817 - RNA, 16 nt, Salmonella enterica enterica serovar Typhi Ty2
auuccccguccugaau

SEQ ID NO: 1767818 - RNA, 19 nt, Salmonella enterica enterica serovar Typhi Ty2
auucccugguucgaaucca

SEQ ID NO: 1767819 - RNA, 14 nt, Salmonella enterica enterica serovar Typhi Ty2
auuccgccugcugu

SEQ ID NO: 1767820 - RNA, 23 nt, Salmonella enterica enterica serovar Typhi Ty2
auuccgcguguuuguaaaaauag

SEQ ID NO: 1767821 - RNA, 13 nt, Salmonella enterica enterica serovar Typhi Ty2
auuccgcgcauaa

SEQ ID NO: 1767822 - RNA, 21 nt, Salmonella enterica enterica serovar Typhi Ty2
auuccgcgcuaucgguaucau

SEQ ID NO: 1767823 - RNA, 15 nt, Salmonella enterica enterica serovar Typhi Ty2
auuccgcagaagccg

SEQ ID NO: 1767824 - RNA, 14 nt, Salmonella enterica enterica serovar Typhi Ty2
auuccugaguuuau

SEQ ID NO: 1767825 - RNA, 19 nt, Salmonella enterica enterica serovar Typhi Ty2
auuccugaguaaugaucau

SEQ ID NO: 1767826 - RNA, 14 nt, Salmonella enterica enterica serovar Typhi Ty2
auuccugccgccgc

SEQ ID NO: 1767827 - RNA, 19 nt, Salmonella enterica enterica serovar Typhi Ty2
auucgacaguucccggcaa

SEQ ID NO: 1767828 - RNA, 17 nt, Salmonella enterica enterica serovar Typhi Ty2
auucgguaguuccagaa

SEQ ID NO: 1767829 - RNA, 19 nt, Salmonella enterica enterica serovar Typhi Ty2
auucggccuucgguuuuau

SEQ ID NO: 1767830 - RNA, 15 nt, Salmonella enterica enterica serovar Typhi Ty2
auucgccguucuguu

SEQ ID NO: 1767831 - RNA, 22 nt, Salmonella enterica enterica serovar Typhi Ty2
auucuacaguuugucaucaguc

SEQ ID NO: 1767832 - RNA, 19 nt, Salmonella enterica enterica serovar Typhi Ty2
auucuaacauaaugaaucc

SEQ ID NO: 1767833 - RNA, 19 nt, Salmonella enterica enterica serovar Typhi Ty2
auucuacaguuugucauca

SEQ ID NO: 1767834 - RNA, 17 nt, Salmonella enterica enterica serovar Typhi Ty2
auucuaaaaguaagcua

SEQ ID NO: 1767835 - RNA, 17 nt, Salmonella enterica enterica serovar Typhi Ty2
auucuuuucacgcauug

SEQ ID NO: 1767836 - RNA, 21 nt, Salmonella enterica enterica serovar Typhi Ty2
auugaacauuuuuucagccug

SEQ ID NO: 1767837 - RNA, 21 nt, Salmonella enterica enterica serovar Typhi Ty2
auugaacgcuggcggcaggcc

SEQ ID NO: 1767838 - RNA, 18 nt, Salmonella enterica enterica serovar Typhi Ty2
auucuuaguccucagcga

SEQ ID NO: 1767839 - RNA, 19 nt, Salmonella enterica enterica serovar Typhi Ty2
auucuuucgcguaaacacu

SEQ ID NO: 1767840 - RNA, 21 nt, Salmonella enterica enterica serovar Typhi Ty2
auucucccuacugcuuagcuc

SEQ ID NO: 1767841 - RNA, 22 nt, Salmonella enterica enterica serovar Typhi Ty2
auucugugaugaugcguuuguu

SEQ ID NO: 1767842 - RNA, 23 nt, Salmonella enterica enterica serovar Typhi Ty2
auucuguggggcuuaacccacga

SEQ ID NO: 1767843 - RNA, 17 nt, Salmonella enterica enterica serovar Typhi Ty2
auucuguguuuuuucgu

SEQ ID NO: 1767844 - RNA, 18 nt, Salmonella enterica enterica serovar Typhi Ty2
auucuguuagcgcccucu

SEQ ID NO: 1767845 - RNA, 20 nt, Salmonella enterica enterica serovar Typhi Ty2
auucucagccagguauuuag

SEQ ID NO: 1767846 - RNA, 14 nt, Salmonella enterica enterica serovar Typhi Ty2
auucucccaaauuu

SEQ ID NO: 1767847 - RNA, 20 nt, Salmonella enterica enterica serovar Typhi Ty2
auugaggcggguaauuugcg

SEQ ID NO: 1767848 - RNA, 20 nt, Salmonella enterica enterica serovar Typhi Ty2
auugaggcguuuccagugca

SEQ ID NO: 1767849 - RNA, 23 nt, Salmonella enterica enterica serovar Typhi Ty2
auugaggcguuuccagugcagcu

SEQ ID NO: 1767850 - RNA, 19 nt, Salmonella enterica enterica serovar Typhi Ty2
auugaggcggguaauuugc

SEQ ID NO: 1767851 - RNA, 16 nt, Salmonella enterica enterica serovar Typhi Ty2
auugaggcuacccaga

SEQ ID NO: 1767852 - RNA, 15 nt, Salmonella enterica enterica serovar Typhi Ty2
auugaggcuacccag

SEQ ID NO: 1767853 - RNA, 18 nt, Salmonella enterica enterica serovar Typhi Ty2
auugagcuggauaagcug

SEQ ID NO: 1767854 - RNA, 20 nt, Salmonella enterica enterica serovar Typhi Ty2
auugagguauaggaaaauga

SEQ ID NO: 1767855 - RNA, 15 nt, Salmonella enterica enterica serovar Typhi Ty2
auugacuuucagagc

SEQ ID NO: 1767856 - RNA, 22 nt, Salmonella enterica enterica serovar Typhi Ty2
auugacuuaucgcgcuggcagu

SEQ ID NO: 1767857 - RNA, 14 nt, Salmonella enterica enterica serovar Typhi Ty2
auugacuucaacgc

SEQ ID NO: 1767858 - RNA, 17 nt, Salmonella enterica enterica serovar Typhi Ty2
auugacuggauuuuuga

SEQ ID NO: 1767859 - RNA, 20 nt, Salmonella enterica enterica serovar Typhi Ty2
auugagcgcaaaacgcugcu

SEQ ID NO: 1767860 - RNA, 23 nt, Salmonella enterica enterica serovar Typhi Ty2
auugaauauuugcgcaguuuaaa

SEQ ID NO: 1767861 - RNA, 19 nt, Salmonella enterica enterica serovar Typhi Ty2
auugaauucaccgcaugac

SEQ ID NO: 1767862 - RNA, 20 nt, Salmonella enterica enterica serovar Typhi Ty2
auugaauuugacgacaugca

SEQ ID NO: 1767863 - RNA, 17 nt, Salmonella enterica enterica serovar Typhi Ty2
auugaacggcucaaaau

SEQ ID NO: 1767864 - RNA, 16 nt, Salmonella enterica enterica serovar Typhi Ty2
auugacgguaaaguaa

SEQ ID NO: 1767865 - RNA, 18 nt, Salmonella enterica enterica serovar Typhi Ty2
auugacgggaaaucuccc

SEQ ID NO: 1767866 - RNA, 13 nt, Salmonella enterica enterica serovar Typhi Ty2
auugaccuucaug

SEQ ID NO: 1767867 - RNA, 20 nt, Salmonella enterica enterica serovar Typhi Ty2
auugaccguccccagccaga

SEQ ID NO: 1767868 - RNA, 18 nt, Salmonella enterica enterica serovar Typhi Ty2
auugaccguccccagcca

SEQ ID NO: 1767869 - RNA, 12 nt, Salmonella enterica enterica serovar Typhi Ty2
auugauucugug

SEQ ID NO: 1767870 - RNA, 17 nt, Salmonella enterica enterica serovar Typhi Ty2
auugauuggcaaacugu

SEQ ID NO: 1767871 - RNA, 14 nt, Salmonella enterica enterica serovar Typhi Ty2
auugcgccaccuua

SEQ ID NO: 1767872 - RNA, 14 nt, Salmonella enterica enterica serovar Typhi Ty2
auugcgagaaaaaa

SEQ ID NO: 1767873 - RNA, 15 nt, Salmonella enterica enterica serovar Typhi Ty2
auugauuuuucuggu

SEQ ID NO: 1767874 - RNA, 16 nt, Salmonella enterica enterica serovar Typhi Ty2
auugauaauaaccguc

SEQ ID NO: 1767875 - RNA, 18 nt, Salmonella enterica enterica serovar Typhi Ty2
auugauuagcuuuuuacu

SEQ ID NO: 1767876 - RNA, 18 nt, Salmonella enterica enterica serovar Typhi Ty2
auugaucacaaaaucauu

SEQ ID NO: 1767877 - RNA, 22 nt, Salmonella enterica enterica serovar Typhi Ty2
auugaucacaaaaucauugcgu

SEQ ID NO: 1767878 - RNA, 22 nt, Salmonella enterica enterica serovar Typhi Ty2
auugcucuuccggcauaaaaag

SEQ ID NO: 1767879 - RNA, 14 nt, Salmonella enterica enterica serovar Typhi Ty2
auugcugagcugac

SEQ ID NO: 1767880 - RNA, 22 nt, Salmonella enterica enterica serovar Typhi Ty2
auugcuucguggcaaucagcaa

SEQ ID NO: 1767881 - RNA, 17 nt, Salmonella enterica enterica serovar Typhi Ty2
auuggaaaaccccaucc

SEQ ID NO: 1767882 - RNA, 13 nt, Salmonella enterica enterica serovar Typhi Ty2
auugcgccaccuu

SEQ ID NO: 1767883 - RNA, 21 nt, Salmonella enterica enterica serovar Typhi Ty2
aaaaggucgacauuuaaugag

SEQ ID NO: 1767884 - RNA, 19 nt, Salmonella enterica enterica serovar Typhi Ty2
aaaagguggguuccagcgc

SEQ ID NO: 1767885 - RNA, 20 nt, Salmonella enterica enterica serovar Typhi Ty2
aaaagguuagguuaaauagu

SEQ ID NO: 1767886 - RNA, 14 nt, Salmonella enterica enterica serovar Typhi Ty2
auuggucugauuca

SEQ ID NO: 1767887 - RNA, 18 nt, Salmonella enterica enterica serovar Typhi Ty2
auugucaccguaauauaa

SEQ ID NO: 1767888 - RNA, 21 nt, Salmonella enterica enterica serovar Typhi Ty2
auugucagcucuuuguuuagc

SEQ ID NO: 1767889 - RNA, 13 nt, Salmonella enterica enterica serovar Typhi Ty2
auuguaugcaaga

SEQ ID NO: 1767890 - RNA, 15 nt, Salmonella enterica enterica serovar Typhi Ty2
auuggccccuggccg

SEQ ID NO: 1767891 - RNA, 13 nt, Salmonella enterica enterica serovar Typhi Ty2
auuggccccuggc

SEQ ID NO: 1767892 - RNA, 14 nt, Salmonella enterica enterica serovar Typhi Ty2
auuggcaucauaaa

SEQ ID NO: 1767893 - RNA, 11 nt, Salmonella enterica enterica serovar Typhi Ty2
auuggcaucug

SEQ ID NO: 1767894 - RNA, 19 nt, Salmonella enterica enterica serovar Typhi Ty2
auuggguaguaauauuaaa

SEQ ID NO: 1767895 - RNA, 16 nt, Salmonella enterica enterica serovar Typhi Ty2
auuggcgcagccuguu

SEQ ID NO: 1767896 - RNA, 20 nt, Salmonella enterica enterica serovar Typhi Ty2
auugggcguaagaaaaguuu

SEQ ID NO: 1767897 - RNA, 13 nt, Salmonella enterica enterica serovar Typhi Ty2
auuggcaccacca

SEQ ID NO: 1767898 - RNA, 17 nt, Salmonella enterica enterica serovar Typhi Ty2
auuuaauggucuuaaau

SEQ ID NO: 1767899 - RNA, 13 nt, Salmonella enterica enterica serovar Typhi Ty2
auuuaauauuuau

SEQ ID NO: 1767900 - RNA, 21 nt, Salmonella enterica enterica serovar Typhi Ty2
auuuaagccagacgcgcagca

SEQ ID NO: 1767901 - RNA, 19 nt, Salmonella enterica enterica serovar Typhi Ty2
auuuaagccagauguaauc

SEQ ID NO: 1767902 - RNA, 13 nt, Salmonella enterica enterica serovar Typhi Ty2
auuguuuucuauu

SEQ ID NO: 1767903 - RNA, 13 nt, Salmonella enterica enterica serovar Typhi Ty2
auuguuuuacuuu

SEQ ID NO: 1767904 - RNA, 15 nt, Salmonella enterica enterica serovar Typhi Ty2
auugugaaccauggc

SEQ ID NO: 1767905 - RNA, 16 nt, Salmonella enterica enterica serovar Typhi Ty2
auugugagaaaagcag

SEQ ID NO: 1767906 - RNA, 18 nt, Salmonella enterica enterica serovar Typhi Ty2
auugugagaaaagcagag

SEQ ID NO: 1767907 - RNA, 17 nt, Salmonella enterica enterica serovar Typhi Ty2
auuguuuguagaaagug

SEQ ID NO: 1767908 - RNA, 15 nt, Salmonella enterica enterica serovar Typhi Ty2
auuguggaaauaaga

SEQ ID NO: 1767909 - RNA, 22 nt, Salmonella enterica enterica serovar Typhi Ty2
auuuacaaaugaccucaagaau

SEQ ID NO: 1767910 - RNA, 16 nt, Salmonella enterica enterica serovar Typhi Ty2
auuuacugaauaaaua

SEQ ID NO: 1767911 - RNA, 15 nt, Salmonella enterica enterica serovar Typhi Ty2
auuuacuccaaaaau

SEQ ID NO: 1767912 - RNA, 15 nt, Salmonella enterica enterica serovar Typhi Ty2
auuuacgcagcccca

SEQ ID NO: 1767913 - RNA, 23 nt, Salmonella enterica enterica serovar Typhi Ty2
auuuagcuauuccaaaauaauaa

SEQ ID NO: 1767914 - RNA, 22 nt, Salmonella enterica enterica serovar Typhi Ty2
auuuagcuauuccaaaauaaua

SEQ ID NO: 1767915 - RNA, 17 nt, Salmonella enterica enterica serovar Typhi Ty2
augccgggugcggcgcu

SEQ ID NO: 1767916 - RNA, 15 nt, Salmonella enterica enterica serovar Typhi Ty2
augccgggcaaaaaa

SEQ ID NO: 1767917 - RNA, 22 nt, Salmonella enterica enterica serovar Typhi Ty2
augccggauaguuacccggcaa

SEQ ID NO: 1767918 - RNA, 23 nt, Salmonella enterica enterica serovar Typhi Ty2
augccggugcgagaaaaagcaau

SEQ ID NO: 1767919 - RNA, 23 nt, Salmonella enterica enterica serovar Typhi Ty2
augcccggaugauuaucaucuau

SEQ ID NO: 1767920 - RNA, 19 nt, Salmonella enterica enterica serovar Typhi Ty2
augcccgguaagaaugcgc

SEQ ID NO: 1767921 - RNA, 23 nt, Salmonella enterica enterica serovar Typhi Ty2
augcccaccggaccuaauagcca

SEQ ID NO: 1767922 - RNA, 12 nt, Salmonella enterica enterica serovar Typhi Ty2
augcccaaaaua

SEQ ID NO: 1767923 - RNA, 15 nt, Salmonella enterica enterica serovar Typhi Ty2
augcccauaaagaaa

SEQ ID NO: 1767924 - RNA, 21 nt, Salmonella enterica enterica serovar Typhi Ty2
augccacgccccuaaggcagc

SEQ ID NO: 1767925 - RNA, 13 nt, Salmonella enterica enterica serovar Typhi Ty2
augccacuguuca

SEQ ID NO: 1767926 - RNA, 17 nt, Salmonella enterica enterica serovar Typhi Ty2
augccagaauugcacgc

SEQ ID NO: 1767927 - RNA, 20 nt, Salmonella enterica enterica serovar Typhi Ty2
augcagguaguccaaauaag

SEQ ID NO: 1767928 - RNA, 15 nt, Salmonella enterica enterica serovar Typhi Ty2
augcauaaaaaaacg

SEQ ID NO: 1767929 - RNA, 13 nt, Salmonella enterica enterica serovar Typhi Ty2
augcauaaucgcc

SEQ ID NO: 1767930 - RNA, 13 nt, Salmonella enterica enterica serovar Typhi Ty2
augcaucaugcua

SEQ ID NO: 1767931 - RNA, 12 nt, Salmonella enterica enterica serovar Typhi Ty2
augcaccgccuu

SEQ ID NO: 1767932 - RNA, 15 nt, Salmonella enterica enterica serovar Typhi Ty2
augcaccucgccaaa

SEQ ID NO: 1767933 - RNA, 15 nt, Salmonella enterica enterica serovar Typhi Ty2
augaucgccucuucg

SEQ ID NO: 1767934 - RNA, 17 nt, Salmonella enterica enterica serovar Typhi Ty2
augaucguuuccagcau

SEQ ID NO: 1767935 - RNA, 20 nt, Salmonella enterica enterica serovar Typhi Ty2
augaucguaugcagccaggc

SEQ ID NO: 1767936 - RNA, 21 nt, Salmonella enterica enterica serovar Typhi Ty2
augcagcuugcaggcaaaacg

SEQ ID NO: 1767937 - RNA, 23 nt, Salmonella enterica enterica serovar Typhi Ty2
augcagggauccuguaacaacug

SEQ ID NO: 1767938 - RNA, 13 nt, Salmonella enterica enterica serovar Typhi Ty2
augcacugcugau

SEQ ID NO: 1767939 - RNA, 18 nt, Salmonella enterica enterica serovar Typhi Ty2
augcacguuaaagccgac

SEQ ID NO: 1767940 - RNA, 17 nt, Salmonella enterica enterica serovar Typhi Ty2
augcacuacgaaaagag

SEQ ID NO: 1767941 - RNA, 15 nt, Salmonella enterica enterica serovar Typhi Ty2
augcucaggcaacac

SEQ ID NO: 1767942 - RNA, 23 nt, Salmonella enterica enterica serovar Typhi Ty2
augcucagggcauccgccgccgc

SEQ ID NO: 1767943 - RNA, 19 nt, Salmonella enterica enterica serovar Typhi Ty2
augcucaccgcgaauauac

SEQ ID NO: 1767944 - RNA, 17 nt, Salmonella enterica enterica serovar Typhi Ty2
augcuccaauaaauauu

SEQ ID NO: 1767945 - RNA, 13 nt, Salmonella enterica enterica serovar Typhi Ty2
augcugaauagcc

SEQ ID NO: 1767946 - RNA, 15 nt, Salmonella enterica enterica serovar Typhi Ty2
augcugaauagccag

SEQ ID NO: 1767947 - RNA, 14 nt, Salmonella enterica enterica serovar Typhi Ty2
augcugaacagccg

SEQ ID NO: 1767948 - RNA, 13 nt, Salmonella enterica enterica serovar Typhi Ty2
augcuaucccagg

SEQ ID NO: 1767949 - RNA, 23 nt, Salmonella enterica enterica serovar Typhi Ty2
aaaagaguaaaguuauucacgua

SEQ ID NO: 1767950 - RNA, 23 nt, Salmonella enterica enterica serovar Typhi Ty2
augcuaucgguaguguuaucgcc

SEQ ID NO: 1767951 - RNA, 22 nt, Salmonella enterica enterica serovar Typhi Ty2
augcuaucgguaguguuaucgc

SEQ ID NO: 1767952 - RNA, 19 nt, Salmonella enterica enterica serovar Typhi Ty2
augcuaucgcggauaagcc

SEQ ID NO: 1767953 - RNA, 22 nt, Salmonella enterica enterica serovar Typhi Ty2
augcucaaccaguaccgggccu

SEQ ID NO: 1767954 - RNA, 17 nt, Salmonella enterica enterica serovar Typhi Ty2
aaaagagcuuauuuuga

SEQ ID NO: 1767955 - RNA, 20 nt, Salmonella enterica enterica serovar Typhi Ty2
aaaagaccauccgguuuuaa

SEQ ID NO: 1767956 - RNA, 13 nt, Salmonella enterica enterica serovar Typhi Ty2
augcuaaaacaga

SEQ ID NO: 1767957 - RNA, 19 nt, Salmonella enterica enterica serovar Typhi Ty2
augcguuuuuaucuuucuu

SEQ ID NO: 1767958 - RNA, 17 nt, Salmonella enterica enterica serovar Typhi Ty2
augcguuguaccguuuu

SEQ ID NO: 1767959 - RNA, 17 nt, Salmonella enterica enterica serovar Typhi Ty2
augcgcugcacaaucgc

SEQ ID NO: 1767960 - RNA, 15 nt, Salmonella enterica enterica serovar Typhi Ty2
augcgcugaauagcg

SEQ ID NO: 1767961 - RNA, 16 nt, Salmonella enterica enterica serovar Typhi Ty2
augcgcuagcuggcag

SEQ ID NO: 1767962 - RNA, 17 nt, Salmonella enterica enterica serovar Typhi Ty2
augcgcuuccagcauga

SEQ ID NO: 1767963 - RNA, 24 nt, Salmonella enterica enterica serovar Typhi Ty2
augccuaaaccgacaauauucgcc

SEQ ID NO: 1767964 - RNA, 18 nt, Salmonella enterica enterica serovar Typhi Ty2
augccguuuuaacgucau

SEQ ID NO: 1767965 - RNA, 20 nt, Salmonella enterica enterica serovar Typhi Ty2
augccgugaggcugaagcgc

SEQ ID NO: 1767966 - RNA, 14 nt, Salmonella enterica enterica serovar Typhi Ty2
augccgugaguaau

SEQ ID NO: 1767967 - RNA, 21 nt, Salmonella enterica enterica serovar Typhi Ty2
augccguucuuuaaucagauu

SEQ ID NO: 1767968 - RNA, 20 nt, Salmonella enterica enterica serovar Typhi Ty2
augcgcagaaacugaucgaa

SEQ ID NO: 1767969 - RNA, 18 nt, Salmonella enterica enterica serovar Typhi Ty2
augcgaugccgcacgccu

SEQ ID NO: 1767970 - RNA, 19 nt, Salmonella enterica enterica serovar Typhi Ty2
augcggcuuugcgccggca

SEQ ID NO: 1767971 - RNA, 21 nt, Salmonella enterica enterica serovar Typhi Ty2
augcggcugacgauacucagc

SEQ ID NO: 1767972 - RNA, 13 nt, Salmonella enterica enterica serovar Typhi Ty2
augcggauaaagc

SEQ ID NO: 1767973 - RNA, 22 nt, Salmonella enterica enterica serovar Typhi Ty2
augcguauuuccaccuucucuu

SEQ ID NO: 1767974 - RNA, 22 nt, Salmonella enterica enterica serovar Typhi Ty2
augcguaccugcgcgcaggucu

SEQ ID NO: 1767975 - RNA, 21 nt, Salmonella enterica enterica serovar Typhi Ty2
augcggucguauuaccaaccc

SEQ ID NO: 1767976 - RNA, 15 nt, Salmonella enterica enterica serovar Typhi Ty2
augcgguuaaaccag

SEQ ID NO: 1767977 - RNA, 22 nt, Salmonella enterica enterica serovar Typhi Ty2
augcgucagcgcggcuuccagu

SEQ ID NO: 1767978 - RNA, 16 nt, Salmonella enterica enterica serovar Typhi Ty2
augcguccgcccagaa

SEQ ID NO: 1767979 - RNA, 12 nt, Salmonella enterica enterica serovar Typhi Ty2
augcguucaaaa

SEQ ID NO: 1767980 - RNA, 16 nt, Salmonella enterica enterica serovar Typhi Ty2
augucaacuuaaacgu

SEQ ID NO: 1767981 - RNA, 13 nt, Salmonella enterica enterica serovar Typhi Ty2
auguauuuaaguc

SEQ ID NO: 1767982 - RNA, 20 nt, Salmonella enterica enterica serovar Typhi Ty2
augucauccgguucacccac

SEQ ID NO: 1767983 - RNA, 17 nt, Salmonella enterica enterica serovar Typhi Ty2
augucaugacuuaacgu

SEQ ID NO: 1767984 - RNA, 14 nt, Salmonella enterica enterica serovar Typhi Ty2
augucaucggcuuu

SEQ ID NO: 1767985 - RNA, 17 nt, Salmonella enterica enterica serovar Typhi Ty2
auguccauaaauagauc

SEQ ID NO: 1767986 - RNA, 16 nt, Salmonella enterica enterica serovar Typhi Ty2
augucaguaauauauu

SEQ ID NO: 1767987 - RNA, 17 nt, Salmonella enterica enterica serovar Typhi Ty2
augucaggaucagauau

SEQ ID NO: 1767988 - RNA, 16 nt, Salmonella enterica enterica serovar Typhi Ty2
augucauauuugugag

SEQ ID NO: 1767989 - RNA, 14 nt, Salmonella enterica enterica serovar Typhi Ty2
aaaagauaaccauu

SEQ ID NO: 1767990 - RNA, 17 nt, Salmonella enterica enterica serovar Typhi Ty2
auguaucgcgcggauuc

SEQ ID NO: 1767991 - RNA, 21 nt, Salmonella enterica enterica serovar Typhi Ty2
auguaguuguucuuuuuaugg

SEQ ID NO: 1767992 - RNA, 20 nt, Salmonella enterica enterica serovar Typhi Ty2
auguaucgcgcuuacacaga

SEQ ID NO: 1767993 - RNA, 20 nt, Salmonella enterica enterica serovar Typhi Ty2
auguaucgcgcggauuccgc

SEQ ID NO: 1767994 - RNA, 13 nt, Salmonella enterica enterica serovar Typhi Ty2
aaaagcaaagagg

SEQ ID NO: 1767995 - RNA, 13 nt, Salmonella enterica enterica serovar Typhi Ty2
auguagccagcca

SEQ ID NO: 1767996 - RNA, 21 nt, Salmonella enterica enterica serovar Typhi Ty2
auguaguaaauaggagaugca

SEQ ID NO: 1767997 - RNA, 15 nt, Salmonella enterica enterica serovar Typhi Ty2
auguagcaaauuuca

SEQ ID NO: 1767998 - RNA, 16 nt, Salmonella enterica enterica serovar Typhi Ty2
auguaaucugacagau

SEQ ID NO: 1767999 - RNA, 20 nt, Salmonella enterica enterica serovar Typhi Ty2
auguacgccuaaaaaugagg

SEQ ID NO: 1768000 - RNA, 18 nt, Salmonella enterica enterica serovar Typhi Ty2
auggucgcgccaaaagag

SEQ ID NO: 1768001 - RNA, 17 nt, Salmonella enterica enterica serovar Typhi Ty2
auggucccugauauaca

SEQ ID NO: 1768002 - RNA, 21 nt, Salmonella enterica enterica serovar Typhi Ty2
auggucucguugccauugguu

SEQ ID NO: 1768003 - RNA, 16 nt, Salmonella enterica enterica serovar Typhi Ty2
auggucuguaccacca

SEQ ID NO: 1768004 - RNA, 20 nt, Salmonella enterica enterica serovar Typhi Ty2
auggucucguugccauuggu

SEQ ID NO: 1768005 - RNA, 22 nt, Salmonella enterica enterica serovar Typhi Ty2
augguuuugcccauuuccugca

SEQ ID NO: 1768006 - RNA, 19 nt, Salmonella enterica enterica serovar Typhi Ty2
auguaaaaaaauaaaaaag

SEQ ID NO: 1768007 - RNA, 16 nt, Salmonella enterica enterica serovar Typhi Ty2
auguaaaaaaauaaaa

SEQ ID NO: 1768008 - RNA, 12 nt, Salmonella enterica enterica serovar Typhi Ty2
augguauuuauu

SEQ ID NO: 1768009 - RNA, 16 nt, Salmonella enterica enterica serovar Typhi Ty2
augguauuucagaccg

SEQ ID NO: 1768010 - RNA, 22 nt, Salmonella enterica enterica serovar Typhi Ty2
augggguuuguccugcagcgcc

SEQ ID NO: 1768011 - RNA, 23 nt, Salmonella enterica enterica serovar Typhi Ty2
auggguaaaaauauggcgggccu

SEQ ID NO: 1768012 - RNA, 16 nt, Salmonella enterica enterica serovar Typhi Ty2
augggauaacgcagaa

SEQ ID NO: 1768013 - RNA, 18 nt, Salmonella enterica enterica serovar Typhi Ty2
augggauacgccagcaga

SEQ ID NO: 1768014 - RNA, 17 nt, Salmonella enterica enterica serovar Typhi Ty2
augggaggauacuguuu

SEQ ID NO: 1768015 - RNA, 16 nt, Salmonella enterica enterica serovar Typhi Ty2
augggauugcaaaaaa

SEQ ID NO: 1768016 - RNA, 18 nt, Salmonella enterica enterica serovar Typhi Ty2
augggauuugaugcccaa

SEQ ID NO: 1768017 - RNA, 17 nt, Salmonella enterica enterica serovar Typhi Ty2
augggccuacgccugga

SEQ ID NO: 1768018 - RNA, 18 nt, Salmonella enterica enterica serovar Typhi Ty2
auggcuuucagauuagcc

SEQ ID NO: 1768019 - RNA, 17 nt, Salmonella enterica enterica serovar Typhi Ty2
auggcgguuccggggaa

SEQ ID NO: 1768020 - RNA, 16 nt, Salmonella enterica enterica serovar Typhi Ty2
auggcgguauaacugc

SEQ ID NO: 1768021 - RNA, 20 nt, Salmonella enterica enterica serovar Typhi Ty2
auggcggucgccauauguuc

SEQ ID NO: 1768022 - RNA, 20 nt, Salmonella enterica enterica serovar Typhi Ty2
auggcggugcuuaaccggga

SEQ ID NO: 1768023 - RNA, 16 nt, Salmonella enterica enterica serovar Typhi Ty2
auggcggcugcgccuu

SEQ ID NO: 1768024 - RNA, 20 nt, Salmonella enterica enterica serovar Typhi Ty2
auggcggcggacaugguaau

SEQ ID NO: 1768025 - RNA, 18 nt, Salmonella enterica enterica serovar Typhi Ty2
auggcggcguaccgccuu

SEQ ID NO: 1768026 - RNA, 22 nt, Salmonella enterica enterica serovar Typhi Ty2
auggcgcugucggcgcccagcu

SEQ ID NO: 1768027 - RNA, 15 nt, Salmonella enterica enterica serovar Typhi Ty2
auggcgcugcgcgca

SEQ ID NO: 1768028 - RNA, 17 nt, Salmonella enterica enterica serovar Typhi Ty2
auggcgcuaagccagcc

SEQ ID NO: 1768029 - RNA, 22 nt, Salmonella enterica enterica serovar Typhi Ty2
auggcggauuccaguagcgcgc

SEQ ID NO: 1768030 - RNA, 19 nt, Salmonella enterica enterica serovar Typhi Ty2
augcugacgcguuuuuuca

SEQ ID NO: 1768031 - RNA, 21 nt, Salmonella enterica enterica serovar Typhi Ty2
augcugauuaaugauuugcuu

SEQ ID NO: 1768032 - RNA, 22 nt, Salmonella enterica enterica serovar Typhi Ty2
augcugguuuuagcuuauccca

SEQ ID NO: 1768033 - RNA, 15 nt, Salmonella enterica enterica serovar Typhi Ty2
augcuggcugaaaug

SEQ ID NO: 1768034 - RNA, 21 nt, Salmonella enterica enterica serovar Typhi Ty2
auggcaaagucgaacgacuga

SEQ ID NO: 1768035 - RNA, 17 nt, Salmonella enterica enterica serovar Typhi Ty2
auggcacaucaggcaaa

SEQ ID NO: 1768036 - RNA, 14 nt, Salmonella enterica enterica serovar Typhi Ty2
auggccugaugacg

SEQ ID NO: 1768037 - RNA, 14 nt, Salmonella enterica enterica serovar Typhi Ty2
auggccauagacuu

SEQ ID NO: 1768038 - RNA, 18 nt, Salmonella enterica enterica serovar Typhi Ty2
auggccagaaugacaugg

SEQ ID NO: 1768039 - RNA, 20 nt, Salmonella enterica enterica serovar Typhi Ty2
auggcgcgccacuucuuuga

SEQ ID NO: 1768040 - RNA, 19 nt, Salmonella enterica enterica serovar Typhi Ty2
auggcgcgaaaacagcugg

SEQ ID NO: 1768041 - RNA, 22 nt, Salmonella enterica enterica serovar Typhi Ty2
auggcgaucagcgccaccacaa

SEQ ID NO: 1768042 - RNA, 15 nt, Salmonella enterica enterica serovar Typhi Ty2
auggcgacgaucagc

SEQ ID NO: 1768043 - RNA, 18 nt, Salmonella enterica enterica serovar Typhi Ty2
auggcgacguaacugucu

SEQ ID NO: 1768044 - RNA, 21 nt, Salmonella enterica enterica serovar Typhi Ty2
auucaccucccugcaacagca

SEQ ID NO: 1768045 - RNA, 15 nt, Salmonella enterica enterica serovar Typhi Ty2
auucacguuccauuu

SEQ ID NO: 1768046 - RNA, 17 nt, Salmonella enterica enterica serovar Typhi Ty2
auucacgcgauuguuau

SEQ ID NO: 1768047 - RNA, 22 nt, Salmonella enterica enterica serovar Typhi Ty2
auucacgcgauuguuauccccc

SEQ ID NO: 1768048 - RNA, 16 nt, Salmonella enterica enterica serovar Typhi Ty2
auucacguagcggcgc

SEQ ID NO: 1768049 - RNA, 12 nt, Salmonella enterica enterica serovar Typhi Ty2
auucagaaaguu

SEQ ID NO: 1768050 - RNA, 16 nt, Salmonella enterica enterica serovar Typhi Ty2
auucagcaggaggcuu

SEQ ID NO: 1768051 - RNA, 15 nt, Salmonella enterica enterica serovar Typhi Ty2
auucagcaguucauu

SEQ ID NO: 1768052 - RNA, 17 nt, Salmonella enterica enterica serovar Typhi Ty2
auucagcacccagcgaa

SEQ ID NO: 1768053 - RNA, 13 nt, Salmonella enterica enterica serovar Typhi Ty2
auucagcggcugc

SEQ ID NO: 1768054 - RNA, 15 nt, Salmonella enterica enterica serovar Typhi Ty2
auucagggugcugau

SEQ ID NO: 1768055 - RNA, 16 nt, Salmonella enterica enterica serovar Typhi Ty2
auucaggguugucuca

SEQ ID NO: 1768056 - RNA, 11 nt, Salmonella enterica enterica serovar Typhi Ty2
auucagguaau

SEQ ID NO: 1768057 - RNA, 20 nt, Salmonella enterica enterica serovar Typhi Ty2
auucagggcuuuauuuuaca

SEQ ID NO: 1768058 - RNA, 16 nt, Salmonella enterica enterica serovar Typhi Ty2
auucaggccgccagca

SEQ ID NO: 1768059 - RNA, 21 nt, Salmonella enterica enterica serovar Typhi Ty2
auucagggaacguugcgccau

SEQ ID NO: 1768060 - RNA, 14 nt, Salmonella enterica enterica serovar Typhi Ty2
auucauaaaagauc

SEQ ID NO: 1768061 - RNA, 18 nt, Salmonella enterica enterica serovar Typhi Ty2
auucagguggauuuuugc

SEQ ID NO: 1768062 - RNA, 17 nt, Salmonella enterica enterica serovar Typhi Ty2
auucaaccaguuaauuu

SEQ ID NO: 1768063 - RNA, 11 nt, Salmonella enterica enterica serovar Typhi Ty2
auucaauauug

SEQ ID NO: 1768064 - RNA, 19 nt, Salmonella enterica enterica serovar Typhi Ty2
auucaacgccaucuuccuc

SEQ ID NO: 1768065 - RNA, 20 nt, Salmonella enterica enterica serovar Typhi Ty2
auuauucggcgacuggaaca

SEQ ID NO: 1768066 - RNA, 20 nt, Salmonella enterica enterica serovar Typhi Ty2
auucaaauguuguuugaaaa

SEQ ID NO: 1768067 - RNA, 21 nt, Salmonella enterica enterica serovar Typhi Ty2
auucaauuagcgccuccccua

SEQ ID NO: 1768068 - RNA, 18 nt, Salmonella enterica enterica serovar Typhi Ty2
auucaauucuggaaucaa

SEQ ID NO: 1768069 - RNA, 19 nt, Salmonella enterica enterica serovar Typhi Ty2
auucaauucuggaaucaau

SEQ ID NO: 1768070 - RNA, 18 nt, Salmonella enterica enterica serovar Typhi Ty2
aaaaggcgguucccgggc

SEQ ID NO: 1768071 - RNA, 22 nt, Salmonella enterica enterica serovar Typhi Ty2
aaaaggcagauucuucugccuu

SEQ ID NO: 1768072 - RNA, 19 nt, Salmonella enterica enterica serovar Typhi Ty2
aaaaggccuggcugagaaa

SEQ ID NO: 1768073 - RNA, 20 nt, Salmonella enterica enterica serovar Typhi Ty2
aaaaggcgacgaugugcaua

SEQ ID NO: 1768074 - RNA, 22 nt, Salmonella enterica enterica serovar Typhi Ty2
aaaaggcagagcgcgcucugcc

SEQ ID NO: 1768075 - RNA, 22 nt, Salmonella enterica enterica serovar Typhi Ty2
auucacaccuuuauauuuuucc

SEQ ID NO: 1768076 - RNA, 15 nt, Salmonella enterica enterica serovar Typhi Ty2
auucacaccuuuaua

SEQ ID NO: 1768077 - RNA, 21 nt, Salmonella enterica enterica serovar Typhi Ty2
auucacaccaaugucauauuu

SEQ ID NO: 1768078 - RNA, 21 nt, Salmonella enterica enterica serovar Typhi Ty2
auucacauuauucacgcuaug

SEQ ID NO: 1768079 - RNA, 16 nt, Salmonella enterica enterica serovar Typhi Ty2
auucaccaaaaggcag

SEQ ID NO: 1768080 - RNA, 21 nt, Salmonella enterica enterica serovar Typhi Ty2
auucacccaauaaauaauauc

SEQ ID NO: 1768081 - RNA, 16 nt, Salmonella enterica enterica serovar Typhi Ty2
auuaucuuuauugaaa

SEQ ID NO: 1768082 - RNA, 17 nt, Salmonella enterica enterica serovar Typhi Ty2
auuaugaucgguuuuuu

SEQ ID NO: 1768083 - RNA, 21 nt, Salmonella enterica enterica serovar Typhi Ty2
auuauuccuugaucaggaaau

SEQ ID NO: 1768084 - RNA, 22 nt, Salmonella enterica enterica serovar Typhi Ty2
auuauucaccuggauuccucca

SEQ ID NO: 1768085 - RNA, 13 nt, Salmonella enterica enterica serovar Typhi Ty2
auuaugccgacca

SEQ ID NO: 1768086 - RNA, 23 nt, Salmonella enterica enterica serovar Typhi Ty2
auuauccagccgaaguucauaaa

SEQ ID NO: 1768087 - RNA, 18 nt, Salmonella enterica enterica serovar Typhi Ty2
auuauccgccgcaaauuc

SEQ ID NO: 1768088 - RNA, 18 nt, Salmonella enterica enterica serovar Typhi Ty2
auuaucugauucaauuaa

SEQ ID NO: 1768089 - RNA, 15 nt, Salmonella enterica enterica serovar Typhi Ty2
auuaucaaaagugau

SEQ ID NO: 1768090 - RNA, 13 nt, Salmonella enterica enterica serovar Typhi Ty2
auuauauuuaaaa

SEQ ID NO: 1768091 - RNA, 22 nt, Salmonella enterica enterica serovar Typhi Ty2
auuauacuugcugcuauguaaa

SEQ ID NO: 1768092 - RNA, 14 nt, Salmonella enterica enterica serovar Typhi Ty2
auuauauuuuaugg

SEQ ID NO: 1768093 - RNA, 20 nt, Salmonella enterica enterica serovar Typhi Ty2
auuaucaauuucauauuauu

SEQ ID NO: 1768094 - RNA, 11 nt, Salmonella enterica enterica serovar Typhi Ty2
auuaucaccau

SEQ ID NO: 1768095 - RNA, 17 nt, Salmonella enterica enterica serovar Typhi Ty2
auuaucagaaggcuuga

SEQ ID NO: 1768096 - RNA, 18 nt, Salmonella enterica enterica serovar Typhi Ty2
auuaucaggaugaauaug

SEQ ID NO: 1768097 - RNA, 20 nt, Salmonella enterica enterica serovar Typhi Ty2
auuaucauaaugucccugcc

SEQ ID NO: 1768098 - RNA, 19 nt, Salmonella enterica enterica serovar Typhi Ty2
auuaggcguaauuauuaca

SEQ ID NO: 1768099 - RNA, 19 nt, Salmonella enterica enterica serovar Typhi Ty2
auuaggcguaaaauugccg

SEQ ID NO: 1768100 - RNA, 21 nt, Salmonella enterica enterica serovar Typhi Ty2
auuagggggcgggcugaaauc

SEQ ID NO: 1768101 - RNA, 15 nt, Salmonella enterica enterica serovar Typhi Ty2
auuauaaagcauaaa

SEQ ID NO: 1768102 - RNA, 13 nt, Salmonella enterica enterica serovar Typhi Ty2
auuagcuggcugc

SEQ ID NO: 1768103 - RNA, 23 nt, Salmonella enterica enterica serovar Typhi Ty2
auuagcuuuuuacucucuuucug

SEQ ID NO: 1768104 - RNA, 16 nt, Salmonella enterica enterica serovar Typhi Ty2
auuaccccgugguggg

SEQ ID NO: 1768105 - RNA, 18 nt, Salmonella enterica enterica serovar Typhi Ty2
auuaccccgugguggggu

SEQ ID NO: 1768106 - RNA, 19 nt, Salmonella enterica enterica serovar Typhi Ty2
auuacgcuauaaaguuccc

SEQ ID NO: 1768107 - RNA, 14 nt, Salmonella enterica enterica serovar Typhi Ty2
auuacgcaugguca

SEQ ID NO: 1768108 - RNA, 21 nt, Salmonella enterica enterica serovar Typhi Ty2
auuacgcuauaaaguucccau

SEQ ID NO: 1768109 - RNA, 18 nt, Salmonella enterica enterica serovar Typhi Ty2
auguuucgacaguuucuu

SEQ ID NO: 1768110 - RNA, 17 nt, Salmonella enterica enterica serovar Typhi Ty2
auguugcguaaauaaau

SEQ ID NO: 1768111 - RNA, 17 nt, Salmonella enterica enterica serovar Typhi Ty2
auguugccggauagcuc

SEQ ID NO: 1768112 - RNA, 17 nt, Salmonella enterica enterica serovar Typhi Ty2
auguccaucucuuuacc

SEQ ID NO: 1768113 - RNA, 20 nt, Salmonella enterica enterica serovar Typhi Ty2
auguccugccgcaaacgccu

SEQ ID NO: 1768114 - RNA, 19 nt, Salmonella enterica enterica serovar Typhi Ty2
auguccuuuacugcgccag

SEQ ID NO: 1768115 - RNA, 23 nt, Salmonella enterica enterica serovar Typhi Ty2
auguccuuuacugcgccagccug

SEQ ID NO: 1768116 - RNA, 17 nt, Salmonella enterica enterica serovar Typhi Ty2
auguucauaccggauau

SEQ ID NO: 1768117 - RNA, 16 nt, Salmonella enterica enterica serovar Typhi Ty2
auguugaugucacuca

SEQ ID NO: 1768118 - RNA, 19 nt, Salmonella enterica enterica serovar Typhi Ty2
auuaaaaaaggcagaagaa

SEQ ID NO: 1768119 - RNA, 14 nt, Salmonella enterica enterica serovar Typhi Ty2
auguuuuuguuguu

SEQ ID NO: 1768120 - RNA, 18 nt, Salmonella enterica enterica serovar Typhi Ty2
auguuuuuaucagcuugc

SEQ ID NO: 1768121 - RNA, 19 nt, Salmonella enterica enterica serovar Typhi Ty2
auguuuuuaucagcuugcc

SEQ ID NO: 1768122 - RNA, 17 nt, Salmonella enterica enterica serovar Typhi Ty2
auuaaaauaaaugaggc

SEQ ID NO: 1768123 - RNA, 22 nt, Salmonella enterica enterica serovar Typhi Ty2
auuaaacagacaauaccagggc

SEQ ID NO: 1768124 - RNA, 18 nt, Salmonella enterica enterica serovar Typhi Ty2
auuaaauaacaaaugaag

SEQ ID NO: 1768125 - RNA, 21 nt, Salmonella enterica enterica serovar Typhi Ty2
auuaaaucagauaacaaugac

SEQ ID NO: 1768126 - RNA, 20 nt, Salmonella enterica enterica serovar Typhi Ty2
auuaacauuuaagaaacaau

SEQ ID NO: 1768127 - RNA, 19 nt, Salmonella enterica enterica serovar Typhi Ty2
auuaacagucuaucgcugc

SEQ ID NO: 1768128 - RNA, 16 nt, Salmonella enterica enterica serovar Typhi Ty2
auuaacagucuaucgc

SEQ ID NO: 1768129 - RNA, 23 nt, Salmonella enterica enterica serovar Typhi Ty2
auuaacacacaaucgguuaugcg

SEQ ID NO: 1768130 - RNA, 15 nt, Salmonella enterica enterica serovar Typhi Ty2
auuaacaagcagaua

SEQ ID NO: 1768131 - RNA, 17 nt, Salmonella enterica enterica serovar Typhi Ty2
auuaagggacgguaaau

SEQ ID NO: 1768132 - RNA, 14 nt, Salmonella enterica enterica serovar Typhi Ty2
auuaauaugcgcaa

SEQ ID NO: 1768133 - RNA, 19 nt, Salmonella enterica enterica serovar Typhi Ty2
auuaauaugcgcaaucacc

SEQ ID NO: 1768134 - RNA, 16 nt, Salmonella enterica enterica serovar Typhi Ty2
auuaauauuuaacaca

SEQ ID NO: 1768135 - RNA, 18 nt, Salmonella enterica enterica serovar Typhi Ty2
aaaagccaagcacaaaaa

SEQ ID NO: 1768136 - RNA, 15 nt, Salmonella enterica enterica serovar Typhi Ty2
auuaaugauuugcuu

SEQ ID NO: 1768137 - RNA, 17 nt, Salmonella enterica enterica serovar Typhi Ty2
auuaaugauuaaaauaa

SEQ ID NO: 1768138 - RNA, 18 nt, Salmonella enterica enterica serovar Typhi Ty2
auuaaucugugagcacag

SEQ ID NO: 1768139 - RNA, 21 nt, Salmonella enterica enterica serovar Typhi Ty2
auuaauccccggcgaaagaaa

SEQ ID NO: 1768140 - RNA, 19 nt, Salmonella enterica enterica serovar Typhi Ty2
auuaauggcgcaauguccc

SEQ ID NO: 1768141 - RNA, 17 nt, Salmonella enterica enterica serovar Typhi Ty2
auuaaugcuccaauaaa

SEQ ID NO: 1768142 - RNA, 18 nt, Salmonella enterica enterica serovar Typhi Ty2
auuaauuuauccaacagg

SEQ ID NO: 1768143 - RNA, 15 nt, Salmonella enterica enterica serovar Typhi Ty2
auuaauugcuuugca

SEQ ID NO: 1768144 - RNA, 18 nt, Salmonella enterica enterica serovar Typhi Ty2
auuacaaguaauaaaaua

SEQ ID NO: 1768145 - RNA, 18 nt, Salmonella enterica enterica serovar Typhi Ty2
auuacaacauguccuaca

SEQ ID NO: 1768146 - RNA, 14 nt, Salmonella enterica enterica serovar Typhi Ty2
auuacaaaaaucau

SEQ ID NO: 1768147 - RNA, 14 nt, Salmonella enterica enterica serovar Typhi Ty2
auuacaaaaauaga

SEQ ID NO: 1768148 - RNA, 21 nt, Salmonella enterica enterica serovar Typhi Ty2
auuacaaagggcaauauauua

SEQ ID NO: 1768149 - RNA, 16 nt, Salmonella enterica enterica serovar Typhi Ty2
auuacaaacaggcuuu

SEQ ID NO: 1768150 - RNA, 19 nt, Salmonella enterica enterica serovar Typhi Ty2
auuacagcguguucaugcg

SEQ ID NO: 1768151 - RNA, 23 nt, Salmonella enterica enterica serovar Typhi Ty2
auuacagacagucuggauauaaa

SEQ ID NO: 1768152 - RNA, 20 nt, Salmonella enterica enterica serovar Typhi Ty2
auuacccaacaccagacuga

SEQ ID NO: 1768153 - RNA, 15 nt, Salmonella enterica enterica serovar Typhi Ty2
auuaccauuccucac

SEQ ID NO: 1768154 - RNA, 22 nt, Salmonella enterica enterica serovar Typhi Ty2
auauucccguuccagcuugaau

SEQ ID NO: 1768155 - RNA, 11 nt, Salmonella enterica enterica serovar Typhi Ty2
auauuccccac

SEQ ID NO: 1768156 - RNA, 22 nt, Salmonella enterica enterica serovar Typhi Ty2
auauugcgacaacuagaauuuu

SEQ ID NO: 1768157 - RNA, 18 nt, Salmonella enterica enterica serovar Typhi Ty2
auauugccgccauuauuc

SEQ ID NO: 1768158 - RNA, 18 nt, Salmonella enterica enterica serovar Typhi Ty2
auauugauggccacaucg

SEQ ID NO: 1768159 - RNA, 14 nt, Salmonella enterica enterica serovar Typhi Ty2
auauugccauaaau

SEQ ID NO: 1768160 - RNA, 14 nt, Salmonella enterica enterica serovar Typhi Ty2
auauugcauuuuau

SEQ ID NO: 1768161 - RNA, 17 nt, Salmonella enterica enterica serovar Typhi Ty2
auauugcccguuuuaau

SEQ ID NO: 1768162 - RNA, 21 nt, Salmonella enterica enterica serovar Typhi Ty2
auauucaugccagaagcaaau

SEQ ID NO: 1768163 - RNA, 13 nt, Salmonella enterica enterica serovar Typhi Ty2
auauucagaauuu

SEQ ID NO: 1768164 - RNA, 22 nt, Salmonella enterica enterica serovar Typhi Ty2
auauucagaauuuuuaaccauc

SEQ ID NO: 1768165 - RNA, 13 nt, Salmonella enterica enterica serovar Typhi Ty2
auauucaggagca

SEQ ID NO: 1768166 - RNA, 19 nt, Salmonella enterica enterica serovar Typhi Ty2
auauucaucaguuuaaccg

SEQ ID NO: 1768167 - RNA, 14 nt, Salmonella enterica enterica serovar Typhi Ty2
auaugauuuaaaaa

SEQ ID NO: 1768168 - RNA, 15 nt, Salmonella enterica enterica serovar Typhi Ty2
auaugauuuaaaaaa

SEQ ID NO: 1768169 - RNA, 16 nt, Salmonella enterica enterica serovar Typhi Ty2
auaugauuuaaaaaag

SEQ ID NO: 1768170 - RNA, 14 nt, Salmonella enterica enterica serovar Typhi Ty2
auaugcaggcauaa

SEQ ID NO: 1768171 - RNA, 17 nt, Salmonella enterica enterica serovar Typhi Ty2
auaugcaggcauaaaaa

SEQ ID NO: 1768172 - RNA, 19 nt, Salmonella enterica enterica serovar Typhi Ty2
auauuuguuggaaaugcgu

SEQ ID NO: 1768173 - RNA, 18 nt, Salmonella enterica enterica serovar Typhi Ty2
auauuugcgugucaucaa

SEQ ID NO: 1768174 - RNA, 19 nt, Salmonella enterica enterica serovar Typhi Ty2
auauuuucucaauuuuaca

SEQ ID NO: 1768175 - RNA, 12 nt, Salmonella enterica enterica serovar Typhi Ty2
auauuuucucaa

SEQ ID NO: 1768176 - RNA, 10 nt, Salmonella enterica enterica serovar Typhi Ty2
auauuuuuaa

SEQ ID NO: 1768177 - RNA, 21 nt, Salmonella enterica enterica serovar Typhi Ty2
auauuuuuaagguauugauuu

SEQ ID NO: 1768178 - RNA, 13 nt, Salmonella enterica enterica serovar Typhi Ty2
auauuuuguaguu

SEQ ID NO: 1768179 - RNA, 14 nt, Salmonella enterica enterica serovar Typhi Ty2
aucaaaacauuaga

SEQ ID NO: 1768180 - RNA, 20 nt, Salmonella enterica enterica serovar Typhi Ty2
auauuggcgaggaacaucag

SEQ ID NO: 1768181 - RNA, 15 nt, Salmonella enterica enterica serovar Typhi Ty2
auauuuaaaauucca

SEQ ID NO: 1768182 - RNA, 22 nt, Salmonella enterica enterica serovar Typhi Ty2
auauuuauuugcauuguacuuu

SEQ ID NO: 1768183 - RNA, 20 nt, Salmonella enterica enterica serovar Typhi Ty2
auauuuauuugcauuguacu

SEQ ID NO: 1768184 - RNA, 21 nt, Salmonella enterica enterica serovar Typhi Ty2
aucaagcagugacguggcuuc

SEQ ID NO: 1768185 - RNA, 17 nt, Salmonella enterica enterica serovar Typhi Ty2
aucaagcccacacauca

SEQ ID NO: 1768186 - RNA, 15 nt, Salmonella enterica enterica serovar Typhi Ty2
aucaagcccauguuc

SEQ ID NO: 1768187 - RNA, 22 nt, Salmonella enterica enterica serovar Typhi Ty2
aucaagcgguagcguuauccag

SEQ ID NO: 1768188 - RNA, 19 nt, Salmonella enterica enterica serovar Typhi Ty2
aucaauaaccgccagcagu

SEQ ID NO: 1768189 - RNA, 21 nt, Salmonella enterica enterica serovar Typhi Ty2
aucaauacagagauauuaaaa

SEQ ID NO: 1768190 - RNA, 17 nt, Salmonella enterica enterica serovar Typhi Ty2
aucaaucgcuaucugac

SEQ ID NO: 1768191 - RNA, 12 nt, Salmonella enterica enterica serovar Typhi Ty2
aucaaugcccag

SEQ ID NO: 1768192 - RNA, 20 nt, Salmonella enterica enterica serovar Typhi Ty2
aucaaugcgcguaauuugcg

SEQ ID NO: 1768193 - RNA, 22 nt, Salmonella enterica enterica serovar Typhi Ty2
aucaaugcccagcgcaaucacg

SEQ ID NO: 1768194 - RNA, 13 nt, Salmonella enterica enterica serovar Typhi Ty2
aucaaucaccuua

SEQ ID NO: 1768195 - RNA, 18 nt, Salmonella enterica enterica serovar Typhi Ty2
aucaaucaccucuucccc

SEQ ID NO: 1768196 - RNA, 13 nt, Salmonella enterica enterica serovar Typhi Ty2
aucaagaugcuac

SEQ ID NO: 1768197 - RNA, 17 nt, Salmonella enterica enterica serovar Typhi Ty2
aucaagauugaguccau

SEQ ID NO: 1768198 - RNA, 16 nt, Salmonella enterica enterica serovar Typhi Ty2
aucaaccggguaaacg

SEQ ID NO: 1768199 - RNA, 22 nt, Salmonella enterica enterica serovar Typhi Ty2
aucaacgaccaugguucccgcc

SEQ ID NO: 1768200 - RNA, 15 nt, Salmonella enterica enterica serovar Typhi Ty2
aucaaaaucaucgcc

SEQ ID NO: 1768201 - RNA, 20 nt, Salmonella enterica enterica serovar Typhi Ty2
aucaaaacuacgccaaugaa

SEQ ID NO: 1768202 - RNA, 20 nt, Salmonella enterica enterica serovar Typhi Ty2
aucaaacaggacuucucccu

SEQ ID NO: 1768203 - RNA, 22 nt, Salmonella enterica enterica serovar Typhi Ty2
aucaaaccauucccgucccugc

SEQ ID NO: 1768204 - RNA, 20 nt, Salmonella enterica enterica serovar Typhi Ty2
aucaacagcgugagcugucg

SEQ ID NO: 1768205 - RNA, 19 nt, Salmonella enterica enterica serovar Typhi Ty2
aucaacagcggagagacau

SEQ ID NO: 1768206 - RNA, 21 nt, Salmonella enterica enterica serovar Typhi Ty2
aucaaacuuuuaaauugaaga

SEQ ID NO: 1768207 - RNA, 14 nt, Salmonella enterica enterica serovar Typhi Ty2
aucaaacuucguua

SEQ ID NO: 1768208 - RNA, 13 nt, Salmonella enterica enterica serovar Typhi Ty2
aucaccggcauuu

SEQ ID NO: 1768209 - RNA, 18 nt, Salmonella enterica enterica serovar Typhi Ty2
aucaccgccagucccagc

SEQ ID NO: 1768210 - RNA, 22 nt, Salmonella enterica enterica serovar Typhi Ty2
aucaccgcugacugaacucauc

SEQ ID NO: 1768211 - RNA, 20 nt, Salmonella enterica enterica serovar Typhi Ty2
aucaauuccuuuuaauuuaa

SEQ ID NO: 1768212 - RNA, 19 nt, Salmonella enterica enterica serovar Typhi Ty2
aucaauggugaauuugcug

SEQ ID NO: 1768213 - RNA, 15 nt, Salmonella enterica enterica serovar Typhi Ty2
aucacgcccagcgcg

SEQ ID NO: 1768214 - RNA, 13 nt, Salmonella enterica enterica serovar Typhi Ty2
aucacgcccagcg

SEQ ID NO: 1768215 - RNA, 17 nt, Salmonella enterica enterica serovar Typhi Ty2
aucacgccguccagcac

SEQ ID NO: 1768216 - RNA, 18 nt, Salmonella enterica enterica serovar Typhi Ty2
aucacgccguccagcacc

SEQ ID NO: 1768217 - RNA, 13 nt, Salmonella enterica enterica serovar Typhi Ty2
aucacgcaucacu

SEQ ID NO: 1768218 - RNA, 15 nt, Salmonella enterica enterica serovar Typhi Ty2
aucacguagccagag

SEQ ID NO: 1768219 - RNA, 16 nt, Salmonella enterica enterica serovar Typhi Ty2
aucacgguaaaccugu

SEQ ID NO: 1768220 - RNA, 19 nt, Salmonella enterica enterica serovar Typhi Ty2
aucacgcguaucuggucau

SEQ ID NO: 1768221 - RNA, 18 nt, Salmonella enterica enterica serovar Typhi Ty2
aucacgcuggauaagacg

SEQ ID NO: 1768222 - RNA, 22 nt, Salmonella enterica enterica serovar Typhi Ty2
aucacgcuaagucaacucaugc

SEQ ID NO: 1768223 - RNA, 16 nt, Salmonella enterica enterica serovar Typhi Ty2
aucagaccgauaaaua

SEQ ID NO: 1768224 - RNA, 20 nt, Salmonella enterica enterica serovar Typhi Ty2
aucagaccgagacccagcgc

SEQ ID NO: 1768225 - RNA, 16 nt, Salmonella enterica enterica serovar Typhi Ty2
aucagaccgacaaaac

SEQ ID NO: 1768226 - RNA, 13 nt, Salmonella enterica enterica serovar Typhi Ty2
aucagaaaaaccu

SEQ ID NO: 1768227 - RNA, 15 nt, Salmonella enterica enterica serovar Typhi Ty2
aucagaaaaaccucc

SEQ ID NO: 1768228 - RNA, 20 nt, Salmonella enterica enterica serovar Typhi Ty2
aucagaaaaaauuacagccg

SEQ ID NO: 1768229 - RNA, 14 nt, Salmonella enterica enterica serovar Typhi Ty2
aucacuuuugauaa

SEQ ID NO: 1768230 - RNA, 13 nt, Salmonella enterica enterica serovar Typhi Ty2
aucagccaggagu

SEQ ID NO: 1768231 - RNA, 12 nt, Salmonella enterica enterica serovar Typhi Ty2
aucagccaggcg

SEQ ID NO: 1768232 - RNA, 13 nt, Salmonella enterica enterica serovar Typhi Ty2
aucagccauuaac

SEQ ID NO: 1768233 - RNA, 16 nt, Salmonella enterica enterica serovar Typhi Ty2
aucagcgcaauaaauu

SEQ ID NO: 1768234 - RNA, 15 nt, Salmonella enterica enterica serovar Typhi Ty2
aucagcaucccaccg

SEQ ID NO: 1768235 - RNA, 13 nt, Salmonella enterica enterica serovar Typhi Ty2
aucagcgccuccg

SEQ ID NO: 1768236 - RNA, 22 nt, Salmonella enterica enterica serovar Typhi Ty2
aucagcgcggcgugaucaaauu

SEQ ID NO: 1768237 - RNA, 14 nt, Salmonella enterica enterica serovar Typhi Ty2
aucagcgcgggaua

SEQ ID NO: 1768238 - RNA, 15 nt, Salmonella enterica enterica serovar Typhi Ty2
aucagcgccagcccu

SEQ ID NO: 1768239 - RNA, 18 nt, Salmonella enterica enterica serovar Typhi Ty2
aucagcgcguuuuccauc

SEQ ID NO: 1768240 - RNA, 22 nt, Salmonella enterica enterica serovar Typhi Ty2
aucagcuuugcggccagcauau

SEQ ID NO: 1768241 - RNA, 15 nt, Salmonella enterica enterica serovar Typhi Ty2
aucagacuaucuucg

SEQ ID NO: 1768242 - RNA, 14 nt, Salmonella enterica enterica serovar Typhi Ty2
aucagacuaucuuc

SEQ ID NO: 1768243 - RNA, 17 nt, Salmonella enterica enterica serovar Typhi Ty2
aucagaccuguaaaaaa

SEQ ID NO: 1768244 - RNA, 18 nt, Salmonella enterica enterica serovar Typhi Ty2
aucagaccgagacccagc

SEQ ID NO: 1768245 - RNA, 22 nt, Salmonella enterica enterica serovar Typhi Ty2
aucagacgccgggccugcgccu

SEQ ID NO: 1768246 - RNA, 12 nt, Salmonella enterica enterica serovar Typhi Ty2
aucagacgcauc

SEQ ID NO: 1768247 - RNA, 20 nt, Salmonella enterica enterica serovar Typhi Ty2
aucagauacggcuccagcac

SEQ ID NO: 1768248 - RNA, 20 nt, Salmonella enterica enterica serovar Typhi Ty2
aucagcaaaauaccggcagc

SEQ ID NO: 1768249 - RNA, 12 nt, Salmonella enterica enterica serovar Typhi Ty2
aucauaaaucga

SEQ ID NO: 1768250 - RNA, 19 nt, Salmonella enterica enterica serovar Typhi Ty2
aucaguggcggcaaaaaau

SEQ ID NO: 1768251 - RNA, 20 nt, Salmonella enterica enterica serovar Typhi Ty2
aucaguggcgccgcaaugcc

SEQ ID NO: 1768252 - RNA, 20 nt, Salmonella enterica enterica serovar Typhi Ty2
aucaguggcggcaaaaaaua

SEQ ID NO: 1768253 - RNA, 19 nt, Salmonella enterica enterica serovar Typhi Ty2
aucagugcaucuucacugu

SEQ ID NO: 1768254 - RNA, 17 nt, Salmonella enterica enterica serovar Typhi Ty2
aucagugcaucuucacu

SEQ ID NO: 1768255 - RNA, 21 nt, Salmonella enterica enterica serovar Typhi Ty2
aaaacgcucucuuuucuuacu

SEQ ID NO: 1768256 - RNA, 17 nt, Salmonella enterica enterica serovar Typhi Ty2
aucagugagaagggcag

SEQ ID NO: 1768257 - RNA, 21 nt, Salmonella enterica enterica serovar Typhi Ty2
aaaacgcguuagcguuuugaa

SEQ ID NO: 1768258 - RNA, 19 nt, Salmonella enterica enterica serovar Typhi Ty2
aaaacgcgcucgccagcgc

SEQ ID NO: 1768259 - RNA, 12 nt, Salmonella enterica enterica serovar Typhi Ty2
aaaacgccugcc

SEQ ID NO: 1768260 - RNA, 15 nt, Salmonella enterica enterica serovar Typhi Ty2
aaaacgcgcaaaacu

SEQ ID NO: 1768261 - RNA, 18 nt, Salmonella enterica enterica serovar Typhi Ty2
aaaacgcgcucgccagcg

SEQ ID NO: 1768262 - RNA, 23 nt, Salmonella enterica enterica serovar Typhi Ty2
aaaacgcccccugccagcgcuga

SEQ ID NO: 1768263 - RNA, 21 nt, Salmonella enterica enterica serovar Typhi Ty2
aucaggcguuacagacgcugc

SEQ ID NO: 1768264 - RNA, 17 nt, Salmonella enterica enterica serovar Typhi Ty2
aucaggcgugaugacuu

SEQ ID NO: 1768265 - RNA, 20 nt, Salmonella enterica enterica serovar Typhi Ty2
aucaggcgucagcauggugu

SEQ ID NO: 1768266 - RNA, 20 nt, Salmonella enterica enterica serovar Typhi Ty2
aucaggccuacauccggcuc

SEQ ID NO: 1768267 - RNA, 16 nt, Salmonella enterica enterica serovar Typhi Ty2
aucaggccuacaaggc

SEQ ID NO: 1768268 - RNA, 19 nt, Salmonella enterica enterica serovar Typhi Ty2
aucaggccugcaaaccucu

SEQ ID NO: 1768269 - RNA, 13 nt, Salmonella enterica enterica serovar Typhi Ty2
aucaggccugccu

SEQ ID NO: 1768270 - RNA, 13 nt, Salmonella enterica enterica serovar Typhi Ty2
aucaggcccagua

SEQ ID NO: 1768271 - RNA, 18 nt, Salmonella enterica enterica serovar Typhi Ty2
aucaggcaugccaaacca

SEQ ID NO: 1768272 - RNA, 19 nt, Salmonella enterica enterica serovar Typhi Ty2
aucaggcauucagcggguu

SEQ ID NO: 1768273 - RNA, 21 nt, Salmonella enterica enterica serovar Typhi Ty2
aucaggccuacaagaauuuau

SEQ ID NO: 1768274 - RNA, 19 nt, Salmonella enterica enterica serovar Typhi Ty2
aucaggccgacaaaugacg

SEQ ID NO: 1768275 - RNA, 22 nt, Salmonella enterica enterica serovar Typhi Ty2
aucaggaaauucucagaaacaa

SEQ ID NO: 1768276 - RNA, 21 nt, Salmonella enterica enterica serovar Typhi Ty2
aucaggaaaaagggaauaaua

SEQ ID NO: 1768277 - RNA, 13 nt, Salmonella enterica enterica serovar Typhi Ty2
aucaggacaucaa

SEQ ID NO: 1768278 - RNA, 20 nt, Salmonella enterica enterica serovar Typhi Ty2
aucaucccgcccagcaacac

SEQ ID NO: 1768279 - RNA, 17 nt, Salmonella enterica enterica serovar Typhi Ty2
aucauccagucagcaau

SEQ ID NO: 1768280 - RNA, 16 nt, Salmonella enterica enterica serovar Typhi Ty2
aucauccugauuuuac

SEQ ID NO: 1768281 - RNA, 20 nt, Salmonella enterica enterica serovar Typhi Ty2
aucauccgggcauaaaaaaa

SEQ ID NO: 1768282 - RNA, 14 nt, Salmonella enterica enterica serovar Typhi Ty2
aaaacguugcugga

SEQ ID NO: 1768283 - RNA, 22 nt, Salmonella enterica enterica serovar Typhi Ty2
aucaucgcauugagcaggggcu

SEQ ID NO: 1768284 - RNA, 18 nt, Salmonella enterica enterica serovar Typhi Ty2
aucaucaaguaccgugaa

SEQ ID NO: 1768285 - RNA, 14 nt, Salmonella enterica enterica serovar Typhi Ty2
aucaucaucggcac

SEQ ID NO: 1768286 - RNA, 20 nt, Salmonella enterica enterica serovar Typhi Ty2
aucaucaucggcacagccag

SEQ ID NO: 1768287 - RNA, 23 nt, Salmonella enterica enterica serovar Typhi Ty2
aucaucaggguuauccuccagcc

SEQ ID NO: 1768288 - RNA, 16 nt, Salmonella enterica enterica serovar Typhi Ty2
aucaucauaucccggc

SEQ ID NO: 1768289 - RNA, 15 nt, Salmonella enterica enterica serovar Typhi Ty2
auaugaauaaacugu

SEQ ID NO: 1768290 - RNA, 20 nt, Salmonella enterica enterica serovar Typhi Ty2
auaugaauuauuuucuaaaa

SEQ ID NO: 1768291 - RNA, 18 nt, Salmonella enterica enterica serovar Typhi Ty2
auaugacaacacucacaa

SEQ ID NO: 1768292 - RNA, 19 nt, Salmonella enterica enterica serovar Typhi Ty2
auaugaucugcgcaacauu

SEQ ID NO: 1768293 - RNA, 18 nt, Salmonella enterica enterica serovar Typhi Ty2
auaugaucugcacaacau

SEQ ID NO: 1768294 - RNA, 23 nt, Salmonella enterica enterica serovar Typhi Ty2
auaugauauguguaucuugcuuu

SEQ ID NO: 1768295 - RNA, 18 nt, Salmonella enterica enterica serovar Typhi Ty2
auaugaguacuacugaua

SEQ ID NO: 1768296 - RNA, 14 nt, Salmonella enterica enterica serovar Typhi Ty2
auaugaaagagaaa

SEQ ID NO: 1768297 - RNA, 15 nt, Salmonella enterica enterica serovar Typhi Ty2
auaugaaagagaaau

SEQ ID NO: 1768298 - RNA, 20 nt, Salmonella enterica enterica serovar Typhi Ty2
auaucuguuucauggagauc

SEQ ID NO: 1768299 - RNA, 11 nt, Salmonella enterica enterica serovar Typhi Ty2
auaucucuauu

SEQ ID NO: 1768300 - RNA, 21 nt, Salmonella enterica enterica serovar Typhi Ty2
auaucugagcugguuucuccg

SEQ ID NO: 1768301 - RNA, 18 nt, Salmonella enterica enterica serovar Typhi Ty2
auaucucuacccuauugu

SEQ ID NO: 1768302 - RNA, 19 nt, Salmonella enterica enterica serovar Typhi Ty2
auaucgccuugcugcggca

SEQ ID NO: 1768303 - RNA, 17 nt, Salmonella enterica enterica serovar Typhi Ty2
auaucgccuggugugaa

SEQ ID NO: 1768304 - RNA, 13 nt, Salmonella enterica enterica serovar Typhi Ty2
auaucgccauaca

SEQ ID NO: 1768305 - RNA, 15 nt, Salmonella enterica enterica serovar Typhi Ty2
auaucgcuaaaccaa

SEQ ID NO: 1768306 - RNA, 18 nt, Salmonella enterica enterica serovar Typhi Ty2
auaucgcuaaccaaacca

SEQ ID NO: 1768307 - RNA, 13 nt, Salmonella enterica enterica serovar Typhi Ty2
auaucgcgcggca

SEQ ID NO: 1768308 - RNA, 15 nt, Salmonella enterica enterica serovar Typhi Ty2
auaucgcgucaucaa

SEQ ID NO: 1768309 - RNA, 20 nt, Salmonella enterica enterica serovar Typhi Ty2
auaucgguucaauacccuuu

SEQ ID NO: 1768310 - RNA, 14 nt, Salmonella enterica enterica serovar Typhi Ty2
auaucggcugcugu

SEQ ID NO: 1768311 - RNA, 18 nt, Salmonella enterica enterica serovar Typhi Ty2
auaucccggcugacauaa

SEQ ID NO: 1768312 - RNA, 14 nt, Salmonella enterica enterica serovar Typhi Ty2
auaucccgcaagaa

SEQ ID NO: 1768313 - RNA, 17 nt, Salmonella enterica enterica serovar Typhi Ty2
auaucgauagcauuuuu

SEQ ID NO: 1768314 - RNA, 20 nt, Salmonella enterica enterica serovar Typhi Ty2
auaucgacauaaguaaauaa

SEQ ID NO: 1768315 - RNA, 13 nt, Salmonella enterica enterica serovar Typhi Ty2
auaucaucaucuc

SEQ ID NO: 1768316 - RNA, 20 nt, Salmonella enterica enterica serovar Typhi Ty2
auauccaguugcgccagcgu

SEQ ID NO: 1768317 - RNA, 23 nt, Salmonella enterica enterica serovar Typhi Ty2
auauccauugggggguuagugcu

SEQ ID NO: 1768318 - RNA, 17 nt, Salmonella enterica enterica serovar Typhi Ty2
auauauuuacugaauaa

SEQ ID NO: 1768319 - RNA, 15 nt, Salmonella enterica enterica serovar Typhi Ty2
auauacuucaccaua

SEQ ID NO: 1768320 - RNA, 13 nt, Salmonella enterica enterica serovar Typhi Ty2
auauacuucauca

SEQ ID NO: 1768321 - RNA, 11 nt, Salmonella enterica enterica serovar Typhi Ty2
auauaucucua

SEQ ID NO: 1768322 - RNA, 18 nt, Salmonella enterica enterica serovar Typhi Ty2
auauaucgcgucaucaaa

SEQ ID NO: 1768323 - RNA, 21 nt, Salmonella enterica enterica serovar Typhi Ty2
auauaucgcaggaugcgcugc

SEQ ID NO: 1768324 - RNA, 20 nt, Salmonella enterica enterica serovar Typhi Ty2
auauauccgcuauuaccagu

SEQ ID NO: 1768325 - RNA, 16 nt, Salmonella enterica enterica serovar Typhi Ty2
auauauccuaacuuau

SEQ ID NO: 1768326 - RNA, 19 nt, Salmonella enterica enterica serovar Typhi Ty2
auauaagcgguauucaggu

SEQ ID NO: 1768327 - RNA, 20 nt, Salmonella enterica enterica serovar Typhi Ty2
auauaagcgguauucagguu

SEQ ID NO: 1768328 - RNA, 16 nt, Salmonella enterica enterica serovar Typhi Ty2
auauaaggugucuaua

SEQ ID NO: 1768329 - RNA, 15 nt, Salmonella enterica enterica serovar Typhi Ty2
auauaaggugucuau

SEQ ID NO: 1768330 - RNA, 15 nt, Salmonella enterica enterica serovar Typhi Ty2
auauacccccugcaa

SEQ ID NO: 1768331 - RNA, 14 nt, Salmonella enterica enterica serovar Typhi Ty2
auagcugaacauac

SEQ ID NO: 1768332 - RNA, 20 nt, Salmonella enterica enterica serovar Typhi Ty2
auagcuaaugcgguugcgau

SEQ ID NO: 1768333 - RNA, 15 nt, Salmonella enterica enterica serovar Typhi Ty2
auagcuaaugcaaua

SEQ ID NO: 1768334 - RNA, 14 nt, Salmonella enterica enterica serovar Typhi Ty2
auagugacuucugc

SEQ ID NO: 1768335 - RNA, 14 nt, Salmonella enterica enterica serovar Typhi Ty2
auagugauaccagu

SEQ ID NO: 1768336 - RNA, 23 nt, Salmonella enterica enterica serovar Typhi Ty2
auagucuuguuacucaauaaaag

SEQ ID NO: 1768337 - RNA, 22 nt, Salmonella enterica enterica serovar Typhi Ty2
auagucuuguuacucaauaaaa

SEQ ID NO: 1768338 - RNA, 19 nt, Salmonella enterica enterica serovar Typhi Ty2
auagucuuaauuugcuguu

SEQ ID NO: 1768339 - RNA, 23 nt, Salmonella enterica enterica serovar Typhi Ty2
auaguggcgcgacgcgucaguga

SEQ ID NO: 1768340 - RNA, 21 nt, Salmonella enterica enterica serovar Typhi Ty2
auagugcucauucguuuugcu

SEQ ID NO: 1768341 - RNA, 18 nt, Salmonella enterica enterica serovar Typhi Ty2
auaguuuuuaauuccacc

SEQ ID NO: 1768342 - RNA, 18 nt, Salmonella enterica enterica serovar Typhi Ty2
auauaaaaagccagggaa

SEQ ID NO: 1768343 - RNA, 19 nt, Salmonella enterica enterica serovar Typhi Ty2
auauaaaccggaacauaca

SEQ ID NO: 1768344 - RNA, 19 nt, Salmonella enterica enterica serovar Typhi Ty2
auaguuucgucgugaauua

SEQ ID NO: 1768345 - RNA, 21 nt, Salmonella enterica enterica serovar Typhi Ty2
auaguuucgacuuucauuucu

SEQ ID NO: 1768346 - RNA, 12 nt, Salmonella enterica enterica serovar Typhi Ty2
auaguuugcaua

SEQ ID NO: 1768347 - RNA, 19 nt, Salmonella enterica enterica serovar Typhi Ty2
auaguucaucgugaaauua

SEQ ID NO: 1768348 - RNA, 15 nt, Salmonella enterica enterica serovar Typhi Ty2
auagacgcuacugug

SEQ ID NO: 1768349 - RNA, 15 nt, Salmonella enterica enterica serovar Typhi Ty2
auagacgccgaaccu

SEQ ID NO: 1768350 - RNA, 17 nt, Salmonella enterica enterica serovar Typhi Ty2
auagacuucacuuuccc

SEQ ID NO: 1768351 - RNA, 12 nt, Salmonella enterica enterica serovar Typhi Ty2
auagacuccguc

SEQ ID NO: 1768352 - RNA, 17 nt, Salmonella enterica enterica serovar Typhi Ty2
auagaaaauauaugaca

SEQ ID NO: 1768353 - RNA, 12 nt, Salmonella enterica enterica serovar Typhi Ty2
auacuuuuacuc

SEQ ID NO: 1768354 - RNA, 15 nt, Salmonella enterica enterica serovar Typhi Ty2
auagauaaguccuaa

SEQ ID NO: 1768355 - RNA, 20 nt, Salmonella enterica enterica serovar Typhi Ty2
auagauauaacccaguucaa

SEQ ID NO: 1768356 - RNA, 22 nt, Salmonella enterica enterica serovar Typhi Ty2
auagauaucaaacacaaauuuc

SEQ ID NO: 1768357 - RNA, 13 nt, Salmonella enterica enterica serovar Typhi Ty2
auagauuugauuc

SEQ ID NO: 1768358 - RNA, 21 nt, Salmonella enterica enterica serovar Typhi Ty2
auagccgguaacuuucccgcu

SEQ ID NO: 1768359 - RNA, 16 nt, Salmonella enterica enterica serovar Typhi Ty2
auagccgguaacuuuc

SEQ ID NO: 1768360 - RNA, 17 nt, Salmonella enterica enterica serovar Typhi Ty2
auagccagcccccugcc

SEQ ID NO: 1768361 - RNA, 13 nt, Salmonella enterica enterica serovar Typhi Ty2
auagccaaaagcu

SEQ ID NO: 1768362 - RNA, 20 nt, Salmonella enterica enterica serovar Typhi Ty2
auagccaacacauaagccac

SEQ ID NO: 1768363 - RNA, 18 nt, Salmonella enterica enterica serovar Typhi Ty2
auagccagcccccugcca

SEQ ID NO: 1768364 - RNA, 14 nt, Salmonella enterica enterica serovar Typhi Ty2
auagccagaaugcc

SEQ ID NO: 1768365 - RNA, 14 nt, Salmonella enterica enterica serovar Typhi Ty2
auagccacaggcug

SEQ ID NO: 1768366 - RNA, 16 nt, Salmonella enterica enterica serovar Typhi Ty2
auagcguugauaugcu

SEQ ID NO: 1768367 - RNA, 13 nt, Salmonella enterica enterica serovar Typhi Ty2
auagcguuuucca

SEQ ID NO: 1768368 - RNA, 22 nt, Salmonella enterica enterica serovar Typhi Ty2
auagcgguacccggucccuggc

SEQ ID NO: 1768369 - RNA, 18 nt, Salmonella enterica enterica serovar Typhi Ty2
auagcgaggcagcaggau

SEQ ID NO: 1768370 - RNA, 14 nt, Salmonella enterica enterica serovar Typhi Ty2
auagcggguaaaca

SEQ ID NO: 1768371 - RNA, 13 nt, Salmonella enterica enterica serovar Typhi Ty2
auagccugggcaa

SEQ ID NO: 1768372 - RNA, 13 nt, Salmonella enterica enterica serovar Typhi Ty2
auagcagcaaauu

SEQ ID NO: 1768373 - RNA, 19 nt, Salmonella enterica enterica serovar Typhi Ty2
auagcauuaagcugauauu

SEQ ID NO: 1768374 - RNA, 22 nt, Salmonella enterica enterica serovar Typhi Ty2
auagcauggcguguaguaaugc

SEQ ID NO: 1768375 - RNA, 15 nt, Salmonella enterica enterica serovar Typhi Ty2
auagcauuaagcuga

SEQ ID NO: 1768376 - RNA, 16 nt, Salmonella enterica enterica serovar Typhi Ty2
auagcaucuuccucug

SEQ ID NO: 1768377 - RNA, 20 nt, Salmonella enterica enterica serovar Typhi Ty2
auagcaucggucaacugaau

SEQ ID NO: 1768378 - RNA, 20 nt, Salmonella enterica enterica serovar Typhi Ty2
auagcaauuaauaaacaaug

SEQ ID NO: 1768379 - RNA, 15 nt, Salmonella enterica enterica serovar Typhi Ty2
auagcaaucauccug

SEQ ID NO: 1768380 - RNA, 22 nt, Salmonella enterica enterica serovar Typhi Ty2
auacuauccaacagaaggcuuc

SEQ ID NO: 1768381 - RNA, 15 nt, Salmonella enterica enterica serovar Typhi Ty2
auacgcugaagcuug

SEQ ID NO: 1768382 - RNA, 13 nt, Salmonella enterica enterica serovar Typhi Ty2
auacgcugaagcu

SEQ ID NO: 1768383 - RNA, 20 nt, Salmonella enterica enterica serovar Typhi Ty2
auacgcgucaaauagagaaa

SEQ ID NO: 1768384 - RNA, 12 nt, Salmonella enterica enterica serovar Typhi Ty2
auacgcugaaga

SEQ ID NO: 1768385 - RNA, 16 nt, Salmonella enterica enterica serovar Typhi Ty2
auacgcgucagccuac

SEQ ID NO: 1768386 - RNA, 14 nt, Salmonella enterica enterica serovar Typhi Ty2
auacgcucaauaua

SEQ ID NO: 1768387 - RNA, 15 nt, Salmonella enterica enterica serovar Typhi Ty2
auacuccacaguuca

SEQ ID NO: 1768388 - RNA, 14 nt, Salmonella enterica enterica serovar Typhi Ty2
auacuccagcagac

SEQ ID NO: 1768389 - RNA, 19 nt, Salmonella enterica enterica serovar Typhi Ty2
auacucagcgacguaaucu

SEQ ID NO: 1768390 - RNA, 23 nt, Salmonella enterica enterica serovar Typhi Ty2
auacucagcgacguaaucuauuc

SEQ ID NO: 1768391 - RNA, 20 nt, Salmonella enterica enterica serovar Typhi Ty2
auacucugcuuuuucacccu

SEQ ID NO: 1768392 - RNA, 14 nt, Salmonella enterica enterica serovar Typhi Ty2
auacucugcuuuuu

SEQ ID NO: 1768393 - RNA, 20 nt, Salmonella enterica enterica serovar Typhi Ty2
auacuccugcaacagaagag

SEQ ID NO: 1768394 - RNA, 16 nt, Salmonella enterica enterica serovar Typhi Ty2
auacugccgcccaucg

SEQ ID NO: 1768395 - RNA, 13 nt, Salmonella enterica enterica serovar Typhi Ty2
auacugccgccgu

SEQ ID NO: 1768396 - RNA, 14 nt, Salmonella enterica enterica serovar Typhi Ty2
auacuggaaaaaac

SEQ ID NO: 1768397 - RNA, 22 nt, Salmonella enterica enterica serovar Typhi Ty2
auacugggcgcaugaggccugu

SEQ ID NO: 1768398 - RNA, 23 nt, Salmonella enterica enterica serovar Typhi Ty2
auacuuaauucauaacgaccuuu

SEQ ID NO: 1768399 - RNA, 13 nt, Salmonella enterica enterica serovar Typhi Ty2
auacuucaucagg

SEQ ID NO: 1768400 - RNA, 19 nt, Salmonella enterica enterica serovar Typhi Ty2
auacuuauugauccacgga

SEQ ID NO: 1768401 - RNA, 18 nt, Salmonella enterica enterica serovar Typhi Ty2
auaccgccugaugagguu

SEQ ID NO: 1768402 - RNA, 17 nt, Salmonella enterica enterica serovar Typhi Ty2
auaccgcguuugcgcaa

SEQ ID NO: 1768403 - RNA, 16 nt, Salmonella enterica enterica serovar Typhi Ty2
auaccgcuuuguaaaa

SEQ ID NO: 1768404 - RNA, 23 nt, Salmonella enterica enterica serovar Typhi Ty2
auacaggcauggccuucaaucag

SEQ ID NO: 1768405 - RNA, 16 nt, Salmonella enterica enterica serovar Typhi Ty2
auacaggaagccggug

SEQ ID NO: 1768406 - RNA, 17 nt, Salmonella enterica enterica serovar Typhi Ty2
auaccucaaaugcugaa

SEQ ID NO: 1768407 - RNA, 20 nt, Salmonella enterica enterica serovar Typhi Ty2
auaccgcuuuguaaaacauu

SEQ ID NO: 1768408 - RNA, 15 nt, Salmonella enterica enterica serovar Typhi Ty2
auaccggaggagugc

SEQ ID NO: 1768409 - RNA, 14 nt, Salmonella enterica enterica serovar Typhi Ty2
auacgaaauugaga

SEQ ID NO: 1768410 - RNA, 21 nt, Salmonella enterica enterica serovar Typhi Ty2
auaccuucuucacuaaaaaca

SEQ ID NO: 1768411 - RNA, 22 nt, Salmonella enterica enterica serovar Typhi Ty2
auaccuucuucacuaaaaacag

SEQ ID NO: 1768412 - RNA, 22 nt, Salmonella enterica enterica serovar Typhi Ty2
auaccuucgugaugugguugug

SEQ ID NO: 1768413 - RNA, 23 nt, Salmonella enterica enterica serovar Typhi Ty2
auacgccagccgucaugauguuu

SEQ ID NO: 1768414 - RNA, 14 nt, Salmonella enterica enterica serovar Typhi Ty2
auacgccaucuuuc

SEQ ID NO: 1768415 - RNA, 18 nt, Salmonella enterica enterica serovar Typhi Ty2
auacgccgccagcaauac

SEQ ID NO: 1768416 - RNA, 22 nt, Salmonella enterica enterica serovar Typhi Ty2
auacgcagaucuuuuugcuccu

SEQ ID NO: 1768417 - RNA, 17 nt, Salmonella enterica enterica serovar Typhi Ty2
auacgcaccagcucuac

SEQ ID NO: 1768418 - RNA, 12 nt, Salmonella enterica enterica serovar Typhi Ty2
auacgcaccagc

SEQ ID NO: 1768419 - RNA, 15 nt, Salmonella enterica enterica serovar Typhi Ty2
aucgacaaaccacug

SEQ ID NO: 1768420 - RNA, 22 nt, Salmonella enterica enterica serovar Typhi Ty2
aucgacaaaagauuuaucaauu

SEQ ID NO: 1768421 - RNA, 22 nt, Salmonella enterica enterica serovar Typhi Ty2
aucgaaucguucgccagugaca

SEQ ID NO: 1768422 - RNA, 16 nt, Salmonella enterica enterica serovar Typhi Ty2
aucgaauccagcaggc

SEQ ID NO: 1768423 - RNA, 19 nt, Salmonella enterica enterica serovar Typhi Ty2
aucgacauaaguaaauaac

SEQ ID NO: 1768424 - RNA, 14 nt, Salmonella enterica enterica serovar Typhi Ty2
aucgacaucuucau

SEQ ID NO: 1768425 - RNA, 16 nt, Salmonella enterica enterica serovar Typhi Ty2
aucgacaucuucauca

SEQ ID NO: 1768426 - RNA, 15 nt, Salmonella enterica enterica serovar Typhi Ty2
aucgacauuaugauc

SEQ ID NO: 1768427 - RNA, 22 nt, Salmonella enterica enterica serovar Typhi Ty2
aucgacccccaccucaaucacc

SEQ ID NO: 1768428 - RNA, 16 nt, Salmonella enterica enterica serovar Typhi Ty2
aucgagucaggcgcca

SEQ ID NO: 1768429 - RNA, 23 nt, Salmonella enterica enterica serovar Typhi Ty2
aucgacuggcggaauggcgggcg

SEQ ID NO: 1768430 - RNA, 16 nt, Salmonella enterica enterica serovar Typhi Ty2
aucgccacaugcggca

SEQ ID NO: 1768431 - RNA, 14 nt, Salmonella enterica enterica serovar Typhi Ty2
aucgccagauaaau

SEQ ID NO: 1768432 - RNA, 12 nt, Salmonella enterica enterica serovar Typhi Ty2
aucgccagcgcg

SEQ ID NO: 1768433 - RNA, 21 nt, Salmonella enterica enterica serovar Typhi Ty2
aucgauccacuucccauucuc

SEQ ID NO: 1768434 - RNA, 14 nt, Salmonella enterica enterica serovar Typhi Ty2
aucgauaagccagc

SEQ ID NO: 1768435 - RNA, 12 nt, Salmonella enterica enterica serovar Typhi Ty2
aucgccaaagcg

SEQ ID NO: 1768436 - RNA, 13 nt, Salmonella enterica enterica serovar Typhi Ty2
aucgccaaaccag

SEQ ID NO: 1768437 - RNA, 12 nt, Salmonella enterica enterica serovar Typhi Ty2
aucgccaaacca

SEQ ID NO: 1768438 - RNA, 19 nt, Salmonella enterica enterica serovar Typhi Ty2
auccugcucaucgacagaa

SEQ ID NO: 1768439 - RNA, 14 nt, Salmonella enterica enterica serovar Typhi Ty2
auccugccgcacca

SEQ ID NO: 1768440 - RNA, 20 nt, Salmonella enterica enterica serovar Typhi Ty2
auccugcgggaugcguaauc

SEQ ID NO: 1768441 - RNA, 21 nt, Salmonella enterica enterica serovar Typhi Ty2
auccugcgccauugcgggagc

SEQ ID NO: 1768442 - RNA, 15 nt, Salmonella enterica enterica serovar Typhi Ty2
auccggauauucugc

SEQ ID NO: 1768443 - RNA, 19 nt, Salmonella enterica enterica serovar Typhi Ty2
auccugcaccgccugcggc

SEQ ID NO: 1768444 - RNA, 22 nt, Salmonella enterica enterica serovar Typhi Ty2
auccgcgcauacucuuccguca

SEQ ID NO: 1768445 - RNA, 14 nt, Salmonella enterica enterica serovar Typhi Ty2
auccgcgccgccgc

SEQ ID NO: 1768446 - RNA, 18 nt, Salmonella enterica enterica serovar Typhi Ty2
auccgcgccggguuuggc

SEQ ID NO: 1768447 - RNA, 21 nt, Salmonella enterica enterica serovar Typhi Ty2
auccuucuaccuucaccccca

SEQ ID NO: 1768448 - RNA, 11 nt, Salmonella enterica enterica serovar Typhi Ty2
auccuucgccg

SEQ ID NO: 1768449 - RNA, 21 nt, Salmonella enterica enterica serovar Typhi Ty2
auccugucgggcguaccauuu

SEQ ID NO: 1768450 - RNA, 16 nt, Salmonella enterica enterica serovar Typhi Ty2
aucgaacugugagccu

SEQ ID NO: 1768451 - RNA, 16 nt, Salmonella enterica enterica serovar Typhi Ty2
auccuugcacgccaaa

SEQ ID NO: 1768452 - RNA, 16 nt, Salmonella enterica enterica serovar Typhi Ty2
aucgaaagagcaaaua

SEQ ID NO: 1768453 - RNA, 22 nt, Salmonella enterica enterica serovar Typhi Ty2
aucggcgcuacggcguuucacu

SEQ ID NO: 1768454 - RNA, 22 nt, Salmonella enterica enterica serovar Typhi Ty2
aucggcgccggggugcuguucu

SEQ ID NO: 1768455 - RNA, 14 nt, Salmonella enterica enterica serovar Typhi Ty2
aucggccugaaugc

SEQ ID NO: 1768456 - RNA, 14 nt, Salmonella enterica enterica serovar Typhi Ty2
aucggccugcucuu

SEQ ID NO: 1768457 - RNA, 20 nt, Salmonella enterica enterica serovar Typhi Ty2
aucggcguugccuggccucc

SEQ ID NO: 1768458 - RNA, 16 nt, Salmonella enterica enterica serovar Typhi Ty2
aucggcucagcaauca

SEQ ID NO: 1768459 - RNA, 21 nt, Salmonella enterica enterica serovar Typhi Ty2
aucgggaucagaaauucgcag

SEQ ID NO: 1768460 - RNA, 22 nt, Salmonella enterica enterica serovar Typhi Ty2
aucgggacaaucaccaucccau

SEQ ID NO: 1768461 - RNA, 16 nt, Salmonella enterica enterica serovar Typhi Ty2
aucgggcaauccauua

SEQ ID NO: 1768462 - RNA, 18 nt, Salmonella enterica enterica serovar Typhi Ty2
aucgggcuguugaauauc

SEQ ID NO: 1768463 - RNA, 20 nt, Salmonella enterica enterica serovar Typhi Ty2
aucggucugcuucagccacu

SEQ ID NO: 1768464 - RNA, 21 nt, Salmonella enterica enterica serovar Typhi Ty2
aucgguaauugcgccguucac

SEQ ID NO: 1768465 - RNA, 18 nt, Salmonella enterica enterica serovar Typhi Ty2
aucgguauaacuggucau

SEQ ID NO: 1768466 - RNA, 22 nt, Salmonella enterica enterica serovar Typhi Ty2
aucguagcgugcgcaauauggu

SEQ ID NO: 1768467 - RNA, 16 nt, Salmonella enterica enterica serovar Typhi Ty2
aucguaccaauaccca

SEQ ID NO: 1768468 - RNA, 20 nt, Salmonella enterica enterica serovar Typhi Ty2
aucguagacuaagguuuugu

SEQ ID NO: 1768469 - RNA, 23 nt, Salmonella enterica enterica serovar Typhi Ty2
aucguagcaucucuucgacaucu

SEQ ID NO: 1768470 - RNA, 14 nt, Salmonella enterica enterica serovar Typhi Ty2
aucguaagccaccg

SEQ ID NO: 1768471 - RNA, 19 nt, Salmonella enterica enterica serovar Typhi Ty2
aucguaagccgcauuacaa

SEQ ID NO: 1768472 - RNA, 22 nt, Salmonella enterica enterica serovar Typhi Ty2
aucguaaugauuacggaacaaa

SEQ ID NO: 1768473 - RNA, 14 nt, Salmonella enterica enterica serovar Typhi Ty2
aucgguucucugcc

SEQ ID NO: 1768474 - RNA, 16 nt, Salmonella enterica enterica serovar Typhi Ty2
aucgguucucugccau

SEQ ID NO: 1768475 - RNA, 17 nt, Salmonella enterica enterica serovar Typhi Ty2
aucguaaaaugaaaaac

SEQ ID NO: 1768476 - RNA, 22 nt, Salmonella enterica enterica serovar Typhi Ty2
aucgcuuugcagaaaauccuuc

SEQ ID NO: 1768477 - RNA, 17 nt, Salmonella enterica enterica serovar Typhi Ty2
aucgcuuugcagaaaau

SEQ ID NO: 1768478 - RNA, 23 nt, Salmonella enterica enterica serovar Typhi Ty2
aucgcuuuaacgcugcaaaguua

SEQ ID NO: 1768479 - RNA, 15 nt, Salmonella enterica enterica serovar Typhi Ty2
aucgcuugcccagca

SEQ ID NO: 1768480 - RNA, 18 nt, Salmonella enterica enterica serovar Typhi Ty2
aucgcuccauucugucga

SEQ ID NO: 1768481 - RNA, 16 nt, Salmonella enterica enterica serovar Typhi Ty2
aucgcucaacuccugc

SEQ ID NO: 1768482 - RNA, 13 nt, Salmonella enterica enterica serovar Typhi Ty2
aucgcuccggaac

SEQ ID NO: 1768483 - RNA, 13 nt, Salmonella enterica enterica serovar Typhi Ty2
aucggccagcagg

SEQ ID NO: 1768484 - RNA, 18 nt, Salmonella enterica enterica serovar Typhi Ty2
aucggccaggauggcccg

SEQ ID NO: 1768485 - RNA, 22 nt, Salmonella enterica enterica serovar Typhi Ty2
aucggcaucuuuaaccgccugc

SEQ ID NO: 1768486 - RNA, 14 nt, Salmonella enterica enterica serovar Typhi Ty2
aucggaccuccgcg

SEQ ID NO: 1768487 - RNA, 16 nt, Salmonella enterica enterica serovar Typhi Ty2
aucggaaaggugugaa

SEQ ID NO: 1768488 - RNA, 15 nt, Salmonella enterica enterica serovar Typhi Ty2
aucgccgccagcuca

SEQ ID NO: 1768489 - RNA, 21 nt, Salmonella enterica enterica serovar Typhi Ty2
aucgccgcccaguggcaaaau

SEQ ID NO: 1768490 - RNA, 16 nt, Salmonella enterica enterica serovar Typhi Ty2
aucgccgaagcggcag

SEQ ID NO: 1768491 - RNA, 17 nt, Salmonella enterica enterica serovar Typhi Ty2
aucgcccggccuccggu

SEQ ID NO: 1768492 - RNA, 13 nt, Salmonella enterica enterica serovar Typhi Ty2
aucgcuaaucagg

SEQ ID NO: 1768493 - RNA, 15 nt, Salmonella enterica enterica serovar Typhi Ty2
aucgcuaauuuuuaa

SEQ ID NO: 1768494 - RNA, 17 nt, Salmonella enterica enterica serovar Typhi Ty2
aucgcuaaacauauacc

SEQ ID NO: 1768495 - RNA, 19 nt, Salmonella enterica enterica serovar Typhi Ty2
aucgcgccggucgccagca

SEQ ID NO: 1768496 - RNA, 15 nt, Salmonella enterica enterica serovar Typhi Ty2
aucgcgcugauauuu

SEQ ID NO: 1768497 - RNA, 14 nt, Salmonella enterica enterica serovar Typhi Ty2
aucccugcaaacua

SEQ ID NO: 1768498 - RNA, 18 nt, Salmonella enterica enterica serovar Typhi Ty2
aucccuguucaaaagccu

SEQ ID NO: 1768499 - RNA, 20 nt, Salmonella enterica enterica serovar Typhi Ty2
aucccuguucaaaagccugu

SEQ ID NO: 1768500 - RNA, 13 nt, Salmonella enterica enterica serovar Typhi Ty2
auccgaagaacca

SEQ ID NO: 1768501 - RNA, 14 nt, Salmonella enterica enterica serovar Typhi Ty2
aucccgucccacca

SEQ ID NO: 1768502 - RNA, 15 nt, Salmonella enterica enterica serovar Typhi Ty2
aucccgucccaccac

SEQ ID NO: 1768503 - RNA, 19 nt, Salmonella enterica enterica serovar Typhi Ty2
aucccgggcgauaaaccag

SEQ ID NO: 1768504 - RNA, 14 nt, Salmonella enterica enterica serovar Typhi Ty2
aucccuaauaaaau

SEQ ID NO: 1768505 - RNA, 21 nt, Salmonella enterica enterica serovar Typhi Ty2
aucccguuuucgucccagcgc

SEQ ID NO: 1768506 - RNA, 13 nt, Salmonella enterica enterica serovar Typhi Ty2
aucccucaccucc

SEQ ID NO: 1768507 - RNA, 22 nt, Salmonella enterica enterica serovar Typhi Ty2
aucccuccaccagcuucaugcu

SEQ ID NO: 1768508 - RNA, 12 nt, Salmonella enterica enterica serovar Typhi Ty2
auccgacaugau

SEQ ID NO: 1768509 - RNA, 15 nt, Salmonella enterica enterica serovar Typhi Ty2
auccgacaacaugaa

SEQ ID NO: 1768510 - RNA, 23 nt, Salmonella enterica enterica serovar Typhi Ty2
auccgauuucaugcgcagcauga

SEQ ID NO: 1768511 - RNA, 17 nt, Salmonella enterica enterica serovar Typhi Ty2
auccgcagauccagcac

SEQ ID NO: 1768512 - RNA, 18 nt, Salmonella enterica enterica serovar Typhi Ty2
auccgcagauccagcacg

SEQ ID NO: 1768513 - RNA, 16 nt, Salmonella enterica enterica serovar Typhi Ty2
auccgccgccagccau

SEQ ID NO: 1768514 - RNA, 12 nt, Salmonella enterica enterica serovar Typhi Ty2
auccgccgccca

SEQ ID NO: 1768515 - RNA, 15 nt, Salmonella enterica enterica serovar Typhi Ty2
auccgcgaauaccuu

SEQ ID NO: 1768516 - RNA, 20 nt, Salmonella enterica enterica serovar Typhi Ty2
aucccauccgggccacucuc

SEQ ID NO: 1768517 - RNA, 23 nt, Salmonella enterica enterica serovar Typhi Ty2
aucccaguugaucggccagcaag

SEQ ID NO: 1768518 - RNA, 14 nt, Salmonella enterica enterica serovar Typhi Ty2
auccccccuuuuuu

SEQ ID NO: 1768519 - RNA, 21 nt, Salmonella enterica enterica serovar Typhi Ty2
aucccauccgggccacucucc

SEQ ID NO: 1768520 - RNA, 12 nt, Salmonella enterica enterica serovar Typhi Ty2
auccccgcuggc

SEQ ID NO: 1768521 - RNA, 15 nt, Salmonella enterica enterica serovar Typhi Ty2
auccccgccgggcuu

SEQ ID NO: 1768522 - RNA, 13 nt, Salmonella enterica enterica serovar Typhi Ty2
aucccccuggccc

SEQ ID NO: 1768523 - RNA, 23 nt, Salmonella enterica enterica serovar Typhi Ty2
aucccgcugugauccauguugcc

SEQ ID NO: 1768524 - RNA, 16 nt, Salmonella enterica enterica serovar Typhi Ty2
aucccgcgcgccucgc

SEQ ID NO: 1768525 - RNA, 20 nt, Salmonella enterica enterica serovar Typhi Ty2
aucccgcgcgccucgcauaa

SEQ ID NO: 1768526 - RNA, 17 nt, Salmonella enterica enterica serovar Typhi Ty2
auccccggcaaccuuaa

SEQ ID NO: 1768527 - RNA, 23 nt, Salmonella enterica enterica serovar Typhi Ty2
aucccgccuugcggcgccaggac

SEQ ID NO: 1768528 - RNA, 14 nt, Salmonella enterica enterica serovar Typhi Ty2
aucccgccgcaucc

SEQ ID NO: 1768529 - RNA, 21 nt, Salmonella enterica enterica serovar Typhi Ty2
aucccgccaucguccagccau

SEQ ID NO: 1768530 - RNA, 11 nt, Salmonella enterica enterica serovar Typhi Ty2
auccaggugga

SEQ ID NO: 1768531 - RNA, 9 nt, Salmonella enterica enterica serovar Typhi Ty2
auccaguaa

SEQ ID NO: 1768532 - RNA, 14 nt, Salmonella enterica enterica serovar Typhi Ty2
auccauguugccau

SEQ ID NO: 1768533 - RNA, 21 nt, Salmonella enterica enterica serovar Typhi Ty2
auccagcgcguaaauaccuuc

SEQ ID NO: 1768534 - RNA, 19 nt, Salmonella enterica enterica serovar Typhi Ty2
auccagcgcguaaauaccu

SEQ ID NO: 1768535 - RNA, 14 nt, Salmonella enterica enterica serovar Typhi Ty2
aucccacugcacgc

SEQ ID NO: 1768536 - RNA, 21 nt, Salmonella enterica enterica serovar Typhi Ty2
aucccacucuucaaccggcag

SEQ ID NO: 1768537 - RNA, 18 nt, Salmonella enterica enterica serovar Typhi Ty2
aucccacuuaggcagcca

SEQ ID NO: 1768538 - RNA, 13 nt, Salmonella enterica enterica serovar Typhi Ty2
aucccagaaaaug

SEQ ID NO: 1768539 - RNA, 16 nt, Salmonella enterica enterica serovar Typhi Ty2
aucccacuuaggcagc

SEQ ID NO: 1768540 - RNA, 16 nt, Salmonella enterica enterica serovar Typhi Ty2
auccauuuuaaauaca

SEQ ID NO: 1768541 - RNA, 15 nt, Salmonella enterica enterica serovar Typhi Ty2
auccaccgcccgcgu

SEQ ID NO: 1768542 - RNA, 17 nt, Salmonella enterica enterica serovar Typhi Ty2
auccacccgguuuacca

SEQ ID NO: 1768543 - RNA, 20 nt, Salmonella enterica enterica serovar Typhi Ty2
auccacuggucgucugaaag

SEQ ID NO: 1768544 - RNA, 18 nt, Salmonella enterica enterica serovar Typhi Ty2
auccaccgguacgcucca

SEQ ID NO: 1768545 - RNA, 22 nt, Salmonella enterica enterica serovar Typhi Ty2
auccagcgauugacgguuuguc

SEQ ID NO: 1768546 - RNA, 17 nt, Salmonella enterica enterica serovar Typhi Ty2
auccagcgaaccuucca

SEQ ID NO: 1768547 - RNA, 16 nt, Salmonella enterica enterica serovar Typhi Ty2
auccagcgcaaaggga

SEQ ID NO: 1768548 - RNA, 23 nt, Salmonella enterica enterica serovar Typhi Ty2
auccagaacugcgaaaucaccga

SEQ ID NO: 1768549 - RNA, 24 nt, Salmonella enterica enterica serovar Typhi Ty2
auccagaacugcgaaaucaccgac

SEQ ID NO: 1768550 - RNA, 22 nt, Salmonella enterica enterica serovar Typhi Ty2
auccagacaaauaccuccuggc

SEQ ID NO: 1768551 - RNA, 16 nt, Salmonella enterica enterica serovar Typhi Ty2
auccagcaguugccau

SEQ ID NO: 1768552 - RNA, 19 nt, Salmonella enterica enterica serovar Typhi Ty2
auccaauagacuucacuuu

SEQ ID NO: 1768553 - RNA, 20 nt, Salmonella enterica enterica serovar Typhi Ty2
auccaccagcccaucuuucg

SEQ ID NO: 1768554 - RNA, 13 nt, Salmonella enterica enterica serovar Typhi Ty2
auccaccaggcau

SEQ ID NO: 1768555 - RNA, 13 nt, Salmonella enterica enterica serovar Typhi Ty2
auccaccagcgcc

SEQ ID NO: 1768556 - RNA, 19 nt, Salmonella enterica enterica serovar Typhi Ty2
auccaccaccagcaucacg

SEQ ID NO: 1768557 - RNA, 18 nt, Salmonella enterica enterica serovar Typhi Ty2
aucauuaauaaccccagc

SEQ ID NO: 1768558 - RNA, 17 nt, Salmonella enterica enterica serovar Typhi Ty2
aaaacuaccguaccagc

SEQ ID NO: 1768559 - RNA, 14 nt, Salmonella enterica enterica serovar Typhi Ty2
aaaacuuauuuuau

SEQ ID NO: 1768560 - RNA, 19 nt, Salmonella enterica enterica serovar Typhi Ty2
aaaacuuuaacacuaacua

SEQ ID NO: 1768561 - RNA, 11 nt, Salmonella enterica enterica serovar Typhi Ty2
aaaagaaaaaa

SEQ ID NO: 1768562 - RNA, 16 nt, Salmonella enterica enterica serovar Typhi Ty2
aucauucccgcccagu

SEQ ID NO: 1768563 - RNA, 12 nt, Salmonella enterica enterica serovar Typhi Ty2
aucauucaucuc

SEQ ID NO: 1768564 - RNA, 19 nt, Salmonella enterica enterica serovar Typhi Ty2
aucauuauauagucuuaau

SEQ ID NO: 1768565 - RNA, 17 nt, Salmonella enterica enterica serovar Typhi Ty2
aucauucaacgcaucaa

SEQ ID NO: 1768566 - RNA, 13 nt, Salmonella enterica enterica serovar Typhi Ty2
aaaagaaaaaacu

SEQ ID NO: 1768567 - RNA, 20 nt, Salmonella enterica enterica serovar Typhi Ty2
aucugucccagccuuccugg

SEQ ID NO: 1768568 - RNA, 18 nt, Salmonella enterica enterica serovar Typhi Ty2
aucuguuugagaaaaaca

SEQ ID NO: 1768569 - RNA, 14 nt, Salmonella enterica enterica serovar Typhi Ty2
aucuguuucaugga

SEQ ID NO: 1768570 - RNA, 14 nt, Salmonella enterica enterica serovar Typhi Ty2
aucuguuugagaaa

SEQ ID NO: 1768571 - RNA, 13 nt, Salmonella enterica enterica serovar Typhi Ty2
aucuguauaaaau

SEQ ID NO: 1768572 - RNA, 19 nt, Salmonella enterica enterica serovar Typhi Ty2
aucugggcugagaaaaauu

SEQ ID NO: 1768573 - RNA, 18 nt, Salmonella enterica enterica serovar Typhi Ty2
aucuggcugcguaaaauc

SEQ ID NO: 1768574 - RNA, 21 nt, Salmonella enterica enterica serovar Typhi Ty2
aucuggcgcuuuuccagcacg

SEQ ID NO: 1768575 - RNA, 18 nt, Salmonella enterica enterica serovar Typhi Ty2
aucuggcggcgaaagaga

SEQ ID NO: 1768576 - RNA, 20 nt, Salmonella enterica enterica serovar Typhi Ty2
aucuggcggcgaaagagaaa

SEQ ID NO: 1768577 - RNA, 13 nt, Salmonella enterica enterica serovar Typhi Ty2
aucugaaaugcuc

SEQ ID NO: 1768578 - RNA, 12 nt, Salmonella enterica enterica serovar Typhi Ty2
aucucuuuuucu

SEQ ID NO: 1768579 - RNA, 21 nt, Salmonella enterica enterica serovar Typhi Ty2
aucugaacucuuccagauacg

SEQ ID NO: 1768580 - RNA, 22 nt, Salmonella enterica enterica serovar Typhi Ty2
aucugacagccaaacugcugua

SEQ ID NO: 1768581 - RNA, 16 nt, Salmonella enterica enterica serovar Typhi Ty2
aucugacgcggcgccg

SEQ ID NO: 1768582 - RNA, 18 nt, Salmonella enterica enterica serovar Typhi Ty2
aucugacugcgugagugu

SEQ ID NO: 1768583 - RNA, 15 nt, Salmonella enterica enterica serovar Typhi Ty2
aucugacagauaucu

SEQ ID NO: 1768584 - RNA, 14 nt, Salmonella enterica enterica serovar Typhi Ty2
aucugacagccaaa

SEQ ID NO: 1768585 - RNA, 18 nt, Salmonella enterica enterica serovar Typhi Ty2
aucugacaucagaaaaua

SEQ ID NO: 1768586 - RNA, 19 nt, Salmonella enterica enterica serovar Typhi Ty2
aucugcgccggcugcgcug

SEQ ID NO: 1768587 - RNA, 20 nt, Salmonella enterica enterica serovar Typhi Ty2
aucugcgugaugcaucagaa

SEQ ID NO: 1768588 - RNA, 18 nt, Salmonella enterica enterica serovar Typhi Ty2
aucuggaugaaggagaaa

SEQ ID NO: 1768589 - RNA, 17 nt, Salmonella enterica enterica serovar Typhi Ty2
aucuggccaauuuuuca

SEQ ID NO: 1768590 - RNA, 21 nt, Salmonella enterica enterica serovar Typhi Ty2
aucuucaaagccacacugcau

SEQ ID NO: 1768591 - RNA, 21 nt, Salmonella enterica enterica serovar Typhi Ty2
aucuucaagguuaugcgcaca

SEQ ID NO: 1768592 - RNA, 15 nt, Salmonella enterica enterica serovar Typhi Ty2
aucuuauuagcgauu

SEQ ID NO: 1768593 - RNA, 17 nt, Salmonella enterica enterica serovar Typhi Ty2
aucuucacgcagcguga

SEQ ID NO: 1768594 - RNA, 21 nt, Salmonella enterica enterica serovar Typhi Ty2
aucuucacuguuaucgccauu

SEQ ID NO: 1768595 - RNA, 18 nt, Salmonella enterica enterica serovar Typhi Ty2
aucuucacuucacaaaca

SEQ ID NO: 1768596 - RNA, 22 nt, Salmonella enterica enterica serovar Typhi Ty2
aucuucauaaauagccagcauc

SEQ ID NO: 1768597 - RNA, 13 nt, Salmonella enterica enterica serovar Typhi Ty2
aucuucccgcaga

SEQ ID NO: 1768598 - RNA, 22 nt, Salmonella enterica enterica serovar Typhi Ty2
aucuuccagcgucgggccgcgc

SEQ ID NO: 1768599 - RNA, 17 nt, Salmonella enterica enterica serovar Typhi Ty2
aucuuccacgguaaaac

SEQ ID NO: 1768600 - RNA, 13 nt, Salmonella enterica enterica serovar Typhi Ty2
aucuuccagcauc

SEQ ID NO: 1768601 - RNA, 20 nt, Salmonella enterica enterica serovar Typhi Ty2
aucuucauguucuaacagau

SEQ ID NO: 1768602 - RNA, 20 nt, Salmonella enterica enterica serovar Typhi Ty2
aucuuccaacuguacgccac

SEQ ID NO: 1768603 - RNA, 17 nt, Salmonella enterica enterica serovar Typhi Ty2
aucuauauauucuucuu

SEQ ID NO: 1768604 - RNA, 22 nt, Salmonella enterica enterica serovar Typhi Ty2
aucucacgcauggcguugcugc

SEQ ID NO: 1768605 - RNA, 17 nt, Salmonella enterica enterica serovar Typhi Ty2
aucuacaaacgcggaca

SEQ ID NO: 1768606 - RNA, 23 nt, Salmonella enterica enterica serovar Typhi Ty2
aucuacaaucgucuucagcaauu

SEQ ID NO: 1768607 - RNA, 14 nt, Salmonella enterica enterica serovar Typhi Ty2
aucguaugcgccug

SEQ ID NO: 1768608 - RNA, 21 nt, Salmonella enterica enterica serovar Typhi Ty2
aucguaugcgccugucuuaaa

SEQ ID NO: 1768609 - RNA, 21 nt, Salmonella enterica enterica serovar Typhi Ty2
aucguauccggucaauacauc

SEQ ID NO: 1768610 - RNA, 22 nt, Salmonella enterica enterica serovar Typhi Ty2
aucgucaucggucaguuugccc

SEQ ID NO: 1768611 - RNA, 23 nt, Salmonella enterica enterica serovar Typhi Ty2
aucgucacccuauuuugcgccug

SEQ ID NO: 1768612 - RNA, 19 nt, Salmonella enterica enterica serovar Typhi Ty2
aucucucuggcgcauucca

SEQ ID NO: 1768613 - RNA, 23 nt, Salmonella enterica enterica serovar Typhi Ty2
aucucgaccuggcgcucaaucag

SEQ ID NO: 1768614 - RNA, 18 nt, Salmonella enterica enterica serovar Typhi Ty2
aucuccuguaaugaggca

SEQ ID NO: 1768615 - RNA, 13 nt, Salmonella enterica enterica serovar Typhi Ty2
aucucuuuuucuc

SEQ ID NO: 1768616 - RNA, 17 nt, Salmonella enterica enterica serovar Typhi Ty2
aucucuuuuaauuuucu

SEQ ID NO: 1768617 - RNA, 19 nt, Salmonella enterica enterica serovar Typhi Ty2
aucucugucgaccaucgca

SEQ ID NO: 1768618 - RNA, 19 nt, Salmonella enterica enterica serovar Typhi Ty2
aucucaucugcaaaauaua

SEQ ID NO: 1768619 - RNA, 19 nt, Salmonella enterica enterica serovar Typhi Ty2
aucucaucagacuguaugu

SEQ ID NO: 1768620 - RNA, 18 nt, Salmonella enterica enterica serovar Typhi Ty2
aucucauaaacgccugga

SEQ ID NO: 1768621 - RNA, 17 nt, Salmonella enterica enterica serovar Typhi Ty2
aucucauaccaggugcc

SEQ ID NO: 1768622 - RNA, 20 nt, Salmonella enterica enterica serovar Typhi Ty2
aucuccagaccgcugcggaa

SEQ ID NO: 1768623 - RNA, 17 nt, Salmonella enterica enterica serovar Typhi Ty2
aucuccagaccgcugcg

SEQ ID NO: 1768624 - RNA, 19 nt, Salmonella enterica enterica serovar Typhi Ty2
aucuccagaccgcugcgga

SEQ ID NO: 1768625 - RNA, 17 nt, Salmonella enterica enterica serovar Typhi Ty2
aucuccuccggcuucag

SEQ ID NO: 1768626 - RNA, 16 nt, Salmonella enterica enterica serovar Typhi Ty2
aucuccuuuaaugaag

SEQ ID NO: 1768627 - RNA, 22 nt, Salmonella enterica enterica serovar Typhi Ty2
aucuccugcgauagcugcugac

SEQ ID NO: 1768628 - RNA, 20 nt, Salmonella enterica enterica serovar Typhi Ty2
augauagcgccauauaaaua

SEQ ID NO: 1768629 - RNA, 16 nt, Salmonella enterica enterica serovar Typhi Ty2
augauauccagcacgc

SEQ ID NO: 1768630 - RNA, 18 nt, Salmonella enterica enterica serovar Typhi Ty2
augauauccagcacgccu

SEQ ID NO: 1768631 - RNA, 20 nt, Salmonella enterica enterica serovar Typhi Ty2
augaucacuuccgccaccac

SEQ ID NO: 1768632 - RNA, 21 nt, Salmonella enterica enterica serovar Typhi Ty2
augaucaccaucuucacauau

SEQ ID NO: 1768633 - RNA, 17 nt, Salmonella enterica enterica serovar Typhi Ty2
augauaagccugacuac

SEQ ID NO: 1768634 - RNA, 19 nt, Salmonella enterica enterica serovar Typhi Ty2
augauaauuguuaauuauu

SEQ ID NO: 1768635 - RNA, 20 nt, Salmonella enterica enterica serovar Typhi Ty2
augauacguggcucaaggau

SEQ ID NO: 1768636 - RNA, 23 nt, Salmonella enterica enterica serovar Typhi Ty2
augauaaccgccgccaaacugcg

SEQ ID NO: 1768637 - RNA, 20 nt, Salmonella enterica enterica serovar Typhi Ty2
augaggauauugguaucaaa

SEQ ID NO: 1768638 - RNA, 16 nt, Salmonella enterica enterica serovar Typhi Ty2
augagcgcaggcgagc

SEQ ID NO: 1768639 - RNA, 22 nt, Salmonella enterica enterica serovar Typhi Ty2
augagcgcgaaaucaaagaccu

SEQ ID NO: 1768640 - RNA, 20 nt, Salmonella enterica enterica serovar Typhi Ty2
augaggacggcccgcugucu

SEQ ID NO: 1768641 - RNA, 20 nt, Salmonella enterica enterica serovar Typhi Ty2
augaguagaacguauuauua

SEQ ID NO: 1768642 - RNA, 23 nt, Salmonella enterica enterica serovar Typhi Ty2
augaguauauagcgcuccuuuaa

SEQ ID NO: 1768643 - RNA, 16 nt, Salmonella enterica enterica serovar Typhi Ty2
augacaucgcaaugcc

SEQ ID NO: 1768644 - RNA, 13 nt, Salmonella enterica enterica serovar Typhi Ty2
augacguucaauu

SEQ ID NO: 1768645 - RNA, 16 nt, Salmonella enterica enterica serovar Typhi Ty2
augacaugaaagaaga

SEQ ID NO: 1768646 - RNA, 14 nt, Salmonella enterica enterica serovar Typhi Ty2
augacaugcucaug

SEQ ID NO: 1768647 - RNA, 19 nt, Salmonella enterica enterica serovar Typhi Ty2
augacaugcucaugaaggc

SEQ ID NO: 1768648 - RNA, 14 nt, Salmonella enterica enterica serovar Typhi Ty2
augacucaaacaga

SEQ ID NO: 1768649 - RNA, 15 nt, Salmonella enterica enterica serovar Typhi Ty2
augacuaauggcauu

SEQ ID NO: 1768650 - RNA, 19 nt, Salmonella enterica enterica serovar Typhi Ty2
augacucauuaaaaaaaca

SEQ ID NO: 1768651 - RNA, 23 nt, Salmonella enterica enterica serovar Typhi Ty2
augaauuuauggagucaugaaug

SEQ ID NO: 1768652 - RNA, 21 nt, Salmonella enterica enterica serovar Typhi Ty2
augaauuuaucccgugguggg

SEQ ID NO: 1768653 - RNA, 23 nt, Salmonella enterica enterica serovar Typhi Ty2
augaagcugcagggauaugcuga

SEQ ID NO: 1768654 - RNA, 16 nt, Salmonella enterica enterica serovar Typhi Ty2
augaagcggaaaggac

SEQ ID NO: 1768655 - RNA, 16 nt, Salmonella enterica enterica serovar Typhi Ty2
augaacugcaucagaa

SEQ ID NO: 1768656 - RNA, 16 nt, Salmonella enterica enterica serovar Typhi Ty2
augaacguuaucggca

SEQ ID NO: 1768657 - RNA, 16 nt, Salmonella enterica enterica serovar Typhi Ty2
augaagcauaaaaaga

SEQ ID NO: 1768658 - RNA, 22 nt, Salmonella enterica enterica serovar Typhi Ty2
augaacguuuugugucaaaaag

SEQ ID NO: 1768659 - RNA, 18 nt, Salmonella enterica enterica serovar Typhi Ty2
augaaccugaugugcuuu

SEQ ID NO: 1768660 - RNA, 18 nt, Salmonella enterica enterica serovar Typhi Ty2
augaaaaauauaaaaagc

SEQ ID NO: 1768661 - RNA, 14 nt, Salmonella enterica enterica serovar Typhi Ty2
augaaaucacccag

SEQ ID NO: 1768662 - RNA, 21 nt, Salmonella enterica enterica serovar Typhi Ty2
augaaauucuugcccgcugag

SEQ ID NO: 1768663 - RNA, 20 nt, Salmonella enterica enterica serovar Typhi Ty2
augaaaauaauuuuuaucau

SEQ ID NO: 1768664 - RNA, 20 nt, Salmonella enterica enterica serovar Typhi Ty2
aucuuuaugucaguaauaua

SEQ ID NO: 1768665 - RNA, 19 nt, Salmonella enterica enterica serovar Typhi Ty2
aucuuuuaaaaucagauug

SEQ ID NO: 1768666 - RNA, 22 nt, Salmonella enterica enterica serovar Typhi Ty2
aucuucgcaguagauucuaucu

SEQ ID NO: 1768667 - RNA, 21 nt, Salmonella enterica enterica serovar Typhi Ty2
aucuucgccguauucuuaccc

SEQ ID NO: 1768668 - RNA, 21 nt, Salmonella enterica enterica serovar Typhi Ty2
aucuucgccguguucuuaccc

SEQ ID NO: 1768669 - RNA, 13 nt, Salmonella enterica enterica serovar Typhi Ty2
aucuucgauaaga

SEQ ID NO: 1768670 - RNA, 20 nt, Salmonella enterica enterica serovar Typhi Ty2
aucuucggcgcgccgcuggc

SEQ ID NO: 1768671 - RNA, 19 nt, Salmonella enterica enterica serovar Typhi Ty2
aucuucggcgggaucucca

SEQ ID NO: 1768672 - RNA, 22 nt, Salmonella enterica enterica serovar Typhi Ty2
aucuucggcgggaucuccagaa

SEQ ID NO: 1768673 - RNA, 21 nt, Salmonella enterica enterica serovar Typhi Ty2
aucuucguuggcgcugccgga

SEQ ID NO: 1768674 - RNA, 13 nt, Salmonella enterica enterica serovar Typhi Ty2
aguucagcagcac

SEQ ID NO: 1768675 - RNA, 19 nt, Salmonella enterica enterica serovar Typhi Ty2
aguucacgacugauagguu

SEQ ID NO: 1768676 - RNA, 16 nt, Salmonella enterica enterica serovar Typhi Ty2
aguucaccaguuuuuc

SEQ ID NO: 1768677 - RNA, 15 nt, Salmonella enterica enterica serovar Typhi Ty2
aguuauccagcgccc

SEQ ID NO: 1768678 - RNA, 21 nt, Salmonella enterica enterica serovar Typhi Ty2
aguuaucauuauauagucuua

SEQ ID NO: 1768679 - RNA, 15 nt, Salmonella enterica enterica serovar Typhi Ty2
aguuacgcucucagc

SEQ ID NO: 1768680 - RNA, 16 nt, Salmonella enterica enterica serovar Typhi Ty2
aguuacggacaugcga

SEQ ID NO: 1768681 - RNA, 16 nt, Salmonella enterica enterica serovar Typhi Ty2
aguuacuuuccauaua

SEQ ID NO: 1768682 - RNA, 16 nt, Salmonella enterica enterica serovar Typhi Ty2
aguuaauuaaaugcuu

SEQ ID NO: 1768683 - RNA, 23 nt, Salmonella enterica enterica serovar Typhi Ty2
aguguccuuacggacgugggggu

SEQ ID NO: 1768684 - RNA, 23 nt, Salmonella enterica enterica serovar Typhi Ty2
aguuccaguaagguccagggaaa

SEQ ID NO: 1768685 - RNA, 17 nt, Salmonella enterica enterica serovar Typhi Ty2
aguuccaggacggacau

SEQ ID NO: 1768686 - RNA, 20 nt, Salmonella enterica enterica serovar Typhi Ty2
aguuccacauaaaguagcca

SEQ ID NO: 1768687 - RNA, 15 nt, Salmonella enterica enterica serovar Typhi Ty2
aguuccaaucucuuu

SEQ ID NO: 1768688 - RNA, 17 nt, Salmonella enterica enterica serovar Typhi Ty2
aguucauuucaggcaaa

SEQ ID NO: 1768689 - RNA, 16 nt, Salmonella enterica enterica serovar Typhi Ty2
aguucuacgcugccau

SEQ ID NO: 1768690 - RNA, 17 nt, Salmonella enterica enterica serovar Typhi Ty2
aguucucaaugaacagu

SEQ ID NO: 1768691 - RNA, 18 nt, Salmonella enterica enterica serovar Typhi Ty2
aguucucgucugcugaaa

SEQ ID NO: 1768692 - RNA, 12 nt, Salmonella enterica enterica serovar Typhi Ty2
aguucucuucuu

SEQ ID NO: 1768693 - RNA, 14 nt, Salmonella enterica enterica serovar Typhi Ty2
aguuucuuaccuac

SEQ ID NO: 1768694 - RNA, 19 nt, Salmonella enterica enterica serovar Typhi Ty2
aguuucucccgccagaugc

SEQ ID NO: 1768695 - RNA, 15 nt, Salmonella enterica enterica serovar Typhi Ty2
aguuucguuaccccg

SEQ ID NO: 1768696 - RNA, 16 nt, Salmonella enterica enterica serovar Typhi Ty2
aguuucgacuuucauu

SEQ ID NO: 1768697 - RNA, 14 nt, Salmonella enterica enterica serovar Typhi Ty2
aguuucaccuucug

SEQ ID NO: 1768698 - RNA, 22 nt, Salmonella enterica enterica serovar Typhi Ty2
aguuugaugcaaaugucagauc

SEQ ID NO: 1768699 - RNA, 20 nt, Salmonella enterica enterica serovar Typhi Ty2
aguuugcgcgauuuauagag

SEQ ID NO: 1768700 - RNA, 17 nt, Salmonella enterica enterica serovar Typhi Ty2
aguuugcuuaagcuuug

SEQ ID NO: 1768701 - RNA, 18 nt, Salmonella enterica enterica serovar Typhi Ty2
aguuugaugcaaauguca

SEQ ID NO: 1768702 - RNA, 21 nt, Salmonella enterica enterica serovar Typhi Ty2
aguuucuuuuuccaaauaguu

SEQ ID NO: 1768703 - RNA, 10 nt, Salmonella enterica enterica serovar Typhi Ty2
aguuuuaacg

SEQ ID NO: 1768704 - RNA, 22 nt, Salmonella enterica enterica serovar Typhi Ty2
aguuugucuucgaugcgcucau

SEQ ID NO: 1768705 - RNA, 15 nt, Salmonella enterica enterica serovar Typhi Ty2
aguuugugccgccac

SEQ ID NO: 1768706 - RNA, 22 nt, Salmonella enterica enterica serovar Typhi Ty2
aguuugucaacgugugccagga

SEQ ID NO: 1768707 - RNA, 13 nt, Salmonella enterica enterica serovar Typhi Ty2
aguuugucaucca

SEQ ID NO: 1768708 - RNA, 14 nt, Salmonella enterica enterica serovar Typhi Ty2
aguuuaauucuuug

SEQ ID NO: 1768709 - RNA, 15 nt, Salmonella enterica enterica serovar Typhi Ty2
aguuuaauucuuuga

SEQ ID NO: 1768710 - RNA, 18 nt, Salmonella enterica enterica serovar Typhi Ty2
aguuuaaccguuccaacg

SEQ ID NO: 1768711 - RNA, 17 nt, Salmonella enterica enterica serovar Typhi Ty2
aguuuaaaucacagggg

SEQ ID NO: 1768712 - RNA, 22 nt, Salmonella enterica enterica serovar Typhi Ty2
aguuuacgagugcguucuucca

SEQ ID NO: 1768713 - RNA, 22 nt, Salmonella enterica enterica serovar Typhi Ty2
aguuguuuauuccauucaucga

SEQ ID NO: 1768714 - RNA, 18 nt, Salmonella enterica enterica serovar Typhi Ty2
aguuuaaacacucuccac

SEQ ID NO: 1768715 - RNA, 20 nt, Salmonella enterica enterica serovar Typhi Ty2
aguuuagcgagcguucugca

SEQ ID NO: 1768716 - RNA, 15 nt, Salmonella enterica enterica serovar Typhi Ty2
aguuuagccagcagc

SEQ ID NO: 1768717 - RNA, 16 nt, Salmonella enterica enterica serovar Typhi Ty2
aguuuagccagcagcg

SEQ ID NO: 1768718 - RNA, 15 nt, Salmonella enterica enterica serovar Typhi Ty2
aguuuagaaaauaua

SEQ ID NO: 1768719 - RNA, 22 nt, Salmonella enterica enterica serovar Typhi Ty2
aguuuagaaaauauauuggccu

SEQ ID NO: 1768720 - RNA, 17 nt, Salmonella enterica enterica serovar Typhi Ty2
aguuuauucaucuccuc

SEQ ID NO: 1768721 - RNA, 16 nt, Salmonella enterica enterica serovar Typhi Ty2
aguugcgcaggguauc

SEQ ID NO: 1768722 - RNA, 13 nt, Salmonella enterica enterica serovar Typhi Ty2
aguugcgcagggu

SEQ ID NO: 1768723 - RNA, 15 nt, Salmonella enterica enterica serovar Typhi Ty2
aguugcgacugauaa

SEQ ID NO: 1768724 - RNA, 19 nt, Salmonella enterica enterica serovar Typhi Ty2
aguugcgacuguucaucaa

SEQ ID NO: 1768725 - RNA, 18 nt, Salmonella enterica enterica serovar Typhi Ty2
aguugcccgacgccugca

SEQ ID NO: 1768726 - RNA, 16 nt, Salmonella enterica enterica serovar Typhi Ty2
aguugcccauuuuccu

SEQ ID NO: 1768727 - RNA, 17 nt, Salmonella enterica enterica serovar Typhi Ty2
aguugcccauuuuccuc

SEQ ID NO: 1768728 - RNA, 20 nt, Salmonella enterica enterica serovar Typhi Ty2
aguugcccuuaucuggauga

SEQ ID NO: 1768729 - RNA, 21 nt, Salmonella enterica enterica serovar Typhi Ty2
aguuguugucgagguuauaaa

SEQ ID NO: 1768730 - RNA, 19 nt, Salmonella enterica enterica serovar Typhi Ty2
agugcgaugggcuucagau

SEQ ID NO: 1768731 - RNA, 21 nt, Salmonella enterica enterica serovar Typhi Ty2
agugcgcauacuaccgcugcg

SEQ ID NO: 1768732 - RNA, 20 nt, Salmonella enterica enterica serovar Typhi Ty2
agugcgcggcgaaaaagccg

SEQ ID NO: 1768733 - RNA, 11 nt, Salmonella enterica enterica serovar Typhi Ty2
agugccugccg

SEQ ID NO: 1768734 - RNA, 14 nt, Salmonella enterica enterica serovar Typhi Ty2
agugcugaaaaucg

SEQ ID NO: 1768735 - RNA, 14 nt, Salmonella enterica enterica serovar Typhi Ty2
agugcugaacaaua

SEQ ID NO: 1768736 - RNA, 13 nt, Salmonella enterica enterica serovar Typhi Ty2
aguggugggugau

SEQ ID NO: 1768737 - RNA, 17 nt, Salmonella enterica enterica serovar Typhi Ty2
agugguuccaggcgcgc

SEQ ID NO: 1768738 - RNA, 16 nt, Salmonella enterica enterica serovar Typhi Ty2
agugggucacaucgcc

SEQ ID NO: 1768739 - RNA, 19 nt, Salmonella enterica enterica serovar Typhi Ty2
agugguaaaaaagucacuu

SEQ ID NO: 1768740 - RNA, 19 nt, Salmonella enterica enterica serovar Typhi Ty2
aguggcauccgaagaacca

SEQ ID NO: 1768741 - RNA, 14 nt, Salmonella enterica enterica serovar Typhi Ty2
aguggaucagcaga

SEQ ID NO: 1768742 - RNA, 18 nt, Salmonella enterica enterica serovar Typhi Ty2
agugcaguauugcaccag

SEQ ID NO: 1768743 - RNA, 20 nt, Salmonella enterica enterica serovar Typhi Ty2
agugcccgaaagcaauacug

SEQ ID NO: 1768744 - RNA, 22 nt, Salmonella enterica enterica serovar Typhi Ty2
agugccaguccgguauaaaacg

SEQ ID NO: 1768745 - RNA, 19 nt, Salmonella enterica enterica serovar Typhi Ty2
agugcccagcgcgaccugc

SEQ ID NO: 1768746 - RNA, 22 nt, Salmonella enterica enterica serovar Typhi Ty2
agugcauguacaacuucaugag

SEQ ID NO: 1768747 - RNA, 19 nt, Salmonella enterica enterica serovar Typhi Ty2
agugauuuacuccaaaaau

SEQ ID NO: 1768748 - RNA, 23 nt, Salmonella enterica enterica serovar Typhi Ty2
agugauuuacuccaaaaauaaac

SEQ ID NO: 1768749 - RNA, 17 nt, Salmonella enterica enterica serovar Typhi Ty2
agugauucggguaaaca

SEQ ID NO: 1768750 - RNA, 16 nt, Salmonella enterica enterica serovar Typhi Ty2
agugauuauaaaucaa

SEQ ID NO: 1768751 - RNA, 14 nt, Salmonella enterica enterica serovar Typhi Ty2
agugaauaacaacc

SEQ ID NO: 1768752 - RNA, 23 nt, Salmonella enterica enterica serovar Typhi Ty2
agugaaucgacggcaauauuaaa

SEQ ID NO: 1768753 - RNA, 17 nt, Salmonella enterica enterica serovar Typhi Ty2
agugaaucgacggcaau

SEQ ID NO: 1768754 - RNA, 22 nt, Salmonella enterica enterica serovar Typhi Ty2
agugauagcgccauggagaaac

SEQ ID NO: 1768755 - RNA, 21 nt, Salmonella enterica enterica serovar Typhi Ty2
agugauagcgccauggagaaa

SEQ ID NO: 1768756 - RNA, 21 nt, Salmonella enterica enterica serovar Typhi Ty2
agugaucccgacauaggccag

SEQ ID NO: 1768757 - RNA, 15 nt, Salmonella enterica enterica serovar Typhi Ty2
agucaaauuccagca

SEQ ID NO: 1768758 - RNA, 16 nt, Salmonella enterica enterica serovar Typhi Ty2
agucaaauuccagcaa

SEQ ID NO: 1768759 - RNA, 12 nt, Salmonella enterica enterica serovar Typhi Ty2
agucaaauucca

SEQ ID NO: 1768760 - RNA, 14 nt, Salmonella enterica enterica serovar Typhi Ty2
agucaaagguaaua

SEQ ID NO: 1768761 - RNA, 18 nt, Salmonella enterica enterica serovar Typhi Ty2
agucaaauuccagcaaug

SEQ ID NO: 1768762 - RNA, 16 nt, Salmonella enterica enterica serovar Typhi Ty2
aguccgcacgccugca

SEQ ID NO: 1768763 - RNA, 22 nt, Salmonella enterica enterica serovar Typhi Ty2
aguccgggcauaaccucuccuu

SEQ ID NO: 1768764 - RNA, 21 nt, Salmonella enterica enterica serovar Typhi Ty2
aguccgcuuuucguccccuau

SEQ ID NO: 1768765 - RNA, 17 nt, Salmonella enterica enterica serovar Typhi Ty2
aguccgguauaaaacgu

SEQ ID NO: 1768766 - RNA, 17 nt, Salmonella enterica enterica serovar Typhi Ty2
aguccgguggcgaaaac

SEQ ID NO: 1768767 - RNA, 22 nt, Salmonella enterica enterica serovar Typhi Ty2
agucaaaagauugauuuauuca

SEQ ID NO: 1768768 - RNA, 21 nt, Salmonella enterica enterica serovar Typhi Ty2
agucaaacacgaccagcgaca

SEQ ID NO: 1768769 - RNA, 16 nt, Salmonella enterica enterica serovar Typhi Ty2
agucgacucaucuuuu

SEQ ID NO: 1768770 - RNA, 19 nt, Salmonella enterica enterica serovar Typhi Ty2
agucgauguggccuuccuc

SEQ ID NO: 1768771 - RNA, 20 nt, Salmonella enterica enterica serovar Typhi Ty2
agucgcuuaucugcugcugg

SEQ ID NO: 1768772 - RNA, 18 nt, Salmonella enterica enterica serovar Typhi Ty2
agucgcaauauaaauauc

SEQ ID NO: 1768773 - RNA, 16 nt, Salmonella enterica enterica serovar Typhi Ty2
aguccucgcccacuuc

SEQ ID NO: 1768774 - RNA, 21 nt, Salmonella enterica enterica serovar Typhi Ty2
aguccucagcgaauaucucua

SEQ ID NO: 1768775 - RNA, 15 nt, Salmonella enterica enterica serovar Typhi Ty2
aguccuccggcugaa

SEQ ID NO: 1768776 - RNA, 21 nt, Salmonella enterica enterica serovar Typhi Ty2
aguccugcgcuuugacauugu

SEQ ID NO: 1768777 - RNA, 22 nt, Salmonella enterica enterica serovar Typhi Ty2
agucggggcguaaaaauuuucc

SEQ ID NO: 1768778 - RNA, 20 nt, Salmonella enterica enterica serovar Typhi Ty2
agucggggcguaaaaauuuu

SEQ ID NO: 1768779 - RNA, 23 nt, Salmonella enterica enterica serovar Typhi Ty2
agucgggcgugccguccugugcu

SEQ ID NO: 1768780 - RNA, 14 nt, Salmonella enterica enterica serovar Typhi Ty2
agucucccuccugc

SEQ ID NO: 1768781 - RNA, 15 nt, Salmonella enterica enterica serovar Typhi Ty2
agucucccuccugcu

SEQ ID NO: 1768782 - RNA, 23 nt, Salmonella enterica enterica serovar Typhi Ty2
agucucccuccugcuccaugcug

SEQ ID NO: 1768783 - RNA, 20 nt, Salmonella enterica enterica serovar Typhi Ty2
agucucccuccugcuccaug

SEQ ID NO: 1768784 - RNA, 20 nt, Salmonella enterica enterica serovar Typhi Ty2
agucuccugccaaugaaaua

SEQ ID NO: 1768785 - RNA, 19 nt, Salmonella enterica enterica serovar Typhi Ty2
agucucgaaacgaaucuca

SEQ ID NO: 1768786 - RNA, 19 nt, Salmonella enterica enterica serovar Typhi Ty2
agucuccugccaaugaaau

SEQ ID NO: 1768787 - RNA, 16 nt, Salmonella enterica enterica serovar Typhi Ty2
agucucuacuacauau

SEQ ID NO: 1768788 - RNA, 19 nt, Salmonella enterica enterica serovar Typhi Ty2
agugaaggccaaguuuaga

SEQ ID NO: 1768789 - RNA, 13 nt, Salmonella enterica enterica serovar Typhi Ty2
agucugaaaauaa

SEQ ID NO: 1768790 - RNA, 21 nt, Salmonella enterica enterica serovar Typhi Ty2
auacacuuuccauucgacagu

SEQ ID NO: 1768791 - RNA, 19 nt, Salmonella enterica enterica serovar Typhi Ty2
auacacuuuccauucgaca

SEQ ID NO: 1768792 - RNA, 22 nt, Salmonella enterica enterica serovar Typhi Ty2
auacacucaaccaucaaaaaaa

SEQ ID NO: 1768793 - RNA, 17 nt, Salmonella enterica enterica serovar Typhi Ty2
auacacucaaccaacca

SEQ ID NO: 1768794 - RNA, 14 nt, Salmonella enterica enterica serovar Typhi Ty2
auacacucaaccau

SEQ ID NO: 1768795 - RNA, 20 nt, Salmonella enterica enterica serovar Typhi Ty2
auacacugcauaaauaucug

SEQ ID NO: 1768796 - RNA, 15 nt, Salmonella enterica enterica serovar Typhi Ty2
auacaccuuugcccg

SEQ ID NO: 1768797 - RNA, 11 nt, Salmonella enterica enterica serovar Typhi Ty2
auacaccuuca

SEQ ID NO: 1768798 - RNA, 18 nt, Salmonella enterica enterica serovar Typhi Ty2
auacaccaaacgaauuua

SEQ ID NO: 1768799 - RNA, 18 nt, Salmonella enterica enterica serovar Typhi Ty2
auaauuuuauuauauuua

SEQ ID NO: 1768800 - RNA, 13 nt, Salmonella enterica enterica serovar Typhi Ty2
auaauuuuagaaa

SEQ ID NO: 1768801 - RNA, 15 nt, Salmonella enterica enterica serovar Typhi Ty2
auaauuuuugccuuu

SEQ ID NO: 1768802 - RNA, 20 nt, Salmonella enterica enterica serovar Typhi Ty2
auaauugcucacccauuuua

SEQ ID NO: 1768803 - RNA, 16 nt, Salmonella enterica enterica serovar Typhi Ty2
auaauugcucugccag

SEQ ID NO: 1768804 - RNA, 19 nt, Salmonella enterica enterica serovar Typhi Ty2
auaauggcgacggccacgc

SEQ ID NO: 1768805 - RNA, 19 nt, Salmonella enterica enterica serovar Typhi Ty2
auaauggcgcgaaaacagc

SEQ ID NO: 1768806 - RNA, 20 nt, Salmonella enterica enterica serovar Typhi Ty2
auaauggggauuaucaggau

SEQ ID NO: 1768807 - RNA, 19 nt, Salmonella enterica enterica serovar Typhi Ty2
auaauucuguaacucauag

SEQ ID NO: 1768808 - RNA, 12 nt, Salmonella enterica enterica serovar Typhi Ty2
auaaucaccacg

SEQ ID NO: 1768809 - RNA, 14 nt, Salmonella enterica enterica serovar Typhi Ty2
auaaucaccacgua

SEQ ID NO: 1768810 - RNA, 20 nt, Salmonella enterica enterica serovar Typhi Ty2
auaaucacauuaugcugggu

SEQ ID NO: 1768811 - RNA, 19 nt, Salmonella enterica enterica serovar Typhi Ty2
auaaucacauuaugcuggg

SEQ ID NO: 1768812 - RNA, 23 nt, Salmonella enterica enterica serovar Typhi Ty2
auaaucauccgggcauaaaaaaa

SEQ ID NO: 1768813 - RNA, 13 nt, Salmonella enterica enterica serovar Typhi Ty2
auaaucagcgcuc

SEQ ID NO: 1768814 - RNA, 13 nt, Salmonella enterica enterica serovar Typhi Ty2
auaaucagcagcg

SEQ ID NO: 1768815 - RNA, 15 nt, Salmonella enterica enterica serovar Typhi Ty2
auaauccuucccgcu

SEQ ID NO: 1768816 - RNA, 14 nt, Salmonella enterica enterica serovar Typhi Ty2
auaaucgauauaau

SEQ ID NO: 1768817 - RNA, 21 nt, Salmonella enterica enterica serovar Typhi Ty2
auaaucgccgacuaauuauuu

SEQ ID NO: 1768818 - RNA, 17 nt, Salmonella enterica enterica serovar Typhi Ty2
auaaucgauuccuauuu

SEQ ID NO: 1768819 - RNA, 22 nt, Salmonella enterica enterica serovar Typhi Ty2
auaaucucugcgacaaucaggu

SEQ ID NO: 1768820 - RNA, 21 nt, Salmonella enterica enterica serovar Typhi Ty2
auaauggagaugaaaauaauu

SEQ ID NO: 1768821 - RNA, 19 nt, Salmonella enterica enterica serovar Typhi Ty2
auaaugaagcauaaaaaga

SEQ ID NO: 1768822 - RNA, 24 nt, Salmonella enterica enterica serovar Typhi Ty2
auaagaaauaguucaucgugaaau

SEQ ID NO: 1768823 - RNA, 17 nt, Salmonella enterica enterica serovar Typhi Ty2
auaagaaguaaacagaa

SEQ ID NO: 1768824 - RNA, 16 nt, Salmonella enterica enterica serovar Typhi Ty2
auaagaaguaaacaga

SEQ ID NO: 1768825 - RNA, 15 nt, Salmonella enterica enterica serovar Typhi Ty2
auaagaacuuuauca

SEQ ID NO: 1768826 - RNA, 22 nt, Salmonella enterica enterica serovar Typhi Ty2
auaaguuucucuucguuauuuu

SEQ ID NO: 1768827 - RNA, 18 nt, Salmonella enterica enterica serovar Typhi Ty2
auaagugcauguaaauaa

SEQ ID NO: 1768828 - RNA, 16 nt, Salmonella enterica enterica serovar Typhi Ty2
auaauaagaucaaagc

SEQ ID NO: 1768829 - RNA, 23 nt, Salmonella enterica enterica serovar Typhi Ty2
auaauacaccgccauauauuuac

SEQ ID NO: 1768830 - RNA, 12 nt, Salmonella enterica enterica serovar Typhi Ty2
auaauaccucaa

SEQ ID NO: 1768831 - RNA, 23 nt, Salmonella enterica enterica serovar Typhi Ty2
auaauacgaaauugagaauuauu

SEQ ID NO: 1768832 - RNA, 13 nt, Salmonella enterica enterica serovar Typhi Ty2
auaaaauaaacac

SEQ ID NO: 1768833 - RNA, 11 nt, Salmonella enterica enterica serovar Typhi Ty2
auaaaauaaac

SEQ ID NO: 1768834 - RNA, 17 nt, Salmonella enterica enterica serovar Typhi Ty2
aguuuuacgguuuaucc

SEQ ID NO: 1768835 - RNA, 19 nt, Salmonella enterica enterica serovar Typhi Ty2
auaaaauagugaucaucau

SEQ ID NO: 1768836 - RNA, 16 nt, Salmonella enterica enterica serovar Typhi Ty2
auaaaauccugcacgc

SEQ ID NO: 1768837 - RNA, 13 nt, Salmonella enterica enterica serovar Typhi Ty2
auaaaauucacuu

SEQ ID NO: 1768838 - RNA, 14 nt, Salmonella enterica enterica serovar Typhi Ty2
auaaaccaacagcc

SEQ ID NO: 1768839 - RNA, 23 nt, Salmonella enterica enterica serovar Typhi Ty2
auaaauaaccgguaacugucaga

SEQ ID NO: 1768840 - RNA, 13 nt, Salmonella enterica enterica serovar Typhi Ty2
auaaauaauaucg

SEQ ID NO: 1768841 - RNA, 19 nt, Salmonella enterica enterica serovar Typhi Ty2
auaaauaaccgguaacugu

SEQ ID NO: 1768842 - RNA, 14 nt, Salmonella enterica enterica serovar Typhi Ty2
auaaauagcgcugg

SEQ ID NO: 1768843 - RNA, 23 nt, Salmonella enterica enterica serovar Typhi Ty2
auaaauaguaaauagaaaauaau

SEQ ID NO: 1768844 - RNA, 20 nt, Salmonella enterica enterica serovar Typhi Ty2
auaaauaccgcaauaaacac

SEQ ID NO: 1768845 - RNA, 18 nt, Salmonella enterica enterica serovar Typhi Ty2
auaaauagccagcaucau

SEQ ID NO: 1768846 - RNA, 13 nt, Salmonella enterica enterica serovar Typhi Ty2
auaaauagccgac

SEQ ID NO: 1768847 - RNA, 16 nt, Salmonella enterica enterica serovar Typhi Ty2
auaaauauguuauuua

SEQ ID NO: 1768848 - RNA, 18 nt, Salmonella enterica enterica serovar Typhi Ty2
auaaauauuaaugaauaa

SEQ ID NO: 1768849 - RNA, 15 nt, Salmonella enterica enterica serovar Typhi Ty2
auaaaggucggcugc

SEQ ID NO: 1768850 - RNA, 17 nt, Salmonella enterica enterica serovar Typhi Ty2
auaaagcgaauaauuaa

SEQ ID NO: 1768851 - RNA, 14 nt, Salmonella enterica enterica serovar Typhi Ty2
auaaagcauaaaua

SEQ ID NO: 1768852 - RNA, 16 nt, Salmonella enterica enterica serovar Typhi Ty2
auaaagcauaaauaca

SEQ ID NO: 1768853 - RNA, 17 nt, Salmonella enterica enterica serovar Typhi Ty2
auaaagcacagccccag

SEQ ID NO: 1768854 - RNA, 15 nt, Salmonella enterica enterica serovar Typhi Ty2
auaaaccggcggccu

SEQ ID NO: 1768855 - RNA, 21 nt, Salmonella enterica enterica serovar Typhi Ty2
auaaaccgccgcuuugauuug

SEQ ID NO: 1768856 - RNA, 16 nt, Salmonella enterica enterica serovar Typhi Ty2
auaaccuauuuugcaa

SEQ ID NO: 1768857 - RNA, 14 nt, Salmonella enterica enterica serovar Typhi Ty2
auaaccgcccgcgg

SEQ ID NO: 1768858 - RNA, 22 nt, Salmonella enterica enterica serovar Typhi Ty2
auaaccgccgccgcgcccgcgu

SEQ ID NO: 1768859 - RNA, 22 nt, Salmonella enterica enterica serovar Typhi Ty2
auaaccagauggggcuuccauu

SEQ ID NO: 1768860 - RNA, 22 nt, Salmonella enterica enterica serovar Typhi Ty2
auaaccagaaaaccgacagcaa

SEQ ID NO: 1768861 - RNA, 21 nt, Salmonella enterica enterica serovar Typhi Ty2
auaaccacgaaaauuauuuuc

SEQ ID NO: 1768862 - RNA, 16 nt, Salmonella enterica enterica serovar Typhi Ty2
auaaccacgaaaauua

SEQ ID NO: 1768863 - RNA, 17 nt, Salmonella enterica enterica serovar Typhi Ty2
auaaccacgaaaauuau

SEQ ID NO: 1768864 - RNA, 22 nt, Salmonella enterica enterica serovar Typhi Ty2
auaacguuacauuuuccaugcc

SEQ ID NO: 1768865 - RNA, 16 nt, Salmonella enterica enterica serovar Typhi Ty2
auaagaaagauaaaau

SEQ ID NO: 1768866 - RNA, 15 nt, Salmonella enterica enterica serovar Typhi Ty2
auaacguguuaugcg

SEQ ID NO: 1768867 - RNA, 17 nt, Salmonella enterica enterica serovar Typhi Ty2
auaaaucgcagauagca

SEQ ID NO: 1768868 - RNA, 20 nt, Salmonella enterica enterica serovar Typhi Ty2
auaaaucgucggcaggguuu

SEQ ID NO: 1768869 - RNA, 14 nt, Salmonella enterica enterica serovar Typhi Ty2
auaaauuuuuuaac

SEQ ID NO: 1768870 - RNA, 20 nt, Salmonella enterica enterica serovar Typhi Ty2
auaacaucguaaaucaaaug

SEQ ID NO: 1768871 - RNA, 14 nt, Salmonella enterica enterica serovar Typhi Ty2
auaacaucuuccau

SEQ ID NO: 1768872 - RNA, 21 nt, Salmonella enterica enterica serovar Typhi Ty2
auaaccaaacgcgcauuuuau

SEQ ID NO: 1768873 - RNA, 14 nt, Salmonella enterica enterica serovar Typhi Ty2
auaaccaauaauug

SEQ ID NO: 1768874 - RNA, 18 nt, Salmonella enterica enterica serovar Typhi Ty2
auaacaccgcauggcugg

SEQ ID NO: 1768875 - RNA, 19 nt, Salmonella enterica enterica serovar Typhi Ty2
aggaacgcgcagaccguuu

SEQ ID NO: 1768876 - RNA, 23 nt, Salmonella enterica enterica serovar Typhi Ty2
aggaacgcgcagaccguuuucaa

SEQ ID NO: 1768877 - RNA, 19 nt, Salmonella enterica enterica serovar Typhi Ty2
aggaacuaacuccggagcu

SEQ ID NO: 1768878 - RNA, 12 nt, Salmonella enterica enterica serovar Typhi Ty2
aggaacagugac

SEQ ID NO: 1768879 - RNA, 20 nt, Salmonella enterica enterica serovar Typhi Ty2
aggaacaucgacccccaccu

SEQ ID NO: 1768880 - RNA, 14 nt, Salmonella enterica enterica serovar Typhi Ty2
aggaaccacaucca

SEQ ID NO: 1768881 - RNA, 22 nt, Salmonella enterica enterica serovar Typhi Ty2
aggaagacuauccagccaggga

SEQ ID NO: 1768882 - RNA, 18 nt, Salmonella enterica enterica serovar Typhi Ty2
aggaacugcggccagaca

SEQ ID NO: 1768883 - RNA, 17 nt, Salmonella enterica enterica serovar Typhi Ty2
aggaacuguucagccag

SEQ ID NO: 1768884 - RNA, 20 nt, Salmonella enterica enterica serovar Typhi Ty2
agcuuuucauauagucauaa

SEQ ID NO: 1768885 - RNA, 22 nt, Salmonella enterica enterica serovar Typhi Ty2
agcuuuucaugacgcucuccuc

SEQ ID NO: 1768886 - RNA, 21 nt, Salmonella enterica enterica serovar Typhi Ty2
agcuuugcguaaaaaacauca

SEQ ID NO: 1768887 - RNA, 22 nt, Salmonella enterica enterica serovar Typhi Ty2
aggaaauauuaauuaaggauga

SEQ ID NO: 1768888 - RNA, 14 nt, Salmonella enterica enterica serovar Typhi Ty2
aggaaauauuaauu

SEQ ID NO: 1768889 - RNA, 14 nt, Salmonella enterica enterica serovar Typhi Ty2
aggaaauaacgugc

SEQ ID NO: 1768890 - RNA, 21 nt, Salmonella enterica enterica serovar Typhi Ty2
aggaaauccagcagaauaaca

SEQ ID NO: 1768891 - RNA, 16 nt, Salmonella enterica enterica serovar Typhi Ty2
aggaaaucuuccaguu

SEQ ID NO: 1768892 - RNA, 14 nt, Salmonella enterica enterica serovar Typhi Ty2
aggagaugucccac

SEQ ID NO: 1768893 - RNA, 17 nt, Salmonella enterica enterica serovar Typhi Ty2
aggagaugaccugccca

SEQ ID NO: 1768894 - RNA, 21 nt, Salmonella enterica enterica serovar Typhi Ty2
aggagaucggcgcagguccau

SEQ ID NO: 1768895 - RNA, 12 nt, Salmonella enterica enterica serovar Typhi Ty2
aggacaucaaag

SEQ ID NO: 1768896 - RNA, 16 nt, Salmonella enterica enterica serovar Typhi Ty2
aggacaucaaaggcag

SEQ ID NO: 1768897 - RNA, 14 nt, Salmonella enterica enterica serovar Typhi Ty2
aggaccaacaccag

SEQ ID NO: 1768898 - RNA, 17 nt, Salmonella enterica enterica serovar Typhi Ty2
aggaccaaaacaguacu

SEQ ID NO: 1768899 - RNA, 17 nt, Salmonella enterica enterica serovar Typhi Ty2
aggacugauacagccaa

SEQ ID NO: 1768900 - RNA, 11 nt, Salmonella enterica enterica serovar Typhi Ty2
aggagaaaauu

SEQ ID NO: 1768901 - RNA, 22 nt, Salmonella enterica enterica serovar Typhi Ty2
aggaauuacgggcgauacaccu

SEQ ID NO: 1768902 - RNA, 13 nt, Salmonella enterica enterica serovar Typhi Ty2
aggaagucagcuu

SEQ ID NO: 1768903 - RNA, 20 nt, Salmonella enterica enterica serovar Typhi Ty2
aggaaggucgcauccgcguu

SEQ ID NO: 1768904 - RNA, 18 nt, Salmonella enterica enterica serovar Typhi Ty2
aggaaggcgguaagagag

SEQ ID NO: 1768905 - RNA, 22 nt, Salmonella enterica enterica serovar Typhi Ty2
aggaauuuucccauaaaagagc

SEQ ID NO: 1768906 - RNA, 15 nt, Salmonella enterica enterica serovar Typhi Ty2
aggaauuuaucaaca

SEQ ID NO: 1768907 - RNA, 14 nt, Salmonella enterica enterica serovar Typhi Ty2
aggacacaguaaug

SEQ ID NO: 1768908 - RNA, 22 nt, Salmonella enterica enterica serovar Typhi Ty2
agcuugcauggccggucuuaug

SEQ ID NO: 1768909 - RNA, 14 nt, Salmonella enterica enterica serovar Typhi Ty2
agcuugaucaucag

SEQ ID NO: 1768910 - RNA, 20 nt, Salmonella enterica enterica serovar Typhi Ty2
agcuucugucugcgugaaga

SEQ ID NO: 1768911 - RNA, 20 nt, Salmonella enterica enterica serovar Typhi Ty2
agcuuggcggcuuccuguuu

SEQ ID NO: 1768912 - RNA, 16 nt, Salmonella enterica enterica serovar Typhi Ty2
agcuuaauuuuauagc

SEQ ID NO: 1768913 - RNA, 20 nt, Salmonella enterica enterica serovar Typhi Ty2
agcuuaggauaagaauaggu

SEQ ID NO: 1768914 - RNA, 14 nt, Salmonella enterica enterica serovar Typhi Ty2
agcuucaugcgccg

SEQ ID NO: 1768915 - RNA, 22 nt, Salmonella enterica enterica serovar Typhi Ty2
agcuuccagcaaaccuuccgcc

SEQ ID NO: 1768916 - RNA, 17 nt, Salmonella enterica enterica serovar Typhi Ty2
agcugugcguugucuac

SEQ ID NO: 1768917 - RNA, 13 nt, Salmonella enterica enterica serovar Typhi Ty2
agcuguagcauaa

SEQ ID NO: 1768918 - RNA, 19 nt, Salmonella enterica enterica serovar Typhi Ty2
agcugguauaggccaggcu

SEQ ID NO: 1768919 - RNA, 16 nt, Salmonella enterica enterica serovar Typhi Ty2
agcugcuuugccugga

SEQ ID NO: 1768920 - RNA, 21 nt, Salmonella enterica enterica serovar Typhi Ty2
agcugguugauauugugcaua

SEQ ID NO: 1768921 - RNA, 23 nt, Salmonella enterica enterica serovar Typhi Ty2
agcuguaccaucaccugaugucc

SEQ ID NO: 1768922 - RNA, 22 nt, Salmonella enterica enterica serovar Typhi Ty2
agcugcugacguagauucugau

SEQ ID NO: 1768923 - RNA, 21 nt, Salmonella enterica enterica serovar Typhi Ty2
agcugcccggauaaccgcccg

SEQ ID NO: 1768924 - RNA, 17 nt, Salmonella enterica enterica serovar Typhi Ty2
aggcaaaaugccagccc

SEQ ID NO: 1768925 - RNA, 23 nt, Salmonella enterica enterica serovar Typhi Ty2
aggcaagauccggacugauaguc

SEQ ID NO: 1768926 - RNA, 15 nt, Salmonella enterica enterica serovar Typhi Ty2
aggauucgccauucc

SEQ ID NO: 1768927 - RNA, 20 nt, Salmonella enterica enterica serovar Typhi Ty2
aggauuauuggcaucauaaa

SEQ ID NO: 1768928 - RNA, 17 nt, Salmonella enterica enterica serovar Typhi Ty2
aggagcucggccaucug

SEQ ID NO: 1768929 - RNA, 18 nt, Salmonella enterica enterica serovar Typhi Ty2
aggauuagacuucuucca

SEQ ID NO: 1768930 - RNA, 19 nt, Salmonella enterica enterica serovar Typhi Ty2
aggagcgccguggaaaaga

SEQ ID NO: 1768931 - RNA, 19 nt, Salmonella enterica enterica serovar Typhi Ty2
aggagcgcgacgacggcgc

SEQ ID NO: 1768932 - RNA, 15 nt, Salmonella enterica enterica serovar Typhi Ty2
aggagcauagauaac

SEQ ID NO: 1768933 - RNA, 14 nt, Salmonella enterica enterica serovar Typhi Ty2
aggcaucugaaaug

SEQ ID NO: 1768934 - RNA, 19 nt, Salmonella enterica enterica serovar Typhi Ty2
aggcauggccuucaaucag

SEQ ID NO: 1768935 - RNA, 16 nt, Salmonella enterica enterica serovar Typhi Ty2
aggcauuaaaaaaacg

SEQ ID NO: 1768936 - RNA, 14 nt, Salmonella enterica enterica serovar Typhi Ty2
aggcauuaaaaaaa

SEQ ID NO: 1768937 - RNA, 16 nt, Salmonella enterica enterica serovar Typhi Ty2
aggcauguuaugaaua

SEQ ID NO: 1768938 - RNA, 21 nt, Salmonella enterica enterica serovar Typhi Ty2
aggcaccuguaaccuuaaaag

SEQ ID NO: 1768939 - RNA, 18 nt, Salmonella enterica enterica serovar Typhi Ty2
aggcaccugugccauacu

SEQ ID NO: 1768940 - RNA, 18 nt, Salmonella enterica enterica serovar Typhi Ty2
aggccaaauagaacgcuc

SEQ ID NO: 1768941 - RNA, 20 nt, Salmonella enterica enterica serovar Typhi Ty2
aggccaaacccugcgccgca

SEQ ID NO: 1768942 - RNA, 18 nt, Salmonella enterica enterica serovar Typhi Ty2
aggcauuucgccgccauc

SEQ ID NO: 1768943 - RNA, 19 nt, Salmonella enterica enterica serovar Typhi Ty2
aggccaaguuuagaaaaua

SEQ ID NO: 1768944 - RNA, 22 nt, Salmonella enterica enterica serovar Typhi Ty2
aggcccaccgcacgggcaaagc

SEQ ID NO: 1768945 - RNA, 22 nt, Salmonella enterica enterica serovar Typhi Ty2
aggcgccgcucaucaccagcag

SEQ ID NO: 1768946 - RNA, 17 nt, Salmonella enterica enterica serovar Typhi Ty2
aggcgcgcagcugccac

SEQ ID NO: 1768947 - RNA, 14 nt, Salmonella enterica enterica serovar Typhi Ty2
aggcgcgcagcugc

SEQ ID NO: 1768948 - RNA, 22 nt, Salmonella enterica enterica serovar Typhi Ty2
aggcgccucgcgcggcgguuca

SEQ ID NO: 1768949 - RNA, 21 nt, Salmonella enterica enterica serovar Typhi Ty2
aggcgcgaaaaauaggauggc

SEQ ID NO: 1768950 - RNA, 18 nt, Salmonella enterica enterica serovar Typhi Ty2
aggcgcgaccucaucaaa

SEQ ID NO: 1768951 - RNA, 19 nt, Salmonella enterica enterica serovar Typhi Ty2
aggcgcaucagaaaaaccu

SEQ ID NO: 1768952 - RNA, 18 nt, Salmonella enterica enterica serovar Typhi Ty2
aggcgcguagcuggccuu

SEQ ID NO: 1768953 - RNA, 18 nt, Salmonella enterica enterica serovar Typhi Ty2
aggcgcaaaaccauacug

SEQ ID NO: 1768954 - RNA, 14 nt, Salmonella enterica enterica serovar Typhi Ty2
aggcgcaaaccggu

SEQ ID NO: 1768955 - RNA, 13 nt, Salmonella enterica enterica serovar Typhi Ty2
aggcgcaaaacca

SEQ ID NO: 1768956 - RNA, 17 nt, Salmonella enterica enterica serovar Typhi Ty2
aggcgauucaacagggc

SEQ ID NO: 1768957 - RNA, 22 nt, Salmonella enterica enterica serovar Typhi Ty2
aggcgaucggcgugaauaaaau

SEQ ID NO: 1768958 - RNA, 21 nt, Salmonella enterica enterica serovar Typhi Ty2
aggcgauccuguucaaacauc

SEQ ID NO: 1768959 - RNA, 14 nt, Salmonella enterica enterica serovar Typhi Ty2
aggcgcaucagaaa

SEQ ID NO: 1768960 - RNA, 15 nt, Salmonella enterica enterica serovar Typhi Ty2
aggcgcaucagaaaa

SEQ ID NO: 1768961 - RNA, 23 nt, Salmonella enterica enterica serovar Typhi Ty2
aggcgauaccuaaucccuggcga

SEQ ID NO: 1768962 - RNA, 15 nt, Salmonella enterica enterica serovar Typhi Ty2
aggcgauagccccag

SEQ ID NO: 1768963 - RNA, 18 nt, Salmonella enterica enterica serovar Typhi Ty2
aggcgaccaauauccgca

SEQ ID NO: 1768964 - RNA, 16 nt, Salmonella enterica enterica serovar Typhi Ty2
aggcgacgccgccauc

SEQ ID NO: 1768965 - RNA, 15 nt, Salmonella enterica enterica serovar Typhi Ty2
aggcgacaaucucac

SEQ ID NO: 1768966 - RNA, 17 nt, Salmonella enterica enterica serovar Typhi Ty2
aggcgacgaugugcaua

SEQ ID NO: 1768967 - RNA, 13 nt, Salmonella enterica enterica serovar Typhi Ty2
aggcgaaucccca

SEQ ID NO: 1768968 - RNA, 21 nt, Salmonella enterica enterica serovar Typhi Ty2
aggccuacacucugcgcgcga

SEQ ID NO: 1768969 - RNA, 18 nt, Salmonella enterica enterica serovar Typhi Ty2
aggccugauaagcacagg

SEQ ID NO: 1768970 - RNA, 22 nt, Salmonella enterica enterica serovar Typhi Ty2
aggccucuuucaugcggucuuc

SEQ ID NO: 1768971 - RNA, 13 nt, Salmonella enterica enterica serovar Typhi Ty2
aggccucuaucuu

SEQ ID NO: 1768972 - RNA, 21 nt, Salmonella enterica enterica serovar Typhi Ty2
aggccuggcuggaugaggcgc

SEQ ID NO: 1768973 - RNA, 22 nt, Salmonella enterica enterica serovar Typhi Ty2
aggccugccggguuuaaugcgc

SEQ ID NO: 1768974 - RNA, 18 nt, Salmonella enterica enterica serovar Typhi Ty2
aggccuuuugcagcagcg

SEQ ID NO: 1768975 - RNA, 12 nt, Salmonella enterica enterica serovar Typhi Ty2
aggcgaaaacau

SEQ ID NO: 1768976 - RNA, 17 nt, Salmonella enterica enterica serovar Typhi Ty2
aggccuuuucguacaug

SEQ ID NO: 1768977 - RNA, 20 nt, Salmonella enterica enterica serovar Typhi Ty2
aggcgaaaccggccgccauc

SEQ ID NO: 1768978 - RNA, 16 nt, Salmonella enterica enterica serovar Typhi Ty2
aggccgcaaacagcac

SEQ ID NO: 1768979 - RNA, 14 nt, Salmonella enterica enterica serovar Typhi Ty2
aggccgggaaaucu

SEQ ID NO: 1768980 - RNA, 23 nt, Salmonella enterica enterica serovar Typhi Ty2
aggccguuauugucaugcuaaaa

SEQ ID NO: 1768981 - RNA, 22 nt, Salmonella enterica enterica serovar Typhi Ty2
agguaacugcacaagccccacg

SEQ ID NO: 1768982 - RNA, 18 nt, Salmonella enterica enterica serovar Typhi Ty2
agggugcaaagaaacguu

SEQ ID NO: 1768983 - RNA, 17 nt, Salmonella enterica enterica serovar Typhi Ty2
agggugcagcaaauaau

SEQ ID NO: 1768984 - RNA, 18 nt, Salmonella enterica enterica serovar Typhi Ty2
agggugcagcaaauaauc

SEQ ID NO: 1768985 - RNA, 21 nt, Salmonella enterica enterica serovar Typhi Ty2
agguacuuucccccagauugu

SEQ ID NO: 1768986 - RNA, 14 nt, Salmonella enterica enterica serovar Typhi Ty2
agguacgcguuuca

SEQ ID NO: 1768987 - RNA, 17 nt, Salmonella enterica enterica serovar Typhi Ty2
agguaguaacgggcauc

SEQ ID NO: 1768988 - RNA, 17 nt, Salmonella enterica enterica serovar Typhi Ty2
agguaugcuucagcguu

SEQ ID NO: 1768989 - RNA, 13 nt, Salmonella enterica enterica serovar Typhi Ty2
agguauccagcag

SEQ ID NO: 1768990 - RNA, 14 nt, Salmonella enterica enterica serovar Typhi Ty2
aggucauuccugcg

SEQ ID NO: 1768991 - RNA, 16 nt, Salmonella enterica enterica serovar Typhi Ty2
aggucauuauucaggc

SEQ ID NO: 1768992 - RNA, 19 nt, Salmonella enterica enterica serovar Typhi Ty2
aggucaucuuucagaugca

SEQ ID NO: 1768993 - RNA, 21 nt, Salmonella enterica enterica serovar Typhi Ty2
aggucggccaaccgccacaau

SEQ ID NO: 1768994 - RNA, 23 nt, Salmonella enterica enterica serovar Typhi Ty2
aggucgcuauccagcaguaaaua

SEQ ID NO: 1768995 - RNA, 22 nt, Salmonella enterica enterica serovar Typhi Ty2
aggucguaaggauacucagcga

SEQ ID NO: 1768996 - RNA, 14 nt, Salmonella enterica enterica serovar Typhi Ty2
aggucgucuucuug

SEQ ID NO: 1768997 - RNA, 14 nt, Salmonella enterica enterica serovar Typhi Ty2
aggucggcugcccu

SEQ ID NO: 1768998 - RNA, 21 nt, Salmonella enterica enterica serovar Typhi Ty2
aggucuauugccuaaauaacu

SEQ ID NO: 1768999 - RNA, 22 nt, Salmonella enterica enterica serovar Typhi Ty2
aggucguuaggccacuucacac

SEQ ID NO: 1769000 - RNA, 14 nt, Salmonella enterica enterica serovar Typhi Ty2
aggugcuuaucuga

SEQ ID NO: 1769001 - RNA, 17 nt, Salmonella enterica enterica serovar Typhi Ty2
aggugauguccagacca

SEQ ID NO: 1769002 - RNA, 16 nt, Salmonella enterica enterica serovar Typhi Ty2
agggcguuuuauaagc

SEQ ID NO: 1769003 - RNA, 17 nt, Salmonella enterica enterica serovar Typhi Ty2
agggcgugacgcgccag

SEQ ID NO: 1769004 - RNA, 22 nt, Salmonella enterica enterica serovar Typhi Ty2
agggcgucuuauccggccuacc

SEQ ID NO: 1769005 - RNA, 20 nt, Salmonella enterica enterica serovar Typhi Ty2
agggcaccugggcaauaacg

SEQ ID NO: 1769006 - RNA, 18 nt, Salmonella enterica enterica serovar Typhi Ty2
agggcaccugggcaauaa

SEQ ID NO: 1769007 - RNA, 20 nt, Salmonella enterica enterica serovar Typhi Ty2
aggggcuccugcgccggacg

SEQ ID NO: 1769008 - RNA, 15 nt, Salmonella enterica enterica serovar Typhi Ty2
aggggcuccugcgcc

SEQ ID NO: 1769009 - RNA, 16 nt, Salmonella enterica enterica serovar Typhi Ty2
agggguguuacgccau

SEQ ID NO: 1769010 - RNA, 14 nt, Salmonella enterica enterica serovar Typhi Ty2
agggcuuacucccu

SEQ ID NO: 1769011 - RNA, 17 nt, Salmonella enterica enterica serovar Typhi Ty2
agggcuggaaaaucacg

SEQ ID NO: 1769012 - RNA, 23 nt, Salmonella enterica enterica serovar Typhi Ty2
agggaggugcucucccagcugag

SEQ ID NO: 1769013 - RNA, 23 nt, Salmonella enterica enterica serovar Typhi Ty2
agggaguaugcggucaaaagcug

SEQ ID NO: 1769014 - RNA, 12 nt, Salmonella enterica enterica serovar Typhi Ty2
agggagggccaa

SEQ ID NO: 1769015 - RNA, 16 nt, Salmonella enterica enterica serovar Typhi Ty2
agggagugagucccca

SEQ ID NO: 1769016 - RNA, 23 nt, Salmonella enterica enterica serovar Typhi Ty2
agggauaacaguauuuguucaga

SEQ ID NO: 1769017 - RNA, 20 nt, Salmonella enterica enterica serovar Typhi Ty2
agggcaaaguuaucccugcu

SEQ ID NO: 1769018 - RNA, 21 nt, Salmonella enterica enterica serovar Typhi Ty2
agggcaaaguuaucccugcug

SEQ ID NO: 1769019 - RNA, 17 nt, Salmonella enterica enterica serovar Typhi Ty2
agggacuuauuaaaaau

SEQ ID NO: 1769020 - RNA, 19 nt, Salmonella enterica enterica serovar Typhi Ty2
agggacuauaggcaaugau

SEQ ID NO: 1769021 - RNA, 18 nt, Salmonella enterica enterica serovar Typhi Ty2
agggacgcauccugcacu

SEQ ID NO: 1769022 - RNA, 18 nt, Salmonella enterica enterica serovar Typhi Ty2
agggaagacuauuaccac

SEQ ID NO: 1769023 - RNA, 16 nt, Salmonella enterica enterica serovar Typhi Ty2
agggaaaaauagcgau

SEQ ID NO: 1769024 - RNA, 23 nt, Salmonella enterica enterica serovar Typhi Ty2
agggaaaccauguugaucguaaa

SEQ ID NO: 1769025 - RNA, 23 nt, Salmonella enterica enterica serovar Typhi Ty2
aggcuuggcagccccugaaauaa

SEQ ID NO: 1769026 - RNA, 16 nt, Salmonella enterica enterica serovar Typhi Ty2
aggcgcuugugauauc

SEQ ID NO: 1769027 - RNA, 21 nt, Salmonella enterica enterica serovar Typhi Ty2
aggcggaaaacauucgcccgu

SEQ ID NO: 1769028 - RNA, 14 nt, Salmonella enterica enterica serovar Typhi Ty2
aggcgcuugcgccg

SEQ ID NO: 1769029 - RNA, 17 nt, Salmonella enterica enterica serovar Typhi Ty2
aggcuuuaugcugacaa

SEQ ID NO: 1769030 - RNA, 15 nt, Salmonella enterica enterica serovar Typhi Ty2
aguaguuccagcaua

SEQ ID NO: 1769031 - RNA, 13 nt, Salmonella enterica enterica serovar Typhi Ty2
aguaguuaaaaaa

SEQ ID NO: 1769032 - RNA, 16 nt, Salmonella enterica enterica serovar Typhi Ty2
aguaguugguggguga

SEQ ID NO: 1769033 - RNA, 17 nt, Salmonella enterica enterica serovar Typhi Ty2
aguagcuaaugauuauc

SEQ ID NO: 1769034 - RNA, 17 nt, Salmonella enterica enterica serovar Typhi Ty2
aguagccaugcauaaug

SEQ ID NO: 1769035 - RNA, 15 nt, Salmonella enterica enterica serovar Typhi Ty2
aguagcagacagccg

SEQ ID NO: 1769036 - RNA, 21 nt, Salmonella enterica enterica serovar Typhi Ty2
aguagcguucuuuccaguucu

SEQ ID NO: 1769037 - RNA, 20 nt, Salmonella enterica enterica serovar Typhi Ty2
aguagcguucuuuccaguuc

SEQ ID NO: 1769038 - RNA, 22 nt, Salmonella enterica enterica serovar Typhi Ty2
aguaccauaccggugcgcccca

SEQ ID NO: 1769039 - RNA, 11 nt, Salmonella enterica enterica serovar Typhi Ty2
aguagauggcg

SEQ ID NO: 1769040 - RNA, 19 nt, Salmonella enterica enterica serovar Typhi Ty2
aguaccgaacagccaggcu

SEQ ID NO: 1769041 - RNA, 14 nt, Salmonella enterica enterica serovar Typhi Ty2
aguagaucaccagc

SEQ ID NO: 1769042 - RNA, 18 nt, Salmonella enterica enterica serovar Typhi Ty2
aguaccgaacagccaggc

SEQ ID NO: 1769043 - RNA, 21 nt, Salmonella enterica enterica serovar Typhi Ty2
aguauaaauaccuuauucagc

SEQ ID NO: 1769044 - RNA, 21 nt, Salmonella enterica enterica serovar Typhi Ty2
aguaguuguuauagcgcgccc

SEQ ID NO: 1769045 - RNA, 22 nt, Salmonella enterica enterica serovar Typhi Ty2
aguauaauucgucaauaccuaa

SEQ ID NO: 1769046 - RNA, 21 nt, Salmonella enterica enterica serovar Typhi Ty2
aguaucccuuucaaaaaagag

SEQ ID NO: 1769047 - RNA, 23 nt, Salmonella enterica enterica serovar Typhi Ty2
aguaucgcucuauauccugcccu

SEQ ID NO: 1769048 - RNA, 22 nt, Salmonella enterica enterica serovar Typhi Ty2
aguaucucgccaguaaagacac

SEQ ID NO: 1769049 - RNA, 19 nt, Salmonella enterica enterica serovar Typhi Ty2
aguauggcgaccaggaauu

SEQ ID NO: 1769050 - RNA, 19 nt, Salmonella enterica enterica serovar Typhi Ty2
aguauggccucuucaaauu

SEQ ID NO: 1769051 - RNA, 23 nt, Salmonella enterica enterica serovar Typhi Ty2
aguaugccucgcgcaccauaaua

SEQ ID NO: 1769052 - RNA, 14 nt, Salmonella enterica enterica serovar Typhi Ty2
aguauuauccauug

SEQ ID NO: 1769053 - RNA, 15 nt, Salmonella enterica enterica serovar Typhi Ty2
aguauuuacaaaaaa

SEQ ID NO: 1769054 - RNA, 11 nt, Salmonella enterica enterica serovar Typhi Ty2
aguauuucaga

SEQ ID NO: 1769055 - RNA, 14 nt, Salmonella enterica enterica serovar Typhi Ty2
aguauuauuuugau

SEQ ID NO: 1769056 - RNA, 12 nt, Salmonella enterica enterica serovar Typhi Ty2
aguaauccauag

SEQ ID NO: 1769057 - RNA, 12 nt, Salmonella enterica enterica serovar Typhi Ty2
aguaauauuaaa

SEQ ID NO: 1769058 - RNA, 21 nt, Salmonella enterica enterica serovar Typhi Ty2
aguacaaacaaauaaauccau

SEQ ID NO: 1769059 - RNA, 12 nt, Salmonella enterica enterica serovar Typhi Ty2
aguaccagcacu

SEQ ID NO: 1769060 - RNA, 20 nt, Salmonella enterica enterica serovar Typhi Ty2
aguaaccccauacaguaguu

SEQ ID NO: 1769061 - RNA, 22 nt, Salmonella enterica enterica serovar Typhi Ty2
aguaacccgauacccugagccc

SEQ ID NO: 1769062 - RNA, 20 nt, Salmonella enterica enterica serovar Typhi Ty2
aguaauaacaaaaaacauau

SEQ ID NO: 1769063 - RNA, 16 nt, Salmonella enterica enterica serovar Typhi Ty2
aguaacaccgcggcgc

SEQ ID NO: 1769064 - RNA, 18 nt, Salmonella enterica enterica serovar Typhi Ty2
aguaaacuuucagaccuu

SEQ ID NO: 1769065 - RNA, 17 nt, Salmonella enterica enterica serovar Typhi Ty2
aguaaauuauuccuuga

SEQ ID NO: 1769066 - RNA, 13 nt, Salmonella enterica enterica serovar Typhi Ty2
agguggaagaaac

SEQ ID NO: 1769067 - RNA, 21 nt, Salmonella enterica enterica serovar Typhi Ty2
agguggcccauuuuggccgcu

SEQ ID NO: 1769068 - RNA, 15 nt, Salmonella enterica enterica serovar Typhi Ty2
agguugcgcccggcg

SEQ ID NO: 1769069 - RNA, 21 nt, Salmonella enterica enterica serovar Typhi Ty2
agguugcucagguuauacugu

SEQ ID NO: 1769070 - RNA, 16 nt, Salmonella enterica enterica serovar Typhi Ty2
aguaaaauuuuuuuca

SEQ ID NO: 1769071 - RNA, 15 nt, Salmonella enterica enterica serovar Typhi Ty2
agguuucuucaucaa

SEQ ID NO: 1769072 - RNA, 20 nt, Salmonella enterica enterica serovar Typhi Ty2
agguuugcgcggcggguaaa

SEQ ID NO: 1769073 - RNA, 15 nt, Salmonella enterica enterica serovar Typhi Ty2
agguuuaaaccacuc

SEQ ID NO: 1769074 - RNA, 21 nt, Salmonella enterica enterica serovar Typhi Ty2
agguuuaauguugccguggca

SEQ ID NO: 1769075 - RNA, 22 nt, Salmonella enterica enterica serovar Typhi Ty2
agcuaaugauuaucuuuuuuag

SEQ ID NO: 1769076 - RNA, 18 nt, Salmonella enterica enterica serovar Typhi Ty2
agcuaaugcaauaaacua

SEQ ID NO: 1769077 - RNA, 17 nt, Salmonella enterica enterica serovar Typhi Ty2
agcuaaucacccacuuc

SEQ ID NO: 1769078 - RNA, 22 nt, Salmonella enterica enterica serovar Typhi Ty2
agcuaacgacccgaaguggugg

SEQ ID NO: 1769079 - RNA, 23 nt, Salmonella enterica enterica serovar Typhi Ty2
agcuaacgacccgaagugguggg

SEQ ID NO: 1769080 - RNA, 19 nt, Salmonella enterica enterica serovar Typhi Ty2
agcuaaauaaaaauaauca

SEQ ID NO: 1769081 - RNA, 20 nt, Salmonella enterica enterica serovar Typhi Ty2
agcguuuugauguccagaug

SEQ ID NO: 1769082 - RNA, 13 nt, Salmonella enterica enterica serovar Typhi Ty2
agcuaaaaacagc

SEQ ID NO: 1769083 - RNA, 18 nt, Salmonella enterica enterica serovar Typhi Ty2
agcguuuuuaccggcucg

SEQ ID NO: 1769084 - RNA, 19 nt, Salmonella enterica enterica serovar Typhi Ty2
agcguugcagccacguugc

SEQ ID NO: 1769085 - RNA, 17 nt, Salmonella enterica enterica serovar Typhi Ty2
agcguucuuuccaguuc

SEQ ID NO: 1769086 - RNA, 14 nt, Salmonella enterica enterica serovar Typhi Ty2
agcguuucacgcgc

SEQ ID NO: 1769087 - RNA, 22 nt, Salmonella enterica enterica serovar Typhi Ty2
agcguuuguuugucgauuuccg

SEQ ID NO: 1769088 - RNA, 21 nt, Salmonella enterica enterica serovar Typhi Ty2
agcguuuuauccguuuccgca

SEQ ID NO: 1769089 - RNA, 19 nt, Salmonella enterica enterica serovar Typhi Ty2
agcguuuauguuugcugau

SEQ ID NO: 1769090 - RNA, 19 nt, Salmonella enterica enterica serovar Typhi Ty2
agcuauccaguuucugacg

SEQ ID NO: 1769091 - RNA, 19 nt, Salmonella enterica enterica serovar Typhi Ty2
agcuaucgcgccggacagc

SEQ ID NO: 1769092 - RNA, 22 nt, Salmonella enterica enterica serovar Typhi Ty2
agcuauuccuguauaauuauuu

SEQ ID NO: 1769093 - RNA, 18 nt, Salmonella enterica enterica serovar Typhi Ty2
agcuauguuuaagccaga

SEQ ID NO: 1769094 - RNA, 21 nt, Salmonella enterica enterica serovar Typhi Ty2
agcucaggguccccauauccc

SEQ ID NO: 1769095 - RNA, 22 nt, Salmonella enterica enterica serovar Typhi Ty2
agcucaggguccccauaucccg

SEQ ID NO: 1769096 - RNA, 19 nt, Salmonella enterica enterica serovar Typhi Ty2
agcucaguccagccgccgc

SEQ ID NO: 1769097 - RNA, 18 nt, Salmonella enterica enterica serovar Typhi Ty2
agcucagcuggauagagc

SEQ ID NO: 1769098 - RNA, 17 nt, Salmonella enterica enterica serovar Typhi Ty2
agcucacgcgccagcac

SEQ ID NO: 1769099 - RNA, 18 nt, Salmonella enterica enterica serovar Typhi Ty2
agcucacgcgccagcacc

SEQ ID NO: 1769100 - RNA, 19 nt, Salmonella enterica enterica serovar Typhi Ty2
agcucacgcgccagcacca

SEQ ID NO: 1769101 - RNA, 21 nt, Salmonella enterica enterica serovar Typhi Ty2
agcucauguagucauauugcg

SEQ ID NO: 1769102 - RNA, 13 nt, Salmonella enterica enterica serovar Typhi Ty2
agcucauuuuuac

SEQ ID NO: 1769103 - RNA, 17 nt, Salmonella enterica enterica serovar Typhi Ty2
agcucaguugguagagc

SEQ ID NO: 1769104 - RNA, 22 nt, Salmonella enterica enterica serovar Typhi Ty2
agcucaguugguagagcccugg

SEQ ID NO: 1769105 - RNA, 17 nt, Salmonella enterica enterica serovar Typhi Ty2
agcucauacccuuccag

SEQ ID NO: 1769106 - RNA, 18 nt, Salmonella enterica enterica serovar Typhi Ty2
agcucaguuuccagccag

SEQ ID NO: 1769107 - RNA, 22 nt, Salmonella enterica enterica serovar Typhi Ty2
agcggcguuuuuuccugcuggu

SEQ ID NO: 1769108 - RNA, 22 nt, Salmonella enterica enterica serovar Typhi Ty2
agcggcguugcccaguacggcg

SEQ ID NO: 1769109 - RNA, 14 nt, Salmonella enterica enterica serovar Typhi Ty2
agcggcugcgccug

SEQ ID NO: 1769110 - RNA, 13 nt, Salmonella enterica enterica serovar Typhi Ty2
agcgggggcgccu

SEQ ID NO: 1769111 - RNA, 23 nt, Salmonella enterica enterica serovar Typhi Ty2
agcgguugcauaaaauccuggua

SEQ ID NO: 1769112 - RNA, 18 nt, Salmonella enterica enterica serovar Typhi Ty2
agcggcggcuugccuuca

SEQ ID NO: 1769113 - RNA, 23 nt, Salmonella enterica enterica serovar Typhi Ty2
agcggcgggauuuuaagcaucca

SEQ ID NO: 1769114 - RNA, 15 nt, Salmonella enterica enterica serovar Typhi Ty2
agcggcguucaaaac

SEQ ID NO: 1769115 - RNA, 16 nt, Salmonella enterica enterica serovar Typhi Ty2
agcgcuaagcaacagu

SEQ ID NO: 1769116 - RNA, 15 nt, Salmonella enterica enterica serovar Typhi Ty2
agcgcuaacgcgaag

SEQ ID NO: 1769117 - RNA, 18 nt, Salmonella enterica enterica serovar Typhi Ty2
agcgcgucguugccuuug

SEQ ID NO: 1769118 - RNA, 14 nt, Salmonella enterica enterica serovar Typhi Ty2
agcgcuacgccugu

SEQ ID NO: 1769119 - RNA, 16 nt, Salmonella enterica enterica serovar Typhi Ty2
agcgcucaaucagcgc

SEQ ID NO: 1769120 - RNA, 14 nt, Salmonella enterica enterica serovar Typhi Ty2
agcgcuaagcaaca

SEQ ID NO: 1769121 - RNA, 18 nt, Salmonella enterica enterica serovar Typhi Ty2
agcgcucaaucagcgcuu

SEQ ID NO: 1769122 - RNA, 16 nt, Salmonella enterica enterica serovar Typhi Ty2
agcguccggagcagcu

SEQ ID NO: 1769123 - RNA, 18 nt, Salmonella enterica enterica serovar Typhi Ty2
agcguccgccaucgccuc

SEQ ID NO: 1769124 - RNA, 21 nt, Salmonella enterica enterica serovar Typhi Ty2
agcguccgggcaagcccggua

SEQ ID NO: 1769125 - RNA, 22 nt, Salmonella enterica enterica serovar Typhi Ty2
agcgugaaaagcuuagaacuca

SEQ ID NO: 1769126 - RNA, 18 nt, Salmonella enterica enterica serovar Typhi Ty2
agcgugacaguuaccccg

SEQ ID NO: 1769127 - RNA, 22 nt, Salmonella enterica enterica serovar Typhi Ty2
agcgguuuuuuuguggccugcu

SEQ ID NO: 1769128 - RNA, 15 nt, Salmonella enterica enterica serovar Typhi Ty2
agcguaauacaggcg

SEQ ID NO: 1769129 - RNA, 14 nt, Salmonella enterica enterica serovar Typhi Ty2
agcguuacugcaac

SEQ ID NO: 1769130 - RNA, 21 nt, Salmonella enterica enterica serovar Typhi Ty2
agcguuacgggaacagaauua

SEQ ID NO: 1769131 - RNA, 20 nt, Salmonella enterica enterica serovar Typhi Ty2
agcguuaucuguaauugacg

SEQ ID NO: 1769132 - RNA, 21 nt, Salmonella enterica enterica serovar Typhi Ty2
agcguucauucccgccaauaa

SEQ ID NO: 1769133 - RNA, 23 nt, Salmonella enterica enterica serovar Typhi Ty2
agcguuaacgacgcuccagaauc

SEQ ID NO: 1769134 - RNA, 15 nt, Salmonella enterica enterica serovar Typhi Ty2
agcguuacgcgcugc

SEQ ID NO: 1769135 - RNA, 18 nt, Salmonella enterica enterica serovar Typhi Ty2
agcgugccuucaaauaua

SEQ ID NO: 1769136 - RNA, 12 nt, Salmonella enterica enterica serovar Typhi Ty2
agcgugauaauu

SEQ ID NO: 1769137 - RNA, 20 nt, Salmonella enterica enterica serovar Typhi Ty2
agcgugccgagcaacagaaa

SEQ ID NO: 1769138 - RNA, 23 nt, Salmonella enterica enterica serovar Typhi Ty2
agcgugccgagcaacagaaacca

SEQ ID NO: 1769139 - RNA, 23 nt, Salmonella enterica enterica serovar Typhi Ty2
agcgccuccgcguagcccagcgc

SEQ ID NO: 1769140 - RNA, 23 nt, Salmonella enterica enterica serovar Typhi Ty2
agcgccgccagaaucaccucuuu

SEQ ID NO: 1769141 - RNA, 13 nt, Salmonella enterica enterica serovar Typhi Ty2
agcgccgccaaga

SEQ ID NO: 1769142 - RNA, 20 nt, Salmonella enterica enterica serovar Typhi Ty2
agcgccuguaaacguuccug

SEQ ID NO: 1769143 - RNA, 14 nt, Salmonella enterica enterica serovar Typhi Ty2
agcgccuguagcgu

SEQ ID NO: 1769144 - RNA, 20 nt, Salmonella enterica enterica serovar Typhi Ty2
agcgccugugcuuucgccac

SEQ ID NO: 1769145 - RNA, 14 nt, Salmonella enterica enterica serovar Typhi Ty2
agcgccuucaggca

SEQ ID NO: 1769146 - RNA, 23 nt, Salmonella enterica enterica serovar Typhi Ty2
agcgccuucaggcaucagauaaa

SEQ ID NO: 1769147 - RNA, 15 nt, Salmonella enterica enterica serovar Typhi Ty2
agcgccuuuuaaggu

SEQ ID NO: 1769148 - RNA, 22 nt, Salmonella enterica enterica serovar Typhi Ty2
agcgcggcggcaacugagcgaa

SEQ ID NO: 1769149 - RNA, 19 nt, Salmonella enterica enterica serovar Typhi Ty2
agcgcggcauuaauuucuu

SEQ ID NO: 1769150 - RNA, 15 nt, Salmonella enterica enterica serovar Typhi Ty2
agcgcggccagaaug

SEQ ID NO: 1769151 - RNA, 14 nt, Salmonella enterica enterica serovar Typhi Ty2
agcgcgaccgguuu

SEQ ID NO: 1769152 - RNA, 16 nt, Salmonella enterica enterica serovar Typhi Ty2
agcgcgaacaggcugg

SEQ ID NO: 1769153 - RNA, 23 nt, Salmonella enterica enterica serovar Typhi Ty2
agcgcgaauuuuauuaagcaggc

SEQ ID NO: 1769154 - RNA, 15 nt, Salmonella enterica enterica serovar Typhi Ty2
agcgcgaaucgccuc

SEQ ID NO: 1769155 - RNA, 12 nt, Salmonella enterica enterica serovar Typhi Ty2
agcgcgcgcaca

SEQ ID NO: 1769156 - RNA, 19 nt, Salmonella enterica enterica serovar Typhi Ty2
agcgcgcccgccaccagca

SEQ ID NO: 1769157 - RNA, 19 nt, Salmonella enterica enterica serovar Typhi Ty2
agcgcgccgccgcccauaa

SEQ ID NO: 1769158 - RNA, 21 nt, Salmonella enterica enterica serovar Typhi Ty2
agcgcgccggauauggcgucc

SEQ ID NO: 1769159 - RNA, 23 nt, Salmonella enterica enterica serovar Typhi Ty2
agcgccagcgguguuugccagac

SEQ ID NO: 1769160 - RNA, 18 nt, Salmonella enterica enterica serovar Typhi Ty2
agcgccagcgccaccugc

SEQ ID NO: 1769161 - RNA, 14 nt, Salmonella enterica enterica serovar Typhi Ty2
agcgccagcuccau

SEQ ID NO: 1769162 - RNA, 13 nt, Salmonella enterica enterica serovar Typhi Ty2
agcgccagugacg

SEQ ID NO: 1769163 - RNA, 18 nt, Salmonella enterica enterica serovar Typhi Ty2
agcgccauauaaauaggc

SEQ ID NO: 1769164 - RNA, 22 nt, Salmonella enterica enterica serovar Typhi Ty2
agcgccauaaaaaacaccuguc

SEQ ID NO: 1769165 - RNA, 20 nt, Salmonella enterica enterica serovar Typhi Ty2
agcgccauaucggcacugcu

SEQ ID NO: 1769166 - RNA, 14 nt, Salmonella enterica enterica serovar Typhi Ty2
agcgccauauugcu

SEQ ID NO: 1769167 - RNA, 17 nt, Salmonella enterica enterica serovar Typhi Ty2
agcgccaucaggcaaug

SEQ ID NO: 1769168 - RNA, 16 nt, Salmonella enterica enterica serovar Typhi Ty2
agcgcccguccaugag

SEQ ID NO: 1769169 - RNA, 20 nt, Salmonella enterica enterica serovar Typhi Ty2
agcgccauccggcacacaga

SEQ ID NO: 1769170 - RNA, 15 nt, Salmonella enterica enterica serovar Typhi Ty2
agcgcaugcccggua

SEQ ID NO: 1769171 - RNA, 17 nt, Salmonella enterica enterica serovar Typhi Ty2
agcgccacggagcauaa

SEQ ID NO: 1769172 - RNA, 16 nt, Salmonella enterica enterica serovar Typhi Ty2
agcgcaucgcucccca

SEQ ID NO: 1769173 - RNA, 23 nt, Salmonella enterica enterica serovar Typhi Ty2
agcgccagcagcagcgcaaugcg

SEQ ID NO: 1769174 - RNA, 12 nt, Salmonella enterica enterica serovar Typhi Ty2
agcgccagcagc

SEQ ID NO: 1769175 - RNA, 16 nt, Salmonella enterica enterica serovar Typhi Ty2
agcgccagcgccaccu

SEQ ID NO: 1769176 - RNA, 17 nt, Salmonella enterica enterica serovar Typhi Ty2
agcgccagcgccaccug

SEQ ID NO: 1769177 - RNA, 16 nt, Salmonella enterica enterica serovar Typhi Ty2
agcgccagacacugga

SEQ ID NO: 1769178 - RNA, 16 nt, Salmonella enterica enterica serovar Typhi Ty2
agcgccagauagucac

SEQ ID NO: 1769179 - RNA, 17 nt, Salmonella enterica enterica serovar Typhi Ty2
agcgcauccggccagcg

SEQ ID NO: 1769180 - RNA, 19 nt, Salmonella enterica enterica serovar Typhi Ty2
agcgcaauaacaauaaaga

SEQ ID NO: 1769181 - RNA, 11 nt, Salmonella enterica enterica serovar Typhi Ty2
agcgcaaugcu

SEQ ID NO: 1769182 - RNA, 15 nt, Salmonella enterica enterica serovar Typhi Ty2
agcgcaaacaacccg

SEQ ID NO: 1769183 - RNA, 14 nt, Salmonella enterica enterica serovar Typhi Ty2
agcgauuauuucau

SEQ ID NO: 1769184 - RNA, 17 nt, Salmonella enterica enterica serovar Typhi Ty2
agcgauugcgccagacc

SEQ ID NO: 1769185 - RNA, 19 nt, Salmonella enterica enterica serovar Typhi Ty2
agcgauuuuugaucucuuu

SEQ ID NO: 1769186 - RNA, 18 nt, Salmonella enterica enterica serovar Typhi Ty2
agcgaugggagagaggac

SEQ ID NO: 1769187 - RNA, 23 nt, Salmonella enterica enterica serovar Typhi Ty2
agcgaugcgguucaacgcgcugc

SEQ ID NO: 1769188 - RNA, 17 nt, Salmonella enterica enterica serovar Typhi Ty2
agcgaugagcgccagca

SEQ ID NO: 1769189 - RNA, 16 nt, Salmonella enterica enterica serovar Typhi Ty2
agcgaugacagcagga

SEQ ID NO: 1769190 - RNA, 20 nt, Salmonella enterica enterica serovar Typhi Ty2
agcgaugagcgccagcaaca

SEQ ID NO: 1769191 - RNA, 22 nt, Salmonella enterica enterica serovar Typhi Ty2
agcgaugagcgccagcaacagc

SEQ ID NO: 1769192 - RNA, 17 nt, Salmonella enterica enterica serovar Typhi Ty2
agcgaucauaagggagc

SEQ ID NO: 1769193 - RNA, 17 nt, Salmonella enterica enterica serovar Typhi Ty2
agcgaucgagauaagau

SEQ ID NO: 1769194 - RNA, 23 nt, Salmonella enterica enterica serovar Typhi Ty2
agcgaucuccugcaguauuucag

SEQ ID NO: 1769195 - RNA, 19 nt, Salmonella enterica enterica serovar Typhi Ty2
agcgagguucccgccgcca

SEQ ID NO: 1769196 - RNA, 12 nt, Salmonella enterica enterica serovar Typhi Ty2
agcgagguaaaa

SEQ ID NO: 1769197 - RNA, 15 nt, Salmonella enterica enterica serovar Typhi Ty2
agcgagguaaaaagc

SEQ ID NO: 1769198 - RNA, 18 nt, Salmonella enterica enterica serovar Typhi Ty2
agcgauagucguugcgcc

SEQ ID NO: 1769199 - RNA, 18 nt, Salmonella enterica enterica serovar Typhi Ty2
agcgaaucgaucuggcgc

SEQ ID NO: 1769200 - RNA, 20 nt, Salmonella enterica enterica serovar Typhi Ty2
agcgaauuccggccaucaga

SEQ ID NO: 1769201 - RNA, 22 nt, Salmonella enterica enterica serovar Typhi Ty2
agcgaauugccgucgccggaau

SEQ ID NO: 1769202 - RNA, 23 nt, Salmonella enterica enterica serovar Typhi Ty2
agcgacucauucagcaacugcgu

SEQ ID NO: 1769203 - RNA, 15 nt, Salmonella enterica enterica serovar Typhi Ty2
agcgacggcgcgcca

SEQ ID NO: 1769204 - RNA, 21 nt, Salmonella enterica enterica serovar Typhi Ty2
agcgacaccugaucuguaggc

SEQ ID NO: 1769205 - RNA, 18 nt, Salmonella enterica enterica serovar Typhi Ty2
agcgagauaaccgggaau

SEQ ID NO: 1769206 - RNA, 17 nt, Salmonella enterica enterica serovar Typhi Ty2
agcgagauaaccgggaa

SEQ ID NO: 1769207 - RNA, 13 nt, Salmonella enterica enterica serovar Typhi Ty2
agcgagcgccuga

SEQ ID NO: 1769208 - RNA, 16 nt, Salmonella enterica enterica serovar Typhi Ty2
agcgagcguagccaac

SEQ ID NO: 1769209 - RNA, 13 nt, Salmonella enterica enterica serovar Typhi Ty2
agcgagaugaaaa

SEQ ID NO: 1769210 - RNA, 16 nt, Salmonella enterica enterica serovar Typhi Ty2
agcgagaugaaaaguc

SEQ ID NO: 1769211 - RNA, 19 nt, Salmonella enterica enterica serovar Typhi Ty2
agcgagauaaccgggaaua

SEQ ID NO: 1769212 - RNA, 22 nt, Salmonella enterica enterica serovar Typhi Ty2
agccugaagccagcaaucagcc

SEQ ID NO: 1769213 - RNA, 17 nt, Salmonella enterica enterica serovar Typhi Ty2
agccugagcgcgaggca

SEQ ID NO: 1769214 - RNA, 17 nt, Salmonella enterica enterica serovar Typhi Ty2
agccugacgaauagcgc

SEQ ID NO: 1769215 - RNA, 15 nt, Salmonella enterica enterica serovar Typhi Ty2
agccugccagcaacc

SEQ ID NO: 1769216 - RNA, 23 nt, Salmonella enterica enterica serovar Typhi Ty2
agccugcuggucugaaucugcuc

SEQ ID NO: 1769217 - RNA, 21 nt, Salmonella enterica enterica serovar Typhi Ty2
agccugcgcguaaauuucacu

SEQ ID NO: 1769218 - RNA, 18 nt, Salmonella enterica enterica serovar Typhi Ty2
agccuuaaucaacugcgc

SEQ ID NO: 1769219 - RNA, 19 nt, Salmonella enterica enterica serovar Typhi Ty2
agccuguuuggacacggac

SEQ ID NO: 1769220 - RNA, 17 nt, Salmonella enterica enterica serovar Typhi Ty2
agccuguuccagcugcg

SEQ ID NO: 1769221 - RNA, 20 nt, Salmonella enterica enterica serovar Typhi Ty2
agccugugcaaccagcucuu

SEQ ID NO: 1769222 - RNA, 14 nt, Salmonella enterica enterica serovar Typhi Ty2
agccugggcaaggc

SEQ ID NO: 1769223 - RNA, 16 nt, Salmonella enterica enterica serovar Typhi Ty2
agccugugcaaccagc

SEQ ID NO: 1769224 - RNA, 15 nt, Salmonella enterica enterica serovar Typhi Ty2
agcgaauaacauaau

SEQ ID NO: 1769225 - RNA, 18 nt, Salmonella enterica enterica serovar Typhi Ty2
agcgaauaacauaauauu

SEQ ID NO: 1769226 - RNA, 16 nt, Salmonella enterica enterica serovar Typhi Ty2
agcgaaacugauauua

SEQ ID NO: 1769227 - RNA, 15 nt, Salmonella enterica enterica serovar Typhi Ty2
agccuuuuucuuuca

SEQ ID NO: 1769228 - RNA, 19 nt, Salmonella enterica enterica serovar Typhi Ty2
agcgaaaauaaacgcuuga

SEQ ID NO: 1769229 - RNA, 20 nt, Salmonella enterica enterica serovar Typhi Ty2
agcagucccgccgggaucug

SEQ ID NO: 1769230 - RNA, 16 nt, Salmonella enterica enterica serovar Typhi Ty2
agcagugauuaugcuc

SEQ ID NO: 1769231 - RNA, 12 nt, Salmonella enterica enterica serovar Typhi Ty2
agcagugagcuu

SEQ ID NO: 1769232 - RNA, 19 nt, Salmonella enterica enterica serovar Typhi Ty2
agcagugagcuuugcacgc

SEQ ID NO: 1769233 - RNA, 14 nt, Salmonella enterica enterica serovar Typhi Ty2
agcagugggaaaau

SEQ ID NO: 1769234 - RNA, 14 nt, Salmonella enterica enterica serovar Typhi Ty2
agcauacgcugcac

SEQ ID NO: 1769235 - RNA, 17 nt, Salmonella enterica enterica serovar Typhi Ty2
agcauacgacaucgcca

SEQ ID NO: 1769236 - RNA, 21 nt, Salmonella enterica enterica serovar Typhi Ty2
agcauaccgugugcagugaca

SEQ ID NO: 1769237 - RNA, 17 nt, Salmonella enterica enterica serovar Typhi Ty2
agcauagauaacuaugu

SEQ ID NO: 1769238 - RNA, 17 nt, Salmonella enterica enterica serovar Typhi Ty2
agcauagcgccaucagg

SEQ ID NO: 1769239 - RNA, 15 nt, Salmonella enterica enterica serovar Typhi Ty2
agcauagcguuaucu

SEQ ID NO: 1769240 - RNA, 20 nt, Salmonella enterica enterica serovar Typhi Ty2
agcaucgccgguagcuucag

SEQ ID NO: 1769241 - RNA, 21 nt, Salmonella enterica enterica serovar Typhi Ty2
agcaucgcuuuuaggcugaaa

SEQ ID NO: 1769242 - RNA, 23 nt, Salmonella enterica enterica serovar Typhi Ty2
agcaucguaagccgcauuacaaa

SEQ ID NO: 1769243 - RNA, 20 nt, Salmonella enterica enterica serovar Typhi Ty2
agcaucggcagcgccaguga

SEQ ID NO: 1769244 - RNA, 15 nt, Salmonella enterica enterica serovar Typhi Ty2
agcaugacaauaacg

SEQ ID NO: 1769245 - RNA, 16 nt, Salmonella enterica enterica serovar Typhi Ty2
agcagcgccagcgaca

SEQ ID NO: 1769246 - RNA, 18 nt, Salmonella enterica enterica serovar Typhi Ty2
agcagcggcguaucuucc

SEQ ID NO: 1769247 - RNA, 23 nt, Salmonella enterica enterica serovar Typhi Ty2
agcagcggcgguuauccgccagc

SEQ ID NO: 1769248 - RNA, 16 nt, Salmonella enterica enterica serovar Typhi Ty2
agcagcucaacggcag

SEQ ID NO: 1769249 - RNA, 22 nt, Salmonella enterica enterica serovar Typhi Ty2
agcaggaucuccagaucgccac

SEQ ID NO: 1769250 - RNA, 21 nt, Salmonella enterica enterica serovar Typhi Ty2
agcaggcacuguggugugccu

SEQ ID NO: 1769251 - RNA, 15 nt, Salmonella enterica enterica serovar Typhi Ty2
agcaggcacuguggu

SEQ ID NO: 1769252 - RNA, 17 nt, Salmonella enterica enterica serovar Typhi Ty2
agcaggcacuguggugu

SEQ ID NO: 1769253 - RNA, 14 nt, Salmonella enterica enterica serovar Typhi Ty2
agcaggcuuugcug

SEQ ID NO: 1769254 - RNA, 24 nt, Salmonella enterica enterica serovar Typhi Ty2
agcaggcgggacgccauagcguuu

SEQ ID NO: 1769255 - RNA, 10 nt, Salmonella enterica enterica serovar Typhi Ty2
agcagcagaa

SEQ ID NO: 1769256 - RNA, 15 nt, Salmonella enterica enterica serovar Typhi Ty2
agcagcagauaagcg

SEQ ID NO: 1769257 - RNA, 15 nt, Salmonella enterica enterica serovar Typhi Ty2
agcagcagagccgga

SEQ ID NO: 1769258 - RNA, 14 nt, Salmonella enterica enterica serovar Typhi Ty2
agcagcaccggcug

SEQ ID NO: 1769259 - RNA, 15 nt, Salmonella enterica enterica serovar Typhi Ty2
agcagccagaaaaag

SEQ ID NO: 1769260 - RNA, 23 nt, Salmonella enterica enterica serovar Typhi Ty2
agcagcauaaacaucagcgcgga

SEQ ID NO: 1769261 - RNA, 16 nt, Salmonella enterica enterica serovar Typhi Ty2
agcagcaucccggcaa

SEQ ID NO: 1769262 - RNA, 15 nt, Salmonella enterica enterica serovar Typhi Ty2
agcacuuuuuccucc

SEQ ID NO: 1769263 - RNA, 15 nt, Salmonella enterica enterica serovar Typhi Ty2
agcagagccggaacc

SEQ ID NO: 1769264 - RNA, 22 nt, Salmonella enterica enterica serovar Typhi Ty2
agcagauaagcgacucuguauu

SEQ ID NO: 1769265 - RNA, 21 nt, Salmonella enterica enterica serovar Typhi Ty2
agcacuacggauggcccugcc

SEQ ID NO: 1769266 - RNA, 15 nt, Salmonella enterica enterica serovar Typhi Ty2
agcacgugcauggga

SEQ ID NO: 1769267 - RNA, 14 nt, Salmonella enterica enterica serovar Typhi Ty2
agcacuaacagcag

SEQ ID NO: 1769268 - RNA, 24 nt, Salmonella enterica enterica serovar Typhi Ty2
agcacguagcuuauaaaucagcuu

SEQ ID NO: 1769269 - RNA, 22 nt, Salmonella enterica enterica serovar Typhi Ty2
agcaccuuugaacgucgcugau

SEQ ID NO: 1769270 - RNA, 16 nt, Salmonella enterica enterica serovar Typhi Ty2
agcaccuuauccggcc

SEQ ID NO: 1769271 - RNA, 20 nt, Salmonella enterica enterica serovar Typhi Ty2
agcaccuggcggagcugcgc

SEQ ID NO: 1769272 - RNA, 16 nt, Salmonella enterica enterica serovar Typhi Ty2
agcaacccaccugcca

SEQ ID NO: 1769273 - RNA, 19 nt, Salmonella enterica enterica serovar Typhi Ty2
agcaacagugggcuaugaa

SEQ ID NO: 1769274 - RNA, 13 nt, Salmonella enterica enterica serovar Typhi Ty2
agcaccuccagcg

SEQ ID NO: 1769275 - RNA, 16 nt, Salmonella enterica enterica serovar Typhi Ty2
agccaguucucuucuu

SEQ ID NO: 1769276 - RNA, 22 nt, Salmonella enterica enterica serovar Typhi Ty2
agccaguuguucgauaaccugu

SEQ ID NO: 1769277 - RNA, 14 nt, Salmonella enterica enterica serovar Typhi Ty2
agccagucgccagg

SEQ ID NO: 1769278 - RNA, 18 nt, Salmonella enterica enterica serovar Typhi Ty2
agccagucgccaggcaag

SEQ ID NO: 1769279 - RNA, 15 nt, Salmonella enterica enterica serovar Typhi Ty2
agccaucauuaccaa

SEQ ID NO: 1769280 - RNA, 19 nt, Salmonella enterica enterica serovar Typhi Ty2
agccauaaugcaaucaguu

SEQ ID NO: 1769281 - RNA, 13 nt, Salmonella enterica enterica serovar Typhi Ty2
agccaguucucaa

SEQ ID NO: 1769282 - RNA, 15 nt, Salmonella enterica enterica serovar Typhi Ty2
agccauagcagcaaa

SEQ ID NO: 1769283 - RNA, 15 nt, Salmonella enterica enterica serovar Typhi Ty2
agccauauggcauuc

SEQ ID NO: 1769284 - RNA, 16 nt, Salmonella enterica enterica serovar Typhi Ty2
agccauuaaugcaggc

SEQ ID NO: 1769285 - RNA, 14 nt, Salmonella enterica enterica serovar Typhi Ty2
agccauggcccaaa

SEQ ID NO: 1769286 - RNA, 17 nt, Salmonella enterica enterica serovar Typhi Ty2
agccauuaaugcaggca

SEQ ID NO: 1769287 - RNA, 18 nt, Salmonella enterica enterica serovar Typhi Ty2
agccauucauuaaaauug

SEQ ID NO: 1769288 - RNA, 14 nt, Salmonella enterica enterica serovar Typhi Ty2
agccauuaaccaga

SEQ ID NO: 1769289 - RNA, 15 nt, Salmonella enterica enterica serovar Typhi Ty2
agccaugccagcagu

SEQ ID NO: 1769290 - RNA, 17 nt, Salmonella enterica enterica serovar Typhi Ty2
agccaugccagcaguuu

SEQ ID NO: 1769291 - RNA, 22 nt, Salmonella enterica enterica serovar Typhi Ty2
agccaugcuauucagcaguuca

SEQ ID NO: 1769292 - RNA, 17 nt, Salmonella enterica enterica serovar Typhi Ty2
agccauuuuaaaaauau

SEQ ID NO: 1769293 - RNA, 15 nt, Salmonella enterica enterica serovar Typhi Ty2
agccauuuuaaaaau

SEQ ID NO: 1769294 - RNA, 15 nt, Salmonella enterica enterica serovar Typhi Ty2
agcccaauacgccag

SEQ ID NO: 1769295 - RNA, 17 nt, Salmonella enterica enterica serovar Typhi Ty2
agccacccacugacgaa

SEQ ID NO: 1769296 - RNA, 14 nt, Salmonella enterica enterica serovar Typhi Ty2
agcaugcccgccag

SEQ ID NO: 1769297 - RNA, 13 nt, Salmonella enterica enterica serovar Typhi Ty2
agccagacgccag

SEQ ID NO: 1769298 - RNA, 15 nt, Salmonella enterica enterica serovar Typhi Ty2
agccagcgccccugc

SEQ ID NO: 1769299 - RNA, 20 nt, Salmonella enterica enterica serovar Typhi Ty2
agccagcguaaauagcccgg

SEQ ID NO: 1769300 - RNA, 23 nt, Salmonella enterica enterica serovar Typhi Ty2
agccagcguaaauagcccggauc

SEQ ID NO: 1769301 - RNA, 20 nt, Salmonella enterica enterica serovar Typhi Ty2
agccagcucaccagccaaau

SEQ ID NO: 1769302 - RNA, 15 nt, Salmonella enterica enterica serovar Typhi Ty2
agccaccccauuaau

SEQ ID NO: 1769303 - RNA, 15 nt, Salmonella enterica enterica serovar Typhi Ty2
agccagaacucaucu

SEQ ID NO: 1769304 - RNA, 19 nt, Salmonella enterica enterica serovar Typhi Ty2
agccacgcccgccgccuga

SEQ ID NO: 1769305 - RNA, 22 nt, Salmonella enterica enterica serovar Typhi Ty2
agccccgaaagucaucugccag

SEQ ID NO: 1769306 - RNA, 23 nt, Salmonella enterica enterica serovar Typhi Ty2
agccccccgcacagcacauagaa

SEQ ID NO: 1769307 - RNA, 13 nt, Salmonella enterica enterica serovar Typhi Ty2
agccccccgcaca

SEQ ID NO: 1769308 - RNA, 12 nt, Salmonella enterica enterica serovar Typhi Ty2
agccccagcgcc

SEQ ID NO: 1769309 - RNA, 13 nt, Salmonella enterica enterica serovar Typhi Ty2
agccccagcgcca

SEQ ID NO: 1769310 - RNA, 16 nt, Salmonella enterica enterica serovar Typhi Ty2
agcccaucaccgccag

SEQ ID NO: 1769311 - RNA, 21 nt, Salmonella enterica enterica serovar Typhi Ty2
agcccauaaagcacuggugga

SEQ ID NO: 1769312 - RNA, 17 nt, Salmonella enterica enterica serovar Typhi Ty2
agcccauggcaggcagc

SEQ ID NO: 1769313 - RNA, 14 nt, Salmonella enterica enterica serovar Typhi Ty2
agcccauggcaggc

SEQ ID NO: 1769314 - RNA, 20 nt, Salmonella enterica enterica serovar Typhi Ty2
agcccaugauggugaacaga

SEQ ID NO: 1769315 - RNA, 17 nt, Salmonella enterica enterica serovar Typhi Ty2
agcccaugauggugaac

SEQ ID NO: 1769316 - RNA, 21 nt, Salmonella enterica enterica serovar Typhi Ty2
agcccauggcaggcagcacaa

SEQ ID NO: 1769317 - RNA, 18 nt, Salmonella enterica enterica serovar Typhi Ty2
agcccacgcccugcaaug

SEQ ID NO: 1769318 - RNA, 12 nt, Salmonella enterica enterica serovar Typhi Ty2
agcccagcucag

SEQ ID NO: 1769319 - RNA, 14 nt, Salmonella enterica enterica serovar Typhi Ty2
agccgaccuggcgg

SEQ ID NO: 1769320 - RNA, 22 nt, Salmonella enterica enterica serovar Typhi Ty2
agccgaggcuuaauacggcaac

SEQ ID NO: 1769321 - RNA, 23 nt, Salmonella enterica enterica serovar Typhi Ty2
agccgcagaaccauuuccucugc

SEQ ID NO: 1769322 - RNA, 19 nt, Salmonella enterica enterica serovar Typhi Ty2
agccgcagaaccauuuccu

SEQ ID NO: 1769323 - RNA, 17 nt, Salmonella enterica enterica serovar Typhi Ty2
agcccugugccgcuggu

SEQ ID NO: 1769324 - RNA, 22 nt, Salmonella enterica enterica serovar Typhi Ty2
agcccuugaucggguuuuccug

SEQ ID NO: 1769325 - RNA, 18 nt, Salmonella enterica enterica serovar Typhi Ty2
agcccggcggaggccauu

SEQ ID NO: 1769326 - RNA, 16 nt, Salmonella enterica enterica serovar Typhi Ty2
agcccgucccuuccgc

SEQ ID NO: 1769327 - RNA, 21 nt, Salmonella enterica enterica serovar Typhi Ty2
agcccguccagauaaugauca

SEQ ID NO: 1769328 - RNA, 14 nt, Salmonella enterica enterica serovar Typhi Ty2
agcccgucccuucc

SEQ ID NO: 1769329 - RNA, 21 nt, Salmonella enterica enterica serovar Typhi Ty2
agcccgucuuuuuccugcaug

SEQ ID NO: 1769330 - RNA, 14 nt, Salmonella enterica enterica serovar Typhi Ty2
agcccgccagcacc

SEQ ID NO: 1769331 - RNA, 17 nt, Salmonella enterica enterica serovar Typhi Ty2
agcccgcccagcauuac

SEQ ID NO: 1769332 - RNA, 19 nt, Salmonella enterica enterica serovar Typhi Ty2
agcaaaaaagcgccuuuag

SEQ ID NO: 1769333 - RNA, 15 nt, Salmonella enterica enterica serovar Typhi Ty2
agcaaaaaucaccac

SEQ ID NO: 1769334 - RNA, 16 nt, Salmonella enterica enterica serovar Typhi Ty2
agcaaaaucacgcaca

SEQ ID NO: 1769335 - RNA, 18 nt, Salmonella enterica enterica serovar Typhi Ty2
agcaaaccgacccaaaaa

SEQ ID NO: 1769336 - RNA, 17 nt, Salmonella enterica enterica serovar Typhi Ty2
agcaaagcguacaugaa

SEQ ID NO: 1769337 - RNA, 21 nt, Salmonella enterica enterica serovar Typhi Ty2
agcaaauucaggguugucuca

SEQ ID NO: 1769338 - RNA, 18 nt, Salmonella enterica enterica serovar Typhi Ty2
agcaaaucgggaaaauga

SEQ ID NO: 1769339 - RNA, 13 nt, Salmonella enterica enterica serovar Typhi Ty2
agcaaauucaggg

SEQ ID NO: 1769340 - RNA, 14 nt, Salmonella enterica enterica serovar Typhi Ty2
agcaaauugcugau

SEQ ID NO: 1769341 - RNA, 22 nt, Salmonella enterica enterica serovar Typhi Ty2
agcaacacuuugcgcugcgcau

SEQ ID NO: 1769342 - RNA, 18 nt, Salmonella enterica enterica serovar Typhi Ty2
agcaacacagccagcacg

SEQ ID NO: 1769343 - RNA, 14 nt, Salmonella enterica enterica serovar Typhi Ty2
agcaaaucagcuac

SEQ ID NO: 1769344 - RNA, 19 nt, Salmonella enterica enterica serovar Typhi Ty2
agauuuuucugcgccacca

SEQ ID NO: 1769345 - RNA, 15 nt, Salmonella enterica enterica serovar Typhi Ty2
agauuuuucgccagg

SEQ ID NO: 1769346 - RNA, 17 nt, Salmonella enterica enterica serovar Typhi Ty2
agauuuuucucacacau

SEQ ID NO: 1769347 - RNA, 13 nt, Salmonella enterica enterica serovar Typhi Ty2
agauuuucaucau

SEQ ID NO: 1769348 - RNA, 18 nt, Salmonella enterica enterica serovar Typhi Ty2
agauuucuuaauuccuca

SEQ ID NO: 1769349 - RNA, 13 nt, Salmonella enterica enterica serovar Typhi Ty2
agauuucuuaauu

SEQ ID NO: 1769350 - RNA, 15 nt, Salmonella enterica enterica serovar Typhi Ty2
agauuuaaaacaagc

SEQ ID NO: 1769351 - RNA, 14 nt, Salmonella enterica enterica serovar Typhi Ty2
agauuuaaaacaag

SEQ ID NO: 1769352 - RNA, 15 nt, Salmonella enterica enterica serovar Typhi Ty2
agauuuaucuucucu

SEQ ID NO: 1769353 - RNA, 17 nt, Salmonella enterica enterica serovar Typhi Ty2
agauuuaucaauuuuua

SEQ ID NO: 1769354 - RNA, 20 nt, Salmonella enterica enterica serovar Typhi Ty2
agauuucacaauguuuuugu

SEQ ID NO: 1769355 - RNA, 12 nt, Salmonella enterica enterica serovar Typhi Ty2
agauuucaucag

SEQ ID NO: 1769356 - RNA, 17 nt, Salmonella enterica enterica serovar Typhi Ty2
agauuucaucaggcuga

SEQ ID NO: 1769357 - RNA, 17 nt, Salmonella enterica enterica serovar Typhi Ty2
agauugucaccguaaua

SEQ ID NO: 1769358 - RNA, 19 nt, Salmonella enterica enterica serovar Typhi Ty2
agauugucaccguaauaua

SEQ ID NO: 1769359 - RNA, 23 nt, Salmonella enterica enterica serovar Typhi Ty2
agauuguuucggauaauucugac

SEQ ID NO: 1769360 - RNA, 17 nt, Salmonella enterica enterica serovar Typhi Ty2
agauuguuucggauaau

SEQ ID NO: 1769361 - RNA, 18 nt, Salmonella enterica enterica serovar Typhi Ty2
agauuggcccgcccagca

SEQ ID NO: 1769362 - RNA, 16 nt, Salmonella enterica enterica serovar Typhi Ty2
agauuggcaucugcaa

SEQ ID NO: 1769363 - RNA, 13 nt, Salmonella enterica enterica serovar Typhi Ty2
agauuggcaucug

SEQ ID NO: 1769364 - RNA, 14 nt, Salmonella enterica enterica serovar Typhi Ty2
agauucuaacauaa

SEQ ID NO: 1769365 - RNA, 21 nt, Salmonella enterica enterica serovar Typhi Ty2
agauugagacaaauaacuuuc

SEQ ID NO: 1769366 - RNA, 18 nt, Salmonella enterica enterica serovar Typhi Ty2
agauucaggccgccagca

SEQ ID NO: 1769367 - RNA, 19 nt, Salmonella enterica enterica serovar Typhi Ty2
agauucaccaccacccgau

SEQ ID NO: 1769368 - RNA, 17 nt, Salmonella enterica enterica serovar Typhi Ty2
agauuagccaggugacu

SEQ ID NO: 1769369 - RNA, 21 nt, Salmonella enterica enterica serovar Typhi Ty2
agauuacucucuugccagcgc

SEQ ID NO: 1769370 - RNA, 13 nt, Salmonella enterica enterica serovar Typhi Ty2
agaugcgaaucuu

SEQ ID NO: 1769371 - RNA, 23 nt, Salmonella enterica enterica serovar Typhi Ty2
agauggcgccauuggcucggcgu

SEQ ID NO: 1769372 - RNA, 16 nt, Salmonella enterica enterica serovar Typhi Ty2
agauggcgcuaaaacc

SEQ ID NO: 1769373 - RNA, 16 nt, Salmonella enterica enterica serovar Typhi Ty2
agauguaccagcggca

SEQ ID NO: 1769374 - RNA, 16 nt, Salmonella enterica enterica serovar Typhi Ty2
aaaaccccaucccggc

SEQ ID NO: 1769375 - RNA, 19 nt, Salmonella enterica enterica serovar Typhi Ty2
aaaacccgcagccggauag

SEQ ID NO: 1769376 - RNA, 21 nt, Salmonella enterica enterica serovar Typhi Ty2
aaaaccgacgaaagauaaaaa

SEQ ID NO: 1769377 - RNA, 21 nt, Salmonella enterica enterica serovar Typhi Ty2
agaugaccaaagcuauucaca

SEQ ID NO: 1769378 - RNA, 17 nt, Salmonella enterica enterica serovar Typhi Ty2
agauaaacagcagcgcg

SEQ ID NO: 1769379 - RNA, 19 nt, Salmonella enterica enterica serovar Typhi Ty2
agauaaacagguaaaacaa

SEQ ID NO: 1769380 - RNA, 20 nt, Salmonella enterica enterica serovar Typhi Ty2
agauaaacagguaaaacaaa

SEQ ID NO: 1769381 - RNA, 21 nt, Salmonella enterica enterica serovar Typhi Ty2
agaguaaucguauucauugcc

SEQ ID NO: 1769382 - RNA, 18 nt, Salmonella enterica enterica serovar Typhi Ty2
agaguucguuaaucucaa

SEQ ID NO: 1769383 - RNA, 18 nt, Salmonella enterica enterica serovar Typhi Ty2
agauaagccuccggauga

SEQ ID NO: 1769384 - RNA, 12 nt, Salmonella enterica enterica serovar Typhi Ty2
agauaagcgcca

SEQ ID NO: 1769385 - RNA, 16 nt, Salmonella enterica enterica serovar Typhi Ty2
agauaaguccuaacac

SEQ ID NO: 1769386 - RNA, 22 nt, Salmonella enterica enterica serovar Typhi Ty2
agauaagccgucauaaaaucaa

SEQ ID NO: 1769387 - RNA, 20 nt, Salmonella enterica enterica serovar Typhi Ty2
agauaccuacuuuauuuuuc

SEQ ID NO: 1769388 - RNA, 16 nt, Salmonella enterica enterica serovar Typhi Ty2
agauacggcuccagca

SEQ ID NO: 1769389 - RNA, 23 nt, Salmonella enterica enterica serovar Typhi Ty2
agaucauuuacggcgauuugccc

SEQ ID NO: 1769390 - RNA, 21 nt, Salmonella enterica enterica serovar Typhi Ty2
aaaaccagcgcggauaaaaaa

SEQ ID NO: 1769391 - RNA, 22 nt, Salmonella enterica enterica serovar Typhi Ty2
agauccugcgagcuuuccacca

SEQ ID NO: 1769392 - RNA, 21 nt, Salmonella enterica enterica serovar Typhi Ty2
agaucaggcgucagcauggug

SEQ ID NO: 1769393 - RNA, 20 nt, Salmonella enterica enterica serovar Typhi Ty2
agaucagcagaacaaaggcu

SEQ ID NO: 1769394 - RNA, 15 nt, Salmonella enterica enterica serovar Typhi Ty2
agauaucaaacacaa

SEQ ID NO: 1769395 - RNA, 21 nt, Salmonella enterica enterica serovar Typhi Ty2
agauagcccgccagcaccagc

SEQ ID NO: 1769396 - RNA, 16 nt, Salmonella enterica enterica serovar Typhi Ty2
agauaucagucugcaa

SEQ ID NO: 1769397 - RNA, 18 nt, Salmonella enterica enterica serovar Typhi Ty2
agauaucaaacacaaauu

SEQ ID NO: 1769398 - RNA, 17 nt, Salmonella enterica enterica serovar Typhi Ty2
agauaucccaugaaacu

SEQ ID NO: 1769399 - RNA, 15 nt, Salmonella enterica enterica serovar Typhi Ty2
agauauuauaaaaua

SEQ ID NO: 1769400 - RNA, 14 nt, Salmonella enterica enterica serovar Typhi Ty2
agauauggcgggga

SEQ ID NO: 1769401 - RNA, 20 nt, Salmonella enterica enterica serovar Typhi Ty2
agauaugaaaugagaccaau

SEQ ID NO: 1769402 - RNA, 19 nt, Salmonella enterica enterica serovar Typhi Ty2
agaggaggagaugucccac

SEQ ID NO: 1769403 - RNA, 15 nt, Salmonella enterica enterica serovar Typhi Ty2
agaggcagcaaagcu

SEQ ID NO: 1769404 - RNA, 20 nt, Salmonella enterica enterica serovar Typhi Ty2
agaggcauaaaaaaaagccg

SEQ ID NO: 1769405 - RNA, 16 nt, Salmonella enterica enterica serovar Typhi Ty2
agaggacacguuaauu

SEQ ID NO: 1769406 - RNA, 15 nt, Salmonella enterica enterica serovar Typhi Ty2
agaggaauguccagc

SEQ ID NO: 1769407 - RNA, 23 nt, Salmonella enterica enterica serovar Typhi Ty2
agaggcugaaggcgcuccccugc

SEQ ID NO: 1769408 - RNA, 15 nt, Salmonella enterica enterica serovar Typhi Ty2
agaguaacccuuuag

SEQ ID NO: 1769409 - RNA, 13 nt, Salmonella enterica enterica serovar Typhi Ty2
agaguaacccuuu

SEQ ID NO: 1769410 - RNA, 18 nt, Salmonella enterica enterica serovar Typhi Ty2
agaguaaaaccggcacau

SEQ ID NO: 1769411 - RNA, 18 nt, Salmonella enterica enterica serovar Typhi Ty2
agagguuagcgcaggggg

SEQ ID NO: 1769412 - RNA, 22 nt, Salmonella enterica enterica serovar Typhi Ty2
agagguuaccgggcuaaaccac

SEQ ID NO: 1769413 - RNA, 17 nt, Salmonella enterica enterica serovar Typhi Ty2
agacuaaaacgugcuga

SEQ ID NO: 1769414 - RNA, 13 nt, Salmonella enterica enterica serovar Typhi Ty2
agacguuuaagca

SEQ ID NO: 1769415 - RNA, 19 nt, Salmonella enterica enterica serovar Typhi Ty2
agacguuuauaccccacca

SEQ ID NO: 1769416 - RNA, 13 nt, Salmonella enterica enterica serovar Typhi Ty2
agacgucauaccu

SEQ ID NO: 1769417 - RNA, 19 nt, Salmonella enterica enterica serovar Typhi Ty2
agacgucaaacaguuccug

SEQ ID NO: 1769418 - RNA, 13 nt, Salmonella enterica enterica serovar Typhi Ty2
agagauccagaac

SEQ ID NO: 1769419 - RNA, 18 nt, Salmonella enterica enterica serovar Typhi Ty2
agagccggaaccuguccu

SEQ ID NO: 1769420 - RNA, 16 nt, Salmonella enterica enterica serovar Typhi Ty2
agagcuuauuuugacu

SEQ ID NO: 1769421 - RNA, 21 nt, Salmonella enterica enterica serovar Typhi Ty2
agagcgcgcucugccuuuuuu

SEQ ID NO: 1769422 - RNA, 22 nt, Salmonella enterica enterica serovar Typhi Ty2
agagcgaacaguacggucaggc

SEQ ID NO: 1769423 - RNA, 17 nt, Salmonella enterica enterica serovar Typhi Ty2
agagcgaaugcgcgcca

SEQ ID NO: 1769424 - RNA, 13 nt, Salmonella enterica enterica serovar Typhi Ty2
agagcgccaaaaa

SEQ ID NO: 1769425 - RNA, 16 nt, Salmonella enterica enterica serovar Typhi Ty2
agacauuuugaguugc

SEQ ID NO: 1769426 - RNA, 23 nt, Salmonella enterica enterica serovar Typhi Ty2
agaccaauaagucccaucgagcc

SEQ ID NO: 1769427 - RNA, 12 nt, Salmonella enterica enterica serovar Typhi Ty2
agaccaauaaaa

SEQ ID NO: 1769428 - RNA, 19 nt, Salmonella enterica enterica serovar Typhi Ty2
agaccaauacgaucggcug

SEQ ID NO: 1769429 - RNA, 15 nt, Salmonella enterica enterica serovar Typhi Ty2
agaccaucaacagcg

SEQ ID NO: 1769430 - RNA, 21 nt, Salmonella enterica enterica serovar Typhi Ty2
agaccagauuaaucagcagau

SEQ ID NO: 1769431 - RNA, 17 nt, Salmonella enterica enterica serovar Typhi Ty2
agaccacgaaucaggau

SEQ ID NO: 1769432 - RNA, 14 nt, Salmonella enterica enterica serovar Typhi Ty2
agacaggacgccag

SEQ ID NO: 1769433 - RNA, 22 nt, Salmonella enterica enterica serovar Typhi Ty2
agacaggugaacauuacaaugu

SEQ ID NO: 1769434 - RNA, 15 nt, Salmonella enterica enterica serovar Typhi Ty2
agacaguacggauga

SEQ ID NO: 1769435 - RNA, 21 nt, Salmonella enterica enterica serovar Typhi Ty2
agacauauacucuucgccauu

SEQ ID NO: 1769436 - RNA, 15 nt, Salmonella enterica enterica serovar Typhi Ty2
agacauauuuucucu

SEQ ID NO: 1769437 - RNA, 15 nt, Salmonella enterica enterica serovar Typhi Ty2
agacauuauugucuu

SEQ ID NO: 1769438 - RNA, 16 nt, Salmonella enterica enterica serovar Typhi Ty2
agacaugaucuuaccu

SEQ ID NO: 1769439 - RNA, 19 nt, Salmonella enterica enterica serovar Typhi Ty2
agacaugccgccagaccaa

SEQ ID NO: 1769440 - RNA, 21 nt, Salmonella enterica enterica serovar Typhi Ty2
agacauccccgccgagaaaau

SEQ ID NO: 1769441 - RNA, 19 nt, Salmonella enterica enterica serovar Typhi Ty2
aaaacagugauuacaaaau

SEQ ID NO: 1769442 - RNA, 21 nt, Salmonella enterica enterica serovar Typhi Ty2
agacgcaguagcgcuuugaca

SEQ ID NO: 1769443 - RNA, 19 nt, Salmonella enterica enterica serovar Typhi Ty2
agacgcaucaggaaccaca

SEQ ID NO: 1769444 - RNA, 14 nt, Salmonella enterica enterica serovar Typhi Ty2
agacgggccaggcg

SEQ ID NO: 1769445 - RNA, 16 nt, Salmonella enterica enterica serovar Typhi Ty2
agacgccgccgcaucc

SEQ ID NO: 1769446 - RNA, 15 nt, Salmonella enterica enterica serovar Typhi Ty2
agacgguaaucagac

SEQ ID NO: 1769447 - RNA, 15 nt, Salmonella enterica enterica serovar Typhi Ty2
agacgguaagaauaa

SEQ ID NO: 1769448 - RNA, 19 nt, Salmonella enterica enterica serovar Typhi Ty2
agacgguuauuuuucagau

SEQ ID NO: 1769449 - RNA, 16 nt, Salmonella enterica enterica serovar Typhi Ty2
agaccuguaaaaaaac

SEQ ID NO: 1769450 - RNA, 17 nt, Salmonella enterica enterica serovar Typhi Ty2
agaccuguaaaaaaacc

SEQ ID NO: 1769451 - RNA, 20 nt, Salmonella enterica enterica serovar Typhi Ty2
agaccuucaacccagcagca

SEQ ID NO: 1769452 - RNA, 18 nt, Salmonella enterica enterica serovar Typhi Ty2
aaaacagcauaauaaagc

SEQ ID NO: 1769453 - RNA, 19 nt, Salmonella enterica enterica serovar Typhi Ty2
aaaacagcaugguguuagu

SEQ ID NO: 1769454 - RNA, 18 nt, Salmonella enterica enterica serovar Typhi Ty2
aaaacagccgccauggcg

SEQ ID NO: 1769455 - RNA, 14 nt, Salmonella enterica enterica serovar Typhi Ty2
agaccuucaaccca

SEQ ID NO: 1769456 - RNA, 23 nt, Salmonella enterica enterica serovar Typhi Ty2
agaccuuaucgcagucagccuug

SEQ ID NO: 1769457 - RNA, 18 nt, Salmonella enterica enterica serovar Typhi Ty2
agaccgccuaacagcgcc

SEQ ID NO: 1769458 - RNA, 17 nt, Salmonella enterica enterica serovar Typhi Ty2
agaccgacaucgccagu

SEQ ID NO: 1769459 - RNA, 21 nt, Salmonella enterica enterica serovar Typhi Ty2
agacccacauauugcgcuuca

SEQ ID NO: 1769460 - RNA, 16 nt, Salmonella enterica enterica serovar Typhi Ty2
agaaguagcagagaaa

SEQ ID NO: 1769461 - RNA, 18 nt, Salmonella enterica enterica serovar Typhi Ty2
agaaguauggccucuuca

SEQ ID NO: 1769462 - RNA, 20 nt, Salmonella enterica enterica serovar Typhi Ty2
agaagguuauucgccuuuca

SEQ ID NO: 1769463 - RNA, 19 nt, Salmonella enterica enterica serovar Typhi Ty2
agaagggcaggggaaagcu

SEQ ID NO: 1769464 - RNA, 23 nt, Salmonella enterica enterica serovar Typhi Ty2
agaaggucagguuaugcgcgcca

SEQ ID NO: 1769465 - RNA, 17 nt, Salmonella enterica enterica serovar Typhi Ty2
agaaguagcagagaaaa

SEQ ID NO: 1769466 - RNA, 14 nt, Salmonella enterica enterica serovar Typhi Ty2
agaaucccgauaau

SEQ ID NO: 1769467 - RNA, 18 nt, Salmonella enterica enterica serovar Typhi Ty2
agaauguccaucucuuua

SEQ ID NO: 1769468 - RNA, 16 nt, Salmonella enterica enterica serovar Typhi Ty2
agaaugaaaaaaaaau

SEQ ID NO: 1769469 - RNA, 18 nt, Salmonella enterica enterica serovar Typhi Ty2
agaaugaaaaaaaaauua

SEQ ID NO: 1769470 - RNA, 18 nt, Salmonella enterica enterica serovar Typhi Ty2
agaauguguucucccugc

SEQ ID NO: 1769471 - RNA, 13 nt, Salmonella enterica enterica serovar Typhi Ty2
agaauuuauuucu

SEQ ID NO: 1769472 - RNA, 23 nt, Salmonella enterica enterica serovar Typhi Ty2
agaauuuucacuuauaaauaaag

SEQ ID NO: 1769473 - RNA, 11 nt, Salmonella enterica enterica serovar Typhi Ty2
agacaaacagc

SEQ ID NO: 1769474 - RNA, 15 nt, Salmonella enterica enterica serovar Typhi Ty2
agacaaaauucagac

SEQ ID NO: 1769475 - RNA, 10 nt, Salmonella enterica enterica serovar Typhi Ty2
agacaacauc

SEQ ID NO: 1769476 - RNA, 22 nt, Salmonella enterica enterica serovar Typhi Ty2
agacaaucugugugggcacucg

SEQ ID NO: 1769477 - RNA, 21 nt, Salmonella enterica enterica serovar Typhi Ty2
agacaaugcugacacugauau

SEQ ID NO: 1769478 - RNA, 17 nt, Salmonella enterica enterica serovar Typhi Ty2
agacaagcaguucugaa

SEQ ID NO: 1769479 - RNA, 16 nt, Salmonella enterica enterica serovar Typhi Ty2
agacacaauauugcug

SEQ ID NO: 1769480 - RNA, 14 nt, Salmonella enterica enterica serovar Typhi Ty2
agacaauuuucuuc

SEQ ID NO: 1769481 - RNA, 22 nt, Salmonella enterica enterica serovar Typhi Ty2
agacaauugcugcguaacugcc

SEQ ID NO: 1769482 - RNA, 15 nt, Salmonella enterica enterica serovar Typhi Ty2
agacaccccagccua

SEQ ID NO: 1769483 - RNA, 16 nt, Salmonella enterica enterica serovar Typhi Ty2
agacagauaacaccag

SEQ ID NO: 1769484 - RNA, 16 nt, Salmonella enterica enterica serovar Typhi Ty2
agacagauuuggucag

SEQ ID NO: 1769485 - RNA, 13 nt, Salmonella enterica enterica serovar Typhi Ty2
agacacugcacca

SEQ ID NO: 1769486 - RNA, 19 nt, Salmonella enterica enterica serovar Typhi Ty2
agaaauagccgguaacuuu

SEQ ID NO: 1769487 - RNA, 13 nt, Salmonella enterica enterica serovar Typhi Ty2
agaaauauuucac

SEQ ID NO: 1769488 - RNA, 14 nt, Salmonella enterica enterica serovar Typhi Ty2
agaaauauuuugcc

SEQ ID NO: 1769489 - RNA, 23 nt, Salmonella enterica enterica serovar Typhi Ty2
agaaauugcagggugcagcaaau

SEQ ID NO: 1769490 - RNA, 16 nt, Salmonella enterica enterica serovar Typhi Ty2
agaaauuauuuuaaau

SEQ ID NO: 1769491 - RNA, 21 nt, Salmonella enterica enterica serovar Typhi Ty2
agaaauuauuuuaaauuuccu

SEQ ID NO: 1769492 - RNA, 14 nt, Salmonella enterica enterica serovar Typhi Ty2
agaacagcaucacc

SEQ ID NO: 1769493 - RNA, 19 nt, Salmonella enterica enterica serovar Typhi Ty2
agaacagcaucaccggccc

SEQ ID NO: 1769494 - RNA, 18 nt, Salmonella enterica enterica serovar Typhi Ty2
agaacauaaacagcguga

SEQ ID NO: 1769495 - RNA, 16 nt, Salmonella enterica enterica serovar Typhi Ty2
agaaccccugccacaa

SEQ ID NO: 1769496 - RNA, 21 nt, Salmonella enterica enterica serovar Typhi Ty2
agaacccacuuugcuuuucug

SEQ ID NO: 1769497 - RNA, 18 nt, Salmonella enterica enterica serovar Typhi Ty2
agaacugcaaauaccaca

SEQ ID NO: 1769498 - RNA, 22 nt, Salmonella enterica enterica serovar Typhi Ty2
agaacugcaaauaccacaucag

SEQ ID NO: 1769499 - RNA, 23 nt, Salmonella enterica enterica serovar Typhi Ty2
agaacguugacguuucagucacc

SEQ ID NO: 1769500 - RNA, 19 nt, Salmonella enterica enterica serovar Typhi Ty2
agaaccguugcgcccauca

SEQ ID NO: 1769501 - RNA, 18 nt, Salmonella enterica enterica serovar Typhi Ty2
agaacucacgcucaagau

SEQ ID NO: 1769502 - RNA, 16 nt, Salmonella enterica enterica serovar Typhi Ty2
agaacucacgcucaag

SEQ ID NO: 1769503 - RNA, 12 nt, Salmonella enterica enterica serovar Typhi Ty2
agaacucaucuu

SEQ ID NO: 1769504 - RNA, 16 nt, Salmonella enterica enterica serovar Typhi Ty2
agaagcuguaacacug

SEQ ID NO: 1769505 - RNA, 20 nt, Salmonella enterica enterica serovar Typhi Ty2
agaagcugggcgucaacgug

SEQ ID NO: 1769506 - RNA, 22 nt, Salmonella enterica enterica serovar Typhi Ty2
agaagcucaugugcagcaucca

SEQ ID NO: 1769507 - RNA, 19 nt, Salmonella enterica enterica serovar Typhi Ty2
agaagcucaugugcagcau

SEQ ID NO: 1769508 - RNA, 16 nt, Salmonella enterica enterica serovar Typhi Ty2
agaaggcgaacauaag

SEQ ID NO: 1769509 - RNA, 13 nt, Salmonella enterica enterica serovar Typhi Ty2
agaagcaaauuca

SEQ ID NO: 1769510 - RNA, 16 nt, Salmonella enterica enterica serovar Typhi Ty2
agaaaaccccguacag

SEQ ID NO: 1769511 - RNA, 11 nt, Salmonella enterica enterica serovar Typhi Ty2
agaaacaucau

SEQ ID NO: 1769512 - RNA, 13 nt, Salmonella enterica enterica serovar Typhi Ty2
agaaaauaauuca

SEQ ID NO: 1769513 - RNA, 18 nt, Salmonella enterica enterica serovar Typhi Ty2
agaaaauaacaauauuaa

SEQ ID NO: 1769514 - RNA, 19 nt, Salmonella enterica enterica serovar Typhi Ty2
agaaaaggaagaauaaaua

SEQ ID NO: 1769515 - RNA, 12 nt, Salmonella enterica enterica serovar Typhi Ty2
agaaaaacgcgc

SEQ ID NO: 1769516 - RNA, 18 nt, Salmonella enterica enterica serovar Typhi Ty2
agaaaaacgcgcaaaacu

SEQ ID NO: 1769517 - RNA, 23 nt, Salmonella enterica enterica serovar Typhi Ty2
agaaaacagugauuacaaaaugu

SEQ ID NO: 1769518 - RNA, 13 nt, Salmonella enterica enterica serovar Typhi Ty2
agaaaaaguagaa

SEQ ID NO: 1769519 - RNA, 20 nt, Salmonella enterica enterica serovar Typhi Ty2
agaaaaagguaacuauuucu

SEQ ID NO: 1769520 - RNA, 23 nt, Salmonella enterica enterica serovar Typhi Ty2
agaaaaaucagucauuugcaggu

SEQ ID NO: 1769521 - RNA, 22 nt, Salmonella enterica enterica serovar Typhi Ty2
acuuuugccaggcggauaaaac

SEQ ID NO: 1769522 - RNA, 14 nt, Salmonella enterica enterica serovar Typhi Ty2
acuugauggaaaac

SEQ ID NO: 1769523 - RNA, 15 nt, Salmonella enterica enterica serovar Typhi Ty2
acuuuugcaaucgca

SEQ ID NO: 1769524 - RNA, 20 nt, Salmonella enterica enterica serovar Typhi Ty2
agaaagucgcaauauaaaua

SEQ ID NO: 1769525 - RNA, 17 nt, Salmonella enterica enterica serovar Typhi Ty2
agaaaguggcauaucau

SEQ ID NO: 1769526 - RNA, 14 nt, Salmonella enterica enterica serovar Typhi Ty2
agaaauaacucccu

SEQ ID NO: 1769527 - RNA, 23 nt, Salmonella enterica enterica serovar Typhi Ty2
agaaagcuacguuugaacagcag

SEQ ID NO: 1769528 - RNA, 23 nt, Salmonella enterica enterica serovar Typhi Ty2
agaaagcgaauggcgugaagcca

SEQ ID NO: 1769529 - RNA, 18 nt, Salmonella enterica enterica serovar Typhi Ty2
agaaaggggagggcaaca

SEQ ID NO: 1769530 - RNA, 14 nt, Salmonella enterica enterica serovar Typhi Ty2
agaaacugcuguag

SEQ ID NO: 1769531 - RNA, 20 nt, Salmonella enterica enterica serovar Typhi Ty2
agaaaccauaaacaaaacaa

SEQ ID NO: 1769532 - RNA, 23 nt, Salmonella enterica enterica serovar Typhi Ty2
agaaagcauuaaaucaucauaau

SEQ ID NO: 1769533 - RNA, 22 nt, Salmonella enterica enterica serovar Typhi Ty2
acccggcugccauuaucaccau

SEQ ID NO: 1769534 - RNA, 23 nt, Salmonella enterica enterica serovar Typhi Ty2
acccggcaaaggaauuacgggcg

SEQ ID NO: 1769535 - RNA, 16 nt, Salmonella enterica enterica serovar Typhi Ty2
acccggcaauucaucc

SEQ ID NO: 1769536 - RNA, 14 nt, Salmonella enterica enterica serovar Typhi Ty2
acccggcccggcgc

SEQ ID NO: 1769537 - RNA, 18 nt, Salmonella enterica enterica serovar Typhi Ty2
acccgcuuucgcguagcc

SEQ ID NO: 1769538 - RNA, 16 nt, Salmonella enterica enterica serovar Typhi Ty2
acccgcugcuucacgg

SEQ ID NO: 1769539 - RNA, 18 nt, Salmonella enterica enterica serovar Typhi Ty2
acccgcgcucuccggcac

SEQ ID NO: 1769540 - RNA, 15 nt, Salmonella enterica enterica serovar Typhi Ty2
acccgcgccagcagg

SEQ ID NO: 1769541 - RNA, 21 nt, Salmonella enterica enterica serovar Typhi Ty2
acccgcgaucacuaccgccau

SEQ ID NO: 1769542 - RNA, 15 nt, Salmonella enterica enterica serovar Typhi Ty2
acccgcuaugaagac

SEQ ID NO: 1769543 - RNA, 20 nt, Salmonella enterica enterica serovar Typhi Ty2
accccuugcgcguuucugaa

SEQ ID NO: 1769544 - RNA, 13 nt, Salmonella enterica enterica serovar Typhi Ty2
accccugcggcug

SEQ ID NO: 1769545 - RNA, 17 nt, Salmonella enterica enterica serovar Typhi Ty2
accccuucgcccucgcc

SEQ ID NO: 1769546 - RNA, 18 nt, Salmonella enterica enterica serovar Typhi Ty2
accccuguucaaaauagc

SEQ ID NO: 1769547 - RNA, 14 nt, Salmonella enterica enterica serovar Typhi Ty2
accccuuaguuuuc

SEQ ID NO: 1769548 - RNA, 18 nt, Salmonella enterica enterica serovar Typhi Ty2
acccauauucgucuucau

SEQ ID NO: 1769549 - RNA, 21 nt, Salmonella enterica enterica serovar Typhi Ty2
acccauauucgucuucaucuu

SEQ ID NO: 1769550 - RNA, 14 nt, Salmonella enterica enterica serovar Typhi Ty2
acccaucaauaacg

SEQ ID NO: 1769551 - RNA, 15 nt, Salmonella enterica enterica serovar Typhi Ty2
acccaccaacuuuuc

SEQ ID NO: 1769552 - RNA, 12 nt, Salmonella enterica enterica serovar Typhi Ty2
acccacaagaaa

SEQ ID NO: 1769553 - RNA, 14 nt, Salmonella enterica enterica serovar Typhi Ty2
acccaccagcgcca

SEQ ID NO: 1769554 - RNA, 19 nt, Salmonella enterica enterica serovar Typhi Ty2
acccaugccgcgacgaagu

SEQ ID NO: 1769555 - RNA, 23 nt, Salmonella enterica enterica serovar Typhi Ty2
accccgccagcagguuaaacaga

SEQ ID NO: 1769556 - RNA, 18 nt, Salmonella enterica enterica serovar Typhi Ty2
accccaugccgauaauaa

SEQ ID NO: 1769557 - RNA, 15 nt, Salmonella enterica enterica serovar Typhi Ty2
accccauggcgucuu

SEQ ID NO: 1769558 - RNA, 18 nt, Salmonella enterica enterica serovar Typhi Ty2
acccccaccucaaucacc

SEQ ID NO: 1769559 - RNA, 22 nt, Salmonella enterica enterica serovar Typhi Ty2
accccagggagacggccaccca

SEQ ID NO: 1769560 - RNA, 22 nt, Salmonella enterica enterica serovar Typhi Ty2
accccaggcgauaccgcgcugg

SEQ ID NO: 1769561 - RNA, 15 nt, Salmonella enterica enterica serovar Typhi Ty2
accccaguagcccug

SEQ ID NO: 1769562 - RNA, 16 nt, Salmonella enterica enterica serovar Typhi Ty2
accccaggucagcagu

SEQ ID NO: 1769563 - RNA, 17 nt, Salmonella enterica enterica serovar Typhi Ty2
acccacaucagcggcac

SEQ ID NO: 1769564 - RNA, 13 nt, Salmonella enterica enterica serovar Typhi Ty2
acccacaagaaau

SEQ ID NO: 1769565 - RNA, 15 nt, Salmonella enterica enterica serovar Typhi Ty2
acccaaugauccgga

SEQ ID NO: 1769566 - RNA, 13 nt, Salmonella enterica enterica serovar Typhi Ty2
acccacacauaga

SEQ ID NO: 1769567 - RNA, 17 nt, Salmonella enterica enterica serovar Typhi Ty2
acccacaccacagccac

SEQ ID NO: 1769568 - RNA, 14 nt, Salmonella enterica enterica serovar Typhi Ty2
acccaacguuauaa

SEQ ID NO: 1769569 - RNA, 16 nt, Salmonella enterica enterica serovar Typhi Ty2
acccaaauaucaaaua

SEQ ID NO: 1769570 - RNA, 15 nt, Salmonella enterica enterica serovar Typhi Ty2
acccaacaccagacu

SEQ ID NO: 1769571 - RNA, 17 nt, Salmonella enterica enterica serovar Typhi Ty2
accauuaccauuccuca

SEQ ID NO: 1769572 - RNA, 18 nt, Salmonella enterica enterica serovar Typhi Ty2
accauuccgauagcgaaa

SEQ ID NO: 1769573 - RNA, 18 nt, Salmonella enterica enterica serovar Typhi Ty2
accauucccguaaaagaa

SEQ ID NO: 1769574 - RNA, 17 nt, Salmonella enterica enterica serovar Typhi Ty2
accauuggcaccaccag

SEQ ID NO: 1769575 - RNA, 18 nt, Salmonella enterica enterica serovar Typhi Ty2
accauugcguauuucacc

SEQ ID NO: 1769576 - RNA, 17 nt, Salmonella enterica enterica serovar Typhi Ty2
accauugcguauuucac

SEQ ID NO: 1769577 - RNA, 14 nt, Salmonella enterica enterica serovar Typhi Ty2
accauuuccucugc

SEQ ID NO: 1769578 - RNA, 13 nt, Salmonella enterica enterica serovar Typhi Ty2
accaucccggcgu

SEQ ID NO: 1769579 - RNA, 15 nt, Salmonella enterica enterica serovar Typhi Ty2
accauccaugaaaua

SEQ ID NO: 1769580 - RNA, 12 nt, Salmonella enterica enterica serovar Typhi Ty2
accaucacugaa

SEQ ID NO: 1769581 - RNA, 16 nt, Salmonella enterica enterica serovar Typhi Ty2
accaugccacaacaga

SEQ ID NO: 1769582 - RNA, 22 nt, Salmonella enterica enterica serovar Typhi Ty2
accaugauccguucgaucagcu

SEQ ID NO: 1769583 - RNA, 17 nt, Salmonella enterica enterica serovar Typhi Ty2
accaugauaauaaucau

SEQ ID NO: 1769584 - RNA, 13 nt, Salmonella enterica enterica serovar Typhi Ty2
accauaaugaucg

SEQ ID NO: 1769585 - RNA, 21 nt, Salmonella enterica enterica serovar Typhi Ty2
accagaaaaccgacagcaaua

SEQ ID NO: 1769586 - RNA, 13 nt, Salmonella enterica enterica serovar Typhi Ty2
accagaaccucac

SEQ ID NO: 1769587 - RNA, 23 nt, Salmonella enterica enterica serovar Typhi Ty2
accauacugcucaagaauacccu

SEQ ID NO: 1769588 - RNA, 19 nt, Salmonella enterica enterica serovar Typhi Ty2
accauaccggugcgcccca

SEQ ID NO: 1769589 - RNA, 13 nt, Salmonella enterica enterica serovar Typhi Ty2
accgccgcccguc

SEQ ID NO: 1769590 - RNA, 19 nt, Salmonella enterica enterica serovar Typhi Ty2
accgccucgccaaagcgcu

SEQ ID NO: 1769591 - RNA, 14 nt, Salmonella enterica enterica serovar Typhi Ty2
accgccuccaggcc

SEQ ID NO: 1769592 - RNA, 17 nt, Salmonella enterica enterica serovar Typhi Ty2
accgccuguuuaaugau

SEQ ID NO: 1769593 - RNA, 18 nt, Salmonella enterica enterica serovar Typhi Ty2
accgccuucagcgcgccc

SEQ ID NO: 1769594 - RNA, 14 nt, Salmonella enterica enterica serovar Typhi Ty2
accgccuuccugcu

SEQ ID NO: 1769595 - RNA, 20 nt, Salmonella enterica enterica serovar Typhi Ty2
accgcgcggcguucugcgcc

SEQ ID NO: 1769596 - RNA, 20 nt, Salmonella enterica enterica serovar Typhi Ty2
accgcgaugaccaucaaaua

SEQ ID NO: 1769597 - RNA, 13 nt, Salmonella enterica enterica serovar Typhi Ty2
accgcgcccgguu

SEQ ID NO: 1769598 - RNA, 21 nt, Salmonella enterica enterica serovar Typhi Ty2
accgcugauggaccuuuuggu

SEQ ID NO: 1769599 - RNA, 14 nt, Salmonella enterica enterica serovar Typhi Ty2
accgcguaaaaagu

SEQ ID NO: 1769600 - RNA, 18 nt, Salmonella enterica enterica serovar Typhi Ty2
accgcggcaaccagccca

SEQ ID NO: 1769601 - RNA, 21 nt, Salmonella enterica enterica serovar Typhi Ty2
accggcgaacguuggcugggu

SEQ ID NO: 1769602 - RNA, 19 nt, Salmonella enterica enterica serovar Typhi Ty2
accggcguaauugcgccug

SEQ ID NO: 1769603 - RNA, 12 nt, Salmonella enterica enterica serovar Typhi Ty2
accggcgcgccu

SEQ ID NO: 1769604 - RNA, 19 nt, Salmonella enterica enterica serovar Typhi Ty2
accggcggccuaccaguug

SEQ ID NO: 1769605 - RNA, 20 nt, Salmonella enterica enterica serovar Typhi Ty2
accgggcgaaagcacuucuc

SEQ ID NO: 1769606 - RNA, 17 nt, Salmonella enterica enterica serovar Typhi Ty2
accgcugggaugaccug

SEQ ID NO: 1769607 - RNA, 18 nt, Salmonella enterica enterica serovar Typhi Ty2
accgcugcggaacaccag

SEQ ID NO: 1769608 - RNA, 14 nt, Salmonella enterica enterica serovar Typhi Ty2
accgcugcgauaau

SEQ ID NO: 1769609 - RNA, 21 nt, Salmonella enterica enterica serovar Typhi Ty2
accggaugggcagauagaaug

SEQ ID NO: 1769610 - RNA, 14 nt, Salmonella enterica enterica serovar Typhi Ty2
accggacugcucgc

SEQ ID NO: 1769611 - RNA, 16 nt, Salmonella enterica enterica serovar Typhi Ty2
accggaggagugcgcc

SEQ ID NO: 1769612 - RNA, 15 nt, Salmonella enterica enterica serovar Typhi Ty2
accggcccacgcagu

SEQ ID NO: 1769613 - RNA, 18 nt, Salmonella enterica enterica serovar Typhi Ty2
accggccauugccgcgcc

SEQ ID NO: 1769614 - RNA, 21 nt, Salmonella enterica enterica serovar Typhi Ty2
accggauuugacguuauccag

SEQ ID NO: 1769615 - RNA, 17 nt, Salmonella enterica enterica serovar Typhi Ty2
accggccagcgucauca

SEQ ID NO: 1769616 - RNA, 16 nt, Salmonella enterica enterica serovar Typhi Ty2
acccgugcgcgucgcc

SEQ ID NO: 1769617 - RNA, 22 nt, Salmonella enterica enterica serovar Typhi Ty2
acccguuuucuccuucauccag

SEQ ID NO: 1769618 - RNA, 14 nt, Salmonella enterica enterica serovar Typhi Ty2
accgagauacgcug

SEQ ID NO: 1769619 - RNA, 13 nt, Salmonella enterica enterica serovar Typhi Ty2
accgagacagaga

SEQ ID NO: 1769620 - RNA, 14 nt, Salmonella enterica enterica serovar Typhi Ty2
accgacuuucaaau

SEQ ID NO: 1769621 - RNA, 18 nt, Salmonella enterica enterica serovar Typhi Ty2
accgauagcuaucacaca

SEQ ID NO: 1769622 - RNA, 19 nt, Salmonella enterica enterica serovar Typhi Ty2
accgauauagagcccucug

SEQ ID NO: 1769623 - RNA, 13 nt, Salmonella enterica enterica serovar Typhi Ty2
accgagcagcuug

SEQ ID NO: 1769624 - RNA, 18 nt, Salmonella enterica enterica serovar Typhi Ty2
accgauauuuugcugcac

SEQ ID NO: 1769625 - RNA, 22 nt, Salmonella enterica enterica serovar Typhi Ty2
accgaugcaaccgcucuccgca

SEQ ID NO: 1769626 - RNA, 15 nt, Salmonella enterica enterica serovar Typhi Ty2
accgcauggaaucga

SEQ ID NO: 1769627 - RNA, 13 nt, Salmonella enterica enterica serovar Typhi Ty2
accgcaugacaau

SEQ ID NO: 1769628 - RNA, 21 nt, Salmonella enterica enterica serovar Typhi Ty2
accgcaucacgcgaagcggcg

SEQ ID NO: 1769629 - RNA, 14 nt, Salmonella enterica enterica serovar Typhi Ty2
accgccaagcgcgg

SEQ ID NO: 1769630 - RNA, 17 nt, Salmonella enterica enterica serovar Typhi Ty2
accgccaaccgcccguc

SEQ ID NO: 1769631 - RNA, 13 nt, Salmonella enterica enterica serovar Typhi Ty2
accgcagccuuga

SEQ ID NO: 1769632 - RNA, 14 nt, Salmonella enterica enterica serovar Typhi Ty2
accgcagaagguca

SEQ ID NO: 1769633 - RNA, 16 nt, Salmonella enterica enterica serovar Typhi Ty2
accgcagcuuauucca

SEQ ID NO: 1769634 - RNA, 15 nt, Salmonella enterica enterica serovar Typhi Ty2
accgccaucaaacgc

SEQ ID NO: 1769635 - RNA, 17 nt, Salmonella enterica enterica serovar Typhi Ty2
accgccaugcggcgcca

SEQ ID NO: 1769636 - RNA, 23 nt, Salmonella enterica enterica serovar Typhi Ty2
accgccacuuugcuuuguagcgc

SEQ ID NO: 1769637 - RNA, 12 nt, Salmonella enterica enterica serovar Typhi Ty2
accgccagcaga

SEQ ID NO: 1769638 - RNA, 18 nt, Salmonella enterica enterica serovar Typhi Ty2
accgccgccaccaaaaac

SEQ ID NO: 1769639 - RNA, 21 nt, Salmonella enterica enterica serovar Typhi Ty2
accgccgagcauuuccgcagc

SEQ ID NO: 1769640 - RNA, 16 nt, Salmonella enterica enterica serovar Typhi Ty2
accgccgacaaucguc

SEQ ID NO: 1769641 - RNA, 20 nt, Salmonella enterica enterica serovar Typhi Ty2
accgcccagagaauauuggc

SEQ ID NO: 1769642 - RNA, 18 nt, Salmonella enterica enterica serovar Typhi Ty2
accgcccaucaacaccag

SEQ ID NO: 1769643 - RNA, 18 nt, Salmonella enterica enterica serovar Typhi Ty2
accgcccaucgccugauu

SEQ ID NO: 1769644 - RNA, 15 nt, Salmonella enterica enterica serovar Typhi Ty2
accgcccgccgggcg

SEQ ID NO: 1769645 - RNA, 20 nt, Salmonella enterica enterica serovar Typhi Ty2
accgcccgcggcgaucacca

SEQ ID NO: 1769646 - RNA, 13 nt, Salmonella enterica enterica serovar Typhi Ty2
acgccaaaaagug

SEQ ID NO: 1769647 - RNA, 21 nt, Salmonella enterica enterica serovar Typhi Ty2
acgccaagcgcggcagcagcu

SEQ ID NO: 1769648 - RNA, 13 nt, Salmonella enterica enterica serovar Typhi Ty2
acgccaagcagcg

SEQ ID NO: 1769649 - RNA, 19 nt, Salmonella enterica enterica serovar Typhi Ty2
acgccaccuuugaaaauca

SEQ ID NO: 1769650 - RNA, 22 nt, Salmonella enterica enterica serovar Typhi Ty2
acgccaccggguuaaagcccug

SEQ ID NO: 1769651 - RNA, 15 nt, Salmonella enterica enterica serovar Typhi Ty2
acgccacaguugguu

SEQ ID NO: 1769652 - RNA, 14 nt, Salmonella enterica enterica serovar Typhi Ty2
acgccacaaacugc

SEQ ID NO: 1769653 - RNA, 18 nt, Salmonella enterica enterica serovar Typhi Ty2
acgccaccgccaccugcc

SEQ ID NO: 1769654 - RNA, 22 nt, Salmonella enterica enterica serovar Typhi Ty2
acgccaccgccgccaccaaaaa

SEQ ID NO: 1769655 - RNA, 18 nt, Salmonella enterica enterica serovar Typhi Ty2
acgccagucuuugcagga

SEQ ID NO: 1769656 - RNA, 14 nt, Salmonella enterica enterica serovar Typhi Ty2
acgccagugcgcau

SEQ ID NO: 1769657 - RNA, 11 nt, Salmonella enterica enterica serovar Typhi Ty2
acgccagccag

SEQ ID NO: 1769658 - RNA, 12 nt, Salmonella enterica enterica serovar Typhi Ty2
acgccagccagc

SEQ ID NO: 1769659 - RNA, 16 nt, Salmonella enterica enterica serovar Typhi Ty2
acgccagccacugacu

SEQ ID NO: 1769660 - RNA, 14 nt, Salmonella enterica enterica serovar Typhi Ty2
acgccagcagcucg

SEQ ID NO: 1769661 - RNA, 17 nt, Salmonella enterica enterica serovar Typhi Ty2
acgccagauuaucggcc

SEQ ID NO: 1769662 - RNA, 22 nt, Salmonella enterica enterica serovar Typhi Ty2
acgcauugagacaugccgccag

SEQ ID NO: 1769663 - RNA, 22 nt, Salmonella enterica enterica serovar Typhi Ty2
acgcauugccauguuaauacca

SEQ ID NO: 1769664 - RNA, 16 nt, Salmonella enterica enterica serovar Typhi Ty2
acgcaucuuuuucccg

SEQ ID NO: 1769665 - RNA, 15 nt, Salmonella enterica enterica serovar Typhi Ty2
acgcaucuuuuuccc

SEQ ID NO: 1769666 - RNA, 13 nt, Salmonella enterica enterica serovar Typhi Ty2
acgcaugaagcgu

SEQ ID NO: 1769667 - RNA, 17 nt, Salmonella enterica enterica serovar Typhi Ty2
acgcaucgguaaagguu

SEQ ID NO: 1769668 - RNA, 22 nt, Salmonella enterica enterica serovar Typhi Ty2
acgcauccagcgcaaagggaca

SEQ ID NO: 1769669 - RNA, 14 nt, Salmonella enterica enterica serovar Typhi Ty2
acgcauccugcacu

SEQ ID NO: 1769670 - RNA, 18 nt, Salmonella enterica enterica serovar Typhi Ty2
acgcaucccgccaaccag

SEQ ID NO: 1769671 - RNA, 23 nt, Salmonella enterica enterica serovar Typhi Ty2
acgcaucgcugcgcuuacacacc

SEQ ID NO: 1769672 - RNA, 24 nt, Salmonella enterica enterica serovar Typhi Ty2
acgcauaucccacugcacgccagg

SEQ ID NO: 1769673 - RNA, 20 nt, Salmonella enterica enterica serovar Typhi Ty2
acgcauaucccacugcacgc

SEQ ID NO: 1769674 - RNA, 15 nt, Salmonella enterica enterica serovar Typhi Ty2
acgcaucaaagccac

SEQ ID NO: 1769675 - RNA, 16 nt, Salmonella enterica enterica serovar Typhi Ty2
acgcaucaaagccacc

SEQ ID NO: 1769676 - RNA, 12 nt, Salmonella enterica enterica serovar Typhi Ty2
acgcaucaaaua

SEQ ID NO: 1769677 - RNA, 19 nt, Salmonella enterica enterica serovar Typhi Ty2
acgcaucaaauaccuuuuc

SEQ ID NO: 1769678 - RNA, 19 nt, Salmonella enterica enterica serovar Typhi Ty2
acgcauaaaaaaugagaaa

SEQ ID NO: 1769679 - RNA, 20 nt, Salmonella enterica enterica serovar Typhi Ty2
acgcagggccgcgagaacuu

SEQ ID NO: 1769680 - RNA, 20 nt, Salmonella enterica enterica serovar Typhi Ty2
acgcagugcgcgaccgcauc

SEQ ID NO: 1769681 - RNA, 17 nt, Salmonella enterica enterica serovar Typhi Ty2
acgcaguggcaauuuaa

SEQ ID NO: 1769682 - RNA, 17 nt, Salmonella enterica enterica serovar Typhi Ty2
acgcaccguagugacac

SEQ ID NO: 1769683 - RNA, 13 nt, Salmonella enterica enterica serovar Typhi Ty2
acgcacuaccaga

SEQ ID NO: 1769684 - RNA, 16 nt, Salmonella enterica enterica serovar Typhi Ty2
acgcacaguacgcccg

SEQ ID NO: 1769685 - RNA, 17 nt, Salmonella enterica enterica serovar Typhi Ty2
acgcaaggaaauauuaa

SEQ ID NO: 1769686 - RNA, 16 nt, Salmonella enterica enterica serovar Typhi Ty2
acgcaaggaaauauua

SEQ ID NO: 1769687 - RNA, 13 nt, Salmonella enterica enterica serovar Typhi Ty2
acgcaacaacagu

SEQ ID NO: 1769688 - RNA, 17 nt, Salmonella enterica enterica serovar Typhi Ty2
acgcaacaggccgcauc

SEQ ID NO: 1769689 - RNA, 14 nt, Salmonella enterica enterica serovar Typhi Ty2
acgcaacaccaucc

SEQ ID NO: 1769690 - RNA, 22 nt, Salmonella enterica enterica serovar Typhi Ty2
acgcaggcuaacgcgccccagg

SEQ ID NO: 1769691 - RNA, 13 nt, Salmonella enterica enterica serovar Typhi Ty2
acgcagcuuaaag

SEQ ID NO: 1769692 - RNA, 11 nt, Salmonella enterica enterica serovar Typhi Ty2
acgcagcccca

SEQ ID NO: 1769693 - RNA, 14 nt, Salmonella enterica enterica serovar Typhi Ty2
acgcagcauuucgu

SEQ ID NO: 1769694 - RNA, 15 nt, Salmonella enterica enterica serovar Typhi Ty2
acgcagcaagaacag

SEQ ID NO: 1769695 - RNA, 12 nt, Salmonella enterica enterica serovar Typhi Ty2
acgcagcaagaa

SEQ ID NO: 1769696 - RNA, 19 nt, Salmonella enterica enterica serovar Typhi Ty2
acgcagcacguccagauac

SEQ ID NO: 1769697 - RNA, 14 nt, Salmonella enterica enterica serovar Typhi Ty2
acgcagcaucgcca

SEQ ID NO: 1769698 - RNA, 18 nt, Salmonella enterica enterica serovar Typhi Ty2
acgcagcaucucaauauc

SEQ ID NO: 1769699 - RNA, 18 nt, Salmonella enterica enterica serovar Typhi Ty2
acgcagacuauagguggc

SEQ ID NO: 1769700 - RNA, 15 nt, Salmonella enterica enterica serovar Typhi Ty2
acgcagaagacagaa

SEQ ID NO: 1769701 - RNA, 22 nt, Salmonella enterica enterica serovar Typhi Ty2
acgauacagcacggcaguacac

SEQ ID NO: 1769702 - RNA, 20 nt, Salmonella enterica enterica serovar Typhi Ty2
acgauaccgacacaucaucg

SEQ ID NO: 1769703 - RNA, 19 nt, Salmonella enterica enterica serovar Typhi Ty2
acgaggauuagacuucuuc

SEQ ID NO: 1769704 - RNA, 16 nt, Salmonella enterica enterica serovar Typhi Ty2
acgagagacugauaau

SEQ ID NO: 1769705 - RNA, 19 nt, Salmonella enterica enterica serovar Typhi Ty2
acgagaacucggaggcggc

SEQ ID NO: 1769706 - RNA, 16 nt, Salmonella enterica enterica serovar Typhi Ty2
acgagaauaagaccaa

SEQ ID NO: 1769707 - RNA, 18 nt, Salmonella enterica enterica serovar Typhi Ty2
acgagaagcgauuagcug

SEQ ID NO: 1769708 - RNA, 12 nt, Salmonella enterica enterica serovar Typhi Ty2
acgaaguuuaau

SEQ ID NO: 1769709 - RNA, 19 nt, Salmonella enterica enterica serovar Typhi Ty2
acgacuguagauaccuacu

SEQ ID NO: 1769710 - RNA, 22 nt, Salmonella enterica enterica serovar Typhi Ty2
acgaucugacauuugcaucaaa

SEQ ID NO: 1769711 - RNA, 19 nt, Salmonella enterica enterica serovar Typhi Ty2
acgaucuggcaaaccaugu

SEQ ID NO: 1769712 - RNA, 15 nt, Salmonella enterica enterica serovar Typhi Ty2
acgaucgauaaagcg

SEQ ID NO: 1769713 - RNA, 17 nt, Salmonella enterica enterica serovar Typhi Ty2
acgaucccuaauaaaau

SEQ ID NO: 1769714 - RNA, 20 nt, Salmonella enterica enterica serovar Typhi Ty2
acgaugcauaugcacagcgc

SEQ ID NO: 1769715 - RNA, 21 nt, Salmonella enterica enterica serovar Typhi Ty2
acgcaaagacaccccagccua

SEQ ID NO: 1769716 - RNA, 20 nt, Salmonella enterica enterica serovar Typhi Ty2
acgcaaaggcguugugcugc

SEQ ID NO: 1769717 - RNA, 19 nt, Salmonella enterica enterica serovar Typhi Ty2
acgauuggccgucucuuuc

SEQ ID NO: 1769718 - RNA, 19 nt, Salmonella enterica enterica serovar Typhi Ty2
accugagcgugcaauguca

SEQ ID NO: 1769719 - RNA, 23 nt, Salmonella enterica enterica serovar Typhi Ty2
accugauauugcguaagcagcug

SEQ ID NO: 1769720 - RNA, 17 nt, Salmonella enterica enterica serovar Typhi Ty2
accugggaaucgugcaa

SEQ ID NO: 1769721 - RNA, 21 nt, Salmonella enterica enterica serovar Typhi Ty2
accuggguagcuucugucugc

SEQ ID NO: 1769722 - RNA, 20 nt, Salmonella enterica enterica serovar Typhi Ty2
accuggguagcuucugucug

SEQ ID NO: 1769723 - RNA, 17 nt, Salmonella enterica enterica serovar Typhi Ty2
accuguuucgccaggcc

SEQ ID NO: 1769724 - RNA, 12 nt, Salmonella enterica enterica serovar Typhi Ty2
accuguuuguuu

SEQ ID NO: 1769725 - RNA, 11 nt, Salmonella enterica enterica serovar Typhi Ty2
accuuaaugau

SEQ ID NO: 1769726 - RNA, 20 nt, Salmonella enterica enterica serovar Typhi Ty2
accuuaaccgucugcucaga

SEQ ID NO: 1769727 - RNA, 20 nt, Salmonella enterica enterica serovar Typhi Ty2
accuuaaaaggcgcucgccu

SEQ ID NO: 1769728 - RNA, 20 nt, Salmonella enterica enterica serovar Typhi Ty2
accuuacguuucucacuaau

SEQ ID NO: 1769729 - RNA, 23 nt, Salmonella enterica enterica serovar Typhi Ty2
accuuacgcacaugaucuucguu

SEQ ID NO: 1769730 - RNA, 21 nt, Salmonella enterica enterica serovar Typhi Ty2
accuuacuuguaggccuggua

SEQ ID NO: 1769731 - RNA, 20 nt, Salmonella enterica enterica serovar Typhi Ty2
accuucaacccagcagcaga

SEQ ID NO: 1769732 - RNA, 19 nt, Salmonella enterica enterica serovar Typhi Ty2
accuucaagaaucaauaua

SEQ ID NO: 1769733 - RNA, 22 nt, Salmonella enterica enterica serovar Typhi Ty2
accuucccgcgauaaaaacagc

SEQ ID NO: 1769734 - RNA, 17 nt, Salmonella enterica enterica serovar Typhi Ty2
accuucaacccagcagc

SEQ ID NO: 1769735 - RNA, 19 nt, Salmonella enterica enterica serovar Typhi Ty2
accuuccauuaugaugagu

SEQ ID NO: 1769736 - RNA, 16 nt, Salmonella enterica enterica serovar Typhi Ty2
accuugcgccucuggu

SEQ ID NO: 1769737 - RNA, 19 nt, Salmonella enterica enterica serovar Typhi Ty2
accuucgcuuuuaaaacuu

SEQ ID NO: 1769738 - RNA, 14 nt, Salmonella enterica enterica serovar Typhi Ty2
accuugcccuggaa

SEQ ID NO: 1769739 - RNA, 16 nt, Salmonella enterica enterica serovar Typhi Ty2
acgaaccguggccucc

SEQ ID NO: 1769740 - RNA, 19 nt, Salmonella enterica enterica serovar Typhi Ty2
acgaaccugauuguuuuac

SEQ ID NO: 1769741 - RNA, 21 nt, Salmonella enterica enterica serovar Typhi Ty2
acgaacaacaucagacaguac

SEQ ID NO: 1769742 - RNA, 17 nt, Salmonella enterica enterica serovar Typhi Ty2
acgaaaaccguccacau

SEQ ID NO: 1769743 - RNA, 21 nt, Salmonella enterica enterica serovar Typhi Ty2
acgaaaaaugaauaccaaguc

SEQ ID NO: 1769744 - RNA, 13 nt, Salmonella enterica enterica serovar Typhi Ty2
accucaucaaaca

SEQ ID NO: 1769745 - RNA, 19 nt, Salmonella enterica enterica serovar Typhi Ty2
accucccgccggggcuccc

SEQ ID NO: 1769746 - RNA, 18 nt, Salmonella enterica enterica serovar Typhi Ty2
accucagccaacccacgc

SEQ ID NO: 1769747 - RNA, 21 nt, Salmonella enterica enterica serovar Typhi Ty2
accucaccguccgccaggccc

SEQ ID NO: 1769748 - RNA, 16 nt, Salmonella enterica enterica serovar Typhi Ty2
accucaaggcucagca

SEQ ID NO: 1769749 - RNA, 22 nt, Salmonella enterica enterica serovar Typhi Ty2
accuccgcccggugcucaauaa

SEQ ID NO: 1769750 - RNA, 17 nt, Salmonella enterica enterica serovar Typhi Ty2
accucaucaacgccaag

SEQ ID NO: 1769751 - RNA, 20 nt, Salmonella enterica enterica serovar Typhi Ty2
accucgaaaagcgucuucuu

SEQ ID NO: 1769752 - RNA, 13 nt, Salmonella enterica enterica serovar Typhi Ty2
accuccugcaucg

SEQ ID NO: 1769753 - RNA, 20 nt, Salmonella enterica enterica serovar Typhi Ty2
accgggcucacgcuggugcu

SEQ ID NO: 1769754 - RNA, 12 nt, Salmonella enterica enterica serovar Typhi Ty2
accgggcuaaac

SEQ ID NO: 1769755 - RNA, 15 nt, Salmonella enterica enterica serovar Typhi Ty2
accgggcugcagccc

SEQ ID NO: 1769756 - RNA, 16 nt, Salmonella enterica enterica serovar Typhi Ty2
accggggcgcgccgcu

SEQ ID NO: 1769757 - RNA, 16 nt, Salmonella enterica enterica serovar Typhi Ty2
accggugcgccccagc

SEQ ID NO: 1769758 - RNA, 20 nt, Salmonella enterica enterica serovar Typhi Ty2
accggugcggagcaggcaau

SEQ ID NO: 1769759 - RNA, 13 nt, Salmonella enterica enterica serovar Typhi Ty2
accggugcgcccc

SEQ ID NO: 1769760 - RNA, 15 nt, Salmonella enterica enterica serovar Typhi Ty2
accucuuccccgguc

SEQ ID NO: 1769761 - RNA, 13 nt, Salmonella enterica enterica serovar Typhi Ty2
accucuuuuuccg

SEQ ID NO: 1769762 - RNA, 23 nt, Salmonella enterica enterica serovar Typhi Ty2
accucuuugcggccuuuauccag

SEQ ID NO: 1769763 - RNA, 17 nt, Salmonella enterica enterica serovar Typhi Ty2
accugacuauacccaaa

SEQ ID NO: 1769764 - RNA, 13 nt, Salmonella enterica enterica serovar Typhi Ty2
accugaaugcaaa

SEQ ID NO: 1769765 - RNA, 16 nt, Salmonella enterica enterica serovar Typhi Ty2
accugaaugcaaagaa

SEQ ID NO: 1769766 - RNA, 16 nt, Salmonella enterica enterica serovar Typhi Ty2
accugaaaucagccug

SEQ ID NO: 1769767 - RNA, 15 nt, Salmonella enterica enterica serovar Typhi Ty2
accugaaaucagccu

SEQ ID NO: 1769768 - RNA, 16 nt, Salmonella enterica enterica serovar Typhi Ty2
accucucaccgccuag

SEQ ID NO: 1769769 - RNA, 20 nt, Salmonella enterica enterica serovar Typhi Ty2
accucgguauguccugccgc

SEQ ID NO: 1769770 - RNA, 22 nt, Salmonella enterica enterica serovar Typhi Ty2
accucggguaaagguuugcugc

SEQ ID NO: 1769771 - RNA, 18 nt, Salmonella enterica enterica serovar Typhi Ty2
accucgguauguccugcc

SEQ ID NO: 1769772 - RNA, 18 nt, Salmonella enterica enterica serovar Typhi Ty2
accucggguaaagguuug

SEQ ID NO: 1769773 - RNA, 16 nt, Salmonella enterica enterica serovar Typhi Ty2
accucguccagauggg

SEQ ID NO: 1769774 - RNA, 20 nt, Salmonella enterica enterica serovar Typhi Ty2
accucgcaauauucaugcca

SEQ ID NO: 1769775 - RNA, 17 nt, Salmonella enterica enterica serovar Typhi Ty2
acggcgcuuugggaauu

SEQ ID NO: 1769776 - RNA, 14 nt, Salmonella enterica enterica serovar Typhi Ty2
acggcggaccccuc

SEQ ID NO: 1769777 - RNA, 14 nt, Salmonella enterica enterica serovar Typhi Ty2
acggcuacccauga

SEQ ID NO: 1769778 - RNA, 21 nt, Salmonella enterica enterica serovar Typhi Ty2
acggcgugccaguuuuaaaua

SEQ ID NO: 1769779 - RNA, 14 nt, Salmonella enterica enterica serovar Typhi Ty2
acggcgcgaaaggg

SEQ ID NO: 1769780 - RNA, 21 nt, Salmonella enterica enterica serovar Typhi Ty2
acggcgcgaaucccgcguucg

SEQ ID NO: 1769781 - RNA, 11 nt, Salmonella enterica enterica serovar Typhi Ty2
acggcgcgcca

SEQ ID NO: 1769782 - RNA, 19 nt, Salmonella enterica enterica serovar Typhi Ty2
acggcgcagguaaaaucca

SEQ ID NO: 1769783 - RNA, 18 nt, Salmonella enterica enterica serovar Typhi Ty2
acggcgcaggcaaaucaa

SEQ ID NO: 1769784 - RNA, 17 nt, Salmonella enterica enterica serovar Typhi Ty2
acggcaauuuuuacaaa

SEQ ID NO: 1769785 - RNA, 22 nt, Salmonella enterica enterica serovar Typhi Ty2
acggcaauuuuuacaaauuuaa

SEQ ID NO: 1769786 - RNA, 23 nt, Salmonella enterica enterica serovar Typhi Ty2
acggcaacugaaaacaggccugc

SEQ ID NO: 1769787 - RNA, 14 nt, Salmonella enterica enterica serovar Typhi Ty2
acggcaaaguucca

SEQ ID NO: 1769788 - RNA, 15 nt, Salmonella enterica enterica serovar Typhi Ty2
acggcuggcaaugcg

SEQ ID NO: 1769789 - RNA, 18 nt, Salmonella enterica enterica serovar Typhi Ty2
acggcuggcaaugcgcug

SEQ ID NO: 1769790 - RNA, 15 nt, Salmonella enterica enterica serovar Typhi Ty2
acggcuccagcgcca

SEQ ID NO: 1769791 - RNA, 16 nt, Salmonella enterica enterica serovar Typhi Ty2
acggcuaauaugccag

SEQ ID NO: 1769792 - RNA, 19 nt, Salmonella enterica enterica serovar Typhi Ty2
acggcuaauaugccaggcu

SEQ ID NO: 1769793 - RNA, 13 nt, Salmonella enterica enterica serovar Typhi Ty2
acggcugaagcug

SEQ ID NO: 1769794 - RNA, 16 nt, Salmonella enterica enterica serovar Typhi Ty2
acggcuuuccagcagc

SEQ ID NO: 1769795 - RNA, 22 nt, Salmonella enterica enterica serovar Typhi Ty2
acggcuuuaauaccccuguuca

SEQ ID NO: 1769796 - RNA, 16 nt, Salmonella enterica enterica serovar Typhi Ty2
acgggaaggaaauuca

SEQ ID NO: 1769797 - RNA, 14 nt, Salmonella enterica enterica serovar Typhi Ty2
acggcuuuucuuca

SEQ ID NO: 1769798 - RNA, 14 nt, Salmonella enterica enterica serovar Typhi Ty2
acgggaaaucuccc

SEQ ID NO: 1769799 - RNA, 22 nt, Salmonella enterica enterica serovar Typhi Ty2
acgggcgauggcucgcccggua

SEQ ID NO: 1769800 - RNA, 20 nt, Salmonella enterica enterica serovar Typhi Ty2
acgggcgcugucgccgcgca

SEQ ID NO: 1769801 - RNA, 17 nt, Salmonella enterica enterica serovar Typhi Ty2
acgggaaguaaggcaug

SEQ ID NO: 1769802 - RNA, 22 nt, Salmonella enterica enterica serovar Typhi Ty2
acgggcggcgacagagaaugcg

SEQ ID NO: 1769803 - RNA, 14 nt, Salmonella enterica enterica serovar Typhi Ty2
acgguaaguugaaa

SEQ ID NO: 1769804 - RNA, 21 nt, Salmonella enterica enterica serovar Typhi Ty2
acgguaaguugaaaggaaagg

SEQ ID NO: 1769805 - RNA, 20 nt, Salmonella enterica enterica serovar Typhi Ty2
acgguaauugccgggaaaac

SEQ ID NO: 1769806 - RNA, 14 nt, Salmonella enterica enterica serovar Typhi Ty2
acgguaccugaagc

SEQ ID NO: 1769807 - RNA, 16 nt, Salmonella enterica enterica serovar Typhi Ty2
acggugcugaauauua

SEQ ID NO: 1769808 - RNA, 15 nt, Salmonella enterica enterica serovar Typhi Ty2
acguaacuuauccac

SEQ ID NO: 1769809 - RNA, 20 nt, Salmonella enterica enterica serovar Typhi Ty2
acguaacugcgguaaauaau

SEQ ID NO: 1769810 - RNA, 19 nt, Salmonella enterica enterica serovar Typhi Ty2
acguaacugacaauuucca

SEQ ID NO: 1769811 - RNA, 18 nt, Salmonella enterica enterica serovar Typhi Ty2
acguaaucccgccagccu

SEQ ID NO: 1769812 - RNA, 23 nt, Salmonella enterica enterica serovar Typhi Ty2
acguaccguuggaauaaaucaca

SEQ ID NO: 1769813 - RNA, 20 nt, Salmonella enterica enterica serovar Typhi Ty2
acguaacggaaaagcauugc

SEQ ID NO: 1769814 - RNA, 20 nt, Salmonella enterica enterica serovar Typhi Ty2
acguaacgguguuucaucuu

SEQ ID NO: 1769815 - RNA, 16 nt, Salmonella enterica enterica serovar Typhi Ty2
acguaacaugaccugc

SEQ ID NO: 1769816 - RNA, 21 nt, Salmonella enterica enterica serovar Typhi Ty2
acguaaauuacuuaugauaua

SEQ ID NO: 1769817 - RNA, 17 nt, Salmonella enterica enterica serovar Typhi Ty2
acguaaauacccaggcc

SEQ ID NO: 1769818 - RNA, 23 nt, Salmonella enterica enterica serovar Typhi Ty2
acgguuuuauccccuucaggaau

SEQ ID NO: 1769819 - RNA, 18 nt, Salmonella enterica enterica serovar Typhi Ty2
acgguuucgaccagcagc

SEQ ID NO: 1769820 - RNA, 23 nt, Salmonella enterica enterica serovar Typhi Ty2
acgcuuuuaaauucgcuccacug

SEQ ID NO: 1769821 - RNA, 23 nt, Salmonella enterica enterica serovar Typhi Ty2
acgcuuugcgauagcccggcaug

SEQ ID NO: 1769822 - RNA, 23 nt, Salmonella enterica enterica serovar Typhi Ty2
acgcuuuggcaggccucuaucuu

SEQ ID NO: 1769823 - RNA, 22 nt, Salmonella enterica enterica serovar Typhi Ty2
acgcuuuaggguaucauuucca

SEQ ID NO: 1769824 - RNA, 19 nt, Salmonella enterica enterica serovar Typhi Ty2
acgcuuguuguaaagaaau

SEQ ID NO: 1769825 - RNA, 12 nt, Salmonella enterica enterica serovar Typhi Ty2
acggaaggggcc

SEQ ID NO: 1769826 - RNA, 20 nt, Salmonella enterica enterica serovar Typhi Ty2
acggaagguaauagcccucg

SEQ ID NO: 1769827 - RNA, 19 nt, Salmonella enterica enterica serovar Typhi Ty2
acggaauaucccgcaagaa

SEQ ID NO: 1769828 - RNA, 14 nt, Salmonella enterica enterica serovar Typhi Ty2
acggaaccaaaaua

SEQ ID NO: 1769829 - RNA, 22 nt, Salmonella enterica enterica serovar Typhi Ty2
acggaaccauuccgacagugaa

SEQ ID NO: 1769830 - RNA, 21 nt, Salmonella enterica enterica serovar Typhi Ty2
acgcuuuuuuauuuugugacc

SEQ ID NO: 1769831 - RNA, 20 nt, Salmonella enterica enterica serovar Typhi Ty2
acgcuuuuuugcuggcuggc

SEQ ID NO: 1769832 - RNA, 14 nt, Salmonella enterica enterica serovar Typhi Ty2
acggaaaaaauacu

SEQ ID NO: 1769833 - RNA, 15 nt, Salmonella enterica enterica serovar Typhi Ty2
acggaacaaaacgga

SEQ ID NO: 1769834 - RNA, 16 nt, Salmonella enterica enterica serovar Typhi Ty2
acggacaucagaggua

SEQ ID NO: 1769835 - RNA, 21 nt, Salmonella enterica enterica serovar Typhi Ty2
acggaggugccagagauaauu

SEQ ID NO: 1769836 - RNA, 19 nt, Salmonella enterica enterica serovar Typhi Ty2
acggagcauaauuuuccug

SEQ ID NO: 1769837 - RNA, 22 nt, Salmonella enterica enterica serovar Typhi Ty2
acggcaaaauaaauauccuccg

SEQ ID NO: 1769838 - RNA, 13 nt, Salmonella enterica enterica serovar Typhi Ty2
acggcaaacgcug

SEQ ID NO: 1769839 - RNA, 19 nt, Salmonella enterica enterica serovar Typhi Ty2
acggcaaaaagcauaugcg

SEQ ID NO: 1769840 - RNA, 12 nt, Salmonella enterica enterica serovar Typhi Ty2
acgcuguugccg

SEQ ID NO: 1769841 - RNA, 21 nt, Salmonella enterica enterica serovar Typhi Ty2
acgcuuaaucaguugcaggaa

SEQ ID NO: 1769842 - RNA, 18 nt, Salmonella enterica enterica serovar Typhi Ty2
acgcuucguugccccgug

SEQ ID NO: 1769843 - RNA, 15 nt, Salmonella enterica enterica serovar Typhi Ty2
acgcuucuucgauuu

SEQ ID NO: 1769844 - RNA, 22 nt, Salmonella enterica enterica serovar Typhi Ty2
acgcuucgccuguugcugacga

SEQ ID NO: 1769845 - RNA, 14 nt, Salmonella enterica enterica serovar Typhi Ty2
acgcuuauccggcu

SEQ ID NO: 1769846 - RNA, 14 nt, Salmonella enterica enterica serovar Typhi Ty2
acgcuuauccugcc

SEQ ID NO: 1769847 - RNA, 22 nt, Salmonella enterica enterica serovar Typhi Ty2
acgcuuaucgccaaaccagacc

SEQ ID NO: 1769848 - RNA, 22 nt, Salmonella enterica enterica serovar Typhi Ty2
acgcuucauugguuaauucaaa

SEQ ID NO: 1769849 - RNA, 16 nt, Salmonella enterica enterica serovar Typhi Ty2
acgcugagucagaaac

SEQ ID NO: 1769850 - RNA, 20 nt, Salmonella enterica enterica serovar Typhi Ty2
acgcugauacguaacaugac

SEQ ID NO: 1769851 - RNA, 23 nt, Salmonella enterica enterica serovar Typhi Ty2
acgcugaauaucgucaguaugca

SEQ ID NO: 1769852 - RNA, 22 nt, Salmonella enterica enterica serovar Typhi Ty2
acgcugaugcugugcagacugc

SEQ ID NO: 1769853 - RNA, 17 nt, Salmonella enterica enterica serovar Typhi Ty2
acgcugcaaaguuauua

SEQ ID NO: 1769854 - RNA, 13 nt, Salmonella enterica enterica serovar Typhi Ty2
acgcucuucgcca

SEQ ID NO: 1769855 - RNA, 13 nt, Salmonella enterica enterica serovar Typhi Ty2
acgcugaagcuug

SEQ ID NO: 1769856 - RNA, 12 nt, Salmonella enterica enterica serovar Typhi Ty2
acgcucacuuuu

SEQ ID NO: 1769857 - RNA, 13 nt, Salmonella enterica enterica serovar Typhi Ty2
acgcuauuuuuca

SEQ ID NO: 1769858 - RNA, 15 nt, Salmonella enterica enterica serovar Typhi Ty2
acgcuauuuaaaaac

SEQ ID NO: 1769859 - RNA, 17 nt, Salmonella enterica enterica serovar Typhi Ty2
acgcucaaccgguuugu

SEQ ID NO: 1769860 - RNA, 21 nt, Salmonella enterica enterica serovar Typhi Ty2
acgcuauguuugcugagaauu

SEQ ID NO: 1769861 - RNA, 19 nt, Salmonella enterica enterica serovar Typhi Ty2
acgccauagcaucgacccu

SEQ ID NO: 1769862 - RNA, 16 nt, Salmonella enterica enterica serovar Typhi Ty2
acgccaguucccacag

SEQ ID NO: 1769863 - RNA, 21 nt, Salmonella enterica enterica serovar Typhi Ty2
acgccaguucccacagcuuca

SEQ ID NO: 1769864 - RNA, 19 nt, Salmonella enterica enterica serovar Typhi Ty2
acgccauaacacaaacugg

SEQ ID NO: 1769865 - RNA, 14 nt, Salmonella enterica enterica serovar Typhi Ty2
acgccaucgacaaa

SEQ ID NO: 1769866 - RNA, 16 nt, Salmonella enterica enterica serovar Typhi Ty2
acguuuucagcagugc

SEQ ID NO: 1769867 - RNA, 15 nt, Salmonella enterica enterica serovar Typhi Ty2
acuaaaguuuauuua

SEQ ID NO: 1769868 - RNA, 19 nt, Salmonella enterica enterica serovar Typhi Ty2
acuaaauaaauauccuccg

SEQ ID NO: 1769869 - RNA, 19 nt, Salmonella enterica enterica serovar Typhi Ty2
acguuggggauaaccagaa

SEQ ID NO: 1769870 - RNA, 16 nt, Salmonella enterica enterica serovar Typhi Ty2
acguugcuggcgcgcg

SEQ ID NO: 1769871 - RNA, 22 nt, Salmonella enterica enterica serovar Typhi Ty2
acguuuccgcuagggcaucaga

SEQ ID NO: 1769872 - RNA, 19 nt, Salmonella enterica enterica serovar Typhi Ty2
acguuugccggugccauuc

SEQ ID NO: 1769873 - RNA, 22 nt, Salmonella enterica enterica serovar Typhi Ty2
acguuucaguuuuuucaguagc

SEQ ID NO: 1769874 - RNA, 19 nt, Salmonella enterica enterica serovar Typhi Ty2
acgugcggcggccucuuug

SEQ ID NO: 1769875 - RNA, 18 nt, Salmonella enterica enterica serovar Typhi Ty2
acguuaucucgccaggaa

SEQ ID NO: 1769876 - RNA, 21 nt, Salmonella enterica enterica serovar Typhi Ty2
acguuaucugccucaacaagu

SEQ ID NO: 1769877 - RNA, 21 nt, Salmonella enterica enterica serovar Typhi Ty2
acguuaucgccgacaaacagu

SEQ ID NO: 1769878 - RNA, 15 nt, Salmonella enterica enterica serovar Typhi Ty2
acguucaaaaucaaa

SEQ ID NO: 1769879 - RNA, 23 nt, Salmonella enterica enterica serovar Typhi Ty2
acguucagcauauccagcgccug

SEQ ID NO: 1769880 - RNA, 16 nt, Salmonella enterica enterica serovar Typhi Ty2
acguucuuccagaacg

SEQ ID NO: 1769881 - RNA, 14 nt, Salmonella enterica enterica serovar Typhi Ty2
acguucuucuccca

SEQ ID NO: 1769882 - RNA, 12 nt, Salmonella enterica enterica serovar Typhi Ty2
acguagcaaaua

SEQ ID NO: 1769883 - RNA, 14 nt, Salmonella enterica enterica serovar Typhi Ty2
acguagauucugau

SEQ ID NO: 1769884 - RNA, 23 nt, Salmonella enterica enterica serovar Typhi Ty2
acguagcccauugucaucaguau

SEQ ID NO: 1769885 - RNA, 15 nt, Salmonella enterica enterica serovar Typhi Ty2
acguaggccugauaa

SEQ ID NO: 1769886 - RNA, 19 nt, Salmonella enterica enterica serovar Typhi Ty2
acguagcuuauaaaucagc

SEQ ID NO: 1769887 - RNA, 21 nt, Salmonella enterica enterica serovar Typhi Ty2
acguagcuuauaaaucagcuu

SEQ ID NO: 1769888 - RNA, 20 nt, Salmonella enterica enterica serovar Typhi Ty2
acuauaauugcuuuuuucca

SEQ ID NO: 1769889 - RNA, 15 nt, Salmonella enterica enterica serovar Typhi Ty2
acuagacagccucuc

SEQ ID NO: 1769890 - RNA, 14 nt, Salmonella enterica enterica serovar Typhi Ty2
acuaccacuuucuu

SEQ ID NO: 1769891 - RNA, 13 nt, Salmonella enterica enterica serovar Typhi Ty2
acuaccaacugau

SEQ ID NO: 1769892 - RNA, 18 nt, Salmonella enterica enterica serovar Typhi Ty2
acuacauaucuauauuuu

SEQ ID NO: 1769893 - RNA, 16 nt, Salmonella enterica enterica serovar Typhi Ty2
acuaauccccauuuuu

SEQ ID NO: 1769894 - RNA, 12 nt, Salmonella enterica enterica serovar Typhi Ty2
acuacagaaagc

SEQ ID NO: 1769895 - RNA, 18 nt, Salmonella enterica enterica serovar Typhi Ty2
acuaauuauuuuucaaau

SEQ ID NO: 1769896 - RNA, 21 nt, Salmonella enterica enterica serovar Typhi Ty2
acuaauuauuuuucaaaugau

SEQ ID NO: 1769897 - RNA, 21 nt, Salmonella enterica enterica serovar Typhi Ty2
acuaauuguuuguagaaagug

SEQ ID NO: 1769898 - RNA, 17 nt, Salmonella enterica enterica serovar Typhi Ty2
acuaauuauuuuucaaa

SEQ ID NO: 1769899 - RNA, 17 nt, Salmonella enterica enterica serovar Typhi Ty2
acuaagaccagcaucag

SEQ ID NO: 1769900 - RNA, 12 nt, Salmonella enterica enterica serovar Typhi Ty2
acuaacuggcaa

SEQ ID NO: 1769901 - RNA, 11 nt, Salmonella enterica enterica serovar Typhi Ty2
acuaacugccg

SEQ ID NO: 1769902 - RNA, 22 nt, Salmonella enterica enterica serovar Typhi Ty2
acuaacugaccauauaugaaau

SEQ ID NO: 1769903 - RNA, 22 nt, Salmonella enterica enterica serovar Typhi Ty2
acuuacgcccuauccggccgac

SEQ ID NO: 1769904 - RNA, 14 nt, Salmonella enterica enterica serovar Typhi Ty2
acuuacgcacaaac

SEQ ID NO: 1769905 - RNA, 20 nt, Salmonella enterica enterica serovar Typhi Ty2
acuuaaauuaaugauuaaaa

SEQ ID NO: 1769906 - RNA, 20 nt, Salmonella enterica enterica serovar Typhi Ty2
acuuaaaguacuucacaauc

SEQ ID NO: 1769907 - RNA, 20 nt, Salmonella enterica enterica serovar Typhi Ty2
acuuaaacguucguccgcac

SEQ ID NO: 1769908 - RNA, 22 nt, Salmonella enterica enterica serovar Typhi Ty2
acuuaaacgccggauuccagaa

SEQ ID NO: 1769909 - RNA, 23 nt, Salmonella enterica enterica serovar Typhi Ty2
acugucggcgauauagcgcugaa

SEQ ID NO: 1769910 - RNA, 22 nt, Salmonella enterica enterica serovar Typhi Ty2
acuggcaaccagauaauucagg

SEQ ID NO: 1769911 - RNA, 16 nt, Salmonella enterica enterica serovar Typhi Ty2
acuggauggacuguuu

SEQ ID NO: 1769912 - RNA, 17 nt, Salmonella enterica enterica serovar Typhi Ty2
acuggcagcagugacau

SEQ ID NO: 1769913 - RNA, 19 nt, Salmonella enterica enterica serovar Typhi Ty2
acugucuuguggaacacca

SEQ ID NO: 1769914 - RNA, 15 nt, Salmonella enterica enterica serovar Typhi Ty2
acuguucggggauua

SEQ ID NO: 1769915 - RNA, 17 nt, Salmonella enterica enterica serovar Typhi Ty2
acuguucggcggggauc

SEQ ID NO: 1769916 - RNA, 20 nt, Salmonella enterica enterica serovar Typhi Ty2
acuguugaaagccccggcuc

SEQ ID NO: 1769917 - RNA, 18 nt, Salmonella enterica enterica serovar Typhi Ty2
acuuaucucuuuuucucg

SEQ ID NO: 1769918 - RNA, 11 nt, Salmonella enterica enterica serovar Typhi Ty2
acuuaucucuu

SEQ ID NO: 1769919 - RNA, 13 nt, Salmonella enterica enterica serovar Typhi Ty2
acuuacugcuguc

SEQ ID NO: 1769920 - RNA, 22 nt, Salmonella enterica enterica serovar Typhi Ty2
acuuacuuucuugccacuggcc

SEQ ID NO: 1769921 - RNA, 15 nt, Salmonella enterica enterica serovar Typhi Ty2
acuuagagccuaucc

SEQ ID NO: 1769922 - RNA, 16 nt, Salmonella enterica enterica serovar Typhi Ty2
acuuauugcaagaaau

SEQ ID NO: 1769923 - RNA, 22 nt, Salmonella enterica enterica serovar Typhi Ty2
acuuauugaaaccuaauuaaau

SEQ ID NO: 1769924 - RNA, 17 nt, Salmonella enterica enterica serovar Typhi Ty2
acuuauuaccacaguca

SEQ ID NO: 1769925 - RNA, 12 nt, Salmonella enterica enterica serovar Typhi Ty2
acuucacgcugg

SEQ ID NO: 1769926 - RNA, 12 nt, Salmonella enterica enterica serovar Typhi Ty2
acuucacuuucc

SEQ ID NO: 1769927 - RNA, 15 nt, Salmonella enterica enterica serovar Typhi Ty2
acuucaggcugccaa

SEQ ID NO: 1769928 - RNA, 15 nt, Salmonella enterica enterica serovar Typhi Ty2
acuucacacgaacuu

SEQ ID NO: 1769929 - RNA, 21 nt, Salmonella enterica enterica serovar Typhi Ty2
acuucaccauaaaucauuacu

SEQ ID NO: 1769930 - RNA, 18 nt, Salmonella enterica enterica serovar Typhi Ty2
acuucaauucagaaaguu

SEQ ID NO: 1769931 - RNA, 17 nt, Salmonella enterica enterica serovar Typhi Ty2
acuucaauuuuccagau

SEQ ID NO: 1769932 - RNA, 10 nt, Salmonella enterica enterica serovar Typhi Ty2
acuucuucca

SEQ ID NO: 1769933 - RNA, 11 nt, Salmonella enterica enterica serovar Typhi Ty2
acuucuucagu

SEQ ID NO: 1769934 - RNA, 20 nt, Salmonella enterica enterica serovar Typhi Ty2
acuugagaaauuauuuuaaa

SEQ ID NO: 1769935 - RNA, 17 nt, Salmonella enterica enterica serovar Typhi Ty2
acuugaaguaugaaggg

SEQ ID NO: 1769936 - RNA, 18 nt, Salmonella enterica enterica serovar Typhi Ty2
acuucugacccaaucaga

SEQ ID NO: 1769937 - RNA, 12 nt, Salmonella enterica enterica serovar Typhi Ty2
acuucuaauuuu

SEQ ID NO: 1769938 - RNA, 15 nt, Salmonella enterica enterica serovar Typhi Ty2
acuucuaauuuuucc

SEQ ID NO: 1769939 - RNA, 16 nt, Salmonella enterica enterica serovar Typhi Ty2
acuucauuuuccacaa

SEQ ID NO: 1769940 - RNA, 18 nt, Salmonella enterica enterica serovar Typhi Ty2
acuucaugcguuagccua

SEQ ID NO: 1769941 - RNA, 15 nt, Salmonella enterica enterica serovar Typhi Ty2
acuucauccggauaa

SEQ ID NO: 1769942 - RNA, 10 nt, Salmonella enterica enterica serovar Typhi Ty2
acuuccagcg

SEQ ID NO: 1769943 - RNA, 20 nt, Salmonella enterica enterica serovar Typhi Ty2
acuuccauucccgccgcaau

SEQ ID NO: 1769944 - RNA, 17 nt, Salmonella enterica enterica serovar Typhi Ty2
acuuccccuguaacugc

SEQ ID NO: 1769945 - RNA, 15 nt, Salmonella enterica enterica serovar Typhi Ty2
acuuccgcaucaaua

SEQ ID NO: 1769946 - RNA, 15 nt, Salmonella enterica enterica serovar Typhi Ty2
acuuccugcgucagg

SEQ ID NO: 1769947 - RNA, 17 nt, Salmonella enterica enterica serovar Typhi Ty2
acuuccguaaaaagaac

SEQ ID NO: 1769948 - RNA, 20 nt, Salmonella enterica enterica serovar Typhi Ty2
acuuccgguugaccgcauaa

SEQ ID NO: 1769949 - RNA, 14 nt, Salmonella enterica enterica serovar Typhi Ty2
acuuccuguacaaa

SEQ ID NO: 1769950 - RNA, 15 nt, Salmonella enterica enterica serovar Typhi Ty2
acuuccuguaucacu

SEQ ID NO: 1769951 - RNA, 17 nt, Salmonella enterica enterica serovar Typhi Ty2
acuuccuuugccuuucu

SEQ ID NO: 1769952 - RNA, 19 nt, Salmonella enterica enterica serovar Typhi Ty2
acuucggcaaauucuuuuc

SEQ ID NO: 1769953 - RNA, 21 nt, Salmonella enterica enterica serovar Typhi Ty2
acuucgcuuuguuuuccagau

SEQ ID NO: 1769954 - RNA, 18 nt, Salmonella enterica enterica serovar Typhi Ty2
acuucggcaaauucuuuu

SEQ ID NO: 1769955 - RNA, 19 nt, Salmonella enterica enterica serovar Typhi Ty2
acuucgauggccucaucau

SEQ ID NO: 1769956 - RNA, 16 nt, Salmonella enterica enterica serovar Typhi Ty2
acucuucgccauuaca

SEQ ID NO: 1769957 - RNA, 11 nt, Salmonella enterica enterica serovar Typhi Ty2
acucuucugac

SEQ ID NO: 1769958 - RNA, 17 nt, Salmonella enterica enterica serovar Typhi Ty2
acucuuccgcaaucaca

SEQ ID NO: 1769959 - RNA, 16 nt, Salmonella enterica enterica serovar Typhi Ty2
acucuuccgcaaucac

SEQ ID NO: 1769960 - RNA, 23 nt, Salmonella enterica enterica serovar Typhi Ty2
acucuuccccgaucagaaaaccu

SEQ ID NO: 1769961 - RNA, 22 nt, Salmonella enterica enterica serovar Typhi Ty2
acucuuccgggcgcgaucuguu

SEQ ID NO: 1769962 - RNA, 19 nt, Salmonella enterica enterica serovar Typhi Ty2
acucuuccgggcugacaua

SEQ ID NO: 1769963 - RNA, 15 nt, Salmonella enterica enterica serovar Typhi Ty2
acucuuccugcugcg

SEQ ID NO: 1769964 - RNA, 13 nt, Salmonella enterica enterica serovar Typhi Ty2
acucuuccaccac

SEQ ID NO: 1769965 - RNA, 12 nt, Salmonella enterica enterica serovar Typhi Ty2
acucuuccagca

SEQ ID NO: 1769966 - RNA, 20 nt, Salmonella enterica enterica serovar Typhi Ty2
acucuuccagcugcucuccu

SEQ ID NO: 1769967 - RNA, 22 nt, Salmonella enterica enterica serovar Typhi Ty2
acucuuccagcugcucuccuug

SEQ ID NO: 1769968 - RNA, 21 nt, Salmonella enterica enterica serovar Typhi Ty2
acucuuccaccacggcaaaaa

SEQ ID NO: 1769969 - RNA, 19 nt, Salmonella enterica enterica serovar Typhi Ty2
acucuuaauuauaaagcau

SEQ ID NO: 1769970 - RNA, 15 nt, Salmonella enterica enterica serovar Typhi Ty2
acucuucacccuucu

SEQ ID NO: 1769971 - RNA, 23 nt, Salmonella enterica enterica serovar Typhi Ty2
acucugugcguucgcgaauuuca

SEQ ID NO: 1769972 - RNA, 13 nt, Salmonella enterica enterica serovar Typhi Ty2
acucuguuauaua

SEQ ID NO: 1769973 - RNA, 20 nt, Salmonella enterica enterica serovar Typhi Ty2
acucugacgccgguauucau

SEQ ID NO: 1769974 - RNA, 18 nt, Salmonella enterica enterica serovar Typhi Ty2
acucugcgacgccaggcg

SEQ ID NO: 1769975 - RNA, 13 nt, Salmonella enterica enterica serovar Typhi Ty2
acucugcaaacgg

SEQ ID NO: 1769976 - RNA, 12 nt, Salmonella enterica enterica serovar Typhi Ty2
acucugaaaaaa

SEQ ID NO: 1769977 - RNA, 17 nt, Salmonella enterica enterica serovar Typhi Ty2
acucucuugccagcgca

SEQ ID NO: 1769978 - RNA, 16 nt, Salmonella enterica enterica serovar Typhi Ty2
acucucgcagcgaaua

SEQ ID NO: 1769979 - RNA, 16 nt, Salmonella enterica enterica serovar Typhi Ty2
acucucuccaguuugc

SEQ ID NO: 1769980 - RNA, 16 nt, Salmonella enterica enterica serovar Typhi Ty2
acucucauguucaagc

SEQ ID NO: 1769981 - RNA, 15 nt, Salmonella enterica enterica serovar Typhi Ty2
acucucccggcgccc

SEQ ID NO: 1769982 - RNA, 14 nt, Salmonella enterica enterica serovar Typhi Ty2
acucuccaccaaau

SEQ ID NO: 1769983 - RNA, 15 nt, Salmonella enterica enterica serovar Typhi Ty2
acucgcuguggccag

SEQ ID NO: 1769984 - RNA, 19 nt, Salmonella enterica enterica serovar Typhi Ty2
acucgcuguauuucccucu

SEQ ID NO: 1769985 - RNA, 19 nt, Salmonella enterica enterica serovar Typhi Ty2
acucgcuguggccaggcac

SEQ ID NO: 1769986 - RNA, 22 nt, Salmonella enterica enterica serovar Typhi Ty2
acucgcuccuugauugcaagaa

SEQ ID NO: 1769987 - RNA, 16 nt, Salmonella enterica enterica serovar Typhi Ty2
acucggcgaucaccac

SEQ ID NO: 1769988 - RNA, 14 nt, Salmonella enterica enterica serovar Typhi Ty2
acucgaauuguuaa

SEQ ID NO: 1769989 - RNA, 22 nt, Salmonella enterica enterica serovar Typhi Ty2
acucgaccuucaucucuuugcc

SEQ ID NO: 1769990 - RNA, 14 nt, Salmonella enterica enterica serovar Typhi Ty2
acuccggugcccau

SEQ ID NO: 1769991 - RNA, 17 nt, Salmonella enterica enterica serovar Typhi Ty2
acuccccuuuuuuacua

SEQ ID NO: 1769992 - RNA, 21 nt, Salmonella enterica enterica serovar Typhi Ty2
acuauuuuuuaugugacaauc

SEQ ID NO: 1769993 - RNA, 18 nt, Salmonella enterica enterica serovar Typhi Ty2
acuauuuuccccuucugu

SEQ ID NO: 1769994 - RNA, 22 nt, Salmonella enterica enterica serovar Typhi Ty2
acugcugccgcagcacccgcuc

SEQ ID NO: 1769995 - RNA, 18 nt, Salmonella enterica enterica serovar Typhi Ty2
acugcugcgcuuuaucaa

SEQ ID NO: 1769996 - RNA, 10 nt, Salmonella enterica enterica serovar Typhi Ty2
acugcugcuc

SEQ ID NO: 1769997 - RNA, 16 nt, Salmonella enterica enterica serovar Typhi Ty2
acugcguaaucuuuuc

SEQ ID NO: 1769998 - RNA, 21 nt, Salmonella enterica enterica serovar Typhi Ty2
acugcucguaaagcaucagac

SEQ ID NO: 1769999 - RNA, 23 nt, Salmonella enterica enterica serovar Typhi Ty2
acugcuuuuccggcagcgcauaa

SEQ ID NO: 1770000 - RNA, 15 nt, Salmonella enterica enterica serovar Typhi Ty2
acuggaaacagccaa

SEQ ID NO: 1770001 - RNA, 15 nt, Salmonella enterica enterica serovar Typhi Ty2
acugcgccaucuucc

SEQ ID NO: 1770002 - RNA, 15 nt, Salmonella enterica enterica serovar Typhi Ty2
acugcgccagccugc

SEQ ID NO: 1770003 - RNA, 12 nt, Salmonella enterica enterica serovar Typhi Ty2
acugcgcccgca

SEQ ID NO: 1770004 - RNA, 22 nt, Salmonella enterica enterica serovar Typhi Ty2
acugcgaauuuccugccagacc

SEQ ID NO: 1770005 - RNA, 17 nt, Salmonella enterica enterica serovar Typhi Ty2
acugcggccugcaaaga

SEQ ID NO: 1770006 - RNA, 20 nt, Salmonella enterica enterica serovar Typhi Ty2
acugcgcggcaaugagcggc

SEQ ID NO: 1770007 - RNA, 16 nt, Salmonella enterica enterica serovar Typhi Ty2
acugcgcgcccgccuc

SEQ ID NO: 1770008 - RNA, 15 nt, Salmonella enterica enterica serovar Typhi Ty2
acugcgcgcccgccu

SEQ ID NO: 1770009 - RNA, 23 nt, Salmonella enterica enterica serovar Typhi Ty2
acugcgaacgcaucaaagccacc

SEQ ID NO: 1770010 - RNA, 13 nt, Salmonella enterica enterica serovar Typhi Ty2
acugccaaaccac

SEQ ID NO: 1770011 - RNA, 19 nt, Salmonella enterica enterica serovar Typhi Ty2
acugauacuggauaaccgc

SEQ ID NO: 1770012 - RNA, 17 nt, Salmonella enterica enterica serovar Typhi Ty2
acugauagcgaggcagc

SEQ ID NO: 1770013 - RNA, 23 nt, Salmonella enterica enterica serovar Typhi Ty2
acugauaguccaucaccucuucg

SEQ ID NO: 1770014 - RNA, 17 nt, Salmonella enterica enterica serovar Typhi Ty2
acugaucgccuaagauc

SEQ ID NO: 1770015 - RNA, 22 nt, Salmonella enterica enterica serovar Typhi Ty2
acugaucgccuaagaucgggug

SEQ ID NO: 1770016 - RNA, 20 nt, Salmonella enterica enterica serovar Typhi Ty2
acugcaaaucugccgucauc

SEQ ID NO: 1770017 - RNA, 14 nt, Salmonella enterica enterica serovar Typhi Ty2
acugcaaaucugcc

SEQ ID NO: 1770018 - RNA, 13 nt, Salmonella enterica enterica serovar Typhi Ty2
acugcaacgccag

SEQ ID NO: 1770019 - RNA, 13 nt, Salmonella enterica enterica serovar Typhi Ty2
acugcaacugcgc

SEQ ID NO: 1770020 - RNA, 19 nt, Salmonella enterica enterica serovar Typhi Ty2
acugcaaauaccacaucag

SEQ ID NO: 1770021 - RNA, 16 nt, Salmonella enterica enterica serovar Typhi Ty2
acugcaaauaccacau

SEQ ID NO: 1770022 - RNA, 17 nt, Salmonella enterica enterica serovar Typhi Ty2
acucuuuuuucagaaua

SEQ ID NO: 1770023 - RNA, 13 nt, Salmonella enterica enterica serovar Typhi Ty2
acugaaaaucaaa

SEQ ID NO: 1770024 - RNA, 15 nt, Salmonella enterica enterica serovar Typhi Ty2
acucuuugugggacu

SEQ ID NO: 1770025 - RNA, 19 nt, Salmonella enterica enterica serovar Typhi Ty2
acucuuugccgauggcuau

SEQ ID NO: 1770026 - RNA, 22 nt, Salmonella enterica enterica serovar Typhi Ty2
acugaaauggccccaaaucaga

SEQ ID NO: 1770027 - RNA, 16 nt, Salmonella enterica enterica serovar Typhi Ty2
acugagcgccaauuga

SEQ ID NO: 1770028 - RNA, 19 nt, Salmonella enterica enterica serovar Typhi Ty2
aaucgcgguaaaaagcuga

SEQ ID NO: 1770029 - RNA, 18 nt, Salmonella enterica enterica serovar Typhi Ty2
aaucgcuaaacauauacc

SEQ ID NO: 1770030 - RNA, 17 nt, Salmonella enterica enterica serovar Typhi Ty2
aaaaauuucgcuaagau

SEQ ID NO: 1770031 - RNA, 21 nt, Salmonella enterica enterica serovar Typhi Ty2
aaucgcgagaaaauagaggaa

SEQ ID NO: 1770032 - RNA, 18 nt, Salmonella enterica enterica serovar Typhi Ty2
aaucgcgagccuucaaca

SEQ ID NO: 1770033 - RNA, 21 nt, Salmonella enterica enterica serovar Typhi Ty2
aaucgccgucagugagcccuc

SEQ ID NO: 1770034 - RNA, 20 nt, Salmonella enterica enterica serovar Typhi Ty2
aaucgccugcuguacuuuug

SEQ ID NO: 1770035 - RNA, 14 nt, Salmonella enterica enterica serovar Typhi Ty2
aaucgccucaacca

SEQ ID NO: 1770036 - RNA, 21 nt, Salmonella enterica enterica serovar Typhi Ty2
aaucgccaucagcgcgaaaau

SEQ ID NO: 1770037 - RNA, 15 nt, Salmonella enterica enterica serovar Typhi Ty2
aaucgccgccgccag

SEQ ID NO: 1770038 - RNA, 19 nt, Salmonella enterica enterica serovar Typhi Ty2
aauccuuuauuuaauugcu

SEQ ID NO: 1770039 - RNA, 19 nt, Salmonella enterica enterica serovar Typhi Ty2
aauccucuaccggaaaaca

SEQ ID NO: 1770040 - RNA, 18 nt, Salmonella enterica enterica serovar Typhi Ty2
aauccauagccaacacau

SEQ ID NO: 1770041 - RNA, 20 nt, Salmonella enterica enterica serovar Typhi Ty2
aauccccggcgaaagaaaau

SEQ ID NO: 1770042 - RNA, 19 nt, Salmonella enterica enterica serovar Typhi Ty2
aauccccccuuuuuugcug

SEQ ID NO: 1770043 - RNA, 19 nt, Salmonella enterica enterica serovar Typhi Ty2
aaucggaugccauguuucu

SEQ ID NO: 1770044 - RNA, 17 nt, Salmonella enterica enterica serovar Typhi Ty2
aaucggccagcgaaaac

SEQ ID NO: 1770045 - RNA, 19 nt, Salmonella enterica enterica serovar Typhi Ty2
aaucgcuaaacauauaccg

SEQ ID NO: 1770046 - RNA, 13 nt, Salmonella enterica enterica serovar Typhi Ty2
aaucgcuucacgg

SEQ ID NO: 1770047 - RNA, 14 nt, Salmonella enterica enterica serovar Typhi Ty2
aaucguucuugcac

SEQ ID NO: 1770048 - RNA, 22 nt, Salmonella enterica enterica serovar Typhi Ty2
aaucguaugcgccugucuuaaa

SEQ ID NO: 1770049 - RNA, 20 nt, Salmonella enterica enterica serovar Typhi Ty2
aaucguagcgugcgcaauau

SEQ ID NO: 1770050 - RNA, 19 nt, Salmonella enterica enterica serovar Typhi Ty2
aaucgggcgcuaaacccaa

SEQ ID NO: 1770051 - RNA, 14 nt, Salmonella enterica enterica serovar Typhi Ty2
aaucguuuuaugcc

SEQ ID NO: 1770052 - RNA, 18 nt, Salmonella enterica enterica serovar Typhi Ty2
aaucaguacugcgcccgc

SEQ ID NO: 1770053 - RNA, 17 nt, Salmonella enterica enterica serovar Typhi Ty2
aaucaggugaauaccaa

SEQ ID NO: 1770054 - RNA, 18 nt, Salmonella enterica enterica serovar Typhi Ty2
aaucaguggcggcaaaaa

SEQ ID NO: 1770055 - RNA, 23 nt, Salmonella enterica enterica serovar Typhi Ty2
aaucaggcacaacccaaaggcca

SEQ ID NO: 1770056 - RNA, 20 nt, Salmonella enterica enterica serovar Typhi Ty2
aaucagcgcggcaaggauaa

SEQ ID NO: 1770057 - RNA, 14 nt, Salmonella enterica enterica serovar Typhi Ty2
aauaugaauauccg

SEQ ID NO: 1770058 - RNA, 13 nt, Salmonella enterica enterica serovar Typhi Ty2
aaucaucaucagg

SEQ ID NO: 1770059 - RNA, 21 nt, Salmonella enterica enterica serovar Typhi Ty2
aaucaucagaccgauaaauac

SEQ ID NO: 1770060 - RNA, 14 nt, Salmonella enterica enterica serovar Typhi Ty2
aaucaucaaucgcu

SEQ ID NO: 1770061 - RNA, 23 nt, Salmonella enterica enterica serovar Typhi Ty2
aaucaucgaggccaccaaaaauu

SEQ ID NO: 1770062 - RNA, 22 nt, Salmonella enterica enterica serovar Typhi Ty2
aaucaucgaggccaccaaaaau

SEQ ID NO: 1770063 - RNA, 17 nt, Salmonella enterica enterica serovar Typhi Ty2
aaucauccugauuuuac

SEQ ID NO: 1770064 - RNA, 15 nt, Salmonella enterica enterica serovar Typhi Ty2
aaucauguuuuucuc

SEQ ID NO: 1770065 - RNA, 20 nt, Salmonella enterica enterica serovar Typhi Ty2
aaucauugcgcuaaaaucca

SEQ ID NO: 1770066 - RNA, 13 nt, Salmonella enterica enterica serovar Typhi Ty2
aaucauuaucacu

SEQ ID NO: 1770067 - RNA, 14 nt, Salmonella enterica enterica serovar Typhi Ty2
aaucauuaauacac

SEQ ID NO: 1770068 - RNA, 22 nt, Salmonella enterica enterica serovar Typhi Ty2
aauccaacgaaacucagcggcc

SEQ ID NO: 1770069 - RNA, 16 nt, Salmonella enterica enterica serovar Typhi Ty2
aauccaggaauuuucc

SEQ ID NO: 1770070 - RNA, 12 nt, Salmonella enterica enterica serovar Typhi Ty2
aauccaggugga

SEQ ID NO: 1770071 - RNA, 13 nt, Salmonella enterica enterica serovar Typhi Ty2
aauccagguggau

SEQ ID NO: 1770072 - RNA, 15 nt, Salmonella enterica enterica serovar Typhi Ty2
aauccagcuacuggc

SEQ ID NO: 1770073 - RNA, 22 nt, Salmonella enterica enterica serovar Typhi Ty2
aaugccggacgccaccacgccg

SEQ ID NO: 1770074 - RNA, 22 nt, Salmonella enterica enterica serovar Typhi Ty2
aaugccgggcaaaaaacggaac

SEQ ID NO: 1770075 - RNA, 21 nt, Salmonella enterica enterica serovar Typhi Ty2
aaugcguccgccagaugcacc

SEQ ID NO: 1770076 - RNA, 20 nt, Salmonella enterica enterica serovar Typhi Ty2
aaugcgucggcaccauuccc

SEQ ID NO: 1770077 - RNA, 15 nt, Salmonella enterica enterica serovar Typhi Ty2
aaugcuccaauaaau

SEQ ID NO: 1770078 - RNA, 23 nt, Salmonella enterica enterica serovar Typhi Ty2
aaugcugacgcguuuuuucauga

SEQ ID NO: 1770079 - RNA, 20 nt, Salmonella enterica enterica serovar Typhi Ty2
aaugcucauuauuuggauua

SEQ ID NO: 1770080 - RNA, 21 nt, Salmonella enterica enterica serovar Typhi Ty2
aauggcuaugccgacaggggg

SEQ ID NO: 1770081 - RNA, 16 nt, Salmonella enterica enterica serovar Typhi Ty2
aauggcguaaagaggg

SEQ ID NO: 1770082 - RNA, 21 nt, Salmonella enterica enterica serovar Typhi Ty2
aaugggaucuucaaugaacaa

SEQ ID NO: 1770083 - RNA, 18 nt, Salmonella enterica enterica serovar Typhi Ty2
aauggggaucgucugcaa

SEQ ID NO: 1770084 - RNA, 16 nt, Salmonella enterica enterica serovar Typhi Ty2
aaugcuggugcaucug

SEQ ID NO: 1770085 - RNA, 20 nt, Salmonella enterica enterica serovar Typhi Ty2
aaugcugcuuugaugcggca

SEQ ID NO: 1770086 - RNA, 18 nt, Salmonella enterica enterica serovar Typhi Ty2
aauggcaggcagcagaua

SEQ ID NO: 1770087 - RNA, 15 nt, Salmonella enterica enterica serovar Typhi Ty2
aauggcgcguuuuau

SEQ ID NO: 1770088 - RNA, 19 nt, Salmonella enterica enterica serovar Typhi Ty2
aauggcgcguuuuaucaug

SEQ ID NO: 1770089 - RNA, 16 nt, Salmonella enterica enterica serovar Typhi Ty2
aauggcaauggcggcg

SEQ ID NO: 1770090 - RNA, 23 nt, Salmonella enterica enterica serovar Typhi Ty2
aauggauucaugguacucaacau

SEQ ID NO: 1770091 - RNA, 14 nt, Salmonella enterica enterica serovar Typhi Ty2
aaugcauuggccag

SEQ ID NO: 1770092 - RNA, 18 nt, Salmonella enterica enterica serovar Typhi Ty2
aaugcauagccccagcgc

SEQ ID NO: 1770093 - RNA, 19 nt, Salmonella enterica enterica serovar Typhi Ty2
aaugcauagccccagcgca

SEQ ID NO: 1770094 - RNA, 19 nt, Salmonella enterica enterica serovar Typhi Ty2
aaugcauggcagauaaacc

SEQ ID NO: 1770095 - RNA, 21 nt, Salmonella enterica enterica serovar Typhi Ty2
aaugcauggcagauaaaccac

SEQ ID NO: 1770096 - RNA, 19 nt, Salmonella enterica enterica serovar Typhi Ty2
aaugcagggguguccagau

SEQ ID NO: 1770097 - RNA, 20 nt, Salmonella enterica enterica serovar Typhi Ty2
aaugccgauagucuccgcca

SEQ ID NO: 1770098 - RNA, 19 nt, Salmonella enterica enterica serovar Typhi Ty2
aaugccgcgcuuucaguaa

SEQ ID NO: 1770099 - RNA, 20 nt, Salmonella enterica enterica serovar Typhi Ty2
aaugccgccguacaaacccu

SEQ ID NO: 1770100 - RNA, 15 nt, Salmonella enterica enterica serovar Typhi Ty2
aaugcccccucggca

SEQ ID NO: 1770101 - RNA, 14 nt, Salmonella enterica enterica serovar Typhi Ty2
aaugccaaaaaaac

SEQ ID NO: 1770102 - RNA, 21 nt, Salmonella enterica enterica serovar Typhi Ty2
aaugcccgucucauuucugga

SEQ ID NO: 1770103 - RNA, 16 nt, Salmonella enterica enterica serovar Typhi Ty2
aaugcccguugacgaa

SEQ ID NO: 1770104 - RNA, 12 nt, Salmonella enterica enterica serovar Typhi Ty2
aaugcccggcgc

SEQ ID NO: 1770105 - RNA, 17 nt, Salmonella enterica enterica serovar Typhi Ty2
aaugcccgguauuuuuu

SEQ ID NO: 1770106 - RNA, 16 nt, Salmonella enterica enterica serovar Typhi Ty2
aaugcccaggcggcgg

SEQ ID NO: 1770107 - RNA, 17 nt, Salmonella enterica enterica serovar Typhi Ty2
aaugauuacggaacaaa

SEQ ID NO: 1770108 - RNA, 23 nt, Salmonella enterica enterica serovar Typhi Ty2
aaugauuacggaacaaaacggaa

SEQ ID NO: 1770109 - RNA, 14 nt, Salmonella enterica enterica serovar Typhi Ty2
aaugauuaucuuuu

SEQ ID NO: 1770110 - RNA, 14 nt, Salmonella enterica enterica serovar Typhi Ty2
aaugauuaaaauaa

SEQ ID NO: 1770111 - RNA, 16 nt, Salmonella enterica enterica serovar Typhi Ty2
aaugauuaaaauaaau

SEQ ID NO: 1770112 - RNA, 20 nt, Salmonella enterica enterica serovar Typhi Ty2
aaugauguccagaaugcaaa

SEQ ID NO: 1770113 - RNA, 14 nt, Salmonella enterica enterica serovar Typhi Ty2
aaugaugacucauu

SEQ ID NO: 1770114 - RNA, 22 nt, Salmonella enterica enterica serovar Typhi Ty2
aaugauggcgagaguuugugau

SEQ ID NO: 1770115 - RNA, 17 nt, Salmonella enterica enterica serovar Typhi Ty2
aaugaugccccagaaca

SEQ ID NO: 1770116 - RNA, 19 nt, Salmonella enterica enterica serovar Typhi Ty2
aaugauggggucacagguu

SEQ ID NO: 1770117 - RNA, 20 nt, Salmonella enterica enterica serovar Typhi Ty2
aaugaucagaacucacauau

SEQ ID NO: 1770118 - RNA, 12 nt, Salmonella enterica enterica serovar Typhi Ty2
aaugaucagaac

SEQ ID NO: 1770119 - RNA, 18 nt, Salmonella enterica enterica serovar Typhi Ty2
aaugauauuuaaaacugg

SEQ ID NO: 1770120 - RNA, 19 nt, Salmonella enterica enterica serovar Typhi Ty2
aaugaucagcaaaauagug

SEQ ID NO: 1770121 - RNA, 19 nt, Salmonella enterica enterica serovar Typhi Ty2
aaugaucagaacucacaua

SEQ ID NO: 1770122 - RNA, 15 nt, Salmonella enterica enterica serovar Typhi Ty2
aaugauccacggcgu

SEQ ID NO: 1770123 - RNA, 21 nt, Salmonella enterica enterica serovar Typhi Ty2
aaugaucguaugcagccaggc

SEQ ID NO: 1770124 - RNA, 13 nt, Salmonella enterica enterica serovar Typhi Ty2
aaugacaaaaauu

SEQ ID NO: 1770125 - RNA, 18 nt, Salmonella enterica enterica serovar Typhi Ty2
aaugaauuauuuuuucau

SEQ ID NO: 1770126 - RNA, 15 nt, Salmonella enterica enterica serovar Typhi Ty2
aaugaccagaucaac

SEQ ID NO: 1770127 - RNA, 20 nt, Salmonella enterica enterica serovar Typhi Ty2
aaugaccauuaacgccagcg

SEQ ID NO: 1770128 - RNA, 15 nt, Salmonella enterica enterica serovar Typhi Ty2
aaugaccucaagaau

SEQ ID NO: 1770129 - RNA, 18 nt, Salmonella enterica enterica serovar Typhi Ty2
aaugacgagcagguuacu

SEQ ID NO: 1770130 - RNA, 22 nt, Salmonella enterica enterica serovar Typhi Ty2
aaugacggacgcagaccaaagu

SEQ ID NO: 1770131 - RNA, 20 nt, Salmonella enterica enterica serovar Typhi Ty2
aaugacggaccaacaaccca

SEQ ID NO: 1770132 - RNA, 21 nt, Salmonella enterica enterica serovar Typhi Ty2
aaugagugaaaugguugcguu

SEQ ID NO: 1770133 - RNA, 22 nt, Salmonella enterica enterica serovar Typhi Ty2
aaugaguagaacguauuauuau

SEQ ID NO: 1770134 - RNA, 18 nt, Salmonella enterica enterica serovar Typhi Ty2
aaugagaaaaggaagaau

SEQ ID NO: 1770135 - RNA, 13 nt, Salmonella enterica enterica serovar Typhi Ty2
aaugagaugcacg

SEQ ID NO: 1770136 - RNA, 24 nt, Salmonella enterica enterica serovar Typhi Ty2
aaugagcggaacgcguuccacgau

SEQ ID NO: 1770137 - RNA, 13 nt, Salmonella enterica enterica serovar Typhi Ty2
aaugacuuuuuau

SEQ ID NO: 1770138 - RNA, 14 nt, Salmonella enterica enterica serovar Typhi Ty2
aaugagaaaaggaa

SEQ ID NO: 1770139 - RNA, 20 nt, Salmonella enterica enterica serovar Typhi Ty2
aaucuuuuauauguugaaua

SEQ ID NO: 1770140 - RNA, 22 nt, Salmonella enterica enterica serovar Typhi Ty2
aaucuuuuauauguugaauauu

SEQ ID NO: 1770141 - RNA, 23 nt, Salmonella enterica enterica serovar Typhi Ty2
aaucuuucuguaagagacugaca

SEQ ID NO: 1770142 - RNA, 20 nt, Salmonella enterica enterica serovar Typhi Ty2
aaucuuuuugugcaaucaca

SEQ ID NO: 1770143 - RNA, 14 nt, Salmonella enterica enterica serovar Typhi Ty2
aaugaaaaaaaaau

SEQ ID NO: 1770144 - RNA, 12 nt, Salmonella enterica enterica serovar Typhi Ty2
aaucuuuuauau

SEQ ID NO: 1770145 - RNA, 15 nt, Salmonella enterica enterica serovar Typhi Ty2
aaucucuacacaacg

SEQ ID NO: 1770146 - RNA, 13 nt, Salmonella enterica enterica serovar Typhi Ty2
aaugaaucccccc

SEQ ID NO: 1770147 - RNA, 15 nt, Salmonella enterica enterica serovar Typhi Ty2
aaugaauguaggccg

SEQ ID NO: 1770148 - RNA, 18 nt, Salmonella enterica enterica serovar Typhi Ty2
aaugaagcauaaaaagac

SEQ ID NO: 1770149 - RNA, 15 nt, Salmonella enterica enterica serovar Typhi Ty2
aaugaagcauaaaaa

SEQ ID NO: 1770150 - RNA, 16 nt, Salmonella enterica enterica serovar Typhi Ty2
aaugaagcauaaaaag

SEQ ID NO: 1770151 - RNA, 22 nt, Salmonella enterica enterica serovar Typhi Ty2
aaugaaaugcccauaaagaaau

SEQ ID NO: 1770152 - RNA, 22 nt, Salmonella enterica enterica serovar Typhi Ty2
aaugaaaucgucgccaacaccg

SEQ ID NO: 1770153 - RNA, 13 nt, Salmonella enterica enterica serovar Typhi Ty2
aaugaagcauaaa

SEQ ID NO: 1770154 - RNA, 18 nt, Salmonella enterica enterica serovar Typhi Ty2
aaugaacguuuuguguca

SEQ ID NO: 1770155 - RNA, 21 nt, Salmonella enterica enterica serovar Typhi Ty2
aaugaacuacggcccuggcuc

SEQ ID NO: 1770156 - RNA, 21 nt, Salmonella enterica enterica serovar Typhi Ty2
aauuccgcaggagagccagaa

SEQ ID NO: 1770157 - RNA, 16 nt, Salmonella enterica enterica serovar Typhi Ty2
aauucccggcggaaau

SEQ ID NO: 1770158 - RNA, 21 nt, Salmonella enterica enterica serovar Typhi Ty2
aauucccgccucggucaguau

SEQ ID NO: 1770159 - RNA, 18 nt, Salmonella enterica enterica serovar Typhi Ty2
aauuauuuuuucaugacu

SEQ ID NO: 1770160 - RNA, 15 nt, Salmonella enterica enterica serovar Typhi Ty2
aauucaccaaauccu

SEQ ID NO: 1770161 - RNA, 12 nt, Salmonella enterica enterica serovar Typhi Ty2
aauucaaugaga

SEQ ID NO: 1770162 - RNA, 20 nt, Salmonella enterica enterica serovar Typhi Ty2
aauucuuaacccacaagaaa

SEQ ID NO: 1770163 - RNA, 19 nt, Salmonella enterica enterica serovar Typhi Ty2
aauucgcguucagaaaugu

SEQ ID NO: 1770164 - RNA, 22 nt, Salmonella enterica enterica serovar Typhi Ty2
aauucguacguuuuuccauuca

SEQ ID NO: 1770165 - RNA, 22 nt, Salmonella enterica enterica serovar Typhi Ty2
aauucgucaauaccuaaguuca

SEQ ID NO: 1770166 - RNA, 14 nt, Salmonella enterica enterica serovar Typhi Ty2
aauucgugugauuu

SEQ ID NO: 1770167 - RNA, 20 nt, Salmonella enterica enterica serovar Typhi Ty2
aauucuugcccgcugagugg

SEQ ID NO: 1770168 - RNA, 20 nt, Salmonella enterica enterica serovar Typhi Ty2
aauugacuggauuuuugacu

SEQ ID NO: 1770169 - RNA, 23 nt, Salmonella enterica enterica serovar Typhi Ty2
aauugacuggauuuuugacuaaa

SEQ ID NO: 1770170 - RNA, 14 nt, Salmonella enterica enterica serovar Typhi Ty2
aauugacuggauuu

SEQ ID NO: 1770171 - RNA, 14 nt, Salmonella enterica enterica serovar Typhi Ty2
aauugaauuauaau

SEQ ID NO: 1770172 - RNA, 15 nt, Salmonella enterica enterica serovar Typhi Ty2
aauugaauuauaaua

SEQ ID NO: 1770173 - RNA, 22 nt, Salmonella enterica enterica serovar Typhi Ty2
aauugaggccguuauugucaug

SEQ ID NO: 1770174 - RNA, 18 nt, Salmonella enterica enterica serovar Typhi Ty2
aauugaucacaaaaucau

SEQ ID NO: 1770175 - RNA, 13 nt, Salmonella enterica enterica serovar Typhi Ty2
aauugauucugug

SEQ ID NO: 1770176 - RNA, 17 nt, Salmonella enterica enterica serovar Typhi Ty2
aauuaaugauuaaaaua

SEQ ID NO: 1770177 - RNA, 12 nt, Salmonella enterica enterica serovar Typhi Ty2
aauuaaucaggc

SEQ ID NO: 1770178 - RNA, 21 nt, Salmonella enterica enterica serovar Typhi Ty2
aauuaaucaggcauccugccc

SEQ ID NO: 1770179 - RNA, 13 nt, Salmonella enterica enterica serovar Typhi Ty2
aauuaauauuuaa

SEQ ID NO: 1770180 - RNA, 17 nt, Salmonella enterica enterica serovar Typhi Ty2
aauuaaucccaacccga

SEQ ID NO: 1770181 - RNA, 17 nt, Salmonella enterica enterica serovar Typhi Ty2
aauuacgcccaucagcc

SEQ ID NO: 1770182 - RNA, 16 nt, Salmonella enterica enterica serovar Typhi Ty2
aauuacagcucauaaa

SEQ ID NO: 1770183 - RNA, 16 nt, Salmonella enterica enterica serovar Typhi Ty2
aauguacgccuaaaaa

SEQ ID NO: 1770184 - RNA, 14 nt, Salmonella enterica enterica serovar Typhi Ty2
aauuaauaaacaau

SEQ ID NO: 1770185 - RNA, 16 nt, Salmonella enterica enterica serovar Typhi Ty2
aauuaauauuuaacac

SEQ ID NO: 1770186 - RNA, 20 nt, Salmonella enterica enterica serovar Typhi Ty2
aauuagcgacauacauaacg

SEQ ID NO: 1770187 - RNA, 12 nt, Salmonella enterica enterica serovar Typhi Ty2
aauuacuuauga

SEQ ID NO: 1770188 - RNA, 16 nt, Salmonella enterica enterica serovar Typhi Ty2
aauuacuuaugauaua

SEQ ID NO: 1770189 - RNA, 19 nt, Salmonella enterica enterica serovar Typhi Ty2
aauuacuaucuucaaagcc

SEQ ID NO: 1770190 - RNA, 22 nt, Salmonella enterica enterica serovar Typhi Ty2
aauuacguuggggauaaccaga

SEQ ID NO: 1770191 - RNA, 22 nt, Salmonella enterica enterica serovar Typhi Ty2
aauuacuccguuuuaaucuuuu

SEQ ID NO: 1770192 - RNA, 12 nt, Salmonella enterica enterica serovar Typhi Ty2
aauuauuuuuca

SEQ ID NO: 1770193 - RNA, 20 nt, Salmonella enterica enterica serovar Typhi Ty2
aauuaugggauugcaaaaaa

SEQ ID NO: 1770194 - RNA, 15 nt, Salmonella enterica enterica serovar Typhi Ty2
aauuauuaaaucaau

SEQ ID NO: 1770195 - RNA, 18 nt, Salmonella enterica enterica serovar Typhi Ty2
aauuaugccugucaucau

SEQ ID NO: 1770196 - RNA, 17 nt, Salmonella enterica enterica serovar Typhi Ty2
aauuaugaauaaccauc

SEQ ID NO: 1770197 - RNA, 21 nt, Salmonella enterica enterica serovar Typhi Ty2
aauuuguacuucagagcugaa

SEQ ID NO: 1770198 - RNA, 17 nt, Salmonella enterica enterica serovar Typhi Ty2
aauuugucagacaugau

SEQ ID NO: 1770199 - RNA, 18 nt, Salmonella enterica enterica serovar Typhi Ty2
aauuugucguucacuugc

SEQ ID NO: 1770200 - RNA, 16 nt, Salmonella enterica enterica serovar Typhi Ty2
aauuucuugaucaauc

SEQ ID NO: 1770201 - RNA, 18 nt, Salmonella enterica enterica serovar Typhi Ty2
aauuugauuuauuuugaa

SEQ ID NO: 1770202 - RNA, 21 nt, Salmonella enterica enterica serovar Typhi Ty2
aauuugcuuucucgggccugu

SEQ ID NO: 1770203 - RNA, 13 nt, Salmonella enterica enterica serovar Typhi Ty2
aauuuuagaaaua

SEQ ID NO: 1770204 - RNA, 21 nt, Salmonella enterica enterica serovar Typhi Ty2
aauuuuacuuucauuccuuua

SEQ ID NO: 1770205 - RNA, 19 nt, Salmonella enterica enterica serovar Typhi Ty2
aauuuucagacacugcacc

SEQ ID NO: 1770206 - RNA, 16 nt, Salmonella enterica enterica serovar Typhi Ty2
aauuuucacuuauaaa

SEQ ID NO: 1770207 - RNA, 11 nt, Salmonella enterica enterica serovar Typhi Ty2
aauuuugauaa

SEQ ID NO: 1770208 - RNA, 20 nt, Salmonella enterica enterica serovar Typhi Ty2
aauuuugauaagagaaaaua

SEQ ID NO: 1770209 - RNA, 22 nt, Salmonella enterica enterica serovar Typhi Ty2
aauuuuuccgccuccuccgguu

SEQ ID NO: 1770210 - RNA, 12 nt, Salmonella enterica enterica serovar Typhi Ty2
aauuuaugauuu

SEQ ID NO: 1770211 - RNA, 21 nt, Salmonella enterica enterica serovar Typhi Ty2
aauuucaaucgccaguuuuug

SEQ ID NO: 1770212 - RNA, 14 nt, Salmonella enterica enterica serovar Typhi Ty2
aauuuaucaacaaa

SEQ ID NO: 1770213 - RNA, 23 nt, Salmonella enterica enterica serovar Typhi Ty2
aauugcgguagaugaaaauuugu

SEQ ID NO: 1770214 - RNA, 17 nt, Salmonella enterica enterica serovar Typhi Ty2
aauugcgguucugcaua

SEQ ID NO: 1770215 - RNA, 20 nt, Salmonella enterica enterica serovar Typhi Ty2
aauugcgguuuauccccgcu

SEQ ID NO: 1770216 - RNA, 24 nt, Salmonella enterica enterica serovar Typhi Ty2
aauugcgccaggcccagccgcucc

SEQ ID NO: 1770217 - RNA, 17 nt, Salmonella enterica enterica serovar Typhi Ty2
aauugcgccaggcccag

SEQ ID NO: 1770218 - RNA, 13 nt, Salmonella enterica enterica serovar Typhi Ty2
aauuuaaauagca

SEQ ID NO: 1770219 - RNA, 18 nt, Salmonella enterica enterica serovar Typhi Ty2
aauuuaaccguuuuaccu

SEQ ID NO: 1770220 - RNA, 21 nt, Salmonella enterica enterica serovar Typhi Ty2
aauuucgaaacaggaaaaaca

SEQ ID NO: 1770221 - RNA, 20 nt, Salmonella enterica enterica serovar Typhi Ty2
aauuucccccacuucugaca

SEQ ID NO: 1770222 - RNA, 22 nt, Salmonella enterica enterica serovar Typhi Ty2
aauuuccgcacgcgcgcccaug

SEQ ID NO: 1770223 - RNA, 15 nt, Salmonella enterica enterica serovar Typhi Ty2
aauuucggcaaugac

SEQ ID NO: 1770224 - RNA, 20 nt, Salmonella enterica enterica serovar Typhi Ty2
aauuucgcgaauaaucuguu

SEQ ID NO: 1770225 - RNA, 14 nt, Salmonella enterica enterica serovar Typhi Ty2
aauuucucgcccgc

SEQ ID NO: 1770226 - RNA, 18 nt, Salmonella enterica enterica serovar Typhi Ty2
aauuucagggcuuauuca

SEQ ID NO: 1770227 - RNA, 15 nt, Salmonella enterica enterica serovar Typhi Ty2
accaccgcccugucc

SEQ ID NO: 1770228 - RNA, 16 nt, Salmonella enterica enterica serovar Typhi Ty2
accacgaaaauuauuu

SEQ ID NO: 1770229 - RNA, 13 nt, Salmonella enterica enterica serovar Typhi Ty2
accacgaaaauua

SEQ ID NO: 1770230 - RNA, 13 nt, Salmonella enterica enterica serovar Typhi Ty2
accaccucuuucg

SEQ ID NO: 1770231 - RNA, 14 nt, Salmonella enterica enterica serovar Typhi Ty2
accaccaguacaug

SEQ ID NO: 1770232 - RNA, 18 nt, Salmonella enterica enterica serovar Typhi Ty2
accaccauacccaguagc

SEQ ID NO: 1770233 - RNA, 20 nt, Salmonella enterica enterica serovar Typhi Ty2
accaccauacccaguagcag

SEQ ID NO: 1770234 - RNA, 13 nt, Salmonella enterica enterica serovar Typhi Ty2
accacccagccag

SEQ ID NO: 1770235 - RNA, 16 nt, Salmonella enterica enterica serovar Typhi Ty2
accaccaguaaccgcc

SEQ ID NO: 1770236 - RNA, 14 nt, Salmonella enterica enterica serovar Typhi Ty2
accacccugaaaag

SEQ ID NO: 1770237 - RNA, 23 nt, Salmonella enterica enterica serovar Typhi Ty2
accacuccccaacguaauaacca

SEQ ID NO: 1770238 - RNA, 17 nt, Salmonella enterica enterica serovar Typhi Ty2
accacuucggcagaaaa

SEQ ID NO: 1770239 - RNA, 14 nt, Salmonella enterica enterica serovar Typhi Ty2
accacgaucuuguc

SEQ ID NO: 1770240 - RNA, 22 nt, Salmonella enterica enterica serovar Typhi Ty2
accacgccaucaacagcggaga

SEQ ID NO: 1770241 - RNA, 19 nt, Salmonella enterica enterica serovar Typhi Ty2
accacgcccggaucaaaca

SEQ ID NO: 1770242 - RNA, 17 nt, Salmonella enterica enterica serovar Typhi Ty2
accacgcauaccagcca

SEQ ID NO: 1770243 - RNA, 18 nt, Salmonella enterica enterica serovar Typhi Ty2
accacggauaagccagcc

SEQ ID NO: 1770244 - RNA, 19 nt, Salmonella enterica enterica serovar Typhi Ty2
accacgccauggccgcagc

SEQ ID NO: 1770245 - RNA, 19 nt, Salmonella enterica enterica serovar Typhi Ty2
accacgucauccggcaagc

SEQ ID NO: 1770246 - RNA, 16 nt, Salmonella enterica enterica serovar Typhi Ty2
accacgucauccggca

SEQ ID NO: 1770247 - RNA, 15 nt, Salmonella enterica enterica serovar Typhi Ty2
accacgucugaagaa

SEQ ID NO: 1770248 - RNA, 17 nt, Salmonella enterica enterica serovar Typhi Ty2
accacguuaccgcgcag

SEQ ID NO: 1770249 - RNA, 17 nt, Salmonella enterica enterica serovar Typhi Ty2
accacguucauuucgua

SEQ ID NO: 1770250 - RNA, 15 nt, Salmonella enterica enterica serovar Typhi Ty2
accacgguagagauu

SEQ ID NO: 1770251 - RNA, 15 nt, Salmonella enterica enterica serovar Typhi Ty2
accacagccgugucc

SEQ ID NO: 1770252 - RNA, 17 nt, Salmonella enterica enterica serovar Typhi Ty2
accacaggcggaaaaca

SEQ ID NO: 1770253 - RNA, 18 nt, Salmonella enterica enterica serovar Typhi Ty2
accacaccugaugguuau

SEQ ID NO: 1770254 - RNA, 12 nt, Salmonella enterica enterica serovar Typhi Ty2
accaccacgccc

SEQ ID NO: 1770255 - RNA, 15 nt, Salmonella enterica enterica serovar Typhi Ty2
accaccaauuucacc

SEQ ID NO: 1770256 - RNA, 17 nt, Salmonella enterica enterica serovar Typhi Ty2
accacaugaccagcgcc

SEQ ID NO: 1770257 - RNA, 20 nt, Salmonella enterica enterica serovar Typhi Ty2
accacaguugcgacugauaa

SEQ ID NO: 1770258 - RNA, 20 nt, Salmonella enterica enterica serovar Typhi Ty2
accacaucagaccgccaagc

SEQ ID NO: 1770259 - RNA, 14 nt, Salmonella enterica enterica serovar Typhi Ty2
accacauccacccc

SEQ ID NO: 1770260 - RNA, 21 nt, Salmonella enterica enterica serovar Typhi Ty2
accacagugacccgccgccag

SEQ ID NO: 1770261 - RNA, 15 nt, Salmonella enterica enterica serovar Typhi Ty2
accacaaaggcgcgu

SEQ ID NO: 1770262 - RNA, 14 nt, Salmonella enterica enterica serovar Typhi Ty2
accacaacacacgu

SEQ ID NO: 1770263 - RNA, 22 nt, Salmonella enterica enterica serovar Typhi Ty2
accacaaacgccgucacaaagc

SEQ ID NO: 1770264 - RNA, 22 nt, Salmonella enterica enterica serovar Typhi Ty2
accacaauaaucgcgagaaaau

SEQ ID NO: 1770265 - RNA, 20 nt, Salmonella enterica enterica serovar Typhi Ty2
accaauguuaauaagcagaa

SEQ ID NO: 1770266 - RNA, 18 nt, Salmonella enterica enterica serovar Typhi Ty2
accaauggcgcgucuuaa

SEQ ID NO: 1770267 - RNA, 19 nt, Salmonella enterica enterica serovar Typhi Ty2
accaauggcgcgucuuaaa

SEQ ID NO: 1770268 - RNA, 16 nt, Salmonella enterica enterica serovar Typhi Ty2
accaauuccaccaccu

SEQ ID NO: 1770269 - RNA, 14 nt, Salmonella enterica enterica serovar Typhi Ty2
accaauaguaucca

SEQ ID NO: 1770270 - RNA, 23 nt, Salmonella enterica enterica serovar Typhi Ty2
accaauaauaaucccaacauggu

SEQ ID NO: 1770271 - RNA, 16 nt, Salmonella enterica enterica serovar Typhi Ty2
accaauacccagcgcc

SEQ ID NO: 1770272 - RNA, 13 nt, Salmonella enterica enterica serovar Typhi Ty2
accaauagccuug

SEQ ID NO: 1770273 - RNA, 18 nt, Salmonella enterica enterica serovar Typhi Ty2
accaacguuuuuccuuga

SEQ ID NO: 1770274 - RNA, 22 nt, Salmonella enterica enterica serovar Typhi Ty2
accaacgucgugccagugaugc

SEQ ID NO: 1770275 - RNA, 17 nt, Salmonella enterica enterica serovar Typhi Ty2
acaucagcggcacauag

SEQ ID NO: 1770276 - RNA, 21 nt, Salmonella enterica enterica serovar Typhi Ty2
acauccgauuucauggucauc

SEQ ID NO: 1770277 - RNA, 16 nt, Salmonella enterica enterica serovar Typhi Ty2
acaucgcaaaauuccg

SEQ ID NO: 1770278 - RNA, 22 nt, Salmonella enterica enterica serovar Typhi Ty2
acaugaaagaagaaucgcccca

SEQ ID NO: 1770279 - RNA, 15 nt, Salmonella enterica enterica serovar Typhi Ty2
acaucuuccaugccu

SEQ ID NO: 1770280 - RNA, 16 nt, Salmonella enterica enterica serovar Typhi Ty2
acauggcaauggcuuc

SEQ ID NO: 1770281 - RNA, 20 nt, Salmonella enterica enterica serovar Typhi Ty2
acauggcggucgccauaugu

SEQ ID NO: 1770282 - RNA, 21 nt, Salmonella enterica enterica serovar Typhi Ty2
acauggacaccggaagugaau

SEQ ID NO: 1770283 - RNA, 16 nt, Salmonella enterica enterica serovar Typhi Ty2
acauguugugucggcc

SEQ ID NO: 1770284 - RNA, 23 nt, Salmonella enterica enterica serovar Typhi Ty2
acauguucagcgcagaagcagac

SEQ ID NO: 1770285 - RNA, 14 nt, Salmonella enterica enterica serovar Typhi Ty2
acaugggcaggaac

SEQ ID NO: 1770286 - RNA, 16 nt, Salmonella enterica enterica serovar Typhi Ty2
acauuauugcacauaa

SEQ ID NO: 1770287 - RNA, 23 nt, Salmonella enterica enterica serovar Typhi Ty2
acauuauucacgcuauguuugcu

SEQ ID NO: 1770288 - RNA, 15 nt, Salmonella enterica enterica serovar Typhi Ty2
acauuauugucuuug

SEQ ID NO: 1770289 - RNA, 17 nt, Salmonella enterica enterica serovar Typhi Ty2
acauuauuaaaaugucu

SEQ ID NO: 1770290 - RNA, 13 nt, Salmonella enterica enterica serovar Typhi Ty2
acauucagcacau

SEQ ID NO: 1770291 - RNA, 18 nt, Salmonella enterica enterica serovar Typhi Ty2
acauucauugccgccagu

SEQ ID NO: 1770292 - RNA, 20 nt, Salmonella enterica enterica serovar Typhi Ty2
acauuccugacauuuauauu

SEQ ID NO: 1770293 - RNA, 12 nt, Salmonella enterica enterica serovar Typhi Ty2
acauuuauauua

SEQ ID NO: 1770294 - RNA, 20 nt, Salmonella enterica enterica serovar Typhi Ty2
acauugcuguggaaaaucug

SEQ ID NO: 1770295 - RNA, 16 nt, Salmonella enterica enterica serovar Typhi Ty2
acauugggucguaaua

SEQ ID NO: 1770296 - RNA, 19 nt, Salmonella enterica enterica serovar Typhi Ty2
acauaccgucaccacgcgc

SEQ ID NO: 1770297 - RNA, 13 nt, Salmonella enterica enterica serovar Typhi Ty2
acauaccgcagau

SEQ ID NO: 1770298 - RNA, 21 nt, Salmonella enterica enterica serovar Typhi Ty2
acauaauuuccggccaguagc

SEQ ID NO: 1770299 - RNA, 14 nt, Salmonella enterica enterica serovar Typhi Ty2
acaggccgccgagg

SEQ ID NO: 1770300 - RNA, 15 nt, Salmonella enterica enterica serovar Typhi Ty2
acaggccggacaggc

SEQ ID NO: 1770301 - RNA, 19 nt, Salmonella enterica enterica serovar Typhi Ty2
acaggccaaacccugcgcc

SEQ ID NO: 1770302 - RNA, 20 nt, Salmonella enterica enterica serovar Typhi Ty2
acaggcauccgugaccugcu

SEQ ID NO: 1770303 - RNA, 18 nt, Salmonella enterica enterica serovar Typhi Ty2
acaggccauuaagcuucg

SEQ ID NO: 1770304 - RNA, 11 nt, Salmonella enterica enterica serovar Typhi Ty2
acaggaugcuu

SEQ ID NO: 1770305 - RNA, 20 nt, Salmonella enterica enterica serovar Typhi Ty2
acauacugcuuuuucggcuc

SEQ ID NO: 1770306 - RNA, 15 nt, Salmonella enterica enterica serovar Typhi Ty2
acauagaaaauauau

SEQ ID NO: 1770307 - RNA, 21 nt, Salmonella enterica enterica serovar Typhi Ty2
acauacguuuaaagcgcucgu

SEQ ID NO: 1770308 - RNA, 20 nt, Salmonella enterica enterica serovar Typhi Ty2
acauacugaaauuucuuuuc

SEQ ID NO: 1770309 - RNA, 22 nt, Salmonella enterica enterica serovar Typhi Ty2
acauacugaaauuucuuuucca

SEQ ID NO: 1770310 - RNA, 23 nt, Salmonella enterica enterica serovar Typhi Ty2
acauacugaaauuucuuuuccag

SEQ ID NO: 1770311 - RNA, 19 nt, Salmonella enterica enterica serovar Typhi Ty2
acauacguuuaaagcgcuc

SEQ ID NO: 1770312 - RNA, 14 nt, Salmonella enterica enterica serovar Typhi Ty2
acauagcuaaauaa

SEQ ID NO: 1770313 - RNA, 12 nt, Salmonella enterica enterica serovar Typhi Ty2
acauagcaucca

SEQ ID NO: 1770314 - RNA, 15 nt, Salmonella enterica enterica serovar Typhi Ty2
acauagcauaauaau

SEQ ID NO: 1770315 - RNA, 17 nt, Salmonella enterica enterica serovar Typhi Ty2
acauagcuaaauaaaaa

SEQ ID NO: 1770316 - RNA, 19 nt, Salmonella enterica enterica serovar Typhi Ty2
acauaggcaauauccuccg

SEQ ID NO: 1770317 - RNA, 19 nt, Salmonella enterica enterica serovar Typhi Ty2
acauaggcaaacaccucag

SEQ ID NO: 1770318 - RNA, 13 nt, Salmonella enterica enterica serovar Typhi Ty2
acauagggcaucg

SEQ ID NO: 1770319 - RNA, 22 nt, Salmonella enterica enterica serovar Typhi Ty2
acauauauauccgcuauuacca

SEQ ID NO: 1770320 - RNA, 19 nt, Salmonella enterica enterica serovar Typhi Ty2
acauaucgccggggaaaau

SEQ ID NO: 1770321 - RNA, 20 nt, Salmonella enterica enterica serovar Typhi Ty2
acauaucgccggggaaaaua

SEQ ID NO: 1770322 - RNA, 17 nt, Salmonella enterica enterica serovar Typhi Ty2
acauaucccauacguuu

SEQ ID NO: 1770323 - RNA, 16 nt, Salmonella enterica enterica serovar Typhi Ty2
acauauccgcgcacag

SEQ ID NO: 1770324 - RNA, 19 nt, Salmonella enterica enterica serovar Typhi Ty2
acauauuguuuucuauuuu

SEQ ID NO: 1770325 - RNA, 23 nt, Salmonella enterica enterica serovar Typhi Ty2
acauauucaauaauauuaucaua

SEQ ID NO: 1770326 - RNA, 16 nt, Salmonella enterica enterica serovar Typhi Ty2
acaucagagguaauua

SEQ ID NO: 1770327 - RNA, 16 nt, Salmonella enterica enterica serovar Typhi Ty2
acauauuuuucacaca

SEQ ID NO: 1770328 - RNA, 22 nt, Salmonella enterica enterica serovar Typhi Ty2
acauauuuuuaugcacgcuaua

SEQ ID NO: 1770329 - RNA, 12 nt, Salmonella enterica enterica serovar Typhi Ty2
acauccagcugu

SEQ ID NO: 1770330 - RNA, 14 nt, Salmonella enterica enterica serovar Typhi Ty2
acauccagcgccag

SEQ ID NO: 1770331 - RNA, 16 nt, Salmonella enterica enterica serovar Typhi Ty2
acagaaaccauaaaca

SEQ ID NO: 1770332 - RNA, 21 nt, Salmonella enterica enterica serovar Typhi Ty2
acacuugcaacucgcacugau

SEQ ID NO: 1770333 - RNA, 17 nt, Salmonella enterica enterica serovar Typhi Ty2
acacuuucgcccggcgc

SEQ ID NO: 1770334 - RNA, 20 nt, Salmonella enterica enterica serovar Typhi Ty2
acagaaaaaaugcaccgccu

SEQ ID NO: 1770335 - RNA, 18 nt, Salmonella enterica enterica serovar Typhi Ty2
acagaagcgcugguaaau

SEQ ID NO: 1770336 - RNA, 13 nt, Salmonella enterica enterica serovar Typhi Ty2
acagaacugauuu

SEQ ID NO: 1770337 - RNA, 22 nt, Salmonella enterica enterica serovar Typhi Ty2
acagaaucaacgccacaccgag

SEQ ID NO: 1770338 - RNA, 18 nt, Salmonella enterica enterica serovar Typhi Ty2
acagaaucaucaggcuau

SEQ ID NO: 1770339 - RNA, 19 nt, Salmonella enterica enterica serovar Typhi Ty2
acagacgccuuucagacuu

SEQ ID NO: 1770340 - RNA, 12 nt, Salmonella enterica enterica serovar Typhi Ty2
acagaccgccau

SEQ ID NO: 1770341 - RNA, 17 nt, Salmonella enterica enterica serovar Typhi Ty2
acacuaacgcucuucuc

SEQ ID NO: 1770342 - RNA, 22 nt, Salmonella enterica enterica serovar Typhi Ty2
acacuaacuaauuguuuguaga

SEQ ID NO: 1770343 - RNA, 14 nt, Salmonella enterica enterica serovar Typhi Ty2
acacguugcgacaa

SEQ ID NO: 1770344 - RNA, 13 nt, Salmonella enterica enterica serovar Typhi Ty2
acaccgagacaga

SEQ ID NO: 1770345 - RNA, 15 nt, Salmonella enterica enterica serovar Typhi Ty2
acacccucugcgccu

SEQ ID NO: 1770346 - RNA, 15 nt, Salmonella enterica enterica serovar Typhi Ty2
acaccauuucacaaa

SEQ ID NO: 1770347 - RNA, 22 nt, Salmonella enterica enterica serovar Typhi Ty2
acaccauuucacaaauuaaaaa

SEQ ID NO: 1770348 - RNA, 22 nt, Salmonella enterica enterica serovar Typhi Ty2
acacccggcuuuugcuuucugg

SEQ ID NO: 1770349 - RNA, 13 nt, Salmonella enterica enterica serovar Typhi Ty2
acacucucuccag

SEQ ID NO: 1770350 - RNA, 18 nt, Salmonella enterica enterica serovar Typhi Ty2
acacucacaaaacuauuu

SEQ ID NO: 1770351 - RNA, 15 nt, Salmonella enterica enterica serovar Typhi Ty2
acacucaaccaacca

SEQ ID NO: 1770352 - RNA, 15 nt, Salmonella enterica enterica serovar Typhi Ty2
acacuccgcgcaugu

SEQ ID NO: 1770353 - RNA, 15 nt, Salmonella enterica enterica serovar Typhi Ty2
acacucgcggauaau

SEQ ID NO: 1770354 - RNA, 22 nt, Salmonella enterica enterica serovar Typhi Ty2
acacuguugccgacagcggaaa

SEQ ID NO: 1770355 - RNA, 14 nt, Salmonella enterica enterica serovar Typhi Ty2
acacuucagccaga

SEQ ID NO: 1770356 - RNA, 15 nt, Salmonella enterica enterica serovar Typhi Ty2
acacugccaccgcuc

SEQ ID NO: 1770357 - RNA, 14 nt, Salmonella enterica enterica serovar Typhi Ty2
acagcaccagcagg

SEQ ID NO: 1770358 - RNA, 13 nt, Salmonella enterica enterica serovar Typhi Ty2
acagcaccaucau

SEQ ID NO: 1770359 - RNA, 18 nt, Salmonella enterica enterica serovar Typhi Ty2
acagcagaauauugcuga

SEQ ID NO: 1770360 - RNA, 20 nt, Salmonella enterica enterica serovar Typhi Ty2
acagauggcgcugcguuucc

SEQ ID NO: 1770361 - RNA, 21 nt, Salmonella enterica enterica serovar Typhi Ty2
acagaugccuuguaagccgga

SEQ ID NO: 1770362 - RNA, 15 nt, Salmonella enterica enterica serovar Typhi Ty2
acagaugccuuguaa

SEQ ID NO: 1770363 - RNA, 14 nt, Salmonella enterica enterica serovar Typhi Ty2
acagauaauuaaua

SEQ ID NO: 1770364 - RNA, 15 nt, Salmonella enterica enterica serovar Typhi Ty2
acagauacuggaagu

SEQ ID NO: 1770365 - RNA, 16 nt, Salmonella enterica enterica serovar Typhi Ty2
acagauaugaaaugag

SEQ ID NO: 1770366 - RNA, 14 nt, Salmonella enterica enterica serovar Typhi Ty2
acagauaacaccag

SEQ ID NO: 1770367 - RNA, 17 nt, Salmonella enterica enterica serovar Typhi Ty2
acagauaagcgucugca

SEQ ID NO: 1770368 - RNA, 18 nt, Salmonella enterica enterica serovar Typhi Ty2
acagagagggaaaaaaau

SEQ ID NO: 1770369 - RNA, 16 nt, Salmonella enterica enterica serovar Typhi Ty2
acagagaagcugugcc

SEQ ID NO: 1770370 - RNA, 19 nt, Salmonella enterica enterica serovar Typhi Ty2
acagcguacaauggcaggc

SEQ ID NO: 1770371 - RNA, 22 nt, Salmonella enterica enterica serovar Typhi Ty2
acagcguaaugcgccaggcagc

SEQ ID NO: 1770372 - RNA, 17 nt, Salmonella enterica enterica serovar Typhi Ty2
acagcguaggccaggca

SEQ ID NO: 1770373 - RNA, 13 nt, Salmonella enterica enterica serovar Typhi Ty2
acagcguacaggc

SEQ ID NO: 1770374 - RNA, 15 nt, Salmonella enterica enterica serovar Typhi Ty2
acagcguacaggcgg

SEQ ID NO: 1770375 - RNA, 14 nt, Salmonella enterica enterica serovar Typhi Ty2
acagcguauuaagc

SEQ ID NO: 1770376 - RNA, 15 nt, Salmonella enterica enterica serovar Typhi Ty2
acagcguauuaagcc

SEQ ID NO: 1770377 - RNA, 21 nt, Salmonella enterica enterica serovar Typhi Ty2
acagcguaguuuauucaucuc

SEQ ID NO: 1770378 - RNA, 21 nt, Salmonella enterica enterica serovar Typhi Ty2
acaggacgccagcgcggcaug

SEQ ID NO: 1770379 - RNA, 16 nt, Salmonella enterica enterica serovar Typhi Ty2
acaggaguucaucaug

SEQ ID NO: 1770380 - RNA, 20 nt, Salmonella enterica enterica serovar Typhi Ty2
acaggaguuagcauguggga

SEQ ID NO: 1770381 - RNA, 21 nt, Salmonella enterica enterica serovar Typhi Ty2
acagcuggcgauauccgugcc

SEQ ID NO: 1770382 - RNA, 12 nt, Salmonella enterica enterica serovar Typhi Ty2
acagccaaaaau

SEQ ID NO: 1770383 - RNA, 22 nt, Salmonella enterica enterica serovar Typhi Ty2
acagcccauaccacaacagaau

SEQ ID NO: 1770384 - RNA, 23 nt, Salmonella enterica enterica serovar Typhi Ty2
acagcgcuuuaguacgcguucac

SEQ ID NO: 1770385 - RNA, 19 nt, Salmonella enterica enterica serovar Typhi Ty2
acagcgcgaccaggaaacc

SEQ ID NO: 1770386 - RNA, 23 nt, Salmonella enterica enterica serovar Typhi Ty2
acagcgggguaaagccuuuaugc

SEQ ID NO: 1770387 - RNA, 14 nt, Salmonella enterica enterica serovar Typhi Ty2
acagcggcgcgcca

SEQ ID NO: 1770388 - RNA, 13 nt, Salmonella enterica enterica serovar Typhi Ty2
acagcggaaaauc

SEQ ID NO: 1770389 - RNA, 12 nt, Salmonella enterica enterica serovar Typhi Ty2
acagcggagaga

SEQ ID NO: 1770390 - RNA, 22 nt, Salmonella enterica enterica serovar Typhi Ty2
acagcggauuacgcgccugccu

SEQ ID NO: 1770391 - RNA, 15 nt, Salmonella enterica enterica serovar Typhi Ty2
acaccaucccgcucu

SEQ ID NO: 1770392 - RNA, 14 nt, Salmonella enterica enterica serovar Typhi Ty2
acaccagccguuca

SEQ ID NO: 1770393 - RNA, 21 nt, Salmonella enterica enterica serovar Typhi Ty2
acaccagcccuggcuguccuu

SEQ ID NO: 1770394 - RNA, 17 nt, Salmonella enterica enterica serovar Typhi Ty2
acacauaacgcccgaca

SEQ ID NO: 1770395 - RNA, 13 nt, Salmonella enterica enterica serovar Typhi Ty2
acacaguugccuu

SEQ ID NO: 1770396 - RNA, 15 nt, Salmonella enterica enterica serovar Typhi Ty2
acacaucacaaucuc

SEQ ID NO: 1770397 - RNA, 18 nt, Salmonella enterica enterica serovar Typhi Ty2
acacauaucgccagccau

SEQ ID NO: 1770398 - RNA, 19 nt, Salmonella enterica enterica serovar Typhi Ty2
acaccagacugaugaugaa

SEQ ID NO: 1770399 - RNA, 22 nt, Salmonella enterica enterica serovar Typhi Ty2
acacaggcgugguggauaucca

SEQ ID NO: 1770400 - RNA, 15 nt, Salmonella enterica enterica serovar Typhi Ty2
acacagcagaaagca

SEQ ID NO: 1770401 - RNA, 13 nt, Salmonella enterica enterica serovar Typhi Ty2
acacaguaaaaaa

SEQ ID NO: 1770402 - RNA, 15 nt, Salmonella enterica enterica serovar Typhi Ty2
acacacucaucuucg

SEQ ID NO: 1770403 - RNA, 20 nt, Salmonella enterica enterica serovar Typhi Ty2
acacagaaaaaccaaaaaau

SEQ ID NO: 1770404 - RNA, 21 nt, Salmonella enterica enterica serovar Typhi Ty2
acacagaaaaaccaaaaaaua

SEQ ID NO: 1770405 - RNA, 19 nt, Salmonella enterica enterica serovar Typhi Ty2
acacacguaacaaccagaa

SEQ ID NO: 1770406 - RNA, 22 nt, Salmonella enterica enterica serovar Typhi Ty2
acacacaguugccuucgauuaa

SEQ ID NO: 1770407 - RNA, 22 nt, Salmonella enterica enterica serovar Typhi Ty2
acacagacuuugcacagucugc

SEQ ID NO: 1770408 - RNA, 22 nt, Salmonella enterica enterica serovar Typhi Ty2
acacagaaaaaccaaaaaauau

SEQ ID NO: 1770409 - RNA, 13 nt, Salmonella enterica enterica serovar Typhi Ty2
acacagcagaaag

SEQ ID NO: 1770410 - RNA, 19 nt, Salmonella enterica enterica serovar Typhi Ty2
acaauuucaccuuuggcuu

SEQ ID NO: 1770411 - RNA, 12 nt, Salmonella enterica enterica serovar Typhi Ty2
acaauuucuggc

SEQ ID NO: 1770412 - RNA, 15 nt, Salmonella enterica enterica serovar Typhi Ty2
acacacaacuaagug

SEQ ID NO: 1770413 - RNA, 21 nt, Salmonella enterica enterica serovar Typhi Ty2
acaauuacgcaagagagcaac

SEQ ID NO: 1770414 - RNA, 22 nt, Salmonella enterica enterica serovar Typhi Ty2
acaaugugccggauggcgcuaa

SEQ ID NO: 1770415 - RNA, 14 nt, Salmonella enterica enterica serovar Typhi Ty2
acaauaucaucguc

SEQ ID NO: 1770416 - RNA, 15 nt, Salmonella enterica enterica serovar Typhi Ty2
acaaucucaauacca

SEQ ID NO: 1770417 - RNA, 21 nt, Salmonella enterica enterica serovar Typhi Ty2
acaaucugugugggcacucga

SEQ ID NO: 1770418 - RNA, 23 nt, Salmonella enterica enterica serovar Typhi Ty2
acaaucuccagaccgcugcggaa

SEQ ID NO: 1770419 - RNA, 20 nt, Salmonella enterica enterica serovar Typhi Ty2
acaaucucaauaccacgccg

SEQ ID NO: 1770420 - RNA, 18 nt, Salmonella enterica enterica serovar Typhi Ty2
acaaugggauaaaaugga

SEQ ID NO: 1770421 - RNA, 15 nt, Salmonella enterica enterica serovar Typhi Ty2
acaauggcccgauac

SEQ ID NO: 1770422 - RNA, 14 nt, Salmonella enterica enterica serovar Typhi Ty2
acaauguacagaau

SEQ ID NO: 1770423 - RNA, 13 nt, Salmonella enterica enterica serovar Typhi Ty2
acaagaauaugca

SEQ ID NO: 1770424 - RNA, 20 nt, Salmonella enterica enterica serovar Typhi Ty2
acaagaucaaugugcucaac

SEQ ID NO: 1770425 - RNA, 23 nt, Salmonella enterica enterica serovar Typhi Ty2
acaagcaguaucguguuauuuuc

SEQ ID NO: 1770426 - RNA, 22 nt, Salmonella enterica enterica serovar Typhi Ty2
acaagcaguaugaccccuccgg

SEQ ID NO: 1770427 - RNA, 21 nt, Salmonella enterica enterica serovar Typhi Ty2
acaagcaaaccuauuucagua

SEQ ID NO: 1770428 - RNA, 19 nt, Salmonella enterica enterica serovar Typhi Ty2
acaacguucggucauggau

SEQ ID NO: 1770429 - RNA, 19 nt, Salmonella enterica enterica serovar Typhi Ty2
acaacggcaauuuuuacaa

SEQ ID NO: 1770430 - RNA, 16 nt, Salmonella enterica enterica serovar Typhi Ty2
acaacggcaauuuuua

SEQ ID NO: 1770431 - RNA, 17 nt, Salmonella enterica enterica serovar Typhi Ty2
acaacggcgaccuucac

SEQ ID NO: 1770432 - RNA, 19 nt, Salmonella enterica enterica serovar Typhi Ty2
acaacguaauauuaagcag

SEQ ID NO: 1770433 - RNA, 19 nt, Salmonella enterica enterica serovar Typhi Ty2
acaacgucaguggaaaaca

SEQ ID NO: 1770434 - RNA, 17 nt, Salmonella enterica enterica serovar Typhi Ty2
acaacggccagcaaaau

SEQ ID NO: 1770435 - RNA, 21 nt, Salmonella enterica enterica serovar Typhi Ty2
acaacgccgguacgcagcagg

SEQ ID NO: 1770436 - RNA, 19 nt, Salmonella enterica enterica serovar Typhi Ty2
aagccugauacuuuuacuc

SEQ ID NO: 1770437 - RNA, 14 nt, Salmonella enterica enterica serovar Typhi Ty2
aagcgaaugcuguc

SEQ ID NO: 1770438 - RNA, 16 nt, Salmonella enterica enterica serovar Typhi Ty2
aagcgaauacucacuu

SEQ ID NO: 1770439 - RNA, 17 nt, Salmonella enterica enterica serovar Typhi Ty2
aagcgagguaaaaagcg

SEQ ID NO: 1770440 - RNA, 12 nt, Salmonella enterica enterica serovar Typhi Ty2
aagcgaaaauaa

SEQ ID NO: 1770441 - RNA, 23 nt, Salmonella enterica enterica serovar Typhi Ty2
aagccuuucuguucuuugauuag

SEQ ID NO: 1770442 - RNA, 15 nt, Salmonella enterica enterica serovar Typhi Ty2
aagaucgcguacagc

SEQ ID NO: 1770443 - RNA, 20 nt, Salmonella enterica enterica serovar Typhi Ty2
aagaucgcguacagcgccau

SEQ ID NO: 1770444 - RNA, 16 nt, Salmonella enterica enterica serovar Typhi Ty2
aagaucguuauccagc

SEQ ID NO: 1770445 - RNA, 19 nt, Salmonella enterica enterica serovar Typhi Ty2
aagaucguuauccagcagc

SEQ ID NO: 1770446 - RNA, 22 nt, Salmonella enterica enterica serovar Typhi Ty2
aagccggcaggcagcgccagcg

SEQ ID NO: 1770447 - RNA, 22 nt, Salmonella enterica enterica serovar Typhi Ty2
aagccggucguaaugagcacuu

SEQ ID NO: 1770448 - RNA, 16 nt, Salmonella enterica enterica serovar Typhi Ty2
aagccggcggaaaaaa

SEQ ID NO: 1770449 - RNA, 22 nt, Salmonella enterica enterica serovar Typhi Ty2
aagccggcggaaaaaagcagca

SEQ ID NO: 1770450 - RNA, 23 nt, Salmonella enterica enterica serovar Typhi Ty2
aagcgauguauuuauccacgccg

SEQ ID NO: 1770451 - RNA, 18 nt, Salmonella enterica enterica serovar Typhi Ty2
aagcgauuuauccaccgc

SEQ ID NO: 1770452 - RNA, 19 nt, Salmonella enterica enterica serovar Typhi Ty2
aagcgccagauaugaucga

SEQ ID NO: 1770453 - RNA, 22 nt, Salmonella enterica enterica serovar Typhi Ty2
aagcgcauccagcucuuucaau

SEQ ID NO: 1770454 - RNA, 13 nt, Salmonella enterica enterica serovar Typhi Ty2
aagcgcaguguua

SEQ ID NO: 1770455 - RNA, 22 nt, Salmonella enterica enterica serovar Typhi Ty2
aagcgcaggugcgauacggcuu

SEQ ID NO: 1770456 - RNA, 12 nt, Salmonella enterica enterica serovar Typhi Ty2
aagcgccgcgau

SEQ ID NO: 1770457 - RNA, 15 nt, Salmonella enterica enterica serovar Typhi Ty2
aagcgcccgauaaua

SEQ ID NO: 1770458 - RNA, 20 nt, Salmonella enterica enterica serovar Typhi Ty2
aagcgcccaugaagauguag

SEQ ID NO: 1770459 - RNA, 15 nt, Salmonella enterica enterica serovar Typhi Ty2
aagcgcgccgaaaau

SEQ ID NO: 1770460 - RNA, 16 nt, Salmonella enterica enterica serovar Typhi Ty2
aagcgccuguucaaca

SEQ ID NO: 1770461 - RNA, 13 nt, Salmonella enterica enterica serovar Typhi Ty2
aagcgcggacagc

SEQ ID NO: 1770462 - RNA, 14 nt, Salmonella enterica enterica serovar Typhi Ty2
aagcgcggcagcag

SEQ ID NO: 1770463 - RNA, 18 nt, Salmonella enterica enterica serovar Typhi Ty2
aagcucaacgcaggcugg

SEQ ID NO: 1770464 - RNA, 17 nt, Salmonella enterica enterica serovar Typhi Ty2
aagcucaacgcaggcug

SEQ ID NO: 1770465 - RNA, 16 nt, Salmonella enterica enterica serovar Typhi Ty2
aagcuauuacaaaaau

SEQ ID NO: 1770466 - RNA, 17 nt, Salmonella enterica enterica serovar Typhi Ty2
aagcuauuccuguauaa

SEQ ID NO: 1770467 - RNA, 15 nt, Salmonella enterica enterica serovar Typhi Ty2
aagcuaguaaagaaa

SEQ ID NO: 1770468 - RNA, 20 nt, Salmonella enterica enterica serovar Typhi Ty2
aagcuauccucuuuuaucac

SEQ ID NO: 1770469 - RNA, 16 nt, Salmonella enterica enterica serovar Typhi Ty2
aagcggcugucaucaa

SEQ ID NO: 1770470 - RNA, 19 nt, Salmonella enterica enterica serovar Typhi Ty2
aagcgguaaggcaccgguu

SEQ ID NO: 1770471 - RNA, 20 nt, Salmonella enterica enterica serovar Typhi Ty2
aagcuugaaagcagucccgc

SEQ ID NO: 1770472 - RNA, 18 nt, Salmonella enterica enterica serovar Typhi Ty2
aagcuuucaucuuuaaaa

SEQ ID NO: 1770473 - RNA, 15 nt, Salmonella enterica enterica serovar Typhi Ty2
aaggaaauauuaauu

SEQ ID NO: 1770474 - RNA, 13 nt, Salmonella enterica enterica serovar Typhi Ty2
aagcuuguagaaa

SEQ ID NO: 1770475 - RNA, 21 nt, Salmonella enterica enterica serovar Typhi Ty2
aagcuggauaccgcgccagcg

SEQ ID NO: 1770476 - RNA, 18 nt, Salmonella enterica enterica serovar Typhi Ty2
aagcuggccuucagguuu

SEQ ID NO: 1770477 - RNA, 20 nt, Salmonella enterica enterica serovar Typhi Ty2
aagcugggcgucaacgugaa

SEQ ID NO: 1770478 - RNA, 18 nt, Salmonella enterica enterica serovar Typhi Ty2
aagcugguagucgagggu

SEQ ID NO: 1770479 - RNA, 19 nt, Salmonella enterica enterica serovar Typhi Ty2
aagcuggucgagauacugc

SEQ ID NO: 1770480 - RNA, 23 nt, Salmonella enterica enterica serovar Typhi Ty2
aagcugguuaaugaccugccgcg

SEQ ID NO: 1770481 - RNA, 17 nt, Salmonella enterica enterica serovar Typhi Ty2
aaggaugacuaaucaau

SEQ ID NO: 1770482 - RNA, 16 nt, Salmonella enterica enterica serovar Typhi Ty2
aaggaugacuaaucaa

SEQ ID NO: 1770483 - RNA, 12 nt, Salmonella enterica enterica serovar Typhi Ty2
aaggauauugcc

SEQ ID NO: 1770484 - RNA, 19 nt, Salmonella enterica enterica serovar Typhi Ty2
aaggaugaacucuaugcaa

SEQ ID NO: 1770485 - RNA, 14 nt, Salmonella enterica enterica serovar Typhi Ty2
aaggacaagcugcg

SEQ ID NO: 1770486 - RNA, 20 nt, Salmonella enterica enterica serovar Typhi Ty2
aaggacaagcugauuuuucg

SEQ ID NO: 1770487 - RNA, 18 nt, Salmonella enterica enterica serovar Typhi Ty2
aaggauauguauuuguuc

SEQ ID NO: 1770488 - RNA, 13 nt, Salmonella enterica enterica serovar Typhi Ty2
aaggaagggcgcu

SEQ ID NO: 1770489 - RNA, 14 nt, Salmonella enterica enterica serovar Typhi Ty2
aaggccgagcgaag

SEQ ID NO: 1770490 - RNA, 20 nt, Salmonella enterica enterica serovar Typhi Ty2
aaggccggcagccgcugaua

SEQ ID NO: 1770491 - RNA, 14 nt, Salmonella enterica enterica serovar Typhi Ty2
aaggcuccauauca

SEQ ID NO: 1770492 - RNA, 17 nt, Salmonella enterica enterica serovar Typhi Ty2
aaggcuggcacguucuc

SEQ ID NO: 1770493 - RNA, 18 nt, Salmonella enterica enterica serovar Typhi Ty2
aaggcagcgaaagcugcc

SEQ ID NO: 1770494 - RNA, 20 nt, Salmonella enterica enterica serovar Typhi Ty2
aaggcaucuucagacaguuu

SEQ ID NO: 1770495 - RNA, 14 nt, Salmonella enterica enterica serovar Typhi Ty2
aaggcaucuucaga

SEQ ID NO: 1770496 - RNA, 20 nt, Salmonella enterica enterica serovar Typhi Ty2
aaggcaucguugagaaaacc

SEQ ID NO: 1770497 - RNA, 17 nt, Salmonella enterica enterica serovar Typhi Ty2
aaggccaaguuuagaaa

SEQ ID NO: 1770498 - RNA, 19 nt, Salmonella enterica enterica serovar Typhi Ty2
aaggcauuucaaucgccac

SEQ ID NO: 1770499 - RNA, 22 nt, Salmonella enterica enterica serovar Typhi Ty2
aaggcauuaagucauaccuguu

SEQ ID NO: 1770500 - RNA, 15 nt, Salmonella enterica enterica serovar Typhi Ty2
aaggcauucacgcca

SEQ ID NO: 1770501 - RNA, 17 nt, Salmonella enterica enterica serovar Typhi Ty2
aaggcacgcuccugcuc

SEQ ID NO: 1770502 - RNA, 17 nt, Salmonella enterica enterica serovar Typhi Ty2
aaggcaccgguuuuuga

SEQ ID NO: 1770503 - RNA, 21 nt, Salmonella enterica enterica serovar Typhi Ty2
aaguuacaggcuccaaguauu

SEQ ID NO: 1770504 - RNA, 14 nt, Salmonella enterica enterica serovar Typhi Ty2
aaguuaaaacgcca

SEQ ID NO: 1770505 - RNA, 18 nt, Salmonella enterica enterica serovar Typhi Ty2
aaguugacuuuuacgcca

SEQ ID NO: 1770506 - RNA, 15 nt, Salmonella enterica enterica serovar Typhi Ty2
aaguucauaaaugua

SEQ ID NO: 1770507 - RNA, 17 nt, Salmonella enterica enterica serovar Typhi Ty2
aagugcgcacucagaaa

SEQ ID NO: 1770508 - RNA, 21 nt, Salmonella enterica enterica serovar Typhi Ty2
aagugaagaaucuguauaaaa

SEQ ID NO: 1770509 - RNA, 20 nt, Salmonella enterica enterica serovar Typhi Ty2
aagucgaaauuuucuucuuc

SEQ ID NO: 1770510 - RNA, 21 nt, Salmonella enterica enterica serovar Typhi Ty2
aagucgccaugaguucaauau

SEQ ID NO: 1770511 - RNA, 13 nt, Salmonella enterica enterica serovar Typhi Ty2
aagucgcgcauaa

SEQ ID NO: 1770512 - RNA, 17 nt, Salmonella enterica enterica serovar Typhi Ty2
aagucauccagacuaac

SEQ ID NO: 1770513 - RNA, 16 nt, Salmonella enterica enterica serovar Typhi Ty2
aagucauaccuguucc

SEQ ID NO: 1770514 - RNA, 20 nt, Salmonella enterica enterica serovar Typhi Ty2
aagucaucuguucaacuuuu

SEQ ID NO: 1770515 - RNA, 14 nt, Salmonella enterica enterica serovar Typhi Ty2
aagucaucugccag

SEQ ID NO: 1770516 - RNA, 16 nt, Salmonella enterica enterica serovar Typhi Ty2
aaguccuucuuccccc

SEQ ID NO: 1770517 - RNA, 15 nt, Salmonella enterica enterica serovar Typhi Ty2
aaguccuucuucccc

SEQ ID NO: 1770518 - RNA, 17 nt, Salmonella enterica enterica serovar Typhi Ty2
aaguccguauuauccac

SEQ ID NO: 1770519 - RNA, 17 nt, Salmonella enterica enterica serovar Typhi Ty2
aaguccuaacaccugcc

SEQ ID NO: 1770520 - RNA, 18 nt, Salmonella enterica enterica serovar Typhi Ty2
aagucccuggcgcgccag

SEQ ID NO: 1770521 - RNA, 17 nt, Salmonella enterica enterica serovar Typhi Ty2
aaguaucagcgcgcuuu

SEQ ID NO: 1770522 - RNA, 16 nt, Salmonella enterica enterica serovar Typhi Ty2
aaguauaaucauaccg

SEQ ID NO: 1770523 - RNA, 19 nt, Salmonella enterica enterica serovar Typhi Ty2
aaguaugccgcacaaaauu

SEQ ID NO: 1770524 - RNA, 23 nt, Salmonella enterica enterica serovar Typhi Ty2
aaguaguuggugggugaugacgg

SEQ ID NO: 1770525 - RNA, 22 nt, Salmonella enterica enterica serovar Typhi Ty2
aaguagcugaaaaucaaaucgg

SEQ ID NO: 1770526 - RNA, 16 nt, Salmonella enterica enterica serovar Typhi Ty2
aagucacuuacuuucu

SEQ ID NO: 1770527 - RNA, 12 nt, Salmonella enterica enterica serovar Typhi Ty2
aagucagacaag

SEQ ID NO: 1770528 - RNA, 21 nt, Salmonella enterica enterica serovar Typhi Ty2
aagucaacugcucuaccaacu

SEQ ID NO: 1770529 - RNA, 14 nt, Salmonella enterica enterica serovar Typhi Ty2
aagucaccaucagu

SEQ ID NO: 1770530 - RNA, 16 nt, Salmonella enterica enterica serovar Typhi Ty2
aagucaaaauaaaauu

SEQ ID NO: 1770531 - RNA, 13 nt, Salmonella enterica enterica serovar Typhi Ty2
aagguuuuucccg

SEQ ID NO: 1770532 - RNA, 22 nt, Salmonella enterica enterica serovar Typhi Ty2
aaggggccacaggcggcauggg

SEQ ID NO: 1770533 - RNA, 14 nt, Salmonella enterica enterica serovar Typhi Ty2
aagggaaaagccau

SEQ ID NO: 1770534 - RNA, 12 nt, Salmonella enterica enterica serovar Typhi Ty2
aagggcgcugcc

SEQ ID NO: 1770535 - RNA, 18 nt, Salmonella enterica enterica serovar Typhi Ty2
aaggggauaacaaccagg

SEQ ID NO: 1770536 - RNA, 15 nt, Salmonella enterica enterica serovar Typhi Ty2
aaggggccguagaaa

SEQ ID NO: 1770537 - RNA, 18 nt, Salmonella enterica enterica serovar Typhi Ty2
aaguaccaaaacagaaaa

SEQ ID NO: 1770538 - RNA, 22 nt, Salmonella enterica enterica serovar Typhi Ty2
aaguaccgugaagaaacggaaa

SEQ ID NO: 1770539 - RNA, 22 nt, Salmonella enterica enterica serovar Typhi Ty2
aaguaccagcgcgaacauuaca

SEQ ID NO: 1770540 - RNA, 19 nt, Salmonella enterica enterica serovar Typhi Ty2
aaguaauuuccauauuuau

SEQ ID NO: 1770541 - RNA, 19 nt, Salmonella enterica enterica serovar Typhi Ty2
aaguacgccugaaaacaga

SEQ ID NO: 1770542 - RNA, 15 nt, Salmonella enterica enterica serovar Typhi Ty2
aaguagcagagaaaa

SEQ ID NO: 1770543 - RNA, 14 nt, Salmonella enterica enterica serovar Typhi Ty2
aauauccccugaca

SEQ ID NO: 1770544 - RNA, 23 nt, Salmonella enterica enterica serovar Typhi Ty2
aauaucccgcaagaaacaggcug

SEQ ID NO: 1770545 - RNA, 19 nt, Salmonella enterica enterica serovar Typhi Ty2
aauauccgccccgcuggcu

SEQ ID NO: 1770546 - RNA, 20 nt, Salmonella enterica enterica serovar Typhi Ty2
aauauccgguacaccaacua

SEQ ID NO: 1770547 - RNA, 19 nt, Salmonella enterica enterica serovar Typhi Ty2
aauauccuguaacucaucu

SEQ ID NO: 1770548 - RNA, 20 nt, Salmonella enterica enterica serovar Typhi Ty2
aauaucauucgcgucauacu

SEQ ID NO: 1770549 - RNA, 22 nt, Salmonella enterica enterica serovar Typhi Ty2
aauaucauucgcgucauacuua

SEQ ID NO: 1770550 - RNA, 20 nt, Salmonella enterica enterica serovar Typhi Ty2
aauaucauugaggucuuugc

SEQ ID NO: 1770551 - RNA, 22 nt, Salmonella enterica enterica serovar Typhi Ty2
aauaucaucgucauuaaugccu

SEQ ID NO: 1770552 - RNA, 14 nt, Salmonella enterica enterica serovar Typhi Ty2
aauaucaugaauaa

SEQ ID NO: 1770553 - RNA, 13 nt, Salmonella enterica enterica serovar Typhi Ty2
aauauccccugac

SEQ ID NO: 1770554 - RNA, 21 nt, Salmonella enterica enterica serovar Typhi Ty2
aauaucauccgguaucaugcu

SEQ ID NO: 1770555 - RNA, 21 nt, Salmonella enterica enterica serovar Typhi Ty2
aauaucgcggaaauucacuuc

SEQ ID NO: 1770556 - RNA, 17 nt, Salmonella enterica enterica serovar Typhi Ty2
aauaucggguauccauu

SEQ ID NO: 1770557 - RNA, 14 nt, Salmonella enterica enterica serovar Typhi Ty2
aauaucggcaaagu

SEQ ID NO: 1770558 - RNA, 15 nt, Salmonella enterica enterica serovar Typhi Ty2
aauaucgcugccggu

SEQ ID NO: 1770559 - RNA, 12 nt, Salmonella enterica enterica serovar Typhi Ty2
aauauccuucag

SEQ ID NO: 1770560 - RNA, 12 nt, Salmonella enterica enterica serovar Typhi Ty2
aauaucucuccc

SEQ ID NO: 1770561 - RNA, 14 nt, Salmonella enterica enterica serovar Typhi Ty2
aauaugaaagagaa

SEQ ID NO: 1770562 - RNA, 11 nt, Salmonella enterica enterica serovar Typhi Ty2
aauaugaaauu

SEQ ID NO: 1770563 - RNA, 14 nt, Salmonella enterica enterica serovar Typhi Ty2
aauauaaccaauuu

SEQ ID NO: 1770564 - RNA, 14 nt, Salmonella enterica enterica serovar Typhi Ty2
aauauaaucuacca

SEQ ID NO: 1770565 - RNA, 19 nt, Salmonella enterica enterica serovar Typhi Ty2
aauauagcuaaugcaauaa

SEQ ID NO: 1770566 - RNA, 16 nt, Salmonella enterica enterica serovar Typhi Ty2
aauauagcuaaugcaa

SEQ ID NO: 1770567 - RNA, 18 nt, Salmonella enterica enterica serovar Typhi Ty2
aauauacauucauuuuau

SEQ ID NO: 1770568 - RNA, 21 nt, Salmonella enterica enterica serovar Typhi Ty2
aauauacauucauuuuaucga

SEQ ID NO: 1770569 - RNA, 12 nt, Salmonella enterica enterica serovar Typhi Ty2
aauauacauuca

SEQ ID NO: 1770570 - RNA, 20 nt, Salmonella enterica enterica serovar Typhi Ty2
aauauacaccugacggcagc

SEQ ID NO: 1770571 - RNA, 14 nt, Salmonella enterica enterica serovar Typhi Ty2
aauauacgccaccu

SEQ ID NO: 1770572 - RNA, 22 nt, Salmonella enterica enterica serovar Typhi Ty2
aauauaucgcaggaugcgcugc

SEQ ID NO: 1770573 - RNA, 17 nt, Salmonella enterica enterica serovar Typhi Ty2
aauauaucuguuccaca

SEQ ID NO: 1770574 - RNA, 19 nt, Salmonella enterica enterica serovar Typhi Ty2
aauauaguuagaaaauacu

SEQ ID NO: 1770575 - RNA, 15 nt, Salmonella enterica enterica serovar Typhi Ty2
aauauaguuagaaaa

SEQ ID NO: 1770576 - RNA, 18 nt, Salmonella enterica enterica serovar Typhi Ty2
aauauaguuagaaaauac

SEQ ID NO: 1770577 - RNA, 11 nt, Salmonella enterica enterica serovar Typhi Ty2
aauauaugagc

SEQ ID NO: 1770578 - RNA, 16 nt, Salmonella enterica enterica serovar Typhi Ty2
aauauaugaaccaaga

SEQ ID NO: 1770579 - RNA, 15 nt, Salmonella enterica enterica serovar Typhi Ty2
aauaguuacuguuuc

SEQ ID NO: 1770580 - RNA, 15 nt, Salmonella enterica enterica serovar Typhi Ty2
aauaguucagcgcag

SEQ ID NO: 1770581 - RNA, 21 nt, Salmonella enterica enterica serovar Typhi Ty2
aauagugggguguaaagucgg

SEQ ID NO: 1770582 - RNA, 21 nt, Salmonella enterica enterica serovar Typhi Ty2
aauaguauccauaauuuuccc

SEQ ID NO: 1770583 - RNA, 14 nt, Salmonella enterica enterica serovar Typhi Ty2
aauagugcaggaag

SEQ ID NO: 1770584 - RNA, 20 nt, Salmonella enterica enterica serovar Typhi Ty2
aauagcuuuuuacucagggc

SEQ ID NO: 1770585 - RNA, 22 nt, Salmonella enterica enterica serovar Typhi Ty2
aauagcuuuuuacucagggcaa

SEQ ID NO: 1770586 - RNA, 14 nt, Salmonella enterica enterica serovar Typhi Ty2
aauaguaaauagaa

SEQ ID NO: 1770587 - RNA, 16 nt, Salmonella enterica enterica serovar Typhi Ty2
aauaguaaauagaaaa

SEQ ID NO: 1770588 - RNA, 13 nt, Salmonella enterica enterica serovar Typhi Ty2
aauagguugaaag

SEQ ID NO: 1770589 - RNA, 18 nt, Salmonella enterica enterica serovar Typhi Ty2
aauaguaaauagaaaaua

SEQ ID NO: 1770590 - RNA, 22 nt, Salmonella enterica enterica serovar Typhi Ty2
aauaccuccuggcguuaucauc

SEQ ID NO: 1770591 - RNA, 18 nt, Salmonella enterica enterica serovar Typhi Ty2
aauagaauaggaaauaau

SEQ ID NO: 1770592 - RNA, 20 nt, Salmonella enterica enterica serovar Typhi Ty2
aauaccuuauucagcccacg

SEQ ID NO: 1770593 - RNA, 13 nt, Salmonella enterica enterica serovar Typhi Ty2
aauagagaaaaua

SEQ ID NO: 1770594 - RNA, 14 nt, Salmonella enterica enterica serovar Typhi Ty2
aauagacagugauu

SEQ ID NO: 1770595 - RNA, 19 nt, Salmonella enterica enterica serovar Typhi Ty2
aauagacgagcgaaaaacu

SEQ ID NO: 1770596 - RNA, 18 nt, Salmonella enterica enterica serovar Typhi Ty2
aauagauaugaaagaagg

SEQ ID NO: 1770597 - RNA, 17 nt, Salmonella enterica enterica serovar Typhi Ty2
aauagcuggcugucuuc

SEQ ID NO: 1770598 - RNA, 12 nt, Salmonella enterica enterica serovar Typhi Ty2
aauagcugaaaa

SEQ ID NO: 1770599 - RNA, 14 nt, Salmonella enterica enterica serovar Typhi Ty2
aauagccggauaaa

SEQ ID NO: 1770600 - RNA, 19 nt, Salmonella enterica enterica serovar Typhi Ty2
aauagccugggcaaggcug

SEQ ID NO: 1770601 - RNA, 22 nt, Salmonella enterica enterica serovar Typhi Ty2
aauagcgaacaguccaugauga

SEQ ID NO: 1770602 - RNA, 15 nt, Salmonella enterica enterica serovar Typhi Ty2
aauagcggcuaauca

SEQ ID NO: 1770603 - RNA, 17 nt, Salmonella enterica enterica serovar Typhi Ty2
aauagcggcacagauac

SEQ ID NO: 1770604 - RNA, 22 nt, Salmonella enterica enterica serovar Typhi Ty2
aaaaauggguaugcgacugaaa

SEQ ID NO: 1770605 - RNA, 21 nt, Salmonella enterica enterica serovar Typhi Ty2
aauaccguggucuccgccugg

SEQ ID NO: 1770606 - RNA, 14 nt, Salmonella enterica enterica serovar Typhi Ty2
aauaccgugcagga

SEQ ID NO: 1770607 - RNA, 18 nt, Salmonella enterica enterica serovar Typhi Ty2
aauacccauuucuucuuc

SEQ ID NO: 1770608 - RNA, 22 nt, Salmonella enterica enterica serovar Typhi Ty2
aaaaaugauguguuucagcagc

SEQ ID NO: 1770609 - RNA, 16 nt, Salmonella enterica enterica serovar Typhi Ty2
aauaccaggcacuuga

SEQ ID NO: 1770610 - RNA, 17 nt, Salmonella enterica enterica serovar Typhi Ty2
aauacacgauaaaccuc

SEQ ID NO: 1770611 - RNA, 15 nt, Salmonella enterica enterica serovar Typhi Ty2
aauacacaaugcuuc

SEQ ID NO: 1770612 - RNA, 13 nt, Salmonella enterica enterica serovar Typhi Ty2
aauaccaauaaga

SEQ ID NO: 1770613 - RNA, 22 nt, Salmonella enterica enterica serovar Typhi Ty2
aauaccaaagcccgcaaacaga

SEQ ID NO: 1770614 - RNA, 17 nt, Salmonella enterica enterica serovar Typhi Ty2
aauaccaaauauuucuu

SEQ ID NO: 1770615 - RNA, 13 nt, Salmonella enterica enterica serovar Typhi Ty2
aauaccacaaauu

SEQ ID NO: 1770616 - RNA, 14 nt, Salmonella enterica enterica serovar Typhi Ty2
aauaccagcggcaa

SEQ ID NO: 1770617 - RNA, 14 nt, Salmonella enterica enterica serovar Typhi Ty2
aaaaauagcauuaa

SEQ ID NO: 1770618 - RNA, 13 nt, Salmonella enterica enterica serovar Typhi Ty2
aaaaauaggcuuu

SEQ ID NO: 1770619 - RNA, 19 nt, Salmonella enterica enterica serovar Typhi Ty2
aauaaugaagacguugaau

SEQ ID NO: 1770620 - RNA, 12 nt, Salmonella enterica enterica serovar Typhi Ty2
aauaaugacuaa

SEQ ID NO: 1770621 - RNA, 14 nt, Salmonella enterica enterica serovar Typhi Ty2
aauaaugcaaugcc

SEQ ID NO: 1770622 - RNA, 17 nt, Salmonella enterica enterica serovar Typhi Ty2
aauaauguaaaaaaaua

SEQ ID NO: 1770623 - RNA, 20 nt, Salmonella enterica enterica serovar Typhi Ty2
aauaauggcgcgaaaacagc

SEQ ID NO: 1770624 - RNA, 19 nt, Salmonella enterica enterica serovar Typhi Ty2
aauaauggagaugaaaaua

SEQ ID NO: 1770625 - RNA, 14 nt, Salmonella enterica enterica serovar Typhi Ty2
aauaauuuuguuaa

SEQ ID NO: 1770626 - RNA, 13 nt, Salmonella enterica enterica serovar Typhi Ty2
aaaaauaaaaacc

SEQ ID NO: 1770627 - RNA, 13 nt, Salmonella enterica enterica serovar Typhi Ty2
aaaaauaaaaaaa

SEQ ID NO: 1770628 - RNA, 14 nt, Salmonella enterica enterica serovar Typhi Ty2
aauaagccagacuc

SEQ ID NO: 1770629 - RNA, 22 nt, Salmonella enterica enterica serovar Typhi Ty2
aauaagcagaacguagcccauu

SEQ ID NO: 1770630 - RNA, 12 nt, Salmonella enterica enterica serovar Typhi Ty2
aauaagcgaauu

SEQ ID NO: 1770631 - RNA, 15 nt, Salmonella enterica enterica serovar Typhi Ty2
aauaagcgcucaggc

SEQ ID NO: 1770632 - RNA, 19 nt, Salmonella enterica enterica serovar Typhi Ty2
aauaagcgcccaugaagau

SEQ ID NO: 1770633 - RNA, 20 nt, Salmonella enterica enterica serovar Typhi Ty2
aauaagggcauguuucaugu

SEQ ID NO: 1770634 - RNA, 13 nt, Salmonella enterica enterica serovar Typhi Ty2
aauaaggcuggca

SEQ ID NO: 1770635 - RNA, 21 nt, Salmonella enterica enterica serovar Typhi Ty2
aauaaguuagcuuuuuuaugc

SEQ ID NO: 1770636 - RNA, 20 nt, Salmonella enterica enterica serovar Typhi Ty2
aauaauaaaacgacucauca

SEQ ID NO: 1770637 - RNA, 19 nt, Salmonella enterica enterica serovar Typhi Ty2
aauaaccccagcugcggca

SEQ ID NO: 1770638 - RNA, 19 nt, Salmonella enterica enterica serovar Typhi Ty2
aauaacuccagugcagaaa

SEQ ID NO: 1770639 - RNA, 15 nt, Salmonella enterica enterica serovar Typhi Ty2
aauaaccaccuguuc

SEQ ID NO: 1770640 - RNA, 14 nt, Salmonella enterica enterica serovar Typhi Ty2
aauaaccccagcug

SEQ ID NO: 1770641 - RNA, 21 nt, Salmonella enterica enterica serovar Typhi Ty2
aauaacuuuuaauuuuuaugu

SEQ ID NO: 1770642 - RNA, 14 nt, Salmonella enterica enterica serovar Typhi Ty2
aauaagaaacugcu

SEQ ID NO: 1770643 - RNA, 18 nt, Salmonella enterica enterica serovar Typhi Ty2
aauaagaagguuaauaua

SEQ ID NO: 1770644 - RNA, 21 nt, Salmonella enterica enterica serovar Typhi Ty2
aauaagaagguuaauauacau

SEQ ID NO: 1770645 - RNA, 16 nt, Salmonella enterica enterica serovar Typhi Ty2
aauaagaacuuuauca

SEQ ID NO: 1770646 - RNA, 20 nt, Salmonella enterica enterica serovar Typhi Ty2
aauaagacauggaguuccag

SEQ ID NO: 1770647 - RNA, 15 nt, Salmonella enterica enterica serovar Typhi Ty2
aauaaaucaaugaaa

SEQ ID NO: 1770648 - RNA, 15 nt, Salmonella enterica enterica serovar Typhi Ty2
aaguuuaauuccgaa

SEQ ID NO: 1770649 - RNA, 12 nt, Salmonella enterica enterica serovar Typhi Ty2
aauaacaucuuc

SEQ ID NO: 1770650 - RNA, 22 nt, Salmonella enterica enterica serovar Typhi Ty2
aagagaggcuuuaugcugacaa

SEQ ID NO: 1770651 - RNA, 14 nt, Salmonella enterica enterica serovar Typhi Ty2
aagagagugagaaa

SEQ ID NO: 1770652 - RNA, 21 nt, Salmonella enterica enterica serovar Typhi Ty2
aagagagcaacauaccgcaga

SEQ ID NO: 1770653 - RNA, 12 nt, Salmonella enterica enterica serovar Typhi Ty2
aagagagcaaca

SEQ ID NO: 1770654 - RNA, 19 nt, Salmonella enterica enterica serovar Typhi Ty2
aagagauggaaugagcauc

SEQ ID NO: 1770655 - RNA, 14 nt, Salmonella enterica enterica serovar Typhi Ty2
aagagauuagaacg

SEQ ID NO: 1770656 - RNA, 21 nt, Salmonella enterica enterica serovar Typhi Ty2
aagagcacuuugguaaaacgg

SEQ ID NO: 1770657 - RNA, 15 nt, Salmonella enterica enterica serovar Typhi Ty2
aagagcguuacccag

SEQ ID NO: 1770658 - RNA, 16 nt, Salmonella enterica enterica serovar Typhi Ty2
aagagcguuacccaga

SEQ ID NO: 1770659 - RNA, 21 nt, Salmonella enterica enterica serovar Typhi Ty2
aagagcguccaguccuguccc

SEQ ID NO: 1770660 - RNA, 23 nt, Salmonella enterica enterica serovar Typhi Ty2
aagagcggcgaguuguuucaaca

SEQ ID NO: 1770661 - RNA, 21 nt, Salmonella enterica enterica serovar Typhi Ty2
aagaguaucucucuggcgcau

SEQ ID NO: 1770662 - RNA, 15 nt, Salmonella enterica enterica serovar Typhi Ty2
aagagguauccugaa

SEQ ID NO: 1770663 - RNA, 21 nt, Salmonella enterica enterica serovar Typhi Ty2
aagaggcauaaaaaaaagccg

SEQ ID NO: 1770664 - RNA, 12 nt, Salmonella enterica enterica serovar Typhi Ty2
aagaggcagcaa

SEQ ID NO: 1770665 - RNA, 14 nt, Salmonella enterica enterica serovar Typhi Ty2
aagauaaagauauu

SEQ ID NO: 1770666 - RNA, 15 nt, Salmonella enterica enterica serovar Typhi Ty2
aagauaaaaagacag

SEQ ID NO: 1770667 - RNA, 16 nt, Salmonella enterica enterica serovar Typhi Ty2
aagauaaacagcagcg

SEQ ID NO: 1770668 - RNA, 14 nt, Salmonella enterica enterica serovar Typhi Ty2
aagauaagaaguaa

SEQ ID NO: 1770669 - RNA, 17 nt, Salmonella enterica enterica serovar Typhi Ty2
aagauaaccauuucaaa

SEQ ID NO: 1770670 - RNA, 20 nt, Salmonella enterica enterica serovar Typhi Ty2
aagaguccauucggccugcg

SEQ ID NO: 1770671 - RNA, 19 nt, Salmonella enterica enterica serovar Typhi Ty2
aagagugacgguuuucacu

SEQ ID NO: 1770672 - RNA, 12 nt, Salmonella enterica enterica serovar Typhi Ty2
aagauaaaauac

SEQ ID NO: 1770673 - RNA, 11 nt, Salmonella enterica enterica serovar Typhi Ty2
aagaguuaacu

SEQ ID NO: 1770674 - RNA, 22 nt, Salmonella enterica enterica serovar Typhi Ty2
aagauauuuuguuuuaaauuca

SEQ ID NO: 1770675 - RNA, 19 nt, Salmonella enterica enterica serovar Typhi Ty2
aagaaucuguauaaaauau

SEQ ID NO: 1770676 - RNA, 17 nt, Salmonella enterica enterica serovar Typhi Ty2
aagaaucgccagucgca

SEQ ID NO: 1770677 - RNA, 19 nt, Salmonella enterica enterica serovar Typhi Ty2
aagaaucgauguaguuguu

SEQ ID NO: 1770678 - RNA, 18 nt, Salmonella enterica enterica serovar Typhi Ty2
aagaaaccgcagaaaaag

SEQ ID NO: 1770679 - RNA, 16 nt, Salmonella enterica enterica serovar Typhi Ty2
aagacaacguaaacgg

SEQ ID NO: 1770680 - RNA, 20 nt, Salmonella enterica enterica serovar Typhi Ty2
aagaauuugaacucuuucag

SEQ ID NO: 1770681 - RNA, 14 nt, Salmonella enterica enterica serovar Typhi Ty2
aagaauuucaauca

SEQ ID NO: 1770682 - RNA, 18 nt, Salmonella enterica enterica serovar Typhi Ty2
aagaauuucaaucaucau

SEQ ID NO: 1770683 - RNA, 23 nt, Salmonella enterica enterica serovar Typhi Ty2
aagacauucacauauauuucugu

SEQ ID NO: 1770684 - RNA, 16 nt, Salmonella enterica enterica serovar Typhi Ty2
aagacauggaguucca

SEQ ID NO: 1770685 - RNA, 13 nt, Salmonella enterica enterica serovar Typhi Ty2
aagaccagauuaa

SEQ ID NO: 1770686 - RNA, 14 nt, Salmonella enterica enterica serovar Typhi Ty2
aagacccgaaccug

SEQ ID NO: 1770687 - RNA, 16 nt, Salmonella enterica enterica serovar Typhi Ty2
aagaccugcuucaggu

SEQ ID NO: 1770688 - RNA, 17 nt, Salmonella enterica enterica serovar Typhi Ty2
aagaccgauagagacug

SEQ ID NO: 1770689 - RNA, 19 nt, Salmonella enterica enterica serovar Typhi Ty2
aagacgcucgacguccagc

SEQ ID NO: 1770690 - RNA, 20 nt, Salmonella enterica enterica serovar Typhi Ty2
aagacgguuauuuuucagau

SEQ ID NO: 1770691 - RNA, 17 nt, Salmonella enterica enterica serovar Typhi Ty2
aagacgguuauuuuuca

SEQ ID NO: 1770692 - RNA, 22 nt, Salmonella enterica enterica serovar Typhi Ty2
aagaccugcuucagguuaagug

SEQ ID NO: 1770693 - RNA, 16 nt, Salmonella enterica enterica serovar Typhi Ty2
aagacuccggcagcau

SEQ ID NO: 1770694 - RNA, 15 nt, Salmonella enterica enterica serovar Typhi Ty2
aagacuacgcaaaaa

SEQ ID NO: 1770695 - RNA, 20 nt, Salmonella enterica enterica serovar Typhi Ty2
aagacgguuucagugauaaa

SEQ ID NO: 1770696 - RNA, 18 nt, Salmonella enterica enterica serovar Typhi Ty2
aagacugcuccggcaaga

SEQ ID NO: 1770697 - RNA, 13 nt, Salmonella enterica enterica serovar Typhi Ty2
aagacuggcaacc

SEQ ID NO: 1770698 - RNA, 15 nt, Salmonella enterica enterica serovar Typhi Ty2
aagacuuagcccugg

SEQ ID NO: 1770699 - RNA, 17 nt, Salmonella enterica enterica serovar Typhi Ty2
aagagaacguucguugu

SEQ ID NO: 1770700 - RNA, 14 nt, Salmonella enterica enterica serovar Typhi Ty2
aagagaaaauaccg

SEQ ID NO: 1770701 - RNA, 16 nt, Salmonella enterica enterica serovar Typhi Ty2
aagagaaacauacugu

SEQ ID NO: 1770702 - RNA, 21 nt, Salmonella enterica enterica serovar Typhi Ty2
aacuccucacugcguaaaauc

SEQ ID NO: 1770703 - RNA, 15 nt, Salmonella enterica enterica serovar Typhi Ty2
aacuccucuuccgac

SEQ ID NO: 1770704 - RNA, 16 nt, Salmonella enterica enterica serovar Typhi Ty2
aacuccugggcaaaau

SEQ ID NO: 1770705 - RNA, 16 nt, Salmonella enterica enterica serovar Typhi Ty2
aacucgcacaguacac

SEQ ID NO: 1770706 - RNA, 18 nt, Salmonella enterica enterica serovar Typhi Ty2
aacucgcuguggccaggc

SEQ ID NO: 1770707 - RNA, 20 nt, Salmonella enterica enterica serovar Typhi Ty2
aacucuuccccgaucagaaa

SEQ ID NO: 1770708 - RNA, 18 nt, Salmonella enterica enterica serovar Typhi Ty2
aacugaccauauaugaaa

SEQ ID NO: 1770709 - RNA, 15 nt, Salmonella enterica enterica serovar Typhi Ty2
aacugagcgccaauu

SEQ ID NO: 1770710 - RNA, 14 nt, Salmonella enterica enterica serovar Typhi Ty2
aacucuaugcaaaa

SEQ ID NO: 1770711 - RNA, 20 nt, Salmonella enterica enterica serovar Typhi Ty2
aacucucguucggucaggau

SEQ ID NO: 1770712 - RNA, 18 nt, Salmonella enterica enterica serovar Typhi Ty2
aacggcugacgcccauca

SEQ ID NO: 1770713 - RNA, 12 nt, Salmonella enterica enterica serovar Typhi Ty2
aacggcucugca

SEQ ID NO: 1770714 - RNA, 23 nt, Salmonella enterica enterica serovar Typhi Ty2
aacggcggaaccauuuuccccag

SEQ ID NO: 1770715 - RNA, 18 nt, Salmonella enterica enterica serovar Typhi Ty2
aacggcuuuccagcagcc

SEQ ID NO: 1770716 - RNA, 15 nt, Salmonella enterica enterica serovar Typhi Ty2
aacgggcggcggcuu

SEQ ID NO: 1770717 - RNA, 12 nt, Salmonella enterica enterica serovar Typhi Ty2
aacucaagguag

SEQ ID NO: 1770718 - RNA, 22 nt, Salmonella enterica enterica serovar Typhi Ty2
aacuauguacgccaagcugcaa

SEQ ID NO: 1770719 - RNA, 21 nt, Salmonella enterica enterica serovar Typhi Ty2
aacuauaauugcuuuuuucca

SEQ ID NO: 1770720 - RNA, 13 nt, Salmonella enterica enterica serovar Typhi Ty2
aacucaucacagc

SEQ ID NO: 1770721 - RNA, 20 nt, Salmonella enterica enterica serovar Typhi Ty2
aacucaucgcuuagcggcuc

SEQ ID NO: 1770722 - RNA, 18 nt, Salmonella enterica enterica serovar Typhi Ty2
aacucaucggaacaguaa

SEQ ID NO: 1770723 - RNA, 23 nt, Salmonella enterica enterica serovar Typhi Ty2
aacucaugacuucacacuguggu

SEQ ID NO: 1770724 - RNA, 20 nt, Salmonella enterica enterica serovar Typhi Ty2
aacucagcaauauuuuguag

SEQ ID NO: 1770725 - RNA, 12 nt, Salmonella enterica enterica serovar Typhi Ty2
aacucagcaaua

SEQ ID NO: 1770726 - RNA, 17 nt, Salmonella enterica enterica serovar Typhi Ty2
aacucacguuccccagc

SEQ ID NO: 1770727 - RNA, 19 nt, Salmonella enterica enterica serovar Typhi Ty2
aacucacguuccccagcac

SEQ ID NO: 1770728 - RNA, 15 nt, Salmonella enterica enterica serovar Typhi Ty2
aacuuuaucaccagc

SEQ ID NO: 1770729 - RNA, 15 nt, Salmonella enterica enterica serovar Typhi Ty2
aacuuucagaauaau

SEQ ID NO: 1770730 - RNA, 16 nt, Salmonella enterica enterica serovar Typhi Ty2
aacuuucauuucacuu

SEQ ID NO: 1770731 - RNA, 16 nt, Salmonella enterica enterica serovar Typhi Ty2
aacuuuaacacuaacu

SEQ ID NO: 1770732 - RNA, 14 nt, Salmonella enterica enterica serovar Typhi Ty2
aacugucugaauca

SEQ ID NO: 1770733 - RNA, 13 nt, Salmonella enterica enterica serovar Typhi Ty2
aacugucagauca

SEQ ID NO: 1770734 - RNA, 18 nt, Salmonella enterica enterica serovar Typhi Ty2
aacugugcgacaaccugc

SEQ ID NO: 1770735 - RNA, 21 nt, Salmonella enterica enterica serovar Typhi Ty2
aacuguagaaugcuauaugca

SEQ ID NO: 1770736 - RNA, 23 nt, Salmonella enterica enterica serovar Typhi Ty2
aacuguauccguaauaugaugca

SEQ ID NO: 1770737 - RNA, 19 nt, Salmonella enterica enterica serovar Typhi Ty2
aacugccccuugucguaau

SEQ ID NO: 1770738 - RNA, 20 nt, Salmonella enterica enterica serovar Typhi Ty2
aacugauaguuuaaauccag

SEQ ID NO: 1770739 - RNA, 21 nt, Salmonella enterica enterica serovar Typhi Ty2
aacugauaacgauaagugaag

SEQ ID NO: 1770740 - RNA, 14 nt, Salmonella enterica enterica serovar Typhi Ty2
aacugccaaaccac

SEQ ID NO: 1770741 - RNA, 22 nt, Salmonella enterica enterica serovar Typhi Ty2
aacuucacgccaucgacaaagg

SEQ ID NO: 1770742 - RNA, 14 nt, Salmonella enterica enterica serovar Typhi Ty2
aacuguuuuucacu

SEQ ID NO: 1770743 - RNA, 16 nt, Salmonella enterica enterica serovar Typhi Ty2
aacuguucagccagca

SEQ ID NO: 1770744 - RNA, 18 nt, Salmonella enterica enterica serovar Typhi Ty2
aacuguuaucauagacug

SEQ ID NO: 1770745 - RNA, 21 nt, Salmonella enterica enterica serovar Typhi Ty2
aacuuccaccaccuccugcug

SEQ ID NO: 1770746 - RNA, 18 nt, Salmonella enterica enterica serovar Typhi Ty2
aacuucaucguuacgcca

SEQ ID NO: 1770747 - RNA, 20 nt, Salmonella enterica enterica serovar Typhi Ty2
aacuucaugguacagaucca

SEQ ID NO: 1770748 - RNA, 13 nt, Salmonella enterica enterica serovar Typhi Ty2
aacuuccuuugcc

SEQ ID NO: 1770749 - RNA, 18 nt, Salmonella enterica enterica serovar Typhi Ty2
aacuucgcgguuagaaag

SEQ ID NO: 1770750 - RNA, 16 nt, Salmonella enterica enterica serovar Typhi Ty2
aacuuccaccaccucc

SEQ ID NO: 1770751 - RNA, 20 nt, Salmonella enterica enterica serovar Typhi Ty2
aacgcucuuaccgcuaaaau

SEQ ID NO: 1770752 - RNA, 15 nt, Salmonella enterica enterica serovar Typhi Ty2
aacgcuaggcaaccu

SEQ ID NO: 1770753 - RNA, 21 nt, Salmonella enterica enterica serovar Typhi Ty2
aacgcuaucaccgccgcccgu

SEQ ID NO: 1770754 - RNA, 19 nt, Salmonella enterica enterica serovar Typhi Ty2
aacgcucucuuuucuuacu

SEQ ID NO: 1770755 - RNA, 15 nt, Salmonella enterica enterica serovar Typhi Ty2
aacggccagcaaaau

SEQ ID NO: 1770756 - RNA, 17 nt, Salmonella enterica enterica serovar Typhi Ty2
aacggcgacaagaauau

SEQ ID NO: 1770757 - RNA, 20 nt, Salmonella enterica enterica serovar Typhi Ty2
aacggcgcaaagacagguga

SEQ ID NO: 1770758 - RNA, 20 nt, Salmonella enterica enterica serovar Typhi Ty2
aacggcagccgccaccacaa

SEQ ID NO: 1770759 - RNA, 15 nt, Salmonella enterica enterica serovar Typhi Ty2
aacggcaccagcaac

SEQ ID NO: 1770760 - RNA, 20 nt, Salmonella enterica enterica serovar Typhi Ty2
aacggcaauuuuuacaaauu

SEQ ID NO: 1770761 - RNA, 23 nt, Salmonella enterica enterica serovar Typhi Ty2
aacggcaaaucgcgguaaaaagc

SEQ ID NO: 1770762 - RNA, 23 nt, Salmonella enterica enterica serovar Typhi Ty2
aacgccaagcgcggcagcagcuu

SEQ ID NO: 1770763 - RNA, 21 nt, Salmonella enterica enterica serovar Typhi Ty2
aacgccaagcgcggcagcagc

SEQ ID NO: 1770764 - RNA, 15 nt, Salmonella enterica enterica serovar Typhi Ty2
aacgccaacgcccgg

SEQ ID NO: 1770765 - RNA, 23 nt, Salmonella enterica enterica serovar Typhi Ty2
aacgcgagaagaagaauuauuau

SEQ ID NO: 1770766 - RNA, 21 nt, Salmonella enterica enterica serovar Typhi Ty2
aacgcgaaaauaccccagcgc

SEQ ID NO: 1770767 - RNA, 16 nt, Salmonella enterica enterica serovar Typhi Ty2
aacgcgucuucaucag

SEQ ID NO: 1770768 - RNA, 21 nt, Salmonella enterica enterica serovar Typhi Ty2
aacgcgccaaguaaauuugcu

SEQ ID NO: 1770769 - RNA, 18 nt, Salmonella enterica enterica serovar Typhi Ty2
aacgcgcaucaacgccag

SEQ ID NO: 1770770 - RNA, 17 nt, Salmonella enterica enterica serovar Typhi Ty2
aacgcgcgacuuaucuu

SEQ ID NO: 1770771 - RNA, 13 nt, Salmonella enterica enterica serovar Typhi Ty2
aacgcgccacgcg

SEQ ID NO: 1770772 - RNA, 18 nt, Salmonella enterica enterica serovar Typhi Ty2
aacgcgcccaacggaugc

SEQ ID NO: 1770773 - RNA, 15 nt, Salmonella enterica enterica serovar Typhi Ty2
aacgacccaucaaua

SEQ ID NO: 1770774 - RNA, 14 nt, Salmonella enterica enterica serovar Typhi Ty2
aacgaccagaauca

SEQ ID NO: 1770775 - RNA, 13 nt, Salmonella enterica enterica serovar Typhi Ty2
aacgagauucaau

SEQ ID NO: 1770776 - RNA, 22 nt, Salmonella enterica enterica serovar Typhi Ty2
aacgagaauggaugugaauaaa

SEQ ID NO: 1770777 - RNA, 21 nt, Salmonella enterica enterica serovar Typhi Ty2
aacgacuacguucaucaggca

SEQ ID NO: 1770778 - RNA, 19 nt, Salmonella enterica enterica serovar Typhi Ty2
aacgauacagcacggcagu

SEQ ID NO: 1770779 - RNA, 20 nt, Salmonella enterica enterica serovar Typhi Ty2
aacgauaauaucgucaccag

SEQ ID NO: 1770780 - RNA, 14 nt, Salmonella enterica enterica serovar Typhi Ty2
aacgcacuaccaga

SEQ ID NO: 1770781 - RNA, 19 nt, Salmonella enterica enterica serovar Typhi Ty2
aacgcagaagacagaagcu

SEQ ID NO: 1770782 - RNA, 17 nt, Salmonella enterica enterica serovar Typhi Ty2
aacgaggccaccaucac

SEQ ID NO: 1770783 - RNA, 18 nt, Salmonella enterica enterica serovar Typhi Ty2
aacgcagcgcgcguagca

SEQ ID NO: 1770784 - RNA, 21 nt, Salmonella enterica enterica serovar Typhi Ty2
aacgcaggcgauagccccagu

SEQ ID NO: 1770785 - RNA, 15 nt, Salmonella enterica enterica serovar Typhi Ty2
aacgcauauccagca

SEQ ID NO: 1770786 - RNA, 22 nt, Salmonella enterica enterica serovar Typhi Ty2
aacgcaucaaauaccuuuucau

SEQ ID NO: 1770787 - RNA, 15 nt, Salmonella enterica enterica serovar Typhi Ty2
aacgcauccagcgca

SEQ ID NO: 1770788 - RNA, 18 nt, Salmonella enterica enterica serovar Typhi Ty2
aacgcauccagccacgua

SEQ ID NO: 1770789 - RNA, 20 nt, Salmonella enterica enterica serovar Typhi Ty2
aacgcaucugggcugagaaa

SEQ ID NO: 1770790 - RNA, 15 nt, Salmonella enterica enterica serovar Typhi Ty2
aaccguccacaucca

SEQ ID NO: 1770791 - RNA, 14 nt, Salmonella enterica enterica serovar Typhi Ty2
aaccguccacaucc

SEQ ID NO: 1770792 - RNA, 16 nt, Salmonella enterica enterica serovar Typhi Ty2
aaccguccacauccag

SEQ ID NO: 1770793 - RNA, 18 nt, Salmonella enterica enterica serovar Typhi Ty2
aaccgucucaccaggcgu

SEQ ID NO: 1770794 - RNA, 21 nt, Salmonella enterica enterica serovar Typhi Ty2
aaccgucgggcgucgccugcc

SEQ ID NO: 1770795 - RNA, 15 nt, Salmonella enterica enterica serovar Typhi Ty2
aaccgugcuucacgg

SEQ ID NO: 1770796 - RNA, 22 nt, Salmonella enterica enterica serovar Typhi Ty2
aaccguucaucuaucgccagcg

SEQ ID NO: 1770797 - RNA, 14 nt, Salmonella enterica enterica serovar Typhi Ty2
aaccguuaugaauc

SEQ ID NO: 1770798 - RNA, 15 nt, Salmonella enterica enterica serovar Typhi Ty2
aacccgccuucaguc

SEQ ID NO: 1770799 - RNA, 16 nt, Salmonella enterica enterica serovar Typhi Ty2
aaccggguugcggaag

SEQ ID NO: 1770800 - RNA, 22 nt, Salmonella enterica enterica serovar Typhi Ty2
aaccgguggucaucgcggccag

SEQ ID NO: 1770801 - RNA, 16 nt, Salmonella enterica enterica serovar Typhi Ty2
aaccuauuuugcaaaa

SEQ ID NO: 1770802 - RNA, 14 nt, Salmonella enterica enterica serovar Typhi Ty2
aaccuauuuuacaa

SEQ ID NO: 1770803 - RNA, 13 nt, Salmonella enterica enterica serovar Typhi Ty2
aaccuaaccaaac

SEQ ID NO: 1770804 - RNA, 20 nt, Salmonella enterica enterica serovar Typhi Ty2
aaccucaucccggcuuaaau

SEQ ID NO: 1770805 - RNA, 19 nt, Salmonella enterica enterica serovar Typhi Ty2
aaccuccggcuaugccgga

SEQ ID NO: 1770806 - RNA, 17 nt, Salmonella enterica enterica serovar Typhi Ty2
aaccucggcuugcuuca

SEQ ID NO: 1770807 - RNA, 19 nt, Salmonella enterica enterica serovar Typhi Ty2
aaccucaauagguguaucc

SEQ ID NO: 1770808 - RNA, 19 nt, Salmonella enterica enterica serovar Typhi Ty2
aaccucaccguccgccagg

SEQ ID NO: 1770809 - RNA, 14 nt, Salmonella enterica enterica serovar Typhi Ty2
aaccugauauugcg

SEQ ID NO: 1770810 - RNA, 17 nt, Salmonella enterica enterica serovar Typhi Ty2
aaccucuauaguaaauu

SEQ ID NO: 1770811 - RNA, 12 nt, Salmonella enterica enterica serovar Typhi Ty2
aaccugaacaau

SEQ ID NO: 1770812 - RNA, 20 nt, Salmonella enterica enterica serovar Typhi Ty2
aaccuucaagaaucaauaua

SEQ ID NO: 1770813 - RNA, 21 nt, Salmonella enterica enterica serovar Typhi Ty2
aaccugcgccgcgauaaagaa

SEQ ID NO: 1770814 - RNA, 21 nt, Salmonella enterica enterica serovar Typhi Ty2
aaccugcguuacggucgauuu

SEQ ID NO: 1770815 - RNA, 14 nt, Salmonella enterica enterica serovar Typhi Ty2
aaccugguaugaua

SEQ ID NO: 1770816 - RNA, 14 nt, Salmonella enterica enterica serovar Typhi Ty2
aaccuuccgccagg

SEQ ID NO: 1770817 - RNA, 18 nt, Salmonella enterica enterica serovar Typhi Ty2
aaccuuccgccaggcggg

SEQ ID NO: 1770818 - RNA, 15 nt, Salmonella enterica enterica serovar Typhi Ty2
aaccuucgcuuuuaa

SEQ ID NO: 1770819 - RNA, 19 nt, Salmonella enterica enterica serovar Typhi Ty2
aaccuucgcuuuuaaaacu

SEQ ID NO: 1770820 - RNA, 17 nt, Salmonella enterica enterica serovar Typhi Ty2
aaccuucauaaauacgu

SEQ ID NO: 1770821 - RNA, 15 nt, Salmonella enterica enterica serovar Typhi Ty2
aaccuucauaaauac

SEQ ID NO: 1770822 - RNA, 20 nt, Salmonella enterica enterica serovar Typhi Ty2
aaccuuccaucgcauccucg

SEQ ID NO: 1770823 - RNA, 12 nt, Salmonella enterica enterica serovar Typhi Ty2
aaccuugcgccu

SEQ ID NO: 1770824 - RNA, 20 nt, Salmonella enterica enterica serovar Typhi Ty2
aacgaacgcggaucagacgg

SEQ ID NO: 1770825 - RNA, 14 nt, Salmonella enterica enterica serovar Typhi Ty2
aaccuuugcugacg

SEQ ID NO: 1770826 - RNA, 16 nt, Salmonella enterica enterica serovar Typhi Ty2
aaccagcgaaaugacg

SEQ ID NO: 1770827 - RNA, 22 nt, Salmonella enterica enterica serovar Typhi Ty2
aaccagcgccgccagauaaagc

SEQ ID NO: 1770828 - RNA, 17 nt, Salmonella enterica enterica serovar Typhi Ty2
aaccagcgcggccagaa

SEQ ID NO: 1770829 - RNA, 17 nt, Salmonella enterica enterica serovar Typhi Ty2
aaccagcauaauauuca

SEQ ID NO: 1770830 - RNA, 15 nt, Salmonella enterica enterica serovar Typhi Ty2
aaccagcaguccugc

SEQ ID NO: 1770831 - RNA, 23 nt, Salmonella enterica enterica serovar Typhi Ty2
aaccagaguccggcgccugaaua

SEQ ID NO: 1770832 - RNA, 21 nt, Salmonella enterica enterica serovar Typhi Ty2
aaccagacccguugcgucacg

SEQ ID NO: 1770833 - RNA, 16 nt, Salmonella enterica enterica serovar Typhi Ty2
aaccagggaggacgca

SEQ ID NO: 1770834 - RNA, 10 nt, Salmonella enterica enterica serovar Typhi Ty2
aaccagggag

SEQ ID NO: 1770835 - RNA, 11 nt, Salmonella enterica enterica serovar Typhi Ty2
aaccaggcaaa

SEQ ID NO: 1770836 - RNA, 16 nt, Salmonella enterica enterica serovar Typhi Ty2
aaccaggcaaaaauag

SEQ ID NO: 1770837 - RNA, 13 nt, Salmonella enterica enterica serovar Typhi Ty2
aaccagguaaucc

SEQ ID NO: 1770838 - RNA, 14 nt, Salmonella enterica enterica serovar Typhi Ty2
aaccagcuuuucau

SEQ ID NO: 1770839 - RNA, 23 nt, Salmonella enterica enterica serovar Typhi Ty2
aaccaggauucaacgcgugaucc

SEQ ID NO: 1770840 - RNA, 22 nt, Salmonella enterica enterica serovar Typhi Ty2
aaccccggcaaaccuaccggca

SEQ ID NO: 1770841 - RNA, 22 nt, Salmonella enterica enterica serovar Typhi Ty2
aaccccggaaugugaaauacag

SEQ ID NO: 1770842 - RNA, 16 nt, Salmonella enterica enterica serovar Typhi Ty2
aaccccgauaaaccag

SEQ ID NO: 1770843 - RNA, 16 nt, Salmonella enterica enterica serovar Typhi Ty2
aacccgaucgccaucc

SEQ ID NO: 1770844 - RNA, 23 nt, Salmonella enterica enterica serovar Typhi Ty2
aacccgaucgccauccugcaccg

SEQ ID NO: 1770845 - RNA, 14 nt, Salmonella enterica enterica serovar Typhi Ty2
aacccgauacccug

SEQ ID NO: 1770846 - RNA, 18 nt, Salmonella enterica enterica serovar Typhi Ty2
aaccccguggugacacaa

SEQ ID NO: 1770847 - RNA, 17 nt, Salmonella enterica enterica serovar Typhi Ty2
aaccauacauccugauu

SEQ ID NO: 1770848 - RNA, 17 nt, Salmonella enterica enterica serovar Typhi Ty2
aacccauuggcgaggaa

SEQ ID NO: 1770849 - RNA, 17 nt, Salmonella enterica enterica serovar Typhi Ty2
aaccauaaacaaaacaa

SEQ ID NO: 1770850 - RNA, 18 nt, Salmonella enterica enterica serovar Typhi Ty2
aaccaguugccaggguuc

SEQ ID NO: 1770851 - RNA, 14 nt, Salmonella enterica enterica serovar Typhi Ty2
aaccauaauaaaua

SEQ ID NO: 1770852 - RNA, 19 nt, Salmonella enterica enterica serovar Typhi Ty2
aacaucguaaaucaaauga

SEQ ID NO: 1770853 - RNA, 19 nt, Salmonella enterica enterica serovar Typhi Ty2
aacaucgguuuguucauau

SEQ ID NO: 1770854 - RNA, 17 nt, Salmonella enterica enterica serovar Typhi Ty2
aacauggauucgcugga

SEQ ID NO: 1770855 - RNA, 16 nt, Salmonella enterica enterica serovar Typhi Ty2
aacauggguuucuugc

SEQ ID NO: 1770856 - RNA, 16 nt, Salmonella enterica enterica serovar Typhi Ty2
aacauggggagcagca

SEQ ID NO: 1770857 - RNA, 15 nt, Salmonella enterica enterica serovar Typhi Ty2
aacauuuaagauuua

SEQ ID NO: 1770858 - RNA, 19 nt, Salmonella enterica enterica serovar Typhi Ty2
aaccaccagcggaaucccc

SEQ ID NO: 1770859 - RNA, 21 nt, Salmonella enterica enterica serovar Typhi Ty2
aaccaccggcgcgccagcgca

SEQ ID NO: 1770860 - RNA, 22 nt, Salmonella enterica enterica serovar Typhi Ty2
aaccacuuugggccgaaggaag

SEQ ID NO: 1770861 - RNA, 13 nt, Salmonella enterica enterica serovar Typhi Ty2
aaccacuucugac

SEQ ID NO: 1770862 - RNA, 14 nt, Salmonella enterica enterica serovar Typhi Ty2
aaccaaaaaauaug

SEQ ID NO: 1770863 - RNA, 17 nt, Salmonella enterica enterica serovar Typhi Ty2
aaccaaagguauugccu

SEQ ID NO: 1770864 - RNA, 19 nt, Salmonella enterica enterica serovar Typhi Ty2
aacaguucaaacggcccgg

SEQ ID NO: 1770865 - RNA, 21 nt, Salmonella enterica enterica serovar Typhi Ty2
aacaguguaaacgccagauaa

SEQ ID NO: 1770866 - RNA, 17 nt, Salmonella enterica enterica serovar Typhi Ty2
aacagucgcgccgugcc

SEQ ID NO: 1770867 - RNA, 23 nt, Salmonella enterica enterica serovar Typhi Ty2
aacagucccaccagcgcggcaca

SEQ ID NO: 1770868 - RNA, 22 nt, Salmonella enterica enterica serovar Typhi Ty2
aacagugggcuaugaagagaaa

SEQ ID NO: 1770869 - RNA, 23 nt, Salmonella enterica enterica serovar Typhi Ty2
aacagugauuacaaaaugugcaa

SEQ ID NO: 1770870 - RNA, 17 nt, Salmonella enterica enterica serovar Typhi Ty2
aacaguuuuuccuuucu

SEQ ID NO: 1770871 - RNA, 13 nt, Salmonella enterica enterica serovar Typhi Ty2
aacauaaacaaug

SEQ ID NO: 1770872 - RNA, 14 nt, Salmonella enterica enterica serovar Typhi Ty2
aacauaaccggaau

SEQ ID NO: 1770873 - RNA, 21 nt, Salmonella enterica enterica serovar Typhi Ty2
aacauagcuaaauaaaaauaa

SEQ ID NO: 1770874 - RNA, 19 nt, Salmonella enterica enterica serovar Typhi Ty2
aacauagcggcaaggaaaa

SEQ ID NO: 1770875 - RNA, 18 nt, Salmonella enterica enterica serovar Typhi Ty2
aacauagcggcaaggaaa

SEQ ID NO: 1770876 - RNA, 12 nt, Salmonella enterica enterica serovar Typhi Ty2
aacauauauauc

SEQ ID NO: 1770877 - RNA, 18 nt, Salmonella enterica enterica serovar Typhi Ty2
aacauagcuuacuuuuag

SEQ ID NO: 1770878 - RNA, 22 nt, Salmonella enterica enterica serovar Typhi Ty2
aacaucagaaaaaagccaagca

SEQ ID NO: 1770879 - RNA, 15 nt, Salmonella enterica enterica serovar Typhi Ty2
aacaucaaguacagc

SEQ ID NO: 1770880 - RNA, 12 nt, Salmonella enterica enterica serovar Typhi Ty2
aacaucauaaua

SEQ ID NO: 1770881 - RNA, 17 nt, Salmonella enterica enterica serovar Typhi Ty2
aacaucgcaaaauuccg

SEQ ID NO: 1770882 - RNA, 19 nt, Salmonella enterica enterica serovar Typhi Ty2
aacagcgcuaucaggaaga

SEQ ID NO: 1770883 - RNA, 15 nt, Salmonella enterica enterica serovar Typhi Ty2
aacagcgccgcgaau

SEQ ID NO: 1770884 - RNA, 18 nt, Salmonella enterica enterica serovar Typhi Ty2
aacaagggcauaaugauu

SEQ ID NO: 1770885 - RNA, 13 nt, Salmonella enterica enterica serovar Typhi Ty2
aacaagggcauaa

SEQ ID NO: 1770886 - RNA, 20 nt, Salmonella enterica enterica serovar Typhi Ty2
aacagcgccggcagcaguuc

SEQ ID NO: 1770887 - RNA, 21 nt, Salmonella enterica enterica serovar Typhi Ty2
aacagcguaccuuuaucuuga

SEQ ID NO: 1770888 - RNA, 15 nt, Salmonella enterica enterica serovar Typhi Ty2
aacaguacggucagg

SEQ ID NO: 1770889 - RNA, 18 nt, Salmonella enterica enterica serovar Typhi Ty2
aacaguaccugauaaaau

SEQ ID NO: 1770890 - RNA, 15 nt, Salmonella enterica enterica serovar Typhi Ty2
aacaguaccugauaa

SEQ ID NO: 1770891 - RNA, 19 nt, Salmonella enterica enterica serovar Typhi Ty2
aacagguuaaucagcacau

SEQ ID NO: 1770892 - RNA, 13 nt, Salmonella enterica enterica serovar Typhi Ty2
aacaggucacaug

SEQ ID NO: 1770893 - RNA, 18 nt, Salmonella enterica enterica serovar Typhi Ty2
aacagggggcgcaucacu

SEQ ID NO: 1770894 - RNA, 19 nt, Salmonella enterica enterica serovar Typhi Ty2
aacaggcuuuucaggcugu

SEQ ID NO: 1770895 - RNA, 16 nt, Salmonella enterica enterica serovar Typhi Ty2
aacaggcuuuucaggc

SEQ ID NO: 1770896 - RNA, 21 nt, Salmonella enterica enterica serovar Typhi Ty2
aacaggcugaacccugccugc

SEQ ID NO: 1770897 - RNA, 23 nt, Salmonella enterica enterica serovar Typhi Ty2
aacaggcgcaggcauuaaaaaaa

SEQ ID NO: 1770898 - RNA, 20 nt, Salmonella enterica enterica serovar Typhi Ty2
aacaggccaaacccugcgcc

SEQ ID NO: 1770899 - RNA, 13 nt, Salmonella enterica enterica serovar Typhi Ty2
aacaggcgaaaac

SEQ ID NO: 1770900 - RNA, 21 nt, Salmonella enterica enterica serovar Typhi Ty2
cgccuggcuugcggguuuuga

SEQ ID NO: 1770901 - RNA, 15 nt, Salmonella enterica enterica serovar Typhi Ty2
cgccugccgcgccgc

SEQ ID NO: 1770902 - RNA, 14 nt, Salmonella enterica enterica serovar Typhi Ty2
cgccugccgcaugu

SEQ ID NO: 1770903 - RNA, 13 nt, Salmonella enterica enterica serovar Typhi Ty2
cgccugccagcgc

SEQ ID NO: 1770904 - RNA, 14 nt, Salmonella enterica enterica serovar Typhi Ty2
cgccugcauaaugc

SEQ ID NO: 1770905 - RNA, 13 nt, Salmonella enterica enterica serovar Typhi Ty2
cgccugccagaua

SEQ ID NO: 1770906 - RNA, 16 nt, Salmonella enterica enterica serovar Typhi Ty2
cgccugaugcuggcag

SEQ ID NO: 1770907 - RNA, 17 nt, Salmonella enterica enterica serovar Typhi Ty2
cgccugaugcgccgccu

SEQ ID NO: 1770908 - RNA, 15 nt, Salmonella enterica enterica serovar Typhi Ty2
cgccugauucauucc

SEQ ID NO: 1770909 - RNA, 16 nt, Salmonella enterica enterica serovar Typhi Ty2
cgccugauuuaaugaa

SEQ ID NO: 1770910 - RNA, 24 nt, Salmonella enterica enterica serovar Typhi Ty2
cgccugcaauguugaaucccacgc

SEQ ID NO: 1770911 - RNA, 11 nt, Salmonella enterica enterica serovar Typhi Ty2
cgccugcacca

SEQ ID NO: 1770912 - RNA, 14 nt, Salmonella enterica enterica serovar Typhi Ty2
cgccugaugacgcu

SEQ ID NO: 1770913 - RNA, 16 nt, Salmonella enterica enterica serovar Typhi Ty2
cgccugaucuuucugg

SEQ ID NO: 1770914 - RNA, 16 nt, Salmonella enterica enterica serovar Typhi Ty2
cgccugauccggccua

SEQ ID NO: 1770915 - RNA, 15 nt, Salmonella enterica enterica serovar Typhi Ty2
cgccugaucgcgcag

SEQ ID NO: 1770916 - RNA, 14 nt, Salmonella enterica enterica serovar Typhi Ty2
cgccucgcucucuu

SEQ ID NO: 1770917 - RNA, 24 nt, Salmonella enterica enterica serovar Typhi Ty2
cgcgaaucgacaauccgccacgcu

SEQ ID NO: 1770918 - RNA, 17 nt, Salmonella enterica enterica serovar Typhi Ty2
cgcgaauuucaacgcga

SEQ ID NO: 1770919 - RNA, 15 nt, Salmonella enterica enterica serovar Typhi Ty2
cgcgaauuucaaucg

SEQ ID NO: 1770920 - RNA, 18 nt, Salmonella enterica enterica serovar Typhi Ty2
cgcgaauuucaaucgcca

SEQ ID NO: 1770921 - RNA, 17 nt, Salmonella enterica enterica serovar Typhi Ty2
cgcgacaaaaagcgcgc

SEQ ID NO: 1770922 - RNA, 21 nt, Salmonella enterica enterica serovar Typhi Ty2
cgccuuccggccacuccgcca

SEQ ID NO: 1770923 - RNA, 14 nt, Salmonella enterica enterica serovar Typhi Ty2
cgccuuccuccagc

SEQ ID NO: 1770924 - RNA, 22 nt, Salmonella enterica enterica serovar Typhi Ty2
cgcgaaaucaaagaccuccgcc

SEQ ID NO: 1770925 - RNA, 23 nt, Salmonella enterica enterica serovar Typhi Ty2
cgccuucacacugcgccgccagc

SEQ ID NO: 1770926 - RNA, 12 nt, Salmonella enterica enterica serovar Typhi Ty2
cgcgaccagcag

SEQ ID NO: 1770927 - RNA, 16 nt, Salmonella enterica enterica serovar Typhi Ty2
cgcgacagucgcagag

SEQ ID NO: 1770928 - RNA, 15 nt, Salmonella enterica enterica serovar Typhi Ty2
cgcgacagcgcgcca

SEQ ID NO: 1770929 - RNA, 21 nt, Salmonella enterica enterica serovar Typhi Ty2
cgcgacaacgccggaccagac

SEQ ID NO: 1770930 - RNA, 21 nt, Salmonella enterica enterica serovar Typhi Ty2
cgcgacgggaaggaaauucag

SEQ ID NO: 1770931 - RNA, 21 nt, Salmonella enterica enterica serovar Typhi Ty2
cgcgacucccaggcgcgcagc

SEQ ID NO: 1770932 - RNA, 19 nt, Salmonella enterica enterica serovar Typhi Ty2
cgcgacucccaggcgcgca

SEQ ID NO: 1770933 - RNA, 18 nt, Salmonella enterica enterica serovar Typhi Ty2
cgcgacgggaaggaaauu

SEQ ID NO: 1770934 - RNA, 20 nt, Salmonella enterica enterica serovar Typhi Ty2
cgcgacgcccaugcaaccag

SEQ ID NO: 1770935 - RNA, 14 nt, Salmonella enterica enterica serovar Typhi Ty2
cgcgaccagcgcgc

SEQ ID NO: 1770936 - RNA, 16 nt, Salmonella enterica enterica serovar Typhi Ty2
cgcgaccagcgcgcca

SEQ ID NO: 1770937 - RNA, 16 nt, Salmonella enterica enterica serovar Typhi Ty2
cgccgccgcgaccgcu

SEQ ID NO: 1770938 - RNA, 14 nt, Salmonella enterica enterica serovar Typhi Ty2
cgccgccgccaacg

SEQ ID NO: 1770939 - RNA, 19 nt, Salmonella enterica enterica serovar Typhi Ty2
cgccggguuuggcgggcuu

SEQ ID NO: 1770940 - RNA, 15 nt, Salmonella enterica enterica serovar Typhi Ty2
cgccgguacgcagca

SEQ ID NO: 1770941 - RNA, 21 nt, Salmonella enterica enterica serovar Typhi Ty2
cgccgguguuuagccugauac

SEQ ID NO: 1770942 - RNA, 15 nt, Salmonella enterica enterica serovar Typhi Ty2
cgccgucaggcuugc

SEQ ID NO: 1770943 - RNA, 20 nt, Salmonella enterica enterica serovar Typhi Ty2
cgccgucaggcuugccgcgc

SEQ ID NO: 1770944 - RNA, 19 nt, Salmonella enterica enterica serovar Typhi Ty2
cgccggugccugccgccuc

SEQ ID NO: 1770945 - RNA, 18 nt, Salmonella enterica enterica serovar Typhi Ty2
cgccguccagcaccaccu

SEQ ID NO: 1770946 - RNA, 12 nt, Salmonella enterica enterica serovar Typhi Ty2
cgccgucauccg

SEQ ID NO: 1770947 - RNA, 16 nt, Salmonella enterica enterica serovar Typhi Ty2
cgccgugcacuucugc

SEQ ID NO: 1770948 - RNA, 22 nt, Salmonella enterica enterica serovar Typhi Ty2
cgccguguugugugccgcgcug

SEQ ID NO: 1770949 - RNA, 15 nt, Salmonella enterica enterica serovar Typhi Ty2
cgccguuaucggccu

SEQ ID NO: 1770950 - RNA, 21 nt, Salmonella enterica enterica serovar Typhi Ty2
cgccguggcggugacuuccug

SEQ ID NO: 1770951 - RNA, 18 nt, Salmonella enterica enterica serovar Typhi Ty2
cgccuauuuucucuucca

SEQ ID NO: 1770952 - RNA, 12 nt, Salmonella enterica enterica serovar Typhi Ty2
cgccuauuguuc

SEQ ID NO: 1770953 - RNA, 14 nt, Salmonella enterica enterica serovar Typhi Ty2
cgccuauuguucca

SEQ ID NO: 1770954 - RNA, 21 nt, Salmonella enterica enterica serovar Typhi Ty2
cgccuaaaucaagcagugacg

SEQ ID NO: 1770955 - RNA, 22 nt, Salmonella enterica enterica serovar Typhi Ty2
cgccguuugccauaucuggaua

SEQ ID NO: 1770956 - RNA, 22 nt, Salmonella enterica enterica serovar Typhi Ty2
cgccuccugccgaugccgccgc

SEQ ID NO: 1770957 - RNA, 12 nt, Salmonella enterica enterica serovar Typhi Ty2
cgccuccugccg

SEQ ID NO: 1770958 - RNA, 15 nt, Salmonella enterica enterica serovar Typhi Ty2
cgccucaucugcuuc

SEQ ID NO: 1770959 - RNA, 19 nt, Salmonella enterica enterica serovar Typhi Ty2
cgccucaauugccgccagc

SEQ ID NO: 1770960 - RNA, 14 nt, Salmonella enterica enterica serovar Typhi Ty2
cgcgccgcagcgcc

SEQ ID NO: 1770961 - RNA, 19 nt, Salmonella enterica enterica serovar Typhi Ty2
cgcgccaggucucauagcg

SEQ ID NO: 1770962 - RNA, 19 nt, Salmonella enterica enterica serovar Typhi Ty2
cgcgccagucaucgccgcu

SEQ ID NO: 1770963 - RNA, 23 nt, Salmonella enterica enterica serovar Typhi Ty2
cgcgccaguaaucggcgcgaaac

SEQ ID NO: 1770964 - RNA, 17 nt, Salmonella enterica enterica serovar Typhi Ty2
cgcgccaucgucaccgg

SEQ ID NO: 1770965 - RNA, 17 nt, Salmonella enterica enterica serovar Typhi Ty2
cgcgccaucuccuccuc

SEQ ID NO: 1770966 - RNA, 17 nt, Salmonella enterica enterica serovar Typhi Ty2
cgcgcgcagguucgucu

SEQ ID NO: 1770967 - RNA, 22 nt, Salmonella enterica enterica serovar Typhi Ty2
cgcgcgaugguaggccugauaa

SEQ ID NO: 1770968 - RNA, 14 nt, Salmonella enterica enterica serovar Typhi Ty2
cgcgcgaugcugcu

SEQ ID NO: 1770969 - RNA, 15 nt, Salmonella enterica enterica serovar Typhi Ty2
cgcgcggcaggccuu

SEQ ID NO: 1770970 - RNA, 17 nt, Salmonella enterica enterica serovar Typhi Ty2
cgcgcggauucuccagg

SEQ ID NO: 1770971 - RNA, 21 nt, Salmonella enterica enterica serovar Typhi Ty2
cgcgcgccagucaucgccgcu

SEQ ID NO: 1770972 - RNA, 15 nt, Salmonella enterica enterica serovar Typhi Ty2
cgcgccugcucccgc

SEQ ID NO: 1770973 - RNA, 12 nt, Salmonella enterica enterica serovar Typhi Ty2
cgcgccugccaa

SEQ ID NO: 1770974 - RNA, 11 nt, Salmonella enterica enterica serovar Typhi Ty2
cgcgcgaccca

SEQ ID NO: 1770975 - RNA, 20 nt, Salmonella enterica enterica serovar Typhi Ty2
cgcgcgaaacgcacccgcgc

SEQ ID NO: 1770976 - RNA, 12 nt, Salmonella enterica enterica serovar Typhi Ty2
cgcgcgaaggcg

SEQ ID NO: 1770977 - RNA, 21 nt, Salmonella enterica enterica serovar Typhi Ty2
cgcgcgaauaucgcugccggu

SEQ ID NO: 1770978 - RNA, 23 nt, Salmonella enterica enterica serovar Typhi Ty2
cgcgagcguucuauuuggccugc

SEQ ID NO: 1770979 - RNA, 17 nt, Salmonella enterica enterica serovar Typhi Ty2
cgcgagcgugaucucau

SEQ ID NO: 1770980 - RNA, 17 nt, Salmonella enterica enterica serovar Typhi Ty2
cgcgaguauucgcgccc

SEQ ID NO: 1770981 - RNA, 21 nt, Salmonella enterica enterica serovar Typhi Ty2
cgcgcacaacgugcaaaacag

SEQ ID NO: 1770982 - RNA, 15 nt, Salmonella enterica enterica serovar Typhi Ty2
cgcgccagacgccau

SEQ ID NO: 1770983 - RNA, 23 nt, Salmonella enterica enterica serovar Typhi Ty2
cgcgccagaugcuuaaacugcgc

SEQ ID NO: 1770984 - RNA, 12 nt, Salmonella enterica enterica serovar Typhi Ty2
cgcgccagcagg

SEQ ID NO: 1770985 - RNA, 16 nt, Salmonella enterica enterica serovar Typhi Ty2
cgcgccagccaauguc

SEQ ID NO: 1770986 - RNA, 14 nt, Salmonella enterica enterica serovar Typhi Ty2
cgcgccacauacug

SEQ ID NO: 1770987 - RNA, 21 nt, Salmonella enterica enterica serovar Typhi Ty2
cgcgccacggccaacgcgccc

SEQ ID NO: 1770988 - RNA, 12 nt, Salmonella enterica enterica serovar Typhi Ty2
cgcgcagcugcc

SEQ ID NO: 1770989 - RNA, 21 nt, Salmonella enterica enterica serovar Typhi Ty2
cgcgcaguuucuuaccuaccu

SEQ ID NO: 1770990 - RNA, 20 nt, Salmonella enterica enterica serovar Typhi Ty2
cgcgcaucccacaccacacg

SEQ ID NO: 1770991 - RNA, 22 nt, Salmonella enterica enterica serovar Typhi Ty2
cgcgcuaucaacgccuccaggc

SEQ ID NO: 1770992 - RNA, 17 nt, Salmonella enterica enterica serovar Typhi Ty2
cgcgcucaagcgaaaaa

SEQ ID NO: 1770993 - RNA, 11 nt, Salmonella enterica enterica serovar Typhi Ty2
cgcgcucgcca

SEQ ID NO: 1770994 - RNA, 12 nt, Salmonella enterica enterica serovar Typhi Ty2
cgcgcucgccag

SEQ ID NO: 1770995 - RNA, 21 nt, Salmonella enterica enterica serovar Typhi Ty2
cgcgcuagugccgccaggcaa

SEQ ID NO: 1770996 - RNA, 15 nt, Salmonella enterica enterica serovar Typhi Ty2
cgcgcuaucaacgcc

SEQ ID NO: 1770997 - RNA, 19 nt, Salmonella enterica enterica serovar Typhi Ty2
cgcgcuaauuuucagggug

SEQ ID NO: 1770998 - RNA, 22 nt, Salmonella enterica enterica serovar Typhi Ty2
cgcgcguuccaucacuuccugu

SEQ ID NO: 1770999 - RNA, 18 nt, Salmonella enterica enterica serovar Typhi Ty2
cgcgcguucauccaccgc

SEQ ID NO: 1771000 - RNA, 22 nt, Salmonella enterica enterica serovar Typhi Ty2
cgcgcguccacggcgggacgcu

SEQ ID NO: 1771001 - RNA, 16 nt, Salmonella enterica enterica serovar Typhi Ty2
cgcgcggcuaccggac

SEQ ID NO: 1771002 - RNA, 14 nt, Salmonella enterica enterica serovar Typhi Ty2
cgcggaagccacgu

SEQ ID NO: 1771003 - RNA, 19 nt, Salmonella enterica enterica serovar Typhi Ty2
cgcggaacuggugaaacag

SEQ ID NO: 1771004 - RNA, 23 nt, Salmonella enterica enterica serovar Typhi Ty2
cgcggaaucgucacagaccccgc

SEQ ID NO: 1771005 - RNA, 20 nt, Salmonella enterica enterica serovar Typhi Ty2
cgcggaaggcgccucgcgcg

SEQ ID NO: 1771006 - RNA, 12 nt, Salmonella enterica enterica serovar Typhi Ty2
cgcgcuggcaau

SEQ ID NO: 1771007 - RNA, 24 nt, Salmonella enterica enterica serovar Typhi Ty2
cgcgcuuuagggcuuccucgccac

SEQ ID NO: 1771008 - RNA, 14 nt, Salmonella enterica enterica serovar Typhi Ty2
cgcgcugaugguuu

SEQ ID NO: 1771009 - RNA, 14 nt, Salmonella enterica enterica serovar Typhi Ty2
cgcgcugaucgcca

SEQ ID NO: 1771010 - RNA, 15 nt, Salmonella enterica enterica serovar Typhi Ty2
cgcgcugccgcccuu

SEQ ID NO: 1771011 - RNA, 13 nt, Salmonella enterica enterica serovar Typhi Ty2
cgcggcggaccgc

SEQ ID NO: 1771012 - RNA, 13 nt, Salmonella enterica enterica serovar Typhi Ty2
cgcggcuccggcu

SEQ ID NO: 1771013 - RNA, 15 nt, Salmonella enterica enterica serovar Typhi Ty2
cgcggcuaccggacu

SEQ ID NO: 1771014 - RNA, 19 nt, Salmonella enterica enterica serovar Typhi Ty2
cgcggcguaccgcgcgccc

SEQ ID NO: 1771015 - RNA, 21 nt, Salmonella enterica enterica serovar Typhi Ty2
cgcggcggacaacgcuccagc

SEQ ID NO: 1771016 - RNA, 23 nt, Salmonella enterica enterica serovar Typhi Ty2
cgcggcgccgaagcaggcggaga

SEQ ID NO: 1771017 - RNA, 21 nt, Salmonella enterica enterica serovar Typhi Ty2
cgcggcgacggacucgcgcag

SEQ ID NO: 1771018 - RNA, 18 nt, Salmonella enterica enterica serovar Typhi Ty2
cgcggaucggcacacagc

SEQ ID NO: 1771019 - RNA, 17 nt, Salmonella enterica enterica serovar Typhi Ty2
cgcggauuaagcgaauc

SEQ ID NO: 1771020 - RNA, 18 nt, Salmonella enterica enterica serovar Typhi Ty2
cgcuucuauuaccgcagc

SEQ ID NO: 1771021 - RNA, 18 nt, Salmonella enterica enterica serovar Typhi Ty2
cgcuucuaacgaaacaga

SEQ ID NO: 1771022 - RNA, 16 nt, Salmonella enterica enterica serovar Typhi Ty2
cgcuucguuccgcgau

SEQ ID NO: 1771023 - RNA, 15 nt, Salmonella enterica enterica serovar Typhi Ty2
cgcuuccaccucuuc

SEQ ID NO: 1771024 - RNA, 18 nt, Salmonella enterica enterica serovar Typhi Ty2
cgcuuccaguccagcgcg

SEQ ID NO: 1771025 - RNA, 14 nt, Salmonella enterica enterica serovar Typhi Ty2
cgcuuacgcggcgc

SEQ ID NO: 1771026 - RNA, 15 nt, Salmonella enterica enterica serovar Typhi Ty2
cgcuuacaucgccau

SEQ ID NO: 1771027 - RNA, 15 nt, Salmonella enterica enterica serovar Typhi Ty2
cgcuuaccgggcagg

SEQ ID NO: 1771028 - RNA, 22 nt, Salmonella enterica enterica serovar Typhi Ty2
cgcuuaaucuugaguuuggccu

SEQ ID NO: 1771029 - RNA, 22 nt, Salmonella enterica enterica serovar Typhi Ty2
cgcuucaccuuucgccgccaga

SEQ ID NO: 1771030 - RNA, 20 nt, Salmonella enterica enterica serovar Typhi Ty2
cgcuucaccggcgugcgcuu

SEQ ID NO: 1771031 - RNA, 14 nt, Salmonella enterica enterica serovar Typhi Ty2
cgcuucaccggcgu

SEQ ID NO: 1771032 - RNA, 19 nt, Salmonella enterica enterica serovar Typhi Ty2
cgcuuaucccagccgcgau

SEQ ID NO: 1771033 - RNA, 17 nt, Salmonella enterica enterica serovar Typhi Ty2
cgcuuagcuucccgcau

SEQ ID NO: 1771034 - RNA, 18 nt, Salmonella enterica enterica serovar Typhi Ty2
cgcuuauccggccuaccg

SEQ ID NO: 1771035 - RNA, 16 nt, Salmonella enterica enterica serovar Typhi Ty2
cgcuguuuauccacag

SEQ ID NO: 1771036 - RNA, 15 nt, Salmonella enterica enterica serovar Typhi Ty2
cgcuguuuauccaca

SEQ ID NO: 1771037 - RNA, 15 nt, Salmonella enterica enterica serovar Typhi Ty2
cgcuguuaugcacgc

SEQ ID NO: 1771038 - RNA, 17 nt, Salmonella enterica enterica serovar Typhi Ty2
cgcuuaacggcccaggc

SEQ ID NO: 1771039 - RNA, 15 nt, Salmonella enterica enterica serovar Typhi Ty2
cgcuguuuuccgcuu

SEQ ID NO: 1771040 - RNA, 20 nt, Salmonella enterica enterica serovar Typhi Ty2
cgcuggcguauucgcccggc

SEQ ID NO: 1771041 - RNA, 23 nt, Salmonella enterica enterica serovar Typhi Ty2
cgcuggcguauucgcccggcagg

SEQ ID NO: 1771042 - RNA, 14 nt, Salmonella enterica enterica serovar Typhi Ty2
cgcuggcggcccgc

SEQ ID NO: 1771043 - RNA, 16 nt, Salmonella enterica enterica serovar Typhi Ty2
cgcuggcgcgucugug

SEQ ID NO: 1771044 - RNA, 12 nt, Salmonella enterica enterica serovar Typhi Ty2
cgcugggaugac

SEQ ID NO: 1771045 - RNA, 12 nt, Salmonella enterica enterica serovar Typhi Ty2
cgcuggcgcgcu

SEQ ID NO: 1771046 - RNA, 20 nt, Salmonella enterica enterica serovar Typhi Ty2
cgcuggcgcggggaacaccc

SEQ ID NO: 1771047 - RNA, 18 nt, Salmonella enterica enterica serovar Typhi Ty2
cgcuguaacccgccgcca

SEQ ID NO: 1771048 - RNA, 19 nt, Salmonella enterica enterica serovar Typhi Ty2
cgcuguaacccgccgccau

SEQ ID NO: 1771049 - RNA, 16 nt, Salmonella enterica enterica serovar Typhi Ty2
cgcuguaaaccggccc

SEQ ID NO: 1771050 - RNA, 17 nt, Salmonella enterica enterica serovar Typhi Ty2
cgcugguucaugcuucc

SEQ ID NO: 1771051 - RNA, 13 nt, Salmonella enterica enterica serovar Typhi Ty2
cgcuggugcagcc

SEQ ID NO: 1771052 - RNA, 16 nt, Salmonella enterica enterica serovar Typhi Ty2
cgcuggugccaaucuc

SEQ ID NO: 1771053 - RNA, 17 nt, Salmonella enterica enterica serovar Typhi Ty2
cgcuggucagcgcgcca

SEQ ID NO: 1771054 - RNA, 18 nt, Salmonella enterica enterica serovar Typhi Ty2
cgcuggguuuuuccgcuu

SEQ ID NO: 1771055 - RNA, 15 nt, Salmonella enterica enterica serovar Typhi Ty2
cgcugucuauccacu

SEQ ID NO: 1771056 - RNA, 20 nt, Salmonella enterica enterica serovar Typhi Ty2
cgcugucggucagauucaga

SEQ ID NO: 1771057 - RNA, 19 nt, Salmonella enterica enterica serovar Typhi Ty2
cgcugugauccauguugcc

SEQ ID NO: 1771058 - RNA, 14 nt, Salmonella enterica enterica serovar Typhi Ty2
cgcuguccgcccag

SEQ ID NO: 1771059 - RNA, 22 nt, Salmonella enterica enterica serovar Typhi Ty2
cgcugucaccagcagcauuuca

SEQ ID NO: 1771060 - RNA, 20 nt, Salmonella enterica enterica serovar Typhi Ty2
cgcugcaucguuugcaguuc

SEQ ID NO: 1771061 - RNA, 14 nt, Salmonella enterica enterica serovar Typhi Ty2
cgcugccagcugcg

SEQ ID NO: 1771062 - RNA, 14 nt, Salmonella enterica enterica serovar Typhi Ty2
cgcugcacaaucgc

SEQ ID NO: 1771063 - RNA, 20 nt, Salmonella enterica enterica serovar Typhi Ty2
cgcugauguuuugcgccgcg

SEQ ID NO: 1771064 - RNA, 23 nt, Salmonella enterica enterica serovar Typhi Ty2
cgcugauguuuugcgccgcgcgu

SEQ ID NO: 1771065 - RNA, 18 nt, Salmonella enterica enterica serovar Typhi Ty2
cgcugaugugcggccugg

SEQ ID NO: 1771066 - RNA, 16 nt, Salmonella enterica enterica serovar Typhi Ty2
cgcugauuuguuaucu

SEQ ID NO: 1771067 - RNA, 15 nt, Salmonella enterica enterica serovar Typhi Ty2
cgcugauuugccaaa

SEQ ID NO: 1771068 - RNA, 17 nt, Salmonella enterica enterica serovar Typhi Ty2
cgcugaugaaaacccag

SEQ ID NO: 1771069 - RNA, 14 nt, Salmonella enterica enterica serovar Typhi Ty2
cgcugaugacgcgc

SEQ ID NO: 1771070 - RNA, 16 nt, Salmonella enterica enterica serovar Typhi Ty2
cgcugaugaaaaccca

SEQ ID NO: 1771071 - RNA, 17 nt, Salmonella enterica enterica serovar Typhi Ty2
cgcugagaugaccauau

SEQ ID NO: 1771072 - RNA, 20 nt, Salmonella enterica enterica serovar Typhi Ty2
cgcugauacgcuggcacagg

SEQ ID NO: 1771073 - RNA, 17 nt, Salmonella enterica enterica serovar Typhi Ty2
cgcugacgcugcccgcc

SEQ ID NO: 1771074 - RNA, 12 nt, Salmonella enterica enterica serovar Typhi Ty2
cgcugacgccga

SEQ ID NO: 1771075 - RNA, 22 nt, Salmonella enterica enterica serovar Typhi Ty2
cgcugcggcguggagcauucca

SEQ ID NO: 1771076 - RNA, 12 nt, Salmonella enterica enterica serovar Typhi Ty2
cgcugcuccggc

SEQ ID NO: 1771077 - RNA, 14 nt, Salmonella enterica enterica serovar Typhi Ty2
cgcugcuccggcuu

SEQ ID NO: 1771078 - RNA, 15 nt, Salmonella enterica enterica serovar Typhi Ty2
cgcugcugcggcguu

SEQ ID NO: 1771079 - RNA, 22 nt, Salmonella enterica enterica serovar Typhi Ty2
cgcugcuguaacagacgcaggc

SEQ ID NO: 1771080 - RNA, 20 nt, Salmonella enterica enterica serovar Typhi Ty2
cgcuggaaucauccaccaga

SEQ ID NO: 1771081 - RNA, 21 nt, Salmonella enterica enterica serovar Typhi Ty2
cgcuggaacugaucgugccca

SEQ ID NO: 1771082 - RNA, 13 nt, Salmonella enterica enterica serovar Typhi Ty2
cgcuggaagagaa

SEQ ID NO: 1771083 - RNA, 23 nt, Salmonella enterica enterica serovar Typhi Ty2
cgcugcuuagcaguagugagcca

SEQ ID NO: 1771084 - RNA, 14 nt, Salmonella enterica enterica serovar Typhi Ty2
cgcugcuucacgga

SEQ ID NO: 1771085 - RNA, 21 nt, Salmonella enterica enterica serovar Typhi Ty2
cgcuggcaauaaagcagggcg

SEQ ID NO: 1771086 - RNA, 16 nt, Salmonella enterica enterica serovar Typhi Ty2
cgcuggcacaggauau

SEQ ID NO: 1771087 - RNA, 15 nt, Salmonella enterica enterica serovar Typhi Ty2
cgcuggcacuggcag

SEQ ID NO: 1771088 - RNA, 14 nt, Salmonella enterica enterica serovar Typhi Ty2
cgcuggaggccaau

SEQ ID NO: 1771089 - RNA, 16 nt, Salmonella enterica enterica serovar Typhi Ty2
cgcuggcaauaaagca

SEQ ID NO: 1771090 - RNA, 20 nt, Salmonella enterica enterica serovar Typhi Ty2
cgcugcggccagaccgccgc

SEQ ID NO: 1771091 - RNA, 21 nt, Salmonella enterica enterica serovar Typhi Ty2
cgcugcggccagaccgccgcu

SEQ ID NO: 1771092 - RNA, 22 nt, Salmonella enterica enterica serovar Typhi Ty2
cgcugcgcuuacacacccggcc

SEQ ID NO: 1771093 - RNA, 18 nt, Salmonella enterica enterica serovar Typhi Ty2
cgcugcgccugcugccag

SEQ ID NO: 1771094 - RNA, 14 nt, Salmonella enterica enterica serovar Typhi Ty2
cgcugcgcaggcgu

SEQ ID NO: 1771095 - RNA, 13 nt, Salmonella enterica enterica serovar Typhi Ty2
cgcugccgccgcu

SEQ ID NO: 1771096 - RNA, 19 nt, Salmonella enterica enterica serovar Typhi Ty2
cgcugccggaaagccccag

SEQ ID NO: 1771097 - RNA, 19 nt, Salmonella enterica enterica serovar Typhi Ty2
cgcguggaaauaaucugua

SEQ ID NO: 1771098 - RNA, 20 nt, Salmonella enterica enterica serovar Typhi Ty2
cgcgugcuguaccgcguccu

SEQ ID NO: 1771099 - RNA, 17 nt, Salmonella enterica enterica serovar Typhi Ty2
cgcgugcucgcggcgga

SEQ ID NO: 1771100 - RNA, 14 nt, Salmonella enterica enterica serovar Typhi Ty2
cgcguucgcgcagu

SEQ ID NO: 1771101 - RNA, 18 nt, Salmonella enterica enterica serovar Typhi Ty2
cgcgugacgcaguaauac

SEQ ID NO: 1771102 - RNA, 20 nt, Salmonella enterica enterica serovar Typhi Ty2
cgcguuuaaauaaaaauucc

SEQ ID NO: 1771103 - RNA, 17 nt, Salmonella enterica enterica serovar Typhi Ty2
cgcuaccuucuucccau

SEQ ID NO: 1771104 - RNA, 18 nt, Salmonella enterica enterica serovar Typhi Ty2
cgcgggccauacacucaa

SEQ ID NO: 1771105 - RNA, 14 nt, Salmonella enterica enterica serovar Typhi Ty2
cgcgggccugccug

SEQ ID NO: 1771106 - RNA, 22 nt, Salmonella enterica enterica serovar Typhi Ty2
cgcgucauaaugcccagcgccg

SEQ ID NO: 1771107 - RNA, 17 nt, Salmonella enterica enterica serovar Typhi Ty2
cgcgucaucggcgcgcu

SEQ ID NO: 1771108 - RNA, 23 nt, Salmonella enterica enterica serovar Typhi Ty2
cgcgucacaaucgcgccugccag

SEQ ID NO: 1771109 - RNA, 11 nt, Salmonella enterica enterica serovar Typhi Ty2
cgcgucagggc

SEQ ID NO: 1771110 - RNA, 19 nt, Salmonella enterica enterica serovar Typhi Ty2
cgcuaucaccgccgcccgu

SEQ ID NO: 1771111 - RNA, 21 nt, Salmonella enterica enterica serovar Typhi Ty2
cgcuaucaacgccuccaggcu

SEQ ID NO: 1771112 - RNA, 13 nt, Salmonella enterica enterica serovar Typhi Ty2
cgcuaucaaaaug

SEQ ID NO: 1771113 - RNA, 14 nt, Salmonella enterica enterica serovar Typhi Ty2
cgcuauauuccagc

SEQ ID NO: 1771114 - RNA, 13 nt, Salmonella enterica enterica serovar Typhi Ty2
cgcuauccggcau

SEQ ID NO: 1771115 - RNA, 16 nt, Salmonella enterica enterica serovar Typhi Ty2
cgcuauccggcgcgcu

SEQ ID NO: 1771116 - RNA, 17 nt, Salmonella enterica enterica serovar Typhi Ty2
cgcuaucaggcacugaa

SEQ ID NO: 1771117 - RNA, 16 nt, Salmonella enterica enterica serovar Typhi Ty2
cgcuaucaggcacuga

SEQ ID NO: 1771118 - RNA, 17 nt, Salmonella enterica enterica serovar Typhi Ty2
cgcuaucgaccagcacc

SEQ ID NO: 1771119 - RNA, 17 nt, Salmonella enterica enterica serovar Typhi Ty2
cgcuaucugcuccgcca

SEQ ID NO: 1771120 - RNA, 14 nt, Salmonella enterica enterica serovar Typhi Ty2
cgcuacguuuaucu

SEQ ID NO: 1771121 - RNA, 12 nt, Salmonella enterica enterica serovar Typhi Ty2
cgcuaccuuuuu

SEQ ID NO: 1771122 - RNA, 15 nt, Salmonella enterica enterica serovar Typhi Ty2
cgcuacugccgccau

SEQ ID NO: 1771123 - RNA, 20 nt, Salmonella enterica enterica serovar Typhi Ty2
cgcucacgguuucaacuucc

SEQ ID NO: 1771124 - RNA, 21 nt, Salmonella enterica enterica serovar Typhi Ty2
cgcucacgguuucaacuucca

SEQ ID NO: 1771125 - RNA, 11 nt, Salmonella enterica enterica serovar Typhi Ty2
cgcucacgcca

SEQ ID NO: 1771126 - RNA, 16 nt, Salmonella enterica enterica serovar Typhi Ty2
cgcucacgauaacgca

SEQ ID NO: 1771127 - RNA, 14 nt, Salmonella enterica enterica serovar Typhi Ty2
cgcucacgcggcgc

SEQ ID NO: 1771128 - RNA, 15 nt, Salmonella enterica enterica serovar Typhi Ty2
cgcucaccgacuccu

SEQ ID NO: 1771129 - RNA, 19 nt, Salmonella enterica enterica serovar Typhi Ty2
cgcucagcgccguagcggc

SEQ ID NO: 1771130 - RNA, 15 nt, Salmonella enterica enterica serovar Typhi Ty2
cgcucaaauaaugca

SEQ ID NO: 1771131 - RNA, 16 nt, Salmonella enterica enterica serovar Typhi Ty2
cgcucaaccgguuugu

SEQ ID NO: 1771132 - RNA, 19 nt, Salmonella enterica enterica serovar Typhi Ty2
cgcuauugagcgacgccgc

SEQ ID NO: 1771133 - RNA, 19 nt, Salmonella enterica enterica serovar Typhi Ty2
cgcuauuaccccgcggcau

SEQ ID NO: 1771134 - RNA, 20 nt, Salmonella enterica enterica serovar Typhi Ty2
cgcuaucuguugcgccaggg

SEQ ID NO: 1771135 - RNA, 14 nt, Salmonella enterica enterica serovar Typhi Ty2
cgcucaacuccugc

SEQ ID NO: 1771136 - RNA, 13 nt, Salmonella enterica enterica serovar Typhi Ty2
cgcuauuuaaccc

SEQ ID NO: 1771137 - RNA, 16 nt, Salmonella enterica enterica serovar Typhi Ty2
cgcucaccaccgccgc

SEQ ID NO: 1771138 - RNA, 22 nt, Salmonella enterica enterica serovar Typhi Ty2
cgcucaauuauuaaucuuuaca

SEQ ID NO: 1771139 - RNA, 19 nt, Salmonella enterica enterica serovar Typhi Ty2
cgcuccacugauaguccau

SEQ ID NO: 1771140 - RNA, 11 nt, Salmonella enterica enterica serovar Typhi Ty2
cgcuccagaag

SEQ ID NO: 1771141 - RNA, 15 nt, Salmonella enterica enterica serovar Typhi Ty2
cgcuccacgcguccu

SEQ ID NO: 1771142 - RNA, 16 nt, Salmonella enterica enterica serovar Typhi Ty2
cgcuccagcaguucua

SEQ ID NO: 1771143 - RNA, 15 nt, Salmonella enterica enterica serovar Typhi Ty2
cgcucaugcgcgucc

SEQ ID NO: 1771144 - RNA, 14 nt, Salmonella enterica enterica serovar Typhi Ty2
cgcucaugccacgc

SEQ ID NO: 1771145 - RNA, 16 nt, Salmonella enterica enterica serovar Typhi Ty2
cgcucaugcgccuggc

SEQ ID NO: 1771146 - RNA, 14 nt, Salmonella enterica enterica serovar Typhi Ty2
cgcucaucggcggc

SEQ ID NO: 1771147 - RNA, 16 nt, Salmonella enterica enterica serovar Typhi Ty2
cgcuccugcucccaga

SEQ ID NO: 1771148 - RNA, 19 nt, Salmonella enterica enterica serovar Typhi Ty2
cgcuccuugagcgccugga

SEQ ID NO: 1771149 - RNA, 17 nt, Salmonella enterica enterica serovar Typhi Ty2
cgcucccuucccccaga

SEQ ID NO: 1771150 - RNA, 14 nt, Salmonella enterica enterica serovar Typhi Ty2
cgcucccgcgcgcu

SEQ ID NO: 1771151 - RNA, 15 nt, Salmonella enterica enterica serovar Typhi Ty2
cgcuccggcgcuggc

SEQ ID NO: 1771152 - RNA, 21 nt, Salmonella enterica enterica serovar Typhi Ty2
cgcugaagcuugaaccgggua

SEQ ID NO: 1771153 - RNA, 15 nt, Salmonella enterica enterica serovar Typhi Ty2
cgcugaccacgccgc

SEQ ID NO: 1771154 - RNA, 22 nt, Salmonella enterica enterica serovar Typhi Ty2
cgcugaccacgccgccgcgucc

SEQ ID NO: 1771155 - RNA, 16 nt, Salmonella enterica enterica serovar Typhi Ty2
cgcugaaguccgcgau

SEQ ID NO: 1771156 - RNA, 23 nt, Salmonella enterica enterica serovar Typhi Ty2
cgcucuucgccaaucgccgccgc

SEQ ID NO: 1771157 - RNA, 17 nt, Salmonella enterica enterica serovar Typhi Ty2
cgcucuauauccugccc

SEQ ID NO: 1771158 - RNA, 16 nt, Salmonella enterica enterica serovar Typhi Ty2
cgcucucgccgcgcuc

SEQ ID NO: 1771159 - RNA, 15 nt, Salmonella enterica enterica serovar Typhi Ty2
cgcucucgccgcgcu

SEQ ID NO: 1771160 - RNA, 13 nt, Salmonella enterica enterica serovar Typhi Ty2
cgcucuuccgcca

SEQ ID NO: 1771161 - RNA, 16 nt, Salmonella enterica enterica serovar Typhi Ty2
cgcucguacaaaucac

SEQ ID NO: 1771162 - RNA, 21 nt, Salmonella enterica enterica serovar Typhi Ty2
cgcucgucgcgacguccgcca

SEQ ID NO: 1771163 - RNA, 21 nt, Salmonella enterica enterica serovar Typhi Ty2
cgcucggcauacaccgccagc

SEQ ID NO: 1771164 - RNA, 23 nt, Salmonella enterica enterica serovar Typhi Ty2
cgcucgcucaucacaucgcgcag

SEQ ID NO: 1771165 - RNA, 18 nt, Salmonella enterica enterica serovar Typhi Ty2
cgcucgcuuugccgccau

SEQ ID NO: 1771166 - RNA, 22 nt, Salmonella enterica enterica serovar Typhi Ty2
cgcucgcggaagcgaccggcgu

SEQ ID NO: 1771167 - RNA, 16 nt, Salmonella enterica enterica serovar Typhi Ty2
cgauggcaaauaauac

SEQ ID NO: 1771168 - RNA, 16 nt, Salmonella enterica enterica serovar Typhi Ty2
cgauggcgauauugug

SEQ ID NO: 1771169 - RNA, 20 nt, Salmonella enterica enterica serovar Typhi Ty2
cgauggugcggcgcacugcc

SEQ ID NO: 1771170 - RNA, 13 nt, Salmonella enterica enterica serovar Typhi Ty2
cgauggugccgac

SEQ ID NO: 1771171 - RNA, 12 nt, Salmonella enterica enterica serovar Typhi Ty2
cgauuuauucuu

SEQ ID NO: 1771172 - RNA, 16 nt, Salmonella enterica enterica serovar Typhi Ty2
cgauuaacgcauguuc

SEQ ID NO: 1771173 - RNA, 15 nt, Salmonella enterica enterica serovar Typhi Ty2
cgauguuugccacgc

SEQ ID NO: 1771174 - RNA, 22 nt, Salmonella enterica enterica serovar Typhi Ty2
cgauuaaugcuccaauaaauau

SEQ ID NO: 1771175 - RNA, 12 nt, Salmonella enterica enterica serovar Typhi Ty2
cgaucugugucg

SEQ ID NO: 1771176 - RNA, 19 nt, Salmonella enterica enterica serovar Typhi Ty2
cgaucugugucguccaggc

SEQ ID NO: 1771177 - RNA, 20 nt, Salmonella enterica enterica serovar Typhi Ty2
cgaucuguacggcauauucc

SEQ ID NO: 1771178 - RNA, 19 nt, Salmonella enterica enterica serovar Typhi Ty2
cgaucugguuauccaccag

SEQ ID NO: 1771179 - RNA, 23 nt, Salmonella enterica enterica serovar Typhi Ty2
cgaucguaaucacccgcuuccag

SEQ ID NO: 1771180 - RNA, 18 nt, Salmonella enterica enterica serovar Typhi Ty2
cgaucuauuucauaauaa

SEQ ID NO: 1771181 - RNA, 17 nt, Salmonella enterica enterica serovar Typhi Ty2
cgaucuacgguaucugc

SEQ ID NO: 1771182 - RNA, 16 nt, Salmonella enterica enterica serovar Typhi Ty2
cgaucuccaucuccag

SEQ ID NO: 1771183 - RNA, 14 nt, Salmonella enterica enterica serovar Typhi Ty2
cgaugaaaaagagg

SEQ ID NO: 1771184 - RNA, 17 nt, Salmonella enterica enterica serovar Typhi Ty2
cgaugacgacuuuuugc

SEQ ID NO: 1771185 - RNA, 15 nt, Salmonella enterica enterica serovar Typhi Ty2
cgaugacgacuuuuu

SEQ ID NO: 1771186 - RNA, 20 nt, Salmonella enterica enterica serovar Typhi Ty2
cgaugagcgcgaaaucaaag

SEQ ID NO: 1771187 - RNA, 20 nt, Salmonella enterica enterica serovar Typhi Ty2
cgaugacucguauuuaaacc

SEQ ID NO: 1771188 - RNA, 16 nt, Salmonella enterica enterica serovar Typhi Ty2
cgaugaguucaguaug

SEQ ID NO: 1771189 - RNA, 15 nt, Salmonella enterica enterica serovar Typhi Ty2
cgaucaugccgccca

SEQ ID NO: 1771190 - RNA, 13 nt, Salmonella enterica enterica serovar Typhi Ty2
cgauccaggucuu

SEQ ID NO: 1771191 - RNA, 15 nt, Salmonella enterica enterica serovar Typhi Ty2
cgauccagccccagc

SEQ ID NO: 1771192 - RNA, 19 nt, Salmonella enterica enterica serovar Typhi Ty2
cgaucagcgccaccacaaa

SEQ ID NO: 1771193 - RNA, 22 nt, Salmonella enterica enterica serovar Typhi Ty2
cgaucccggcaaaaaucagccc

SEQ ID NO: 1771194 - RNA, 23 nt, Salmonella enterica enterica serovar Typhi Ty2
cgauccccucuuccaucagccag

SEQ ID NO: 1771195 - RNA, 23 nt, Salmonella enterica enterica serovar Typhi Ty2
cgaucgagucaggcgccagaguc

SEQ ID NO: 1771196 - RNA, 13 nt, Salmonella enterica enterica serovar Typhi Ty2
cgacgucaauaaa

SEQ ID NO: 1771197 - RNA, 13 nt, Salmonella enterica enterica serovar Typhi Ty2
cgacgucccguca

SEQ ID NO: 1771198 - RNA, 15 nt, Salmonella enterica enterica serovar Typhi Ty2
cgauaacucuucauc

SEQ ID NO: 1771199 - RNA, 13 nt, Salmonella enterica enterica serovar Typhi Ty2
cgauaagcgcugu

SEQ ID NO: 1771200 - RNA, 18 nt, Salmonella enterica enterica serovar Typhi Ty2
cgauaauaauuaccacgc

SEQ ID NO: 1771201 - RNA, 19 nt, Salmonella enterica enterica serovar Typhi Ty2
cgauaaggauaucuugaug

SEQ ID NO: 1771202 - RNA, 14 nt, Salmonella enterica enterica serovar Typhi Ty2
cgauaccaguaaua

SEQ ID NO: 1771203 - RNA, 18 nt, Salmonella enterica enterica serovar Typhi Ty2
cgauaauacagccugcgu

SEQ ID NO: 1771204 - RNA, 14 nt, Salmonella enterica enterica serovar Typhi Ty2
cgauaaucaccagc

SEQ ID NO: 1771205 - RNA, 15 nt, Salmonella enterica enterica serovar Typhi Ty2
cgauaaucaccagcc

SEQ ID NO: 1771206 - RNA, 22 nt, Salmonella enterica enterica serovar Typhi Ty2
cgauacucacgacuuucaccag

SEQ ID NO: 1771207 - RNA, 13 nt, Salmonella enterica enterica serovar Typhi Ty2
cgauacccgcgau

SEQ ID NO: 1771208 - RNA, 16 nt, Salmonella enterica enterica serovar Typhi Ty2
cgauaucauucucuac

SEQ ID NO: 1771209 - RNA, 16 nt, Salmonella enterica enterica serovar Typhi Ty2
cgauaucgauaaucaa

SEQ ID NO: 1771210 - RNA, 17 nt, Salmonella enterica enterica serovar Typhi Ty2
cgauauaauuuuauuau

SEQ ID NO: 1771211 - RNA, 22 nt, Salmonella enterica enterica serovar Typhi Ty2
cgauauaagcgccgucauccgc

SEQ ID NO: 1771212 - RNA, 12 nt, Salmonella enterica enterica serovar Typhi Ty2
cgaucaccacgc

SEQ ID NO: 1771213 - RNA, 19 nt, Salmonella enterica enterica serovar Typhi Ty2
cgcagcugccacaccacau

SEQ ID NO: 1771214 - RNA, 15 nt, Salmonella enterica enterica serovar Typhi Ty2
cgcagcugggccugc

SEQ ID NO: 1771215 - RNA, 15 nt, Salmonella enterica enterica serovar Typhi Ty2
cgcagcuucgccgcg

SEQ ID NO: 1771216 - RNA, 14 nt, Salmonella enterica enterica serovar Typhi Ty2
aaacgguauuucca

SEQ ID NO: 1771217 - RNA, 16 nt, Salmonella enterica enterica serovar Typhi Ty2
cgcaguaaacuccucu

SEQ ID NO: 1771218 - RNA, 14 nt, Salmonella enterica enterica serovar Typhi Ty2
cgcagguuuuacuu

SEQ ID NO: 1771219 - RNA, 16 nt, Salmonella enterica enterica serovar Typhi Ty2
cgcagucguuccagac

SEQ ID NO: 1771220 - RNA, 16 nt, Salmonella enterica enterica serovar Typhi Ty2
cgcagucaagcuugcc

SEQ ID NO: 1771221 - RNA, 16 nt, Salmonella enterica enterica serovar Typhi Ty2
cgcagugaccagcauc

SEQ ID NO: 1771222 - RNA, 16 nt, Salmonella enterica enterica serovar Typhi Ty2
cgcagugcagcggaug

SEQ ID NO: 1771223 - RNA, 14 nt, Salmonella enterica enterica serovar Typhi Ty2
cgcaguucaauauu

SEQ ID NO: 1771224 - RNA, 19 nt, Salmonella enterica enterica serovar Typhi Ty2
cgcaguucauccacgcggg

SEQ ID NO: 1771225 - RNA, 14 nt, Salmonella enterica enterica serovar Typhi Ty2
cgcauaaaaaauga

SEQ ID NO: 1771226 - RNA, 22 nt, Salmonella enterica enterica serovar Typhi Ty2
cgcaguuugucuucgaugcgcu

SEQ ID NO: 1771227 - RNA, 17 nt, Salmonella enterica enterica serovar Typhi Ty2
cgcaguuuguggcgugu

SEQ ID NO: 1771228 - RNA, 17 nt, Salmonella enterica enterica serovar Typhi Ty2
cgcagcacaugcaauuu

SEQ ID NO: 1771229 - RNA, 12 nt, Salmonella enterica enterica serovar Typhi Ty2
cgcagcaccgcc

SEQ ID NO: 1771230 - RNA, 17 nt, Salmonella enterica enterica serovar Typhi Ty2
cgcagccagaacagaag

SEQ ID NO: 1771231 - RNA, 20 nt, Salmonella enterica enterica serovar Typhi Ty2
cgcagccaacaacaggccgc

SEQ ID NO: 1771232 - RNA, 23 nt, Salmonella enterica enterica serovar Typhi Ty2
cgcagcgcuuugccgcugcugcc

SEQ ID NO: 1771233 - RNA, 12 nt, Salmonella enterica enterica serovar Typhi Ty2
cgcagcgcggcc

SEQ ID NO: 1771234 - RNA, 18 nt, Salmonella enterica enterica serovar Typhi Ty2
cgcagcgccaucaggccc

SEQ ID NO: 1771235 - RNA, 19 nt, Salmonella enterica enterica serovar Typhi Ty2
cgcagcgccauccggcaaa

SEQ ID NO: 1771236 - RNA, 13 nt, Salmonella enterica enterica serovar Typhi Ty2
cgcagcgcggccu

SEQ ID NO: 1771237 - RNA, 15 nt, Salmonella enterica enterica serovar Typhi Ty2
cgcagcgcaacgccu

SEQ ID NO: 1771238 - RNA, 22 nt, Salmonella enterica enterica serovar Typhi Ty2
cgcagcgaccuccgcgcagcaa

SEQ ID NO: 1771239 - RNA, 13 nt, Salmonella enterica enterica serovar Typhi Ty2
cgcagccccagcg

SEQ ID NO: 1771240 - RNA, 15 nt, Salmonella enterica enterica serovar Typhi Ty2
cgcagccccagcgcc

SEQ ID NO: 1771241 - RNA, 22 nt, Salmonella enterica enterica serovar Typhi Ty2
cgcagccccagcgccagccgcg

SEQ ID NO: 1771242 - RNA, 18 nt, Salmonella enterica enterica serovar Typhi Ty2
cgauuucauuggucuuca

SEQ ID NO: 1771243 - RNA, 13 nt, Salmonella enterica enterica serovar Typhi Ty2
cgcaagcagcaca

SEQ ID NO: 1771244 - RNA, 19 nt, Salmonella enterica enterica serovar Typhi Ty2
cgcaaggaaauauuaauua

SEQ ID NO: 1771245 - RNA, 18 nt, Salmonella enterica enterica serovar Typhi Ty2
cgcaauagggggugacau

SEQ ID NO: 1771246 - RNA, 14 nt, Salmonella enterica enterica serovar Typhi Ty2
cgcaaucacauaca

SEQ ID NO: 1771247 - RNA, 17 nt, Salmonella enterica enterica serovar Typhi Ty2
cgcaccaguuccccaua

SEQ ID NO: 1771248 - RNA, 14 nt, Salmonella enterica enterica serovar Typhi Ty2
cgcacccgcgcagg

SEQ ID NO: 1771249 - RNA, 18 nt, Salmonella enterica enterica serovar Typhi Ty2
cgcaauguggacaaucag

SEQ ID NO: 1771250 - RNA, 15 nt, Salmonella enterica enterica serovar Typhi Ty2
cgcaaugccaccaca

SEQ ID NO: 1771251 - RNA, 13 nt, Salmonella enterica enterica serovar Typhi Ty2
cgcaauccccugg

SEQ ID NO: 1771252 - RNA, 16 nt, Salmonella enterica enterica serovar Typhi Ty2
cgcaaucggcuuugac

SEQ ID NO: 1771253 - RNA, 17 nt, Salmonella enterica enterica serovar Typhi Ty2
cgcaccgcgaugcugcu

SEQ ID NO: 1771254 - RNA, 22 nt, Salmonella enterica enterica serovar Typhi Ty2
cgcacggcgcguccucacacug

SEQ ID NO: 1771255 - RNA, 18 nt, Salmonella enterica enterica serovar Typhi Ty2
cgcacugauagccgccag

SEQ ID NO: 1771256 - RNA, 15 nt, Salmonella enterica enterica serovar Typhi Ty2
cgcacuggcgccugc

SEQ ID NO: 1771257 - RNA, 15 nt, Salmonella enterica enterica serovar Typhi Ty2
cgcagaauuuauuuc

SEQ ID NO: 1771258 - RNA, 14 nt, Salmonella enterica enterica serovar Typhi Ty2
cgcagacacugcca

SEQ ID NO: 1771259 - RNA, 16 nt, Salmonella enterica enterica serovar Typhi Ty2
cgcagaccgcgcucca

SEQ ID NO: 1771260 - RNA, 18 nt, Salmonella enterica enterica serovar Typhi Ty2
cgcagagauagccagcga

SEQ ID NO: 1771261 - RNA, 16 nt, Salmonella enterica enterica serovar Typhi Ty2
cgcagcaacaguugcu

SEQ ID NO: 1771262 - RNA, 15 nt, Salmonella enterica enterica serovar Typhi Ty2
cgcagcaagaacaga

SEQ ID NO: 1771263 - RNA, 15 nt, Salmonella enterica enterica serovar Typhi Ty2
cgcagagcccagcgc

SEQ ID NO: 1771264 - RNA, 15 nt, Salmonella enterica enterica serovar Typhi Ty2
cgcagcaaacgccau

SEQ ID NO: 1771265 - RNA, 18 nt, Salmonella enterica enterica serovar Typhi Ty2
cgcagcaaacgccauagc

SEQ ID NO: 1771266 - RNA, 21 nt, Salmonella enterica enterica serovar Typhi Ty2
cgccagagcacgaaaagugug

SEQ ID NO: 1771267 - RNA, 16 nt, Salmonella enterica enterica serovar Typhi Ty2
cgccagacucagccag

SEQ ID NO: 1771268 - RNA, 23 nt, Salmonella enterica enterica serovar Typhi Ty2
cgccagacccacuaacugccgcu

SEQ ID NO: 1771269 - RNA, 15 nt, Salmonella enterica enterica serovar Typhi Ty2
cgccagacccagcgc

SEQ ID NO: 1771270 - RNA, 16 nt, Salmonella enterica enterica serovar Typhi Ty2
cgccagaauagcgcag

SEQ ID NO: 1771271 - RNA, 22 nt, Salmonella enterica enterica serovar Typhi Ty2
cgccagacacuggaaacagcca

SEQ ID NO: 1771272 - RNA, 17 nt, Salmonella enterica enterica serovar Typhi Ty2
cgccagaaaagaaccga

SEQ ID NO: 1771273 - RNA, 23 nt, Salmonella enterica enterica serovar Typhi Ty2
cgccagaucgaacagcggcaggc

SEQ ID NO: 1771274 - RNA, 22 nt, Salmonella enterica enterica serovar Typhi Ty2
cgccagaggcgugcaugggcag

SEQ ID NO: 1771275 - RNA, 14 nt, Salmonella enterica enterica serovar Typhi Ty2
cgccagaggcgugc

SEQ ID NO: 1771276 - RNA, 15 nt, Salmonella enterica enterica serovar Typhi Ty2
cgccagauacacgcc

SEQ ID NO: 1771277 - RNA, 16 nt, Salmonella enterica enterica serovar Typhi Ty2
cgccagauccggcagc

SEQ ID NO: 1771278 - RNA, 17 nt, Salmonella enterica enterica serovar Typhi Ty2
cgccagauucaugauuu

SEQ ID NO: 1771279 - RNA, 20 nt, Salmonella enterica enterica serovar Typhi Ty2
cgccagauaaucgccgccag

SEQ ID NO: 1771280 - RNA, 23 nt, Salmonella enterica enterica serovar Typhi Ty2
cgccagcaacgagcuuuuuucuu

SEQ ID NO: 1771281 - RNA, 15 nt, Salmonella enterica enterica serovar Typhi Ty2
cgccagcaacgccca

SEQ ID NO: 1771282 - RNA, 21 nt, Salmonella enterica enterica serovar Typhi Ty2
cgccagcaaugccgccgccag

SEQ ID NO: 1771283 - RNA, 18 nt, Salmonella enterica enterica serovar Typhi Ty2
cgccagauuaucggccag

SEQ ID NO: 1771284 - RNA, 16 nt, Salmonella enterica enterica serovar Typhi Ty2
cgccagcaguugcagc

SEQ ID NO: 1771285 - RNA, 22 nt, Salmonella enterica enterica serovar Typhi Ty2
cgccagcauaugcacacgcagc

SEQ ID NO: 1771286 - RNA, 15 nt, Salmonella enterica enterica serovar Typhi Ty2
cgccagcagcucgcc

SEQ ID NO: 1771287 - RNA, 11 nt, Salmonella enterica enterica serovar Typhi Ty2
cgccagcagcg

SEQ ID NO: 1771288 - RNA, 21 nt, Salmonella enterica enterica serovar Typhi Ty2
cgccagcaccacuacuacacc

SEQ ID NO: 1771289 - RNA, 16 nt, Salmonella enterica enterica serovar Typhi Ty2
cgccagcaccagcagc

SEQ ID NO: 1771290 - RNA, 14 nt, Salmonella enterica enterica serovar Typhi Ty2
cgccagcaccaggc

SEQ ID NO: 1771291 - RNA, 16 nt, Salmonella enterica enterica serovar Typhi Ty2
cgccagcaccaggcuc

SEQ ID NO: 1771292 - RNA, 13 nt, Salmonella enterica enterica serovar Typhi Ty2
cgccagcauggcg

SEQ ID NO: 1771293 - RNA, 19 nt, Salmonella enterica enterica serovar Typhi Ty2
cgccagccagcucaccagc

SEQ ID NO: 1771294 - RNA, 15 nt, Salmonella enterica enterica serovar Typhi Ty2
cgccagccagcgcca

SEQ ID NO: 1771295 - RNA, 14 nt, Salmonella enterica enterica serovar Typhi Ty2
cgccacggcuuuca

SEQ ID NO: 1771296 - RNA, 15 nt, Salmonella enterica enterica serovar Typhi Ty2
cgccacgccaccggg

SEQ ID NO: 1771297 - RNA, 17 nt, Salmonella enterica enterica serovar Typhi Ty2
cgccaccuuucugcucc

SEQ ID NO: 1771298 - RNA, 22 nt, Salmonella enterica enterica serovar Typhi Ty2
cgccaccuguuucgccaggccg

SEQ ID NO: 1771299 - RNA, 13 nt, Salmonella enterica enterica serovar Typhi Ty2
cgccacuuccagc

SEQ ID NO: 1771300 - RNA, 20 nt, Salmonella enterica enterica serovar Typhi Ty2
cgccacuucuuugaccagcg

SEQ ID NO: 1771301 - RNA, 19 nt, Salmonella enterica enterica serovar Typhi Ty2
cgccacucuggcgacgcca

SEQ ID NO: 1771302 - RNA, 14 nt, Salmonella enterica enterica serovar Typhi Ty2
cgccacgucggcga

SEQ ID NO: 1771303 - RNA, 17 nt, Salmonella enterica enterica serovar Typhi Ty2
cgccaccauccggcgcu

SEQ ID NO: 1771304 - RNA, 14 nt, Salmonella enterica enterica serovar Typhi Ty2
cgccaccagcgcag

SEQ ID NO: 1771305 - RNA, 23 nt, Salmonella enterica enterica serovar Typhi Ty2
cgcauccuguuuuuucagcgcgc

SEQ ID NO: 1771306 - RNA, 13 nt, Salmonella enterica enterica serovar Typhi Ty2
cgccaccacgccg

SEQ ID NO: 1771307 - RNA, 20 nt, Salmonella enterica enterica serovar Typhi Ty2
cgccaccacgcccaacgacc

SEQ ID NO: 1771308 - RNA, 16 nt, Salmonella enterica enterica serovar Typhi Ty2
cgcauccgucaaaaug

SEQ ID NO: 1771309 - RNA, 22 nt, Salmonella enterica enterica serovar Typhi Ty2
cgcauccgggaguuucaugcca

SEQ ID NO: 1771310 - RNA, 14 nt, Salmonella enterica enterica serovar Typhi Ty2
cgcauccggcauca

SEQ ID NO: 1771311 - RNA, 17 nt, Salmonella enterica enterica serovar Typhi Ty2
cgcauaccuucaugcau

SEQ ID NO: 1771312 - RNA, 16 nt, Salmonella enterica enterica serovar Typhi Ty2
cgcauaauccagcagg

SEQ ID NO: 1771313 - RNA, 13 nt, Salmonella enterica enterica serovar Typhi Ty2
cgcauaaccgauu

SEQ ID NO: 1771314 - RNA, 17 nt, Salmonella enterica enterica serovar Typhi Ty2
cgccaggauaauaauga

SEQ ID NO: 1771315 - RNA, 20 nt, Salmonella enterica enterica serovar Typhi Ty2
cgccaggaaccgcggucggc

SEQ ID NO: 1771316 - RNA, 19 nt, Salmonella enterica enterica serovar Typhi Ty2
cgccaggcauguuaugaau

SEQ ID NO: 1771317 - RNA, 18 nt, Salmonella enterica enterica serovar Typhi Ty2
cgccaggcccagccgcuc

SEQ ID NO: 1771318 - RNA, 14 nt, Salmonella enterica enterica serovar Typhi Ty2
cgccagcguugacc

SEQ ID NO: 1771319 - RNA, 18 nt, Salmonella enterica enterica serovar Typhi Ty2
cgccagcuaauuuuacuu

SEQ ID NO: 1771320 - RNA, 15 nt, Salmonella enterica enterica serovar Typhi Ty2
cgccagcugcgcgcu

SEQ ID NO: 1771321 - RNA, 16 nt, Salmonella enterica enterica serovar Typhi Ty2
cgccagcugcgcgcua

SEQ ID NO: 1771322 - RNA, 20 nt, Salmonella enterica enterica serovar Typhi Ty2
cgccagcgacgguaauacca

SEQ ID NO: 1771323 - RNA, 19 nt, Salmonella enterica enterica serovar Typhi Ty2
cgccagcgagaugaaaagu

SEQ ID NO: 1771324 - RNA, 23 nt, Salmonella enterica enterica serovar Typhi Ty2
cgccagccgcgccaucuccuccu

SEQ ID NO: 1771325 - RNA, 22 nt, Salmonella enterica enterica serovar Typhi Ty2
cgccagcggccagcguaccugc

SEQ ID NO: 1771326 - RNA, 23 nt, Salmonella enterica enterica serovar Typhi Ty2
cgccagcgcgguuucuacaccuu

SEQ ID NO: 1771327 - RNA, 12 nt, Salmonella enterica enterica serovar Typhi Ty2
cgccagcggcgc

SEQ ID NO: 1771328 - RNA, 13 nt, Salmonella enterica enterica serovar Typhi Ty2
cgccagcggcgcc

SEQ ID NO: 1771329 - RNA, 18 nt, Salmonella enterica enterica serovar Typhi Ty2
cgccagcgguguuugcca

SEQ ID NO: 1771330 - RNA, 17 nt, Salmonella enterica enterica serovar Typhi Ty2
cgccagcgggccgguaa

SEQ ID NO: 1771331 - RNA, 12 nt, Salmonella enterica enterica serovar Typhi Ty2
cgccagggcggc

SEQ ID NO: 1771332 - RNA, 15 nt, Salmonella enterica enterica serovar Typhi Ty2
cgccaggcgcugcgu

SEQ ID NO: 1771333 - RNA, 19 nt, Salmonella enterica enterica serovar Typhi Ty2
cgccaggcggguggugagc

SEQ ID NO: 1771334 - RNA, 21 nt, Salmonella enterica enterica serovar Typhi Ty2
cgccaggucucauagcgcccc

SEQ ID NO: 1771335 - RNA, 22 nt, Salmonella enterica enterica serovar Typhi Ty2
cgccaggucucauagcgcccca

SEQ ID NO: 1771336 - RNA, 16 nt, Salmonella enterica enterica serovar Typhi Ty2
cgccaguaaucggcgc

SEQ ID NO: 1771337 - RNA, 18 nt, Salmonella enterica enterica serovar Typhi Ty2
cgccagugaauccaccac

SEQ ID NO: 1771338 - RNA, 13 nt, Salmonella enterica enterica serovar Typhi Ty2
cgccagucacccu

SEQ ID NO: 1771339 - RNA, 16 nt, Salmonella enterica enterica serovar Typhi Ty2
cgccaguucccacagc

SEQ ID NO: 1771340 - RNA, 20 nt, Salmonella enterica enterica serovar Typhi Ty2
cgccaguucccacagcuuca

SEQ ID NO: 1771341 - RNA, 17 nt, Salmonella enterica enterica serovar Typhi Ty2
cgccaguuccaucauug

SEQ ID NO: 1771342 - RNA, 19 nt, Salmonella enterica enterica serovar Typhi Ty2
cgccauagaaauagccccg

SEQ ID NO: 1771343 - RNA, 16 nt, Salmonella enterica enterica serovar Typhi Ty2
cgccauacuuacugcu

SEQ ID NO: 1771344 - RNA, 18 nt, Salmonella enterica enterica serovar Typhi Ty2
cgccauaauuguucagcu

SEQ ID NO: 1771345 - RNA, 17 nt, Salmonella enterica enterica serovar Typhi Ty2
cgccauauccccgccau

SEQ ID NO: 1771346 - RNA, 20 nt, Salmonella enterica enterica serovar Typhi Ty2
cgccauauaggcauguuccu

SEQ ID NO: 1771347 - RNA, 16 nt, Salmonella enterica enterica serovar Typhi Ty2
cgccaguuuuuauacu

SEQ ID NO: 1771348 - RNA, 23 nt, Salmonella enterica enterica serovar Typhi Ty2
cgccaguuuuugcgccauugccg

SEQ ID NO: 1771349 - RNA, 22 nt, Salmonella enterica enterica serovar Typhi Ty2
cgccauaaaaaacaccugucug

SEQ ID NO: 1771350 - RNA, 15 nt, Salmonella enterica enterica serovar Typhi Ty2
cgccauaaagcugua

SEQ ID NO: 1771351 - RNA, 18 nt, Salmonella enterica enterica serovar Typhi Ty2
cgccauaaaucagaucca

SEQ ID NO: 1771352 - RNA, 21 nt, Salmonella enterica enterica serovar Typhi Ty2
cgccauaaaucagauccacgc

SEQ ID NO: 1771353 - RNA, 22 nt, Salmonella enterica enterica serovar Typhi Ty2
cgccauaagaauguccccauau

SEQ ID NO: 1771354 - RNA, 11 nt, Salmonella enterica enterica serovar Typhi Ty2
cgccauaauac

SEQ ID NO: 1771355 - RNA, 19 nt, Salmonella enterica enterica serovar Typhi Ty2
cgccauaauacuuaauuca

SEQ ID NO: 1771356 - RNA, 17 nt, Salmonella enterica enterica serovar Typhi Ty2
cgccauccggcauuuuu

SEQ ID NO: 1771357 - RNA, 23 nt, Salmonella enterica enterica serovar Typhi Ty2
cgccauccggcggugcagguugc

SEQ ID NO: 1771358 - RNA, 13 nt, Salmonella enterica enterica serovar Typhi Ty2
cgccauccggcau

SEQ ID NO: 1771359 - RNA, 14 nt, Salmonella enterica enterica serovar Typhi Ty2
cgccauccggcaac

SEQ ID NO: 1771360 - RNA, 13 nt, Salmonella enterica enterica serovar Typhi Ty2
cgccauccugccg

SEQ ID NO: 1771361 - RNA, 14 nt, Salmonella enterica enterica serovar Typhi Ty2
cgccauccggccug

SEQ ID NO: 1771362 - RNA, 17 nt, Salmonella enterica enterica serovar Typhi Ty2
cgccaucagcaaaauac

SEQ ID NO: 1771363 - RNA, 12 nt, Salmonella enterica enterica serovar Typhi Ty2
cgccaucaccag

SEQ ID NO: 1771364 - RNA, 20 nt, Salmonella enterica enterica serovar Typhi Ty2
cgccaucaauuuugcgccua

SEQ ID NO: 1771365 - RNA, 18 nt, Salmonella enterica enterica serovar Typhi Ty2
cgccauaucuucgcgcgu

SEQ ID NO: 1771366 - RNA, 17 nt, Salmonella enterica enterica serovar Typhi Ty2
cgccaucaggcaaucuu

SEQ ID NO: 1771367 - RNA, 21 nt, Salmonella enterica enterica serovar Typhi Ty2
cgccaucaggcaugccaaacc

SEQ ID NO: 1771368 - RNA, 19 nt, Salmonella enterica enterica serovar Typhi Ty2
cgccaucaggcuggguaac

SEQ ID NO: 1771369 - RNA, 14 nt, Salmonella enterica enterica serovar Typhi Ty2
cgcccaaccagccc

SEQ ID NO: 1771370 - RNA, 14 nt, Salmonella enterica enterica serovar Typhi Ty2
cgcccacgccgcgc

SEQ ID NO: 1771371 - RNA, 19 nt, Salmonella enterica enterica serovar Typhi Ty2
cgcccacgcggcgugcgcu

SEQ ID NO: 1771372 - RNA, 21 nt, Salmonella enterica enterica serovar Typhi Ty2
cgccauugaucauuggggaac

SEQ ID NO: 1771373 - RNA, 17 nt, Salmonella enterica enterica serovar Typhi Ty2
cgccauucccgcgacgu

SEQ ID NO: 1771374 - RNA, 16 nt, Salmonella enterica enterica serovar Typhi Ty2
cgccauuuagcgccga

SEQ ID NO: 1771375 - RNA, 23 nt, Salmonella enterica enterica serovar Typhi Ty2
cgccauuggcucggcgucauccc

SEQ ID NO: 1771376 - RNA, 22 nt, Salmonella enterica enterica serovar Typhi Ty2
cgccauuggcaaucaguacgcg

SEQ ID NO: 1771377 - RNA, 16 nt, Salmonella enterica enterica serovar Typhi Ty2
cgccauuuccagcccc

SEQ ID NO: 1771378 - RNA, 20 nt, Salmonella enterica enterica serovar Typhi Ty2
cgccauuuuauccaggccag

SEQ ID NO: 1771379 - RNA, 16 nt, Salmonella enterica enterica serovar Typhi Ty2
cgccauuugcgcggcu

SEQ ID NO: 1771380 - RNA, 18 nt, Salmonella enterica enterica serovar Typhi Ty2
cgccauuugccagauagc

SEQ ID NO: 1771381 - RNA, 17 nt, Salmonella enterica enterica serovar Typhi Ty2
cgcccagauauccgcgc

SEQ ID NO: 1771382 - RNA, 18 nt, Salmonella enterica enterica serovar Typhi Ty2
cgcccagauauccgcgcu

SEQ ID NO: 1771383 - RNA, 16 nt, Salmonella enterica enterica serovar Typhi Ty2
cgcccagaucaggccc

SEQ ID NO: 1771384 - RNA, 21 nt, Salmonella enterica enterica serovar Typhi Ty2
cgcccagcguacguaacuucu

SEQ ID NO: 1771385 - RNA, 23 nt, Salmonella enterica enterica serovar Typhi Ty2
cgccccagcaugagccagcccuc

SEQ ID NO: 1771386 - RNA, 15 nt, Salmonella enterica enterica serovar Typhi Ty2
cgcccaucacaugua

SEQ ID NO: 1771387 - RNA, 16 nt, Salmonella enterica enterica serovar Typhi Ty2
cgcccaucgccacagc

SEQ ID NO: 1771388 - RNA, 15 nt, Salmonella enterica enterica serovar Typhi Ty2
cgcccaucgccacag

SEQ ID NO: 1771389 - RNA, 21 nt, Salmonella enterica enterica serovar Typhi Ty2
cgcccugccauucccagccga

SEQ ID NO: 1771390 - RNA, 16 nt, Salmonella enterica enterica serovar Typhi Ty2
cgcccugaagggcggc

SEQ ID NO: 1771391 - RNA, 13 nt, Salmonella enterica enterica serovar Typhi Ty2
cgcccgguuuugu

SEQ ID NO: 1771392 - RNA, 13 nt, Salmonella enterica enterica serovar Typhi Ty2
cgcccggcgggua

SEQ ID NO: 1771393 - RNA, 18 nt, Salmonella enterica enterica serovar Typhi Ty2
cgcccggcgcgcuggagg

SEQ ID NO: 1771394 - RNA, 14 nt, Salmonella enterica enterica serovar Typhi Ty2
cgcccggcgccagc

SEQ ID NO: 1771395 - RNA, 18 nt, Salmonella enterica enterica serovar Typhi Ty2
cgcccgcucgcgauccuc

SEQ ID NO: 1771396 - RNA, 19 nt, Salmonella enterica enterica serovar Typhi Ty2
cgcccugcgguagcgccga

SEQ ID NO: 1771397 - RNA, 16 nt, Salmonella enterica enterica serovar Typhi Ty2
cgcccugcgucgcgcu

SEQ ID NO: 1771398 - RNA, 14 nt, Salmonella enterica enterica serovar Typhi Ty2
cgcccugcgccagc

SEQ ID NO: 1771399 - RNA, 12 nt, Salmonella enterica enterica serovar Typhi Ty2
cgcccugcggaa

SEQ ID NO: 1771400 - RNA, 15 nt, Salmonella enterica enterica serovar Typhi Ty2
cgcccugcgcgccuu

SEQ ID NO: 1771401 - RNA, 13 nt, Salmonella enterica enterica serovar Typhi Ty2
cgcccugcuccca

SEQ ID NO: 1771402 - RNA, 15 nt, Salmonella enterica enterica serovar Typhi Ty2
cgcccuugccgcuuc

SEQ ID NO: 1771403 - RNA, 23 nt, Salmonella enterica enterica serovar Typhi Ty2
cgcccuuuuaguucaaccugcgc

SEQ ID NO: 1771404 - RNA, 16 nt, Salmonella enterica enterica serovar Typhi Ty2
cgccgaaauuuucccg

SEQ ID NO: 1771405 - RNA, 12 nt, Salmonella enterica enterica serovar Typhi Ty2
cgccgccagcac

SEQ ID NO: 1771406 - RNA, 13 nt, Salmonella enterica enterica serovar Typhi Ty2
cgccgccagccga

SEQ ID NO: 1771407 - RNA, 14 nt, Salmonella enterica enterica serovar Typhi Ty2
cgccgccagcaccg

SEQ ID NO: 1771408 - RNA, 20 nt, Salmonella enterica enterica serovar Typhi Ty2
cgccgccaggauaauaauga

SEQ ID NO: 1771409 - RNA, 18 nt, Salmonella enterica enterica serovar Typhi Ty2
cgccgcaaugccgccugc

SEQ ID NO: 1771410 - RNA, 17 nt, Salmonella enterica enterica serovar Typhi Ty2
cgccgcaaaccagacca

SEQ ID NO: 1771411 - RNA, 19 nt, Salmonella enterica enterica serovar Typhi Ty2
cgccgcaaacgccgagccg

SEQ ID NO: 1771412 - RNA, 15 nt, Salmonella enterica enterica serovar Typhi Ty2
cgccgauuccugcug

SEQ ID NO: 1771413 - RNA, 17 nt, Salmonella enterica enterica serovar Typhi Ty2
cgccgacucacgcagcg

SEQ ID NO: 1771414 - RNA, 23 nt, Salmonella enterica enterica serovar Typhi Ty2
cgccgacaugguuaaccaccagc

SEQ ID NO: 1771415 - RNA, 21 nt, Salmonella enterica enterica serovar Typhi Ty2
cgccgaccacuucaacgccgc

SEQ ID NO: 1771416 - RNA, 16 nt, Salmonella enterica enterica serovar Typhi Ty2
cgccgacaugguuaac

SEQ ID NO: 1771417 - RNA, 14 nt, Salmonella enterica enterica serovar Typhi Ty2
cgccgaccaccagc

SEQ ID NO: 1771418 - RNA, 19 nt, Salmonella enterica enterica serovar Typhi Ty2
cgccgacccccuccuugua

SEQ ID NO: 1771419 - RNA, 12 nt, Salmonella enterica enterica serovar Typhi Ty2
cggccagccaua

SEQ ID NO: 1771420 - RNA, 17 nt, Salmonella enterica enterica serovar Typhi Ty2
cggccagcgucaucaga

SEQ ID NO: 1771421 - RNA, 22 nt, Salmonella enterica enterica serovar Typhi Ty2
cggccauggaacauccucuccu

SEQ ID NO: 1771422 - RNA, 22 nt, Salmonella enterica enterica serovar Typhi Ty2
cggccauggagagugagccacg

SEQ ID NO: 1771423 - RNA, 23 nt, Salmonella enterica enterica serovar Typhi Ty2
cggccaugacucaaacagauagc

SEQ ID NO: 1771424 - RNA, 15 nt, Salmonella enterica enterica serovar Typhi Ty2
cggccauagcgugag

SEQ ID NO: 1771425 - RNA, 19 nt, Salmonella enterica enterica serovar Typhi Ty2
cggccaggauggcccgguu

SEQ ID NO: 1771426 - RNA, 20 nt, Salmonella enterica enterica serovar Typhi Ty2
cggccaguucuuguaguuuu

SEQ ID NO: 1771427 - RNA, 22 nt, Salmonella enterica enterica serovar Typhi Ty2
cggccaauccugcacccgccuu

SEQ ID NO: 1771428 - RNA, 17 nt, Salmonella enterica enterica serovar Typhi Ty2
cggcauuagcaugggcu

SEQ ID NO: 1771429 - RNA, 17 nt, Salmonella enterica enterica serovar Typhi Ty2
cggcauucacgucgcgc

SEQ ID NO: 1771430 - RNA, 15 nt, Salmonella enterica enterica serovar Typhi Ty2
cggcauuaauuucuu

SEQ ID NO: 1771431 - RNA, 14 nt, Salmonella enterica enterica serovar Typhi Ty2
cggccaaagcgcga

SEQ ID NO: 1771432 - RNA, 19 nt, Salmonella enterica enterica serovar Typhi Ty2
cggccaaagcgcgacugga

SEQ ID NO: 1771433 - RNA, 20 nt, Salmonella enterica enterica serovar Typhi Ty2
cggcauucacgucgcgcgcc

SEQ ID NO: 1771434 - RNA, 23 nt, Salmonella enterica enterica serovar Typhi Ty2
cggcauguccggcgacuccagaa

SEQ ID NO: 1771435 - RNA, 17 nt, Salmonella enterica enterica serovar Typhi Ty2
cggcauuaauacaggcc

SEQ ID NO: 1771436 - RNA, 21 nt, Salmonella enterica enterica serovar Typhi Ty2
cggcaugcaucucuucaaaca

SEQ ID NO: 1771437 - RNA, 20 nt, Salmonella enterica enterica serovar Typhi Ty2
cggcaugauagggcgccugu

SEQ ID NO: 1771438 - RNA, 11 nt, Salmonella enterica enterica serovar Typhi Ty2
cggcaucaagc

SEQ ID NO: 1771439 - RNA, 19 nt, Salmonella enterica enterica serovar Typhi Ty2
cggcauaugcaggucgcgc

SEQ ID NO: 1771440 - RNA, 11 nt, Salmonella enterica enterica serovar Typhi Ty2
cggcauagcug

SEQ ID NO: 1771441 - RNA, 16 nt, Salmonella enterica enterica serovar Typhi Ty2
cggcauaugcaggucg

SEQ ID NO: 1771442 - RNA, 19 nt, Salmonella enterica enterica serovar Typhi Ty2
cggcauaagccaguccugc

SEQ ID NO: 1771443 - RNA, 15 nt, Salmonella enterica enterica serovar Typhi Ty2
cggcauccagcgcuc

SEQ ID NO: 1771444 - RNA, 13 nt, Salmonella enterica enterica serovar Typhi Ty2
cggcaucacgccg

SEQ ID NO: 1771445 - RNA, 14 nt, Salmonella enterica enterica serovar Typhi Ty2
cggcaucgccgccc

SEQ ID NO: 1771446 - RNA, 22 nt, Salmonella enterica enterica serovar Typhi Ty2
cggcaucuuuaaccgccugcuc

SEQ ID NO: 1771447 - RNA, 19 nt, Salmonella enterica enterica serovar Typhi Ty2
cggcaucuuuaaccgccug

SEQ ID NO: 1771448 - RNA, 19 nt, Salmonella enterica enterica serovar Typhi Ty2
cggcaugaauugccguggu

SEQ ID NO: 1771449 - RNA, 14 nt, Salmonella enterica enterica serovar Typhi Ty2
cgcuugcuccgcag

SEQ ID NO: 1771450 - RNA, 15 nt, Salmonella enterica enterica serovar Typhi Ty2
cgcuugcgccgccau

SEQ ID NO: 1771451 - RNA, 13 nt, Salmonella enterica enterica serovar Typhi Ty2
cgcuugcgccgcc

SEQ ID NO: 1771452 - RNA, 14 nt, Salmonella enterica enterica serovar Typhi Ty2
cgcuugcgccgcca

SEQ ID NO: 1771453 - RNA, 12 nt, Salmonella enterica enterica serovar Typhi Ty2
cgcuugccacua

SEQ ID NO: 1771454 - RNA, 23 nt, Salmonella enterica enterica serovar Typhi Ty2
cggcagcgcauaagccacuucaa

SEQ ID NO: 1771455 - RNA, 21 nt, Salmonella enterica enterica serovar Typhi Ty2
cggcagccugccgcaucugac

SEQ ID NO: 1771456 - RNA, 16 nt, Salmonella enterica enterica serovar Typhi Ty2
cggcagccaauuuagg

SEQ ID NO: 1771457 - RNA, 17 nt, Salmonella enterica enterica serovar Typhi Ty2
cggcagccgggccgcaa

SEQ ID NO: 1771458 - RNA, 16 nt, Salmonella enterica enterica serovar Typhi Ty2
cggcagccgccaccac

SEQ ID NO: 1771459 - RNA, 20 nt, Salmonella enterica enterica serovar Typhi Ty2
cggcagccgccaccacaaag

SEQ ID NO: 1771460 - RNA, 12 nt, Salmonella enterica enterica serovar Typhi Ty2
cggcagaccgga

SEQ ID NO: 1771461 - RNA, 15 nt, Salmonella enterica enterica serovar Typhi Ty2
cggcagaccggcagc

SEQ ID NO: 1771462 - RNA, 15 nt, Salmonella enterica enterica serovar Typhi Ty2
cggcagacggcuggg

SEQ ID NO: 1771463 - RNA, 23 nt, Salmonella enterica enterica serovar Typhi Ty2
cggcaggacaaucauaauaaacu

SEQ ID NO: 1771464 - RNA, 17 nt, Salmonella enterica enterica serovar Typhi Ty2
cggcaggcagcgccagc

SEQ ID NO: 1771465 - RNA, 12 nt, Salmonella enterica enterica serovar Typhi Ty2
cggcaggcauuu

SEQ ID NO: 1771466 - RNA, 19 nt, Salmonella enterica enterica serovar Typhi Ty2
cggcaggccuuucggcagc

SEQ ID NO: 1771467 - RNA, 17 nt, Salmonella enterica enterica serovar Typhi Ty2
cggcagcgcgccgcccu

SEQ ID NO: 1771468 - RNA, 11 nt, Salmonella enterica enterica serovar Typhi Ty2
cggcaggcugg

SEQ ID NO: 1771469 - RNA, 20 nt, Salmonella enterica enterica serovar Typhi Ty2
cggcagucacuuucagauuu

SEQ ID NO: 1771470 - RNA, 12 nt, Salmonella enterica enterica serovar Typhi Ty2
cggcagucgcua

SEQ ID NO: 1771471 - RNA, 19 nt, Salmonella enterica enterica serovar Typhi Ty2
cggcauacuuucgcgcggc

SEQ ID NO: 1771472 - RNA, 23 nt, Salmonella enterica enterica serovar Typhi Ty2
cggcauacaggccgccgggucag

SEQ ID NO: 1771473 - RNA, 15 nt, Salmonella enterica enterica serovar Typhi Ty2
cggcauacgccgggc

SEQ ID NO: 1771474 - RNA, 23 nt, Salmonella enterica enterica serovar Typhi Ty2
cggcaguucaggcucgcaaauaa

SEQ ID NO: 1771475 - RNA, 22 nt, Salmonella enterica enterica serovar Typhi Ty2
cggcaguggcauguucccaugu

SEQ ID NO: 1771476 - RNA, 17 nt, Salmonella enterica enterica serovar Typhi Ty2
cggcaguugcuggcgcu

SEQ ID NO: 1771477 - RNA, 17 nt, Salmonella enterica enterica serovar Typhi Ty2
cggccgccaucgcaauc

SEQ ID NO: 1771478 - RNA, 22 nt, Salmonella enterica enterica serovar Typhi Ty2
cggcccaggcaucgacgccagc

SEQ ID NO: 1771479 - RNA, 19 nt, Salmonella enterica enterica serovar Typhi Ty2
cggccauuaacacacaauc

SEQ ID NO: 1771480 - RNA, 17 nt, Salmonella enterica enterica serovar Typhi Ty2
cggccgcuuuucggcgc

SEQ ID NO: 1771481 - RNA, 15 nt, Salmonella enterica enterica serovar Typhi Ty2
cggccggaugccagu

SEQ ID NO: 1771482 - RNA, 20 nt, Salmonella enterica enterica serovar Typhi Ty2
cggcgacgugacgcgccagc

SEQ ID NO: 1771483 - RNA, 18 nt, Salmonella enterica enterica serovar Typhi Ty2
cggcgacuauugcgccga

SEQ ID NO: 1771484 - RNA, 17 nt, Salmonella enterica enterica serovar Typhi Ty2
cggcgacugccgcagac

SEQ ID NO: 1771485 - RNA, 13 nt, Salmonella enterica enterica serovar Typhi Ty2
cggcgaccagcag

SEQ ID NO: 1771486 - RNA, 15 nt, Salmonella enterica enterica serovar Typhi Ty2
cggcgaaccggcauc

SEQ ID NO: 1771487 - RNA, 18 nt, Salmonella enterica enterica serovar Typhi Ty2
cggcgaaaaagccggcgg

SEQ ID NO: 1771488 - RNA, 18 nt, Salmonella enterica enterica serovar Typhi Ty2
cggcgaaaaccgagcauc

SEQ ID NO: 1771489 - RNA, 22 nt, Salmonella enterica enterica serovar Typhi Ty2
cggccugcggugguggggccua

SEQ ID NO: 1771490 - RNA, 16 nt, Salmonella enterica enterica serovar Typhi Ty2
cggccugcaggcaacg

SEQ ID NO: 1771491 - RNA, 16 nt, Salmonella enterica enterica serovar Typhi Ty2
cggccucgcuggucag

SEQ ID NO: 1771492 - RNA, 24 nt, Salmonella enterica enterica serovar Typhi Ty2
cggcgcgaaacaggucggcaugca

SEQ ID NO: 1771493 - RNA, 15 nt, Salmonella enterica enterica serovar Typhi Ty2
cggcgcccauccgcc

SEQ ID NO: 1771494 - RNA, 10 nt, Salmonella enterica enterica serovar Typhi Ty2
cggcgcgcca

SEQ ID NO: 1771495 - RNA, 14 nt, Salmonella enterica enterica serovar Typhi Ty2
cggcgcgaaucccg

SEQ ID NO: 1771496 - RNA, 23 nt, Salmonella enterica enterica serovar Typhi Ty2
cggcgcgaguguagucccgccgg

SEQ ID NO: 1771497 - RNA, 13 nt, Salmonella enterica enterica serovar Typhi Ty2
cggcgcgcguggc

SEQ ID NO: 1771498 - RNA, 20 nt, Salmonella enterica enterica serovar Typhi Ty2
cggcgcgccuuccagcaauu

SEQ ID NO: 1771499 - RNA, 14 nt, Salmonella enterica enterica serovar Typhi Ty2
cggcgcagacacug

SEQ ID NO: 1771500 - RNA, 13 nt, Salmonella enterica enterica serovar Typhi Ty2
cggcgcacugccu

SEQ ID NO: 1771501 - RNA, 19 nt, Salmonella enterica enterica serovar Typhi Ty2
cggcgcagacacugccacc

SEQ ID NO: 1771502 - RNA, 13 nt, Salmonella enterica enterica serovar Typhi Ty2
cggcgcagcgacc

SEQ ID NO: 1771503 - RNA, 23 nt, Salmonella enterica enterica serovar Typhi Ty2
cggcgcagcgaccuccgcgcagc

SEQ ID NO: 1771504 - RNA, 20 nt, Salmonella enterica enterica serovar Typhi Ty2
cggcgccaaucaccgccagc

SEQ ID NO: 1771505 - RNA, 21 nt, Salmonella enterica enterica serovar Typhi Ty2
cggcgccaaucaccgccagca

SEQ ID NO: 1771506 - RNA, 12 nt, Salmonella enterica enterica serovar Typhi Ty2
cggcgccaacgc

SEQ ID NO: 1771507 - RNA, 18 nt, Salmonella enterica enterica serovar Typhi Ty2
cggcgccaaucaccgcca

SEQ ID NO: 1771508 - RNA, 17 nt, Salmonella enterica enterica serovar Typhi Ty2
cggcgcccagccugccu

SEQ ID NO: 1771509 - RNA, 22 nt, Salmonella enterica enterica serovar Typhi Ty2
cggcgcccagcuuacgcgcaga

SEQ ID NO: 1771510 - RNA, 22 nt, Salmonella enterica enterica serovar Typhi Ty2
cggcgauaaaugucaggaucag

SEQ ID NO: 1771511 - RNA, 17 nt, Salmonella enterica enterica serovar Typhi Ty2
cggcguaccgcgcgccc

SEQ ID NO: 1771512 - RNA, 15 nt, Salmonella enterica enterica serovar Typhi Ty2
cggcguaccgcgcgc

SEQ ID NO: 1771513 - RNA, 20 nt, Salmonella enterica enterica serovar Typhi Ty2
cggcguaacggcugacgccc

SEQ ID NO: 1771514 - RNA, 13 nt, Salmonella enterica enterica serovar Typhi Ty2
cggcggucugcgc

SEQ ID NO: 1771515 - RNA, 13 nt, Salmonella enterica enterica serovar Typhi Ty2
cggcguaauguug

SEQ ID NO: 1771516 - RNA, 15 nt, Salmonella enterica enterica serovar Typhi Ty2
cggcgguucaucgga

SEQ ID NO: 1771517 - RNA, 15 nt, Salmonella enterica enterica serovar Typhi Ty2
cggcgguggccaguc

SEQ ID NO: 1771518 - RNA, 15 nt, Salmonella enterica enterica serovar Typhi Ty2
cggcgcuucgcagcg

SEQ ID NO: 1771519 - RNA, 19 nt, Salmonella enterica enterica serovar Typhi Ty2
cggcgcuuccugcagugga

SEQ ID NO: 1771520 - RNA, 13 nt, Salmonella enterica enterica serovar Typhi Ty2
cggcgcuggcgcu

SEQ ID NO: 1771521 - RNA, 13 nt, Salmonella enterica enterica serovar Typhi Ty2
cggcggaaaauag

SEQ ID NO: 1771522 - RNA, 23 nt, Salmonella enterica enterica serovar Typhi Ty2
cggcggaaaaaagcagcaucccg

SEQ ID NO: 1771523 - RNA, 16 nt, Salmonella enterica enterica serovar Typhi Ty2
cggcggaaugcugguu

SEQ ID NO: 1771524 - RNA, 15 nt, Salmonella enterica enterica serovar Typhi Ty2
cggcgcuggcgcgcu

SEQ ID NO: 1771525 - RNA, 14 nt, Salmonella enterica enterica serovar Typhi Ty2
cggcgcuaaccagc

SEQ ID NO: 1771526 - RNA, 22 nt, Salmonella enterica enterica serovar Typhi Ty2
cggcgcgguauuucgccgccgc

SEQ ID NO: 1771527 - RNA, 18 nt, Salmonella enterica enterica serovar Typhi Ty2
cggcgggaucuccagaag

SEQ ID NO: 1771528 - RNA, 16 nt, Salmonella enterica enterica serovar Typhi Ty2
cggcgggagcucuacc

SEQ ID NO: 1771529 - RNA, 21 nt, Salmonella enterica enterica serovar Typhi Ty2
ccaggguuuagccccagaccg

SEQ ID NO: 1771530 - RNA, 22 nt, Salmonella enterica enterica serovar Typhi Ty2
ccagguaacauacaaaaaguac

SEQ ID NO: 1771531 - RNA, 19 nt, Salmonella enterica enterica serovar Typhi Ty2
ccagguaacauacaaaaag

SEQ ID NO: 1771532 - RNA, 21 nt, Salmonella enterica enterica serovar Typhi Ty2
ccagccgcgccaucuccuccu

SEQ ID NO: 1771533 - RNA, 12 nt, Salmonella enterica enterica serovar Typhi Ty2
ccagccgcccgc

SEQ ID NO: 1771534 - RNA, 18 nt, Salmonella enterica enterica serovar Typhi Ty2
ccagccgcuuuccgccgc

SEQ ID NO: 1771535 - RNA, 18 nt, Salmonella enterica enterica serovar Typhi Ty2
ccaggugacuuugcccuu

SEQ ID NO: 1771536 - RNA, 16 nt, Salmonella enterica enterica serovar Typhi Ty2
ccagguauacagacaa

SEQ ID NO: 1771537 - RNA, 18 nt, Salmonella enterica enterica serovar Typhi Ty2
ccagguuauucaggugga

SEQ ID NO: 1771538 - RNA, 15 nt, Salmonella enterica enterica serovar Typhi Ty2
ccagguuaauccuua

SEQ ID NO: 1771539 - RNA, 16 nt, Salmonella enterica enterica serovar Typhi Ty2
ccagguuauucaggug

SEQ ID NO: 1771540 - RNA, 18 nt, Salmonella enterica enterica serovar Typhi Ty2
ccaggugucguuaaugcu

SEQ ID NO: 1771541 - RNA, 14 nt, Salmonella enterica enterica serovar Typhi Ty2
ccaguagcgcgccc

SEQ ID NO: 1771542 - RNA, 18 nt, Salmonella enterica enterica serovar Typhi Ty2
ccaguagcgcgacgccaa

SEQ ID NO: 1771543 - RNA, 12 nt, Salmonella enterica enterica serovar Typhi Ty2
ccaguagcagcg

SEQ ID NO: 1771544 - RNA, 15 nt, Salmonella enterica enterica serovar Typhi Ty2
ccaguacuuucuuuu

SEQ ID NO: 1771545 - RNA, 14 nt, Salmonella enterica enterica serovar Typhi Ty2
ccaguagcugcucc

SEQ ID NO: 1771546 - RNA, 13 nt, Salmonella enterica enterica serovar Typhi Ty2
ccagucaguuuau

SEQ ID NO: 1771547 - RNA, 18 nt, Salmonella enterica enterica serovar Typhi Ty2
ccagucaucauaauucag

SEQ ID NO: 1771548 - RNA, 14 nt, Salmonella enterica enterica serovar Typhi Ty2
ccagucaucgccgc

SEQ ID NO: 1771549 - RNA, 23 nt, Salmonella enterica enterica serovar Typhi Ty2
ccaguaauaucgccucccugccu

SEQ ID NO: 1771550 - RNA, 15 nt, Salmonella enterica enterica serovar Typhi Ty2
ccaguaauucccccg

SEQ ID NO: 1771551 - RNA, 22 nt, Salmonella enterica enterica serovar Typhi Ty2
ccaguacaaacaaauaaaucca

SEQ ID NO: 1771552 - RNA, 19 nt, Salmonella enterica enterica serovar Typhi Ty2
ccaguacaaacaaauaaau

SEQ ID NO: 1771553 - RNA, 14 nt, Salmonella enterica enterica serovar Typhi Ty2
ccaguaccagcacu

SEQ ID NO: 1771554 - RNA, 13 nt, Salmonella enterica enterica serovar Typhi Ty2
ccaguaccgccgc

SEQ ID NO: 1771555 - RNA, 20 nt, Salmonella enterica enterica serovar Typhi Ty2
ccagguuuuggucagcucac

SEQ ID NO: 1771556 - RNA, 13 nt, Salmonella enterica enterica serovar Typhi Ty2
ccagguuuuacau

SEQ ID NO: 1771557 - RNA, 15 nt, Salmonella enterica enterica serovar Typhi Ty2
ccaguaagggcagcc

SEQ ID NO: 1771558 - RNA, 22 nt, Salmonella enterica enterica serovar Typhi Ty2
ccaguaaaaucggaccuccgcg

SEQ ID NO: 1771559 - RNA, 20 nt, Salmonella enterica enterica serovar Typhi Ty2
ccaguaacucaucgccagcc

SEQ ID NO: 1771560 - RNA, 15 nt, Salmonella enterica enterica serovar Typhi Ty2
ccagucgggcgugcc

SEQ ID NO: 1771561 - RNA, 22 nt, Salmonella enterica enterica serovar Typhi Ty2
ccagucggcaaagaccaauaaa

SEQ ID NO: 1771562 - RNA, 17 nt, Salmonella enterica enterica serovar Typhi Ty2
ccagucggaaccggcaa

SEQ ID NO: 1771563 - RNA, 13 nt, Salmonella enterica enterica serovar Typhi Ty2
ccagucggacagc

SEQ ID NO: 1771564 - RNA, 17 nt, Salmonella enterica enterica serovar Typhi Ty2
ccagucgcuccaccacu

SEQ ID NO: 1771565 - RNA, 16 nt, Salmonella enterica enterica serovar Typhi Ty2
ccagucgcuccaccac

SEQ ID NO: 1771566 - RNA, 14 nt, Salmonella enterica enterica serovar Typhi Ty2
ccagugaauacugc

SEQ ID NO: 1771567 - RNA, 17 nt, Salmonella enterica enterica serovar Typhi Ty2
ccagugaauccaccacg

SEQ ID NO: 1771568 - RNA, 15 nt, Salmonella enterica enterica serovar Typhi Ty2
ccagugaaauaaaug

SEQ ID NO: 1771569 - RNA, 14 nt, Salmonella enterica enterica serovar Typhi Ty2
ccagugaaaaaaag

SEQ ID NO: 1771570 - RNA, 21 nt, Salmonella enterica enterica serovar Typhi Ty2
ccagucuuauuguccuguuuc

SEQ ID NO: 1771571 - RNA, 21 nt, Salmonella enterica enterica serovar Typhi Ty2
ccaguccuccggcugaagccc

SEQ ID NO: 1771572 - RNA, 15 nt, Salmonella enterica enterica serovar Typhi Ty2
ccagucgacucaucu

SEQ ID NO: 1771573 - RNA, 18 nt, Salmonella enterica enterica serovar Typhi Ty2
ccagucgacucaucuuuu

SEQ ID NO: 1771574 - RNA, 15 nt, Salmonella enterica enterica serovar Typhi Ty2
ccagucgcuccacca

SEQ ID NO: 1771575 - RNA, 18 nt, Salmonella enterica enterica serovar Typhi Ty2
ccagucgcagcaaacggc

SEQ ID NO: 1771576 - RNA, 13 nt, Salmonella enterica enterica serovar Typhi Ty2
ccagucgcagcca

SEQ ID NO: 1771577 - RNA, 12 nt, Salmonella enterica enterica serovar Typhi Ty2
ccaguuccccau

SEQ ID NO: 1771578 - RNA, 18 nt, Salmonella enterica enterica serovar Typhi Ty2
ccaguucccccgguuacc

SEQ ID NO: 1771579 - RNA, 17 nt, Salmonella enterica enterica serovar Typhi Ty2
ccaguugaucggccagc

SEQ ID NO: 1771580 - RNA, 12 nt, Salmonella enterica enterica serovar Typhi Ty2
ccaguucacucc

SEQ ID NO: 1771581 - RNA, 17 nt, Salmonella enterica enterica serovar Typhi Ty2
ccaguucauugauuaac

SEQ ID NO: 1771582 - RNA, 22 nt, Salmonella enterica enterica serovar Typhi Ty2
ccagugcccgaaagcaauacug

SEQ ID NO: 1771583 - RNA, 13 nt, Salmonella enterica enterica serovar Typhi Ty2
ccagugccaagca

SEQ ID NO: 1771584 - RNA, 23 nt, Salmonella enterica enterica serovar Typhi Ty2
ccauagcguuuaaaaagcugcau

SEQ ID NO: 1771585 - RNA, 14 nt, Salmonella enterica enterica serovar Typhi Ty2
ccauaggccagcgu

SEQ ID NO: 1771586 - RNA, 18 nt, Salmonella enterica enterica serovar Typhi Ty2
ccauagcccacuauuuuu

SEQ ID NO: 1771587 - RNA, 23 nt, Salmonella enterica enterica serovar Typhi Ty2
ccauagcaucgacccuugcgacc

SEQ ID NO: 1771588 - RNA, 21 nt, Salmonella enterica enterica serovar Typhi Ty2
ccauagccaacacauaagcca

SEQ ID NO: 1771589 - RNA, 23 nt, Salmonella enterica enterica serovar Typhi Ty2
ccauagccaacacauaagccacu

SEQ ID NO: 1771590 - RNA, 19 nt, Salmonella enterica enterica serovar Typhi Ty2
ccauacguuuuuauuaucu

SEQ ID NO: 1771591 - RNA, 19 nt, Salmonella enterica enterica serovar Typhi Ty2
ccauacgcccacgcggcgu

SEQ ID NO: 1771592 - RNA, 21 nt, Salmonella enterica enterica serovar Typhi Ty2
ccauacacugcauaaauaucu

SEQ ID NO: 1771593 - RNA, 16 nt, Salmonella enterica enterica serovar Typhi Ty2
ccauacccggcuccca

SEQ ID NO: 1771594 - RNA, 15 nt, Salmonella enterica enterica serovar Typhi Ty2
ccauacccggcuccc

SEQ ID NO: 1771595 - RNA, 20 nt, Salmonella enterica enterica serovar Typhi Ty2
ccauaccuaaugcccgcuug

SEQ ID NO: 1771596 - RNA, 15 nt, Salmonella enterica enterica serovar Typhi Ty2
ccauaccccaucauc

SEQ ID NO: 1771597 - RNA, 22 nt, Salmonella enterica enterica serovar Typhi Ty2
ccauacgauucagguuuugcug

SEQ ID NO: 1771598 - RNA, 18 nt, Salmonella enterica enterica serovar Typhi Ty2
ccaguugcauacauaaau

SEQ ID NO: 1771599 - RNA, 23 nt, Salmonella enterica enterica serovar Typhi Ty2
ccaguugccaggguucaaccuga

SEQ ID NO: 1771600 - RNA, 17 nt, Salmonella enterica enterica serovar Typhi Ty2
ccaguugcauacauaaa

SEQ ID NO: 1771601 - RNA, 20 nt, Salmonella enterica enterica serovar Typhi Ty2
ccaguugcucauaacggcua

SEQ ID NO: 1771602 - RNA, 14 nt, Salmonella enterica enterica serovar Typhi Ty2
ccaguugcgcaggg

SEQ ID NO: 1771603 - RNA, 14 nt, Salmonella enterica enterica serovar Typhi Ty2
ccaguuggcaacgu

SEQ ID NO: 1771604 - RNA, 15 nt, Salmonella enterica enterica serovar Typhi Ty2
ccaguugcugcaucg

SEQ ID NO: 1771605 - RNA, 20 nt, Salmonella enterica enterica serovar Typhi Ty2
ccaguuuuaaauaucauuua

SEQ ID NO: 1771606 - RNA, 15 nt, Salmonella enterica enterica serovar Typhi Ty2
ccaguuuuaagcgca

SEQ ID NO: 1771607 - RNA, 20 nt, Salmonella enterica enterica serovar Typhi Ty2
ccaguuguccgcuggucagc

SEQ ID NO: 1771608 - RNA, 20 nt, Salmonella enterica enterica serovar Typhi Ty2
ccaguuggcguaccaucagc

SEQ ID NO: 1771609 - RNA, 21 nt, Salmonella enterica enterica serovar Typhi Ty2
ccaguuguaacgccuggcgca

SEQ ID NO: 1771610 - RNA, 18 nt, Salmonella enterica enterica serovar Typhi Ty2
ccaguuggcgaccgcugc

SEQ ID NO: 1771611 - RNA, 20 nt, Salmonella enterica enterica serovar Typhi Ty2
ccauaaaauaaagucagcaa

SEQ ID NO: 1771612 - RNA, 12 nt, Salmonella enterica enterica serovar Typhi Ty2
ccauaaaaugau

SEQ ID NO: 1771613 - RNA, 17 nt, Salmonella enterica enterica serovar Typhi Ty2
ccaguuuuuuccagcgc

SEQ ID NO: 1771614 - RNA, 21 nt, Salmonella enterica enterica serovar Typhi Ty2
ccauaaugaucguaugcagcc

SEQ ID NO: 1771615 - RNA, 16 nt, Salmonella enterica enterica serovar Typhi Ty2
ccauugcugucgacaa

SEQ ID NO: 1771616 - RNA, 16 nt, Salmonella enterica enterica serovar Typhi Ty2
ccauugcugacaaaau

SEQ ID NO: 1771617 - RNA, 20 nt, Salmonella enterica enterica serovar Typhi Ty2
ccauugccgcgacaaaaagc

SEQ ID NO: 1771618 - RNA, 16 nt, Salmonella enterica enterica serovar Typhi Ty2
ccauugcgagaaaaaa

SEQ ID NO: 1771619 - RNA, 14 nt, Salmonella enterica enterica serovar Typhi Ty2
ccauugcguauuuc

SEQ ID NO: 1771620 - RNA, 15 nt, Salmonella enterica enterica serovar Typhi Ty2
ccauugccaguaccg

SEQ ID NO: 1771621 - RNA, 11 nt, Salmonella enterica enterica serovar Typhi Ty2
ccauugccgcg

SEQ ID NO: 1771622 - RNA, 13 nt, Salmonella enterica enterica serovar Typhi Ty2
ccauucugcugau

SEQ ID NO: 1771623 - RNA, 23 nt, Salmonella enterica enterica serovar Typhi Ty2
ccauuuuagggccgggcagugcu

SEQ ID NO: 1771624 - RNA, 14 nt, Salmonella enterica enterica serovar Typhi Ty2
ccauuuuaaauaca

SEQ ID NO: 1771625 - RNA, 16 nt, Salmonella enterica enterica serovar Typhi Ty2
ccauuuggcuuaaaua

SEQ ID NO: 1771626 - RNA, 14 nt, Salmonella enterica enterica serovar Typhi Ty2
ccauuugccagaua

SEQ ID NO: 1771627 - RNA, 18 nt, Salmonella enterica enterica serovar Typhi Ty2
ccauuucuucuucaagcc

SEQ ID NO: 1771628 - RNA, 21 nt, Salmonella enterica enterica serovar Typhi Ty2
ccauuucgccuauuuucucuu

SEQ ID NO: 1771629 - RNA, 11 nt, Salmonella enterica enterica serovar Typhi Ty2
ccauuuuucag

SEQ ID NO: 1771630 - RNA, 23 nt, Salmonella enterica enterica serovar Typhi Ty2
ccauuuuggacuugggcagugcu

SEQ ID NO: 1771631 - RNA, 18 nt, Salmonella enterica enterica serovar Typhi Ty2
ccauuuugguuacuauuu

SEQ ID NO: 1771632 - RNA, 17 nt, Salmonella enterica enterica serovar Typhi Ty2
cccaaccgaaacguaug

SEQ ID NO: 1771633 - RNA, 21 nt, Salmonella enterica enterica serovar Typhi Ty2
ccauuuuuuuagcuuaaaaaa

SEQ ID NO: 1771634 - RNA, 17 nt, Salmonella enterica enterica serovar Typhi Ty2
cccaacgacagcacuac

SEQ ID NO: 1771635 - RNA, 20 nt, Salmonella enterica enterica serovar Typhi Ty2
cccaacggaugcgccauccc

SEQ ID NO: 1771636 - RNA, 15 nt, Salmonella enterica enterica serovar Typhi Ty2
cccaacugagcgcca

SEQ ID NO: 1771637 - RNA, 21 nt, Salmonella enterica enterica serovar Typhi Ty2
ccauuaauauagaguugugaa

SEQ ID NO: 1771638 - RNA, 13 nt, Salmonella enterica enterica serovar Typhi Ty2
ccauuaaugcagg

SEQ ID NO: 1771639 - RNA, 21 nt, Salmonella enterica enterica serovar Typhi Ty2
ccauuaccuggcaacauagca

SEQ ID NO: 1771640 - RNA, 16 nt, Salmonella enterica enterica serovar Typhi Ty2
ccauguuuaccaucgc

SEQ ID NO: 1771641 - RNA, 23 nt, Salmonella enterica enterica serovar Typhi Ty2
ccauguuuuauacucaaaaaauc

SEQ ID NO: 1771642 - RNA, 17 nt, Salmonella enterica enterica serovar Typhi Ty2
ccauucccgauaaugac

SEQ ID NO: 1771643 - RNA, 12 nt, Salmonella enterica enterica serovar Typhi Ty2
ccauuacucuca

SEQ ID NO: 1771644 - RNA, 13 nt, Salmonella enterica enterica serovar Typhi Ty2
ccauuagcuguug

SEQ ID NO: 1771645 - RNA, 14 nt, Salmonella enterica enterica serovar Typhi Ty2
ccauuacgcccccu

SEQ ID NO: 1771646 - RNA, 15 nt, Salmonella enterica enterica serovar Typhi Ty2
ccauucgcccaguca

SEQ ID NO: 1771647 - RNA, 16 nt, Salmonella enterica enterica serovar Typhi Ty2
ccauucggccugcggu

SEQ ID NO: 1771648 - RNA, 20 nt, Salmonella enterica enterica serovar Typhi Ty2
ccauucccgauaaugaccga

SEQ ID NO: 1771649 - RNA, 15 nt, Salmonella enterica enterica serovar Typhi Ty2
ccauuccccacgcca

SEQ ID NO: 1771650 - RNA, 18 nt, Salmonella enterica enterica serovar Typhi Ty2
ccauucccguaaaagaag

SEQ ID NO: 1771651 - RNA, 15 nt, Salmonella enterica enterica serovar Typhi Ty2
ccauguacuccugau

SEQ ID NO: 1771652 - RNA, 23 nt, Salmonella enterica enterica serovar Typhi Ty2
ccaugguucacaauacagaacau

SEQ ID NO: 1771653 - RNA, 23 nt, Salmonella enterica enterica serovar Typhi Ty2
ccauggucagacgcucagccuua

SEQ ID NO: 1771654 - RNA, 21 nt, Salmonella enterica enterica serovar Typhi Ty2
ccauguugagcgcuugcugcg

SEQ ID NO: 1771655 - RNA, 15 nt, Salmonella enterica enterica serovar Typhi Ty2
ccauguucauaaagu

SEQ ID NO: 1771656 - RNA, 18 nt, Salmonella enterica enterica serovar Typhi Ty2
ccauguugcguaaauaaa

SEQ ID NO: 1771657 - RNA, 19 nt, Salmonella enterica enterica serovar Typhi Ty2
ccauguugcguaaauaaau

SEQ ID NO: 1771658 - RNA, 22 nt, Salmonella enterica enterica serovar Typhi Ty2
ccauguggccagcggccagcca

SEQ ID NO: 1771659 - RNA, 20 nt, Salmonella enterica enterica serovar Typhi Ty2
ccaugucuugcuaucaaacu

SEQ ID NO: 1771660 - RNA, 18 nt, Salmonella enterica enterica serovar Typhi Ty2
ccaugucagcgcaaagcc

SEQ ID NO: 1771661 - RNA, 15 nt, Salmonella enterica enterica serovar Typhi Ty2
ccaucgguucucugc

SEQ ID NO: 1771662 - RNA, 19 nt, Salmonella enterica enterica serovar Typhi Ty2
ccaucggcaaacgccgccu

SEQ ID NO: 1771663 - RNA, 16 nt, Salmonella enterica enterica serovar Typhi Ty2
ccaucggaguccagca

SEQ ID NO: 1771664 - RNA, 20 nt, Salmonella enterica enterica serovar Typhi Ty2
ccaucggcugguuauacugg

SEQ ID NO: 1771665 - RNA, 22 nt, Salmonella enterica enterica serovar Typhi Ty2
ccaucgcuuuacguuuggcggc

SEQ ID NO: 1771666 - RNA, 21 nt, Salmonella enterica enterica serovar Typhi Ty2
ccaugaagcgauuuauccacc

SEQ ID NO: 1771667 - RNA, 12 nt, Salmonella enterica enterica serovar Typhi Ty2
ccaugaaaaaaa

SEQ ID NO: 1771668 - RNA, 13 nt, Salmonella enterica enterica serovar Typhi Ty2
ccaugaaaaaaac

SEQ ID NO: 1771669 - RNA, 22 nt, Salmonella enterica enterica serovar Typhi Ty2
ccaugaccaccagcgcgaccgg

SEQ ID NO: 1771670 - RNA, 13 nt, Salmonella enterica enterica serovar Typhi Ty2
ccaucuuucuuuu

SEQ ID NO: 1771671 - RNA, 17 nt, Salmonella enterica enterica serovar Typhi Ty2
ccaucuuucuuuucgcg

SEQ ID NO: 1771672 - RNA, 16 nt, Salmonella enterica enterica serovar Typhi Ty2
ccaucuuuaccaaugu

SEQ ID NO: 1771673 - RNA, 16 nt, Salmonella enterica enterica serovar Typhi Ty2
ccaucuuucacccauu

SEQ ID NO: 1771674 - RNA, 22 nt, Salmonella enterica enterica serovar Typhi Ty2
ccaucuuugcaccgcuaaaaaa

SEQ ID NO: 1771675 - RNA, 14 nt, Salmonella enterica enterica serovar Typhi Ty2
ccauggccgcagcc

SEQ ID NO: 1771676 - RNA, 17 nt, Salmonella enterica enterica serovar Typhi Ty2
ccauggagagugagcca

SEQ ID NO: 1771677 - RNA, 19 nt, Salmonella enterica enterica serovar Typhi Ty2
ccauggaacauccucuccu

SEQ ID NO: 1771678 - RNA, 19 nt, Salmonella enterica enterica serovar Typhi Ty2
ccaugcccaguucaaucaa

SEQ ID NO: 1771679 - RNA, 14 nt, Salmonella enterica enterica serovar Typhi Ty2
ccaugacguucaau

SEQ ID NO: 1771680 - RNA, 15 nt, Salmonella enterica enterica serovar Typhi Ty2
ccaugagcgaaacuc

SEQ ID NO: 1771681 - RNA, 22 nt, Salmonella enterica enterica serovar Typhi Ty2
ccaugccacaacagaagcggcc

SEQ ID NO: 1771682 - RNA, 14 nt, Salmonella enterica enterica serovar Typhi Ty2
aaacaaugcaggua

SEQ ID NO: 1771683 - RNA, 15 nt, Salmonella enterica enterica serovar Typhi Ty2
ccaucaggcauaaac

SEQ ID NO: 1771684 - RNA, 22 nt, Salmonella enterica enterica serovar Typhi Ty2
ccaucaggcaucugaaaugcuc

SEQ ID NO: 1771685 - RNA, 19 nt, Salmonella enterica enterica serovar Typhi Ty2
ccauauuguucaguuucaa

SEQ ID NO: 1771686 - RNA, 15 nt, Salmonella enterica enterica serovar Typhi Ty2
ccaucauucaacgca

SEQ ID NO: 1771687 - RNA, 14 nt, Salmonella enterica enterica serovar Typhi Ty2
ccaucauagcccau

SEQ ID NO: 1771688 - RNA, 15 nt, Salmonella enterica enterica serovar Typhi Ty2
ccaucauaccgccaa

SEQ ID NO: 1771689 - RNA, 13 nt, Salmonella enterica enterica serovar Typhi Ty2
ccauccaccagaa

SEQ ID NO: 1771690 - RNA, 16 nt, Salmonella enterica enterica serovar Typhi Ty2
ccaucauuuccggcgg

SEQ ID NO: 1771691 - RNA, 16 nt, Salmonella enterica enterica serovar Typhi Ty2
ccauauucuucgcaua

SEQ ID NO: 1771692 - RNA, 23 nt, Salmonella enterica enterica serovar Typhi Ty2
ccauauuuuuucugccaguuucu

SEQ ID NO: 1771693 - RNA, 15 nt, Salmonella enterica enterica serovar Typhi Ty2
ccaucaaaaaaaaua

SEQ ID NO: 1771694 - RNA, 22 nt, Salmonella enterica enterica serovar Typhi Ty2
ccauccggcacggucaaucauc

SEQ ID NO: 1771695 - RNA, 17 nt, Salmonella enterica enterica serovar Typhi Ty2
ccauccggcacaguauu

SEQ ID NO: 1771696 - RNA, 20 nt, Salmonella enterica enterica serovar Typhi Ty2
ccauccggcaaacucagcgg

SEQ ID NO: 1771697 - RNA, 20 nt, Salmonella enterica enterica serovar Typhi Ty2
ccauccggcacacagaauua

SEQ ID NO: 1771698 - RNA, 14 nt, Salmonella enterica enterica serovar Typhi Ty2
ccauccggcaaaau

SEQ ID NO: 1771699 - RNA, 15 nt, Salmonella enterica enterica serovar Typhi Ty2
ccauccggcaaaauu

SEQ ID NO: 1771700 - RNA, 16 nt, Salmonella enterica enterica serovar Typhi Ty2
ccauccggcauuuuuu

SEQ ID NO: 1771701 - RNA, 19 nt, Salmonella enterica enterica serovar Typhi Ty2
ccauccggcauuuuucuca

SEQ ID NO: 1771702 - RNA, 16 nt, Salmonella enterica enterica serovar Typhi Ty2
ccauccgggccacucu

SEQ ID NO: 1771703 - RNA, 19 nt, Salmonella enterica enterica serovar Typhi Ty2
cccagcgccagccgcgcca

SEQ ID NO: 1771704 - RNA, 16 nt, Salmonella enterica enterica serovar Typhi Ty2
cccagcgcccccagca

SEQ ID NO: 1771705 - RNA, 12 nt, Salmonella enterica enterica serovar Typhi Ty2
cccagcgccccc

SEQ ID NO: 1771706 - RNA, 15 nt, Salmonella enterica enterica serovar Typhi Ty2
cccagcgcuggcaga

SEQ ID NO: 1771707 - RNA, 17 nt, Salmonella enterica enterica serovar Typhi Ty2
cccagcgcuccaccaac

SEQ ID NO: 1771708 - RNA, 19 nt, Salmonella enterica enterica serovar Typhi Ty2
cccagcgcggcccauucaa

SEQ ID NO: 1771709 - RNA, 22 nt, Salmonella enterica enterica serovar Typhi Ty2
cccagcgggugaugcgccagcc

SEQ ID NO: 1771710 - RNA, 15 nt, Salmonella enterica enterica serovar Typhi Ty2
cccaggccgccaccg

SEQ ID NO: 1771711 - RNA, 22 nt, Salmonella enterica enterica serovar Typhi Ty2
cccaggccaaaaccacagugac

SEQ ID NO: 1771712 - RNA, 19 nt, Salmonella enterica enterica serovar Typhi Ty2
cccagcuugcccagauccu

SEQ ID NO: 1771713 - RNA, 18 nt, Salmonella enterica enterica serovar Typhi Ty2
cccaggauaguacugacc

SEQ ID NO: 1771714 - RNA, 17 nt, Salmonella enterica enterica serovar Typhi Ty2
cccagcccugugccgcu

SEQ ID NO: 1771715 - RNA, 14 nt, Salmonella enterica enterica serovar Typhi Ty2
cccagcccugugcc

SEQ ID NO: 1771716 - RNA, 14 nt, Salmonella enterica enterica serovar Typhi Ty2
cccagccuucuccc

SEQ ID NO: 1771717 - RNA, 21 nt, Salmonella enterica enterica serovar Typhi Ty2
cccagccuuccuggucugcca

SEQ ID NO: 1771718 - RNA, 19 nt, Salmonella enterica enterica serovar Typhi Ty2
cccagauguugauacagaa

SEQ ID NO: 1771719 - RNA, 20 nt, Salmonella enterica enterica serovar Typhi Ty2
cccagauguugauacagaaa

SEQ ID NO: 1771720 - RNA, 18 nt, Salmonella enterica enterica serovar Typhi Ty2
cccagaaucccgccuugc

SEQ ID NO: 1771721 - RNA, 19 nt, Salmonella enterica enterica serovar Typhi Ty2
cccagaaaauuaacgacaa

SEQ ID NO: 1771722 - RNA, 16 nt, Salmonella enterica enterica serovar Typhi Ty2
cccacuuucagcuccg

SEQ ID NO: 1771723 - RNA, 20 nt, Salmonella enterica enterica serovar Typhi Ty2
cccacuuguagcgagcgccg

SEQ ID NO: 1771724 - RNA, 17 nt, Salmonella enterica enterica serovar Typhi Ty2
cccacuuuacacgcgcu

SEQ ID NO: 1771725 - RNA, 18 nt, Salmonella enterica enterica serovar Typhi Ty2
cccacuuugcucaccacg

SEQ ID NO: 1771726 - RNA, 19 nt, Salmonella enterica enterica serovar Typhi Ty2
cccaggcgcgcagcugcca

SEQ ID NO: 1771727 - RNA, 18 nt, Salmonella enterica enterica serovar Typhi Ty2
cccaggcgcuauucccag

SEQ ID NO: 1771728 - RNA, 22 nt, Salmonella enterica enterica serovar Typhi Ty2
cccaggccugaugagcgcagcg

SEQ ID NO: 1771729 - RNA, 13 nt, Salmonella enterica enterica serovar Typhi Ty2
cccaggcguccag

SEQ ID NO: 1771730 - RNA, 19 nt, Salmonella enterica enterica serovar Typhi Ty2
cccaggcggguagucccag

SEQ ID NO: 1771731 - RNA, 18 nt, Salmonella enterica enterica serovar Typhi Ty2
cccagugucaacugcgcc

SEQ ID NO: 1771732 - RNA, 19 nt, Salmonella enterica enterica serovar Typhi Ty2
cccaguuauuaaguuuuac

SEQ ID NO: 1771733 - RNA, 21 nt, Salmonella enterica enterica serovar Typhi Ty2
cccaguccuuccggcgagaga

SEQ ID NO: 1771734 - RNA, 18 nt, Salmonella enterica enterica serovar Typhi Ty2
cccagucuuccugcggua

SEQ ID NO: 1771735 - RNA, 14 nt, Salmonella enterica enterica serovar Typhi Ty2
cccaguggcaaaau

SEQ ID NO: 1771736 - RNA, 17 nt, Salmonella enterica enterica serovar Typhi Ty2
cccagugccaccagccg

SEQ ID NO: 1771737 - RNA, 18 nt, Salmonella enterica enterica serovar Typhi Ty2
cccaguagcagacagccg

SEQ ID NO: 1771738 - RNA, 17 nt, Salmonella enterica enterica serovar Typhi Ty2
cccaguagcagacagcc

SEQ ID NO: 1771739 - RNA, 14 nt, Salmonella enterica enterica serovar Typhi Ty2
cccaguaccagcac

SEQ ID NO: 1771740 - RNA, 19 nt, Salmonella enterica enterica serovar Typhi Ty2
cccaguccacguuuuacuu

SEQ ID NO: 1771741 - RNA, 23 nt, Salmonella enterica enterica serovar Typhi Ty2
cccagguuguaucauguuccggc

SEQ ID NO: 1771742 - RNA, 17 nt, Salmonella enterica enterica serovar Typhi Ty2
cccaguacaaacaaaua

SEQ ID NO: 1771743 - RNA, 21 nt, Salmonella enterica enterica serovar Typhi Ty2
cccagguuugaggcuugcagc

SEQ ID NO: 1771744 - RNA, 18 nt, Salmonella enterica enterica serovar Typhi Ty2
cccaucacgcccuguaaa

SEQ ID NO: 1771745 - RNA, 20 nt, Salmonella enterica enterica serovar Typhi Ty2
cccauauugauggccacauc

SEQ ID NO: 1771746 - RNA, 15 nt, Salmonella enterica enterica serovar Typhi Ty2
cccauaguagcuaau

SEQ ID NO: 1771747 - RNA, 13 nt, Salmonella enterica enterica serovar Typhi Ty2
cccauccccauau

SEQ ID NO: 1771748 - RNA, 11 nt, Salmonella enterica enterica serovar Typhi Ty2
cccaucccaga

SEQ ID NO: 1771749 - RNA, 18 nt, Salmonella enterica enterica serovar Typhi Ty2
cccaucagggaaaaaugu

SEQ ID NO: 1771750 - RNA, 14 nt, Salmonella enterica enterica serovar Typhi Ty2
cccaucauugacuu

SEQ ID NO: 1771751 - RNA, 17 nt, Salmonella enterica enterica serovar Typhi Ty2
cccauccgucaggaugg

SEQ ID NO: 1771752 - RNA, 12 nt, Salmonella enterica enterica serovar Typhi Ty2
cccaguuuaccc

SEQ ID NO: 1771753 - RNA, 17 nt, Salmonella enterica enterica serovar Typhi Ty2
aaacaauuuacgcagcc

SEQ ID NO: 1771754 - RNA, 14 nt, Salmonella enterica enterica serovar Typhi Ty2
aaacaccagaaugc

SEQ ID NO: 1771755 - RNA, 14 nt, Salmonella enterica enterica serovar Typhi Ty2
ccccgucauauuac

SEQ ID NO: 1771756 - RNA, 16 nt, Salmonella enterica enterica serovar Typhi Ty2
ccccggugagcgccgc

SEQ ID NO: 1771757 - RNA, 17 nt, Salmonella enterica enterica serovar Typhi Ty2
ccccugacgcgcgcagu

SEQ ID NO: 1771758 - RNA, 13 nt, Salmonella enterica enterica serovar Typhi Ty2
ccccuucgcuguc

SEQ ID NO: 1771759 - RNA, 18 nt, Salmonella enterica enterica serovar Typhi Ty2
ccccucggcagcaauacg

SEQ ID NO: 1771760 - RNA, 20 nt, Salmonella enterica enterica serovar Typhi Ty2
ccccucggcagcaauacgcc

SEQ ID NO: 1771761 - RNA, 14 nt, Salmonella enterica enterica serovar Typhi Ty2
ccccuuuuuugcug

SEQ ID NO: 1771762 - RNA, 20 nt, Salmonella enterica enterica serovar Typhi Ty2
cccgacacggcucgccuuug

SEQ ID NO: 1771763 - RNA, 19 nt, Salmonella enterica enterica serovar Typhi Ty2
cccgaaagucaucugccag

SEQ ID NO: 1771764 - RNA, 23 nt, Salmonella enterica enterica serovar Typhi Ty2
cccgagcgacgcccugcccauga

SEQ ID NO: 1771765 - RNA, 14 nt, Salmonella enterica enterica serovar Typhi Ty2
cccgagcgacgccc

SEQ ID NO: 1771766 - RNA, 11 nt, Salmonella enterica enterica serovar Typhi Ty2
cccgcaaaagc

SEQ ID NO: 1771767 - RNA, 15 nt, Salmonella enterica enterica serovar Typhi Ty2
cccgcaaaccagguc

SEQ ID NO: 1771768 - RNA, 18 nt, Salmonella enterica enterica serovar Typhi Ty2
cccgcacaaacgcuuuuu

SEQ ID NO: 1771769 - RNA, 16 nt, Salmonella enterica enterica serovar Typhi Ty2
cccgcacgcuuucuuc

SEQ ID NO: 1771770 - RNA, 13 nt, Salmonella enterica enterica serovar Typhi Ty2
cccgcagccacuc

SEQ ID NO: 1771771 - RNA, 15 nt, Salmonella enterica enterica serovar Typhi Ty2
cccgcagccacuccc

SEQ ID NO: 1771772 - RNA, 18 nt, Salmonella enterica enterica serovar Typhi Ty2
cccgcauucgcggcaagc

SEQ ID NO: 1771773 - RNA, 21 nt, Salmonella enterica enterica serovar Typhi Ty2
cccgccagaugcagcggcagu

SEQ ID NO: 1771774 - RNA, 14 nt, Salmonella enterica enterica serovar Typhi Ty2
cccgccaccgccgc

SEQ ID NO: 1771775 - RNA, 14 nt, Salmonella enterica enterica serovar Typhi Ty2
cccgccagcggcgc

SEQ ID NO: 1771776 - RNA, 12 nt, Salmonella enterica enterica serovar Typhi Ty2
cccgccagcacc

SEQ ID NO: 1771777 - RNA, 12 nt, Salmonella enterica enterica serovar Typhi Ty2
cccgccgccauc

SEQ ID NO: 1771778 - RNA, 11 nt, Salmonella enterica enterica serovar Typhi Ty2
cccgccgccau

SEQ ID NO: 1771779 - RNA, 16 nt, Salmonella enterica enterica serovar Typhi Ty2
ccccaccgacacaaau

SEQ ID NO: 1771780 - RNA, 13 nt, Salmonella enterica enterica serovar Typhi Ty2
ccccacgcccgcc

SEQ ID NO: 1771781 - RNA, 23 nt, Salmonella enterica enterica serovar Typhi Ty2
ccccacgauacgccccugcuggc

SEQ ID NO: 1771782 - RNA, 14 nt, Salmonella enterica enterica serovar Typhi Ty2
ccccagcaccgaaa

SEQ ID NO: 1771783 - RNA, 18 nt, Salmonella enterica enterica serovar Typhi Ty2
ccccagcacgacagagau

SEQ ID NO: 1771784 - RNA, 12 nt, Salmonella enterica enterica serovar Typhi Ty2
ccccagccagag

SEQ ID NO: 1771785 - RNA, 17 nt, Salmonella enterica enterica serovar Typhi Ty2
cccaucuaaccgggccu

SEQ ID NO: 1771786 - RNA, 18 nt, Salmonella enterica enterica serovar Typhi Ty2
cccaucguaacgccgucg

SEQ ID NO: 1771787 - RNA, 23 nt, Salmonella enterica enterica serovar Typhi Ty2
cccaugcaccagucccagcccca

SEQ ID NO: 1771788 - RNA, 14 nt, Salmonella enterica enterica serovar Typhi Ty2
cccauguugcgccg

SEQ ID NO: 1771789 - RNA, 13 nt, Salmonella enterica enterica serovar Typhi Ty2
cccauuuuauccu

SEQ ID NO: 1771790 - RNA, 19 nt, Salmonella enterica enterica serovar Typhi Ty2
cccauuuuauccucuucaa

SEQ ID NO: 1771791 - RNA, 22 nt, Salmonella enterica enterica serovar Typhi Ty2
cccauguucaugaaccacgcca

SEQ ID NO: 1771792 - RNA, 20 nt, Salmonella enterica enterica serovar Typhi Ty2
cccauguugagcgcuugcug

SEQ ID NO: 1771793 - RNA, 18 nt, Salmonella enterica enterica serovar Typhi Ty2
cccauggaugcgccgccc

SEQ ID NO: 1771794 - RNA, 15 nt, Salmonella enterica enterica serovar Typhi Ty2
cccauggccccaugu

SEQ ID NO: 1771795 - RNA, 13 nt, Salmonella enterica enterica serovar Typhi Ty2
ccccaucccagac

SEQ ID NO: 1771796 - RNA, 21 nt, Salmonella enterica enterica serovar Typhi Ty2
ccccauauugauggccacauc

SEQ ID NO: 1771797 - RNA, 19 nt, Salmonella enterica enterica serovar Typhi Ty2
ccccauauugaucgggauu

SEQ ID NO: 1771798 - RNA, 17 nt, Salmonella enterica enterica serovar Typhi Ty2
ccccaguugguuguagc

SEQ ID NO: 1771799 - RNA, 14 nt, Salmonella enterica enterica serovar Typhi Ty2
ccccauaaauaauc

SEQ ID NO: 1771800 - RNA, 20 nt, Salmonella enterica enterica serovar Typhi Ty2
cccccagauagaaccacgca

SEQ ID NO: 1771801 - RNA, 11 nt, Salmonella enterica enterica serovar Typhi Ty2
cccccagcacg

SEQ ID NO: 1771802 - RNA, 15 nt, Salmonella enterica enterica serovar Typhi Ty2
cccccaccucaauca

SEQ ID NO: 1771803 - RNA, 15 nt, Salmonella enterica enterica serovar Typhi Ty2
ccccgcaacggcgcu

SEQ ID NO: 1771804 - RNA, 16 nt, Salmonella enterica enterica serovar Typhi Ty2
ccccgcaauugcgcgg

SEQ ID NO: 1771805 - RNA, 17 nt, Salmonella enterica enterica serovar Typhi Ty2
ccccgauaaaccaggca

SEQ ID NO: 1771806 - RNA, 15 nt, Salmonella enterica enterica serovar Typhi Ty2
cccccuaucuggaug

SEQ ID NO: 1771807 - RNA, 15 nt, Salmonella enterica enterica serovar Typhi Ty2
cccccugccagcgcu

SEQ ID NO: 1771808 - RNA, 16 nt, Salmonella enterica enterica serovar Typhi Ty2
cccugcgguagcgccg

SEQ ID NO: 1771809 - RNA, 13 nt, Salmonella enterica enterica serovar Typhi Ty2
cccugcucccaca

SEQ ID NO: 1771810 - RNA, 14 nt, Salmonella enterica enterica serovar Typhi Ty2
cccugcuccugcca

SEQ ID NO: 1771811 - RNA, 12 nt, Salmonella enterica enterica serovar Typhi Ty2
cccugccacagu

SEQ ID NO: 1771812 - RNA, 17 nt, Salmonella enterica enterica serovar Typhi Ty2
cccugccacaaccgccc

SEQ ID NO: 1771813 - RNA, 23 nt, Salmonella enterica enterica serovar Typhi Ty2
cccugccacaacggcaauuuuua

SEQ ID NO: 1771814 - RNA, 13 nt, Salmonella enterica enterica serovar Typhi Ty2
cccugcccaugaa

SEQ ID NO: 1771815 - RNA, 13 nt, Salmonella enterica enterica serovar Typhi Ty2
cccugcccgccag

SEQ ID NO: 1771816 - RNA, 20 nt, Salmonella enterica enterica serovar Typhi Ty2
cccugccagcguaagcgccc

SEQ ID NO: 1771817 - RNA, 15 nt, Salmonella enterica enterica serovar Typhi Ty2
cccugccggcggcag

SEQ ID NO: 1771818 - RNA, 20 nt, Salmonella enterica enterica serovar Typhi Ty2
cccugccgucucaaccagca

SEQ ID NO: 1771819 - RNA, 16 nt, Salmonella enterica enterica serovar Typhi Ty2
cccugagcccacagcg

SEQ ID NO: 1771820 - RNA, 23 nt, Salmonella enterica enterica serovar Typhi Ty2
cccugauggcgcgccacuucuuu

SEQ ID NO: 1771821 - RNA, 23 nt, Salmonella enterica enterica serovar Typhi Ty2
cccugauauacaaaacccauauc

SEQ ID NO: 1771822 - RNA, 13 nt, Salmonella enterica enterica serovar Typhi Ty2
cccugauguagcu

SEQ ID NO: 1771823 - RNA, 21 nt, Salmonella enterica enterica serovar Typhi Ty2
cccugcaaacuauguacgcca

SEQ ID NO: 1771824 - RNA, 24 nt, Salmonella enterica enterica serovar Typhi Ty2
cccugcaaagcaaaaaucaccaca

SEQ ID NO: 1771825 - RNA, 22 nt, Salmonella enterica enterica serovar Typhi Ty2
cccucugaaacgcuucaccggc

SEQ ID NO: 1771826 - RNA, 19 nt, Salmonella enterica enterica serovar Typhi Ty2
cccucugagcugguguaau

SEQ ID NO: 1771827 - RNA, 22 nt, Salmonella enterica enterica serovar Typhi Ty2
cccucugauuggcuguuaguaa

SEQ ID NO: 1771828 - RNA, 16 nt, Salmonella enterica enterica serovar Typhi Ty2
cccucugauuggcugu

SEQ ID NO: 1771829 - RNA, 17 nt, Salmonella enterica enterica serovar Typhi Ty2
cccucugcaccagaacu

SEQ ID NO: 1771830 - RNA, 21 nt, Salmonella enterica enterica serovar Typhi Ty2
cccucuucuucuuccgucagc

SEQ ID NO: 1771831 - RNA, 18 nt, Salmonella enterica enterica serovar Typhi Ty2
cccugaauuucaauaauc

SEQ ID NO: 1771832 - RNA, 18 nt, Salmonella enterica enterica serovar Typhi Ty2
cccugacacuguagcaac

SEQ ID NO: 1771833 - RNA, 17 nt, Salmonella enterica enterica serovar Typhi Ty2
cccucgacaggaguaua

SEQ ID NO: 1771834 - RNA, 12 nt, Salmonella enterica enterica serovar Typhi Ty2
cccucgccagca

SEQ ID NO: 1771835 - RNA, 19 nt, Salmonella enterica enterica serovar Typhi Ty2
cccuccugcuccaugcugu

SEQ ID NO: 1771836 - RNA, 17 nt, Salmonella enterica enterica serovar Typhi Ty2
cccuccggccagcgcca

SEQ ID NO: 1771837 - RNA, 13 nt, Salmonella enterica enterica serovar Typhi Ty2
cccuccggccagc

SEQ ID NO: 1771838 - RNA, 16 nt, Salmonella enterica enterica serovar Typhi Ty2
cccucaccucccccgc

SEQ ID NO: 1771839 - RNA, 22 nt, Salmonella enterica enterica serovar Typhi Ty2
cccucaaacaggcugucugcca

SEQ ID NO: 1771840 - RNA, 22 nt, Salmonella enterica enterica serovar Typhi Ty2
cccucaacgcccugcucccaca

SEQ ID NO: 1771841 - RNA, 17 nt, Salmonella enterica enterica serovar Typhi Ty2
cccucaagacgguuauu

SEQ ID NO: 1771842 - RNA, 20 nt, Salmonella enterica enterica serovar Typhi Ty2
cccucaacgcccugcuccca

SEQ ID NO: 1771843 - RNA, 14 nt, Salmonella enterica enterica serovar Typhi Ty2
cccuauuguuccag

SEQ ID NO: 1771844 - RNA, 18 nt, Salmonella enterica enterica serovar Typhi Ty2
aaacaccggggcauuucc

SEQ ID NO: 1771845 - RNA, 17 nt, Salmonella enterica enterica serovar Typhi Ty2
aaacaccggggcauuuc

SEQ ID NO: 1771846 - RNA, 15 nt, Salmonella enterica enterica serovar Typhi Ty2
cccgucccaccacgc

SEQ ID NO: 1771847 - RNA, 21 nt, Salmonella enterica enterica serovar Typhi Ty2
cccgucaucuucuaccuggaa

SEQ ID NO: 1771848 - RNA, 22 nt, Salmonella enterica enterica serovar Typhi Ty2
cccgucugggagccgcugcuca

SEQ ID NO: 1771849 - RNA, 14 nt, Salmonella enterica enterica serovar Typhi Ty2
cccguuaaauacca

SEQ ID NO: 1771850 - RNA, 22 nt, Salmonella enterica enterica serovar Typhi Ty2
cccguucacguuuuuacucuug

SEQ ID NO: 1771851 - RNA, 15 nt, Salmonella enterica enterica serovar Typhi Ty2
cccgugguuuuacug

SEQ ID NO: 1771852 - RNA, 17 nt, Salmonella enterica enterica serovar Typhi Ty2
cccuacgcuucucucca

SEQ ID NO: 1771853 - RNA, 19 nt, Salmonella enterica enterica serovar Typhi Ty2
cccuacgcuucucuccaua

SEQ ID NO: 1771854 - RNA, 15 nt, Salmonella enterica enterica serovar Typhi Ty2
cccuauuagcacgcc

SEQ ID NO: 1771855 - RNA, 20 nt, Salmonella enterica enterica serovar Typhi Ty2
cccuaaaaauagcaccaggc

SEQ ID NO: 1771856 - RNA, 21 nt, Salmonella enterica enterica serovar Typhi Ty2
cccguuucagccccuugcuga

SEQ ID NO: 1771857 - RNA, 19 nt, Salmonella enterica enterica serovar Typhi Ty2
cccguuugcgagacggcga

SEQ ID NO: 1771858 - RNA, 21 nt, Salmonella enterica enterica serovar Typhi Ty2
cccguugucuucaccuugcug

SEQ ID NO: 1771859 - RNA, 16 nt, Salmonella enterica enterica serovar Typhi Ty2
cccguugcgucacgaa

SEQ ID NO: 1771860 - RNA, 22 nt, Salmonella enterica enterica serovar Typhi Ty2
cccgccgggcgucacccgccgg

SEQ ID NO: 1771861 - RNA, 23 nt, Salmonella enterica enterica serovar Typhi Ty2
cccgccgggcgucacccgccggc

SEQ ID NO: 1771862 - RNA, 20 nt, Salmonella enterica enterica serovar Typhi Ty2
cccggcuuuauuacuucuuc

SEQ ID NO: 1771863 - RNA, 20 nt, Salmonella enterica enterica serovar Typhi Ty2
cccgggagaacgccgggccu

SEQ ID NO: 1771864 - RNA, 22 nt, Salmonella enterica enterica serovar Typhi Ty2
cccggcugccauuaucaccauu

SEQ ID NO: 1771865 - RNA, 17 nt, Salmonella enterica enterica serovar Typhi Ty2
cccggcuuaaauuuuua

SEQ ID NO: 1771866 - RNA, 15 nt, Salmonella enterica enterica serovar Typhi Ty2
cccggcuuccagcgg

SEQ ID NO: 1771867 - RNA, 11 nt, Salmonella enterica enterica serovar Typhi Ty2
cccggcuaaac

SEQ ID NO: 1771868 - RNA, 17 nt, Salmonella enterica enterica serovar Typhi Ty2
cccggcucauuaccgac

SEQ ID NO: 1771869 - RNA, 16 nt, Salmonella enterica enterica serovar Typhi Ty2
cccggucaacgcgccg

SEQ ID NO: 1771870 - RNA, 18 nt, Salmonella enterica enterica serovar Typhi Ty2
cccggucaacgcgccgcc

SEQ ID NO: 1771871 - RNA, 14 nt, Salmonella enterica enterica serovar Typhi Ty2
cccgggugcgcagc

SEQ ID NO: 1771872 - RNA, 17 nt, Salmonella enterica enterica serovar Typhi Ty2
cccggugagcgccgcgc

SEQ ID NO: 1771873 - RNA, 17 nt, Salmonella enterica enterica serovar Typhi Ty2
cccgguggcgcugcgcu

SEQ ID NO: 1771874 - RNA, 18 nt, Salmonella enterica enterica serovar Typhi Ty2
cccgguggcgccacgcca

SEQ ID NO: 1771875 - RNA, 16 nt, Salmonella enterica enterica serovar Typhi Ty2
cccguauucaggcgau

SEQ ID NO: 1771876 - RNA, 15 nt, Salmonella enterica enterica serovar Typhi Ty2
ccgaccgccagcaga

SEQ ID NO: 1771877 - RNA, 21 nt, Salmonella enterica enterica serovar Typhi Ty2
ccgaccauuggcaccaccagg

SEQ ID NO: 1771878 - RNA, 22 nt, Salmonella enterica enterica serovar Typhi Ty2
ccgaccccgccgucagacaggc

SEQ ID NO: 1771879 - RNA, 21 nt, Salmonella enterica enterica serovar Typhi Ty2
ccgaccaguuuuugcgccagc

SEQ ID NO: 1771880 - RNA, 16 nt, Salmonella enterica enterica serovar Typhi Ty2
ccgaccagggcauccc

SEQ ID NO: 1771881 - RNA, 15 nt, Salmonella enterica enterica serovar Typhi Ty2
ccgaccaccagcuug

SEQ ID NO: 1771882 - RNA, 14 nt, Salmonella enterica enterica serovar Typhi Ty2
ccgacauucccagu

SEQ ID NO: 1771883 - RNA, 12 nt, Salmonella enterica enterica serovar Typhi Ty2
aaaccacuccgg

SEQ ID NO: 1771884 - RNA, 15 nt, Salmonella enterica enterica serovar Typhi Ty2
ccgacacgcucaugu

SEQ ID NO: 1771885 - RNA, 14 nt, Salmonella enterica enterica serovar Typhi Ty2
ccgaccgucggcgc

SEQ ID NO: 1771886 - RNA, 15 nt, Salmonella enterica enterica serovar Typhi Ty2
ccgaccgucagcucc

SEQ ID NO: 1771887 - RNA, 15 nt, Salmonella enterica enterica serovar Typhi Ty2
ccgacgcgaugccag

SEQ ID NO: 1771888 - RNA, 15 nt, Salmonella enterica enterica serovar Typhi Ty2
ccgacgcgggccgca

SEQ ID NO: 1771889 - RNA, 13 nt, Salmonella enterica enterica serovar Typhi Ty2
ccgacgccagcca

SEQ ID NO: 1771890 - RNA, 13 nt, Salmonella enterica enterica serovar Typhi Ty2
ccgacuuucaaau

SEQ ID NO: 1771891 - RNA, 14 nt, Salmonella enterica enterica serovar Typhi Ty2
ccgacuuuucgccc

SEQ ID NO: 1771892 - RNA, 19 nt, Salmonella enterica enterica serovar Typhi Ty2
ccgacuuuuuugccuuuca

SEQ ID NO: 1771893 - RNA, 22 nt, Salmonella enterica enterica serovar Typhi Ty2
ccgacuuuuuugccuuucagau

SEQ ID NO: 1771894 - RNA, 18 nt, Salmonella enterica enterica serovar Typhi Ty2
ccgacuuuuuugccuuuc

SEQ ID NO: 1771895 - RNA, 15 nt, Salmonella enterica enterica serovar Typhi Ty2
ccgagaaacaccaga

SEQ ID NO: 1771896 - RNA, 22 nt, Salmonella enterica enterica serovar Typhi Ty2
ccgagccagaacgagaggagga

SEQ ID NO: 1771897 - RNA, 19 nt, Salmonella enterica enterica serovar Typhi Ty2
ccgagcauuuccgcagcca

SEQ ID NO: 1771898 - RNA, 18 nt, Salmonella enterica enterica serovar Typhi Ty2
ccgagcagcuuggcggcu

SEQ ID NO: 1771899 - RNA, 14 nt, Salmonella enterica enterica serovar Typhi Ty2
ccgaacaugccgcc

SEQ ID NO: 1771900 - RNA, 15 nt, Salmonella enterica enterica serovar Typhi Ty2
aaacauauaucucua

SEQ ID NO: 1771901 - RNA, 15 nt, Salmonella enterica enterica serovar Typhi Ty2
aaacaucaugcccaa

SEQ ID NO: 1771902 - RNA, 19 nt, Salmonella enterica enterica serovar Typhi Ty2
ccgaacugcaucccugcuu

SEQ ID NO: 1771903 - RNA, 14 nt, Salmonella enterica enterica serovar Typhi Ty2
aaacaucagccauu

SEQ ID NO: 1771904 - RNA, 18 nt, Salmonella enterica enterica serovar Typhi Ty2
aaacaucagcgcaugccc

SEQ ID NO: 1771905 - RNA, 20 nt, Salmonella enterica enterica serovar Typhi Ty2
ccgaaagccgguaaucgauc

SEQ ID NO: 1771906 - RNA, 15 nt, Salmonella enterica enterica serovar Typhi Ty2
aaacauauccauaca

SEQ ID NO: 1771907 - RNA, 14 nt, Salmonella enterica enterica serovar Typhi Ty2
aaacauauaucucu

SEQ ID NO: 1771908 - RNA, 17 nt, Salmonella enterica enterica serovar Typhi Ty2
aaacaugucaaaauccu

SEQ ID NO: 1771909 - RNA, 13 nt, Salmonella enterica enterica serovar Typhi Ty2
ccgaaucgccgcu

SEQ ID NO: 1771910 - RNA, 20 nt, Salmonella enterica enterica serovar Typhi Ty2
ccgaauagcgacaaaugaag

SEQ ID NO: 1771911 - RNA, 13 nt, Salmonella enterica enterica serovar Typhi Ty2
ccgaagcaggcgg

SEQ ID NO: 1771912 - RNA, 15 nt, Salmonella enterica enterica serovar Typhi Ty2
aaacagccgccaugg

SEQ ID NO: 1771913 - RNA, 23 nt, Salmonella enterica enterica serovar Typhi Ty2
aaacagcgccaguuuuuccuguu

SEQ ID NO: 1771914 - RNA, 16 nt, Salmonella enterica enterica serovar Typhi Ty2
aaacagccaaucauaa

SEQ ID NO: 1771915 - RNA, 17 nt, Salmonella enterica enterica serovar Typhi Ty2
aaacagccaaucauaaa

SEQ ID NO: 1771916 - RNA, 14 nt, Salmonella enterica enterica serovar Typhi Ty2
aaacagcuguaaau

SEQ ID NO: 1771917 - RNA, 16 nt, Salmonella enterica enterica serovar Typhi Ty2
cccuuuuucaauaagc

SEQ ID NO: 1771918 - RNA, 20 nt, Salmonella enterica enterica serovar Typhi Ty2
aaacaggccugcggaaaaag

SEQ ID NO: 1771919 - RNA, 13 nt, Salmonella enterica enterica serovar Typhi Ty2
cccuuuuugcauu

SEQ ID NO: 1771920 - RNA, 11 nt, Salmonella enterica enterica serovar Typhi Ty2
cccuuaucugg

SEQ ID NO: 1771921 - RNA, 14 nt, Salmonella enterica enterica serovar Typhi Ty2
cccuuaucaaaggc

SEQ ID NO: 1771922 - RNA, 21 nt, Salmonella enterica enterica serovar Typhi Ty2
aaacagcagcgcggcacacag

SEQ ID NO: 1771923 - RNA, 17 nt, Salmonella enterica enterica serovar Typhi Ty2
aaacagcacgcucaaau

SEQ ID NO: 1771924 - RNA, 11 nt, Salmonella enterica enterica serovar Typhi Ty2
aaacagaugcu

SEQ ID NO: 1771925 - RNA, 13 nt, Salmonella enterica enterica serovar Typhi Ty2
cccuucaggaaua

SEQ ID NO: 1771926 - RNA, 20 nt, Salmonella enterica enterica serovar Typhi Ty2
aaacagauaagcgucugcaa

SEQ ID NO: 1771927 - RNA, 16 nt, Salmonella enterica enterica serovar Typhi Ty2
cccuucaccgcuuuuc

SEQ ID NO: 1771928 - RNA, 17 nt, Salmonella enterica enterica serovar Typhi Ty2
ccgcaucuucgcccggc

SEQ ID NO: 1771929 - RNA, 15 nt, Salmonella enterica enterica serovar Typhi Ty2
ccgcaucgauacccu

SEQ ID NO: 1771930 - RNA, 14 nt, Salmonella enterica enterica serovar Typhi Ty2
ccgcaucgccgcgg

SEQ ID NO: 1771931 - RNA, 18 nt, Salmonella enterica enterica serovar Typhi Ty2
ccgcaucagcaacgcgcc

SEQ ID NO: 1771932 - RNA, 15 nt, Salmonella enterica enterica serovar Typhi Ty2
ccgcaucacggcagc

SEQ ID NO: 1771933 - RNA, 19 nt, Salmonella enterica enterica serovar Typhi Ty2
ccgcauccccauagacagu

SEQ ID NO: 1771934 - RNA, 18 nt, Salmonella enterica enterica serovar Typhi Ty2
ccgcaggagagccagaag

SEQ ID NO: 1771935 - RNA, 14 nt, Salmonella enterica enterica serovar Typhi Ty2
ccgcaggccuggcu

SEQ ID NO: 1771936 - RNA, 14 nt, Salmonella enterica enterica serovar Typhi Ty2
ccgcaggcuuccag

SEQ ID NO: 1771937 - RNA, 14 nt, Salmonella enterica enterica serovar Typhi Ty2
ccgcagaaaaagcc

SEQ ID NO: 1771938 - RNA, 19 nt, Salmonella enterica enterica serovar Typhi Ty2
ccgcagauccagcacggcc

SEQ ID NO: 1771939 - RNA, 21 nt, Salmonella enterica enterica serovar Typhi Ty2
ccgcagauccagcacggccuu

SEQ ID NO: 1771940 - RNA, 17 nt, Salmonella enterica enterica serovar Typhi Ty2
ccgagcgguaagagcca

SEQ ID NO: 1771941 - RNA, 23 nt, Salmonella enterica enterica serovar Typhi Ty2
ccgaugucgcuucgcuuaucugg

SEQ ID NO: 1771942 - RNA, 23 nt, Salmonella enterica enterica serovar Typhi Ty2
ccgcaaaaugaggacacaguaau

SEQ ID NO: 1771943 - RNA, 22 nt, Salmonella enterica enterica serovar Typhi Ty2
ccgauuuuuuaucucgccgucg

SEQ ID NO: 1771944 - RNA, 12 nt, Salmonella enterica enterica serovar Typhi Ty2
ccgcaaaaccuu

SEQ ID NO: 1771945 - RNA, 21 nt, Salmonella enterica enterica serovar Typhi Ty2
ccgcaaaaccuucauaaauac

SEQ ID NO: 1771946 - RNA, 13 nt, Salmonella enterica enterica serovar Typhi Ty2
ccgcaauccccug

SEQ ID NO: 1771947 - RNA, 14 nt, Salmonella enterica enterica serovar Typhi Ty2
ccgcaauccuggcu

SEQ ID NO: 1771948 - RNA, 17 nt, Salmonella enterica enterica serovar Typhi Ty2
ccgcaaugaccacaaau

SEQ ID NO: 1771949 - RNA, 18 nt, Salmonella enterica enterica serovar Typhi Ty2
ccgcaaugaccacaaauu

SEQ ID NO: 1771950 - RNA, 15 nt, Salmonella enterica enterica serovar Typhi Ty2
ccgcacagacgucgg

SEQ ID NO: 1771951 - RNA, 23 nt, Salmonella enterica enterica serovar Typhi Ty2
ccgcacagacgucggcaccgaau

SEQ ID NO: 1771952 - RNA, 16 nt, Salmonella enterica enterica serovar Typhi Ty2
ccgcacacagcagaaa

SEQ ID NO: 1771953 - RNA, 18 nt, Salmonella enterica enterica serovar Typhi Ty2
ccgcaauugguaauuaaa

SEQ ID NO: 1771954 - RNA, 14 nt, Salmonella enterica enterica serovar Typhi Ty2
ccgcacagcagaca

SEQ ID NO: 1771955 - RNA, 14 nt, Salmonella enterica enterica serovar Typhi Ty2
ccgcacauaaucac

SEQ ID NO: 1771956 - RNA, 17 nt, Salmonella enterica enterica serovar Typhi Ty2
ccgccauccgacacagc

SEQ ID NO: 1771957 - RNA, 22 nt, Salmonella enterica enterica serovar Typhi Ty2
ccgccauccggcaaacucagcg

SEQ ID NO: 1771958 - RNA, 19 nt, Salmonella enterica enterica serovar Typhi Ty2
ccgccauccggcauuuuuu

SEQ ID NO: 1771959 - RNA, 16 nt, Salmonella enterica enterica serovar Typhi Ty2
ccgccaucgcugggau

SEQ ID NO: 1771960 - RNA, 14 nt, Salmonella enterica enterica serovar Typhi Ty2
ccgccaguuuuuau

SEQ ID NO: 1771961 - RNA, 20 nt, Salmonella enterica enterica serovar Typhi Ty2
ccgccauagaaauagccccg

SEQ ID NO: 1771962 - RNA, 18 nt, Salmonella enterica enterica serovar Typhi Ty2
ccgccagcuccugcgggc

SEQ ID NO: 1771963 - RNA, 20 nt, Salmonella enterica enterica serovar Typhi Ty2
aaaccagcuuuucauuuguu

SEQ ID NO: 1771964 - RNA, 20 nt, Salmonella enterica enterica serovar Typhi Ty2
aaaccagcgcggauaaaaaa

SEQ ID NO: 1771965 - RNA, 12 nt, Salmonella enterica enterica serovar Typhi Ty2
aaaccaguucac

SEQ ID NO: 1771966 - RNA, 17 nt, Salmonella enterica enterica serovar Typhi Ty2
aaaccaguugccagggu

SEQ ID NO: 1771967 - RNA, 20 nt, Salmonella enterica enterica serovar Typhi Ty2
ccgccagcgacauggcgguc

SEQ ID NO: 1771968 - RNA, 19 nt, Salmonella enterica enterica serovar Typhi Ty2
ccgccagcgagaugaaaag

SEQ ID NO: 1771969 - RNA, 12 nt, Salmonella enterica enterica serovar Typhi Ty2
aaaccagauacg

SEQ ID NO: 1771970 - RNA, 14 nt, Salmonella enterica enterica serovar Typhi Ty2
ccgccaccgcgcgc

SEQ ID NO: 1771971 - RNA, 23 nt, Salmonella enterica enterica serovar Typhi Ty2
ccgccaauauccggcacgccagc

SEQ ID NO: 1771972 - RNA, 13 nt, Salmonella enterica enterica serovar Typhi Ty2
ccgccaauaacca

SEQ ID NO: 1771973 - RNA, 19 nt, Salmonella enterica enterica serovar Typhi Ty2
ccgcauuuaacaggacgcu

SEQ ID NO: 1771974 - RNA, 14 nt, Salmonella enterica enterica serovar Typhi Ty2
ccgccaaacgcggu

SEQ ID NO: 1771975 - RNA, 16 nt, Salmonella enterica enterica serovar Typhi Ty2
ccgcauuuuuucuuca

SEQ ID NO: 1771976 - RNA, 21 nt, Salmonella enterica enterica serovar Typhi Ty2
ccgccaacgguaaguugaaag

SEQ ID NO: 1771977 - RNA, 14 nt, Salmonella enterica enterica serovar Typhi Ty2
ccgccagcaccagg

SEQ ID NO: 1771978 - RNA, 14 nt, Salmonella enterica enterica serovar Typhi Ty2
ccgccagcacagca

SEQ ID NO: 1771979 - RNA, 13 nt, Salmonella enterica enterica serovar Typhi Ty2
ccgccagcacagc

SEQ ID NO: 1771980 - RNA, 17 nt, Salmonella enterica enterica serovar Typhi Ty2
ccgccagacucagccag

SEQ ID NO: 1771981 - RNA, 22 nt, Salmonella enterica enterica serovar Typhi Ty2
ccgccagacucagccaggucug

SEQ ID NO: 1771982 - RNA, 18 nt, Salmonella enterica enterica serovar Typhi Ty2
ccgccaccuuucugcucc

SEQ ID NO: 1771983 - RNA, 20 nt, Salmonella enterica enterica serovar Typhi Ty2
ccgccgaggcuaagccagaa

SEQ ID NO: 1771984 - RNA, 21 nt, Salmonella enterica enterica serovar Typhi Ty2
aaaccauucaaauucaauaaa

SEQ ID NO: 1771985 - RNA, 22 nt, Salmonella enterica enterica serovar Typhi Ty2
aaacccacccgguaauaccgau

SEQ ID NO: 1771986 - RNA, 15 nt, Salmonella enterica enterica serovar Typhi Ty2
aaacccggugcggca

SEQ ID NO: 1771987 - RNA, 14 nt, Salmonella enterica enterica serovar Typhi Ty2
ccgccgcaacgcgc

SEQ ID NO: 1771988 - RNA, 18 nt, Salmonella enterica enterica serovar Typhi Ty2
aaaccccagauuacugcc

SEQ ID NO: 1771989 - RNA, 15 nt, Salmonella enterica enterica serovar Typhi Ty2
aaacccauauuccug

SEQ ID NO: 1771990 - RNA, 13 nt, Salmonella enterica enterica serovar Typhi Ty2
aaacccgccaccg

SEQ ID NO: 1771991 - RNA, 15 nt, Salmonella enterica enterica serovar Typhi Ty2
ccgccgacaccggcc

SEQ ID NO: 1771992 - RNA, 16 nt, Salmonella enterica enterica serovar Typhi Ty2
ccgccgacccccuccu

SEQ ID NO: 1771993 - RNA, 11 nt, Salmonella enterica enterica serovar Typhi Ty2
ccgcccuuucg

SEQ ID NO: 1771994 - RNA, 13 nt, Salmonella enterica enterica serovar Typhi Ty2
ccgcccugcccgc

SEQ ID NO: 1771995 - RNA, 18 nt, Salmonella enterica enterica serovar Typhi Ty2
ccgcccuguccuccaugg

SEQ ID NO: 1771996 - RNA, 16 nt, Salmonella enterica enterica serovar Typhi Ty2
ccgccaucguccagcc

SEQ ID NO: 1771997 - RNA, 13 nt, Salmonella enterica enterica serovar Typhi Ty2
ccgccaucucacg

SEQ ID NO: 1771998 - RNA, 20 nt, Salmonella enterica enterica serovar Typhi Ty2
ccgccaucucacgcauggcg

SEQ ID NO: 1771999 - RNA, 12 nt, Salmonella enterica enterica serovar Typhi Ty2
ccgccaugaaaa

SEQ ID NO: 1772000 - RNA, 18 nt, Salmonella enterica enterica serovar Typhi Ty2
ccgccauggcgaauccgu

SEQ ID NO: 1772001 - RNA, 18 nt, Salmonella enterica enterica serovar Typhi Ty2
ccgccauugccaguaccg

SEQ ID NO: 1772002 - RNA, 15 nt, Salmonella enterica enterica serovar Typhi Ty2
ccgcccaaccagccc

SEQ ID NO: 1772003 - RNA, 17 nt, Salmonella enterica enterica serovar Typhi Ty2
ccgcccagaacggcagc

SEQ ID NO: 1772004 - RNA, 23 nt, Salmonella enterica enterica serovar Typhi Ty2
ccgcccagauguugauacagaaa

SEQ ID NO: 1772005 - RNA, 18 nt, Salmonella enterica enterica serovar Typhi Ty2
ccgcccaguaccagcacu

SEQ ID NO: 1772006 - RNA, 13 nt, Salmonella enterica enterica serovar Typhi Ty2
ccgcccagucacg

SEQ ID NO: 1772007 - RNA, 16 nt, Salmonella enterica enterica serovar Typhi Ty2
ccgccccagcagcagc

SEQ ID NO: 1772008 - RNA, 14 nt, Salmonella enterica enterica serovar Typhi Ty2
ccgcccauccaggg

SEQ ID NO: 1772009 - RNA, 22 nt, Salmonella enterica enterica serovar Typhi Ty2
ccgcccauuaauaucagcccca

SEQ ID NO: 1772010 - RNA, 13 nt, Salmonella enterica enterica serovar Typhi Ty2
ccgcccgcguagc

SEQ ID NO: 1772011 - RNA, 21 nt, Salmonella enterica enterica serovar Typhi Ty2
ccgcccgcggcgaucaccacg

SEQ ID NO: 1772012 - RNA, 18 nt, Salmonella enterica enterica serovar Typhi Ty2
ccgccgcuauuaccccgc

SEQ ID NO: 1772013 - RNA, 15 nt, Salmonella enterica enterica serovar Typhi Ty2
ccgccggcagcagcu

SEQ ID NO: 1772014 - RNA, 18 nt, Salmonella enterica enterica serovar Typhi Ty2
ccgccgcuggucaacacg

SEQ ID NO: 1772015 - RNA, 15 nt, Salmonella enterica enterica serovar Typhi Ty2
ccgccgcuggcgggc

SEQ ID NO: 1772016 - RNA, 11 nt, Salmonella enterica enterica serovar Typhi Ty2
ccgccggaggg

SEQ ID NO: 1772017 - RNA, 16 nt, Salmonella enterica enterica serovar Typhi Ty2
ccgccgccgggccgcc

SEQ ID NO: 1772018 - RNA, 14 nt, Salmonella enterica enterica serovar Typhi Ty2
ccgccgccgggccg

SEQ ID NO: 1772019 - RNA, 13 nt, Salmonella enterica enterica serovar Typhi Ty2
ccgccgccgcgcc

SEQ ID NO: 1772020 - RNA, 17 nt, Salmonella enterica enterica serovar Typhi Ty2
ccgccgcgauguuugcu

SEQ ID NO: 1772021 - RNA, 13 nt, Salmonella enterica enterica serovar Typhi Ty2
ccgccgcgaccag

SEQ ID NO: 1772022 - RNA, 14 nt, Salmonella enterica enterica serovar Typhi Ty2
ccgccgcgagcagc

SEQ ID NO: 1772023 - RNA, 15 nt, Salmonella enterica enterica serovar Typhi Ty2
ccgccgccaucacca

SEQ ID NO: 1772024 - RNA, 19 nt, Salmonella enterica enterica serovar Typhi Ty2
ccgccgccagccaucccca

SEQ ID NO: 1772025 - RNA, 19 nt, Salmonella enterica enterica serovar Typhi Ty2
ccgccgccagcaccgccgc

SEQ ID NO: 1772026 - RNA, 18 nt, Salmonella enterica enterica serovar Typhi Ty2
ccgccgcaggccaucaua

SEQ ID NO: 1772027 - RNA, 15 nt, Salmonella enterica enterica serovar Typhi Ty2
ccgccuagcgucccg

SEQ ID NO: 1772028 - RNA, 11 nt, Salmonella enterica enterica serovar Typhi Ty2
ccgccuccggg

SEQ ID NO: 1772029 - RNA, 14 nt, Salmonella enterica enterica serovar Typhi Ty2
ccgccgugauaaau

SEQ ID NO: 1772030 - RNA, 19 nt, Salmonella enterica enterica serovar Typhi Ty2
ccgccgucggcaauaaacu

SEQ ID NO: 1772031 - RNA, 22 nt, Salmonella enterica enterica serovar Typhi Ty2
ccgucuccuccuugugggcagc

SEQ ID NO: 1772032 - RNA, 11 nt, Salmonella enterica enterica serovar Typhi Ty2
ccgucucgguu

SEQ ID NO: 1772033 - RNA, 22 nt, Salmonella enterica enterica serovar Typhi Ty2
ccgucucuuuaucuaacugcgg

SEQ ID NO: 1772034 - RNA, 20 nt, Salmonella enterica enterica serovar Typhi Ty2
ccgucucuuuaucuaacugc

SEQ ID NO: 1772035 - RNA, 16 nt, Salmonella enterica enterica serovar Typhi Ty2
ccgucguuacccuccu

SEQ ID NO: 1772036 - RNA, 18 nt, Salmonella enterica enterica serovar Typhi Ty2
ccgucguuaacaucauca

SEQ ID NO: 1772037 - RNA, 22 nt, Salmonella enterica enterica serovar Typhi Ty2
ccgucgugccuuucaggcgcgg

SEQ ID NO: 1772038 - RNA, 21 nt, Salmonella enterica enterica serovar Typhi Ty2
ccgucgugacuaauagccaaa

SEQ ID NO: 1772039 - RNA, 13 nt, Salmonella enterica enterica serovar Typhi Ty2
ccgucucaccagg

SEQ ID NO: 1772040 - RNA, 18 nt, Salmonella enterica enterica serovar Typhi Ty2
ccgucguugcugucgcgc

SEQ ID NO: 1772041 - RNA, 14 nt, Salmonella enterica enterica serovar Typhi Ty2
ccgucugcaaaauu

SEQ ID NO: 1772042 - RNA, 13 nt, Salmonella enterica enterica serovar Typhi Ty2
ccgugcccagcau

SEQ ID NO: 1772043 - RNA, 14 nt, Salmonella enterica enterica serovar Typhi Ty2
ccgugcccagcauc

SEQ ID NO: 1772044 - RNA, 16 nt, Salmonella enterica enterica serovar Typhi Ty2
ccguggccaaaaaauc

SEQ ID NO: 1772045 - RNA, 19 nt, Salmonella enterica enterica serovar Typhi Ty2
aaacgauuaauaaccaaua

SEQ ID NO: 1772046 - RNA, 14 nt, Salmonella enterica enterica serovar Typhi Ty2
aaacgacauaaccg

SEQ ID NO: 1772047 - RNA, 17 nt, Salmonella enterica enterica serovar Typhi Ty2
ccgucgauaaaauccuc

SEQ ID NO: 1772048 - RNA, 17 nt, Salmonella enterica enterica serovar Typhi Ty2
ccgucguagccaccauc

SEQ ID NO: 1772049 - RNA, 16 nt, Salmonella enterica enterica serovar Typhi Ty2
ccgguuauccauauga

SEQ ID NO: 1772050 - RNA, 13 nt, Salmonella enterica enterica serovar Typhi Ty2
ccgguucacccac

SEQ ID NO: 1772051 - RNA, 13 nt, Salmonella enterica enterica serovar Typhi Ty2
ccgguugcgcgcu

SEQ ID NO: 1772052 - RNA, 21 nt, Salmonella enterica enterica serovar Typhi Ty2
ccgguugcccauuuugcgguu

SEQ ID NO: 1772053 - RNA, 17 nt, Salmonella enterica enterica serovar Typhi Ty2
ccgguuucaauccaugu

SEQ ID NO: 1772054 - RNA, 12 nt, Salmonella enterica enterica serovar Typhi Ty2
ccgguugcugau

SEQ ID NO: 1772055 - RNA, 13 nt, Salmonella enterica enterica serovar Typhi Ty2
ccuaaagaaaaac

SEQ ID NO: 1772056 - RNA, 23 nt, Salmonella enterica enterica serovar Typhi Ty2
ccguuuuuaucuccccaauugcu

SEQ ID NO: 1772057 - RNA, 17 nt, Salmonella enterica enterica serovar Typhi Ty2
ccguuuuagguucuuca

SEQ ID NO: 1772058 - RNA, 12 nt, Salmonella enterica enterica serovar Typhi Ty2
ccguuuguaaca

SEQ ID NO: 1772059 - RNA, 17 nt, Salmonella enterica enterica serovar Typhi Ty2
ccguuuucgucaacaua

SEQ ID NO: 1772060 - RNA, 13 nt, Salmonella enterica enterica serovar Typhi Ty2
ccguuuguuuauu

SEQ ID NO: 1772061 - RNA, 12 nt, Salmonella enterica enterica serovar Typhi Ty2
ccguuugccaua

SEQ ID NO: 1772062 - RNA, 15 nt, Salmonella enterica enterica serovar Typhi Ty2
ccguuugcagccaga

SEQ ID NO: 1772063 - RNA, 20 nt, Salmonella enterica enterica serovar Typhi Ty2
ccguuugcgccagcccggcg

SEQ ID NO: 1772064 - RNA, 22 nt, Salmonella enterica enterica serovar Typhi Ty2
ccuaaaucugccaucagcaccu

SEQ ID NO: 1772065 - RNA, 21 nt, Salmonella enterica enterica serovar Typhi Ty2
ccuaacacaugcaagucgaac

SEQ ID NO: 1772066 - RNA, 11 nt, Salmonella enterica enterica serovar Typhi Ty2
ccuaacaguuu

SEQ ID NO: 1772067 - RNA, 15 nt, Salmonella enterica enterica serovar Typhi Ty2
ccuaacaucauuccc

SEQ ID NO: 1772068 - RNA, 18 nt, Salmonella enterica enterica serovar Typhi Ty2
ccuaagagaaaaccccgu

SEQ ID NO: 1772069 - RNA, 15 nt, Salmonella enterica enterica serovar Typhi Ty2
ccuaacuggaaaaag

SEQ ID NO: 1772070 - RNA, 17 nt, Salmonella enterica enterica serovar Typhi Ty2
ccuaauagccagcccca

SEQ ID NO: 1772071 - RNA, 15 nt, Salmonella enterica enterica serovar Typhi Ty2
ccguuaacugcugcu

SEQ ID NO: 1772072 - RNA, 19 nt, Salmonella enterica enterica serovar Typhi Ty2
ccguguugugugccgcgcu

SEQ ID NO: 1772073 - RNA, 14 nt, Salmonella enterica enterica serovar Typhi Ty2
ccguuaagcccuga

SEQ ID NO: 1772074 - RNA, 13 nt, Salmonella enterica enterica serovar Typhi Ty2
ccguuaagcugga

SEQ ID NO: 1772075 - RNA, 13 nt, Salmonella enterica enterica serovar Typhi Ty2
ccguuaccagcau

SEQ ID NO: 1772076 - RNA, 20 nt, Salmonella enterica enterica serovar Typhi Ty2
ccguuaauggaggcagugaa

SEQ ID NO: 1772077 - RNA, 16 nt, Salmonella enterica enterica serovar Typhi Ty2
ccguuauucauucacc

SEQ ID NO: 1772078 - RNA, 15 nt, Salmonella enterica enterica serovar Typhi Ty2
ccguuacuuccccca

SEQ ID NO: 1772079 - RNA, 19 nt, Salmonella enterica enterica serovar Typhi Ty2
ccguucaucgguaauauua

SEQ ID NO: 1772080 - RNA, 15 nt, Salmonella enterica enterica serovar Typhi Ty2
ccguuccaccgccaa

SEQ ID NO: 1772081 - RNA, 20 nt, Salmonella enterica enterica serovar Typhi Ty2
ccguucauucgccccagcau

SEQ ID NO: 1772082 - RNA, 23 nt, Salmonella enterica enterica serovar Typhi Ty2
ccguucaucuaucgccagcgcgu

SEQ ID NO: 1772083 - RNA, 22 nt, Salmonella enterica enterica serovar Typhi Ty2
ccguucccucgacaauuucacc

SEQ ID NO: 1772084 - RNA, 20 nt, Salmonella enterica enterica serovar Typhi Ty2
ccguugcaauauaguugagc

SEQ ID NO: 1772085 - RNA, 13 nt, Salmonella enterica enterica serovar Typhi Ty2
ccguucuuccugg

SEQ ID NO: 1772086 - RNA, 18 nt, Salmonella enterica enterica serovar Typhi Ty2
ccguucugugcgccgcug

SEQ ID NO: 1772087 - RNA, 18 nt, Salmonella enterica enterica serovar Typhi Ty2
ccguuuaccggugcagac

SEQ ID NO: 1772088 - RNA, 21 nt, Salmonella enterica enterica serovar Typhi Ty2
ccguuucagaaagagauuaga

SEQ ID NO: 1772089 - RNA, 20 nt, Salmonella enterica enterica serovar Typhi Ty2
ccguuuaucguuaccggcuc

SEQ ID NO: 1772090 - RNA, 20 nt, Salmonella enterica enterica serovar Typhi Ty2
ccguuuccgcaauaagugca

SEQ ID NO: 1772091 - RNA, 17 nt, Salmonella enterica enterica serovar Typhi Ty2
ccguuucagccccuugc

SEQ ID NO: 1772092 - RNA, 17 nt, Salmonella enterica enterica serovar Typhi Ty2
ccguugcgcccaucauc

SEQ ID NO: 1772093 - RNA, 19 nt, Salmonella enterica enterica serovar Typhi Ty2
ccucgacaauuucaccuuu

SEQ ID NO: 1772094 - RNA, 16 nt, Salmonella enterica enterica serovar Typhi Ty2
ccucgaccaguuuuuc

SEQ ID NO: 1772095 - RNA, 17 nt, Salmonella enterica enterica serovar Typhi Ty2
ccucgcuuaaaccacca

SEQ ID NO: 1772096 - RNA, 20 nt, Salmonella enterica enterica serovar Typhi Ty2
ccucgcgcauccgggccgcu

SEQ ID NO: 1772097 - RNA, 13 nt, Salmonella enterica enterica serovar Typhi Ty2
ccuccaucgccag

SEQ ID NO: 1772098 - RNA, 21 nt, Salmonella enterica enterica serovar Typhi Ty2
ccuccauggcuugucgccaac

SEQ ID NO: 1772099 - RNA, 14 nt, Salmonella enterica enterica serovar Typhi Ty2
ccuccauccaggua

SEQ ID NO: 1772100 - RNA, 20 nt, Salmonella enterica enterica serovar Typhi Ty2
ccuccaguaauucccggcag

SEQ ID NO: 1772101 - RNA, 17 nt, Salmonella enterica enterica serovar Typhi Ty2
ccuccggccagcgccag

SEQ ID NO: 1772102 - RNA, 13 nt, Salmonella enterica enterica serovar Typhi Ty2
ccuccggcacaca

SEQ ID NO: 1772103 - RNA, 18 nt, Salmonella enterica enterica serovar Typhi Ty2
ccuccggaucgacagcaa

SEQ ID NO: 1772104 - RNA, 15 nt, Salmonella enterica enterica serovar Typhi Ty2
ccuccgggaaaacau

SEQ ID NO: 1772105 - RNA, 17 nt, Salmonella enterica enterica serovar Typhi Ty2
ccuccggcggugaagca

SEQ ID NO: 1772106 - RNA, 15 nt, Salmonella enterica enterica serovar Typhi Ty2
ccuccggcgcggcgc

SEQ ID NO: 1772107 - RNA, 19 nt, Salmonella enterica enterica serovar Typhi Ty2
ccuccggugaagguaauuu

SEQ ID NO: 1772108 - RNA, 13 nt, Salmonella enterica enterica serovar Typhi Ty2
ccuccggcuucag

SEQ ID NO: 1772109 - RNA, 18 nt, Salmonella enterica enterica serovar Typhi Ty2
ccucauccagauguuaua

SEQ ID NO: 1772110 - RNA, 18 nt, Salmonella enterica enterica serovar Typhi Ty2
ccucaucccggcuuaaau

SEQ ID NO: 1772111 - RNA, 13 nt, Salmonella enterica enterica serovar Typhi Ty2
aaacgcacccgcg

SEQ ID NO: 1772112 - RNA, 22 nt, Salmonella enterica enterica serovar Typhi Ty2
ccucagaaagcguuggcgugcg

SEQ ID NO: 1772113 - RNA, 12 nt, Salmonella enterica enterica serovar Typhi Ty2
ccucagaauccg

SEQ ID NO: 1772114 - RNA, 19 nt, Salmonella enterica enterica serovar Typhi Ty2
ccucagauguaucgcgcuu

SEQ ID NO: 1772115 - RNA, 19 nt, Salmonella enterica enterica serovar Typhi Ty2
ccucagcaaugauuuuuag

SEQ ID NO: 1772116 - RNA, 16 nt, Salmonella enterica enterica serovar Typhi Ty2
ccucagcaggcgggcu

SEQ ID NO: 1772117 - RNA, 17 nt, Salmonella enterica enterica serovar Typhi Ty2
ccuauuuugcaaaacug

SEQ ID NO: 1772118 - RNA, 15 nt, Salmonella enterica enterica serovar Typhi Ty2
ccuaucccaauucgu

SEQ ID NO: 1772119 - RNA, 21 nt, Salmonella enterica enterica serovar Typhi Ty2
ccuauuucaguacagccaaaa

SEQ ID NO: 1772120 - RNA, 20 nt, Salmonella enterica enterica serovar Typhi Ty2
ccucacacugauggcagacc

SEQ ID NO: 1772121 - RNA, 19 nt, Salmonella enterica enterica serovar Typhi Ty2
ccucaaucggcgauaaacc

SEQ ID NO: 1772122 - RNA, 12 nt, Salmonella enterica enterica serovar Typhi Ty2
ccuauccggccg

SEQ ID NO: 1772123 - RNA, 22 nt, Salmonella enterica enterica serovar Typhi Ty2
ccuaucaggcguugaccgcuuc

SEQ ID NO: 1772124 - RNA, 18 nt, Salmonella enterica enterica serovar Typhi Ty2
ccuauagacaccuuauau

SEQ ID NO: 1772125 - RNA, 14 nt, Salmonella enterica enterica serovar Typhi Ty2
ccuagcgucccggc

SEQ ID NO: 1772126 - RNA, 16 nt, Salmonella enterica enterica serovar Typhi Ty2
ccuagcgucccggcaa

SEQ ID NO: 1772127 - RNA, 22 nt, Salmonella enterica enterica serovar Typhi Ty2
ccuacgcuuaccgggccugugu

SEQ ID NO: 1772128 - RNA, 15 nt, Salmonella enterica enterica serovar Typhi Ty2
ccuaccugccgccau

SEQ ID NO: 1772129 - RNA, 21 nt, Salmonella enterica enterica serovar Typhi Ty2
ccuacuguggugugccugcgu

SEQ ID NO: 1772130 - RNA, 18 nt, Salmonella enterica enterica serovar Typhi Ty2
ccuacacaaaaucauucg

SEQ ID NO: 1772131 - RNA, 23 nt, Salmonella enterica enterica serovar Typhi Ty2
ccuacaaggaaagaaaaugccag

SEQ ID NO: 1772132 - RNA, 17 nt, Salmonella enterica enterica serovar Typhi Ty2
ccuacaaggcauucagg

SEQ ID NO: 1772133 - RNA, 19 nt, Salmonella enterica enterica serovar Typhi Ty2
ccuacaauggaaaaaucug

SEQ ID NO: 1772134 - RNA, 23 nt, Salmonella enterica enterica serovar Typhi Ty2
ccggcaaaggaauuacgggcgau

SEQ ID NO: 1772135 - RNA, 18 nt, Salmonella enterica enterica serovar Typhi Ty2
ccggcaaagaagcuuaca

SEQ ID NO: 1772136 - RNA, 20 nt, Salmonella enterica enterica serovar Typhi Ty2
ccggcaaaaagaaucgccag

SEQ ID NO: 1772137 - RNA, 13 nt, Salmonella enterica enterica serovar Typhi Ty2
ccggauuuuaaau

SEQ ID NO: 1772138 - RNA, 13 nt, Salmonella enterica enterica serovar Typhi Ty2
ccggaugcggcua

SEQ ID NO: 1772139 - RNA, 14 nt, Salmonella enterica enterica serovar Typhi Ty2
ccggauggcacugc

SEQ ID NO: 1772140 - RNA, 18 nt, Salmonella enterica enterica serovar Typhi Ty2
ccggauggcgcugcgcuu

SEQ ID NO: 1772141 - RNA, 22 nt, Salmonella enterica enterica serovar Typhi Ty2
ccggauggcaguacagggcgau

SEQ ID NO: 1772142 - RNA, 23 nt, Salmonella enterica enterica serovar Typhi Ty2
ccggauggcggcgugaccgccuu

SEQ ID NO: 1772143 - RNA, 20 nt, Salmonella enterica enterica serovar Typhi Ty2
ccggauggcggcuacgccuu

SEQ ID NO: 1772144 - RNA, 13 nt, Salmonella enterica enterica serovar Typhi Ty2
ccggauuuaccag

SEQ ID NO: 1772145 - RNA, 15 nt, Salmonella enterica enterica serovar Typhi Ty2
ccggaugcgacgcgc

SEQ ID NO: 1772146 - RNA, 16 nt, Salmonella enterica enterica serovar Typhi Ty2
ccggaugcgccucauc

SEQ ID NO: 1772147 - RNA, 16 nt, Salmonella enterica enterica serovar Typhi Ty2
ccggaugcaccaucuc

SEQ ID NO: 1772148 - RNA, 16 nt, Salmonella enterica enterica serovar Typhi Ty2
ccggaugccccaucac

SEQ ID NO: 1772149 - RNA, 16 nt, Salmonella enterica enterica serovar Typhi Ty2
ccggaucggccauauc

SEQ ID NO: 1772150 - RNA, 18 nt, Salmonella enterica enterica serovar Typhi Ty2
ccggaucgcuaauuuuua

SEQ ID NO: 1772151 - RNA, 18 nt, Salmonella enterica enterica serovar Typhi Ty2
ccggaugacgcuucgcuu

SEQ ID NO: 1772152 - RNA, 16 nt, Salmonella enterica enterica serovar Typhi Ty2
ccggaucgaucccggc

SEQ ID NO: 1772153 - RNA, 12 nt, Salmonella enterica enterica serovar Typhi Ty2
ccggaucgaucc

SEQ ID NO: 1772154 - RNA, 21 nt, Salmonella enterica enterica serovar Typhi Ty2
ccggauacucgacgcacucca

SEQ ID NO: 1772155 - RNA, 14 nt, Salmonella enterica enterica serovar Typhi Ty2
ccggacgcaccagc

SEQ ID NO: 1772156 - RNA, 13 nt, Salmonella enterica enterica serovar Typhi Ty2
ccggacgccacca

SEQ ID NO: 1772157 - RNA, 17 nt, Salmonella enterica enterica serovar Typhi Ty2
ccggacgccguccaggc

SEQ ID NO: 1772158 - RNA, 14 nt, Salmonella enterica enterica serovar Typhi Ty2
ccggacgccaccac

SEQ ID NO: 1772159 - RNA, 14 nt, Salmonella enterica enterica serovar Typhi Ty2
ccgcuucgccacuc

SEQ ID NO: 1772160 - RNA, 23 nt, Salmonella enterica enterica serovar Typhi Ty2
ccgcuucauuggcgucugcuggc

SEQ ID NO: 1772161 - RNA, 12 nt, Salmonella enterica enterica serovar Typhi Ty2
ccgcuuccagcg

SEQ ID NO: 1772162 - RNA, 14 nt, Salmonella enterica enterica serovar Typhi Ty2
ccgcuucacacugg

SEQ ID NO: 1772163 - RNA, 17 nt, Salmonella enterica enterica serovar Typhi Ty2
ccgcuucacgcgcggcu

SEQ ID NO: 1772164 - RNA, 14 nt, Salmonella enterica enterica serovar Typhi Ty2
ccgccugaaucgcc

SEQ ID NO: 1772165 - RNA, 16 nt, Salmonella enterica enterica serovar Typhi Ty2
ccgccugaaucgccgc

SEQ ID NO: 1772166 - RNA, 16 nt, Salmonella enterica enterica serovar Typhi Ty2
ccgccucgaccccuuc

SEQ ID NO: 1772167 - RNA, 19 nt, Salmonella enterica enterica serovar Typhi Ty2
ccgcuguuacugucggcga

SEQ ID NO: 1772168 - RNA, 21 nt, Salmonella enterica enterica serovar Typhi Ty2
ccgcuguuaugcacgcgcggc

SEQ ID NO: 1772169 - RNA, 22 nt, Salmonella enterica enterica serovar Typhi Ty2
ccggaccuaauagccagcccca

SEQ ID NO: 1772170 - RNA, 20 nt, Salmonella enterica enterica serovar Typhi Ty2
ccggaaaagcgcuggcuggc

SEQ ID NO: 1772171 - RNA, 16 nt, Salmonella enterica enterica serovar Typhi Ty2
ccgcuuuuuccagcau

SEQ ID NO: 1772172 - RNA, 17 nt, Salmonella enterica enterica serovar Typhi Ty2
ccgcuuuuuucagcggc

SEQ ID NO: 1772173 - RNA, 17 nt, Salmonella enterica enterica serovar Typhi Ty2
ccggaaaagcgcuggcu

SEQ ID NO: 1772174 - RNA, 19 nt, Salmonella enterica enterica serovar Typhi Ty2
ccgcuuuucuggcuucagc

SEQ ID NO: 1772175 - RNA, 21 nt, Salmonella enterica enterica serovar Typhi Ty2
ccgcuuuugccgcgacuuccg

SEQ ID NO: 1772176 - RNA, 22 nt, Salmonella enterica enterica serovar Typhi Ty2
ccgcuuuaugcgcuuccagcau

SEQ ID NO: 1772177 - RNA, 21 nt, Salmonella enterica enterica serovar Typhi Ty2
ccgcuuuaucguaaccgaugu

SEQ ID NO: 1772178 - RNA, 17 nt, Salmonella enterica enterica serovar Typhi Ty2
ccggcaccucguccaga

SEQ ID NO: 1772179 - RNA, 20 nt, Salmonella enterica enterica serovar Typhi Ty2
ccggcacauauuccggcgcu

SEQ ID NO: 1772180 - RNA, 13 nt, Salmonella enterica enterica serovar Typhi Ty2
ccggcacauccag

SEQ ID NO: 1772181 - RNA, 16 nt, Salmonella enterica enterica serovar Typhi Ty2
ccggcacaaccuggcu

SEQ ID NO: 1772182 - RNA, 18 nt, Salmonella enterica enterica serovar Typhi Ty2
ccggcagacggcugggcu

SEQ ID NO: 1772183 - RNA, 21 nt, Salmonella enterica enterica serovar Typhi Ty2
ccggcagcagugagcuuugca

SEQ ID NO: 1772184 - RNA, 20 nt, Salmonella enterica enterica serovar Typhi Ty2
ccggcaggcagcgccagcgg

SEQ ID NO: 1772185 - RNA, 19 nt, Salmonella enterica enterica serovar Typhi Ty2
ccggcagguagucauauuc

SEQ ID NO: 1772186 - RNA, 15 nt, Salmonella enterica enterica serovar Typhi Ty2
ccggcaucacgccgg

SEQ ID NO: 1772187 - RNA, 22 nt, Salmonella enterica enterica serovar Typhi Ty2
ccggcaguuauuuuacgggcgu

SEQ ID NO: 1772188 - RNA, 15 nt, Salmonella enterica enterica serovar Typhi Ty2
ccggcgaaagcggac

SEQ ID NO: 1772189 - RNA, 20 nt, Salmonella enterica enterica serovar Typhi Ty2
ccggcgaaaucgugcgcccc

SEQ ID NO: 1772190 - RNA, 19 nt, Salmonella enterica enterica serovar Typhi Ty2
ccggcgaaaccgauuuccu

SEQ ID NO: 1772191 - RNA, 19 nt, Salmonella enterica enterica serovar Typhi Ty2
ccggcgaacguuggcuggg

SEQ ID NO: 1772192 - RNA, 16 nt, Salmonella enterica enterica serovar Typhi Ty2
ccggcgauagcggccu

SEQ ID NO: 1772193 - RNA, 22 nt, Salmonella enterica enterica serovar Typhi Ty2
ccggcgaaaaccgagcauccgc

SEQ ID NO: 1772194 - RNA, 13 nt, Salmonella enterica enterica serovar Typhi Ty2
ccggccuacagac

SEQ ID NO: 1772195 - RNA, 21 nt, Salmonella enterica enterica serovar Typhi Ty2
ccggcauuaugcaggcgucgg

SEQ ID NO: 1772196 - RNA, 15 nt, Salmonella enterica enterica serovar Typhi Ty2
ccggccagcgccagc

SEQ ID NO: 1772197 - RNA, 18 nt, Salmonella enterica enterica serovar Typhi Ty2
ccggcguuccgcccaggc

SEQ ID NO: 1772198 - RNA, 13 nt, Salmonella enterica enterica serovar Typhi Ty2
ccggcguugaaau

SEQ ID NO: 1772199 - RNA, 19 nt, Salmonella enterica enterica serovar Typhi Ty2
ccggcguuuuuagugacag

SEQ ID NO: 1772200 - RNA, 21 nt, Salmonella enterica enterica serovar Typhi Ty2
aaaccgucauuuaccagugcu

SEQ ID NO: 1772201 - RNA, 16 nt, Salmonella enterica enterica serovar Typhi Ty2
aaaccgucauuuacca

SEQ ID NO: 1772202 - RNA, 17 nt, Salmonella enterica enterica serovar Typhi Ty2
aaaccgccucaauugcc

SEQ ID NO: 1772203 - RNA, 18 nt, Salmonella enterica enterica serovar Typhi Ty2
ccggcguaauugcgccug

SEQ ID NO: 1772204 - RNA, 18 nt, Salmonella enterica enterica serovar Typhi Ty2
ccggcgucauacugccaa

SEQ ID NO: 1772205 - RNA, 14 nt, Salmonella enterica enterica serovar Typhi Ty2
ccggcgcagacggc

SEQ ID NO: 1772206 - RNA, 22 nt, Salmonella enterica enterica serovar Typhi Ty2
ccggcgcaaacaguacgcccgc

SEQ ID NO: 1772207 - RNA, 18 nt, Salmonella enterica enterica serovar Typhi Ty2
ccggcgauggugcggcgc

SEQ ID NO: 1772208 - RNA, 17 nt, Salmonella enterica enterica serovar Typhi Ty2
ccggcggcgacuggcua

SEQ ID NO: 1772209 - RNA, 18 nt, Salmonella enterica enterica serovar Typhi Ty2
ccggcgcagcaucugcgg

SEQ ID NO: 1772210 - RNA, 21 nt, Salmonella enterica enterica serovar Typhi Ty2
ccgggcagacaucgccgugcu

SEQ ID NO: 1772211 - RNA, 22 nt, Salmonella enterica enterica serovar Typhi Ty2
ccgggcagcaucucgauuacag

SEQ ID NO: 1772212 - RNA, 16 nt, Salmonella enterica enterica serovar Typhi Ty2
ccgggcauaaaaaaag

SEQ ID NO: 1772213 - RNA, 13 nt, Salmonella enterica enterica serovar Typhi Ty2
ccgggcauggcuc

SEQ ID NO: 1772214 - RNA, 13 nt, Salmonella enterica enterica serovar Typhi Ty2
ccgggccaaugcc

SEQ ID NO: 1772215 - RNA, 17 nt, Salmonella enterica enterica serovar Typhi Ty2
ccgggccaaugccgccu

SEQ ID NO: 1772216 - RNA, 13 nt, Salmonella enterica enterica serovar Typhi Ty2
ccgggcgaccacc

SEQ ID NO: 1772217 - RNA, 13 nt, Salmonella enterica enterica serovar Typhi Ty2
ccgggccuggcau

SEQ ID NO: 1772218 - RNA, 17 nt, Salmonella enterica enterica serovar Typhi Ty2
ccgggcgacacgcgcgc

SEQ ID NO: 1772219 - RNA, 20 nt, Salmonella enterica enterica serovar Typhi Ty2
ccgggccaucuuuuuucacu

SEQ ID NO: 1772220 - RNA, 15 nt, Salmonella enterica enterica serovar Typhi Ty2
ccggcugccauuauc

SEQ ID NO: 1772221 - RNA, 22 nt, Salmonella enterica enterica serovar Typhi Ty2
ccggcugcauauacucacugaa

SEQ ID NO: 1772222 - RNA, 21 nt, Salmonella enterica enterica serovar Typhi Ty2
ccggcugcgucgcuucuuguu

SEQ ID NO: 1772223 - RNA, 22 nt, Salmonella enterica enterica serovar Typhi Ty2
ccggcuccgaccaucgccgcga

SEQ ID NO: 1772224 - RNA, 15 nt, Salmonella enterica enterica serovar Typhi Ty2
aaaccguuaugaauc

SEQ ID NO: 1772225 - RNA, 19 nt, Salmonella enterica enterica serovar Typhi Ty2
ccgguacaccaacuaccaa

SEQ ID NO: 1772226 - RNA, 22 nt, Salmonella enterica enterica serovar Typhi Ty2
ccgguaauaauuagcauccagc

SEQ ID NO: 1772227 - RNA, 22 nt, Salmonella enterica enterica serovar Typhi Ty2
ccgguaacgauaaaaugcaaau

SEQ ID NO: 1772228 - RNA, 20 nt, Salmonella enterica enterica serovar Typhi Ty2
ccgguaaauccacaaccggc

SEQ ID NO: 1772229 - RNA, 18 nt, Salmonella enterica enterica serovar Typhi Ty2
ccgggugcaaauccaucu

SEQ ID NO: 1772230 - RNA, 20 nt, Salmonella enterica enterica serovar Typhi Ty2
ccggguucagcgacaggcug

SEQ ID NO: 1772231 - RNA, 13 nt, Salmonella enterica enterica serovar Typhi Ty2
ccggguucugcgg

SEQ ID NO: 1772232 - RNA, 22 nt, Salmonella enterica enterica serovar Typhi Ty2
ccgggcgcaccaguuccccaua

SEQ ID NO: 1772233 - RNA, 22 nt, Salmonella enterica enterica serovar Typhi Ty2
ccgggcgucacccgccggcagc

SEQ ID NO: 1772234 - RNA, 23 nt, Salmonella enterica enterica serovar Typhi Ty2
ccgggcucauuuuauccaacagc

SEQ ID NO: 1772235 - RNA, 14 nt, Salmonella enterica enterica serovar Typhi Ty2
ccgggcugcacgcc

SEQ ID NO: 1772236 - RNA, 21 nt, Salmonella enterica enterica serovar Typhi Ty2
ccgggcugaacgccaggccgu

SEQ ID NO: 1772237 - RNA, 23 nt, Salmonella enterica enterica serovar Typhi Ty2
ccggguaggacauagccgccacc

SEQ ID NO: 1772238 - RNA, 20 nt, Salmonella enterica enterica serovar Typhi Ty2
ccggguauaccaucggcugg

SEQ ID NO: 1772239 - RNA, 21 nt, Salmonella enterica enterica serovar Typhi Ty2
ccggguauuucugaaaaaccg

SEQ ID NO: 1772240 - RNA, 23 nt, Salmonella enterica enterica serovar Typhi Ty2
ccgggucggacgagcgcgucagc

SEQ ID NO: 1772241 - RNA, 15 nt, Salmonella enterica enterica serovar Typhi Ty2
ccggucggcgcguca

SEQ ID NO: 1772242 - RNA, 14 nt, Salmonella enterica enterica serovar Typhi Ty2
ccggugagcgccgc

SEQ ID NO: 1772243 - RNA, 19 nt, Salmonella enterica enterica serovar Typhi Ty2
ccggugccauuccagccgg

SEQ ID NO: 1772244 - RNA, 19 nt, Salmonella enterica enterica serovar Typhi Ty2
ccggugcggcaagcgcgcu

SEQ ID NO: 1772245 - RNA, 15 nt, Salmonella enterica enterica serovar Typhi Ty2
ccggucagucccagc

SEQ ID NO: 1772246 - RNA, 22 nt, Salmonella enterica enterica serovar Typhi Ty2
ccggucaucgcggaaagcaaug

SEQ ID NO: 1772247 - RNA, 15 nt, Salmonella enterica enterica serovar Typhi Ty2
ccgguagccagccaa

SEQ ID NO: 1772248 - RNA, 15 nt, Salmonella enterica enterica serovar Typhi Ty2
ccgguagccaggcgc

SEQ ID NO: 1772249 - RNA, 17 nt, Salmonella enterica enterica serovar Typhi Ty2
ccgguagccaggcgcga

SEQ ID NO: 1772250 - RNA, 18 nt, Salmonella enterica enterica serovar Typhi Ty2
ccgguauuuuucaccuca

SEQ ID NO: 1772251 - RNA, 13 nt, Salmonella enterica enterica serovar Typhi Ty2
ccgguauccagcg

SEQ ID NO: 1772252 - RNA, 17 nt, Salmonella enterica enterica serovar Typhi Ty2
cgacaauguccgccaga

SEQ ID NO: 1772253 - RNA, 15 nt, Salmonella enterica enterica serovar Typhi Ty2
cgacaaucagcacca

SEQ ID NO: 1772254 - RNA, 20 nt, Salmonella enterica enterica serovar Typhi Ty2
cgacaagcggguggucugga

SEQ ID NO: 1772255 - RNA, 19 nt, Salmonella enterica enterica serovar Typhi Ty2
cgacaagcuaauccccagc

SEQ ID NO: 1772256 - RNA, 22 nt, Salmonella enterica enterica serovar Typhi Ty2
cgacaagcuaauccccagcgcu

SEQ ID NO: 1772257 - RNA, 21 nt, Salmonella enterica enterica serovar Typhi Ty2
cgacacauucaggcuuuccac

SEQ ID NO: 1772258 - RNA, 22 nt, Salmonella enterica enterica serovar Typhi Ty2
cgaauuccuuuuuccgccaccu

SEQ ID NO: 1772259 - RNA, 21 nt, Salmonella enterica enterica serovar Typhi Ty2
cgaauuuauaagccugagcgc

SEQ ID NO: 1772260 - RNA, 14 nt, Salmonella enterica enterica serovar Typhi Ty2
cgaauugucgguuu

SEQ ID NO: 1772261 - RNA, 15 nt, Salmonella enterica enterica serovar Typhi Ty2
cgaauuucacgcagc

SEQ ID NO: 1772262 - RNA, 12 nt, Salmonella enterica enterica serovar Typhi Ty2
cgaauuuccagc

SEQ ID NO: 1772263 - RNA, 20 nt, Salmonella enterica enterica serovar Typhi Ty2
cgacaaaaccguucugagcg

SEQ ID NO: 1772264 - RNA, 15 nt, Salmonella enterica enterica serovar Typhi Ty2
cgacaaaagccagau

SEQ ID NO: 1772265 - RNA, 15 nt, Salmonella enterica enterica serovar Typhi Ty2
cgacaaacagcuauc

SEQ ID NO: 1772266 - RNA, 18 nt, Salmonella enterica enterica serovar Typhi Ty2
cgacaaaccacugcugua

SEQ ID NO: 1772267 - RNA, 15 nt, Salmonella enterica enterica serovar Typhi Ty2
cgacaaacagcgccc

SEQ ID NO: 1772268 - RNA, 22 nt, Salmonella enterica enterica serovar Typhi Ty2
cgacaaagcguggggaaaaccc

SEQ ID NO: 1772269 - RNA, 16 nt, Salmonella enterica enterica serovar Typhi Ty2
cgacaaccagcgaaau

SEQ ID NO: 1772270 - RNA, 22 nt, Salmonella enterica enterica serovar Typhi Ty2
cgacacgcgcgcugcgccugga

SEQ ID NO: 1772271 - RNA, 18 nt, Salmonella enterica enterica serovar Typhi Ty2
cgacacggcgcagauauu

SEQ ID NO: 1772272 - RNA, 19 nt, Salmonella enterica enterica serovar Typhi Ty2
cgacagagaaugcgccgcc

SEQ ID NO: 1772273 - RNA, 19 nt, Salmonella enterica enterica serovar Typhi Ty2
cgacagauuggucagcagc

SEQ ID NO: 1772274 - RNA, 12 nt, Salmonella enterica enterica serovar Typhi Ty2
cgacagcgcgcc

SEQ ID NO: 1772275 - RNA, 20 nt, Salmonella enterica enterica serovar Typhi Ty2
cgacagcgcuauccggccca

SEQ ID NO: 1772276 - RNA, 21 nt, Salmonella enterica enterica serovar Typhi Ty2
cgacagccgcguuuugccgcu

SEQ ID NO: 1772277 - RNA, 20 nt, Salmonella enterica enterica serovar Typhi Ty2
cgacagccagcauuuccagc

SEQ ID NO: 1772278 - RNA, 13 nt, Salmonella enterica enterica serovar Typhi Ty2
cgacagcccccau

SEQ ID NO: 1772279 - RNA, 17 nt, Salmonella enterica enterica serovar Typhi Ty2
cgacauaaaacccgccu

SEQ ID NO: 1772280 - RNA, 14 nt, Salmonella enterica enterica serovar Typhi Ty2
cgacauagcugaac

SEQ ID NO: 1772281 - RNA, 12 nt, Salmonella enterica enterica serovar Typhi Ty2
cgacaucagcca

SEQ ID NO: 1772282 - RNA, 12 nt, Salmonella enterica enterica serovar Typhi Ty2
cgacaucgccag

SEQ ID NO: 1772283 - RNA, 24 nt, Salmonella enterica enterica serovar Typhi Ty2
cgacaucgccaguugcagauuacu

SEQ ID NO: 1772284 - RNA, 16 nt, Salmonella enterica enterica serovar Typhi Ty2
cgacaucgccaaccgc

SEQ ID NO: 1772285 - RNA, 15 nt, Salmonella enterica enterica serovar Typhi Ty2
cgacaucgccaccgc

SEQ ID NO: 1772286 - RNA, 17 nt, Salmonella enterica enterica serovar Typhi Ty2
cgacaucagccagccgc

SEQ ID NO: 1772287 - RNA, 14 nt, Salmonella enterica enterica serovar Typhi Ty2
cgacaguaacugca

SEQ ID NO: 1772288 - RNA, 21 nt, Salmonella enterica enterica serovar Typhi Ty2
cgacaggguuugccagcacca

SEQ ID NO: 1772289 - RNA, 19 nt, Salmonella enterica enterica serovar Typhi Ty2
cgacaggguuugccagcac

SEQ ID NO: 1772290 - RNA, 22 nt, Salmonella enterica enterica serovar Typhi Ty2
cgacagggcgugaaccagcauc

SEQ ID NO: 1772291 - RNA, 16 nt, Salmonella enterica enterica serovar Typhi Ty2
cgaaugugcuuaucac

SEQ ID NO: 1772292 - RNA, 22 nt, Salmonella enterica enterica serovar Typhi Ty2
cgaaugugcaccuuaaccgucu

SEQ ID NO: 1772293 - RNA, 16 nt, Salmonella enterica enterica serovar Typhi Ty2
cgaaugcugcaucuua

SEQ ID NO: 1772294 - RNA, 17 nt, Salmonella enterica enterica serovar Typhi Ty2
cgaaugcuggcugaaau

SEQ ID NO: 1772295 - RNA, 17 nt, Salmonella enterica enterica serovar Typhi Ty2
cgaaucgccgcuuuuuc

SEQ ID NO: 1772296 - RNA, 22 nt, Salmonella enterica enterica serovar Typhi Ty2
cgaaucgccuguaccgggcaga

SEQ ID NO: 1772297 - RNA, 16 nt, Salmonella enterica enterica serovar Typhi Ty2
cgaauccuccuguuga

SEQ ID NO: 1772298 - RNA, 12 nt, Salmonella enterica enterica serovar Typhi Ty2
cgaauccuccug

SEQ ID NO: 1772299 - RNA, 15 nt, Salmonella enterica enterica serovar Typhi Ty2
cgaauaacauaauau

SEQ ID NO: 1772300 - RNA, 17 nt, Salmonella enterica enterica serovar Typhi Ty2
cgaauaacgccagguag

SEQ ID NO: 1772301 - RNA, 17 nt, Salmonella enterica enterica serovar Typhi Ty2
cgaaucauguuuuucuc

SEQ ID NO: 1772302 - RNA, 19 nt, Salmonella enterica enterica serovar Typhi Ty2
cgaauccccaucuccagac

SEQ ID NO: 1772303 - RNA, 16 nt, Salmonella enterica enterica serovar Typhi Ty2
cgaacguuggcugggu

SEQ ID NO: 1772304 - RNA, 17 nt, Salmonella enterica enterica serovar Typhi Ty2
cgaacgcaucaaagcca

SEQ ID NO: 1772305 - RNA, 20 nt, Salmonella enterica enterica serovar Typhi Ty2
ccuuuuuauggcccgccagc

SEQ ID NO: 1772306 - RNA, 19 nt, Salmonella enterica enterica serovar Typhi Ty2
ccuuuuuauggcccgccag

SEQ ID NO: 1772307 - RNA, 13 nt, Salmonella enterica enterica serovar Typhi Ty2
ccuuuuucaauuu

SEQ ID NO: 1772308 - RNA, 19 nt, Salmonella enterica enterica serovar Typhi Ty2
ccuuuuucaugcaauaauc

SEQ ID NO: 1772309 - RNA, 18 nt, Salmonella enterica enterica serovar Typhi Ty2
cgaaccguaaacgccugc

SEQ ID NO: 1772310 - RNA, 19 nt, Salmonella enterica enterica serovar Typhi Ty2
cgaaccuuaagcgcgaaau

SEQ ID NO: 1772311 - RNA, 20 nt, Salmonella enterica enterica serovar Typhi Ty2
cgaaccugguacaccagacg

SEQ ID NO: 1772312 - RNA, 22 nt, Salmonella enterica enterica serovar Typhi Ty2
cgaacugauggcgcuaagccag

SEQ ID NO: 1772313 - RNA, 13 nt, Salmonella enterica enterica serovar Typhi Ty2
cgaacugauggcg

SEQ ID NO: 1772314 - RNA, 23 nt, Salmonella enterica enterica serovar Typhi Ty2
cgaacuuacgacgcgccaccauc

SEQ ID NO: 1772315 - RNA, 23 nt, Salmonella enterica enterica serovar Typhi Ty2
cgaccggcaaaaagaaucgccag

SEQ ID NO: 1772316 - RNA, 21 nt, Salmonella enterica enterica serovar Typhi Ty2
cgaccggauuggucugauuca

SEQ ID NO: 1772317 - RNA, 13 nt, Salmonella enterica enterica serovar Typhi Ty2
cgaccggcagccg

SEQ ID NO: 1772318 - RNA, 20 nt, Salmonella enterica enterica serovar Typhi Ty2
cgaccggcacucaccucuuc

SEQ ID NO: 1772319 - RNA, 22 nt, Salmonella enterica enterica serovar Typhi Ty2
cgaccggcucgcuguucgccag

SEQ ID NO: 1772320 - RNA, 11 nt, Salmonella enterica enterica serovar Typhi Ty2
cgaccgccaua

SEQ ID NO: 1772321 - RNA, 19 nt, Salmonella enterica enterica serovar Typhi Ty2
cgacccauaacgggaagcc

SEQ ID NO: 1772322 - RNA, 16 nt, Salmonella enterica enterica serovar Typhi Ty2
cgacccgcaucagacc

SEQ ID NO: 1772323 - RNA, 16 nt, Salmonella enterica enterica serovar Typhi Ty2
cgacccgcaucgccgc

SEQ ID NO: 1772324 - RNA, 13 nt, Salmonella enterica enterica serovar Typhi Ty2
cgaccaggaucag

SEQ ID NO: 1772325 - RNA, 22 nt, Salmonella enterica enterica serovar Typhi Ty2
cgaccacuucaacgccgcgcuu

SEQ ID NO: 1772326 - RNA, 21 nt, Salmonella enterica enterica serovar Typhi Ty2
cgaccacuucaacgccgcgcu

SEQ ID NO: 1772327 - RNA, 17 nt, Salmonella enterica enterica serovar Typhi Ty2
cgaccacuucaacgccg

SEQ ID NO: 1772328 - RNA, 21 nt, Salmonella enterica enterica serovar Typhi Ty2
cgaccauuggcaccaccagga

SEQ ID NO: 1772329 - RNA, 16 nt, Salmonella enterica enterica serovar Typhi Ty2
cgaccaggaucagacc

SEQ ID NO: 1772330 - RNA, 19 nt, Salmonella enterica enterica serovar Typhi Ty2
cgaccaguuuagcuaaauc

SEQ ID NO: 1772331 - RNA, 17 nt, Salmonella enterica enterica serovar Typhi Ty2
cgaccacgccaccgccg

SEQ ID NO: 1772332 - RNA, 17 nt, Salmonella enterica enterica serovar Typhi Ty2
cgacaucuuuuccugaa

SEQ ID NO: 1772333 - RNA, 17 nt, Salmonella enterica enterica serovar Typhi Ty2
cgacaugucaugacuua

SEQ ID NO: 1772334 - RNA, 16 nt, Salmonella enterica enterica serovar Typhi Ty2
cgacauggcugagaau

SEQ ID NO: 1772335 - RNA, 19 nt, Salmonella enterica enterica serovar Typhi Ty2
cgacauuuuuguuaauauu

SEQ ID NO: 1772336 - RNA, 13 nt, Salmonella enterica enterica serovar Typhi Ty2
cgaccaauauccg

SEQ ID NO: 1772337 - RNA, 14 nt, Salmonella enterica enterica serovar Typhi Ty2
cgaccuuauuccca

SEQ ID NO: 1772338 - RNA, 17 nt, Salmonella enterica enterica serovar Typhi Ty2
cgaccuucacgccgcca

SEQ ID NO: 1772339 - RNA, 17 nt, Salmonella enterica enterica serovar Typhi Ty2
cgaccugcauauuuuuc

SEQ ID NO: 1772340 - RNA, 12 nt, Salmonella enterica enterica serovar Typhi Ty2
cgacgcauugag

SEQ ID NO: 1772341 - RNA, 20 nt, Salmonella enterica enterica serovar Typhi Ty2
cgacgcauugagacaugccg

SEQ ID NO: 1772342 - RNA, 17 nt, Salmonella enterica enterica serovar Typhi Ty2
cgacgccauuccccagc

SEQ ID NO: 1772343 - RNA, 14 nt, Salmonella enterica enterica serovar Typhi Ty2
cgacgcacuccaga

SEQ ID NO: 1772344 - RNA, 20 nt, Salmonella enterica enterica serovar Typhi Ty2
cgacgagguuuccggcggga

SEQ ID NO: 1772345 - RNA, 19 nt, Salmonella enterica enterica serovar Typhi Ty2
cgacgauacaacucaucca

SEQ ID NO: 1772346 - RNA, 20 nt, Salmonella enterica enterica serovar Typhi Ty2
cgacgcccugcccaugaagc

SEQ ID NO: 1772347 - RNA, 18 nt, Salmonella enterica enterica serovar Typhi Ty2
cgacgccgucucuuuuug

SEQ ID NO: 1772348 - RNA, 17 nt, Salmonella enterica enterica serovar Typhi Ty2
cgacgcggcuccggcuu

SEQ ID NO: 1772349 - RNA, 16 nt, Salmonella enterica enterica serovar Typhi Ty2
cgacgcgccaccaucg

SEQ ID NO: 1772350 - RNA, 17 nt, Salmonella enterica enterica serovar Typhi Ty2
cgacgcucuuccucaau

SEQ ID NO: 1772351 - RNA, 14 nt, Salmonella enterica enterica serovar Typhi Ty2
cgacgcguuuucca

SEQ ID NO: 1772352 - RNA, 18 nt, Salmonella enterica enterica serovar Typhi Ty2
cgacgcugcgaccgagug

SEQ ID NO: 1772353 - RNA, 18 nt, Salmonella enterica enterica serovar Typhi Ty2
cgacggccaguugcgcag

SEQ ID NO: 1772354 - RNA, 23 nt, Salmonella enterica enterica serovar Typhi Ty2
cgacggagauuaacagcgcgacc

SEQ ID NO: 1772355 - RNA, 20 nt, Salmonella enterica enterica serovar Typhi Ty2
cgacggugaugacccgcagc

SEQ ID NO: 1772356 - RNA, 21 nt, Salmonella enterica enterica serovar Typhi Ty2
cgacgggcggcgacagagaau

SEQ ID NO: 1772357 - RNA, 16 nt, Salmonella enterica enterica serovar Typhi Ty2
cgacggggcgcagaag

SEQ ID NO: 1772358 - RNA, 16 nt, Salmonella enterica enterica serovar Typhi Ty2
ccuugcggugagaaac

SEQ ID NO: 1772359 - RNA, 16 nt, Salmonella enterica enterica serovar Typhi Ty2
ccuugcgguugcagca

SEQ ID NO: 1772360 - RNA, 22 nt, Salmonella enterica enterica serovar Typhi Ty2
ccuuguccauguaaacuccauu

SEQ ID NO: 1772361 - RNA, 14 nt, Salmonella enterica enterica serovar Typhi Ty2
ccuuguaggccuga

SEQ ID NO: 1772362 - RNA, 20 nt, Salmonella enterica enterica serovar Typhi Ty2
ccuuguuauccuaaaucugc

SEQ ID NO: 1772363 - RNA, 22 nt, Salmonella enterica enterica serovar Typhi Ty2
ccuuguucaauagagcgcagca

SEQ ID NO: 1772364 - RNA, 19 nt, Salmonella enterica enterica serovar Typhi Ty2
ccuuucaacggauugugaa

SEQ ID NO: 1772365 - RNA, 19 nt, Salmonella enterica enterica serovar Typhi Ty2
ccuuuacuucuuugcgauu

SEQ ID NO: 1772366 - RNA, 22 nt, Salmonella enterica enterica serovar Typhi Ty2
ccuuuauauuuuucccuggccg

SEQ ID NO: 1772367 - RNA, 18 nt, Salmonella enterica enterica serovar Typhi Ty2
ccuuuacugacaauaagu

SEQ ID NO: 1772368 - RNA, 17 nt, Salmonella enterica enterica serovar Typhi Ty2
ccuuuacuguugccuuu

SEQ ID NO: 1772369 - RNA, 18 nt, Salmonella enterica enterica serovar Typhi Ty2
ccuuuaaccucuuuuuca

SEQ ID NO: 1772370 - RNA, 22 nt, Salmonella enterica enterica serovar Typhi Ty2
ccuuuaacgccuucauauuaaa

SEQ ID NO: 1772371 - RNA, 12 nt, Salmonella enterica enterica serovar Typhi Ty2
ccuuguuuuaac

SEQ ID NO: 1772372 - RNA, 22 nt, Salmonella enterica enterica serovar Typhi Ty2
ccuuucauucgucaaauucacc

SEQ ID NO: 1772373 - RNA, 23 nt, Salmonella enterica enterica serovar Typhi Ty2
ccuuuccuuauuaaagccccuuc

SEQ ID NO: 1772374 - RNA, 13 nt, Salmonella enterica enterica serovar Typhi Ty2
ccuuuccugugcu

SEQ ID NO: 1772375 - RNA, 14 nt, Salmonella enterica enterica serovar Typhi Ty2
ccuuuccugugcuc

SEQ ID NO: 1772376 - RNA, 15 nt, Salmonella enterica enterica serovar Typhi Ty2
ccuuucggacuuccu

SEQ ID NO: 1772377 - RNA, 21 nt, Salmonella enterica enterica serovar Typhi Ty2
ccuuucguaguuggcaacccg

SEQ ID NO: 1772378 - RNA, 23 nt, Salmonella enterica enterica serovar Typhi Ty2
ccuuugcgaauggccuccagcag

SEQ ID NO: 1772379 - RNA, 12 nt, Salmonella enterica enterica serovar Typhi Ty2
ccuuugccuuuc

SEQ ID NO: 1772380 - RNA, 15 nt, Salmonella enterica enterica serovar Typhi Ty2
ccuuugccuucgccg

SEQ ID NO: 1772381 - RNA, 16 nt, Salmonella enterica enterica serovar Typhi Ty2
ccuuugccgguuuuug

SEQ ID NO: 1772382 - RNA, 21 nt, Salmonella enterica enterica serovar Typhi Ty2
ccuuugucacccgcuuuuccu

SEQ ID NO: 1772383 - RNA, 13 nt, Salmonella enterica enterica serovar Typhi Ty2
ccuuugucaucca

SEQ ID NO: 1772384 - RNA, 22 nt, Salmonella enterica enterica serovar Typhi Ty2
ccuuugucgaaauugccgcccg

SEQ ID NO: 1772385 - RNA, 13 nt, Salmonella enterica enterica serovar Typhi Ty2
ccuuuugcagaau

SEQ ID NO: 1772386 - RNA, 14 nt, Salmonella enterica enterica serovar Typhi Ty2
ccuuuugacgcuuc

SEQ ID NO: 1772387 - RNA, 20 nt, Salmonella enterica enterica serovar Typhi Ty2
ccuuccucgucggcaagaau

SEQ ID NO: 1772388 - RNA, 19 nt, Salmonella enterica enterica serovar Typhi Ty2
ccuuccucauuuuugccca

SEQ ID NO: 1772389 - RNA, 22 nt, Salmonella enterica enterica serovar Typhi Ty2
ccuucagugauaaagcacagcc

SEQ ID NO: 1772390 - RNA, 17 nt, Salmonella enterica enterica serovar Typhi Ty2
ccuucgaugaucaugcg

SEQ ID NO: 1772391 - RNA, 14 nt, Salmonella enterica enterica serovar Typhi Ty2
ccuucgccgccgcu

SEQ ID NO: 1772392 - RNA, 19 nt, Salmonella enterica enterica serovar Typhi Ty2
ccuucgccggguugagcga

SEQ ID NO: 1772393 - RNA, 13 nt, Salmonella enterica enterica serovar Typhi Ty2
ccuucgccgccca

SEQ ID NO: 1772394 - RNA, 24 nt, Salmonella enterica enterica serovar Typhi Ty2
ccuucgauaguccauuuuccuaug

SEQ ID NO: 1772395 - RNA, 17 nt, Salmonella enterica enterica serovar Typhi Ty2
ccuuccuguggaaggca

SEQ ID NO: 1772396 - RNA, 16 nt, Salmonella enterica enterica serovar Typhi Ty2
ccuucuuuggcuuaau

SEQ ID NO: 1772397 - RNA, 21 nt, Salmonella enterica enterica serovar Typhi Ty2
ccuucuuuggugcgacgccag

SEQ ID NO: 1772398 - RNA, 12 nt, Salmonella enterica enterica serovar Typhi Ty2
ccuucuuuuacu

SEQ ID NO: 1772399 - RNA, 19 nt, Salmonella enterica enterica serovar Typhi Ty2
ccuugaaguuauccagcgc

SEQ ID NO: 1772400 - RNA, 20 nt, Salmonella enterica enterica serovar Typhi Ty2
ccuucuuuauucacuuuuuc

SEQ ID NO: 1772401 - RNA, 15 nt, Salmonella enterica enterica serovar Typhi Ty2
ccuucuucacccacu

SEQ ID NO: 1772402 - RNA, 18 nt, Salmonella enterica enterica serovar Typhi Ty2
ccuucuucaucuucaccu

SEQ ID NO: 1772403 - RNA, 14 nt, Salmonella enterica enterica serovar Typhi Ty2
ccuucuucgccaac

SEQ ID NO: 1772404 - RNA, 20 nt, Salmonella enterica enterica serovar Typhi Ty2
ccuucuucccauauuuuuuc

SEQ ID NO: 1772405 - RNA, 12 nt, Salmonella enterica enterica serovar Typhi Ty2
ccuucuuccccc

SEQ ID NO: 1772406 - RNA, 14 nt, Salmonella enterica enterica serovar Typhi Ty2
ccuucuucccccug

SEQ ID NO: 1772407 - RNA, 21 nt, Salmonella enterica enterica serovar Typhi Ty2
ccuucuguaagcaauuaauau

SEQ ID NO: 1772408 - RNA, 14 nt, Salmonella enterica enterica serovar Typhi Ty2
ccuucgccuucacg

SEQ ID NO: 1772409 - RNA, 16 nt, Salmonella enterica enterica serovar Typhi Ty2
ccuuaaucgacuucau

SEQ ID NO: 1772410 - RNA, 23 nt, Salmonella enterica enterica serovar Typhi Ty2
ccuuaauccccggcccgccgcug

SEQ ID NO: 1772411 - RNA, 14 nt, Salmonella enterica enterica serovar Typhi Ty2
ccuguagcagcgcc

SEQ ID NO: 1772412 - RNA, 14 nt, Salmonella enterica enterica serovar Typhi Ty2
ccuguaccaccacg

SEQ ID NO: 1772413 - RNA, 15 nt, Salmonella enterica enterica serovar Typhi Ty2
ccuguaccaccacgc

SEQ ID NO: 1772414 - RNA, 17 nt, Salmonella enterica enterica serovar Typhi Ty2
ccuguaccgggcagaca

SEQ ID NO: 1772415 - RNA, 18 nt, Salmonella enterica enterica serovar Typhi Ty2
ccuuaucggagucuuauc

SEQ ID NO: 1772416 - RNA, 18 nt, Salmonella enterica enterica serovar Typhi Ty2
ccuuauucccauuccugc

SEQ ID NO: 1772417 - RNA, 14 nt, Salmonella enterica enterica serovar Typhi Ty2
ccuuaugucauuca

SEQ ID NO: 1772418 - RNA, 14 nt, Salmonella enterica enterica serovar Typhi Ty2
ccuuacccggccug

SEQ ID NO: 1772419 - RNA, 18 nt, Salmonella enterica enterica serovar Typhi Ty2
ccuuacccgaccuacauc

SEQ ID NO: 1772420 - RNA, 21 nt, Salmonella enterica enterica serovar Typhi Ty2
ccuuacaggcgcaucagaaaa

SEQ ID NO: 1772421 - RNA, 14 nt, Salmonella enterica enterica serovar Typhi Ty2
ccuuacaggcgcau

SEQ ID NO: 1772422 - RNA, 13 nt, Salmonella enterica enterica serovar Typhi Ty2
ccuuauccggccc

SEQ ID NO: 1772423 - RNA, 20 nt, Salmonella enterica enterica serovar Typhi Ty2
ccuucaaauauauugaaaag

SEQ ID NO: 1772424 - RNA, 23 nt, Salmonella enterica enterica serovar Typhi Ty2
ccuucaaauauauugaaaaggga

SEQ ID NO: 1772425 - RNA, 20 nt, Salmonella enterica enterica serovar Typhi Ty2
ccuucaauaucaacgaccgu

SEQ ID NO: 1772426 - RNA, 23 nt, Salmonella enterica enterica serovar Typhi Ty2
ccuucacauuggcaaaccccugc

SEQ ID NO: 1772427 - RNA, 19 nt, Salmonella enterica enterica serovar Typhi Ty2
ccuucagaaaauuauuuuc

SEQ ID NO: 1772428 - RNA, 22 nt, Salmonella enterica enterica serovar Typhi Ty2
ccuucacguuauucggaaugau

SEQ ID NO: 1772429 - RNA, 16 nt, Salmonella enterica enterica serovar Typhi Ty2
ccuucacggucaaacg

SEQ ID NO: 1772430 - RNA, 14 nt, Salmonella enterica enterica serovar Typhi Ty2
ccuucacgccgcca

SEQ ID NO: 1772431 - RNA, 20 nt, Salmonella enterica enterica serovar Typhi Ty2
ccugguuauuagaugcgaau

SEQ ID NO: 1772432 - RNA, 17 nt, Salmonella enterica enterica serovar Typhi Ty2
ccuguaaggcucucuua

SEQ ID NO: 1772433 - RNA, 13 nt, Salmonella enterica enterica serovar Typhi Ty2
ccuggucugccag

SEQ ID NO: 1772434 - RNA, 16 nt, Salmonella enterica enterica serovar Typhi Ty2
ccuggugagcuccagc

SEQ ID NO: 1772435 - RNA, 17 nt, Salmonella enterica enterica serovar Typhi Ty2
ccuggucgauagccuua

SEQ ID NO: 1772436 - RNA, 19 nt, Salmonella enterica enterica serovar Typhi Ty2
ccuggcuuaccugcucugg

SEQ ID NO: 1772437 - RNA, 20 nt, Salmonella enterica enterica serovar Typhi Ty2
ccuggcugucggcagaaccu

SEQ ID NO: 1772438 - RNA, 13 nt, Salmonella enterica enterica serovar Typhi Ty2
ccuggcucuuccg

SEQ ID NO: 1772439 - RNA, 20 nt, Salmonella enterica enterica serovar Typhi Ty2
ccuggcgugucaucaaaauc

SEQ ID NO: 1772440 - RNA, 21 nt, Salmonella enterica enterica serovar Typhi Ty2
ccuggcgugcgauuugcucaa

SEQ ID NO: 1772441 - RNA, 20 nt, Salmonella enterica enterica serovar Typhi Ty2
ccuggcucaauccaggugga

SEQ ID NO: 1772442 - RNA, 16 nt, Salmonella enterica enterica serovar Typhi Ty2
ccuggcgagaauagaa

SEQ ID NO: 1772443 - RNA, 19 nt, Salmonella enterica enterica serovar Typhi Ty2
ccuggcgggaaacagguac

SEQ ID NO: 1772444 - RNA, 20 nt, Salmonella enterica enterica serovar Typhi Ty2
ccuggcgggaaacagguacu

SEQ ID NO: 1772445 - RNA, 17 nt, Salmonella enterica enterica serovar Typhi Ty2
ccuggcggagcugcgcu

SEQ ID NO: 1772446 - RNA, 22 nt, Salmonella enterica enterica serovar Typhi Ty2
ccuggcgggcagccuucaaguu

SEQ ID NO: 1772447 - RNA, 14 nt, Salmonella enterica enterica serovar Typhi Ty2
ccuggcgaauaaaa

SEQ ID NO: 1772448 - RNA, 19 nt, Salmonella enterica enterica serovar Typhi Ty2
ccuggcgaauaaaauucag

SEQ ID NO: 1772449 - RNA, 22 nt, Salmonella enterica enterica serovar Typhi Ty2
ccuggcgaauaaaauucagcgc

SEQ ID NO: 1772450 - RNA, 18 nt, Salmonella enterica enterica serovar Typhi Ty2
ccuggccgauaugaauaa

SEQ ID NO: 1772451 - RNA, 19 nt, Salmonella enterica enterica serovar Typhi Ty2
ccuggcccggcaguugcug

SEQ ID NO: 1772452 - RNA, 15 nt, Salmonella enterica enterica serovar Typhi Ty2
ccuggccaauggcuc

SEQ ID NO: 1772453 - RNA, 22 nt, Salmonella enterica enterica serovar Typhi Ty2
ccuggcauggugcagccgccau

SEQ ID NO: 1772454 - RNA, 17 nt, Salmonella enterica enterica serovar Typhi Ty2
ccuggcaguucagucgg

SEQ ID NO: 1772455 - RNA, 17 nt, Salmonella enterica enterica serovar Typhi Ty2
ccuggcagaaaggugaa

SEQ ID NO: 1772456 - RNA, 22 nt, Salmonella enterica enterica serovar Typhi Ty2
ccuggcacuucgcgccauugau

SEQ ID NO: 1772457 - RNA, 14 nt, Salmonella enterica enterica serovar Typhi Ty2
ccuggauuuuaccu

SEQ ID NO: 1772458 - RNA, 19 nt, Salmonella enterica enterica serovar Typhi Ty2
ccuggaugcuuaaaauccc

SEQ ID NO: 1772459 - RNA, 18 nt, Salmonella enterica enterica serovar Typhi Ty2
ccuggaugaagcagacau

SEQ ID NO: 1772460 - RNA, 18 nt, Salmonella enterica enterica serovar Typhi Ty2
ccuggauaauaagacgcc

SEQ ID NO: 1772461 - RNA, 23 nt, Salmonella enterica enterica serovar Typhi Ty2
ccuggauacguuccagcagcgca

SEQ ID NO: 1772462 - RNA, 22 nt, Salmonella enterica enterica serovar Typhi Ty2
ccuggagagcagcgccagcgac

SEQ ID NO: 1772463 - RNA, 18 nt, Salmonella enterica enterica serovar Typhi Ty2
ccuggagaucagcauggu

SEQ ID NO: 1772464 - RNA, 16 nt, Salmonella enterica enterica serovar Typhi Ty2
ccuggagagcagcgcc

SEQ ID NO: 1772465 - RNA, 18 nt, Salmonella enterica enterica serovar Typhi Ty2
ccugcuugucgaucauca

SEQ ID NO: 1772466 - RNA, 20 nt, Salmonella enterica enterica serovar Typhi Ty2
ccugcuugucgaucaucaga

SEQ ID NO: 1772467 - RNA, 17 nt, Salmonella enterica enterica serovar Typhi Ty2
ccuggaaaaaagcgccc

SEQ ID NO: 1772468 - RNA, 20 nt, Salmonella enterica enterica serovar Typhi Ty2
ccugcuuuuucaucauacug

SEQ ID NO: 1772469 - RNA, 23 nt, Salmonella enterica enterica serovar Typhi Ty2
ccuggaaaaaagcgcccagcgcc

SEQ ID NO: 1772470 - RNA, 23 nt, Salmonella enterica enterica serovar Typhi Ty2
ccuggaaguugaagaaaaacccc

SEQ ID NO: 1772471 - RNA, 15 nt, Salmonella enterica enterica serovar Typhi Ty2
ccuggaauuuuucca

SEQ ID NO: 1772472 - RNA, 17 nt, Salmonella enterica enterica serovar Typhi Ty2
ccugcuguaaccccugc

SEQ ID NO: 1772473 - RNA, 16 nt, Salmonella enterica enterica serovar Typhi Ty2
ccugcuguaaccccug

SEQ ID NO: 1772474 - RNA, 15 nt, Salmonella enterica enterica serovar Typhi Ty2
ccugcuguacuuuug

SEQ ID NO: 1772475 - RNA, 15 nt, Salmonella enterica enterica serovar Typhi Ty2
ccugcuguaaccccu

SEQ ID NO: 1772476 - RNA, 19 nt, Salmonella enterica enterica serovar Typhi Ty2
ccugcuggucgccgcccau

SEQ ID NO: 1772477 - RNA, 18 nt, Salmonella enterica enterica serovar Typhi Ty2
ccugcugccaucgcuucu

SEQ ID NO: 1772478 - RNA, 12 nt, Salmonella enterica enterica serovar Typhi Ty2
ccugcucccaga

SEQ ID NO: 1772479 - RNA, 13 nt, Salmonella enterica enterica serovar Typhi Ty2
ccugcucaucagg

SEQ ID NO: 1772480 - RNA, 16 nt, Salmonella enterica enterica serovar Typhi Ty2
ccugcucccagauuaa

SEQ ID NO: 1772481 - RNA, 13 nt, Salmonella enterica enterica serovar Typhi Ty2
ccugcuccgccag

SEQ ID NO: 1772482 - RNA, 17 nt, Salmonella enterica enterica serovar Typhi Ty2
ccugcggcgcgcccggc

SEQ ID NO: 1772483 - RNA, 13 nt, Salmonella enterica enterica serovar Typhi Ty2
ccugcggccccag

SEQ ID NO: 1772484 - RNA, 16 nt, Salmonella enterica enterica serovar Typhi Ty2
ccugcgguaaacgcuc

SEQ ID NO: 1772485 - RNA, 18 nt, Salmonella enterica enterica serovar Typhi Ty2
ccugcggguucaucgcca

SEQ ID NO: 1772486 - RNA, 14 nt, Salmonella enterica enterica serovar Typhi Ty2
ccugcucaaucgca

SEQ ID NO: 1772487 - RNA, 13 nt, Salmonella enterica enterica serovar Typhi Ty2
ccugccucaacau

SEQ ID NO: 1772488 - RNA, 16 nt, Salmonella enterica enterica serovar Typhi Ty2
ccugccguuugcgcca

SEQ ID NO: 1772489 - RNA, 21 nt, Salmonella enterica enterica serovar Typhi Ty2
ccugccuuugucacccgcuuu

SEQ ID NO: 1772490 - RNA, 21 nt, Salmonella enterica enterica serovar Typhi Ty2
ccugcgaaaagcgugcgccuu

SEQ ID NO: 1772491 - RNA, 23 nt, Salmonella enterica enterica serovar Typhi Ty2
ccugcauauauccuaacuuauua

SEQ ID NO: 1772492 - RNA, 16 nt, Salmonella enterica enterica serovar Typhi Ty2
ccugcaguauuucaga

SEQ ID NO: 1772493 - RNA, 14 nt, Salmonella enterica enterica serovar Typhi Ty2
ccugccagauaguu

SEQ ID NO: 1772494 - RNA, 21 nt, Salmonella enterica enterica serovar Typhi Ty2
ccugccagcaacccaccugcc

SEQ ID NO: 1772495 - RNA, 16 nt, Salmonella enterica enterica serovar Typhi Ty2
ccugccaguccgcccg

SEQ ID NO: 1772496 - RNA, 18 nt, Salmonella enterica enterica serovar Typhi Ty2
ccugccaguccgcccgcc

SEQ ID NO: 1772497 - RNA, 19 nt, Salmonella enterica enterica serovar Typhi Ty2
ccugcccuuucuucaaugg

SEQ ID NO: 1772498 - RNA, 12 nt, Salmonella enterica enterica serovar Typhi Ty2
ccugcccuuuca

SEQ ID NO: 1772499 - RNA, 19 nt, Salmonella enterica enterica serovar Typhi Ty2
ccugcccacuuugccauga

SEQ ID NO: 1772500 - RNA, 20 nt, Salmonella enterica enterica serovar Typhi Ty2
ccugccauucccagccgagc

SEQ ID NO: 1772501 - RNA, 16 nt, Salmonella enterica enterica serovar Typhi Ty2
ccugccauucccagcc

SEQ ID NO: 1772502 - RNA, 21 nt, Salmonella enterica enterica serovar Typhi Ty2
ccugccauucacgcuggguga

SEQ ID NO: 1772503 - RNA, 15 nt, Salmonella enterica enterica serovar Typhi Ty2
ccugccauucccagc

SEQ ID NO: 1772504 - RNA, 13 nt, Salmonella enterica enterica serovar Typhi Ty2
ccugcacuuccag

SEQ ID NO: 1772505 - RNA, 15 nt, Salmonella enterica enterica serovar Typhi Ty2
ccugcaggguaauua

SEQ ID NO: 1772506 - RNA, 22 nt, Salmonella enterica enterica serovar Typhi Ty2
ccugcaggguuugcgcagacug

SEQ ID NO: 1772507 - RNA, 18 nt, Salmonella enterica enterica serovar Typhi Ty2
cauucucugucgccgccc

SEQ ID NO: 1772508 - RNA, 15 nt, Salmonella enterica enterica serovar Typhi Ty2
cauucucuugccugc

SEQ ID NO: 1772509 - RNA, 17 nt, Salmonella enterica enterica serovar Typhi Ty2
cauucccagccgagcgg

SEQ ID NO: 1772510 - RNA, 14 nt, Salmonella enterica enterica serovar Typhi Ty2
cauucccagcgccc

SEQ ID NO: 1772511 - RNA, 13 nt, Salmonella enterica enterica serovar Typhi Ty2
cauuccccacgcc

SEQ ID NO: 1772512 - RNA, 18 nt, Salmonella enterica enterica serovar Typhi Ty2
cauucccgccaauaacca

SEQ ID NO: 1772513 - RNA, 17 nt, Salmonella enterica enterica serovar Typhi Ty2
cauucuaccggcugugg

SEQ ID NO: 1772514 - RNA, 22 nt, Salmonella enterica enterica serovar Typhi Ty2
cauucuguuuucgagccuugcc

SEQ ID NO: 1772515 - RNA, 15 nt, Salmonella enterica enterica serovar Typhi Ty2
cauugagcauucuac

SEQ ID NO: 1772516 - RNA, 21 nt, Salmonella enterica enterica serovar Typhi Ty2
cauugacuuaucgcgcuggca

SEQ ID NO: 1772517 - RNA, 16 nt, Salmonella enterica enterica serovar Typhi Ty2
cauugacuacugugac

SEQ ID NO: 1772518 - RNA, 14 nt, Salmonella enterica enterica serovar Typhi Ty2
cauugacucaugaa

SEQ ID NO: 1772519 - RNA, 12 nt, Salmonella enterica enterica serovar Typhi Ty2
cauuccagaccc

SEQ ID NO: 1772520 - RNA, 17 nt, Salmonella enterica enterica serovar Typhi Ty2
cauucagcaacugcgua

SEQ ID NO: 1772521 - RNA, 13 nt, Salmonella enterica enterica serovar Typhi Ty2
cauuauuccccuc

SEQ ID NO: 1772522 - RNA, 15 nt, Salmonella enterica enterica serovar Typhi Ty2
cauuauugcaucaau

SEQ ID NO: 1772523 - RNA, 15 nt, Salmonella enterica enterica serovar Typhi Ty2
cauucacgccaccau

SEQ ID NO: 1772524 - RNA, 16 nt, Salmonella enterica enterica serovar Typhi Ty2
cauucacgccaccauc

SEQ ID NO: 1772525 - RNA, 15 nt, Salmonella enterica enterica serovar Typhi Ty2
cauucacacuccagg

SEQ ID NO: 1772526 - RNA, 17 nt, Salmonella enterica enterica serovar Typhi Ty2
cauuauguuuugaacau

SEQ ID NO: 1772527 - RNA, 19 nt, Salmonella enterica enterica serovar Typhi Ty2
cauuaugaucgguuuuuuu

SEQ ID NO: 1772528 - RNA, 23 nt, Salmonella enterica enterica serovar Typhi Ty2
cauuaugaucgguuuuuuuagaa

SEQ ID NO: 1772529 - RNA, 12 nt, Salmonella enterica enterica serovar Typhi Ty2
cauuaucaccau

SEQ ID NO: 1772530 - RNA, 15 nt, Salmonella enterica enterica serovar Typhi Ty2
cauuaucgaacugaa

SEQ ID NO: 1772531 - RNA, 13 nt, Salmonella enterica enterica serovar Typhi Ty2
cauuacaaacagg

SEQ ID NO: 1772532 - RNA, 17 nt, Salmonella enterica enterica serovar Typhi Ty2
cauuacaggcaucuucc

SEQ ID NO: 1772533 - RNA, 17 nt, Salmonella enterica enterica serovar Typhi Ty2
cauuaacgggaaacugu

SEQ ID NO: 1772534 - RNA, 20 nt, Salmonella enterica enterica serovar Typhi Ty2
cauuaacuccggacguaccc

SEQ ID NO: 1772535 - RNA, 13 nt, Salmonella enterica enterica serovar Typhi Ty2
cauuaacguccau

SEQ ID NO: 1772536 - RNA, 15 nt, Salmonella enterica enterica serovar Typhi Ty2
cauuaacccggcccc

SEQ ID NO: 1772537 - RNA, 22 nt, Salmonella enterica enterica serovar Typhi Ty2
cauuaacaucagaaaaaagcca

SEQ ID NO: 1772538 - RNA, 17 nt, Salmonella enterica enterica serovar Typhi Ty2
cauuaacaaaucauuuc

SEQ ID NO: 1772539 - RNA, 14 nt, Salmonella enterica enterica serovar Typhi Ty2
cauuaaaaaaacau

SEQ ID NO: 1772540 - RNA, 18 nt, Salmonella enterica enterica serovar Typhi Ty2
cauuaaaauugaacggac

SEQ ID NO: 1772541 - RNA, 14 nt, Salmonella enterica enterica serovar Typhi Ty2
cauguugaccaggu

SEQ ID NO: 1772542 - RNA, 19 nt, Salmonella enterica enterica serovar Typhi Ty2
cauguugcguaaauaaaua

SEQ ID NO: 1772543 - RNA, 22 nt, Salmonella enterica enterica serovar Typhi Ty2
caugucagcgcaaagccaauac

SEQ ID NO: 1772544 - RNA, 17 nt, Salmonella enterica enterica serovar Typhi Ty2
cauguucccaugucagc

SEQ ID NO: 1772545 - RNA, 19 nt, Salmonella enterica enterica serovar Typhi Ty2
cauguagcgcggcagcgcg

SEQ ID NO: 1772546 - RNA, 21 nt, Salmonella enterica enterica serovar Typhi Ty2
cauguagcgcggcagcgcgca

SEQ ID NO: 1772547 - RNA, 15 nt, Salmonella enterica enterica serovar Typhi Ty2
cauggcgccaccagc

SEQ ID NO: 1772548 - RNA, 13 nt, Salmonella enterica enterica serovar Typhi Ty2
cauggcgccacca

SEQ ID NO: 1772549 - RNA, 17 nt, Salmonella enterica enterica serovar Typhi Ty2
cauggcgcgacauggcg

SEQ ID NO: 1772550 - RNA, 19 nt, Salmonella enterica enterica serovar Typhi Ty2
cauggcggcgacaaugcuc

SEQ ID NO: 1772551 - RNA, 19 nt, Salmonella enterica enterica serovar Typhi Ty2
caugggcgucuuaaugcuc

SEQ ID NO: 1772552 - RNA, 21 nt, Salmonella enterica enterica serovar Typhi Ty2
cauguaaaugacgccagacua

SEQ ID NO: 1772553 - RNA, 13 nt, Salmonella enterica enterica serovar Typhi Ty2
cauguaaaugacg

SEQ ID NO: 1772554 - RNA, 16 nt, Salmonella enterica enterica serovar Typhi Ty2
cauguaaauaaggcug

SEQ ID NO: 1772555 - RNA, 23 nt, Salmonella enterica enterica serovar Typhi Ty2
cauggggugaggcaucgcccugu

SEQ ID NO: 1772556 - RNA, 24 nt, Salmonella enterica enterica serovar Typhi Ty2
caugguguugguacacagcacaau

SEQ ID NO: 1772557 - RNA, 16 nt, Salmonella enterica enterica serovar Typhi Ty2
cauggguaaagcccau

SEQ ID NO: 1772558 - RNA, 21 nt, Salmonella enterica enterica serovar Typhi Ty2
caugguguucagauggccaau

SEQ ID NO: 1772559 - RNA, 14 nt, Salmonella enterica enterica serovar Typhi Ty2
caugguuaaccacc

SEQ ID NO: 1772560 - RNA, 23 nt, Salmonella enterica enterica serovar Typhi Ty2
caugcgggggaaucuuauuuucc

SEQ ID NO: 1772561 - RNA, 13 nt, Salmonella enterica enterica serovar Typhi Ty2
caugcgcuggacu

SEQ ID NO: 1772562 - RNA, 23 nt, Salmonella enterica enterica serovar Typhi Ty2
caugcguccgcccagaaagauca

SEQ ID NO: 1772563 - RNA, 19 nt, Salmonella enterica enterica serovar Typhi Ty2
caugcuauucagcaguuca

SEQ ID NO: 1772564 - RNA, 21 nt, Salmonella enterica enterica serovar Typhi Ty2
cauggccggucuuaugcugcc

SEQ ID NO: 1772565 - RNA, 17 nt, Salmonella enterica enterica serovar Typhi Ty2
cauggcgaagugcagcg

SEQ ID NO: 1772566 - RNA, 21 nt, Salmonella enterica enterica serovar Typhi Ty2
cauggcgaauccguugaucgu

SEQ ID NO: 1772567 - RNA, 16 nt, Salmonella enterica enterica serovar Typhi Ty2
caugaugaucuucagc

SEQ ID NO: 1772568 - RNA, 13 nt, Salmonella enterica enterica serovar Typhi Ty2
caugaugccaaau

SEQ ID NO: 1772569 - RNA, 14 nt, Salmonella enterica enterica serovar Typhi Ty2
caugaugaucuuca

SEQ ID NO: 1772570 - RNA, 16 nt, Salmonella enterica enterica serovar Typhi Ty2
caugauggcguaaucc

SEQ ID NO: 1772571 - RNA, 16 nt, Salmonella enterica enterica serovar Typhi Ty2
caugauuaaagccacg

SEQ ID NO: 1772572 - RNA, 23 nt, Salmonella enterica enterica serovar Typhi Ty2
caugauaguaucgcugcuaaacg

SEQ ID NO: 1772573 - RNA, 16 nt, Salmonella enterica enterica serovar Typhi Ty2
caugauagggcagcag

SEQ ID NO: 1772574 - RNA, 13 nt, Salmonella enterica enterica serovar Typhi Ty2
caugaucuuuccu

SEQ ID NO: 1772575 - RNA, 22 nt, Salmonella enterica enterica serovar Typhi Ty2
caugauccguucgaucagcugg

SEQ ID NO: 1772576 - RNA, 14 nt, Salmonella enterica enterica serovar Typhi Ty2
caugaucgccgcca

SEQ ID NO: 1772577 - RNA, 23 nt, Salmonella enterica enterica serovar Typhi Ty2
caugaucuuuccuuuuucaggca

SEQ ID NO: 1772578 - RNA, 17 nt, Salmonella enterica enterica serovar Typhi Ty2
caugaugagcgccauau

SEQ ID NO: 1772579 - RNA, 18 nt, Salmonella enterica enterica serovar Typhi Ty2
caugcaagagucccagaa

SEQ ID NO: 1772580 - RNA, 23 nt, Salmonella enterica enterica serovar Typhi Ty2
caugcaaaaugcuucuucaaccu

SEQ ID NO: 1772581 - RNA, 17 nt, Salmonella enterica enterica serovar Typhi Ty2
caugcaaaaaagagggu

SEQ ID NO: 1772582 - RNA, 17 nt, Salmonella enterica enterica serovar Typhi Ty2
caugcaaaaaagcccau

SEQ ID NO: 1772583 - RNA, 14 nt, Salmonella enterica enterica serovar Typhi Ty2
caugccaaaccaga

SEQ ID NO: 1772584 - RNA, 14 nt, Salmonella enterica enterica serovar Typhi Ty2
caugcaucaauggc

SEQ ID NO: 1772585 - RNA, 18 nt, Salmonella enterica enterica serovar Typhi Ty2
caugcaucucuucaaaca

SEQ ID NO: 1772586 - RNA, 17 nt, Salmonella enterica enterica serovar Typhi Ty2
caugcagcucaagcgcc

SEQ ID NO: 1772587 - RNA, 20 nt, Salmonella enterica enterica serovar Typhi Ty2
caugcagccauagcgcgccg

SEQ ID NO: 1772588 - RNA, 21 nt, Salmonella enterica enterica serovar Typhi Ty2
caugcacgcuuuuuugcuggc

SEQ ID NO: 1772589 - RNA, 22 nt, Salmonella enterica enterica serovar Typhi Ty2
caugcagagcaacgagaaccca

SEQ ID NO: 1772590 - RNA, 18 nt, Salmonella enterica enterica serovar Typhi Ty2
caugccaucauuaauuua

SEQ ID NO: 1772591 - RNA, 14 nt, Salmonella enterica enterica serovar Typhi Ty2
caugcccgccagcg

SEQ ID NO: 1772592 - RNA, 18 nt, Salmonella enterica enterica serovar Typhi Ty2
caugcccacaggcagggc

SEQ ID NO: 1772593 - RNA, 15 nt, Salmonella enterica enterica serovar Typhi Ty2
caugcccacaggcag

SEQ ID NO: 1772594 - RNA, 14 nt, Salmonella enterica enterica serovar Typhi Ty2
caugccauugcuuu

SEQ ID NO: 1772595 - RNA, 16 nt, Salmonella enterica enterica serovar Typhi Ty2
caugccaucucuuaau

SEQ ID NO: 1772596 - RNA, 21 nt, Salmonella enterica enterica serovar Typhi Ty2
caugccagaagcaaauucagg

SEQ ID NO: 1772597 - RNA, 17 nt, Salmonella enterica enterica serovar Typhi Ty2
caugccagaagcaaauu

SEQ ID NO: 1772598 - RNA, 16 nt, Salmonella enterica enterica serovar Typhi Ty2
caugccagaagcaaau

SEQ ID NO: 1772599 - RNA, 22 nt, Salmonella enterica enterica serovar Typhi Ty2
caugccagcaguuuuucaaucu

SEQ ID NO: 1772600 - RNA, 15 nt, Salmonella enterica enterica serovar Typhi Ty2
caugccagaauugca

SEQ ID NO: 1772601 - RNA, 21 nt, Salmonella enterica enterica serovar Typhi Ty2
caugcgaucgggcaauccauu

SEQ ID NO: 1772602 - RNA, 18 nt, Salmonella enterica enterica serovar Typhi Ty2
caugcgacgugucgcgua

SEQ ID NO: 1772603 - RNA, 21 nt, Salmonella enterica enterica serovar Typhi Ty2
caugccuuuauuucaagcaau

SEQ ID NO: 1772604 - RNA, 18 nt, Salmonella enterica enterica serovar Typhi Ty2
caugccuucuuugccuuu

SEQ ID NO: 1772605 - RNA, 21 nt, Salmonella enterica enterica serovar Typhi Ty2
caugccgccugccgcgccgcc

SEQ ID NO: 1772606 - RNA, 22 nt, Salmonella enterica enterica serovar Typhi Ty2
caugccggugcgagaaaaagca

SEQ ID NO: 1772607 - RNA, 18 nt, Salmonella enterica enterica serovar Typhi Ty2
caugccguauuuaugcua

SEQ ID NO: 1772608 - RNA, 22 nt, Salmonella enterica enterica serovar Typhi Ty2
caugccggcuggcaauuugaua

SEQ ID NO: 1772609 - RNA, 18 nt, Salmonella enterica enterica serovar Typhi Ty2
caugccggcuuuccgcac

SEQ ID NO: 1772610 - RNA, 21 nt, Salmonella enterica enterica serovar Typhi Ty2
caugacgccaagcugcagaau

SEQ ID NO: 1772611 - RNA, 16 nt, Salmonella enterica enterica serovar Typhi Ty2
caugagccagcccuca

SEQ ID NO: 1772612 - RNA, 23 nt, Salmonella enterica enterica serovar Typhi Ty2
caugacguuuugggaaaaccagu

SEQ ID NO: 1772613 - RNA, 17 nt, Salmonella enterica enterica serovar Typhi Ty2
caugauacguggcucaa

SEQ ID NO: 1772614 - RNA, 17 nt, Salmonella enterica enterica serovar Typhi Ty2
caugaguaaugaccaca

SEQ ID NO: 1772615 - RNA, 18 nt, Salmonella enterica enterica serovar Typhi Ty2
caugagucgcgcgcgcca

SEQ ID NO: 1772616 - RNA, 14 nt, Salmonella enterica enterica serovar Typhi Ty2
caugaccagcgccg

SEQ ID NO: 1772617 - RNA, 16 nt, Salmonella enterica enterica serovar Typhi Ty2
caugaccggaugugcc

SEQ ID NO: 1772618 - RNA, 14 nt, Salmonella enterica enterica serovar Typhi Ty2
caugacauccauga

SEQ ID NO: 1772619 - RNA, 15 nt, Salmonella enterica enterica serovar Typhi Ty2
caugacaucagaagu

SEQ ID NO: 1772620 - RNA, 18 nt, Salmonella enterica enterica serovar Typhi Ty2
caugaaugccccagcgcu

SEQ ID NO: 1772621 - RNA, 21 nt, Salmonella enterica enterica serovar Typhi Ty2
caugaaugccccagcgcugcu

SEQ ID NO: 1772622 - RNA, 18 nt, Salmonella enterica enterica serovar Typhi Ty2
caugaaucaucacaauua

SEQ ID NO: 1772623 - RNA, 19 nt, Salmonella enterica enterica serovar Typhi Ty2
caugaaucaucacaauuag

SEQ ID NO: 1772624 - RNA, 20 nt, Salmonella enterica enterica serovar Typhi Ty2
caugaauuacagcucauaaa

SEQ ID NO: 1772625 - RNA, 23 nt, Salmonella enterica enterica serovar Typhi Ty2
caugaauaucaaaccacgcugag

SEQ ID NO: 1772626 - RNA, 14 nt, Salmonella enterica enterica serovar Typhi Ty2
caucuuucuuuucg

SEQ ID NO: 1772627 - RNA, 13 nt, Salmonella enterica enterica serovar Typhi Ty2
caucuuucuuuuc

SEQ ID NO: 1772628 - RNA, 13 nt, Salmonella enterica enterica serovar Typhi Ty2
caucuuuguucug

SEQ ID NO: 1772629 - RNA, 22 nt, Salmonella enterica enterica serovar Typhi Ty2
caucuuuuacaggccggacagg

SEQ ID NO: 1772630 - RNA, 13 nt, Salmonella enterica enterica serovar Typhi Ty2
caucuuuuuucac

SEQ ID NO: 1772631 - RNA, 17 nt, Salmonella enterica enterica serovar Typhi Ty2
caucuuuuugcucaagc

SEQ ID NO: 1772632 - RNA, 13 nt, Salmonella enterica enterica serovar Typhi Ty2
caugaaaaaaacg

SEQ ID NO: 1772633 - RNA, 18 nt, Salmonella enterica enterica serovar Typhi Ty2
caugaaacucgacacacu

SEQ ID NO: 1772634 - RNA, 16 nt, Salmonella enterica enterica serovar Typhi Ty2
caugaacguuaucggc

SEQ ID NO: 1772635 - RNA, 23 nt, Salmonella enterica enterica serovar Typhi Ty2
caugaacguuggcgauaaggucg

SEQ ID NO: 1772636 - RNA, 14 nt, Salmonella enterica enterica serovar Typhi Ty2
caugaagaaaauac

SEQ ID NO: 1772637 - RNA, 14 nt, Salmonella enterica enterica serovar Typhi Ty2
caucguuacccauu

SEQ ID NO: 1772638 - RNA, 21 nt, Salmonella enterica enterica serovar Typhi Ty2
caucguggccgauauugccuu

SEQ ID NO: 1772639 - RNA, 13 nt, Salmonella enterica enterica serovar Typhi Ty2
caucuucugcguc

SEQ ID NO: 1772640 - RNA, 21 nt, Salmonella enterica enterica serovar Typhi Ty2
caucuucuuugacccacgcca

SEQ ID NO: 1772641 - RNA, 19 nt, Salmonella enterica enterica serovar Typhi Ty2
caucuuuaaccgccugcuc

SEQ ID NO: 1772642 - RNA, 14 nt, Salmonella enterica enterica serovar Typhi Ty2
cauccagcgccugc

SEQ ID NO: 1772643 - RNA, 11 nt, Salmonella enterica enterica serovar Typhi Ty2
cauccagacca

SEQ ID NO: 1772644 - RNA, 13 nt, Salmonella enterica enterica serovar Typhi Ty2
cauccagaaggca

SEQ ID NO: 1772645 - RNA, 16 nt, Salmonella enterica enterica serovar Typhi Ty2
cauccagacaugcaca

SEQ ID NO: 1772646 - RNA, 14 nt, Salmonella enterica enterica serovar Typhi Ty2
cauccagagcaguc

SEQ ID NO: 1772647 - RNA, 14 nt, Salmonella enterica enterica serovar Typhi Ty2
cauccagaucggca

SEQ ID NO: 1772648 - RNA, 21 nt, Salmonella enterica enterica serovar Typhi Ty2
cauccagcaauaacaccggcg

SEQ ID NO: 1772649 - RNA, 18 nt, Salmonella enterica enterica serovar Typhi Ty2
cauccagcacgagcgcca

SEQ ID NO: 1772650 - RNA, 14 nt, Salmonella enterica enterica serovar Typhi Ty2
cauccacggccccg

SEQ ID NO: 1772651 - RNA, 18 nt, Salmonella enterica enterica serovar Typhi Ty2
cauccaccuuauccuggc

SEQ ID NO: 1772652 - RNA, 17 nt, Salmonella enterica enterica serovar Typhi Ty2
cauccaccaggcaugca

SEQ ID NO: 1772653 - RNA, 12 nt, Salmonella enterica enterica serovar Typhi Ty2
cauccacauucg

SEQ ID NO: 1772654 - RNA, 16 nt, Salmonella enterica enterica serovar Typhi Ty2
caucaugcuugcuuug

SEQ ID NO: 1772655 - RNA, 15 nt, Salmonella enterica enterica serovar Typhi Ty2
caucaugcgccaggu

SEQ ID NO: 1772656 - RNA, 20 nt, Salmonella enterica enterica serovar Typhi Ty2
caucaugcgcagaaacugau

SEQ ID NO: 1772657 - RNA, 17 nt, Salmonella enterica enterica serovar Typhi Ty2
caucaugcccacaggca

SEQ ID NO: 1772658 - RNA, 15 nt, Salmonella enterica enterica serovar Typhi Ty2
caucaugauauaauu

SEQ ID NO: 1772659 - RNA, 19 nt, Salmonella enterica enterica serovar Typhi Ty2
caucauuaaagcgcucaag

SEQ ID NO: 1772660 - RNA, 20 nt, Salmonella enterica enterica serovar Typhi Ty2
caucauguugaaauauuuga

SEQ ID NO: 1772661 - RNA, 19 nt, Salmonella enterica enterica serovar Typhi Ty2
cauccaguuguuuauucca

SEQ ID NO: 1772662 - RNA, 20 nt, Salmonella enterica enterica serovar Typhi Ty2
cauccagcuugccgucacag

SEQ ID NO: 1772663 - RNA, 13 nt, Salmonella enterica enterica serovar Typhi Ty2
cauccaucaucua

SEQ ID NO: 1772664 - RNA, 15 nt, Salmonella enterica enterica serovar Typhi Ty2
cauccaucacuccuu

SEQ ID NO: 1772665 - RNA, 14 nt, Salmonella enterica enterica serovar Typhi Ty2
cauccaucagcgcg

SEQ ID NO: 1772666 - RNA, 15 nt, Salmonella enterica enterica serovar Typhi Ty2
cauccauuaaaaucu

SEQ ID NO: 1772667 - RNA, 16 nt, Salmonella enterica enterica serovar Typhi Ty2
caucccaccggaaaug

SEQ ID NO: 1772668 - RNA, 18 nt, Salmonella enterica enterica serovar Typhi Ty2
cauccauugcgccacgga

SEQ ID NO: 1772669 - RNA, 21 nt, Salmonella enterica enterica serovar Typhi Ty2
cauccgauuucauggucaucg

SEQ ID NO: 1772670 - RNA, 23 nt, Salmonella enterica enterica serovar Typhi Ty2
cauccgauuucauggucaucgca

SEQ ID NO: 1772671 - RNA, 19 nt, Salmonella enterica enterica serovar Typhi Ty2
cauccgcaagacacgcuuc

SEQ ID NO: 1772672 - RNA, 15 nt, Salmonella enterica enterica serovar Typhi Ty2
cauccccgccgagaa

SEQ ID NO: 1772673 - RNA, 16 nt, Salmonella enterica enterica serovar Typhi Ty2
cauccccaccgcugau

SEQ ID NO: 1772674 - RNA, 16 nt, Salmonella enterica enterica serovar Typhi Ty2
caucccauccgggcca

SEQ ID NO: 1772675 - RNA, 23 nt, Salmonella enterica enterica serovar Typhi Ty2
caucccauccgggccacucucca

SEQ ID NO: 1772676 - RNA, 10 nt, Salmonella enterica enterica serovar Typhi Ty2
caucccagac

SEQ ID NO: 1772677 - RNA, 13 nt, Salmonella enterica enterica serovar Typhi Ty2
cauccggccagcg

SEQ ID NO: 1772678 - RNA, 15 nt, Salmonella enterica enterica serovar Typhi Ty2
cauccggcauuuuuu

SEQ ID NO: 1772679 - RNA, 14 nt, Salmonella enterica enterica serovar Typhi Ty2
cauccggccuguuc

SEQ ID NO: 1772680 - RNA, 16 nt, Salmonella enterica enterica serovar Typhi Ty2
cauccgccagccgcca

SEQ ID NO: 1772681 - RNA, 17 nt, Salmonella enterica enterica serovar Typhi Ty2
cauccgccagccgccau

SEQ ID NO: 1772682 - RNA, 17 nt, Salmonella enterica enterica serovar Typhi Ty2
cauccgccagcgccucu

SEQ ID NO: 1772683 - RNA, 23 nt, Salmonella enterica enterica serovar Typhi Ty2
cauccgcgcaauaugcggcgcca

SEQ ID NO: 1772684 - RNA, 19 nt, Salmonella enterica enterica serovar Typhi Ty2
cauccggcgcugcgcggcg

SEQ ID NO: 1772685 - RNA, 23 nt, Salmonella enterica enterica serovar Typhi Ty2
cauccuuuacaauuucgcaaaca

SEQ ID NO: 1772686 - RNA, 18 nt, Salmonella enterica enterica serovar Typhi Ty2
caucgacuucgaagguuc

SEQ ID NO: 1772687 - RNA, 17 nt, Salmonella enterica enterica serovar Typhi Ty2
caucgacuucaagguuc

SEQ ID NO: 1772688 - RNA, 23 nt, Salmonella enterica enterica serovar Typhi Ty2
caucgagccaacguauaaaaugg

SEQ ID NO: 1772689 - RNA, 16 nt, Salmonella enterica enterica serovar Typhi Ty2
caucgccagcuucgcu

SEQ ID NO: 1772690 - RNA, 20 nt, Salmonella enterica enterica serovar Typhi Ty2
caucgccauccugcagccau

SEQ ID NO: 1772691 - RNA, 13 nt, Salmonella enterica enterica serovar Typhi Ty2
caucgccagccau

SEQ ID NO: 1772692 - RNA, 18 nt, Salmonella enterica enterica serovar Typhi Ty2
caucgccauuaaaagcca

SEQ ID NO: 1772693 - RNA, 18 nt, Salmonella enterica enterica serovar Typhi Ty2
caucgccaccgcauggaa

SEQ ID NO: 1772694 - RNA, 18 nt, Salmonella enterica enterica serovar Typhi Ty2
caucgcauuaacguccau

SEQ ID NO: 1772695 - RNA, 15 nt, Salmonella enterica enterica serovar Typhi Ty2
caucgccagauaaau

SEQ ID NO: 1772696 - RNA, 15 nt, Salmonella enterica enterica serovar Typhi Ty2
caucggcagcgccag

SEQ ID NO: 1772697 - RNA, 16 nt, Salmonella enterica enterica serovar Typhi Ty2
caucggcacagccagu

SEQ ID NO: 1772698 - RNA, 15 nt, Salmonella enterica enterica serovar Typhi Ty2
caucggcacagccag

SEQ ID NO: 1772699 - RNA, 12 nt, Salmonella enterica enterica serovar Typhi Ty2
caucggcaaacg

SEQ ID NO: 1772700 - RNA, 24 nt, Salmonella enterica enterica serovar Typhi Ty2
caucggcgaguuuggugcccgcgu

SEQ ID NO: 1772701 - RNA, 18 nt, Salmonella enterica enterica serovar Typhi Ty2
caucgcuucuacagccac

SEQ ID NO: 1772702 - RNA, 21 nt, Salmonella enterica enterica serovar Typhi Ty2
caucgcuuuuaggcugaaagc

SEQ ID NO: 1772703 - RNA, 21 nt, Salmonella enterica enterica serovar Typhi Ty2
caucgcuggugugcagccagu

SEQ ID NO: 1772704 - RNA, 19 nt, Salmonella enterica enterica serovar Typhi Ty2
caucgccgcaaugaccaca

SEQ ID NO: 1772705 - RNA, 17 nt, Salmonella enterica enterica serovar Typhi Ty2
caucgccgauuccugcu

SEQ ID NO: 1772706 - RNA, 21 nt, Salmonella enterica enterica serovar Typhi Ty2
caucgcccugauggcgcgcca

SEQ ID NO: 1772707 - RNA, 17 nt, Salmonella enterica enterica serovar Typhi Ty2
caucggucaguuugccc

SEQ ID NO: 1772708 - RNA, 17 nt, Salmonella enterica enterica serovar Typhi Ty2
caucgggucgcgcgccg

SEQ ID NO: 1772709 - RNA, 22 nt, Salmonella enterica enterica serovar Typhi Ty2
caucgucuuuuaccgcgucgcu

SEQ ID NO: 1772710 - RNA, 21 nt, Salmonella enterica enterica serovar Typhi Ty2
caucgggcuguuauucagcag

SEQ ID NO: 1772711 - RNA, 15 nt, Salmonella enterica enterica serovar Typhi Ty2
caucggcgcgucgcu

SEQ ID NO: 1772712 - RNA, 16 nt, Salmonella enterica enterica serovar Typhi Ty2
caucggcgcgcuggcg

SEQ ID NO: 1772713 - RNA, 20 nt, Salmonella enterica enterica serovar Typhi Ty2
caucacagccacacugcugu

SEQ ID NO: 1772714 - RNA, 19 nt, Salmonella enterica enterica serovar Typhi Ty2
caucacagccacacugcug

SEQ ID NO: 1772715 - RNA, 18 nt, Salmonella enterica enterica serovar Typhi Ty2
caucacagccacacugcu

SEQ ID NO: 1772716 - RNA, 16 nt, Salmonella enterica enterica serovar Typhi Ty2
caucacagccacacug

SEQ ID NO: 1772717 - RNA, 21 nt, Salmonella enterica enterica serovar Typhi Ty2
caucacaugcgggagcaaaau

SEQ ID NO: 1772718 - RNA, 17 nt, Salmonella enterica enterica serovar Typhi Ty2
caucacaucaaagcccc

SEQ ID NO: 1772719 - RNA, 19 nt, Salmonella enterica enterica serovar Typhi Ty2
caucacauguagcgcggca

SEQ ID NO: 1772720 - RNA, 18 nt, Salmonella enterica enterica serovar Typhi Ty2
caucaccaucgccggaga

SEQ ID NO: 1772721 - RNA, 23 nt, Salmonella enterica enterica serovar Typhi Ty2
caucaccaucguugccagcggcc

SEQ ID NO: 1772722 - RNA, 22 nt, Salmonella enterica enterica serovar Typhi Ty2
caucaauaccugucggcaaauc

SEQ ID NO: 1772723 - RNA, 22 nt, Salmonella enterica enterica serovar Typhi Ty2
caucacaaucuccagaccgcug

SEQ ID NO: 1772724 - RNA, 14 nt, Salmonella enterica enterica serovar Typhi Ty2
caucacgaaauaac

SEQ ID NO: 1772725 - RNA, 19 nt, Salmonella enterica enterica serovar Typhi Ty2
caucacguucgcgcauacc

SEQ ID NO: 1772726 - RNA, 13 nt, Salmonella enterica enterica serovar Typhi Ty2
caucaccggcccc

SEQ ID NO: 1772727 - RNA, 21 nt, Salmonella enterica enterica serovar Typhi Ty2
caucaccgucuucaggucauu

SEQ ID NO: 1772728 - RNA, 14 nt, Salmonella enterica enterica serovar Typhi Ty2
caucaccuccagca

SEQ ID NO: 1772729 - RNA, 15 nt, Salmonella enterica enterica serovar Typhi Ty2
caucagaaaaaccuc

SEQ ID NO: 1772730 - RNA, 21 nt, Salmonella enterica enterica serovar Typhi Ty2
caucacuuuuggcgacaggaa

SEQ ID NO: 1772731 - RNA, 22 nt, Salmonella enterica enterica serovar Typhi Ty2
caucagcaaaauaccggcagcg

SEQ ID NO: 1772732 - RNA, 14 nt, Salmonella enterica enterica serovar Typhi Ty2
caucagcaaaauac

SEQ ID NO: 1772733 - RNA, 18 nt, Salmonella enterica enterica serovar Typhi Ty2
caucagcacaaaauccca

SEQ ID NO: 1772734 - RNA, 15 nt, Salmonella enterica enterica serovar Typhi Ty2
caucagcaaaugaac

SEQ ID NO: 1772735 - RNA, 16 nt, Salmonella enterica enterica serovar Typhi Ty2
caucacuuccuguauc

SEQ ID NO: 1772736 - RNA, 21 nt, Salmonella enterica enterica serovar Typhi Ty2
caucacuuccuguaucacuga

SEQ ID NO: 1772737 - RNA, 18 nt, Salmonella enterica enterica serovar Typhi Ty2
caucacugaacccaaaca

SEQ ID NO: 1772738 - RNA, 22 nt, Salmonella enterica enterica serovar Typhi Ty2
cauauucuuugcgccuuauuca

SEQ ID NO: 1772739 - RNA, 14 nt, Salmonella enterica enterica serovar Typhi Ty2
cauauugccgcaca

SEQ ID NO: 1772740 - RNA, 15 nt, Salmonella enterica enterica serovar Typhi Ty2
cauauucgccaccgc

SEQ ID NO: 1772741 - RNA, 20 nt, Salmonella enterica enterica serovar Typhi Ty2
cauauucauaucgaagccca

SEQ ID NO: 1772742 - RNA, 16 nt, Salmonella enterica enterica serovar Typhi Ty2
cauaucgcuaaaccaa

SEQ ID NO: 1772743 - RNA, 16 nt, Salmonella enterica enterica serovar Typhi Ty2
cauaucgccgccacau

SEQ ID NO: 1772744 - RNA, 19 nt, Salmonella enterica enterica serovar Typhi Ty2
cauaucgcggguaaacuca

SEQ ID NO: 1772745 - RNA, 12 nt, Salmonella enterica enterica serovar Typhi Ty2
cauauauuauua

SEQ ID NO: 1772746 - RNA, 21 nt, Salmonella enterica enterica serovar Typhi Ty2
cauauauuuacugaauaaaua

SEQ ID NO: 1772747 - RNA, 12 nt, Salmonella enterica enterica serovar Typhi Ty2
cauauauuuacu

SEQ ID NO: 1772748 - RNA, 14 nt, Salmonella enterica enterica serovar Typhi Ty2
cauaucgcaauuga

SEQ ID NO: 1772749 - RNA, 15 nt, Salmonella enterica enterica serovar Typhi Ty2
cauaucgcgcagcgu

SEQ ID NO: 1772750 - RNA, 12 nt, Salmonella enterica enterica serovar Typhi Ty2
cauaucgacggu

SEQ ID NO: 1772751 - RNA, 19 nt, Salmonella enterica enterica serovar Typhi Ty2
caucaaguaccgugaagaa

SEQ ID NO: 1772752 - RNA, 22 nt, Salmonella enterica enterica serovar Typhi Ty2
caucaaguacagcuuaaucacc

SEQ ID NO: 1772753 - RNA, 22 nt, Salmonella enterica enterica serovar Typhi Ty2
caucaagcugcuggcgagcagg

SEQ ID NO: 1772754 - RNA, 18 nt, Salmonella enterica enterica serovar Typhi Ty2
caucaacagcggagagac

SEQ ID NO: 1772755 - RNA, 15 nt, Salmonella enterica enterica serovar Typhi Ty2
caucaaauaauacgc

SEQ ID NO: 1772756 - RNA, 19 nt, Salmonella enterica enterica serovar Typhi Ty2
cauauuugcgugucaucaa

SEQ ID NO: 1772757 - RNA, 20 nt, Salmonella enterica enterica serovar Typhi Ty2
cauauugcgcuucacuaacu

SEQ ID NO: 1772758 - RNA, 21 nt, Salmonella enterica enterica serovar Typhi Ty2
cauauuuucaacggcaucaau

SEQ ID NO: 1772759 - RNA, 13 nt, Salmonella enterica enterica serovar Typhi Ty2
cauauuuuuaugc

SEQ ID NO: 1772760 - RNA, 16 nt, Salmonella enterica enterica serovar Typhi Ty2
cauauuuuuucaggaa

SEQ ID NO: 1772761 - RNA, 13 nt, Salmonella enterica enterica serovar Typhi Ty2
caucaaagccacc

SEQ ID NO: 1772762 - RNA, 21 nt, Salmonella enterica enterica serovar Typhi Ty2
cauagcguuuaaaaagcugca

SEQ ID NO: 1772763 - RNA, 22 nt, Salmonella enterica enterica serovar Typhi Ty2
cauagcguugauaugcucgaca

SEQ ID NO: 1772764 - RNA, 18 nt, Salmonella enterica enterica serovar Typhi Ty2
cauagcuaaauaaaaaua

SEQ ID NO: 1772765 - RNA, 20 nt, Salmonella enterica enterica serovar Typhi Ty2
cauagcuaaauaaaaauaau

SEQ ID NO: 1772766 - RNA, 12 nt, Salmonella enterica enterica serovar Typhi Ty2
cauaggacugau

SEQ ID NO: 1772767 - RNA, 15 nt, Salmonella enterica enterica serovar Typhi Ty2
cauagccgcgcguca

SEQ ID NO: 1772768 - RNA, 20 nt, Salmonella enterica enterica serovar Typhi Ty2
cauagccaacacauaagcca

SEQ ID NO: 1772769 - RNA, 13 nt, Salmonella enterica enterica serovar Typhi Ty2
cauagcaucacca

SEQ ID NO: 1772770 - RNA, 19 nt, Salmonella enterica enterica serovar Typhi Ty2
cauagcggccagauggcaa

SEQ ID NO: 1772771 - RNA, 19 nt, Salmonella enterica enterica serovar Typhi Ty2
cauagcgggcagcauugac

SEQ ID NO: 1772772 - RNA, 18 nt, Salmonella enterica enterica serovar Typhi Ty2
cauauaaauuucauccau

SEQ ID NO: 1772773 - RNA, 23 nt, Salmonella enterica enterica serovar Typhi Ty2
cauauaaccacgaaaauuauuuu

SEQ ID NO: 1772774 - RNA, 16 nt, Salmonella enterica enterica serovar Typhi Ty2
cauauaugcgacagaa

SEQ ID NO: 1772775 - RNA, 16 nt, Salmonella enterica enterica serovar Typhi Ty2
cauauaacuuucaaua

SEQ ID NO: 1772776 - RNA, 12 nt, Salmonella enterica enterica serovar Typhi Ty2
cauagaaccacu

SEQ ID NO: 1772777 - RNA, 18 nt, Salmonella enterica enterica serovar Typhi Ty2
cauagaaagauuucauca

SEQ ID NO: 1772778 - RNA, 13 nt, Salmonella enterica enterica serovar Typhi Ty2
cauagaauuucag

SEQ ID NO: 1772779 - RNA, 21 nt, Salmonella enterica enterica serovar Typhi Ty2
cauagacgcccugcaaagcaa

SEQ ID NO: 1772780 - RNA, 23 nt, Salmonella enterica enterica serovar Typhi Ty2
cauagacgcccugcaaagcaaaa

SEQ ID NO: 1772781 - RNA, 14 nt, Salmonella enterica enterica serovar Typhi Ty2
cauagacgcccugc

SEQ ID NO: 1772782 - RNA, 17 nt, Salmonella enterica enterica serovar Typhi Ty2
cauagauaccuucuuca

SEQ ID NO: 1772783 - RNA, 15 nt, Salmonella enterica enterica serovar Typhi Ty2
cauagauaccuucuu

SEQ ID NO: 1772784 - RNA, 21 nt, Salmonella enterica enterica serovar Typhi Ty2
cauacuccugccugacaauga

SEQ ID NO: 1772785 - RNA, 15 nt, Salmonella enterica enterica serovar Typhi Ty2
cauacugaagauaaa

SEQ ID NO: 1772786 - RNA, 19 nt, Salmonella enterica enterica serovar Typhi Ty2
cauacugauuucggaauga

SEQ ID NO: 1772787 - RNA, 15 nt, Salmonella enterica enterica serovar Typhi Ty2
cauacucuccuccau

SEQ ID NO: 1772788 - RNA, 14 nt, Salmonella enterica enterica serovar Typhi Ty2
cauacugcccagcc

SEQ ID NO: 1772789 - RNA, 20 nt, Salmonella enterica enterica serovar Typhi Ty2
cauacugcuuuuucggcuca

SEQ ID NO: 1772790 - RNA, 15 nt, Salmonella enterica enterica serovar Typhi Ty2
cauacuuccucaccg

SEQ ID NO: 1772791 - RNA, 15 nt, Salmonella enterica enterica serovar Typhi Ty2
cauacuuacugcugu

SEQ ID NO: 1772792 - RNA, 16 nt, Salmonella enterica enterica serovar Typhi Ty2
cauacuuacugcuguc

SEQ ID NO: 1772793 - RNA, 23 nt, Salmonella enterica enterica serovar Typhi Ty2
cauagaaaaagaacugcaaauac

SEQ ID NO: 1772794 - RNA, 13 nt, Salmonella enterica enterica serovar Typhi Ty2
cauacuuugcauu

SEQ ID NO: 1772795 - RNA, 16 nt, Salmonella enterica enterica serovar Typhi Ty2
cauacugccaaccauu

SEQ ID NO: 1772796 - RNA, 17 nt, Salmonella enterica enterica serovar Typhi Ty2
ccagcaucgaccaggau

SEQ ID NO: 1772797 - RNA, 13 nt, Salmonella enterica enterica serovar Typhi Ty2
ccagcaucccgcu

SEQ ID NO: 1772798 - RNA, 20 nt, Salmonella enterica enterica serovar Typhi Ty2
ccagcauauuaacagugagu

SEQ ID NO: 1772799 - RNA, 18 nt, Salmonella enterica enterica serovar Typhi Ty2
ccagcaucaauagcagcu

SEQ ID NO: 1772800 - RNA, 17 nt, Salmonella enterica enterica serovar Typhi Ty2
ccagcaugagccagccc

SEQ ID NO: 1772801 - RNA, 17 nt, Salmonella enterica enterica serovar Typhi Ty2
ccagcaucggcagcgcc

SEQ ID NO: 1772802 - RNA, 21 nt, Salmonella enterica enterica serovar Typhi Ty2
ccagcaucgguagaaugaaug

SEQ ID NO: 1772803 - RNA, 14 nt, Salmonella enterica enterica serovar Typhi Ty2
ccagcaugcccgcc

SEQ ID NO: 1772804 - RNA, 18 nt, Salmonella enterica enterica serovar Typhi Ty2
ccagcauggcgucggcga

SEQ ID NO: 1772805 - RNA, 22 nt, Salmonella enterica enterica serovar Typhi Ty2
ccagcauggcgucggcgacuuu

SEQ ID NO: 1772806 - RNA, 17 nt, Salmonella enterica enterica serovar Typhi Ty2
ccagcauuaacccggcc

SEQ ID NO: 1772807 - RNA, 17 nt, Salmonella enterica enterica serovar Typhi Ty2
ccagcauuuccagcugg

SEQ ID NO: 1772808 - RNA, 11 nt, Salmonella enterica enterica serovar Typhi Ty2
ccagcauuucu

SEQ ID NO: 1772809 - RNA, 21 nt, Salmonella enterica enterica serovar Typhi Ty2
ccagcagguggaucugaaucu

SEQ ID NO: 1772810 - RNA, 22 nt, Salmonella enterica enterica serovar Typhi Ty2
ccagcaggugcggacugggcug

SEQ ID NO: 1772811 - RNA, 17 nt, Salmonella enterica enterica serovar Typhi Ty2
ccagcauaccgcccaac

SEQ ID NO: 1772812 - RNA, 17 nt, Salmonella enterica enterica serovar Typhi Ty2
ccagcaguugccauagc

SEQ ID NO: 1772813 - RNA, 23 nt, Salmonella enterica enterica serovar Typhi Ty2
ccagcauagucgcuccccauaaa

SEQ ID NO: 1772814 - RNA, 18 nt, Salmonella enterica enterica serovar Typhi Ty2
ccagcccgccgcccuccg

SEQ ID NO: 1772815 - RNA, 15 nt, Salmonella enterica enterica serovar Typhi Ty2
ccagcccccugccag

SEQ ID NO: 1772816 - RNA, 18 nt, Salmonella enterica enterica serovar Typhi Ty2
ccagccauugcugacaaa

SEQ ID NO: 1772817 - RNA, 16 nt, Salmonella enterica enterica serovar Typhi Ty2
ccagcccuaaaaauag

SEQ ID NO: 1772818 - RNA, 19 nt, Salmonella enterica enterica serovar Typhi Ty2
ccagccgcaucuuauauuu

SEQ ID NO: 1772819 - RNA, 22 nt, Salmonella enterica enterica serovar Typhi Ty2
ccagcccuaaaaauagcaccag

SEQ ID NO: 1772820 - RNA, 16 nt, Salmonella enterica enterica serovar Typhi Ty2
ccagccaguccuccgg

SEQ ID NO: 1772821 - RNA, 21 nt, Salmonella enterica enterica serovar Typhi Ty2
ccagccauggcccuuuugccc

SEQ ID NO: 1772822 - RNA, 14 nt, Salmonella enterica enterica serovar Typhi Ty2
ccagccaugccagc

SEQ ID NO: 1772823 - RNA, 18 nt, Salmonella enterica enterica serovar Typhi Ty2
ccagccagggaucaagca

SEQ ID NO: 1772824 - RNA, 14 nt, Salmonella enterica enterica serovar Typhi Ty2
ccagccaggcgauu

SEQ ID NO: 1772825 - RNA, 17 nt, Salmonella enterica enterica serovar Typhi Ty2
ccagccagcgacgcaug

SEQ ID NO: 1772826 - RNA, 18 nt, Salmonella enterica enterica serovar Typhi Ty2
ccagccagcgccaccaaa

SEQ ID NO: 1772827 - RNA, 13 nt, Salmonella enterica enterica serovar Typhi Ty2
ccagccacugacu

SEQ ID NO: 1772828 - RNA, 14 nt, Salmonella enterica enterica serovar Typhi Ty2
ccagccacugcgcc

SEQ ID NO: 1772829 - RNA, 15 nt, Salmonella enterica enterica serovar Typhi Ty2
ccagccacuccuuac

SEQ ID NO: 1772830 - RNA, 15 nt, Salmonella enterica enterica serovar Typhi Ty2
ccagccagacgccag

SEQ ID NO: 1772831 - RNA, 12 nt, Salmonella enterica enterica serovar Typhi Ty2
ccagccacaaga

SEQ ID NO: 1772832 - RNA, 16 nt, Salmonella enterica enterica serovar Typhi Ty2
ccagcaaugauuuuau

SEQ ID NO: 1772833 - RNA, 18 nt, Salmonella enterica enterica serovar Typhi Ty2
ccagcaaugccgccgcca

SEQ ID NO: 1772834 - RNA, 16 nt, Salmonella enterica enterica serovar Typhi Ty2
ccagcaaugccgccgc

SEQ ID NO: 1772835 - RNA, 23 nt, Salmonella enterica enterica serovar Typhi Ty2
ccagcaaggagacgcccgucacc

SEQ ID NO: 1772836 - RNA, 12 nt, Salmonella enterica enterica serovar Typhi Ty2
ccagcaaggcaa

SEQ ID NO: 1772837 - RNA, 15 nt, Salmonella enterica enterica serovar Typhi Ty2
ccagcaauaacaccg

SEQ ID NO: 1772838 - RNA, 16 nt, Salmonella enterica enterica serovar Typhi Ty2
ccagcaccagcagcgc

SEQ ID NO: 1772839 - RNA, 14 nt, Salmonella enterica enterica serovar Typhi Ty2
ccagcaccagcagu

SEQ ID NO: 1772840 - RNA, 16 nt, Salmonella enterica enterica serovar Typhi Ty2
ccagcaccagcauuag

SEQ ID NO: 1772841 - RNA, 15 nt, Salmonella enterica enterica serovar Typhi Ty2
ccagcaccaucuuuu

SEQ ID NO: 1772842 - RNA, 15 nt, Salmonella enterica enterica serovar Typhi Ty2
ccagcacagcccagu

SEQ ID NO: 1772843 - RNA, 12 nt, Salmonella enterica enterica serovar Typhi Ty2
ccagcacagccc

SEQ ID NO: 1772844 - RNA, 21 nt, Salmonella enterica enterica serovar Typhi Ty2
ccagcacagguacaggccgcc

SEQ ID NO: 1772845 - RNA, 18 nt, Salmonella enterica enterica serovar Typhi Ty2
ccagauuuuucucacaca

SEQ ID NO: 1772846 - RNA, 13 nt, Salmonella enterica enterica serovar Typhi Ty2
ccagcaaaauaau

SEQ ID NO: 1772847 - RNA, 22 nt, Salmonella enterica enterica serovar Typhi Ty2
ccagauugucgcaaaccaccgg

SEQ ID NO: 1772848 - RNA, 12 nt, Salmonella enterica enterica serovar Typhi Ty2
ccagcaaaucgc

SEQ ID NO: 1772849 - RNA, 11 nt, Salmonella enterica enterica serovar Typhi Ty2
ccagcaaaauu

SEQ ID NO: 1772850 - RNA, 23 nt, Salmonella enterica enterica serovar Typhi Ty2
ccagcaaaccuuccgccaggcgg

SEQ ID NO: 1772851 - RNA, 22 nt, Salmonella enterica enterica serovar Typhi Ty2
ccagcaaaucgcccaucacaug

SEQ ID NO: 1772852 - RNA, 22 nt, Salmonella enterica enterica serovar Typhi Ty2
ccagcaacguauuccacggaau

SEQ ID NO: 1772853 - RNA, 17 nt, Salmonella enterica enterica serovar Typhi Ty2
ccagcaacccaccugcc

SEQ ID NO: 1772854 - RNA, 19 nt, Salmonella enterica enterica serovar Typhi Ty2
ccagcaacgcgcuaaaugc

SEQ ID NO: 1772855 - RNA, 20 nt, Salmonella enterica enterica serovar Typhi Ty2
ccagcaacgagcuuuuuucu

SEQ ID NO: 1772856 - RNA, 15 nt, Salmonella enterica enterica serovar Typhi Ty2
ccagcaacagcguac

SEQ ID NO: 1772857 - RNA, 21 nt, Salmonella enterica enterica serovar Typhi Ty2
ccagcaacagguaccccgcca

SEQ ID NO: 1772858 - RNA, 20 nt, Salmonella enterica enterica serovar Typhi Ty2
ccagcaacagugggcuauga

SEQ ID NO: 1772859 - RNA, 19 nt, Salmonella enterica enterica serovar Typhi Ty2
ccagcagaugcaguucacc

SEQ ID NO: 1772860 - RNA, 19 nt, Salmonella enterica enterica serovar Typhi Ty2
ccagcacuaacagcagcag

SEQ ID NO: 1772861 - RNA, 17 nt, Salmonella enterica enterica serovar Typhi Ty2
ccagcagcgcaccugcc

SEQ ID NO: 1772862 - RNA, 19 nt, Salmonella enterica enterica serovar Typhi Ty2
ccagcagcguuuugcgcgu

SEQ ID NO: 1772863 - RNA, 21 nt, Salmonella enterica enterica serovar Typhi Ty2
ccagcagcauaaaaccgccgc

SEQ ID NO: 1772864 - RNA, 15 nt, Salmonella enterica enterica serovar Typhi Ty2
ccagcagccacagga

SEQ ID NO: 1772865 - RNA, 14 nt, Salmonella enterica enterica serovar Typhi Ty2
ccagcagcagcgca

SEQ ID NO: 1772866 - RNA, 13 nt, Salmonella enterica enterica serovar Typhi Ty2
ccagcagcagcac

SEQ ID NO: 1772867 - RNA, 21 nt, Salmonella enterica enterica serovar Typhi Ty2
ccagcagaugcaguucacccu

SEQ ID NO: 1772868 - RNA, 16 nt, Salmonella enterica enterica serovar Typhi Ty2
ccagacuuuccagcac

SEQ ID NO: 1772869 - RNA, 15 nt, Salmonella enterica enterica serovar Typhi Ty2
ccagacuaaaacgug

SEQ ID NO: 1772870 - RNA, 16 nt, Salmonella enterica enterica serovar Typhi Ty2
ccagacucaccccuuc

SEQ ID NO: 1772871 - RNA, 13 nt, Salmonella enterica enterica serovar Typhi Ty2
ccagacuaaucca

SEQ ID NO: 1772872 - RNA, 15 nt, Salmonella enterica enterica serovar Typhi Ty2
ccagacucgcucccu

SEQ ID NO: 1772873 - RNA, 17 nt, Salmonella enterica enterica serovar Typhi Ty2
ccagaguccggcgccug

SEQ ID NO: 1772874 - RNA, 20 nt, Salmonella enterica enterica serovar Typhi Ty2
ccagaggaucuggacgccaa

SEQ ID NO: 1772875 - RNA, 18 nt, Salmonella enterica enterica serovar Typhi Ty2
ccagagcgcggccuuugc

SEQ ID NO: 1772876 - RNA, 18 nt, Salmonella enterica enterica serovar Typhi Ty2
ccagagccccaaugcuuu

SEQ ID NO: 1772877 - RNA, 19 nt, Salmonella enterica enterica serovar Typhi Ty2
ccagacccgauaguguaaa

SEQ ID NO: 1772878 - RNA, 19 nt, Salmonella enterica enterica serovar Typhi Ty2
ccagaccauucaaccagcc

SEQ ID NO: 1772879 - RNA, 22 nt, Salmonella enterica enterica serovar Typhi Ty2
ccagaccgauauuuugcugcac

SEQ ID NO: 1772880 - RNA, 17 nt, Salmonella enterica enterica serovar Typhi Ty2
ccagacaggacgccagc

SEQ ID NO: 1772881 - RNA, 13 nt, Salmonella enterica enterica serovar Typhi Ty2
ccagacaggacgc

SEQ ID NO: 1772882 - RNA, 17 nt, Salmonella enterica enterica serovar Typhi Ty2
ccagacaugcacauggu

SEQ ID NO: 1772883 - RNA, 21 nt, Salmonella enterica enterica serovar Typhi Ty2
ccagaccggauugcccgcggc

SEQ ID NO: 1772884 - RNA, 14 nt, Salmonella enterica enterica serovar Typhi Ty2
ccagaccgcuuaac

SEQ ID NO: 1772885 - RNA, 23 nt, Salmonella enterica enterica serovar Typhi Ty2
ccagaccugaauauucggcucca

SEQ ID NO: 1772886 - RNA, 17 nt, Salmonella enterica enterica serovar Typhi Ty2
ccagacgcguaaccccu

SEQ ID NO: 1772887 - RNA, 19 nt, Salmonella enterica enterica serovar Typhi Ty2
ccagacgcguaaccccugc

SEQ ID NO: 1772888 - RNA, 20 nt, Salmonella enterica enterica serovar Typhi Ty2
ccagacgccauaucgccgcc

SEQ ID NO: 1772889 - RNA, 17 nt, Salmonella enterica enterica serovar Typhi Ty2
ccagacgggccaggcga

SEQ ID NO: 1772890 - RNA, 13 nt, Salmonella enterica enterica serovar Typhi Ty2
ccagacgccagcc

SEQ ID NO: 1772891 - RNA, 16 nt, Salmonella enterica enterica serovar Typhi Ty2
ccagauaauccagcgu

SEQ ID NO: 1772892 - RNA, 14 nt, Salmonella enterica enterica serovar Typhi Ty2
ccagauaaggcuca

SEQ ID NO: 1772893 - RNA, 20 nt, Salmonella enterica enterica serovar Typhi Ty2
ccagauaaucaaacgcgccg

SEQ ID NO: 1772894 - RNA, 18 nt, Salmonella enterica enterica serovar Typhi Ty2
ccagauaauuaugccugu

SEQ ID NO: 1772895 - RNA, 14 nt, Salmonella enterica enterica serovar Typhi Ty2
ccagauacgcgccg

SEQ ID NO: 1772896 - RNA, 15 nt, Salmonella enterica enterica serovar Typhi Ty2
ccagauacgccgcgc

SEQ ID NO: 1772897 - RNA, 17 nt, Salmonella enterica enterica serovar Typhi Ty2
ccagauacgcgccggcc

SEQ ID NO: 1772898 - RNA, 21 nt, Salmonella enterica enterica serovar Typhi Ty2
ccagauacaaaucucagggug

SEQ ID NO: 1772899 - RNA, 13 nt, Salmonella enterica enterica serovar Typhi Ty2
ccagauacauggc

SEQ ID NO: 1772900 - RNA, 14 nt, Salmonella enterica enterica serovar Typhi Ty2
ccagauacauggcu

SEQ ID NO: 1772901 - RNA, 21 nt, Salmonella enterica enterica serovar Typhi Ty2
ccagauaagcucuccuggaug

SEQ ID NO: 1772902 - RNA, 15 nt, Salmonella enterica enterica serovar Typhi Ty2
ccagauauuuuuccg

SEQ ID NO: 1772903 - RNA, 17 nt, Salmonella enterica enterica serovar Typhi Ty2
ccagauagcgucuucag

SEQ ID NO: 1772904 - RNA, 19 nt, Salmonella enterica enterica serovar Typhi Ty2
ccagaucgauauccgugcg

SEQ ID NO: 1772905 - RNA, 23 nt, Salmonella enterica enterica serovar Typhi Ty2
ccagaugcuuaaugcucugcugu

SEQ ID NO: 1772906 - RNA, 22 nt, Salmonella enterica enterica serovar Typhi Ty2
ccagaugcgaaacguccccugc

SEQ ID NO: 1772907 - RNA, 21 nt, Salmonella enterica enterica serovar Typhi Ty2
ccagaucgcgguaacggccug

SEQ ID NO: 1772908 - RNA, 21 nt, Salmonella enterica enterica serovar Typhi Ty2
ccagauggggcuuccauugca

SEQ ID NO: 1772909 - RNA, 17 nt, Salmonella enterica enterica serovar Typhi Ty2
ccagauggggcuuccau

SEQ ID NO: 1772910 - RNA, 18 nt, Salmonella enterica enterica serovar Typhi Ty2
ccagaugucgcggauaug

SEQ ID NO: 1772911 - RNA, 22 nt, Salmonella enterica enterica serovar Typhi Ty2
ccagauggcaagauuaaccagc

SEQ ID NO: 1772912 - RNA, 18 nt, Salmonella enterica enterica serovar Typhi Ty2
ccagauggauaaccugcc

SEQ ID NO: 1772913 - RNA, 18 nt, Salmonella enterica enterica serovar Typhi Ty2
ccagauggcugcacccgg

SEQ ID NO: 1772914 - RNA, 17 nt, Salmonella enterica enterica serovar Typhi Ty2
ccagauuaucggccagc

SEQ ID NO: 1772915 - RNA, 19 nt, Salmonella enterica enterica serovar Typhi Ty2
ccagauuaucggccagcgc

SEQ ID NO: 1772916 - RNA, 17 nt, Salmonella enterica enterica serovar Typhi Ty2
ccagaaccguugcgccc

SEQ ID NO: 1772917 - RNA, 23 nt, Salmonella enterica enterica serovar Typhi Ty2
ccagaacguugacguuucaguca

SEQ ID NO: 1772918 - RNA, 23 nt, Salmonella enterica enterica serovar Typhi Ty2
ccagaacgaauuuacucgccaau

SEQ ID NO: 1772919 - RNA, 17 nt, Salmonella enterica enterica serovar Typhi Ty2
ccacuuuugucggccug

SEQ ID NO: 1772920 - RNA, 19 nt, Salmonella enterica enterica serovar Typhi Ty2
ccacuuucuguaauuugaa

SEQ ID NO: 1772921 - RNA, 20 nt, Salmonella enterica enterica serovar Typhi Ty2
ccagaaaaccgacagcaaua

SEQ ID NO: 1772922 - RNA, 16 nt, Salmonella enterica enterica serovar Typhi Ty2
ccagaaaaaaaagcgc

SEQ ID NO: 1772923 - RNA, 17 nt, Salmonella enterica enterica serovar Typhi Ty2
ccagaaacgguccugau

SEQ ID NO: 1772924 - RNA, 12 nt, Salmonella enterica enterica serovar Typhi Ty2
ccagaagcacuu

SEQ ID NO: 1772925 - RNA, 14 nt, Salmonella enterica enterica serovar Typhi Ty2
ccagaaggcaggcu

SEQ ID NO: 1772926 - RNA, 14 nt, Salmonella enterica enterica serovar Typhi Ty2
ccagaagcacuucu

SEQ ID NO: 1772927 - RNA, 21 nt, Salmonella enterica enterica serovar Typhi Ty2
ccagaacugcgaaaucaccga

SEQ ID NO: 1772928 - RNA, 15 nt, Salmonella enterica enterica serovar Typhi Ty2
ccagaauacgccgcc

SEQ ID NO: 1772929 - RNA, 15 nt, Salmonella enterica enterica serovar Typhi Ty2
ccagaauacaccgcc

SEQ ID NO: 1772930 - RNA, 23 nt, Salmonella enterica enterica serovar Typhi Ty2
ccagaaguagcagagaaaagguu

SEQ ID NO: 1772931 - RNA, 16 nt, Salmonella enterica enterica serovar Typhi Ty2
ccagaaucaccucuuu

SEQ ID NO: 1772932 - RNA, 14 nt, Salmonella enterica enterica serovar Typhi Ty2
ccagaaucagugac

SEQ ID NO: 1772933 - RNA, 22 nt, Salmonella enterica enterica serovar Typhi Ty2
ccagaauuuccuucgcuuccug

SEQ ID NO: 1772934 - RNA, 13 nt, Salmonella enterica enterica serovar Typhi Ty2
ccagaauucagca

SEQ ID NO: 1772935 - RNA, 18 nt, Salmonella enterica enterica serovar Typhi Ty2
ccagaauucagcauguac

SEQ ID NO: 1772936 - RNA, 18 nt, Salmonella enterica enterica serovar Typhi Ty2
ccagacagauaacaccag

SEQ ID NO: 1772937 - RNA, 20 nt, Salmonella enterica enterica serovar Typhi Ty2
ccagacagauaacaccagcg

SEQ ID NO: 1772938 - RNA, 22 nt, Salmonella enterica enterica serovar Typhi Ty2
ccagacacuggaaacagccaau

SEQ ID NO: 1772939 - RNA, 23 nt, Salmonella enterica enterica serovar Typhi Ty2
ccagacaauccgcggcaaacccc

SEQ ID NO: 1772940 - RNA, 16 nt, Salmonella enterica enterica serovar Typhi Ty2
ccacuucuuccagcgu

SEQ ID NO: 1772941 - RNA, 18 nt, Salmonella enterica enterica serovar Typhi Ty2
ccacuucugacagaauau

SEQ ID NO: 1772942 - RNA, 21 nt, Salmonella enterica enterica serovar Typhi Ty2
ccacuucaacgccgcgcuucu

SEQ ID NO: 1772943 - RNA, 14 nt, Salmonella enterica enterica serovar Typhi Ty2
ccacuggccuccca

SEQ ID NO: 1772944 - RNA, 22 nt, Salmonella enterica enterica serovar Typhi Ty2
ccacgccaacguccgccgucag

SEQ ID NO: 1772945 - RNA, 21 nt, Salmonella enterica enterica serovar Typhi Ty2
ccacgccaauacgggagagcg

SEQ ID NO: 1772946 - RNA, 22 nt, Salmonella enterica enterica serovar Typhi Ty2
ccacgccaaccaucggcacacu

SEQ ID NO: 1772947 - RNA, 15 nt, Salmonella enterica enterica serovar Typhi Ty2
ccacgccagcagcuc

SEQ ID NO: 1772948 - RNA, 15 nt, Salmonella enterica enterica serovar Typhi Ty2
ccacgccaccgggcc

SEQ ID NO: 1772949 - RNA, 17 nt, Salmonella enterica enterica serovar Typhi Ty2
ccacugcccgccgccac

SEQ ID NO: 1772950 - RNA, 22 nt, Salmonella enterica enterica serovar Typhi Ty2
ccacaguugguucugcucaaug

SEQ ID NO: 1772951 - RNA, 16 nt, Salmonella enterica enterica serovar Typhi Ty2
ccacauauaaguaacu

SEQ ID NO: 1772952 - RNA, 15 nt, Salmonella enterica enterica serovar Typhi Ty2
ccacauagcauccag

SEQ ID NO: 1772953 - RNA, 20 nt, Salmonella enterica enterica serovar Typhi Ty2
ccacaguaauggacagguaa

SEQ ID NO: 1772954 - RNA, 20 nt, Salmonella enterica enterica serovar Typhi Ty2
ccacagugacccgccgccag

SEQ ID NO: 1772955 - RNA, 21 nt, Salmonella enterica enterica serovar Typhi Ty2
ccacagucauggcuuuuaccc

SEQ ID NO: 1772956 - RNA, 17 nt, Salmonella enterica enterica serovar Typhi Ty2
ccacagucgucuggcgc

SEQ ID NO: 1772957 - RNA, 21 nt, Salmonella enterica enterica serovar Typhi Ty2
ccacaccugaugguuauuuuc

SEQ ID NO: 1772958 - RNA, 21 nt, Salmonella enterica enterica serovar Typhi Ty2
ccacacggaauccccggcuuc

SEQ ID NO: 1772959 - RNA, 16 nt, Salmonella enterica enterica serovar Typhi Ty2
ccacacggcauucacg

SEQ ID NO: 1772960 - RNA, 13 nt, Salmonella enterica enterica serovar Typhi Ty2
ccacacugcaucg

SEQ ID NO: 1772961 - RNA, 13 nt, Salmonella enterica enterica serovar Typhi Ty2
ccacaugaccagc

SEQ ID NO: 1772962 - RNA, 21 nt, Salmonella enterica enterica serovar Typhi Ty2
ccacaucggaucgauaugugu

SEQ ID NO: 1772963 - RNA, 23 nt, Salmonella enterica enterica serovar Typhi Ty2
ccacaucgcgagcacuuuuuccu

SEQ ID NO: 1772964 - RNA, 22 nt, Salmonella enterica enterica serovar Typhi Ty2
ccacaucagaccgccaagcgcg

SEQ ID NO: 1772965 - RNA, 19 nt, Salmonella enterica enterica serovar Typhi Ty2
ccacauauaaguaacuggu

SEQ ID NO: 1772966 - RNA, 16 nt, Salmonella enterica enterica serovar Typhi Ty2
ccacauuccagaccug

SEQ ID NO: 1772967 - RNA, 23 nt, Salmonella enterica enterica serovar Typhi Ty2
ccacaugccggugcgagaaaaag

SEQ ID NO: 1772968 - RNA, 21 nt, Salmonella enterica enterica serovar Typhi Ty2
ccacaugagaagggcaauauc

SEQ ID NO: 1772969 - RNA, 18 nt, Salmonella enterica enterica serovar Typhi Ty2
ccacaacggcaauuuuua

SEQ ID NO: 1772970 - RNA, 16 nt, Salmonella enterica enterica serovar Typhi Ty2
ccacaaccggcuggcu

SEQ ID NO: 1772971 - RNA, 21 nt, Salmonella enterica enterica serovar Typhi Ty2
ccacaaauuuugauaaaaaca

SEQ ID NO: 1772972 - RNA, 22 nt, Salmonella enterica enterica serovar Typhi Ty2
ccacaaauuuugauaaaaacac

SEQ ID NO: 1772973 - RNA, 18 nt, Salmonella enterica enterica serovar Typhi Ty2
ccacaacgugauaaccaa

SEQ ID NO: 1772974 - RNA, 13 nt, Salmonella enterica enterica serovar Typhi Ty2
ccacaaaggcgcg

SEQ ID NO: 1772975 - RNA, 12 nt, Salmonella enterica enterica serovar Typhi Ty2
ccaaugagcugc

SEQ ID NO: 1772976 - RNA, 21 nt, Salmonella enterica enterica serovar Typhi Ty2
ccaaugaaauaauuguguaau

SEQ ID NO: 1772977 - RNA, 15 nt, Salmonella enterica enterica serovar Typhi Ty2
ccaaugcaacgccuu

SEQ ID NO: 1772978 - RNA, 17 nt, Salmonella enterica enterica serovar Typhi Ty2
ccaauaacguaaccgcu

SEQ ID NO: 1772979 - RNA, 13 nt, Salmonella enterica enterica serovar Typhi Ty2
ccaauaauuuuag

SEQ ID NO: 1772980 - RNA, 16 nt, Salmonella enterica enterica serovar Typhi Ty2
ccaauaauaaucccaa

SEQ ID NO: 1772981 - RNA, 19 nt, Salmonella enterica enterica serovar Typhi Ty2
ccacccgcgcgcuuuccac

SEQ ID NO: 1772982 - RNA, 13 nt, Salmonella enterica enterica serovar Typhi Ty2
ccacccgcuauga

SEQ ID NO: 1772983 - RNA, 16 nt, Salmonella enterica enterica serovar Typhi Ty2
ccaccagcuuaucuga

SEQ ID NO: 1772984 - RNA, 19 nt, Salmonella enterica enterica serovar Typhi Ty2
ccaccagcgccaggccauu

SEQ ID NO: 1772985 - RNA, 22 nt, Salmonella enterica enterica serovar Typhi Ty2
ccaccagcgccauaauccagaa

SEQ ID NO: 1772986 - RNA, 18 nt, Salmonella enterica enterica serovar Typhi Ty2
ccaccagcgccagcggcu

SEQ ID NO: 1772987 - RNA, 12 nt, Salmonella enterica enterica serovar Typhi Ty2
ccaccagcgcca

SEQ ID NO: 1772988 - RNA, 23 nt, Salmonella enterica enterica serovar Typhi Ty2
ccacccauuuauguuugcccagc

SEQ ID NO: 1772989 - RNA, 16 nt, Salmonella enterica enterica serovar Typhi Ty2
ccacccauuuuccgcu

SEQ ID NO: 1772990 - RNA, 23 nt, Salmonella enterica enterica serovar Typhi Ty2
ccaccagccgauaacucuucauc

SEQ ID NO: 1772991 - RNA, 18 nt, Salmonella enterica enterica serovar Typhi Ty2
ccaccagccggagccggu

SEQ ID NO: 1772992 - RNA, 23 nt, Salmonella enterica enterica serovar Typhi Ty2
ccaccagcccaucuuucgccagc

SEQ ID NO: 1772993 - RNA, 12 nt, Salmonella enterica enterica serovar Typhi Ty2
ccaccacaaagc

SEQ ID NO: 1772994 - RNA, 21 nt, Salmonella enterica enterica serovar Typhi Ty2
ccaccuggcccugcaucagcu

SEQ ID NO: 1772995 - RNA, 13 nt, Salmonella enterica enterica serovar Typhi Ty2
ccaccugcgcguu

SEQ ID NO: 1772996 - RNA, 18 nt, Salmonella enterica enterica serovar Typhi Ty2
ccaccuggcccugcauca

SEQ ID NO: 1772997 - RNA, 19 nt, Salmonella enterica enterica serovar Typhi Ty2
ccaccuucucuuuaugcgu

SEQ ID NO: 1772998 - RNA, 18 nt, Salmonella enterica enterica serovar Typhi Ty2
ccaccuuaaacuugccgu

SEQ ID NO: 1772999 - RNA, 18 nt, Salmonella enterica enterica serovar Typhi Ty2
ccacgaaaauuauuuucg

SEQ ID NO: 1773000 - RNA, 15 nt, Salmonella enterica enterica serovar Typhi Ty2
ccacgaaaauuauuu

SEQ ID NO: 1773001 - RNA, 17 nt, Salmonella enterica enterica serovar Typhi Ty2
ccacgcaggcgaccucg

SEQ ID NO: 1773002 - RNA, 11 nt, Salmonella enterica enterica serovar Typhi Ty2
ccacgcagccg

SEQ ID NO: 1773003 - RNA, 15 nt, Salmonella enterica enterica serovar Typhi Ty2
ccacgcagcgcagac

SEQ ID NO: 1773004 - RNA, 17 nt, Salmonella enterica enterica serovar Typhi Ty2
ccacgaacgauauaaaa

SEQ ID NO: 1773005 - RNA, 20 nt, Salmonella enterica enterica serovar Typhi Ty2
ccacgaacgauauaaaaacc

SEQ ID NO: 1773006 - RNA, 15 nt, Salmonella enterica enterica serovar Typhi Ty2
ccaccgcuccgcgca

SEQ ID NO: 1773007 - RNA, 23 nt, Salmonella enterica enterica serovar Typhi Ty2
ccaccggagcggcguccgccagc

SEQ ID NO: 1773008 - RNA, 21 nt, Salmonella enterica enterica serovar Typhi Ty2
ccaccguuuaaucgcccugcg

SEQ ID NO: 1773009 - RNA, 19 nt, Salmonella enterica enterica serovar Typhi Ty2
ccaaccaucggcacacuuu

SEQ ID NO: 1773010 - RNA, 16 nt, Salmonella enterica enterica serovar Typhi Ty2
ccaaccaggcaaacca

SEQ ID NO: 1773011 - RNA, 18 nt, Salmonella enterica enterica serovar Typhi Ty2
ccaacagcaauguuucaa

SEQ ID NO: 1773012 - RNA, 18 nt, Salmonella enterica enterica serovar Typhi Ty2
ccaacacggcgcucagga

SEQ ID NO: 1773013 - RNA, 12 nt, Salmonella enterica enterica serovar Typhi Ty2
ccaacaccagcc

SEQ ID NO: 1773014 - RNA, 19 nt, Salmonella enterica enterica serovar Typhi Ty2
ccaacacaucgacaugcag

SEQ ID NO: 1773015 - RNA, 15 nt, Salmonella enterica enterica serovar Typhi Ty2
ccaaauaacccaggg

SEQ ID NO: 1773016 - RNA, 19 nt, Salmonella enterica enterica serovar Typhi Ty2
ccaaagugguuccaggcgc

SEQ ID NO: 1773017 - RNA, 13 nt, Salmonella enterica enterica serovar Typhi Ty2
ccaaaugcccagc

SEQ ID NO: 1773018 - RNA, 21 nt, Salmonella enterica enterica serovar Typhi Ty2
ccaaaugccugccguuuuuaa

SEQ ID NO: 1773019 - RNA, 22 nt, Salmonella enterica enterica serovar Typhi Ty2
ccaaauaggcgaggaaaacauu

SEQ ID NO: 1773020 - RNA, 14 nt, Salmonella enterica enterica serovar Typhi Ty2
ccaaaguuuuuaaa

SEQ ID NO: 1773021 - RNA, 19 nt, Salmonella enterica enterica serovar Typhi Ty2
ccaaauaaaagccgccgug

SEQ ID NO: 1773022 - RNA, 18 nt, Salmonella enterica enterica serovar Typhi Ty2
ccaaagcgcauccgguaa

SEQ ID NO: 1773023 - RNA, 22 nt, Salmonella enterica enterica serovar Typhi Ty2
ccaaaguuaaucagcgccgucg

SEQ ID NO: 1773024 - RNA, 16 nt, Salmonella enterica enterica serovar Typhi Ty2
ccaaacuuacgcagcu

SEQ ID NO: 1773025 - RNA, 19 nt, Salmonella enterica enterica serovar Typhi Ty2
ccaaagcaaucgccagcgc

SEQ ID NO: 1773026 - RNA, 21 nt, Salmonella enterica enterica serovar Typhi Ty2
ccaaagagcugaauguauaua

SEQ ID NO: 1773027 - RNA, 15 nt, Salmonella enterica enterica serovar Typhi Ty2
ccaaccgaacaauau

SEQ ID NO: 1773028 - RNA, 14 nt, Salmonella enterica enterica serovar Typhi Ty2
ccaaccgccacaau

SEQ ID NO: 1773029 - RNA, 11 nt, Salmonella enterica enterica serovar Typhi Ty2
ccaaccgccag

SEQ ID NO: 1773030 - RNA, 14 nt, Salmonella enterica enterica serovar Typhi Ty2
ccaaccgccagcca

SEQ ID NO: 1773031 - RNA, 15 nt, Salmonella enterica enterica serovar Typhi Ty2
ccaaccgugcuucac

SEQ ID NO: 1773032 - RNA, 17 nt, Salmonella enterica enterica serovar Typhi Ty2
ccaaguaaauuugcugu

SEQ ID NO: 1773033 - RNA, 22 nt, Salmonella enterica enterica serovar Typhi Ty2
ccaagcgcgguaaauuucuuga

SEQ ID NO: 1773034 - RNA, 19 nt, Salmonella enterica enterica serovar Typhi Ty2
ccaaacugcggaauuuuau

SEQ ID NO: 1773035 - RNA, 19 nt, Salmonella enterica enterica serovar Typhi Ty2
ccaaacuggcaaauaaaau

SEQ ID NO: 1773036 - RNA, 22 nt, Salmonella enterica enterica serovar Typhi Ty2
ccaaacuggcugugccaauaac

SEQ ID NO: 1773037 - RNA, 18 nt, Salmonella enterica enterica serovar Typhi Ty2
ccaaacucugaaaaaauu

SEQ ID NO: 1773038 - RNA, 19 nt, Salmonella enterica enterica serovar Typhi Ty2
ccaaacgcggucaggguga

SEQ ID NO: 1773039 - RNA, 19 nt, Salmonella enterica enterica serovar Typhi Ty2
ccaaacgaauuuaaauagc

SEQ ID NO: 1773040 - RNA, 20 nt, Salmonella enterica enterica serovar Typhi Ty2
ccaaaccugagcauauaaau

SEQ ID NO: 1773041 - RNA, 21 nt, Salmonella enterica enterica serovar Typhi Ty2
ccaaaauucacgcuucucugg

SEQ ID NO: 1773042 - RNA, 13 nt, Salmonella enterica enterica serovar Typhi Ty2
ccaaaccagaccc

SEQ ID NO: 1773043 - RNA, 11 nt, Salmonella enterica enterica serovar Typhi Ty2
ccaaaaagaaa

SEQ ID NO: 1773044 - RNA, 14 nt, Salmonella enterica enterica serovar Typhi Ty2
ccaaaaauaaaagg

SEQ ID NO: 1773045 - RNA, 13 nt, Salmonella enterica enterica serovar Typhi Ty2
ccaaaaaccccga

SEQ ID NO: 1773046 - RNA, 16 nt, Salmonella enterica enterica serovar Typhi Ty2
ccaaaacccaccagca

SEQ ID NO: 1773047 - RNA, 16 nt, Salmonella enterica enterica serovar Typhi Ty2
ccaaaauaauaaaaau

SEQ ID NO: 1773048 - RNA, 21 nt, Salmonella enterica enterica serovar Typhi Ty2
ccaaaagguuagguuaaauag

SEQ ID NO: 1773049 - RNA, 19 nt, Salmonella enterica enterica serovar Typhi Ty2
cauuuuucucaggacgcca

SEQ ID NO: 1773050 - RNA, 12 nt, Salmonella enterica enterica serovar Typhi Ty2
cauuuuucucag

SEQ ID NO: 1773051 - RNA, 14 nt, Salmonella enterica enterica serovar Typhi Ty2
cauuuuuucagccu

SEQ ID NO: 1773052 - RNA, 21 nt, Salmonella enterica enterica serovar Typhi Ty2
cauuuuuugacaacaaaaaga

SEQ ID NO: 1773053 - RNA, 20 nt, Salmonella enterica enterica serovar Typhi Ty2
cauuuuuuuugcaugguagu

SEQ ID NO: 1773054 - RNA, 18 nt, Salmonella enterica enterica serovar Typhi Ty2
cauuuuucgcccacaucu

SEQ ID NO: 1773055 - RNA, 14 nt, Salmonella enterica enterica serovar Typhi Ty2
cauuuuuaucagcu

SEQ ID NO: 1773056 - RNA, 22 nt, Salmonella enterica enterica serovar Typhi Ty2
cauuuuguggcggauacgcuuc

SEQ ID NO: 1773057 - RNA, 15 nt, Salmonella enterica enterica serovar Typhi Ty2
cauuuucuuuacgcu

SEQ ID NO: 1773058 - RNA, 18 nt, Salmonella enterica enterica serovar Typhi Ty2
cauuuuggccgcuuuagu

SEQ ID NO: 1773059 - RNA, 21 nt, Salmonella enterica enterica serovar Typhi Ty2
cauuuugcuggaaaaauaaga

SEQ ID NO: 1773060 - RNA, 19 nt, Salmonella enterica enterica serovar Typhi Ty2
cauuuugguuggcgacuuc

SEQ ID NO: 1773061 - RNA, 18 nt, Salmonella enterica enterica serovar Typhi Ty2
cauugaucaggcaaaaau

SEQ ID NO: 1773062 - RNA, 19 nt, Salmonella enterica enterica serovar Typhi Ty2
cauugaugaugaagcugca

SEQ ID NO: 1773063 - RNA, 16 nt, Salmonella enterica enterica serovar Typhi Ty2
cauuuucggcagcgcg

SEQ ID NO: 1773064 - RNA, 18 nt, Salmonella enterica enterica serovar Typhi Ty2
cauugagcauucuacagu

SEQ ID NO: 1773065 - RNA, 18 nt, Salmonella enterica enterica serovar Typhi Ty2
caguaaccgccacagcau

SEQ ID NO: 1773066 - RNA, 21 nt, Salmonella enterica enterica serovar Typhi Ty2
caguaaccuauuuuacaaaau

SEQ ID NO: 1773067 - RNA, 15 nt, Salmonella enterica enterica serovar Typhi Ty2
caguaaccgccacag

SEQ ID NO: 1773068 - RNA, 14 nt, Salmonella enterica enterica serovar Typhi Ty2
caguaacguucuuc

SEQ ID NO: 1773069 - RNA, 15 nt, Salmonella enterica enterica serovar Typhi Ty2
caguaacgcguccaa

SEQ ID NO: 1773070 - RNA, 12 nt, Salmonella enterica enterica serovar Typhi Ty2
caguaaggggau

SEQ ID NO: 1773071 - RNA, 13 nt, Salmonella enterica enterica serovar Typhi Ty2
caguaacugcaaa

SEQ ID NO: 1773072 - RNA, 13 nt, Salmonella enterica enterica serovar Typhi Ty2
caguaaaggggag

SEQ ID NO: 1773073 - RNA, 23 nt, Salmonella enterica enterica serovar Typhi Ty2
caguacaaacaaauaaauccaug

SEQ ID NO: 1773074 - RNA, 18 nt, Salmonella enterica enterica serovar Typhi Ty2
caguacaaacgcaccgcc

SEQ ID NO: 1773075 - RNA, 17 nt, Salmonella enterica enterica serovar Typhi Ty2
caguacagccaaaaaua

SEQ ID NO: 1773076 - RNA, 17 nt, Salmonella enterica enterica serovar Typhi Ty2
caguaccgaaaucauca

SEQ ID NO: 1773077 - RNA, 20 nt, Salmonella enterica enterica serovar Typhi Ty2
caguaauauccccaucccag

SEQ ID NO: 1773078 - RNA, 23 nt, Salmonella enterica enterica serovar Typhi Ty2
caguaauaucgccucccugccua

SEQ ID NO: 1773079 - RNA, 22 nt, Salmonella enterica enterica serovar Typhi Ty2
caguaauauaaccaauuuaaaa

SEQ ID NO: 1773080 - RNA, 21 nt, Salmonella enterica enterica serovar Typhi Ty2
caguaagucgccgcagcucca

SEQ ID NO: 1773081 - RNA, 21 nt, Salmonella enterica enterica serovar Typhi Ty2
caguaauauaaccaauuuaaa

SEQ ID NO: 1773082 - RNA, 22 nt, Salmonella enterica enterica serovar Typhi Ty2
caguaauuuuucucccagcaga

SEQ ID NO: 1773083 - RNA, 14 nt, Salmonella enterica enterica serovar Typhi Ty2
caguaauuuuucuc

SEQ ID NO: 1773084 - RNA, 20 nt, Salmonella enterica enterica serovar Typhi Ty2
caguaauuuuucucccagca

SEQ ID NO: 1773085 - RNA, 18 nt, Salmonella enterica enterica serovar Typhi Ty2
caguaauuuuuccgccuc

SEQ ID NO: 1773086 - RNA, 13 nt, Salmonella enterica enterica serovar Typhi Ty2
caguaauuuuucc

SEQ ID NO: 1773087 - RNA, 18 nt, Salmonella enterica enterica serovar Typhi Ty2
caguaauguccagauuac

SEQ ID NO: 1773088 - RNA, 16 nt, Salmonella enterica enterica serovar Typhi Ty2
caguaaucgcacggcu

SEQ ID NO: 1773089 - RNA, 23 nt, Salmonella enterica enterica serovar Typhi Ty2
caguaauggacagguaaaccggu

SEQ ID NO: 1773090 - RNA, 19 nt, Salmonella enterica enterica serovar Typhi Ty2
cagguugcguccgccgcua

SEQ ID NO: 1773091 - RNA, 19 nt, Salmonella enterica enterica serovar Typhi Ty2
cagguugcguaacgccaca

SEQ ID NO: 1773092 - RNA, 18 nt, Salmonella enterica enterica serovar Typhi Ty2
cagguugccagaaacaac

SEQ ID NO: 1773093 - RNA, 22 nt, Salmonella enterica enterica serovar Typhi Ty2
cagguucccgcccugcccgcca

SEQ ID NO: 1773094 - RNA, 17 nt, Salmonella enterica enterica serovar Typhi Ty2
cagguucccgcccugcc

SEQ ID NO: 1773095 - RNA, 22 nt, Salmonella enterica enterica serovar Typhi Ty2
cagguuuacguagcagcgcgcg

SEQ ID NO: 1773096 - RNA, 17 nt, Salmonella enterica enterica serovar Typhi Ty2
cagguuuacguagcagc

SEQ ID NO: 1773097 - RNA, 21 nt, Salmonella enterica enterica serovar Typhi Ty2
cagguuuacccugauuuucaa

SEQ ID NO: 1773098 - RNA, 16 nt, Salmonella enterica enterica serovar Typhi Ty2
cagguugugcaucucc

SEQ ID NO: 1773099 - RNA, 15 nt, Salmonella enterica enterica serovar Typhi Ty2
cagguuuuuaagcug

SEQ ID NO: 1773100 - RNA, 22 nt, Salmonella enterica enterica serovar Typhi Ty2
cagguuuuuugugaguucauaa

SEQ ID NO: 1773101 - RNA, 13 nt, Salmonella enterica enterica serovar Typhi Ty2
caguaaaaaaacg

SEQ ID NO: 1773102 - RNA, 18 nt, Salmonella enterica enterica serovar Typhi Ty2
cagguuucuggcaacagc

SEQ ID NO: 1773103 - RNA, 20 nt, Salmonella enterica enterica serovar Typhi Ty2
cagguuucuggcaacagcca

SEQ ID NO: 1773104 - RNA, 13 nt, Salmonella enterica enterica serovar Typhi Ty2
cagguuuuacuuc

SEQ ID NO: 1773105 - RNA, 16 nt, Salmonella enterica enterica serovar Typhi Ty2
aaacaaauaaauccau

SEQ ID NO: 1773106 - RNA, 19 nt, Salmonella enterica enterica serovar Typhi Ty2
aaacaacaaaguauaaagc

SEQ ID NO: 1773107 - RNA, 23 nt, Salmonella enterica enterica serovar Typhi Ty2
caggucgaugaggauauugguau

SEQ ID NO: 1773108 - RNA, 13 nt, Salmonella enterica enterica serovar Typhi Ty2
caggucgcucuuu

SEQ ID NO: 1773109 - RNA, 16 nt, Salmonella enterica enterica serovar Typhi Ty2
caggucggccaaccgc

SEQ ID NO: 1773110 - RNA, 21 nt, Salmonella enterica enterica serovar Typhi Ty2
caggucguccguugccaccca

SEQ ID NO: 1773111 - RNA, 20 nt, Salmonella enterica enterica serovar Typhi Ty2
cagguauuuagccacgccgu

SEQ ID NO: 1773112 - RNA, 24 nt, Salmonella enterica enterica serovar Typhi Ty2
cagguauuucgaggggcaggaagg

SEQ ID NO: 1773113 - RNA, 13 nt, Salmonella enterica enterica serovar Typhi Ty2
cagguauucuaac

SEQ ID NO: 1773114 - RNA, 21 nt, Salmonella enterica enterica serovar Typhi Ty2
caggggcuauugaaaaagccg

SEQ ID NO: 1773115 - RNA, 17 nt, Salmonella enterica enterica serovar Typhi Ty2
cagggguguuacgccau

SEQ ID NO: 1773116 - RNA, 23 nt, Salmonella enterica enterica serovar Typhi Ty2
caggggggaaaugagaaaaggaa

SEQ ID NO: 1773117 - RNA, 24 nt, Salmonella enterica enterica serovar Typhi Ty2
cagggggauagcgacggggcgcag

SEQ ID NO: 1773118 - RNA, 19 nt, Salmonella enterica enterica serovar Typhi Ty2
caggucaucaccuccagca

SEQ ID NO: 1773119 - RNA, 23 nt, Salmonella enterica enterica serovar Typhi Ty2
caggucaucaccuccagcacgcg

SEQ ID NO: 1773120 - RNA, 11 nt, Salmonella enterica enterica serovar Typhi Ty2
cagguggaucc

SEQ ID NO: 1773121 - RNA, 22 nt, Salmonella enterica enterica serovar Typhi Ty2
cagguggauuuuugcugguugu

SEQ ID NO: 1773122 - RNA, 18 nt, Salmonella enterica enterica serovar Typhi Ty2
cagguggaucccccuggc

SEQ ID NO: 1773123 - RNA, 12 nt, Salmonella enterica enterica serovar Typhi Ty2
cagguuaacucc

SEQ ID NO: 1773124 - RNA, 15 nt, Salmonella enterica enterica serovar Typhi Ty2
cagguuaaucagcac

SEQ ID NO: 1773125 - RNA, 23 nt, Salmonella enterica enterica serovar Typhi Ty2
cagguguuauucgcccaaaugca

SEQ ID NO: 1773126 - RNA, 17 nt, Salmonella enterica enterica serovar Typhi Ty2
cagguuaaagccucuuu

SEQ ID NO: 1773127 - RNA, 18 nt, Salmonella enterica enterica serovar Typhi Ty2
caggugucguuaaugcuc

SEQ ID NO: 1773128 - RNA, 20 nt, Salmonella enterica enterica serovar Typhi Ty2
cagguuauauuccgccucgu

SEQ ID NO: 1773129 - RNA, 13 nt, Salmonella enterica enterica serovar Typhi Ty2
cagguuagcagcc

SEQ ID NO: 1773130 - RNA, 20 nt, Salmonella enterica enterica serovar Typhi Ty2
cagguuacucuuccaccauc

SEQ ID NO: 1773131 - RNA, 17 nt, Salmonella enterica enterica serovar Typhi Ty2
cagguuauuguugcuac

SEQ ID NO: 1773132 - RNA, 12 nt, Salmonella enterica enterica serovar Typhi Ty2
cagguucagcaa

SEQ ID NO: 1773133 - RNA, 15 nt, Salmonella enterica enterica serovar Typhi Ty2
caggugcggcugggc

SEQ ID NO: 1773134 - RNA, 13 nt, Salmonella enterica enterica serovar Typhi Ty2
caggugcugccac

SEQ ID NO: 1773135 - RNA, 16 nt, Salmonella enterica enterica serovar Typhi Ty2
caggugcugccacauc

SEQ ID NO: 1773136 - RNA, 22 nt, Salmonella enterica enterica serovar Typhi Ty2
caggugauugcccuccagccau

SEQ ID NO: 1773137 - RNA, 13 nt, Salmonella enterica enterica serovar Typhi Ty2
caggugaccaggc

SEQ ID NO: 1773138 - RNA, 14 nt, Salmonella enterica enterica serovar Typhi Ty2
caggucugcaccac

SEQ ID NO: 1773139 - RNA, 17 nt, Salmonella enterica enterica serovar Typhi Ty2
caggugaucuguucaaa

SEQ ID NO: 1773140 - RNA, 18 nt, Salmonella enterica enterica serovar Typhi Ty2
caguagauggcgcuaaaa

SEQ ID NO: 1773141 - RNA, 17 nt, Salmonella enterica enterica serovar Typhi Ty2
caguacuuucuuuugau

SEQ ID NO: 1773142 - RNA, 22 nt, Salmonella enterica enterica serovar Typhi Ty2
caguacgucaacaaugcuuuca

SEQ ID NO: 1773143 - RNA, 17 nt, Salmonella enterica enterica serovar Typhi Ty2
caguaccgccuucagcg

SEQ ID NO: 1773144 - RNA, 17 nt, Salmonella enterica enterica serovar Typhi Ty2
caguacccgcacgcuuu

SEQ ID NO: 1773145 - RNA, 22 nt, Salmonella enterica enterica serovar Typhi Ty2
caguaccgggccuccuuuccug

SEQ ID NO: 1773146 - RNA, 22 nt, Salmonella enterica enterica serovar Typhi Ty2
caguaccgccuucagcgcgccc

SEQ ID NO: 1773147 - RNA, 17 nt, Salmonella enterica enterica serovar Typhi Ty2
caguaccggcaggacaa

SEQ ID NO: 1773148 - RNA, 22 nt, Salmonella enterica enterica serovar Typhi Ty2
caguaccugacuuuuccauacu

SEQ ID NO: 1773149 - RNA, 11 nt, Salmonella enterica enterica serovar Typhi Ty2
caguaccuuua

SEQ ID NO: 1773150 - RNA, 15 nt, Salmonella enterica enterica serovar Typhi Ty2
caguacgcccgccuc

SEQ ID NO: 1773151 - RNA, 21 nt, Salmonella enterica enterica serovar Typhi Ty2
caguacgcccgugacgccagg

SEQ ID NO: 1773152 - RNA, 15 nt, Salmonella enterica enterica serovar Typhi Ty2
caguacgcugccauc

SEQ ID NO: 1773153 - RNA, 22 nt, Salmonella enterica enterica serovar Typhi Ty2
caguagcgcgacgccaaaccug

SEQ ID NO: 1773154 - RNA, 13 nt, Salmonella enterica enterica serovar Typhi Ty2
caguagcgcgccc

SEQ ID NO: 1773155 - RNA, 13 nt, Salmonella enterica enterica serovar Typhi Ty2
caguaguaaaccg

SEQ ID NO: 1773156 - RNA, 21 nt, Salmonella enterica enterica serovar Typhi Ty2
caguaggcgaacuucauccac

SEQ ID NO: 1773157 - RNA, 12 nt, Salmonella enterica enterica serovar Typhi Ty2
caguagccaugc

SEQ ID NO: 1773158 - RNA, 16 nt, Salmonella enterica enterica serovar Typhi Ty2
caguagcagacagccg

SEQ ID NO: 1773159 - RNA, 22 nt, Salmonella enterica enterica serovar Typhi Ty2
caguaguuaccguaaucaucgc

SEQ ID NO: 1773160 - RNA, 20 nt, Salmonella enterica enterica serovar Typhi Ty2
caguagucgcgccauuccgc

SEQ ID NO: 1773161 - RNA, 12 nt, Salmonella enterica enterica serovar Typhi Ty2
caguagugagcc

SEQ ID NO: 1773162 - RNA, 22 nt, Salmonella enterica enterica serovar Typhi Ty2
caguaguugaccugaucggcca

SEQ ID NO: 1773163 - RNA, 15 nt, Salmonella enterica enterica serovar Typhi Ty2
caguauaaauaccuu

SEQ ID NO: 1773164 - RNA, 21 nt, Salmonella enterica enterica serovar Typhi Ty2
caguccccagcguaccacgcc

SEQ ID NO: 1773165 - RNA, 22 nt, Salmonella enterica enterica serovar Typhi Ty2
cagucccaaugcggaaaccagu

SEQ ID NO: 1773166 - RNA, 12 nt, Salmonella enterica enterica serovar Typhi Ty2
caguccagaugc

SEQ ID NO: 1773167 - RNA, 22 nt, Salmonella enterica enterica serovar Typhi Ty2
caguccagccgccgcgcggcag

SEQ ID NO: 1773168 - RNA, 17 nt, Salmonella enterica enterica serovar Typhi Ty2
cagucaucgcgccaaac

SEQ ID NO: 1773169 - RNA, 19 nt, Salmonella enterica enterica serovar Typhi Ty2
caguccaccuguaaccgcu

SEQ ID NO: 1773170 - RNA, 16 nt, Salmonella enterica enterica serovar Typhi Ty2
cagucagaggaauucu

SEQ ID NO: 1773171 - RNA, 11 nt, Salmonella enterica enterica serovar Typhi Ty2
cagucagcucc

SEQ ID NO: 1773172 - RNA, 15 nt, Salmonella enterica enterica serovar Typhi Ty2
cagucauggcuuuua

SEQ ID NO: 1773173 - RNA, 23 nt, Salmonella enterica enterica serovar Typhi Ty2
cagucaugaaaucgauuuguuua

SEQ ID NO: 1773174 - RNA, 17 nt, Salmonella enterica enterica serovar Typhi Ty2
cagucauuugcagguua

SEQ ID NO: 1773175 - RNA, 12 nt, Salmonella enterica enterica serovar Typhi Ty2
cagucaguuuau

SEQ ID NO: 1773176 - RNA, 14 nt, Salmonella enterica enterica serovar Typhi Ty2
cagucaucgccgcu

SEQ ID NO: 1773177 - RNA, 20 nt, Salmonella enterica enterica serovar Typhi Ty2
caguauugccgaugccugcg

SEQ ID NO: 1773178 - RNA, 16 nt, Salmonella enterica enterica serovar Typhi Ty2
caguauugccgaugcc

SEQ ID NO: 1773179 - RNA, 18 nt, Salmonella enterica enterica serovar Typhi Ty2
cagucacccugcccugca

SEQ ID NO: 1773180 - RNA, 12 nt, Salmonella enterica enterica serovar Typhi Ty2
cagucgcgccgu

SEQ ID NO: 1773181 - RNA, 19 nt, Salmonella enterica enterica serovar Typhi Ty2
cagucgccagaaggcaggc

SEQ ID NO: 1773182 - RNA, 16 nt, Salmonella enterica enterica serovar Typhi Ty2
cagucgcagagcccag

SEQ ID NO: 1773183 - RNA, 23 nt, Salmonella enterica enterica serovar Typhi Ty2
cagucgcucuaucgccuggagcu

SEQ ID NO: 1773184 - RNA, 14 nt, Salmonella enterica enterica serovar Typhi Ty2
cagucgcuccacca

SEQ ID NO: 1773185 - RNA, 21 nt, Salmonella enterica enterica serovar Typhi Ty2
cagucggcaaagaccaauaaa

SEQ ID NO: 1773186 - RNA, 16 nt, Salmonella enterica enterica serovar Typhi Ty2
cagucguugcgccugu

SEQ ID NO: 1773187 - RNA, 16 nt, Salmonella enterica enterica serovar Typhi Ty2
caguccgcacgccugc

SEQ ID NO: 1773188 - RNA, 19 nt, Salmonella enterica enterica serovar Typhi Ty2
caguccgcgcgcuuuuuug

SEQ ID NO: 1773189 - RNA, 17 nt, Salmonella enterica enterica serovar Typhi Ty2
caguccgggcauaaccu

SEQ ID NO: 1773190 - RNA, 21 nt, Salmonella enterica enterica serovar Typhi Ty2
caguccgguggcgaaaacgcu

SEQ ID NO: 1773191 - RNA, 23 nt, Salmonella enterica enterica serovar Typhi Ty2
cagucgaacauccuugcacgcca

SEQ ID NO: 1773192 - RNA, 20 nt, Salmonella enterica enterica serovar Typhi Ty2
cagucgauguggccuuccuc

SEQ ID NO: 1773193 - RNA, 14 nt, Salmonella enterica enterica serovar Typhi Ty2
caguccugucccug

SEQ ID NO: 1773194 - RNA, 14 nt, Salmonella enterica enterica serovar Typhi Ty2
caguccucgcccac

SEQ ID NO: 1773195 - RNA, 16 nt, Salmonella enterica enterica serovar Typhi Ty2
caguccuccggcugaa

SEQ ID NO: 1773196 - RNA, 15 nt, Salmonella enterica enterica serovar Typhi Ty2
cagugaguaacguua

SEQ ID NO: 1773197 - RNA, 17 nt, Salmonella enterica enterica serovar Typhi Ty2
cagugagcccuccucca

SEQ ID NO: 1773198 - RNA, 20 nt, Salmonella enterica enterica serovar Typhi Ty2
cagugauccaucgguucucu

SEQ ID NO: 1773199 - RNA, 14 nt, Salmonella enterica enterica serovar Typhi Ty2
cagugacccgccgc

SEQ ID NO: 1773200 - RNA, 16 nt, Salmonella enterica enterica serovar Typhi Ty2
cagugacccgccgcca

SEQ ID NO: 1773201 - RNA, 16 nt, Salmonella enterica enterica serovar Typhi Ty2
cagugacgccaguucc

SEQ ID NO: 1773202 - RNA, 16 nt, Salmonella enterica enterica serovar Typhi Ty2
cagugauggauuucac

SEQ ID NO: 1773203 - RNA, 21 nt, Salmonella enterica enterica serovar Typhi Ty2
cagugaugaaucgcuauugag

SEQ ID NO: 1773204 - RNA, 23 nt, Salmonella enterica enterica serovar Typhi Ty2
cagugauucgcgaaucgcuucac

SEQ ID NO: 1773205 - RNA, 22 nt, Salmonella enterica enterica serovar Typhi Ty2
cagugauuuacuccaaaaauaa

SEQ ID NO: 1773206 - RNA, 19 nt, Salmonella enterica enterica serovar Typhi Ty2
cagugcaggauuuguauca

SEQ ID NO: 1773207 - RNA, 16 nt, Salmonella enterica enterica serovar Typhi Ty2
cagugcagaaagugug

SEQ ID NO: 1773208 - RNA, 17 nt, Salmonella enterica enterica serovar Typhi Ty2
cagugaaaaaccgaucu

SEQ ID NO: 1773209 - RNA, 15 nt, Salmonella enterica enterica serovar Typhi Ty2
cagugaaaagcugga

SEQ ID NO: 1773210 - RNA, 19 nt, Salmonella enterica enterica serovar Typhi Ty2
cagucugcagaccuguucu

SEQ ID NO: 1773211 - RNA, 13 nt, Salmonella enterica enterica serovar Typhi Ty2
cagucugcccggc

SEQ ID NO: 1773212 - RNA, 16 nt, Salmonella enterica enterica serovar Typhi Ty2
cagucuggcggcagcc

SEQ ID NO: 1773213 - RNA, 18 nt, Salmonella enterica enterica serovar Typhi Ty2
cagugaauuaugaccaau

SEQ ID NO: 1773214 - RNA, 22 nt, Salmonella enterica enterica serovar Typhi Ty2
cagugaauauccccugacagag

SEQ ID NO: 1773215 - RNA, 15 nt, Salmonella enterica enterica serovar Typhi Ty2
cagugacauuuaucu

SEQ ID NO: 1773216 - RNA, 17 nt, Salmonella enterica enterica serovar Typhi Ty2
cagugacagaggaauga

SEQ ID NO: 1773217 - RNA, 21 nt, Salmonella enterica enterica serovar Typhi Ty2
cagugacaaacucacguuccc

SEQ ID NO: 1773218 - RNA, 19 nt, Salmonella enterica enterica serovar Typhi Ty2
cagugaaaccggcgcgccu

SEQ ID NO: 1773219 - RNA, 19 nt, Salmonella enterica enterica serovar Typhi Ty2
cagugaaacgggugagguc

SEQ ID NO: 1773220 - RNA, 13 nt, Salmonella enterica enterica serovar Typhi Ty2
cagugaaauaaau

SEQ ID NO: 1773221 - RNA, 16 nt, Salmonella enterica enterica serovar Typhi Ty2
cagugaacacccugcc

SEQ ID NO: 1773222 - RNA, 18 nt, Salmonella enterica enterica serovar Typhi Ty2
caggccucugcuuuucuc

SEQ ID NO: 1773223 - RNA, 16 nt, Salmonella enterica enterica serovar Typhi Ty2
caggccuccugacgaa

SEQ ID NO: 1773224 - RNA, 22 nt, Salmonella enterica enterica serovar Typhi Ty2
caggccggauggcggcuuugaa

SEQ ID NO: 1773225 - RNA, 19 nt, Salmonella enterica enterica serovar Typhi Ty2
caggcgauagccguccaug

SEQ ID NO: 1773226 - RNA, 17 nt, Salmonella enterica enterica serovar Typhi Ty2
caggcgauuacaacgcg

SEQ ID NO: 1773227 - RNA, 19 nt, Salmonella enterica enterica serovar Typhi Ty2
caggccugauaagcgcagc

SEQ ID NO: 1773228 - RNA, 19 nt, Salmonella enterica enterica serovar Typhi Ty2
caggccugaugagcgcagc

SEQ ID NO: 1773229 - RNA, 22 nt, Salmonella enterica enterica serovar Typhi Ty2
caggccugcauuugcuggcgug

SEQ ID NO: 1773230 - RNA, 16 nt, Salmonella enterica enterica serovar Typhi Ty2
caggccugguuaacaa

SEQ ID NO: 1773231 - RNA, 13 nt, Salmonella enterica enterica serovar Typhi Ty2
caggccgccaccg

SEQ ID NO: 1773232 - RNA, 14 nt, Salmonella enterica enterica serovar Typhi Ty2
caggccgccaccgc

SEQ ID NO: 1773233 - RNA, 17 nt, Salmonella enterica enterica serovar Typhi Ty2
caggccgccaccgccuc

SEQ ID NO: 1773234 - RNA, 15 nt, Salmonella enterica enterica serovar Typhi Ty2
caggccggauaagag

SEQ ID NO: 1773235 - RNA, 21 nt, Salmonella enterica enterica serovar Typhi Ty2
caggccggauaaggcagcaau

SEQ ID NO: 1773236 - RNA, 14 nt, Salmonella enterica enterica serovar Typhi Ty2
caggccgcgccgcu

SEQ ID NO: 1773237 - RNA, 15 nt, Salmonella enterica enterica serovar Typhi Ty2
caggccgcgccgcug

SEQ ID NO: 1773238 - RNA, 14 nt, Salmonella enterica enterica serovar Typhi Ty2
caggccgcgcugau

SEQ ID NO: 1773239 - RNA, 20 nt, Salmonella enterica enterica serovar Typhi Ty2
caggccauuuuuucgaugau

SEQ ID NO: 1773240 - RNA, 19 nt, Salmonella enterica enterica serovar Typhi Ty2
caggccagaauucagcaug

SEQ ID NO: 1773241 - RNA, 23 nt, Salmonella enterica enterica serovar Typhi Ty2
caggccagauauugccgaccauu

SEQ ID NO: 1773242 - RNA, 14 nt, Salmonella enterica enterica serovar Typhi Ty2
caggaucuucaucc

SEQ ID NO: 1773243 - RNA, 21 nt, Salmonella enterica enterica serovar Typhi Ty2
caggaucaaaaucgcgcccca

SEQ ID NO: 1773244 - RNA, 22 nt, Salmonella enterica enterica serovar Typhi Ty2
caggauaguacugaccagacag

SEQ ID NO: 1773245 - RNA, 22 nt, Salmonella enterica enterica serovar Typhi Ty2
caggauauuuugcucauauugu

SEQ ID NO: 1773246 - RNA, 14 nt, Salmonella enterica enterica serovar Typhi Ty2
caggcauuaaaaaa

SEQ ID NO: 1773247 - RNA, 17 nt, Salmonella enterica enterica serovar Typhi Ty2
caggcauggcagcaggg

SEQ ID NO: 1773248 - RNA, 12 nt, Salmonella enterica enterica serovar Typhi Ty2
caggcauggcca

SEQ ID NO: 1773249 - RNA, 22 nt, Salmonella enterica enterica serovar Typhi Ty2
caggcaucaacguuguccagcg

SEQ ID NO: 1773250 - RNA, 16 nt, Salmonella enterica enterica serovar Typhi Ty2
caggaugccaaccacc

SEQ ID NO: 1773251 - RNA, 16 nt, Salmonella enterica enterica serovar Typhi Ty2
caggcauccugcccug

SEQ ID NO: 1773252 - RNA, 18 nt, Salmonella enterica enterica serovar Typhi Ty2
caggcaucgacgccagcg

SEQ ID NO: 1773253 - RNA, 16 nt, Salmonella enterica enterica serovar Typhi Ty2
caggcaucgacgccag

SEQ ID NO: 1773254 - RNA, 17 nt, Salmonella enterica enterica serovar Typhi Ty2
cagggcggccuccuggc

SEQ ID NO: 1773255 - RNA, 14 nt, Salmonella enterica enterica serovar Typhi Ty2
cagggcggcgcgcu

SEQ ID NO: 1773256 - RNA, 22 nt, Salmonella enterica enterica serovar Typhi Ty2
cagggcggcaaaaucuuuuucg

SEQ ID NO: 1773257 - RNA, 20 nt, Salmonella enterica enterica serovar Typhi Ty2
aaaauuuuuuaucagguugu

SEQ ID NO: 1773258 - RNA, 13 nt, Salmonella enterica enterica serovar Typhi Ty2
cagggcggaagca

SEQ ID NO: 1773259 - RNA, 14 nt, Salmonella enterica enterica serovar Typhi Ty2
cagggcguaagcgc

SEQ ID NO: 1773260 - RNA, 19 nt, Salmonella enterica enterica serovar Typhi Ty2
cagggcugaaucggcaccu

SEQ ID NO: 1773261 - RNA, 18 nt, Salmonella enterica enterica serovar Typhi Ty2
cagggccgcgagaacuuc

SEQ ID NO: 1773262 - RNA, 15 nt, Salmonella enterica enterica serovar Typhi Ty2
cagggcaucaugaug

SEQ ID NO: 1773263 - RNA, 15 nt, Salmonella enterica enterica serovar Typhi Ty2
cagggcaggcaguga

SEQ ID NO: 1773264 - RNA, 14 nt, Salmonella enterica enterica serovar Typhi Ty2
cagggacuuauuaa

SEQ ID NO: 1773265 - RNA, 20 nt, Salmonella enterica enterica serovar Typhi Ty2
cagggacgauaggcgcguca

SEQ ID NO: 1773266 - RNA, 19 nt, Salmonella enterica enterica serovar Typhi Ty2
cagggacgcauccugcacu

SEQ ID NO: 1773267 - RNA, 20 nt, Salmonella enterica enterica serovar Typhi Ty2
cagggagacggccacccauc

SEQ ID NO: 1773268 - RNA, 13 nt, Salmonella enterica enterica serovar Typhi Ty2
caggcggucaucg

SEQ ID NO: 1773269 - RNA, 18 nt, Salmonella enterica enterica serovar Typhi Ty2
caggcgguauuucauaau

SEQ ID NO: 1773270 - RNA, 14 nt, Salmonella enterica enterica serovar Typhi Ty2
caggcgcaggcauu

SEQ ID NO: 1773271 - RNA, 22 nt, Salmonella enterica enterica serovar Typhi Ty2
caggcgucauagccgcgcguca

SEQ ID NO: 1773272 - RNA, 19 nt, Salmonella enterica enterica serovar Typhi Ty2
caggcgucauagccgcgcg

SEQ ID NO: 1773273 - RNA, 20 nt, Salmonella enterica enterica serovar Typhi Ty2
caggcgucagcauggugugu

SEQ ID NO: 1773274 - RNA, 21 nt, Salmonella enterica enterica serovar Typhi Ty2
caggcgucaaaacaggucugu

SEQ ID NO: 1773275 - RNA, 17 nt, Salmonella enterica enterica serovar Typhi Ty2
caggcguagagaggcau

SEQ ID NO: 1773276 - RNA, 17 nt, Salmonella enterica enterica serovar Typhi Ty2
caggcguaagaucccag

SEQ ID NO: 1773277 - RNA, 22 nt, Salmonella enterica enterica serovar Typhi Ty2
caggcuccgcgcagggugaaga

SEQ ID NO: 1773278 - RNA, 19 nt, Salmonella enterica enterica serovar Typhi Ty2
caggcucaggaaaacaaau

SEQ ID NO: 1773279 - RNA, 15 nt, Salmonella enterica enterica serovar Typhi Ty2
caggcucaccagccc

SEQ ID NO: 1773280 - RNA, 14 nt, Salmonella enterica enterica serovar Typhi Ty2
caggcucagcgcca

SEQ ID NO: 1773281 - RNA, 19 nt, Salmonella enterica enterica serovar Typhi Ty2
caggcugguggagagcagu

SEQ ID NO: 1773282 - RNA, 15 nt, Salmonella enterica enterica serovar Typhi Ty2
caggcuggagagcaa

SEQ ID NO: 1773283 - RNA, 12 nt, Salmonella enterica enterica serovar Typhi Ty2
caggcuggaaau

SEQ ID NO: 1773284 - RNA, 15 nt, Salmonella enterica enterica serovar Typhi Ty2
caggcuguugcgcau

SEQ ID NO: 1773285 - RNA, 14 nt, Salmonella enterica enterica serovar Typhi Ty2
caggcugucugcca

SEQ ID NO: 1773286 - RNA, 17 nt, Salmonella enterica enterica serovar Typhi Ty2
caggcuuaacacccgga

SEQ ID NO: 1773287 - RNA, 19 nt, Salmonella enterica enterica serovar Typhi Ty2
cagggaauacccgcccggu

SEQ ID NO: 1773288 - RNA, 19 nt, Salmonella enterica enterica serovar Typhi Ty2
cagggaacguugcgccaug

SEQ ID NO: 1773289 - RNA, 15 nt, Salmonella enterica enterica serovar Typhi Ty2
caggcuuccagauac

SEQ ID NO: 1773290 - RNA, 22 nt, Salmonella enterica enterica serovar Typhi Ty2
caggcuucaucggauagaugaa

SEQ ID NO: 1773291 - RNA, 21 nt, Salmonella enterica enterica serovar Typhi Ty2
caggcuucaucggauagauga

SEQ ID NO: 1773292 - RNA, 12 nt, Salmonella enterica enterica serovar Typhi Ty2
caggaacgccau

SEQ ID NO: 1773293 - RNA, 20 nt, Salmonella enterica enterica serovar Typhi Ty2
caggaacagauacuggaagu

SEQ ID NO: 1773294 - RNA, 14 nt, Salmonella enterica enterica serovar Typhi Ty2
caggaaggcgugca

SEQ ID NO: 1773295 - RNA, 13 nt, Salmonella enterica enterica serovar Typhi Ty2
caggaagggcagc

SEQ ID NO: 1773296 - RNA, 15 nt, Salmonella enterica enterica serovar Typhi Ty2
caggaauaaagguca

SEQ ID NO: 1773297 - RNA, 18 nt, Salmonella enterica enterica serovar Typhi Ty2
caggacgagagacugaua

SEQ ID NO: 1773298 - RNA, 17 nt, Salmonella enterica enterica serovar Typhi Ty2
caggacgccagugaaag

SEQ ID NO: 1773299 - RNA, 15 nt, Salmonella enterica enterica serovar Typhi Ty2
caggacgcuccauca

SEQ ID NO: 1773300 - RNA, 15 nt, Salmonella enterica enterica serovar Typhi Ty2
caggacgcacccugu

SEQ ID NO: 1773301 - RNA, 12 nt, Salmonella enterica enterica serovar Typhi Ty2
caggacgccagu

SEQ ID NO: 1773302 - RNA, 16 nt, Salmonella enterica enterica serovar Typhi Ty2
caggacugacugcugu

SEQ ID NO: 1773303 - RNA, 13 nt, Salmonella enterica enterica serovar Typhi Ty2
caggacugacugc

SEQ ID NO: 1773304 - RNA, 20 nt, Salmonella enterica enterica serovar Typhi Ty2
caggauaauaucgcuggcca

SEQ ID NO: 1773305 - RNA, 18 nt, Salmonella enterica enterica serovar Typhi Ty2
caggagcggguagagcuu

SEQ ID NO: 1773306 - RNA, 12 nt, Salmonella enterica enterica serovar Typhi Ty2
caggauaaagac

SEQ ID NO: 1773307 - RNA, 14 nt, Salmonella enterica enterica serovar Typhi Ty2
caggagcauagaua

SEQ ID NO: 1773308 - RNA, 12 nt, Salmonella enterica enterica serovar Typhi Ty2
caggagcauggu

SEQ ID NO: 1773309 - RNA, 18 nt, Salmonella enterica enterica serovar Typhi Ty2
caggagcaaaccgaccca

SEQ ID NO: 1773310 - RNA, 16 nt, Salmonella enterica enterica serovar Typhi Ty2
caggaacagauacugg

SEQ ID NO: 1773311 - RNA, 14 nt, Salmonella enterica enterica serovar Typhi Ty2
cagcuugcaggcaa

SEQ ID NO: 1773312 - RNA, 15 nt, Salmonella enterica enterica serovar Typhi Ty2
cagcuugcuggccgc

SEQ ID NO: 1773313 - RNA, 22 nt, Salmonella enterica enterica serovar Typhi Ty2
cagcucugccuguagcagcgcc

SEQ ID NO: 1773314 - RNA, 16 nt, Salmonella enterica enterica serovar Typhi Ty2
cagcuuaucuuuuucg

SEQ ID NO: 1773315 - RNA, 18 nt, Salmonella enterica enterica serovar Typhi Ty2
cagcuuaaaucgcggcgc

SEQ ID NO: 1773316 - RNA, 16 nt, Salmonella enterica enterica serovar Typhi Ty2
cagcuuaaaucgcggc

SEQ ID NO: 1773317 - RNA, 19 nt, Salmonella enterica enterica serovar Typhi Ty2
cagcuguuuaagcgccucc

SEQ ID NO: 1773318 - RNA, 20 nt, Salmonella enterica enterica serovar Typhi Ty2
cagcuguuuaagcgccucca

SEQ ID NO: 1773319 - RNA, 18 nt, Salmonella enterica enterica serovar Typhi Ty2
cagcuucagcaucaucuc

SEQ ID NO: 1773320 - RNA, 20 nt, Salmonella enterica enterica serovar Typhi Ty2
cagcuucagcaucaucuccc

SEQ ID NO: 1773321 - RNA, 18 nt, Salmonella enterica enterica serovar Typhi Ty2
cagcgcugucagugaaaa

SEQ ID NO: 1773322 - RNA, 19 nt, Salmonella enterica enterica serovar Typhi Ty2
cagcgcggcguacacuuca

SEQ ID NO: 1773323 - RNA, 15 nt, Salmonella enterica enterica serovar Typhi Ty2
cagcgcuccaccaac

SEQ ID NO: 1773324 - RNA, 23 nt, Salmonella enterica enterica serovar Typhi Ty2
cagcgcuccaccaaccaggcaaa

SEQ ID NO: 1773325 - RNA, 17 nt, Salmonella enterica enterica serovar Typhi Ty2
cagcgcgguuucuacac

SEQ ID NO: 1773326 - RNA, 23 nt, Salmonella enterica enterica serovar Typhi Ty2
cagcgcuccgggguucuuuuuaa

SEQ ID NO: 1773327 - RNA, 22 nt, Salmonella enterica enterica serovar Typhi Ty2
cagcgcugagucauccuucccc

SEQ ID NO: 1773328 - RNA, 20 nt, Salmonella enterica enterica serovar Typhi Ty2
cagcgcugcauuugcugccg

SEQ ID NO: 1773329 - RNA, 14 nt, Salmonella enterica enterica serovar Typhi Ty2
cagcucaacuauua

SEQ ID NO: 1773330 - RNA, 19 nt, Salmonella enterica enterica serovar Typhi Ty2
cagcuauuuuucaccauaa

SEQ ID NO: 1773331 - RNA, 18 nt, Salmonella enterica enterica serovar Typhi Ty2
cagcucaccgagacugcc

SEQ ID NO: 1773332 - RNA, 16 nt, Salmonella enterica enterica serovar Typhi Ty2
cagcucaagcgccgcg

SEQ ID NO: 1773333 - RNA, 17 nt, Salmonella enterica enterica serovar Typhi Ty2
cagcuacuucaggcugu

SEQ ID NO: 1773334 - RNA, 19 nt, Salmonella enterica enterica serovar Typhi Ty2
cagcucagcuuuaaugcuu

SEQ ID NO: 1773335 - RNA, 19 nt, Salmonella enterica enterica serovar Typhi Ty2
cagcucagaaauaaaacca

SEQ ID NO: 1773336 - RNA, 16 nt, Salmonella enterica enterica serovar Typhi Ty2
cagcucauacccuucc

SEQ ID NO: 1773337 - RNA, 17 nt, Salmonella enterica enterica serovar Typhi Ty2
cagcucauacccuucca

SEQ ID NO: 1773338 - RNA, 20 nt, Salmonella enterica enterica serovar Typhi Ty2
cagcucauacccuuccaguu

SEQ ID NO: 1773339 - RNA, 20 nt, Salmonella enterica enterica serovar Typhi Ty2
cagcuccagccgcugccuuc

SEQ ID NO: 1773340 - RNA, 23 nt, Salmonella enterica enterica serovar Typhi Ty2
cagcuccagcucaggguccccau

SEQ ID NO: 1773341 - RNA, 21 nt, Salmonella enterica enterica serovar Typhi Ty2
cagcucauuuuuacagacacg

SEQ ID NO: 1773342 - RNA, 16 nt, Salmonella enterica enterica serovar Typhi Ty2
cagcuccagcucaggg

SEQ ID NO: 1773343 - RNA, 13 nt, Salmonella enterica enterica serovar Typhi Ty2
cagcuccaugucu

SEQ ID NO: 1773344 - RNA, 22 nt, Salmonella enterica enterica serovar Typhi Ty2
cagcuccaugucuugcuaucaa

SEQ ID NO: 1773345 - RNA, 15 nt, Salmonella enterica enterica serovar Typhi Ty2
cagcuccauccacca

SEQ ID NO: 1773346 - RNA, 18 nt, Salmonella enterica enterica serovar Typhi Ty2
cagcucccgcgucacgac

SEQ ID NO: 1773347 - RNA, 22 nt, Salmonella enterica enterica serovar Typhi Ty2
cagcucaugcaagacaucuaac

SEQ ID NO: 1773348 - RNA, 17 nt, Salmonella enterica enterica serovar Typhi Ty2
cagcucaugcgcggcgg

SEQ ID NO: 1773349 - RNA, 17 nt, Salmonella enterica enterica serovar Typhi Ty2
cagcucauuuuuacaga

SEQ ID NO: 1773350 - RNA, 15 nt, Salmonella enterica enterica serovar Typhi Ty2
cacgucgauuuuccc

SEQ ID NO: 1773351 - RNA, 17 nt, Salmonella enterica enterica serovar Typhi Ty2
cacgucugaugcguggc

SEQ ID NO: 1773352 - RNA, 18 nt, Salmonella enterica enterica serovar Typhi Ty2
cacgucuccucagaugua

SEQ ID NO: 1773353 - RNA, 17 nt, Salmonella enterica enterica serovar Typhi Ty2
cacuuucgcccggcgcc

SEQ ID NO: 1773354 - RNA, 17 nt, Salmonella enterica enterica serovar Typhi Ty2
cacuuuccgaaucaggc

SEQ ID NO: 1773355 - RNA, 17 nt, Salmonella enterica enterica serovar Typhi Ty2
cacuuucagaccacuau

SEQ ID NO: 1773356 - RNA, 22 nt, Salmonella enterica enterica serovar Typhi Ty2
cacuuuuucucuuaucgccgcc

SEQ ID NO: 1773357 - RNA, 17 nt, Salmonella enterica enterica serovar Typhi Ty2
cacuuucucggcuuucc

SEQ ID NO: 1773358 - RNA, 21 nt, Salmonella enterica enterica serovar Typhi Ty2
cacuuucucggcuuuccagcu

SEQ ID NO: 1773359 - RNA, 22 nt, Salmonella enterica enterica serovar Typhi Ty2
cagaaauccgcgaauaccuucc

SEQ ID NO: 1773360 - RNA, 18 nt, Salmonella enterica enterica serovar Typhi Ty2
cagaaaucggcagcaccc

SEQ ID NO: 1773361 - RNA, 19 nt, Salmonella enterica enterica serovar Typhi Ty2
cagaaauaaaauacuucca

SEQ ID NO: 1773362 - RNA, 14 nt, Salmonella enterica enterica serovar Typhi Ty2
cagaaauaaaauac

SEQ ID NO: 1773363 - RNA, 15 nt, Salmonella enterica enterica serovar Typhi Ty2
cagaaauaaaauacu

SEQ ID NO: 1773364 - RNA, 19 nt, Salmonella enterica enterica serovar Typhi Ty2
cagaaaaaagccaagcaca

SEQ ID NO: 1773365 - RNA, 22 nt, Salmonella enterica enterica serovar Typhi Ty2
cagaaaaaagccaagcacaaaa

SEQ ID NO: 1773366 - RNA, 11 nt, Salmonella enterica enterica serovar Typhi Ty2
cagaaaaaccu

SEQ ID NO: 1773367 - RNA, 18 nt, Salmonella enterica enterica serovar Typhi Ty2
cagaaaaaccaaaaaaua

SEQ ID NO: 1773368 - RNA, 22 nt, Salmonella enterica enterica serovar Typhi Ty2
cagaaacaacgcgggccauaca

SEQ ID NO: 1773369 - RNA, 22 nt, Salmonella enterica enterica serovar Typhi Ty2
cagaagaucuaaagccaguuuc

SEQ ID NO: 1773370 - RNA, 17 nt, Salmonella enterica enterica serovar Typhi Ty2
cagaauggcgauuaacg

SEQ ID NO: 1773371 - RNA, 13 nt, Salmonella enterica enterica serovar Typhi Ty2
cagaacaaaggcu

SEQ ID NO: 1773372 - RNA, 20 nt, Salmonella enterica enterica serovar Typhi Ty2
cagacaagcacauaacugag

SEQ ID NO: 1773373 - RNA, 21 nt, Salmonella enterica enterica serovar Typhi Ty2
cagaauucguacguuuuucca

SEQ ID NO: 1773374 - RNA, 18 nt, Salmonella enterica enterica serovar Typhi Ty2
cagaauuaacucaucaca

SEQ ID NO: 1773375 - RNA, 20 nt, Salmonella enterica enterica serovar Typhi Ty2
cagacagccgacggcaaaaa

SEQ ID NO: 1773376 - RNA, 12 nt, Salmonella enterica enterica serovar Typhi Ty2
cagacagccgac

SEQ ID NO: 1773377 - RNA, 17 nt, Salmonella enterica enterica serovar Typhi Ty2
cagacagccauauuuau

SEQ ID NO: 1773378 - RNA, 21 nt, Salmonella enterica enterica serovar Typhi Ty2
cagacagccgaucaggccgca

SEQ ID NO: 1773379 - RNA, 15 nt, Salmonella enterica enterica serovar Typhi Ty2
cagacaggacgccag

SEQ ID NO: 1773380 - RNA, 12 nt, Salmonella enterica enterica serovar Typhi Ty2
cagacacugcca

SEQ ID NO: 1773381 - RNA, 22 nt, Salmonella enterica enterica serovar Typhi Ty2
cagacagauaacaccagcgauc

SEQ ID NO: 1773382 - RNA, 19 nt, Salmonella enterica enterica serovar Typhi Ty2
cagacagauaacaccagcg

SEQ ID NO: 1773383 - RNA, 22 nt, Salmonella enterica enterica serovar Typhi Ty2
cagacacuggaaacagccaauc

SEQ ID NO: 1773384 - RNA, 13 nt, Salmonella enterica enterica serovar Typhi Ty2
cagacacugcacc

SEQ ID NO: 1773385 - RNA, 14 nt, Salmonella enterica enterica serovar Typhi Ty2
cagacacugcacca

SEQ ID NO: 1773386 - RNA, 20 nt, Salmonella enterica enterica serovar Typhi Ty2
cagaccacgaaucaggauau

SEQ ID NO: 1773387 - RNA, 19 nt, Salmonella enterica enterica serovar Typhi Ty2
cagaccaccccacaguaau

SEQ ID NO: 1773388 - RNA, 14 nt, Salmonella enterica enterica serovar Typhi Ty2
cagacgcugguugu

SEQ ID NO: 1773389 - RNA, 21 nt, Salmonella enterica enterica serovar Typhi Ty2
cagacgcguauggcgguuggg

SEQ ID NO: 1773390 - RNA, 19 nt, Salmonella enterica enterica serovar Typhi Ty2
cagacgcuccgcaguaauc

SEQ ID NO: 1773391 - RNA, 16 nt, Salmonella enterica enterica serovar Typhi Ty2
cagacgcugcuucacg

SEQ ID NO: 1773392 - RNA, 17 nt, Salmonella enterica enterica serovar Typhi Ty2
cagacgcaucuuuuucc

SEQ ID NO: 1773393 - RNA, 20 nt, Salmonella enterica enterica serovar Typhi Ty2
cagacgcaucaggaaccaca

SEQ ID NO: 1773394 - RNA, 14 nt, Salmonella enterica enterica serovar Typhi Ty2
cagacgcgcagcac

SEQ ID NO: 1773395 - RNA, 12 nt, Salmonella enterica enterica serovar Typhi Ty2
cagacuaucuuc

SEQ ID NO: 1773396 - RNA, 16 nt, Salmonella enterica enterica serovar Typhi Ty2
cagacuguaugugcuc

SEQ ID NO: 1773397 - RNA, 12 nt, Salmonella enterica enterica serovar Typhi Ty2
cagacuuuccag

SEQ ID NO: 1773398 - RNA, 15 nt, Salmonella enterica enterica serovar Typhi Ty2
cagaggaaugaaaac

SEQ ID NO: 1773399 - RNA, 18 nt, Salmonella enterica enterica serovar Typhi Ty2
cagagcaucaauggugaa

SEQ ID NO: 1773400 - RNA, 15 nt, Salmonella enterica enterica serovar Typhi Ty2
cagagugcucaauaa

SEQ ID NO: 1773401 - RNA, 22 nt, Salmonella enterica enterica serovar Typhi Ty2
cagagugagauagcggcgcgcu

SEQ ID NO: 1773402 - RNA, 16 nt, Salmonella enterica enterica serovar Typhi Ty2
cagagugcucaauaag

SEQ ID NO: 1773403 - RNA, 20 nt, Salmonella enterica enterica serovar Typhi Ty2
cagaggaucuggacgccaau

SEQ ID NO: 1773404 - RNA, 15 nt, Salmonella enterica enterica serovar Typhi Ty2
cagaggacauuaaag

SEQ ID NO: 1773405 - RNA, 13 nt, Salmonella enterica enterica serovar Typhi Ty2
cagaguccagcgg

SEQ ID NO: 1773406 - RNA, 18 nt, Salmonella enterica enterica serovar Typhi Ty2
cagagucgaaagaaacgc

SEQ ID NO: 1773407 - RNA, 15 nt, Salmonella enterica enterica serovar Typhi Ty2
cagagagggaaaaaa

SEQ ID NO: 1773408 - RNA, 18 nt, Salmonella enterica enterica serovar Typhi Ty2
cagagagggaaaaaaauc

SEQ ID NO: 1773409 - RNA, 21 nt, Salmonella enterica enterica serovar Typhi Ty2
cagagcaacgagaacccacuu

SEQ ID NO: 1773410 - RNA, 22 nt, Salmonella enterica enterica serovar Typhi Ty2
cagagagcguuucuacgccaug

SEQ ID NO: 1773411 - RNA, 13 nt, Salmonella enterica enterica serovar Typhi Ty2
aaaaucagcaauc

SEQ ID NO: 1773412 - RNA, 17 nt, Salmonella enterica enterica serovar Typhi Ty2
cagauguuuacgcugcu

SEQ ID NO: 1773413 - RNA, 15 nt, Salmonella enterica enterica serovar Typhi Ty2
cagauguuauaaacu

SEQ ID NO: 1773414 - RNA, 23 nt, Salmonella enterica enterica serovar Typhi Ty2
cagauguccaccgauuucaucgc

SEQ ID NO: 1773415 - RNA, 21 nt, Salmonella enterica enterica serovar Typhi Ty2
cagauggcgucacauggcgaa

SEQ ID NO: 1773416 - RNA, 22 nt, Salmonella enterica enterica serovar Typhi Ty2
cagauggcgauucauaugcgcc

SEQ ID NO: 1773417 - RNA, 22 nt, Salmonella enterica enterica serovar Typhi Ty2
cagauggcuaugaagcuggagc

SEQ ID NO: 1773418 - RNA, 13 nt, Salmonella enterica enterica serovar Typhi Ty2
cagauggcugcac

SEQ ID NO: 1773419 - RNA, 18 nt, Salmonella enterica enterica serovar Typhi Ty2
cagauggauaaccugccg

SEQ ID NO: 1773420 - RNA, 18 nt, Salmonella enterica enterica serovar Typhi Ty2
cagaugggccauuuacgc

SEQ ID NO: 1773421 - RNA, 22 nt, Salmonella enterica enterica serovar Typhi Ty2
cagauggcuuuacgcuuauucg

SEQ ID NO: 1773422 - RNA, 22 nt, Salmonella enterica enterica serovar Typhi Ty2
cagaugguauaaaucacgcuga

SEQ ID NO: 1773423 - RNA, 20 nt, Salmonella enterica enterica serovar Typhi Ty2
cagaugcuuaaugcucugcu

SEQ ID NO: 1773424 - RNA, 23 nt, Salmonella enterica enterica serovar Typhi Ty2
cagaugcuuaaugcucugcugug

SEQ ID NO: 1773425 - RNA, 21 nt, Salmonella enterica enterica serovar Typhi Ty2
cagaugcugucuuagugaaag

SEQ ID NO: 1773426 - RNA, 14 nt, Salmonella enterica enterica serovar Typhi Ty2
cagauggaaaccgg

SEQ ID NO: 1773427 - RNA, 16 nt, Salmonella enterica enterica serovar Typhi Ty2
cagaugcguuuucugc

SEQ ID NO: 1773428 - RNA, 15 nt, Salmonella enterica enterica serovar Typhi Ty2
cagauuuucuuuaau

SEQ ID NO: 1773429 - RNA, 22 nt, Salmonella enterica enterica serovar Typhi Ty2
cagauuuucauuuagcgccugu

SEQ ID NO: 1773430 - RNA, 17 nt, Salmonella enterica enterica serovar Typhi Ty2
cagauuaugcaguucuu

SEQ ID NO: 1773431 - RNA, 16 nt, Salmonella enterica enterica serovar Typhi Ty2
cagauuaucagcgaga

SEQ ID NO: 1773432 - RNA, 18 nt, Salmonella enterica enterica serovar Typhi Ty2
cagauuacgcauggucaa

SEQ ID NO: 1773433 - RNA, 21 nt, Salmonella enterica enterica serovar Typhi Ty2
cagaucuucaaucgugaccac

SEQ ID NO: 1773434 - RNA, 15 nt, Salmonella enterica enterica serovar Typhi Ty2
cagaucuucagaggc

SEQ ID NO: 1773435 - RNA, 17 nt, Salmonella enterica enterica serovar Typhi Ty2
cagaucuuuauccugca

SEQ ID NO: 1773436 - RNA, 17 nt, Salmonella enterica enterica serovar Typhi Ty2
cagaugcagcaacguuu

SEQ ID NO: 1773437 - RNA, 16 nt, Salmonella enterica enterica serovar Typhi Ty2
cagaugcaguucaccc

SEQ ID NO: 1773438 - RNA, 20 nt, Salmonella enterica enterica serovar Typhi Ty2
cagauaagcgacucuguauu

SEQ ID NO: 1773439 - RNA, 23 nt, Salmonella enterica enterica serovar Typhi Ty2
cagauaaguuugcagaucggccu

SEQ ID NO: 1773440 - RNA, 21 nt, Salmonella enterica enterica serovar Typhi Ty2
cagauaacugagcuugagcca

SEQ ID NO: 1773441 - RNA, 13 nt, Salmonella enterica enterica serovar Typhi Ty2
cagauaacuuccu

SEQ ID NO: 1773442 - RNA, 16 nt, Salmonella enterica enterica serovar Typhi Ty2
cagaucgguuuauccc

SEQ ID NO: 1773443 - RNA, 20 nt, Salmonella enterica enterica serovar Typhi Ty2
cagaucguaugcgccuguua

SEQ ID NO: 1773444 - RNA, 23 nt, Salmonella enterica enterica serovar Typhi Ty2
cagaucguagccauguuccucac

SEQ ID NO: 1773445 - RNA, 15 nt, Salmonella enterica enterica serovar Typhi Ty2
cagaucggcaucuuu

SEQ ID NO: 1773446 - RNA, 20 nt, Salmonella enterica enterica serovar Typhi Ty2
cagaucgccaaagucauugc

SEQ ID NO: 1773447 - RNA, 15 nt, Salmonella enterica enterica serovar Typhi Ty2
cagaucgaccagcgc

SEQ ID NO: 1773448 - RNA, 13 nt, Salmonella enterica enterica serovar Typhi Ty2
cagaucgccgccg

SEQ ID NO: 1773449 - RNA, 15 nt, Salmonella enterica enterica serovar Typhi Ty2
cagcacuucccgcuc

SEQ ID NO: 1773450 - RNA, 19 nt, Salmonella enterica enterica serovar Typhi Ty2
cagcagaacaaccagugcg

SEQ ID NO: 1773451 - RNA, 15 nt, Salmonella enterica enterica serovar Typhi Ty2
cagcagaaaaccggu

SEQ ID NO: 1773452 - RNA, 15 nt, Salmonella enterica enterica serovar Typhi Ty2
cagcaccgcuggcga

SEQ ID NO: 1773453 - RNA, 22 nt, Salmonella enterica enterica serovar Typhi Ty2
cagcacauuacaggcaucuucc

SEQ ID NO: 1773454 - RNA, 14 nt, Salmonella enterica enterica serovar Typhi Ty2
cagcacaugcaauu

SEQ ID NO: 1773455 - RNA, 19 nt, Salmonella enterica enterica serovar Typhi Ty2
cagcacauucagcagcgcc

SEQ ID NO: 1773456 - RNA, 16 nt, Salmonella enterica enterica serovar Typhi Ty2
cagcacauagaagcuc

SEQ ID NO: 1773457 - RNA, 22 nt, Salmonella enterica enterica serovar Typhi Ty2
cagcaacgcgcuaaaugcauag

SEQ ID NO: 1773458 - RNA, 17 nt, Salmonella enterica enterica serovar Typhi Ty2
cagcaacgccuccagcg

SEQ ID NO: 1773459 - RNA, 13 nt, Salmonella enterica enterica serovar Typhi Ty2
cagcaacgcccag

SEQ ID NO: 1773460 - RNA, 18 nt, Salmonella enterica enterica serovar Typhi Ty2
cagcaacgagcuuuuuuc

SEQ ID NO: 1773461 - RNA, 17 nt, Salmonella enterica enterica serovar Typhi Ty2
aaaauggcaaguaaaau

SEQ ID NO: 1773462 - RNA, 17 nt, Salmonella enterica enterica serovar Typhi Ty2
cagcaacgagcuuuuuu

SEQ ID NO: 1773463 - RNA, 22 nt, Salmonella enterica enterica serovar Typhi Ty2
cagcaauuucucgcccgccaga

SEQ ID NO: 1773464 - RNA, 20 nt, Salmonella enterica enterica serovar Typhi Ty2
cagcaaugccgccgccaggu

SEQ ID NO: 1773465 - RNA, 20 nt, Salmonella enterica enterica serovar Typhi Ty2
cagcaaugauaacggcgcca

SEQ ID NO: 1773466 - RNA, 20 nt, Salmonella enterica enterica serovar Typhi Ty2
cagcaauguuaaauucagca

SEQ ID NO: 1773467 - RNA, 20 nt, Salmonella enterica enterica serovar Typhi Ty2
cagcaauuccgccaucucau

SEQ ID NO: 1773468 - RNA, 14 nt, Salmonella enterica enterica serovar Typhi Ty2
cagcacaaaauccc

SEQ ID NO: 1773469 - RNA, 22 nt, Salmonella enterica enterica serovar Typhi Ty2
cagcacaauaccuucugcgccc

SEQ ID NO: 1773470 - RNA, 18 nt, Salmonella enterica enterica serovar Typhi Ty2
cagcaagucgcgggcgcu

SEQ ID NO: 1773471 - RNA, 17 nt, Salmonella enterica enterica serovar Typhi Ty2
cagcaaugccgccgcca

SEQ ID NO: 1773472 - RNA, 18 nt, Salmonella enterica enterica serovar Typhi Ty2
cagcaaugagacaacggc

SEQ ID NO: 1773473 - RNA, 15 nt, Salmonella enterica enterica serovar Typhi Ty2
cagcaaugagcaggc

SEQ ID NO: 1773474 - RNA, 17 nt, Salmonella enterica enterica serovar Typhi Ty2
cagcaucggcagcgcca

SEQ ID NO: 1773475 - RNA, 15 nt, Salmonella enterica enterica serovar Typhi Ty2
cagcaucgccaucaa

SEQ ID NO: 1773476 - RNA, 14 nt, Salmonella enterica enterica serovar Typhi Ty2
cagcaucgcccggg

SEQ ID NO: 1773477 - RNA, 23 nt, Salmonella enterica enterica serovar Typhi Ty2
cagcaucgcccgggcaauuucuc

SEQ ID NO: 1773478 - RNA, 14 nt, Salmonella enterica enterica serovar Typhi Ty2
cagcaucugcggcu

SEQ ID NO: 1773479 - RNA, 17 nt, Salmonella enterica enterica serovar Typhi Ty2
cagcaucuuaugcgcaa

SEQ ID NO: 1773480 - RNA, 18 nt, Salmonella enterica enterica serovar Typhi Ty2
cagcauauuuuccggcgu

SEQ ID NO: 1773481 - RNA, 15 nt, Salmonella enterica enterica serovar Typhi Ty2
cagcaucaugucccc

SEQ ID NO: 1773482 - RNA, 22 nt, Salmonella enterica enterica serovar Typhi Ty2
cagcaucaucucccaggccgcc

SEQ ID NO: 1773483 - RNA, 12 nt, Salmonella enterica enterica serovar Typhi Ty2
cagcaucaucuc

SEQ ID NO: 1773484 - RNA, 18 nt, Salmonella enterica enterica serovar Typhi Ty2
cagcaucaucucccaggc

SEQ ID NO: 1773485 - RNA, 15 nt, Salmonella enterica enterica serovar Typhi Ty2
cagcaucccggcaaa

SEQ ID NO: 1773486 - RNA, 23 nt, Salmonella enterica enterica serovar Typhi Ty2
cagcaucccguuaugguuaucaa

SEQ ID NO: 1773487 - RNA, 14 nt, Salmonella enterica enterica serovar Typhi Ty2
cagcaugcccgcca

SEQ ID NO: 1773488 - RNA, 16 nt, Salmonella enterica enterica serovar Typhi Ty2
cagcaugagccagccc

SEQ ID NO: 1773489 - RNA, 15 nt, Salmonella enterica enterica serovar Typhi Ty2
cagcauggcgccugc

SEQ ID NO: 1773490 - RNA, 23 nt, Salmonella enterica enterica serovar Typhi Ty2
cagcaugguguguucccgcgcca

SEQ ID NO: 1773491 - RNA, 17 nt, Salmonella enterica enterica serovar Typhi Ty2
cagcauuaacccggccc

SEQ ID NO: 1773492 - RNA, 17 nt, Salmonella enterica enterica serovar Typhi Ty2
cagccacggcaacgccg

SEQ ID NO: 1773493 - RNA, 20 nt, Salmonella enterica enterica serovar Typhi Ty2
cagccagcgccaccaaagcc

SEQ ID NO: 1773494 - RNA, 14 nt, Salmonella enterica enterica serovar Typhi Ty2
cagccagcgccccu

SEQ ID NO: 1773495 - RNA, 16 nt, Salmonella enterica enterica serovar Typhi Ty2
cagccagcgccccugc

SEQ ID NO: 1773496 - RNA, 19 nt, Salmonella enterica enterica serovar Typhi Ty2
cagccagcgccccugcggg

SEQ ID NO: 1773497 - RNA, 20 nt, Salmonella enterica enterica serovar Typhi Ty2
cagccagcguuucuggaagu

SEQ ID NO: 1773498 - RNA, 23 nt, Salmonella enterica enterica serovar Typhi Ty2
cagccagggaucaagcaaugcca

SEQ ID NO: 1773499 - RNA, 17 nt, Salmonella enterica enterica serovar Typhi Ty2
cagccaggcggcaaagu

SEQ ID NO: 1773500 - RNA, 11 nt, Salmonella enterica enterica serovar Typhi Ty2
cagccaggugg

SEQ ID NO: 1773501 - RNA, 13 nt, Salmonella enterica enterica serovar Typhi Ty2
cagccagguggca

SEQ ID NO: 1773502 - RNA, 12 nt, Salmonella enterica enterica serovar Typhi Ty2
cagcauuucuuc

SEQ ID NO: 1773503 - RNA, 13 nt, Salmonella enterica enterica serovar Typhi Ty2
cagcauuucuuca

SEQ ID NO: 1773504 - RNA, 15 nt, Salmonella enterica enterica serovar Typhi Ty2
cagccaaaacgucgu

SEQ ID NO: 1773505 - RNA, 17 nt, Salmonella enterica enterica serovar Typhi Ty2
cagccaaaauaugcugg

SEQ ID NO: 1773506 - RNA, 19 nt, Salmonella enterica enterica serovar Typhi Ty2
cagcauugggucaugcgga

SEQ ID NO: 1773507 - RNA, 23 nt, Salmonella enterica enterica serovar Typhi Ty2
cagcauuucaaucgcgcccgcca

SEQ ID NO: 1773508 - RNA, 17 nt, Salmonella enterica enterica serovar Typhi Ty2
cagcauugaccaccaua

SEQ ID NO: 1773509 - RNA, 17 nt, Salmonella enterica enterica serovar Typhi Ty2
cagccacaugccuucuu

SEQ ID NO: 1773510 - RNA, 19 nt, Salmonella enterica enterica serovar Typhi Ty2
cagccacauuguaugcaag

SEQ ID NO: 1773511 - RNA, 17 nt, Salmonella enterica enterica serovar Typhi Ty2
cagcaguuccccgccgc

SEQ ID NO: 1773512 - RNA, 17 nt, Salmonella enterica enterica serovar Typhi Ty2
cagcagugagcuuugca

SEQ ID NO: 1773513 - RNA, 23 nt, Salmonella enterica enterica serovar Typhi Ty2
cagcaguggcucagucagucccg

SEQ ID NO: 1773514 - RNA, 17 nt, Salmonella enterica enterica serovar Typhi Ty2
cagcauacgucugcgcu

SEQ ID NO: 1773515 - RNA, 18 nt, Salmonella enterica enterica serovar Typhi Ty2
cagcauacgacaucgcca

SEQ ID NO: 1773516 - RNA, 21 nt, Salmonella enterica enterica serovar Typhi Ty2
cagcauacugaugucguugua

SEQ ID NO: 1773517 - RNA, 19 nt, Salmonella enterica enterica serovar Typhi Ty2
cagcauauccagcgccugc

SEQ ID NO: 1773518 - RNA, 14 nt, Salmonella enterica enterica serovar Typhi Ty2
cagcauauccagcg

SEQ ID NO: 1773519 - RNA, 23 nt, Salmonella enterica enterica serovar Typhi Ty2
cagcauaucgauagcaucgguca

SEQ ID NO: 1773520 - RNA, 15 nt, Salmonella enterica enterica serovar Typhi Ty2
cagcauauccagcgc

SEQ ID NO: 1773521 - RNA, 16 nt, Salmonella enterica enterica serovar Typhi Ty2
cagcauauccagcgcc

SEQ ID NO: 1773522 - RNA, 23 nt, Salmonella enterica enterica serovar Typhi Ty2
cagcauaauauccugcaccgccu

SEQ ID NO: 1773523 - RNA, 18 nt, Salmonella enterica enterica serovar Typhi Ty2
cagcauaauauucauaac

SEQ ID NO: 1773524 - RNA, 17 nt, Salmonella enterica enterica serovar Typhi Ty2
cagcauaccgcccaaca

SEQ ID NO: 1773525 - RNA, 12 nt, Salmonella enterica enterica serovar Typhi Ty2
cagcaggcuuug

SEQ ID NO: 1773526 - RNA, 20 nt, Salmonella enterica enterica serovar Typhi Ty2
cagcaggcuuugcugcugcg

SEQ ID NO: 1773527 - RNA, 21 nt, Salmonella enterica enterica serovar Typhi Ty2
cagcagggauauacaaauauc

SEQ ID NO: 1773528 - RNA, 20 nt, Salmonella enterica enterica serovar Typhi Ty2
cagcagguugagucugcucg

SEQ ID NO: 1773529 - RNA, 22 nt, Salmonella enterica enterica serovar Typhi Ty2
cagcagcuucagcaucaucucc

SEQ ID NO: 1773530 - RNA, 17 nt, Salmonella enterica enterica serovar Typhi Ty2
cagcagcuucaugcauc

SEQ ID NO: 1773531 - RNA, 13 nt, Salmonella enterica enterica serovar Typhi Ty2
cagcagcugcugu

SEQ ID NO: 1773532 - RNA, 16 nt, Salmonella enterica enterica serovar Typhi Ty2
cagcaggacgcgcacu

SEQ ID NO: 1773533 - RNA, 22 nt, Salmonella enterica enterica serovar Typhi Ty2
cagcagcgcuuucuucuucacg

SEQ ID NO: 1773534 - RNA, 20 nt, Salmonella enterica enterica serovar Typhi Ty2
cagcagcgcuuucuucuuca

SEQ ID NO: 1773535 - RNA, 22 nt, Salmonella enterica enterica serovar Typhi Ty2
cagcagcgcgaucgccccgacc

SEQ ID NO: 1773536 - RNA, 16 nt, Salmonella enterica enterica serovar Typhi Ty2
cagcagacaggugaac

SEQ ID NO: 1773537 - RNA, 14 nt, Salmonella enterica enterica serovar Typhi Ty2
cagcagaccggcaa

SEQ ID NO: 1773538 - RNA, 23 nt, Salmonella enterica enterica serovar Typhi Ty2
cagcagaccggcaaaaauuugcg

SEQ ID NO: 1773539 - RNA, 20 nt, Salmonella enterica enterica serovar Typhi Ty2
cagcagacugccuacgcggc

SEQ ID NO: 1773540 - RNA, 12 nt, Salmonella enterica enterica serovar Typhi Ty2
cagcagaauaac

SEQ ID NO: 1773541 - RNA, 17 nt, Salmonella enterica enterica serovar Typhi Ty2
cagcagaaucaggcaca

SEQ ID NO: 1773542 - RNA, 14 nt, Salmonella enterica enterica serovar Typhi Ty2
cagcagacagguga

SEQ ID NO: 1773543 - RNA, 17 nt, Salmonella enterica enterica serovar Typhi Ty2
cagcagacaaccgacgc

SEQ ID NO: 1773544 - RNA, 22 nt, Salmonella enterica enterica serovar Typhi Ty2
cagcagacugccuacgcggcca

SEQ ID NO: 1773545 - RNA, 15 nt, Salmonella enterica enterica serovar Typhi Ty2
cagcagacugguaac

SEQ ID NO: 1773546 - RNA, 17 nt, Salmonella enterica enterica serovar Typhi Ty2
cagcgaaagcugccuuu

SEQ ID NO: 1773547 - RNA, 23 nt, Salmonella enterica enterica serovar Typhi Ty2
cagcgaaaugacggccaccagcg

SEQ ID NO: 1773548 - RNA, 16 nt, Salmonella enterica enterica serovar Typhi Ty2
cagcgaaagcugccuu

SEQ ID NO: 1773549 - RNA, 21 nt, Salmonella enterica enterica serovar Typhi Ty2
cagcgaaagaugcguaccgcu

SEQ ID NO: 1773550 - RNA, 19 nt, Salmonella enterica enterica serovar Typhi Ty2
cagcgaaacugcgcgccgg

SEQ ID NO: 1773551 - RNA, 19 nt, Salmonella enterica enterica serovar Typhi Ty2
cagccuggagagcagcgcc

SEQ ID NO: 1773552 - RNA, 18 nt, Salmonella enterica enterica serovar Typhi Ty2
cagccuuuucauauggaa

SEQ ID NO: 1773553 - RNA, 21 nt, Salmonella enterica enterica serovar Typhi Ty2
cagcgacaaggcaccguuucu

SEQ ID NO: 1773554 - RNA, 15 nt, Salmonella enterica enterica serovar Typhi Ty2
cagcgacacuccgcg

SEQ ID NO: 1773555 - RNA, 19 nt, Salmonella enterica enterica serovar Typhi Ty2
cagcgacacuccgcgcaug

SEQ ID NO: 1773556 - RNA, 16 nt, Salmonella enterica enterica serovar Typhi Ty2
cagcgaaccgcggcau

SEQ ID NO: 1773557 - RNA, 19 nt, Salmonella enterica enterica serovar Typhi Ty2
cagcgaacucccgggcgcu

SEQ ID NO: 1773558 - RNA, 21 nt, Salmonella enterica enterica serovar Typhi Ty2
cagccggaaaagcgcuggcug

SEQ ID NO: 1773559 - RNA, 16 nt, Salmonella enterica enterica serovar Typhi Ty2
cagccggauuuuaaau

SEQ ID NO: 1773560 - RNA, 18 nt, Salmonella enterica enterica serovar Typhi Ty2
cagccucgcguugagggu

SEQ ID NO: 1773561 - RNA, 17 nt, Salmonella enterica enterica serovar Typhi Ty2
cagccucucuugauaac

SEQ ID NO: 1773562 - RNA, 11 nt, Salmonella enterica enterica serovar Typhi Ty2
cagccgccauu

SEQ ID NO: 1773563 - RNA, 13 nt, Salmonella enterica enterica serovar Typhi Ty2
cagccgccaaaaa

SEQ ID NO: 1773564 - RNA, 23 nt, Salmonella enterica enterica serovar Typhi Ty2
cagccgcauuuuucauggugaac

SEQ ID NO: 1773565 - RNA, 12 nt, Salmonella enterica enterica serovar Typhi Ty2
cagccgccacca

SEQ ID NO: 1773566 - RNA, 17 nt, Salmonella enterica enterica serovar Typhi Ty2
cagccgccaccacaaag

SEQ ID NO: 1773567 - RNA, 17 nt, Salmonella enterica enterica serovar Typhi Ty2
cagccgaucuauuucau

SEQ ID NO: 1773568 - RNA, 17 nt, Salmonella enterica enterica serovar Typhi Ty2
cagccgaucaucacgaa

SEQ ID NO: 1773569 - RNA, 22 nt, Salmonella enterica enterica serovar Typhi Ty2
cagccgagcgguaagagccaga

SEQ ID NO: 1773570 - RNA, 23 nt, Salmonella enterica enterica serovar Typhi Ty2
cagccgagcgguaagagccagac

SEQ ID NO: 1773571 - RNA, 18 nt, Salmonella enterica enterica serovar Typhi Ty2
cagccgacuaucuucuuc

SEQ ID NO: 1773572 - RNA, 17 nt, Salmonella enterica enterica serovar Typhi Ty2
cagccgauuucauacca

SEQ ID NO: 1773573 - RNA, 14 nt, Salmonella enterica enterica serovar Typhi Ty2
cagccauggcccuu

SEQ ID NO: 1773574 - RNA, 23 nt, Salmonella enterica enterica serovar Typhi Ty2
cagccauggcccaaaagguagcg

SEQ ID NO: 1773575 - RNA, 22 nt, Salmonella enterica enterica serovar Typhi Ty2
cagccaugccauauggccgucg

SEQ ID NO: 1773576 - RNA, 22 nt, Salmonella enterica enterica serovar Typhi Ty2
cagccauggcccaaaagguagc

SEQ ID NO: 1773577 - RNA, 23 nt, Salmonella enterica enterica serovar Typhi Ty2
cagcccuuucaggaauuuaucaa

SEQ ID NO: 1773578 - RNA, 23 nt, Salmonella enterica enterica serovar Typhi Ty2
cagcccuaaauggagcgagcugg

SEQ ID NO: 1773579 - RNA, 21 nt, Salmonella enterica enterica serovar Typhi Ty2
cagcgccacggagcauaauuu

SEQ ID NO: 1773580 - RNA, 16 nt, Salmonella enterica enterica serovar Typhi Ty2
cagcgccagcggcugc

SEQ ID NO: 1773581 - RNA, 14 nt, Salmonella enterica enterica serovar Typhi Ty2
cagcgccagauagu

SEQ ID NO: 1773582 - RNA, 17 nt, Salmonella enterica enterica serovar Typhi Ty2
cagcgccagauagucac

SEQ ID NO: 1773583 - RNA, 23 nt, Salmonella enterica enterica serovar Typhi Ty2
cagcgccauccacggccccgggc

SEQ ID NO: 1773584 - RNA, 20 nt, Salmonella enterica enterica serovar Typhi Ty2
cagcgccauugcuaggaaca

SEQ ID NO: 1773585 - RNA, 22 nt, Salmonella enterica enterica serovar Typhi Ty2
cagcgccauaaucgcuuuuucc

SEQ ID NO: 1773586 - RNA, 15 nt, Salmonella enterica enterica serovar Typhi Ty2
cagcgccaucaggaa

SEQ ID NO: 1773587 - RNA, 19 nt, Salmonella enterica enterica serovar Typhi Ty2
cagcgccagcggcugcucc

SEQ ID NO: 1773588 - RNA, 19 nt, Salmonella enterica enterica serovar Typhi Ty2
cagcgccagcgugcgcagc

SEQ ID NO: 1773589 - RNA, 15 nt, Salmonella enterica enterica serovar Typhi Ty2
cagcgcccagcagcu

SEQ ID NO: 1773590 - RNA, 20 nt, Salmonella enterica enterica serovar Typhi Ty2
cagcgcccacaccauaccgc

SEQ ID NO: 1773591 - RNA, 15 nt, Salmonella enterica enterica serovar Typhi Ty2
cagcgcccccagcaa

SEQ ID NO: 1773592 - RNA, 16 nt, Salmonella enterica enterica serovar Typhi Ty2
cagcgcaaucugcucg

SEQ ID NO: 1773593 - RNA, 15 nt, Salmonella enterica enterica serovar Typhi Ty2
cagcgacuucaggcg

SEQ ID NO: 1773594 - RNA, 17 nt, Salmonella enterica enterica serovar Typhi Ty2
cagcgcaccuucaacag

SEQ ID NO: 1773595 - RNA, 17 nt, Salmonella enterica enterica serovar Typhi Ty2
cagcgcaaucugcucga

SEQ ID NO: 1773596 - RNA, 19 nt, Salmonella enterica enterica serovar Typhi Ty2
cagcgccaccaaagccagg

SEQ ID NO: 1773597 - RNA, 21 nt, Salmonella enterica enterica serovar Typhi Ty2
cagcgccaacgccacugccau

SEQ ID NO: 1773598 - RNA, 17 nt, Salmonella enterica enterica serovar Typhi Ty2
cagcgcagaauuuauuu

SEQ ID NO: 1773599 - RNA, 18 nt, Salmonella enterica enterica serovar Typhi Ty2
cagcgccgcgaaugugcc

SEQ ID NO: 1773600 - RNA, 15 nt, Salmonella enterica enterica serovar Typhi Ty2
cagcgccgcgcaagc

SEQ ID NO: 1773601 - RNA, 11 nt, Salmonella enterica enterica serovar Typhi Ty2
cagcgccgccu

SEQ ID NO: 1773602 - RNA, 20 nt, Salmonella enterica enterica serovar Typhi Ty2
cagcgccggauaauccagac

SEQ ID NO: 1773603 - RNA, 19 nt, Salmonella enterica enterica serovar Typhi Ty2
cagcgccgucauaccgccc

SEQ ID NO: 1773604 - RNA, 17 nt, Salmonella enterica enterica serovar Typhi Ty2
cagcgccguagcggcag

SEQ ID NO: 1773605 - RNA, 15 nt, Salmonella enterica enterica serovar Typhi Ty2
cagcgcgcgacccag

SEQ ID NO: 1773606 - RNA, 17 nt, Salmonella enterica enterica serovar Typhi Ty2
cagcgcgcgcgacggca

SEQ ID NO: 1773607 - RNA, 14 nt, Salmonella enterica enterica serovar Typhi Ty2
cagcgcgccgcagc

SEQ ID NO: 1773608 - RNA, 13 nt, Salmonella enterica enterica serovar Typhi Ty2
cagcgcgccgccc

SEQ ID NO: 1773609 - RNA, 19 nt, Salmonella enterica enterica serovar Typhi Ty2
cagcgcgcccgccaccagc

SEQ ID NO: 1773610 - RNA, 21 nt, Salmonella enterica enterica serovar Typhi Ty2
cagcgcgccaauggccgcccc

SEQ ID NO: 1773611 - RNA, 15 nt, Salmonella enterica enterica serovar Typhi Ty2
cagcgcgcaaaaacc

SEQ ID NO: 1773612 - RNA, 22 nt, Salmonella enterica enterica serovar Typhi Ty2
cagcgcgaccugcaucccuuuc

SEQ ID NO: 1773613 - RNA, 14 nt, Salmonella enterica enterica serovar Typhi Ty2
cagcgcgaacaggc

SEQ ID NO: 1773614 - RNA, 16 nt, Salmonella enterica enterica serovar Typhi Ty2
cagcgcgaccaggaaa

SEQ ID NO: 1773615 - RNA, 24 nt, Salmonella enterica enterica serovar Typhi Ty2
uuuuuuaugaccguauuacaagua

SEQ ID NO: 1773616 - RNA, 16 nt, Salmonella enterica enterica serovar Typhi Ty2
uuuuuuauaacauaaa

SEQ ID NO: 1773617 - RNA, 19 nt, Salmonella enterica enterica serovar Typhi Ty2
uuuuuuacuuucaaaauac

SEQ ID NO: 1773618 - RNA, 22 nt, Salmonella enterica enterica serovar Typhi Ty2
uuuuugcacggcaucuuuguuc

SEQ ID NO: 1773619 - RNA, 18 nt, Salmonella enterica enterica serovar Typhi Ty2
uuuuugcuuuaauauuca

SEQ ID NO: 1773620 - RNA, 19 nt, Salmonella enterica enterica serovar Typhi Ty2
uuuuugaguuugucaucca

SEQ ID NO: 1773621 - RNA, 15 nt, Salmonella enterica enterica serovar Typhi Ty2
uuuuugaccauucca

SEQ ID NO: 1773622 - RNA, 12 nt, Salmonella enterica enterica serovar Typhi Ty2
uuuuucuucagu

SEQ ID NO: 1773623 - RNA, 16 nt, Salmonella enterica enterica serovar Typhi Ty2
uuuuucgcgugccauu

SEQ ID NO: 1773624 - RNA, 20 nt, Salmonella enterica enterica serovar Typhi Ty2
uuuuucggcuggcagcggcu

SEQ ID NO: 1773625 - RNA, 20 nt, Salmonella enterica enterica serovar Typhi Ty2
uuuuucccgauaacguaaau

SEQ ID NO: 1773626 - RNA, 21 nt, Salmonella enterica enterica serovar Typhi Ty2
uuuuuccagcacggcauaagc

SEQ ID NO: 1773627 - RNA, 12 nt, Salmonella enterica enterica serovar Typhi Ty2
uuuuuccagcuc

SEQ ID NO: 1773628 - RNA, 21 nt, Salmonella enterica enterica serovar Typhi Ty2
uuuuuccagcucagaaauaaa

SEQ ID NO: 1773629 - RNA, 20 nt, Salmonella enterica enterica serovar Typhi Ty2
uuuugauacucaucauaauc

SEQ ID NO: 1773630 - RNA, 13 nt, Salmonella enterica enterica serovar Typhi Ty2
uuuuauaacauaa

SEQ ID NO: 1773631 - RNA, 13 nt, Salmonella enterica enterica serovar Typhi Ty2
uuuuauacauccu

SEQ ID NO: 1773632 - RNA, 15 nt, Salmonella enterica enterica serovar Typhi Ty2
uuuuauagcagucag

SEQ ID NO: 1773633 - RNA, 20 nt, Salmonella enterica enterica serovar Typhi Ty2
uuuuagccuguuauucaauu

SEQ ID NO: 1773634 - RNA, 20 nt, Salmonella enterica enterica serovar Typhi Ty2
uuuuaugcacgcuauaacgu

SEQ ID NO: 1773635 - RNA, 23 nt, Salmonella enterica enterica serovar Typhi Ty2
uuuuaucucuuuugcuucaauaa

SEQ ID NO: 1773636 - RNA, 20 nt, Salmonella enterica enterica serovar Typhi Ty2
uuuuaucgacagauuuugca

SEQ ID NO: 1773637 - RNA, 20 nt, Salmonella enterica enterica serovar Typhi Ty2
uuuuauauguugaauauuca

SEQ ID NO: 1773638 - RNA, 22 nt, Salmonella enterica enterica serovar Typhi Ty2
uuuuauauguugaauauucaau

SEQ ID NO: 1773639 - RNA, 21 nt, Salmonella enterica enterica serovar Typhi Ty2
uuuuauccuguguuuggccgc

SEQ ID NO: 1773640 - RNA, 23 nt, Salmonella enterica enterica serovar Typhi Ty2
uuuuauccguuuccgcaauaagu

SEQ ID NO: 1773641 - RNA, 17 nt, Salmonella enterica enterica serovar Typhi Ty2
uuuuaucaggccugccu

SEQ ID NO: 1773642 - RNA, 17 nt, Salmonella enterica enterica serovar Typhi Ty2
uuuuaauuuucuguaau

SEQ ID NO: 1773643 - RNA, 13 nt, Salmonella enterica enterica serovar Typhi Ty2
uuuuacacugaag

SEQ ID NO: 1773644 - RNA, 20 nt, Salmonella enterica enterica serovar Typhi Ty2
uuuuaccaguacaauuucug

SEQ ID NO: 1773645 - RNA, 23 nt, Salmonella enterica enterica serovar Typhi Ty2
uuuuaccccccaugaauuacagc

SEQ ID NO: 1773646 - RNA, 18 nt, Salmonella enterica enterica serovar Typhi Ty2
uuuuacuuaaaauugaau

SEQ ID NO: 1773647 - RNA, 21 nt, Salmonella enterica enterica serovar Typhi Ty2
uuuuagcaaugaugaugaagg

SEQ ID NO: 1773648 - RNA, 14 nt, Salmonella enterica enterica serovar Typhi Ty2
uuuuagaauuaucu

SEQ ID NO: 1773649 - RNA, 21 nt, Salmonella enterica enterica serovar Typhi Ty2
uuuuacgccauaacacaaacu

SEQ ID NO: 1773650 - RNA, 19 nt, Salmonella enterica enterica serovar Typhi Ty2
uuuuacugcguaaucuuuu

SEQ ID NO: 1773651 - RNA, 16 nt, Salmonella enterica enterica serovar Typhi Ty2
uuuucuuauuacaaga

SEQ ID NO: 1773652 - RNA, 23 nt, Salmonella enterica enterica serovar Typhi Ty2
uuuucuucuggccauuucaucau

SEQ ID NO: 1773653 - RNA, 17 nt, Salmonella enterica enterica serovar Typhi Ty2
uuuucuguaauucuccc

SEQ ID NO: 1773654 - RNA, 17 nt, Salmonella enterica enterica serovar Typhi Ty2
uuuugauaaaucagcac

SEQ ID NO: 1773655 - RNA, 17 nt, Salmonella enterica enterica serovar Typhi Ty2
uuuugaaaucacgccac

SEQ ID NO: 1773656 - RNA, 13 nt, Salmonella enterica enterica serovar Typhi Ty2
uuuucuauuuucu

SEQ ID NO: 1773657 - RNA, 15 nt, Salmonella enterica enterica serovar Typhi Ty2
uuuucucaauacgau

SEQ ID NO: 1773658 - RNA, 21 nt, Salmonella enterica enterica serovar Typhi Ty2
uuuucggcacaucaauaaauc

SEQ ID NO: 1773659 - RNA, 14 nt, Salmonella enterica enterica serovar Typhi Ty2
uuuucccauaaaag

SEQ ID NO: 1773660 - RNA, 14 nt, Salmonella enterica enterica serovar Typhi Ty2
uuuucccaacugua

SEQ ID NO: 1773661 - RNA, 23 nt, Salmonella enterica enterica serovar Typhi Ty2
uuuucccacucgcuuccuuuauu

SEQ ID NO: 1773662 - RNA, 13 nt, Salmonella enterica enterica serovar Typhi Ty2
uuuuccaucacgu

SEQ ID NO: 1773663 - RNA, 22 nt, Salmonella enterica enterica serovar Typhi Ty2
uuuuccauucacacaauuuucu

SEQ ID NO: 1773664 - RNA, 12 nt, Salmonella enterica enterica serovar Typhi Ty2
uuuuaugcguuu

SEQ ID NO: 1773665 - RNA, 23 nt, Salmonella enterica enterica serovar Typhi Ty2
uuuuauggaaucggcuaguaaua

SEQ ID NO: 1773666 - RNA, 16 nt, Salmonella enterica enterica serovar Typhi Ty2
uuuuauuauauuuaaa

SEQ ID NO: 1773667 - RNA, 19 nt, Salmonella enterica enterica serovar Typhi Ty2
uuuuauuuguguauuuuuu

SEQ ID NO: 1773668 - RNA, 17 nt, Salmonella enterica enterica serovar Typhi Ty2
uuuucaaccacggauaa

SEQ ID NO: 1773669 - RNA, 21 nt, Salmonella enterica enterica serovar Typhi Ty2
uuuucaacggcaucaauaauu

SEQ ID NO: 1773670 - RNA, 17 nt, Salmonella enterica enterica serovar Typhi Ty2
uuuucaaugcacgccac

SEQ ID NO: 1773671 - RNA, 22 nt, Salmonella enterica enterica serovar Typhi Ty2
uuuuccagccgcuuuucgcuua

SEQ ID NO: 1773672 - RNA, 18 nt, Salmonella enterica enterica serovar Typhi Ty2
uuuuccacagacccagua

SEQ ID NO: 1773673 - RNA, 19 nt, Salmonella enterica enterica serovar Typhi Ty2
uuuuccagcauuucuucaa

SEQ ID NO: 1773674 - RNA, 22 nt, Salmonella enterica enterica serovar Typhi Ty2
uuuuccagcgccgccagaauca

SEQ ID NO: 1773675 - RNA, 21 nt, Salmonella enterica enterica serovar Typhi Ty2
uuuggcaaucaaauccagcuc

SEQ ID NO: 1773676 - RNA, 24 nt, Salmonella enterica enterica serovar Typhi Ty2
uuuggcaggccucuaucuucucag

SEQ ID NO: 1773677 - RNA, 24 nt, Salmonella enterica enterica serovar Typhi Ty2
uuuggcaucaaaguuauuuaccac

SEQ ID NO: 1773678 - RNA, 12 nt, Salmonella enterica enterica serovar Typhi Ty2
uuugcuuuguag

SEQ ID NO: 1773679 - RNA, 21 nt, Salmonella enterica enterica serovar Typhi Ty2
uuugcuucucgccuucggccu

SEQ ID NO: 1773680 - RNA, 17 nt, Salmonella enterica enterica serovar Typhi Ty2
uuugcuuucucgggccu

SEQ ID NO: 1773681 - RNA, 19 nt, Salmonella enterica enterica serovar Typhi Ty2
uuugcuguuuuauuuccuc

SEQ ID NO: 1773682 - RNA, 17 nt, Salmonella enterica enterica serovar Typhi Ty2
uuugcuguuuuuuguug

SEQ ID NO: 1773683 - RNA, 12 nt, Salmonella enterica enterica serovar Typhi Ty2
uuugcuuccagu

SEQ ID NO: 1773684 - RNA, 20 nt, Salmonella enterica enterica serovar Typhi Ty2
uuugcuucaauaaguuagcu

SEQ ID NO: 1773685 - RNA, 15 nt, Salmonella enterica enterica serovar Typhi Ty2
uuugcgcuacgcugc

SEQ ID NO: 1773686 - RNA, 22 nt, Salmonella enterica enterica serovar Typhi Ty2
uuugcggacuagacagccucuc

SEQ ID NO: 1773687 - RNA, 19 nt, Salmonella enterica enterica serovar Typhi Ty2
uuugcggcgucgccuggug

SEQ ID NO: 1773688 - RNA, 16 nt, Salmonella enterica enterica serovar Typhi Ty2
uuugcgguuuuaauuu

SEQ ID NO: 1773689 - RNA, 18 nt, Salmonella enterica enterica serovar Typhi Ty2
uuugcguaaaaaacauca

SEQ ID NO: 1773690 - RNA, 18 nt, Salmonella enterica enterica serovar Typhi Ty2
uuugcgucguuaacugca

SEQ ID NO: 1773691 - RNA, 19 nt, Salmonella enterica enterica serovar Typhi Ty2
uuugcuacaccccuucugg

SEQ ID NO: 1773692 - RNA, 12 nt, Salmonella enterica enterica serovar Typhi Ty2
uuugcucgccau

SEQ ID NO: 1773693 - RNA, 22 nt, Salmonella enterica enterica serovar Typhi Ty2
uuugcucaguucagcggucaua

SEQ ID NO: 1773694 - RNA, 19 nt, Salmonella enterica enterica serovar Typhi Ty2
uuugcugcauuucuuguug

SEQ ID NO: 1773695 - RNA, 11 nt, Salmonella enterica enterica serovar Typhi Ty2
uuugcugccac

SEQ ID NO: 1773696 - RNA, 20 nt, Salmonella enterica enterica serovar Typhi Ty2
uuugcuggaaaaauaagagg

SEQ ID NO: 1773697 - RNA, 15 nt, Salmonella enterica enterica serovar Typhi Ty2
uuuguacagcuugcc

SEQ ID NO: 1773698 - RNA, 14 nt, Salmonella enterica enterica serovar Typhi Ty2
uuuguaacauauuu

SEQ ID NO: 1773699 - RNA, 17 nt, Salmonella enterica enterica serovar Typhi Ty2
uuuguaacauauuuuua

SEQ ID NO: 1773700 - RNA, 18 nt, Salmonella enterica enterica serovar Typhi Ty2
uuuguaacauauuuuuau

SEQ ID NO: 1773701 - RNA, 19 nt, Salmonella enterica enterica serovar Typhi Ty2
uuuguaaaauacauucucu

SEQ ID NO: 1773702 - RNA, 17 nt, Salmonella enterica enterica serovar Typhi Ty2
uuuguaaaauacauucu

SEQ ID NO: 1773703 - RNA, 21 nt, Salmonella enterica enterica serovar Typhi Ty2
uuugggaauuagcgaaucaca

SEQ ID NO: 1773704 - RNA, 18 nt, Salmonella enterica enterica serovar Typhi Ty2
uuugggcagauaucggaa

SEQ ID NO: 1773705 - RNA, 17 nt, Salmonella enterica enterica serovar Typhi Ty2
uuuggcgggcuuauccc

SEQ ID NO: 1773706 - RNA, 18 nt, Salmonella enterica enterica serovar Typhi Ty2
uuuggcgaauaaucaacc

SEQ ID NO: 1773707 - RNA, 21 nt, Salmonella enterica enterica serovar Typhi Ty2
uuuggucggcguaacccagug

SEQ ID NO: 1773708 - RNA, 21 nt, Salmonella enterica enterica serovar Typhi Ty2
uuuggugcccgcguggaaaac

SEQ ID NO: 1773709 - RNA, 19 nt, Salmonella enterica enterica serovar Typhi Ty2
uuugguuagggaucaucuu

SEQ ID NO: 1773710 - RNA, 18 nt, Salmonella enterica enterica serovar Typhi Ty2
uuugguuacuauuuuuca

SEQ ID NO: 1773711 - RNA, 13 nt, Salmonella enterica enterica serovar Typhi Ty2
uuuuaaauguuuu

SEQ ID NO: 1773712 - RNA, 17 nt, Salmonella enterica enterica serovar Typhi Ty2
uuuuaaauguuuuuuca

SEQ ID NO: 1773713 - RNA, 13 nt, Salmonella enterica enterica serovar Typhi Ty2
uuuuaaauugaag

SEQ ID NO: 1773714 - RNA, 12 nt, Salmonella enterica enterica serovar Typhi Ty2
uuuuaaccauca

SEQ ID NO: 1773715 - RNA, 20 nt, Salmonella enterica enterica serovar Typhi Ty2
uuuuaaggcggcaaagauaa

SEQ ID NO: 1773716 - RNA, 22 nt, Salmonella enterica enterica serovar Typhi Ty2
uuuuaaauaacuuuuaauuuuu

SEQ ID NO: 1773717 - RNA, 19 nt, Salmonella enterica enterica serovar Typhi Ty2
uuuuaaauaacuuuuaauu

SEQ ID NO: 1773718 - RNA, 15 nt, Salmonella enterica enterica serovar Typhi Ty2
uuuuaaacgccugau

SEQ ID NO: 1773719 - RNA, 14 nt, Salmonella enterica enterica serovar Typhi Ty2
uuuuaaaauguuuu

SEQ ID NO: 1773720 - RNA, 21 nt, Salmonella enterica enterica serovar Typhi Ty2
uuuuaaaauguuuuuguuguu

SEQ ID NO: 1773721 - RNA, 13 nt, Salmonella enterica enterica serovar Typhi Ty2
uuuuaaaaguuag

SEQ ID NO: 1773722 - RNA, 22 nt, Salmonella enterica enterica serovar Typhi Ty2
uuuguucagacacauucuguga

SEQ ID NO: 1773723 - RNA, 18 nt, Salmonella enterica enterica serovar Typhi Ty2
uuuguuaucuacagugua

SEQ ID NO: 1773724 - RNA, 18 nt, Salmonella enterica enterica serovar Typhi Ty2
uuuguuuaucauccugac

SEQ ID NO: 1773725 - RNA, 22 nt, Salmonella enterica enterica serovar Typhi Ty2
uuuguugaucugguucacagau

SEQ ID NO: 1773726 - RNA, 12 nt, Salmonella enterica enterica serovar Typhi Ty2
uuuguuuaaaaa

SEQ ID NO: 1773727 - RNA, 18 nt, Salmonella enterica enterica serovar Typhi Ty2
uuuguuuuccagauucuc

SEQ ID NO: 1773728 - RNA, 18 nt, Salmonella enterica enterica serovar Typhi Ty2
uuugucugucggacucag

SEQ ID NO: 1773729 - RNA, 18 nt, Salmonella enterica enterica serovar Typhi Ty2
uuugucgcuguuaaucuc

SEQ ID NO: 1773730 - RNA, 23 nt, Salmonella enterica enterica serovar Typhi Ty2
uuuguggccugcuuaaacaguau

SEQ ID NO: 1773731 - RNA, 18 nt, Salmonella enterica enterica serovar Typhi Ty2
uuuacuaaugaauuuaau

SEQ ID NO: 1773732 - RNA, 22 nt, Salmonella enterica enterica serovar Typhi Ty2
uuuacguaacugcgguaaauaa

SEQ ID NO: 1773733 - RNA, 20 nt, Salmonella enterica enterica serovar Typhi Ty2
uuuacgcagauaacuuccuu

SEQ ID NO: 1773734 - RNA, 20 nt, Salmonella enterica enterica serovar Typhi Ty2
uuuacggcccuaccauuacc

SEQ ID NO: 1773735 - RNA, 13 nt, Salmonella enterica enterica serovar Typhi Ty2
uuuacgcugcucc

SEQ ID NO: 1773736 - RNA, 23 nt, Salmonella enterica enterica serovar Typhi Ty2
uuuacacggugugaucaccgccc

SEQ ID NO: 1773737 - RNA, 21 nt, Salmonella enterica enterica serovar Typhi Ty2
uuuacgauacguuuaaaauga

SEQ ID NO: 1773738 - RNA, 20 nt, Salmonella enterica enterica serovar Typhi Ty2
uuuacugcgaaggcuacugc

SEQ ID NO: 1773739 - RNA, 20 nt, Salmonella enterica enterica serovar Typhi Ty2
uuuacugaauaacagcacca

SEQ ID NO: 1773740 - RNA, 14 nt, Salmonella enterica enterica serovar Typhi Ty2
uuuacugacaauaa

SEQ ID NO: 1773741 - RNA, 18 nt, Salmonella enterica enterica serovar Typhi Ty2
uuuacuuuuuuaaauguu

SEQ ID NO: 1773742 - RNA, 12 nt, Salmonella enterica enterica serovar Typhi Ty2
uuuacuuucauu

SEQ ID NO: 1773743 - RNA, 16 nt, Salmonella enterica enterica serovar Typhi Ty2
uuuacuuaauucugcu

SEQ ID NO: 1773744 - RNA, 19 nt, Salmonella enterica enterica serovar Typhi Ty2
uuuaggcggcuucacgcca

SEQ ID NO: 1773745 - RNA, 17 nt, Salmonella enterica enterica serovar Typhi Ty2
uuuaguuucuuuucguu

SEQ ID NO: 1773746 - RNA, 14 nt, Salmonella enterica enterica serovar Typhi Ty2
uuuagaaaauauau

SEQ ID NO: 1773747 - RNA, 13 nt, Salmonella enterica enterica serovar Typhi Ty2
uuuagaauuaucu

SEQ ID NO: 1773748 - RNA, 17 nt, Salmonella enterica enterica serovar Typhi Ty2
uuuagaauuaucugaaa

SEQ ID NO: 1773749 - RNA, 13 nt, Salmonella enterica enterica serovar Typhi Ty2
uuuagcaccagac

SEQ ID NO: 1773750 - RNA, 14 nt, Salmonella enterica enterica serovar Typhi Ty2
uuuauaacauaaau

SEQ ID NO: 1773751 - RNA, 23 nt, Salmonella enterica enterica serovar Typhi Ty2
uuuauaacauaaauaguauuagu

SEQ ID NO: 1773752 - RNA, 13 nt, Salmonella enterica enterica serovar Typhi Ty2
uuuauaaaguaaa

SEQ ID NO: 1773753 - RNA, 14 nt, Salmonella enterica enterica serovar Typhi Ty2
uuuaucagaccugu

SEQ ID NO: 1773754 - RNA, 12 nt, Salmonella enterica enterica serovar Typhi Ty2
uuuaucaggccu

SEQ ID NO: 1773755 - RNA, 20 nt, Salmonella enterica enterica serovar Typhi Ty2
uuuaucaggccuacaagaau

SEQ ID NO: 1773756 - RNA, 21 nt, Salmonella enterica enterica serovar Typhi Ty2
uuuauauucugggcuuacuuu

SEQ ID NO: 1773757 - RNA, 15 nt, Salmonella enterica enterica serovar Typhi Ty2
uuuauauuuuuaagg

SEQ ID NO: 1773758 - RNA, 18 nt, Salmonella enterica enterica serovar Typhi Ty2
uuuaucuuuuacgcuguc

SEQ ID NO: 1773759 - RNA, 22 nt, Salmonella enterica enterica serovar Typhi Ty2
uuuaucuuuaaauuucagggcu

SEQ ID NO: 1773760 - RNA, 22 nt, Salmonella enterica enterica serovar Typhi Ty2
uuuaucuucucuaucagcgccu

SEQ ID NO: 1773761 - RNA, 17 nt, Salmonella enterica enterica serovar Typhi Ty2
uuuaucugcccuuucuu

SEQ ID NO: 1773762 - RNA, 15 nt, Salmonella enterica enterica serovar Typhi Ty2
uuuaucuauuucuua

SEQ ID NO: 1773763 - RNA, 24 nt, Salmonella enterica enterica serovar Typhi Ty2
uuuaucuauucagguuauuugccu

SEQ ID NO: 1773764 - RNA, 13 nt, Salmonella enterica enterica serovar Typhi Ty2
uuuaucuauuucu

SEQ ID NO: 1773765 - RNA, 15 nt, Salmonella enterica enterica serovar Typhi Ty2
uuuaucgggcuguug

SEQ ID NO: 1773766 - RNA, 22 nt, Salmonella enterica enterica serovar Typhi Ty2
uuuauccccgcuggcgcgggga

SEQ ID NO: 1773767 - RNA, 22 nt, Salmonella enterica enterica serovar Typhi Ty2
uuuauccccgcuggugcgggga

SEQ ID NO: 1773768 - RNA, 18 nt, Salmonella enterica enterica serovar Typhi Ty2
uuuauccggcgccauagu

SEQ ID NO: 1773769 - RNA, 17 nt, Salmonella enterica enterica serovar Typhi Ty2
uuuaucgaucuccaucu

SEQ ID NO: 1773770 - RNA, 11 nt, Salmonella enterica enterica serovar Typhi Ty2
uuuauccagua

SEQ ID NO: 1773771 - RNA, 11 nt, Salmonella enterica enterica serovar Typhi Ty2
uuuaugguucc

SEQ ID NO: 1773772 - RNA, 15 nt, Salmonella enterica enterica serovar Typhi Ty2
uuuauggcacaucag

SEQ ID NO: 1773773 - RNA, 13 nt, Salmonella enterica enterica serovar Typhi Ty2
uuuauuaacccuu

SEQ ID NO: 1773774 - RNA, 18 nt, Salmonella enterica enterica serovar Typhi Ty2
uuuauuaccugguauuau

SEQ ID NO: 1773775 - RNA, 20 nt, Salmonella enterica enterica serovar Typhi Ty2
uuuaugcaguuccguugcaa

SEQ ID NO: 1773776 - RNA, 22 nt, Salmonella enterica enterica serovar Typhi Ty2
uuuaugcacgccgggaauuauu

SEQ ID NO: 1773777 - RNA, 15 nt, Salmonella enterica enterica serovar Typhi Ty2
uuuaugcguuauaga

SEQ ID NO: 1773778 - RNA, 13 nt, Salmonella enterica enterica serovar Typhi Ty2
uuuccaaaaucca

SEQ ID NO: 1773779 - RNA, 22 nt, Salmonella enterica enterica serovar Typhi Ty2
uuuccacaaucccggcaacugc

SEQ ID NO: 1773780 - RNA, 13 nt, Salmonella enterica enterica serovar Typhi Ty2
uuucauuucugcc

SEQ ID NO: 1773781 - RNA, 16 nt, Salmonella enterica enterica serovar Typhi Ty2
uuucauuucgaucugu

SEQ ID NO: 1773782 - RNA, 16 nt, Salmonella enterica enterica serovar Typhi Ty2
uuucauguaaaugacg

SEQ ID NO: 1773783 - RNA, 21 nt, Salmonella enterica enterica serovar Typhi Ty2
uuucauggucaucgcaaauuc

SEQ ID NO: 1773784 - RNA, 22 nt, Salmonella enterica enterica serovar Typhi Ty2
uuucauggucaucgcaaauucu

SEQ ID NO: 1773785 - RNA, 14 nt, Salmonella enterica enterica serovar Typhi Ty2
uuucauuacgcuuc

SEQ ID NO: 1773786 - RNA, 14 nt, Salmonella enterica enterica serovar Typhi Ty2
uuucaugccauacu

SEQ ID NO: 1773787 - RNA, 16 nt, Salmonella enterica enterica serovar Typhi Ty2
uuucaugccauacucc

SEQ ID NO: 1773788 - RNA, 16 nt, Salmonella enterica enterica serovar Typhi Ty2
uuucaugauauucugu

SEQ ID NO: 1773789 - RNA, 15 nt, Salmonella enterica enterica serovar Typhi Ty2
uuucaucuucaguaa

SEQ ID NO: 1773790 - RNA, 19 nt, Salmonella enterica enterica serovar Typhi Ty2
uuucaucgccgauuccugc

SEQ ID NO: 1773791 - RNA, 19 nt, Salmonella enterica enterica serovar Typhi Ty2
uuucaucuccgauaaauaa

SEQ ID NO: 1773792 - RNA, 12 nt, Salmonella enterica enterica serovar Typhi Ty2
uuucaucaccau

SEQ ID NO: 1773793 - RNA, 21 nt, Salmonella enterica enterica serovar Typhi Ty2
uuucagcguaccgaagaacau

SEQ ID NO: 1773794 - RNA, 18 nt, Salmonella enterica enterica serovar Typhi Ty2
uuucagcucgcaggccau

SEQ ID NO: 1773795 - RNA, 22 nt, Salmonella enterica enterica serovar Typhi Ty2
uuucagcggcagcucugccugu

SEQ ID NO: 1773796 - RNA, 12 nt, Salmonella enterica enterica serovar Typhi Ty2
uuucagccccuu

SEQ ID NO: 1773797 - RNA, 19 nt, Salmonella enterica enterica serovar Typhi Ty2
uuucagccgcgcauagcug

SEQ ID NO: 1773798 - RNA, 14 nt, Salmonella enterica enterica serovar Typhi Ty2
uuucagcagugcaa

SEQ ID NO: 1773799 - RNA, 15 nt, Salmonella enterica enterica serovar Typhi Ty2
uuucacuuaucccug

SEQ ID NO: 1773800 - RNA, 14 nt, Salmonella enterica enterica serovar Typhi Ty2
uuucacuuccaugc

SEQ ID NO: 1773801 - RNA, 22 nt, Salmonella enterica enterica serovar Typhi Ty2
uuucagaggucaggauuuucgc

SEQ ID NO: 1773802 - RNA, 18 nt, Salmonella enterica enterica serovar Typhi Ty2
uuucagaucgguaaaagc

SEQ ID NO: 1773803 - RNA, 20 nt, Salmonella enterica enterica serovar Typhi Ty2
uuucauaugcgggguuugca

SEQ ID NO: 1773804 - RNA, 23 nt, Salmonella enterica enterica serovar Typhi Ty2
uuucauauuauuauauagacucc

SEQ ID NO: 1773805 - RNA, 15 nt, Salmonella enterica enterica serovar Typhi Ty2
uuucauagaaccacu

SEQ ID NO: 1773806 - RNA, 16 nt, Salmonella enterica enterica serovar Typhi Ty2
uuucagggaaaagaag

SEQ ID NO: 1773807 - RNA, 15 nt, Salmonella enterica enterica serovar Typhi Ty2
uuucaguugcccauu

SEQ ID NO: 1773808 - RNA, 14 nt, Salmonella enterica enterica serovar Typhi Ty2
uuucagugauaaag

SEQ ID NO: 1773809 - RNA, 23 nt, Salmonella enterica enterica serovar Typhi Ty2
uuucaauaauggcgcgaaaacag

SEQ ID NO: 1773810 - RNA, 20 nt, Salmonella enterica enterica serovar Typhi Ty2
uuucaauccuucuucugaaa

SEQ ID NO: 1773811 - RNA, 16 nt, Salmonella enterica enterica serovar Typhi Ty2
uuucaaucgccaccac

SEQ ID NO: 1773812 - RNA, 18 nt, Salmonella enterica enterica serovar Typhi Ty2
uuucaauacuccacaguu

SEQ ID NO: 1773813 - RNA, 21 nt, Salmonella enterica enterica serovar Typhi Ty2
uuucaauaaucccuucuuuua

SEQ ID NO: 1773814 - RNA, 11 nt, Salmonella enterica enterica serovar Typhi Ty2
uuucaauaaua

SEQ ID NO: 1773815 - RNA, 20 nt, Salmonella enterica enterica serovar Typhi Ty2
uuucaacagcacccaggcac

SEQ ID NO: 1773816 - RNA, 19 nt, Salmonella enterica enterica serovar Typhi Ty2
uuucaacuuccgcguuagg

SEQ ID NO: 1773817 - RNA, 15 nt, Salmonella enterica enterica serovar Typhi Ty2
uuucaacugccccuu

SEQ ID NO: 1773818 - RNA, 22 nt, Salmonella enterica enterica serovar Typhi Ty2
uuucaacggauugugaaauucg

SEQ ID NO: 1773819 - RNA, 18 nt, Salmonella enterica enterica serovar Typhi Ty2
uuucaacccccucagcaa

SEQ ID NO: 1773820 - RNA, 20 nt, Salmonella enterica enterica serovar Typhi Ty2
uuucaccucacuccagaccu

SEQ ID NO: 1773821 - RNA, 24 nt, Salmonella enterica enterica serovar Typhi Ty2
uuucaccgcgucguuacgcucguc

SEQ ID NO: 1773822 - RNA, 23 nt, Salmonella enterica enterica serovar Typhi Ty2
uuucacgccauugccaggacuga

SEQ ID NO: 1773823 - RNA, 19 nt, Salmonella enterica enterica serovar Typhi Ty2
uuucaccuggaugcugccu

SEQ ID NO: 1773824 - RNA, 21 nt, Salmonella enterica enterica serovar Typhi Ty2
uuucacgccuuuugacgcuuc

SEQ ID NO: 1773825 - RNA, 21 nt, Salmonella enterica enterica serovar Typhi Ty2
uuucacuaauccccauuuuuu

SEQ ID NO: 1773826 - RNA, 23 nt, Salmonella enterica enterica serovar Typhi Ty2
uuucaauuccgcaggagagccag

SEQ ID NO: 1773827 - RNA, 17 nt, Salmonella enterica enterica serovar Typhi Ty2
uuucaauuccacaggcg

SEQ ID NO: 1773828 - RNA, 23 nt, Salmonella enterica enterica serovar Typhi Ty2
uuuauugggcguaagaaaaguuu

SEQ ID NO: 1773829 - RNA, 22 nt, Salmonella enterica enterica serovar Typhi Ty2
uuuauugaagugcgaaauuuaa

SEQ ID NO: 1773830 - RNA, 18 nt, Salmonella enterica enterica serovar Typhi Ty2
uuuauuuaggauuugucu

SEQ ID NO: 1773831 - RNA, 17 nt, Salmonella enterica enterica serovar Typhi Ty2
uuuauuaguaauaucag

SEQ ID NO: 1773832 - RNA, 13 nt, Salmonella enterica enterica serovar Typhi Ty2
uuuauuauuucca

SEQ ID NO: 1773833 - RNA, 15 nt, Salmonella enterica enterica serovar Typhi Ty2
uuuauucgcuuguuu

SEQ ID NO: 1773834 - RNA, 13 nt, Salmonella enterica enterica serovar Typhi Ty2
uuucaaauagcug

SEQ ID NO: 1773835 - RNA, 23 nt, Salmonella enterica enterica serovar Typhi Ty2
uuuauuuggcucugaagcguaaa

SEQ ID NO: 1773836 - RNA, 21 nt, Salmonella enterica enterica serovar Typhi Ty2
uuuauuuuuuuacauuauucc

SEQ ID NO: 1773837 - RNA, 17 nt, Salmonella enterica enterica serovar Typhi Ty2
uuucuguaauuugaaau

SEQ ID NO: 1773838 - RNA, 21 nt, Salmonella enterica enterica serovar Typhi Ty2
uuucuggcuucagccugugca

SEQ ID NO: 1773839 - RNA, 15 nt, Salmonella enterica enterica serovar Typhi Ty2
uuucuguuccgaaau

SEQ ID NO: 1773840 - RNA, 20 nt, Salmonella enterica enterica serovar Typhi Ty2
uuucuguguugcucaaaaaa

SEQ ID NO: 1773841 - RNA, 14 nt, Salmonella enterica enterica serovar Typhi Ty2
uuucuguuaucagg

SEQ ID NO: 1773842 - RNA, 13 nt, Salmonella enterica enterica serovar Typhi Ty2
uuucuuaauuccu

SEQ ID NO: 1773843 - RNA, 18 nt, Salmonella enterica enterica serovar Typhi Ty2
uuucuuaauaugcugccu

SEQ ID NO: 1773844 - RNA, 12 nt, Salmonella enterica enterica serovar Typhi Ty2
uuucuuaacccc

SEQ ID NO: 1773845 - RNA, 17 nt, Salmonella enterica enterica serovar Typhi Ty2
uuucuuauuacaagaaa

SEQ ID NO: 1773846 - RNA, 21 nt, Salmonella enterica enterica serovar Typhi Ty2
uuucuucaagcguuuccagag

SEQ ID NO: 1773847 - RNA, 13 nt, Salmonella enterica enterica serovar Typhi Ty2
uuucuuucaucaa

SEQ ID NO: 1773848 - RNA, 14 nt, Salmonella enterica enterica serovar Typhi Ty2
uuucuuucaucaaa

SEQ ID NO: 1773849 - RNA, 17 nt, Salmonella enterica enterica serovar Typhi Ty2
uuucuuucagcucuuca

SEQ ID NO: 1773850 - RNA, 22 nt, Salmonella enterica enterica serovar Typhi Ty2
uuucuugaugugucuauuuauu

SEQ ID NO: 1773851 - RNA, 21 nt, Salmonella enterica enterica serovar Typhi Ty2
uuucuugccacuggccuccca

SEQ ID NO: 1773852 - RNA, 11 nt, Salmonella enterica enterica serovar Typhi Ty2
uuucuucuuca

SEQ ID NO: 1773853 - RNA, 15 nt, Salmonella enterica enterica serovar Typhi Ty2
uuucuucuuaacacu

SEQ ID NO: 1773854 - RNA, 21 nt, Salmonella enterica enterica serovar Typhi Ty2
uuucuucccuccccugcgccu

SEQ ID NO: 1773855 - RNA, 13 nt, Salmonella enterica enterica serovar Typhi Ty2
uuucuucaucaaa

SEQ ID NO: 1773856 - RNA, 14 nt, Salmonella enterica enterica serovar Typhi Ty2
uuugaaguguuccu

SEQ ID NO: 1773857 - RNA, 15 nt, Salmonella enterica enterica serovar Typhi Ty2
uuugaacucuuucag

SEQ ID NO: 1773858 - RNA, 13 nt, Salmonella enterica enterica serovar Typhi Ty2
uuucuuuuccaga

SEQ ID NO: 1773859 - RNA, 17 nt, Salmonella enterica enterica serovar Typhi Ty2
uuucuuugcgaaacauc

SEQ ID NO: 1773860 - RNA, 13 nt, Salmonella enterica enterica serovar Typhi Ty2
uuugaaaaucaca

SEQ ID NO: 1773861 - RNA, 21 nt, Salmonella enterica enterica serovar Typhi Ty2
uuugacgacaaacuccagcuc

SEQ ID NO: 1773862 - RNA, 13 nt, Salmonella enterica enterica serovar Typhi Ty2
uuugaccucgccu

SEQ ID NO: 1773863 - RNA, 22 nt, Salmonella enterica enterica serovar Typhi Ty2
uuugacucgcuacgcucgcccu

SEQ ID NO: 1773864 - RNA, 22 nt, Salmonella enterica enterica serovar Typhi Ty2
uuugacgccgggaaauuuuucg

SEQ ID NO: 1773865 - RNA, 15 nt, Salmonella enterica enterica serovar Typhi Ty2
uuugagaaaaacauc

SEQ ID NO: 1773866 - RNA, 15 nt, Salmonella enterica enterica serovar Typhi Ty2
uuugagcaacuucag

SEQ ID NO: 1773867 - RNA, 22 nt, Salmonella enterica enterica serovar Typhi Ty2
uuugagcaucaaacuuuuaaau

SEQ ID NO: 1773868 - RNA, 18 nt, Salmonella enterica enterica serovar Typhi Ty2
uuugaggaaaccuuucuu

SEQ ID NO: 1773869 - RNA, 12 nt, Salmonella enterica enterica serovar Typhi Ty2
uuugaggaaacc

SEQ ID NO: 1773870 - RNA, 21 nt, Salmonella enterica enterica serovar Typhi Ty2
uuugauagacguaaugaucag

SEQ ID NO: 1773871 - RNA, 15 nt, Salmonella enterica enterica serovar Typhi Ty2
uuugauaagagaaaa

SEQ ID NO: 1773872 - RNA, 14 nt, Salmonella enterica enterica serovar Typhi Ty2
uuugauacucugcu

SEQ ID NO: 1773873 - RNA, 17 nt, Salmonella enterica enterica serovar Typhi Ty2
uuugauaaacugcgcca

SEQ ID NO: 1773874 - RNA, 17 nt, Salmonella enterica enterica serovar Typhi Ty2
uuugagucgcauccagu

SEQ ID NO: 1773875 - RNA, 23 nt, Salmonella enterica enterica serovar Typhi Ty2
uuugauuuauuuugaauuuuuau

SEQ ID NO: 1773876 - RNA, 14 nt, Salmonella enterica enterica serovar Typhi Ty2
uuugaucugcuuga

SEQ ID NO: 1773877 - RNA, 18 nt, Salmonella enterica enterica serovar Typhi Ty2
uuugauccguuucagaaa

SEQ ID NO: 1773878 - RNA, 21 nt, Salmonella enterica enterica serovar Typhi Ty2
uuugaucccguccgcgcucau

SEQ ID NO: 1773879 - RNA, 20 nt, Salmonella enterica enterica serovar Typhi Ty2
uuugauccguuucagaaaga

SEQ ID NO: 1773880 - RNA, 17 nt, Salmonella enterica enterica serovar Typhi Ty2
uuugauauuuaaucgcu

SEQ ID NO: 1773881 - RNA, 21 nt, Salmonella enterica enterica serovar Typhi Ty2
uuugauguccggcgcguucau

SEQ ID NO: 1773882 - RNA, 15 nt, Salmonella enterica enterica serovar Typhi Ty2
uuugcauucgcuccu

SEQ ID NO: 1773883 - RNA, 14 nt, Salmonella enterica enterica serovar Typhi Ty2
uuugcauugccacu

SEQ ID NO: 1773884 - RNA, 20 nt, Salmonella enterica enterica serovar Typhi Ty2
uuugccaaauauucucccua

SEQ ID NO: 1773885 - RNA, 18 nt, Salmonella enterica enterica serovar Typhi Ty2
uuugccagacgggccagg

SEQ ID NO: 1773886 - RNA, 23 nt, Salmonella enterica enterica serovar Typhi Ty2
uuugcgccggcaguccuugcagc

SEQ ID NO: 1773887 - RNA, 22 nt, Salmonella enterica enterica serovar Typhi Ty2
uuugcgcccgcucuuauugcuc

SEQ ID NO: 1773888 - RNA, 11 nt, Salmonella enterica enterica serovar Typhi Ty2
uuugcgcggcu

SEQ ID NO: 1773889 - RNA, 10 nt, Salmonella enterica enterica serovar Typhi Ty2
uuugcgcgcg

SEQ ID NO: 1773890 - RNA, 21 nt, Salmonella enterica enterica serovar Typhi Ty2
uuugcgcgaggucgagcucag

SEQ ID NO: 1773891 - RNA, 20 nt, Salmonella enterica enterica serovar Typhi Ty2
uuugcgcaguuuaaaucaca

SEQ ID NO: 1773892 - RNA, 15 nt, Salmonella enterica enterica serovar Typhi Ty2
uuugccucuggccag

SEQ ID NO: 1773893 - RNA, 15 nt, Salmonella enterica enterica serovar Typhi Ty2
uuugcgacacgcugc

SEQ ID NO: 1773894 - RNA, 22 nt, Salmonella enterica enterica serovar Typhi Ty2
uuugcacggcaucuuuguucug

SEQ ID NO: 1773895 - RNA, 20 nt, Salmonella enterica enterica serovar Typhi Ty2
uuugcaccgcuaaaaaacag

SEQ ID NO: 1773896 - RNA, 17 nt, Salmonella enterica enterica serovar Typhi Ty2
uuugcaccgcuaaaaaa

SEQ ID NO: 1773897 - RNA, 19 nt, Salmonella enterica enterica serovar Typhi Ty2
uuugcagguuacucacugc

SEQ ID NO: 1773898 - RNA, 13 nt, Salmonella enterica enterica serovar Typhi Ty2
uuugcauaaauaa

SEQ ID NO: 1773899 - RNA, 23 nt, Salmonella enterica enterica serovar Typhi Ty2
uuuccugaucaaucaacucuuua

SEQ ID NO: 1773900 - RNA, 21 nt, Salmonella enterica enterica serovar Typhi Ty2
uuuccugccuucugaaaguuu

SEQ ID NO: 1773901 - RNA, 18 nt, Salmonella enterica enterica serovar Typhi Ty2
uuuccugccuucugaaag

SEQ ID NO: 1773902 - RNA, 17 nt, Salmonella enterica enterica serovar Typhi Ty2
uuuccguauugcaaugc

SEQ ID NO: 1773903 - RNA, 16 nt, Salmonella enterica enterica serovar Typhi Ty2
uuuccgcugucuaucc

SEQ ID NO: 1773904 - RNA, 23 nt, Salmonella enterica enterica serovar Typhi Ty2
uuuccggucgcgcaaucgguaaa

SEQ ID NO: 1773905 - RNA, 20 nt, Salmonella enterica enterica serovar Typhi Ty2
uuucgaaacaggaaaaacau

SEQ ID NO: 1773906 - RNA, 12 nt, Salmonella enterica enterica serovar Typhi Ty2
uuucgccagcau

SEQ ID NO: 1773907 - RNA, 21 nt, Salmonella enterica enterica serovar Typhi Ty2
uuucgcaaacugaucgaggac

SEQ ID NO: 1773908 - RNA, 18 nt, Salmonella enterica enterica serovar Typhi Ty2
uuucgagcagaacuggcg

SEQ ID NO: 1773909 - RNA, 17 nt, Salmonella enterica enterica serovar Typhi Ty2
uuucgacggcaaccuuc

SEQ ID NO: 1773910 - RNA, 16 nt, Salmonella enterica enterica serovar Typhi Ty2
uuucgacuuucauuuc

SEQ ID NO: 1773911 - RNA, 16 nt, Salmonella enterica enterica serovar Typhi Ty2
uuucgaugaaaaagag

SEQ ID NO: 1773912 - RNA, 17 nt, Salmonella enterica enterica serovar Typhi Ty2
uuuccagcucagaaaua

SEQ ID NO: 1773913 - RNA, 22 nt, Salmonella enterica enterica serovar Typhi Ty2
uuuccagcuccagccgcugccu

SEQ ID NO: 1773914 - RNA, 18 nt, Salmonella enterica enterica serovar Typhi Ty2
uuuccagcauuagcgcca

SEQ ID NO: 1773915 - RNA, 21 nt, Salmonella enterica enterica serovar Typhi Ty2
uuuccagccguaccacccggg

SEQ ID NO: 1773916 - RNA, 23 nt, Salmonella enterica enterica serovar Typhi Ty2
uuuccagcacggcauaagccuca

SEQ ID NO: 1773917 - RNA, 23 nt, Salmonella enterica enterica serovar Typhi Ty2
uuuccagcacgaccuuuucuuca

SEQ ID NO: 1773918 - RNA, 20 nt, Salmonella enterica enterica serovar Typhi Ty2
uuuccagaguacauucucuu

SEQ ID NO: 1773919 - RNA, 20 nt, Salmonella enterica enterica serovar Typhi Ty2
uuuccaguugcggcaucaga

SEQ ID NO: 1773920 - RNA, 20 nt, Salmonella enterica enterica serovar Typhi Ty2
uuuccaguucuggcugcgcu

SEQ ID NO: 1773921 - RNA, 20 nt, Salmonella enterica enterica serovar Typhi Ty2
uuuccaguguuguucucuga

SEQ ID NO: 1773922 - RNA, 16 nt, Salmonella enterica enterica serovar Typhi Ty2
uuuccaggugcugcca

SEQ ID NO: 1773923 - RNA, 18 nt, Salmonella enterica enterica serovar Typhi Ty2
uuucccuuuuuaaaauga

SEQ ID NO: 1773924 - RNA, 17 nt, Salmonella enterica enterica serovar Typhi Ty2
uuuccgccaugaaaaaa

SEQ ID NO: 1773925 - RNA, 17 nt, Salmonella enterica enterica serovar Typhi Ty2
uuuccgcaucguuauca

SEQ ID NO: 1773926 - RNA, 18 nt, Salmonella enterica enterica serovar Typhi Ty2
uuuccgcgagagaaaaaa

SEQ ID NO: 1773927 - RNA, 15 nt, Salmonella enterica enterica serovar Typhi Ty2
uuucccaagucacgc

SEQ ID NO: 1773928 - RNA, 13 nt, Salmonella enterica enterica serovar Typhi Ty2
uuucccacuguuc

SEQ ID NO: 1773929 - RNA, 20 nt, Salmonella enterica enterica serovar Typhi Ty2
uuucccaacuguauuuugaa

SEQ ID NO: 1773930 - RNA, 22 nt, Salmonella enterica enterica serovar Typhi Ty2
uuuccccaaagguguuauuucu

SEQ ID NO: 1773931 - RNA, 15 nt, Salmonella enterica enterica serovar Typhi Ty2
uuuccccgacggccu

SEQ ID NO: 1773932 - RNA, 15 nt, Salmonella enterica enterica serovar Typhi Ty2
uuucccccacuucug

SEQ ID NO: 1773933 - RNA, 18 nt, Salmonella enterica enterica serovar Typhi Ty2
uuucccgcgugaacacca

SEQ ID NO: 1773934 - RNA, 16 nt, Salmonella enterica enterica serovar Typhi Ty2
uuucuacuacaacugu

SEQ ID NO: 1773935 - RNA, 17 nt, Salmonella enterica enterica serovar Typhi Ty2
uuucuacuacaacuguc

SEQ ID NO: 1773936 - RNA, 19 nt, Salmonella enterica enterica serovar Typhi Ty2
uuucuagggauaacaguau

SEQ ID NO: 1773937 - RNA, 13 nt, Salmonella enterica enterica serovar Typhi Ty2
uuucuacaaaugu

SEQ ID NO: 1773938 - RNA, 20 nt, Salmonella enterica enterica serovar Typhi Ty2
uuucgccguaaaacaacagc

SEQ ID NO: 1773939 - RNA, 15 nt, Salmonella enterica enterica serovar Typhi Ty2
uuucgcccucgccac

SEQ ID NO: 1773940 - RNA, 18 nt, Salmonella enterica enterica serovar Typhi Ty2
uuucgccccacuggcccc

SEQ ID NO: 1773941 - RNA, 16 nt, Salmonella enterica enterica serovar Typhi Ty2
uuucgcucgcuuugcc

SEQ ID NO: 1773942 - RNA, 15 nt, Salmonella enterica enterica serovar Typhi Ty2
uuucgcuguaauagu

SEQ ID NO: 1773943 - RNA, 15 nt, Salmonella enterica enterica serovar Typhi Ty2
uuucggacuuccugu

SEQ ID NO: 1773944 - RNA, 24 nt, Salmonella enterica enterica serovar Typhi Ty2
uuucguaaaauauauauuuucuca

SEQ ID NO: 1773945 - RNA, 15 nt, Salmonella enterica enterica serovar Typhi Ty2
uuucgggcacuggcg

SEQ ID NO: 1773946 - RNA, 16 nt, Salmonella enterica enterica serovar Typhi Ty2
uuucucaaacacuucu

SEQ ID NO: 1773947 - RNA, 16 nt, Salmonella enterica enterica serovar Typhi Ty2
uuucuaucguuauaua

SEQ ID NO: 1773948 - RNA, 13 nt, Salmonella enterica enterica serovar Typhi Ty2
uuucuaucccuuc

SEQ ID NO: 1773949 - RNA, 11 nt, Salmonella enterica enterica serovar Typhi Ty2
uuucucgccau

SEQ ID NO: 1773950 - RNA, 17 nt, Salmonella enterica enterica serovar Typhi Ty2
uuucucggcuuuccagc

SEQ ID NO: 1773951 - RNA, 14 nt, Salmonella enterica enterica serovar Typhi Ty2
uuucuccguuguug

SEQ ID NO: 1773952 - RNA, 19 nt, Salmonella enterica enterica serovar Typhi Ty2
uuucucccgccagaugcag

SEQ ID NO: 1773953 - RNA, 18 nt, Salmonella enterica enterica serovar Typhi Ty2
uuucucccgccagaugca

SEQ ID NO: 1773954 - RNA, 18 nt, Salmonella enterica enterica serovar Typhi Ty2
uuucucauuaaaaaaccg

SEQ ID NO: 1773955 - RNA, 12 nt, Salmonella enterica enterica serovar Typhi Ty2
uuucucaucaag

SEQ ID NO: 1773956 - RNA, 13 nt, Salmonella enterica enterica serovar Typhi Ty2
uuucucauuaaaa

SEQ ID NO: 1773957 - RNA, 11 nt, Salmonella enterica enterica serovar Typhi Ty2
uuucucagcca

SEQ ID NO: 1773958 - RNA, 18 nt, Salmonella enterica enterica serovar Typhi Ty2
uuucugacguaacuuauc

SEQ ID NO: 1773959 - RNA, 14 nt, Salmonella enterica enterica serovar Typhi Ty2
uuucugaauagaaa

SEQ ID NO: 1773960 - RNA, 16 nt, Salmonella enterica enterica serovar Typhi Ty2
uuucucguguagccag

SEQ ID NO: 1773961 - RNA, 14 nt, Salmonella enterica enterica serovar Typhi Ty2
uuucugaugcgccu

SEQ ID NO: 1773962 - RNA, 20 nt, Salmonella enterica enterica serovar Typhi Ty2
uuucugauaacgcaggcgau

SEQ ID NO: 1773963 - RNA, 17 nt, Salmonella enterica enterica serovar Typhi Ty2
uuucuggcaacagccau

SEQ ID NO: 1773964 - RNA, 15 nt, Salmonella enterica enterica serovar Typhi Ty2
uuucugcuggccuuu

SEQ ID NO: 1773965 - RNA, 18 nt, Salmonella enterica enterica serovar Typhi Ty2
uuucugccuuuaacaaau

SEQ ID NO: 1773966 - RNA, 14 nt, Salmonella enterica enterica serovar Typhi Ty2
uugccgcaggcaac

SEQ ID NO: 1773967 - RNA, 20 nt, Salmonella enterica enterica serovar Typhi Ty2
uugccggauggcacugcgcu

SEQ ID NO: 1773968 - RNA, 24 nt, Salmonella enterica enterica serovar Typhi Ty2
uugccgcgccagacgccauaucgc

SEQ ID NO: 1773969 - RNA, 23 nt, Salmonella enterica enterica serovar Typhi Ty2
uugcgcccgcucuuauugcucuu

SEQ ID NO: 1773970 - RNA, 17 nt, Salmonella enterica enterica serovar Typhi Ty2
uugcgacaaccuguagg

SEQ ID NO: 1773971 - RNA, 22 nt, Salmonella enterica enterica serovar Typhi Ty2
uugcgaauggccuccagcagca

SEQ ID NO: 1773972 - RNA, 15 nt, Salmonella enterica enterica serovar Typhi Ty2
uugccuuucagaucg

SEQ ID NO: 1773973 - RNA, 14 nt, Salmonella enterica enterica serovar Typhi Ty2
uugccggcaucauu

SEQ ID NO: 1773974 - RNA, 15 nt, Salmonella enterica enterica serovar Typhi Ty2
uugcgugucaucaaa

SEQ ID NO: 1773975 - RNA, 14 nt, Salmonella enterica enterica serovar Typhi Ty2
uugcgucuguuuuu

SEQ ID NO: 1773976 - RNA, 15 nt, Salmonella enterica enterica serovar Typhi Ty2
uugcguaagcagcug

SEQ ID NO: 1773977 - RNA, 15 nt, Salmonella enterica enterica serovar Typhi Ty2
uugcguaaugauuaa

SEQ ID NO: 1773978 - RNA, 14 nt, Salmonella enterica enterica serovar Typhi Ty2
uugcgcucugccag

SEQ ID NO: 1773979 - RNA, 24 nt, Salmonella enterica enterica serovar Typhi Ty2
uugcucacggcgauaccaguaaua

SEQ ID NO: 1773980 - RNA, 12 nt, Salmonella enterica enterica serovar Typhi Ty2
uugcucaaugga

SEQ ID NO: 1773981 - RNA, 17 nt, Salmonella enterica enterica serovar Typhi Ty2
uugcucaauggauuuuc

SEQ ID NO: 1773982 - RNA, 22 nt, Salmonella enterica enterica serovar Typhi Ty2
uugcucacccauuuuauccucu

SEQ ID NO: 1773983 - RNA, 11 nt, Salmonella enterica enterica serovar Typhi Ty2
uugcucaagcu

SEQ ID NO: 1773984 - RNA, 20 nt, Salmonella enterica enterica serovar Typhi Ty2
uugcgcguucggguuuuccu

SEQ ID NO: 1773985 - RNA, 16 nt, Salmonella enterica enterica serovar Typhi Ty2
uugcagacgugcaaua

SEQ ID NO: 1773986 - RNA, 15 nt, Salmonella enterica enterica serovar Typhi Ty2
uugcacguucugcug

SEQ ID NO: 1773987 - RNA, 13 nt, Salmonella enterica enterica serovar Typhi Ty2
uugcauuauauuu

SEQ ID NO: 1773988 - RNA, 18 nt, Salmonella enterica enterica serovar Typhi Ty2
uugcauggcaauuaaauu

SEQ ID NO: 1773989 - RNA, 13 nt, Salmonella enterica enterica serovar Typhi Ty2
uugcccuccagcc

SEQ ID NO: 1773990 - RNA, 20 nt, Salmonella enterica enterica serovar Typhi Ty2
uugcccgguggcgcugcgcu

SEQ ID NO: 1773991 - RNA, 22 nt, Salmonella enterica enterica serovar Typhi Ty2
uugcccggccguuaccguggcg

SEQ ID NO: 1773992 - RNA, 14 nt, Salmonella enterica enterica serovar Typhi Ty2
uugcccuuuuguuu

SEQ ID NO: 1773993 - RNA, 20 nt, Salmonella enterica enterica serovar Typhi Ty2
uugccgauuccaugcccagu

SEQ ID NO: 1773994 - RNA, 21 nt, Salmonella enterica enterica serovar Typhi Ty2
uugccacaauaucaucgucau

SEQ ID NO: 1773995 - RNA, 23 nt, Salmonella enterica enterica serovar Typhi Ty2
uugcccgcaggcuuccagauaca

SEQ ID NO: 1773996 - RNA, 23 nt, Salmonella enterica enterica serovar Typhi Ty2
uugccccguggcgggaugcccca

SEQ ID NO: 1773997 - RNA, 22 nt, Salmonella enterica enterica serovar Typhi Ty2
uugccccucccugaaucauauu

SEQ ID NO: 1773998 - RNA, 16 nt, Salmonella enterica enterica serovar Typhi Ty2
uuggugggugaugacg

SEQ ID NO: 1773999 - RNA, 18 nt, Salmonella enterica enterica serovar Typhi Ty2
uugggcagugcucgccaa

SEQ ID NO: 1774000 - RNA, 22 nt, Salmonella enterica enterica serovar Typhi Ty2
uuggcuccaguaccgggcagga

SEQ ID NO: 1774001 - RNA, 13 nt, Salmonella enterica enterica serovar Typhi Ty2
uuggcuccaguac

SEQ ID NO: 1774002 - RNA, 19 nt, Salmonella enterica enterica serovar Typhi Ty2
uuggcguaaaucaggccaa

SEQ ID NO: 1774003 - RNA, 18 nt, Salmonella enterica enterica serovar Typhi Ty2
uuggcgaauaaucaacca

SEQ ID NO: 1774004 - RNA, 11 nt, Salmonella enterica enterica serovar Typhi Ty2
uuggccagcgu

SEQ ID NO: 1774005 - RNA, 14 nt, Salmonella enterica enterica serovar Typhi Ty2
uuggcaucugcaau

SEQ ID NO: 1774006 - RNA, 14 nt, Salmonella enterica enterica serovar Typhi Ty2
uuggcgaucacaau

SEQ ID NO: 1774007 - RNA, 22 nt, Salmonella enterica enterica serovar Typhi Ty2
uuggcgaggaacaucagccagc

SEQ ID NO: 1774008 - RNA, 13 nt, Salmonella enterica enterica serovar Typhi Ty2
uugcuuuuuucca

SEQ ID NO: 1774009 - RNA, 17 nt, Salmonella enterica enterica serovar Typhi Ty2
uugcuuuucaucaccau

SEQ ID NO: 1774010 - RNA, 14 nt, Salmonella enterica enterica serovar Typhi Ty2
uugcuuucuugaau

SEQ ID NO: 1774011 - RNA, 14 nt, Salmonella enterica enterica serovar Typhi Ty2
uuggacgaggaaaa

SEQ ID NO: 1774012 - RNA, 16 nt, Salmonella enterica enterica serovar Typhi Ty2
uuggacgaggaaaaau

SEQ ID NO: 1774013 - RNA, 18 nt, Salmonella enterica enterica serovar Typhi Ty2
uugcugaaucugcggcug

SEQ ID NO: 1774014 - RNA, 17 nt, Salmonella enterica enterica serovar Typhi Ty2
uugcuguuaauuucccg

SEQ ID NO: 1774015 - RNA, 17 nt, Salmonella enterica enterica serovar Typhi Ty2
uugcugucgcgcaauac

SEQ ID NO: 1774016 - RNA, 16 nt, Salmonella enterica enterica serovar Typhi Ty2
uugcugcgcaggggcu

SEQ ID NO: 1774017 - RNA, 17 nt, Salmonella enterica enterica serovar Typhi Ty2
uugcuguuuuauuuccu

SEQ ID NO: 1774018 - RNA, 16 nt, Salmonella enterica enterica serovar Typhi Ty2
uugcuuaccuuguucu

SEQ ID NO: 1774019 - RNA, 16 nt, Salmonella enterica enterica serovar Typhi Ty2
uugcuuauccggccua

SEQ ID NO: 1774020 - RNA, 13 nt, Salmonella enterica enterica serovar Typhi Ty2
uuguuuaccccag

SEQ ID NO: 1774021 - RNA, 13 nt, Salmonella enterica enterica serovar Typhi Ty2
uuguuuaaaaacc

SEQ ID NO: 1774022 - RNA, 20 nt, Salmonella enterica enterica serovar Typhi Ty2
uuguuguuaauuugauuuau

SEQ ID NO: 1774023 - RNA, 23 nt, Salmonella enterica enterica serovar Typhi Ty2
uuuaaaacuucccgcgcagugca

SEQ ID NO: 1774024 - RNA, 16 nt, Salmonella enterica enterica serovar Typhi Ty2
uuuaaaauccggcugc

SEQ ID NO: 1774025 - RNA, 13 nt, Salmonella enterica enterica serovar Typhi Ty2
uuuaaaaucaacg

SEQ ID NO: 1774026 - RNA, 21 nt, Salmonella enterica enterica serovar Typhi Ty2
uuuaacgcaaccgucucacca

SEQ ID NO: 1774027 - RNA, 18 nt, Salmonella enterica enterica serovar Typhi Ty2
uuuaauaccgcguaaaaa

SEQ ID NO: 1774028 - RNA, 21 nt, Salmonella enterica enterica serovar Typhi Ty2
uuuaauacgcugucgaugaua

SEQ ID NO: 1774029 - RNA, 15 nt, Salmonella enterica enterica serovar Typhi Ty2
uuuaauuuucuguaa

SEQ ID NO: 1774030 - RNA, 21 nt, Salmonella enterica enterica serovar Typhi Ty2
uuuaauuuucuguaauucucc

SEQ ID NO: 1774031 - RNA, 19 nt, Salmonella enterica enterica serovar Typhi Ty2
uuguacaaaaaaugugagc

SEQ ID NO: 1774032 - RNA, 15 nt, Salmonella enterica enterica serovar Typhi Ty2
uuguacagcuugccg

SEQ ID NO: 1774033 - RNA, 17 nt, Salmonella enterica enterica serovar Typhi Ty2
uuguacagcuugccguc

SEQ ID NO: 1774034 - RNA, 13 nt, Salmonella enterica enterica serovar Typhi Ty2
uuguacaggauau

SEQ ID NO: 1774035 - RNA, 17 nt, Salmonella enterica enterica serovar Typhi Ty2
uuguacagcaauaaaag

SEQ ID NO: 1774036 - RNA, 15 nt, Salmonella enterica enterica serovar Typhi Ty2
uugucagacaugaua

SEQ ID NO: 1774037 - RNA, 18 nt, Salmonella enterica enterica serovar Typhi Ty2
uuguccggaucucgccag

SEQ ID NO: 1774038 - RNA, 20 nt, Salmonella enterica enterica serovar Typhi Ty2
uuguccgaugcagacaaaau

SEQ ID NO: 1774039 - RNA, 20 nt, Salmonella enterica enterica serovar Typhi Ty2
uugucucaaaaaauaucucu

SEQ ID NO: 1774040 - RNA, 14 nt, Salmonella enterica enterica serovar Typhi Ty2
uugucuaacuuacc

SEQ ID NO: 1774041 - RNA, 15 nt, Salmonella enterica enterica serovar Typhi Ty2
uugugcagaaucauu

SEQ ID NO: 1774042 - RNA, 17 nt, Salmonella enterica enterica serovar Typhi Ty2
uuguggcgaccagcaga

SEQ ID NO: 1774043 - RNA, 15 nt, Salmonella enterica enterica serovar Typhi Ty2
uuguggcgaccagca

SEQ ID NO: 1774044 - RNA, 12 nt, Salmonella enterica enterica serovar Typhi Ty2
uugugcuuuagc

SEQ ID NO: 1774045 - RNA, 22 nt, Salmonella enterica enterica serovar Typhi Ty2
uugugcuuauggguuuccucca

SEQ ID NO: 1774046 - RNA, 16 nt, Salmonella enterica enterica serovar Typhi Ty2
uuguuacucaauaaaa

SEQ ID NO: 1774047 - RNA, 19 nt, Salmonella enterica enterica serovar Typhi Ty2
uuguuccugcuggcaaaac

SEQ ID NO: 1774048 - RNA, 16 nt, Salmonella enterica enterica serovar Typhi Ty2
uuguucgucuuuugaa

SEQ ID NO: 1774049 - RNA, 21 nt, Salmonella enterica enterica serovar Typhi Ty2
uuguucaguuucaaagaacga

SEQ ID NO: 1774050 - RNA, 14 nt, Salmonella enterica enterica serovar Typhi Ty2
uuguuccagcagcu

SEQ ID NO: 1774051 - RNA, 14 nt, Salmonella enterica enterica serovar Typhi Ty2
uucuacaaugcggu

SEQ ID NO: 1774052 - RNA, 16 nt, Salmonella enterica enterica serovar Typhi Ty2
uucuacaaguucagua

SEQ ID NO: 1774053 - RNA, 18 nt, Salmonella enterica enterica serovar Typhi Ty2
uucuaaagacaugaucuu

SEQ ID NO: 1774054 - RNA, 19 nt, Salmonella enterica enterica serovar Typhi Ty2
uucuacuacagaaagccau

SEQ ID NO: 1774055 - RNA, 18 nt, Salmonella enterica enterica serovar Typhi Ty2
uucuauuaaaucagauaa

SEQ ID NO: 1774056 - RNA, 15 nt, Salmonella enterica enterica serovar Typhi Ty2
uucucaaaggcuuug

SEQ ID NO: 1774057 - RNA, 20 nt, Salmonella enterica enterica serovar Typhi Ty2
uucgucaaugcugcuuugau

SEQ ID NO: 1774058 - RNA, 17 nt, Salmonella enterica enterica serovar Typhi Ty2
uucgucaggaggccuga

SEQ ID NO: 1774059 - RNA, 16 nt, Salmonella enterica enterica serovar Typhi Ty2
uucguagacucaggcg

SEQ ID NO: 1774060 - RNA, 13 nt, Salmonella enterica enterica serovar Typhi Ty2
uucguagacucag

SEQ ID NO: 1774061 - RNA, 18 nt, Salmonella enterica enterica serovar Typhi Ty2
uucguagcgcaaauaucc

SEQ ID NO: 1774062 - RNA, 15 nt, Salmonella enterica enterica serovar Typhi Ty2
uucguucucugaaua

SEQ ID NO: 1774063 - RNA, 11 nt, Salmonella enterica enterica serovar Typhi Ty2
uuaucaggccu

SEQ ID NO: 1774064 - RNA, 23 nt, Salmonella enterica enterica serovar Typhi Ty2
uuaucacugguuauaugaauaaa

SEQ ID NO: 1774065 - RNA, 21 nt, Salmonella enterica enterica serovar Typhi Ty2
uuaucaggccgacaaaugacg

SEQ ID NO: 1774066 - RNA, 15 nt, Salmonella enterica enterica serovar Typhi Ty2
uucggcgaaagaagc

SEQ ID NO: 1774067 - RNA, 17 nt, Salmonella enterica enterica serovar Typhi Ty2
uucgguaguuccagaau

SEQ ID NO: 1774068 - RNA, 14 nt, Salmonella enterica enterica serovar Typhi Ty2
uucggguuuuccug

SEQ ID NO: 1774069 - RNA, 13 nt, Salmonella enterica enterica serovar Typhi Ty2
uucgggccgccgc

SEQ ID NO: 1774070 - RNA, 21 nt, Salmonella enterica enterica serovar Typhi Ty2
uucggcuccagguugcucagg

SEQ ID NO: 1774071 - RNA, 13 nt, Salmonella enterica enterica serovar Typhi Ty2
uucggcuucaauu

SEQ ID NO: 1774072 - RNA, 17 nt, Salmonella enterica enterica serovar Typhi Ty2
uucggcuucaccgauuu

SEQ ID NO: 1774073 - RNA, 19 nt, Salmonella enterica enterica serovar Typhi Ty2
uucggcuccaauauuucag

SEQ ID NO: 1774074 - RNA, 17 nt, Salmonella enterica enterica serovar Typhi Ty2
uucucuaucagcgccuc

SEQ ID NO: 1774075 - RNA, 15 nt, Salmonella enterica enterica serovar Typhi Ty2
uucucccuacugcuu

SEQ ID NO: 1774076 - RNA, 23 nt, Salmonella enterica enterica serovar Typhi Ty2
uucucccgccagaugcagcggca

SEQ ID NO: 1774077 - RNA, 22 nt, Salmonella enterica enterica serovar Typhi Ty2
uucuccccuucaucaguaacug

SEQ ID NO: 1774078 - RNA, 18 nt, Salmonella enterica enterica serovar Typhi Ty2
uucucccgccagaugcag

SEQ ID NO: 1774079 - RNA, 18 nt, Salmonella enterica enterica serovar Typhi Ty2
uucuccggcaguccaugc

SEQ ID NO: 1774080 - RNA, 22 nt, Salmonella enterica enterica serovar Typhi Ty2
uucuccgggauagcaaucucgc

SEQ ID NO: 1774081 - RNA, 14 nt, Salmonella enterica enterica serovar Typhi Ty2
uucucaaugaacag

SEQ ID NO: 1774082 - RNA, 20 nt, Salmonella enterica enterica serovar Typhi Ty2
uucuccaggcgaauccccau

SEQ ID NO: 1774083 - RNA, 13 nt, Salmonella enterica enterica serovar Typhi Ty2
uucucuucugcug

SEQ ID NO: 1774084 - RNA, 18 nt, Salmonella enterica enterica serovar Typhi Ty2
uucucuucguuauuuucc

SEQ ID NO: 1774085 - RNA, 19 nt, Salmonella enterica enterica serovar Typhi Ty2
uucucuuaugccgcuuuug

SEQ ID NO: 1774086 - RNA, 14 nt, Salmonella enterica enterica serovar Typhi Ty2
uucucuuuuauuau

SEQ ID NO: 1774087 - RNA, 13 nt, Salmonella enterica enterica serovar Typhi Ty2
uucugcaggccaa

SEQ ID NO: 1774088 - RNA, 23 nt, Salmonella enterica enterica serovar Typhi Ty2
uucugcaggcgggugcgcagccc

SEQ ID NO: 1774089 - RNA, 11 nt, Salmonella enterica enterica serovar Typhi Ty2
uucugcaaaau

SEQ ID NO: 1774090 - RNA, 22 nt, Salmonella enterica enterica serovar Typhi Ty2
uucugccgcgcgguauuucgca

SEQ ID NO: 1774091 - RNA, 12 nt, Salmonella enterica enterica serovar Typhi Ty2
uucugccagguu

SEQ ID NO: 1774092 - RNA, 15 nt, Salmonella enterica enterica serovar Typhi Ty2
uucugucgccaccac

SEQ ID NO: 1774093 - RNA, 19 nt, Salmonella enterica enterica serovar Typhi Ty2
uucugcgccauuuccagcc

SEQ ID NO: 1774094 - RNA, 18 nt, Salmonella enterica enterica serovar Typhi Ty2
uucugcgccagccagcuc

SEQ ID NO: 1774095 - RNA, 13 nt, Salmonella enterica enterica serovar Typhi Ty2
uucugccuuuuuu

SEQ ID NO: 1774096 - RNA, 13 nt, Salmonella enterica enterica serovar Typhi Ty2
uucuguucagugg

SEQ ID NO: 1774097 - RNA, 20 nt, Salmonella enterica enterica serovar Typhi Ty2
uucuguuuucgagccuugcc

SEQ ID NO: 1774098 - RNA, 18 nt, Salmonella enterica enterica serovar Typhi Ty2
uucuuaacccacaagaaa

SEQ ID NO: 1774099 - RNA, 17 nt, Salmonella enterica enterica serovar Typhi Ty2
uucuuaucccacagcgu

SEQ ID NO: 1774100 - RNA, 16 nt, Salmonella enterica enterica serovar Typhi Ty2
uucuuauuacaagaaa

SEQ ID NO: 1774101 - RNA, 23 nt, Salmonella enterica enterica serovar Typhi Ty2
uucuucgcgcauuucuguugcaa

SEQ ID NO: 1774102 - RNA, 19 nt, Salmonella enterica enterica serovar Typhi Ty2
uucuucgccgucauaaaac

SEQ ID NO: 1774103 - RNA, 23 nt, Salmonella enterica enterica serovar Typhi Ty2
uugaucaucagggcgaacauucc

SEQ ID NO: 1774104 - RNA, 13 nt, Salmonella enterica enterica serovar Typhi Ty2
uugaucauccuua

SEQ ID NO: 1774105 - RNA, 23 nt, Salmonella enterica enterica serovar Typhi Ty2
uugaucacgguacgcaucaccag

SEQ ID NO: 1774106 - RNA, 20 nt, Salmonella enterica enterica serovar Typhi Ty2
uugaucaggaaaucuuccag

SEQ ID NO: 1774107 - RNA, 22 nt, Salmonella enterica enterica serovar Typhi Ty2
uugaucaggcaaaaaucggccu

SEQ ID NO: 1774108 - RNA, 13 nt, Salmonella enterica enterica serovar Typhi Ty2
uugauggacgcga

SEQ ID NO: 1774109 - RNA, 21 nt, Salmonella enterica enterica serovar Typhi Ty2
uugaugucauccgguucaccc

SEQ ID NO: 1774110 - RNA, 15 nt, Salmonella enterica enterica serovar Typhi Ty2
uugcaaagcccauaa

SEQ ID NO: 1774111 - RNA, 12 nt, Salmonella enterica enterica serovar Typhi Ty2
uugcaacuauua

SEQ ID NO: 1774112 - RNA, 16 nt, Salmonella enterica enterica serovar Typhi Ty2
uugauaccuauuuaau

SEQ ID NO: 1774113 - RNA, 21 nt, Salmonella enterica enterica serovar Typhi Ty2
uugauaauguuggauuauaca

SEQ ID NO: 1774114 - RNA, 14 nt, Salmonella enterica enterica serovar Typhi Ty2
uugauacauuuuuu

SEQ ID NO: 1774115 - RNA, 23 nt, Salmonella enterica enterica serovar Typhi Ty2
uugauagcgacgcccauuagcau

SEQ ID NO: 1774116 - RNA, 22 nt, Salmonella enterica enterica serovar Typhi Ty2
uugacguaacgcuggugaccaa

SEQ ID NO: 1774117 - RNA, 17 nt, Salmonella enterica enterica serovar Typhi Ty2
uugaccauuaccauucc

SEQ ID NO: 1774118 - RNA, 16 nt, Salmonella enterica enterica serovar Typhi Ty2
uugacucuguuauaua

SEQ ID NO: 1774119 - RNA, 19 nt, Salmonella enterica enterica serovar Typhi Ty2
uugacuucaacgcaggcga

SEQ ID NO: 1774120 - RNA, 15 nt, Salmonella enterica enterica serovar Typhi Ty2
uugagacaugccgcc

SEQ ID NO: 1774121 - RNA, 16 nt, Salmonella enterica enterica serovar Typhi Ty2
uugacuuacaaaaaau

SEQ ID NO: 1774122 - RNA, 18 nt, Salmonella enterica enterica serovar Typhi Ty2
uugacuggauuuuugacu

SEQ ID NO: 1774123 - RNA, 13 nt, Salmonella enterica enterica serovar Typhi Ty2
uugaaauccucua

SEQ ID NO: 1774124 - RNA, 14 nt, Salmonella enterica enterica serovar Typhi Ty2
uucuuuucuuucag

SEQ ID NO: 1774125 - RNA, 12 nt, Salmonella enterica enterica serovar Typhi Ty2
uucuuuucaggc

SEQ ID NO: 1774126 - RNA, 12 nt, Salmonella enterica enterica serovar Typhi Ty2
uucuuuuuauau

SEQ ID NO: 1774127 - RNA, 13 nt, Salmonella enterica enterica serovar Typhi Ty2
uucuucuggcugc

SEQ ID NO: 1774128 - RNA, 12 nt, Salmonella enterica enterica serovar Typhi Ty2
uucuucuucacg

SEQ ID NO: 1774129 - RNA, 20 nt, Salmonella enterica enterica serovar Typhi Ty2
uucuuuaagaacgguuggaa

SEQ ID NO: 1774130 - RNA, 15 nt, Salmonella enterica enterica serovar Typhi Ty2
uucuuuaauuugugc

SEQ ID NO: 1774131 - RNA, 17 nt, Salmonella enterica enterica serovar Typhi Ty2
uucuuuaauuugugcca

SEQ ID NO: 1774132 - RNA, 15 nt, Salmonella enterica enterica serovar Typhi Ty2
uucuuuaaucagauu

SEQ ID NO: 1774133 - RNA, 14 nt, Salmonella enterica enterica serovar Typhi Ty2
uucuuuccugcaaa

SEQ ID NO: 1774134 - RNA, 18 nt, Salmonella enterica enterica serovar Typhi Ty2
uucuuucagcucuucaau

SEQ ID NO: 1774135 - RNA, 13 nt, Salmonella enterica enterica serovar Typhi Ty2
uucuuucacuguc

SEQ ID NO: 1774136 - RNA, 13 nt, Salmonella enterica enterica serovar Typhi Ty2
uugacaugaaaaa

SEQ ID NO: 1774137 - RNA, 14 nt, Salmonella enterica enterica serovar Typhi Ty2
uugaccaucgccag

SEQ ID NO: 1774138 - RNA, 18 nt, Salmonella enterica enterica serovar Typhi Ty2
uugaccagauaaucaaac

SEQ ID NO: 1774139 - RNA, 15 nt, Salmonella enterica enterica serovar Typhi Ty2
uugaauaucgcuuuu

SEQ ID NO: 1774140 - RNA, 23 nt, Salmonella enterica enterica serovar Typhi Ty2
uugaagugguggcgaacaggcuc

SEQ ID NO: 1774141 - RNA, 18 nt, Salmonella enterica enterica serovar Typhi Ty2
uugaauaaccauacugac

SEQ ID NO: 1774142 - RNA, 17 nt, Salmonella enterica enterica serovar Typhi Ty2
uugaauaacguguuaug

SEQ ID NO: 1774143 - RNA, 16 nt, Salmonella enterica enterica serovar Typhi Ty2
uugaauaaugcccguu

SEQ ID NO: 1774144 - RNA, 22 nt, Salmonella enterica enterica serovar Typhi Ty2
uugaacagcgucauccaguguu

SEQ ID NO: 1774145 - RNA, 18 nt, Salmonella enterica enterica serovar Typhi Ty2
ugauguguuucagcagcc

SEQ ID NO: 1774146 - RNA, 17 nt, Salmonella enterica enterica serovar Typhi Ty2
ugauguguuucagcagc

SEQ ID NO: 1774147 - RNA, 17 nt, Salmonella enterica enterica serovar Typhi Ty2
ugauguuuuuaaaagaa

SEQ ID NO: 1774148 - RNA, 18 nt, Salmonella enterica enterica serovar Typhi Ty2
ugauuauuguuaaaaaga

SEQ ID NO: 1774149 - RNA, 17 nt, Salmonella enterica enterica serovar Typhi Ty2
ugauuaaaagucaacug

SEQ ID NO: 1774150 - RNA, 18 nt, Salmonella enterica enterica serovar Typhi Ty2
ugaugggcgcacagcgcc

SEQ ID NO: 1774151 - RNA, 15 nt, Salmonella enterica enterica serovar Typhi Ty2
ugaugguuauuuuca

SEQ ID NO: 1774152 - RNA, 21 nt, Salmonella enterica enterica serovar Typhi Ty2
ugauguagcuugaaagcgcaa

SEQ ID NO: 1774153 - RNA, 17 nt, Salmonella enterica enterica serovar Typhi Ty2
ugauggccuuugugauc

SEQ ID NO: 1774154 - RNA, 20 nt, Salmonella enterica enterica serovar Typhi Ty2
ugauggcgcugcgcuuauca

SEQ ID NO: 1774155 - RNA, 13 nt, Salmonella enterica enterica serovar Typhi Ty2
ugauggcgcugcg

SEQ ID NO: 1774156 - RNA, 18 nt, Salmonella enterica enterica serovar Typhi Ty2
ugauggcgcuaagccagc

SEQ ID NO: 1774157 - RNA, 19 nt, Salmonella enterica enterica serovar Typhi Ty2
ugauggcguagcgccauca

SEQ ID NO: 1774158 - RNA, 15 nt, Salmonella enterica enterica serovar Typhi Ty2
ugauggccacaucgu

SEQ ID NO: 1774159 - RNA, 20 nt, Salmonella enterica enterica serovar Typhi Ty2
ugauggcagaccguggccgu

SEQ ID NO: 1774160 - RNA, 20 nt, Salmonella enterica enterica serovar Typhi Ty2
ugauuucgccccacuggccc

SEQ ID NO: 1774161 - RNA, 12 nt, Salmonella enterica enterica serovar Typhi Ty2
ugauuuaaaaaa

SEQ ID NO: 1774162 - RNA, 14 nt, Salmonella enterica enterica serovar Typhi Ty2
ugauuccuggcuug

SEQ ID NO: 1774163 - RNA, 14 nt, Salmonella enterica enterica serovar Typhi Ty2
ugauuuuaugaugc

SEQ ID NO: 1774164 - RNA, 16 nt, Salmonella enterica enterica serovar Typhi Ty2
ugauuuuacuaaugaa

SEQ ID NO: 1774165 - RNA, 18 nt, Salmonella enterica enterica serovar Typhi Ty2
ugauuugcuuuauuuguu

SEQ ID NO: 1774166 - RNA, 19 nt, Salmonella enterica enterica serovar Typhi Ty2
ugauuuguuuuuuauauuu

SEQ ID NO: 1774167 - RNA, 22 nt, Salmonella enterica enterica serovar Typhi Ty2
ugauuuguuuuuuauauuuuua

SEQ ID NO: 1774168 - RNA, 16 nt, Salmonella enterica enterica serovar Typhi Ty2
ugcaaacgcggcgcca

SEQ ID NO: 1774169 - RNA, 20 nt, Salmonella enterica enterica serovar Typhi Ty2
ugcaaaccggguaacaacau

SEQ ID NO: 1774170 - RNA, 13 nt, Salmonella enterica enterica serovar Typhi Ty2
ugauuuuuuugcu

SEQ ID NO: 1774171 - RNA, 11 nt, Salmonella enterica enterica serovar Typhi Ty2
ugauuuuauga

SEQ ID NO: 1774172 - RNA, 21 nt, Salmonella enterica enterica serovar Typhi Ty2
ugaugacgcgaauuauagaac

SEQ ID NO: 1774173 - RNA, 22 nt, Salmonella enterica enterica serovar Typhi Ty2
ugaucggccagauaguggcuga

SEQ ID NO: 1774174 - RNA, 14 nt, Salmonella enterica enterica serovar Typhi Ty2
ugaucgccucuucg

SEQ ID NO: 1774175 - RNA, 17 nt, Salmonella enterica enterica serovar Typhi Ty2
ugaucgauccgcaucag

SEQ ID NO: 1774176 - RNA, 16 nt, Salmonella enterica enterica serovar Typhi Ty2
ugaucgaauucauuac

SEQ ID NO: 1774177 - RNA, 19 nt, Salmonella enterica enterica serovar Typhi Ty2
ugauggagguuguuuuauu

SEQ ID NO: 1774178 - RNA, 18 nt, Salmonella enterica enterica serovar Typhi Ty2
ugaugcguuuguuggaga

SEQ ID NO: 1774179 - RNA, 23 nt, Salmonella enterica enterica serovar Typhi Ty2
ugaugcguuguaccguuuuccag

SEQ ID NO: 1774180 - RNA, 13 nt, Salmonella enterica enterica serovar Typhi Ty2
ugaugagaggcga

SEQ ID NO: 1774181 - RNA, 20 nt, Salmonella enterica enterica serovar Typhi Ty2
ugaugcaucagaacaaacuu

SEQ ID NO: 1774182 - RNA, 11 nt, Salmonella enterica enterica serovar Typhi Ty2
ugaucccacca

SEQ ID NO: 1774183 - RNA, 22 nt, Salmonella enterica enterica serovar Typhi Ty2
ugauccacagguuaucgccgcc

SEQ ID NO: 1774184 - RNA, 22 nt, Salmonella enterica enterica serovar Typhi Ty2
ugauccaccaccaguacauggc

SEQ ID NO: 1774185 - RNA, 23 nt, Salmonella enterica enterica serovar Typhi Ty2
ugauccgcccccuccaguagcag

SEQ ID NO: 1774186 - RNA, 20 nt, Salmonella enterica enterica serovar Typhi Ty2
ugauccguucgaucagcugg

SEQ ID NO: 1774187 - RNA, 22 nt, Salmonella enterica enterica serovar Typhi Ty2
ugauccugcaacagcaccagca

SEQ ID NO: 1774188 - RNA, 17 nt, Salmonella enterica enterica serovar Typhi Ty2
ugauauuuuuacugauu

SEQ ID NO: 1774189 - RNA, 23 nt, Salmonella enterica enterica serovar Typhi Ty2
ugaucagcaaaauaguguugaau

SEQ ID NO: 1774190 - RNA, 18 nt, Salmonella enterica enterica serovar Typhi Ty2
ugaucaggaaaucuucca

SEQ ID NO: 1774191 - RNA, 23 nt, Salmonella enterica enterica serovar Typhi Ty2
ugauaucgcugugguuuauccgc

SEQ ID NO: 1774192 - RNA, 16 nt, Salmonella enterica enterica serovar Typhi Ty2
ugauauugugcauacu

SEQ ID NO: 1774193 - RNA, 14 nt, Salmonella enterica enterica serovar Typhi Ty2
ugaguguuacucuu

SEQ ID NO: 1774194 - RNA, 19 nt, Salmonella enterica enterica serovar Typhi Ty2
ugcacauaacgugccaucu

SEQ ID NO: 1774195 - RNA, 13 nt, Salmonella enterica enterica serovar Typhi Ty2
ugcacagucugca

SEQ ID NO: 1774196 - RNA, 15 nt, Salmonella enterica enterica serovar Typhi Ty2
ugcacauguuucagc

SEQ ID NO: 1774197 - RNA, 13 nt, Salmonella enterica enterica serovar Typhi Ty2
ugcacuuccugcg

SEQ ID NO: 1774198 - RNA, 23 nt, Salmonella enterica enterica serovar Typhi Ty2
ugcacgucgcgcucgcucaucac

SEQ ID NO: 1774199 - RNA, 22 nt, Salmonella enterica enterica serovar Typhi Ty2
ugcacaagaaacauguuguguc

SEQ ID NO: 1774200 - RNA, 16 nt, Salmonella enterica enterica serovar Typhi Ty2
ugcacaaaauacuguu

SEQ ID NO: 1774201 - RNA, 15 nt, Salmonella enterica enterica serovar Typhi Ty2
ugcacaaaauacugu

SEQ ID NO: 1774202 - RNA, 16 nt, Salmonella enterica enterica serovar Typhi Ty2
ugcacaaucgccagcc

SEQ ID NO: 1774203 - RNA, 17 nt, Salmonella enterica enterica serovar Typhi Ty2
ugcaaugcagaugcuca

SEQ ID NO: 1774204 - RNA, 17 nt, Salmonella enterica enterica serovar Typhi Ty2
ugcaaagaagggcaggg

SEQ ID NO: 1774205 - RNA, 16 nt, Salmonella enterica enterica serovar Typhi Ty2
ugcaaaguuauuacau

SEQ ID NO: 1774206 - RNA, 13 nt, Salmonella enterica enterica serovar Typhi Ty2
ugcaaagcaaaaa

SEQ ID NO: 1774207 - RNA, 19 nt, Salmonella enterica enterica serovar Typhi Ty2
ugcaagccugauacuuuua

SEQ ID NO: 1774208 - RNA, 19 nt, Salmonella enterica enterica serovar Typhi Ty2
ugcaaguugcaagucacca

SEQ ID NO: 1774209 - RNA, 14 nt, Salmonella enterica enterica serovar Typhi Ty2
ugcagaaucauuaa

SEQ ID NO: 1774210 - RNA, 14 nt, Salmonella enterica enterica serovar Typhi Ty2
ugcagaccucugca

SEQ ID NO: 1774211 - RNA, 16 nt, Salmonella enterica enterica serovar Typhi Ty2
ugcagaccucugcaaa

SEQ ID NO: 1774212 - RNA, 16 nt, Salmonella enterica enterica serovar Typhi Ty2
ugcagaccucugcuuu

SEQ ID NO: 1774213 - RNA, 21 nt, Salmonella enterica enterica serovar Typhi Ty2
ugcagacgcucguauccgagc

SEQ ID NO: 1774214 - RNA, 14 nt, Salmonella enterica enterica serovar Typhi Ty2
ugcagaugcucagg

SEQ ID NO: 1774215 - RNA, 18 nt, Salmonella enterica enterica serovar Typhi Ty2
ugcagauuacugagcagu

SEQ ID NO: 1774216 - RNA, 18 nt, Salmonella enterica enterica serovar Typhi Ty2
ugcagaucggccuguuuu

SEQ ID NO: 1774217 - RNA, 14 nt, Salmonella enterica enterica serovar Typhi Ty2
ugcagccaggccau

SEQ ID NO: 1774218 - RNA, 23 nt, Salmonella enterica enterica serovar Typhi Ty2
ugcagcaacugauucaaaaggug

SEQ ID NO: 1774219 - RNA, 18 nt, Salmonella enterica enterica serovar Typhi Ty2
ugcagcauugggauggau

SEQ ID NO: 1774220 - RNA, 16 nt, Salmonella enterica enterica serovar Typhi Ty2
ugcagcgccgccugua

SEQ ID NO: 1774221 - RNA, 21 nt, Salmonella enterica enterica serovar Typhi Ty2
ugcagcgccuggcgguaugaa

SEQ ID NO: 1774222 - RNA, 18 nt, Salmonella enterica enterica serovar Typhi Ty2
ugcagcgcggcggcaacu

SEQ ID NO: 1774223 - RNA, 15 nt, Salmonella enterica enterica serovar Typhi Ty2
ugcagcgccagagau

SEQ ID NO: 1774224 - RNA, 18 nt, Salmonella enterica enterica serovar Typhi Ty2
ugcagcggaauucccaca

SEQ ID NO: 1774225 - RNA, 21 nt, Salmonella enterica enterica serovar Typhi Ty2
ugcagcggcaguuccggcguu

SEQ ID NO: 1774226 - RNA, 23 nt, Salmonella enterica enterica serovar Typhi Ty2
ugcagcggaugcucuuuacggac

SEQ ID NO: 1774227 - RNA, 16 nt, Salmonella enterica enterica serovar Typhi Ty2
ugcagcucaagcgccg

SEQ ID NO: 1774228 - RNA, 14 nt, Salmonella enterica enterica serovar Typhi Ty2
ugcagcguuuccag

SEQ ID NO: 1774229 - RNA, 16 nt, Salmonella enterica enterica serovar Typhi Ty2
ugcagcguuuccagcc

SEQ ID NO: 1774230 - RNA, 13 nt, Salmonella enterica enterica serovar Typhi Ty2
ugcaggaaggucu

SEQ ID NO: 1774231 - RNA, 22 nt, Salmonella enterica enterica serovar Typhi Ty2
ugcaggcugagcguagaccgcc

SEQ ID NO: 1774232 - RNA, 22 nt, Salmonella enterica enterica serovar Typhi Ty2
ugcagggacuuauuaaaaauag

SEQ ID NO: 1774233 - RNA, 19 nt, Salmonella enterica enterica serovar Typhi Ty2
ugcaggacuuaccuugagu

SEQ ID NO: 1774234 - RNA, 18 nt, Salmonella enterica enterica serovar Typhi Ty2
ugcaggcaggucuccagc

SEQ ID NO: 1774235 - RNA, 18 nt, Salmonella enterica enterica serovar Typhi Ty2
ugcaggcauaaaaaagag

SEQ ID NO: 1774236 - RNA, 16 nt, Salmonella enterica enterica serovar Typhi Ty2
ugcaggcaaaacgggc

SEQ ID NO: 1774237 - RNA, 19 nt, Salmonella enterica enterica serovar Typhi Ty2
ugcaggcaaaacgggcggc

SEQ ID NO: 1774238 - RNA, 21 nt, Salmonella enterica enterica serovar Typhi Ty2
ugcaggccaaauagaacgcuc

SEQ ID NO: 1774239 - RNA, 18 nt, Salmonella enterica enterica serovar Typhi Ty2
ugcaggccaagcagcgcc

SEQ ID NO: 1774240 - RNA, 22 nt, Salmonella enterica enterica serovar Typhi Ty2
ugagcguccagucgggcgugcc

SEQ ID NO: 1774241 - RNA, 23 nt, Salmonella enterica enterica serovar Typhi Ty2
ugagcgucacgccaucagggacg

SEQ ID NO: 1774242 - RNA, 20 nt, Salmonella enterica enterica serovar Typhi Ty2
ugagcguagaccgcccagga

SEQ ID NO: 1774243 - RNA, 12 nt, Salmonella enterica enterica serovar Typhi Ty2
ugagcgggccgu

SEQ ID NO: 1774244 - RNA, 11 nt, Salmonella enterica enterica serovar Typhi Ty2
ugagcuaauca

SEQ ID NO: 1774245 - RNA, 18 nt, Salmonella enterica enterica serovar Typhi Ty2
ugagcuaaucacccacuu

SEQ ID NO: 1774246 - RNA, 13 nt, Salmonella enterica enterica serovar Typhi Ty2
ugagcucauccag

SEQ ID NO: 1774247 - RNA, 14 nt, Salmonella enterica enterica serovar Typhi Ty2
ugagcucauccagc

SEQ ID NO: 1774248 - RNA, 17 nt, Salmonella enterica enterica serovar Typhi Ty2
ugagcgcgaacgcucca

SEQ ID NO: 1774249 - RNA, 22 nt, Salmonella enterica enterica serovar Typhi Ty2
ugagcgcagcgacuucaggcgu

SEQ ID NO: 1774250 - RNA, 20 nt, Salmonella enterica enterica serovar Typhi Ty2
ugagcgagucagacaccagc

SEQ ID NO: 1774251 - RNA, 19 nt, Salmonella enterica enterica serovar Typhi Ty2
ugagcggcucauccagcaa

SEQ ID NO: 1774252 - RNA, 23 nt, Salmonella enterica enterica serovar Typhi Ty2
ugagcgcgaggcauaccgcccag

SEQ ID NO: 1774253 - RNA, 16 nt, Salmonella enterica enterica serovar Typhi Ty2
ugagcuucaccgccag

SEQ ID NO: 1774254 - RNA, 15 nt, Salmonella enterica enterica serovar Typhi Ty2
ugagcuugagccagc

SEQ ID NO: 1774255 - RNA, 12 nt, Salmonella enterica enterica serovar Typhi Ty2
ugagcugaaagc

SEQ ID NO: 1774256 - RNA, 19 nt, Salmonella enterica enterica serovar Typhi Ty2
ugagcucguuauaagcuuu

SEQ ID NO: 1774257 - RNA, 24 nt, Salmonella enterica enterica serovar Typhi Ty2
ugaggaaaaagcgcacuuuccaua

SEQ ID NO: 1774258 - RNA, 16 nt, Salmonella enterica enterica serovar Typhi Ty2
ugaguauuggcaagaa

SEQ ID NO: 1774259 - RNA, 16 nt, Salmonella enterica enterica serovar Typhi Ty2
ugagguuucagcaccu

SEQ ID NO: 1774260 - RNA, 19 nt, Salmonella enterica enterica serovar Typhi Ty2
ugaggcuuugagcgucagc

SEQ ID NO: 1774261 - RNA, 16 nt, Salmonella enterica enterica serovar Typhi Ty2
ugagggcgauaauccg

SEQ ID NO: 1774262 - RNA, 19 nt, Salmonella enterica enterica serovar Typhi Ty2
ugaggccuguuucuuacca

SEQ ID NO: 1774263 - RNA, 16 nt, Salmonella enterica enterica serovar Typhi Ty2
ugaggccgcucgccau

SEQ ID NO: 1774264 - RNA, 21 nt, Salmonella enterica enterica serovar Typhi Ty2
ugaggccguuuuuuuguuuua

SEQ ID NO: 1774265 - RNA, 20 nt, Salmonella enterica enterica serovar Typhi Ty2
ugagaaggucaguccaccug

SEQ ID NO: 1774266 - RNA, 14 nt, Salmonella enterica enterica serovar Typhi Ty2
ugagaagggcagau

SEQ ID NO: 1774267 - RNA, 18 nt, Salmonella enterica enterica serovar Typhi Ty2
ugagaucgguaauuucca

SEQ ID NO: 1774268 - RNA, 19 nt, Salmonella enterica enterica serovar Typhi Ty2
ugagcagacauauuuucaa

SEQ ID NO: 1774269 - RNA, 16 nt, Salmonella enterica enterica serovar Typhi Ty2
ugagcagaucagcacg

SEQ ID NO: 1774270 - RNA, 12 nt, Salmonella enterica enterica serovar Typhi Ty2
ugagcagcgcga

SEQ ID NO: 1774271 - RNA, 18 nt, Salmonella enterica enterica serovar Typhi Ty2
ugagcacgcggaagaaau

SEQ ID NO: 1774272 - RNA, 19 nt, Salmonella enterica enterica serovar Typhi Ty2
ugagccgaaauccaccagc

SEQ ID NO: 1774273 - RNA, 13 nt, Salmonella enterica enterica serovar Typhi Ty2
ugagcccacagcg

SEQ ID NO: 1774274 - RNA, 17 nt, Salmonella enterica enterica serovar Typhi Ty2
ugagcccacagcggaug

SEQ ID NO: 1774275 - RNA, 21 nt, Salmonella enterica enterica serovar Typhi Ty2
ugagcgaauccccgggaacau

SEQ ID NO: 1774276 - RNA, 16 nt, Salmonella enterica enterica serovar Typhi Ty2
ugagcgaaacuccagc

SEQ ID NO: 1774277 - RNA, 12 nt, Salmonella enterica enterica serovar Typhi Ty2
ugacuuugcucu

SEQ ID NO: 1774278 - RNA, 19 nt, Salmonella enterica enterica serovar Typhi Ty2
ugacuguaauaauacuaac

SEQ ID NO: 1774279 - RNA, 21 nt, Salmonella enterica enterica serovar Typhi Ty2
ugacuuuaccgguuucaaucc

SEQ ID NO: 1774280 - RNA, 17 nt, Salmonella enterica enterica serovar Typhi Ty2
ugagaaaaccauauaaa

SEQ ID NO: 1774281 - RNA, 21 nt, Salmonella enterica enterica serovar Typhi Ty2
ugacuuuuuucaaccucacug

SEQ ID NO: 1774282 - RNA, 13 nt, Salmonella enterica enterica serovar Typhi Ty2
ugagaaaaauacg

SEQ ID NO: 1774283 - RNA, 12 nt, Salmonella enterica enterica serovar Typhi Ty2
ugacuuuuacgc

SEQ ID NO: 1774284 - RNA, 12 nt, Salmonella enterica enterica serovar Typhi Ty2
ugagaaaaggaa

SEQ ID NO: 1774285 - RNA, 14 nt, Salmonella enterica enterica serovar Typhi Ty2
ugacggaaaccagc

SEQ ID NO: 1774286 - RNA, 19 nt, Salmonella enterica enterica serovar Typhi Ty2
ugacgcuugcaugaccauc

SEQ ID NO: 1774287 - RNA, 19 nt, Salmonella enterica enterica serovar Typhi Ty2
ugacggccugucuccucag

SEQ ID NO: 1774288 - RNA, 21 nt, Salmonella enterica enterica serovar Typhi Ty2
ugacggcaaagcccacgcccu

SEQ ID NO: 1774289 - RNA, 19 nt, Salmonella enterica enterica serovar Typhi Ty2
ugacucauuaaaaaaacau

SEQ ID NO: 1774290 - RNA, 20 nt, Salmonella enterica enterica serovar Typhi Ty2
ugacugcgggggcaaaugcg

SEQ ID NO: 1774291 - RNA, 21 nt, Salmonella enterica enterica serovar Typhi Ty2
ugacugccguauaauccagcu

SEQ ID NO: 1774292 - RNA, 21 nt, Salmonella enterica enterica serovar Typhi Ty2
ugaccgggcucacgcuggugc

SEQ ID NO: 1774293 - RNA, 18 nt, Salmonella enterica enterica serovar Typhi Ty2
ugaccgguaagcccaugg

SEQ ID NO: 1774294 - RNA, 15 nt, Salmonella enterica enterica serovar Typhi Ty2
ugaccgucagccccg

SEQ ID NO: 1774295 - RNA, 19 nt, Salmonella enterica enterica serovar Typhi Ty2
ugaccgguaagcccauggc

SEQ ID NO: 1774296 - RNA, 19 nt, Salmonella enterica enterica serovar Typhi Ty2
ugaccgcuucgccuucgcc

SEQ ID NO: 1774297 - RNA, 14 nt, Salmonella enterica enterica serovar Typhi Ty2
ugacccgcagcaau

SEQ ID NO: 1774298 - RNA, 16 nt, Salmonella enterica enterica serovar Typhi Ty2
ugaccaucgccagcca

SEQ ID NO: 1774299 - RNA, 19 nt, Salmonella enterica enterica serovar Typhi Ty2
ugaccauuaccauuccuca

SEQ ID NO: 1774300 - RNA, 17 nt, Salmonella enterica enterica serovar Typhi Ty2
ugaccaugccacaacag

SEQ ID NO: 1774301 - RNA, 13 nt, Salmonella enterica enterica serovar Typhi Ty2
ugacccagacaaa

SEQ ID NO: 1774302 - RNA, 14 nt, Salmonella enterica enterica serovar Typhi Ty2
ugacgaucaugccg

SEQ ID NO: 1774303 - RNA, 19 nt, Salmonella enterica enterica serovar Typhi Ty2
ugacgauacgucauaucau

SEQ ID NO: 1774304 - RNA, 16 nt, Salmonella enterica enterica serovar Typhi Ty2
ugacgagucggaucau

SEQ ID NO: 1774305 - RNA, 16 nt, Salmonella enterica enterica serovar Typhi Ty2
ugacgagggaagggga

SEQ ID NO: 1774306 - RNA, 16 nt, Salmonella enterica enterica serovar Typhi Ty2
ugacgcucuccuccaa

SEQ ID NO: 1774307 - RNA, 23 nt, Salmonella enterica enterica serovar Typhi Ty2
ugacgagcagguuacucuuccac

SEQ ID NO: 1774308 - RNA, 17 nt, Salmonella enterica enterica serovar Typhi Ty2
ugaccucaauccgugcc

SEQ ID NO: 1774309 - RNA, 13 nt, Salmonella enterica enterica serovar Typhi Ty2
ugaccucauccau

SEQ ID NO: 1774310 - RNA, 14 nt, Salmonella enterica enterica serovar Typhi Ty2
ugaccuacaggccg

SEQ ID NO: 1774311 - RNA, 19 nt, Salmonella enterica enterica serovar Typhi Ty2
ugacagcacaauuccggcc

SEQ ID NO: 1774312 - RNA, 21 nt, Salmonella enterica enterica serovar Typhi Ty2
ugacagcaaguugcgccacug

SEQ ID NO: 1774313 - RNA, 18 nt, Salmonella enterica enterica serovar Typhi Ty2
ugacagcacauagccuaa

SEQ ID NO: 1774314 - RNA, 21 nt, Salmonella enterica enterica serovar Typhi Ty2
ugacagagcucgucaaaaauc

SEQ ID NO: 1774315 - RNA, 14 nt, Salmonella enterica enterica serovar Typhi Ty2
ugacacucauccag

SEQ ID NO: 1774316 - RNA, 14 nt, Salmonella enterica enterica serovar Typhi Ty2
ugacacugauauac

SEQ ID NO: 1774317 - RNA, 16 nt, Salmonella enterica enterica serovar Typhi Ty2
ugacacucauccagac

SEQ ID NO: 1774318 - RNA, 21 nt, Salmonella enterica enterica serovar Typhi Ty2
ugacacuguagcaacugccag

SEQ ID NO: 1774319 - RNA, 20 nt, Salmonella enterica enterica serovar Typhi Ty2
ugacacggaacaacggcaca

SEQ ID NO: 1774320 - RNA, 15 nt, Salmonella enterica enterica serovar Typhi Ty2
ugacacggucagcgg

SEQ ID NO: 1774321 - RNA, 14 nt, Salmonella enterica enterica serovar Typhi Ty2
ugacacggaacaac

SEQ ID NO: 1774322 - RNA, 15 nt, Salmonella enterica enterica serovar Typhi Ty2
ugaccacauuuucuc

SEQ ID NO: 1774323 - RNA, 18 nt, Salmonella enterica enterica serovar Typhi Ty2
ugaccaccagcgcgaccg

SEQ ID NO: 1774324 - RNA, 15 nt, Salmonella enterica enterica serovar Typhi Ty2
ugaccaucaaauaau

SEQ ID NO: 1774325 - RNA, 22 nt, Salmonella enterica enterica serovar Typhi Ty2
ugaccaguuguuccgcgcugau

SEQ ID NO: 1774326 - RNA, 21 nt, Salmonella enterica enterica serovar Typhi Ty2
ugaccaauguuaauaagcaga

SEQ ID NO: 1774327 - RNA, 18 nt, Salmonella enterica enterica serovar Typhi Ty2
ugaccaagcgucagcaug

SEQ ID NO: 1774328 - RNA, 18 nt, Salmonella enterica enterica serovar Typhi Ty2
ugacauagcauaauaaug

SEQ ID NO: 1774329 - RNA, 20 nt, Salmonella enterica enterica serovar Typhi Ty2
ugacaaauuguuuaaaaaca

SEQ ID NO: 1774330 - RNA, 23 nt, Salmonella enterica enterica serovar Typhi Ty2
ugacaaacucacguuccccagca

SEQ ID NO: 1774331 - RNA, 11 nt, Salmonella enterica enterica serovar Typhi Ty2
ugacaauaagu

SEQ ID NO: 1774332 - RNA, 18 nt, Salmonella enterica enterica serovar Typhi Ty2
ugaauugccauuguucgc

SEQ ID NO: 1774333 - RNA, 22 nt, Salmonella enterica enterica serovar Typhi Ty2
ugaauuuaauggucuuaaaugc

SEQ ID NO: 1774334 - RNA, 20 nt, Salmonella enterica enterica serovar Typhi Ty2
ugaauuuaucccgugguggg

SEQ ID NO: 1774335 - RNA, 17 nt, Salmonella enterica enterica serovar Typhi Ty2
ugaauuauaauaaaggg

SEQ ID NO: 1774336 - RNA, 14 nt, Salmonella enterica enterica serovar Typhi Ty2
ugaauucaacgucc

SEQ ID NO: 1774337 - RNA, 14 nt, Salmonella enterica enterica serovar Typhi Ty2
ugaauaaugaccuc

SEQ ID NO: 1774338 - RNA, 17 nt, Salmonella enterica enterica serovar Typhi Ty2
ugaauaccacaaauuuu

SEQ ID NO: 1774339 - RNA, 16 nt, Salmonella enterica enterica serovar Typhi Ty2
ugaauaauuucuucuu

SEQ ID NO: 1774340 - RNA, 12 nt, Salmonella enterica enterica serovar Typhi Ty2
ugaauaccagcg

SEQ ID NO: 1774341 - RNA, 19 nt, Salmonella enterica enterica serovar Typhi Ty2
ugaauaccagcggcaaaca

SEQ ID NO: 1774342 - RNA, 12 nt, Salmonella enterica enterica serovar Typhi Ty2
ucuuucaauccu

SEQ ID NO: 1774343 - RNA, 16 nt, Salmonella enterica enterica serovar Typhi Ty2
ugaauauccgccgccc

SEQ ID NO: 1774344 - RNA, 17 nt, Salmonella enterica enterica serovar Typhi Ty2
ugaauauucaauggguu

SEQ ID NO: 1774345 - RNA, 15 nt, Salmonella enterica enterica serovar Typhi Ty2
ugaaucgccgucagu

SEQ ID NO: 1774346 - RNA, 18 nt, Salmonella enterica enterica serovar Typhi Ty2
ugaaucggcaccuggagc

SEQ ID NO: 1774347 - RNA, 21 nt, Salmonella enterica enterica serovar Typhi Ty2
ugaaucucagauaauagcugc

SEQ ID NO: 1774348 - RNA, 17 nt, Salmonella enterica enterica serovar Typhi Ty2
ugaaucucuucccagcg

SEQ ID NO: 1774349 - RNA, 12 nt, Salmonella enterica enterica serovar Typhi Ty2
ugccuaccgggc

SEQ ID NO: 1774350 - RNA, 14 nt, Salmonella enterica enterica serovar Typhi Ty2
ugccuacgcggcca

SEQ ID NO: 1774351 - RNA, 16 nt, Salmonella enterica enterica serovar Typhi Ty2
ugccgugaggcugaag

SEQ ID NO: 1774352 - RNA, 16 nt, Salmonella enterica enterica serovar Typhi Ty2
ugccgugaaaacgaau

SEQ ID NO: 1774353 - RNA, 15 nt, Salmonella enterica enterica serovar Typhi Ty2
ugccugccgccucca

SEQ ID NO: 1774354 - RNA, 23 nt, Salmonella enterica enterica serovar Typhi Ty2
ugccugaaggcgcuaugcuuacc

SEQ ID NO: 1774355 - RNA, 16 nt, Salmonella enterica enterica serovar Typhi Ty2
ugccucacccugaaau

SEQ ID NO: 1774356 - RNA, 18 nt, Salmonella enterica enterica serovar Typhi Ty2
ugccuucaaauauauuga

SEQ ID NO: 1774357 - RNA, 22 nt, Salmonella enterica enterica serovar Typhi Ty2
ugccuugugucacauuuucuug

SEQ ID NO: 1774358 - RNA, 23 nt, Salmonella enterica enterica serovar Typhi Ty2
ugccuuuaacaaauuaaauccug

SEQ ID NO: 1774359 - RNA, 17 nt, Salmonella enterica enterica serovar Typhi Ty2
ugccuuguaggccugau

SEQ ID NO: 1774360 - RNA, 16 nt, Salmonella enterica enterica serovar Typhi Ty2
ugccuugcgaauggag

SEQ ID NO: 1774361 - RNA, 13 nt, Salmonella enterica enterica serovar Typhi Ty2
ugccggauggcac

SEQ ID NO: 1774362 - RNA, 19 nt, Salmonella enterica enterica serovar Typhi Ty2
ugccggauggcgcuaaugc

SEQ ID NO: 1774363 - RNA, 20 nt, Salmonella enterica enterica serovar Typhi Ty2
ugccggaucaggcguugugc

SEQ ID NO: 1774364 - RNA, 20 nt, Salmonella enterica enterica serovar Typhi Ty2
ugccgccaucucacgcaugg

SEQ ID NO: 1774365 - RNA, 16 nt, Salmonella enterica enterica serovar Typhi Ty2
ugccgcccaggccaug

SEQ ID NO: 1774366 - RNA, 15 nt, Salmonella enterica enterica serovar Typhi Ty2
ugccgcccaggccug

SEQ ID NO: 1774367 - RNA, 16 nt, Salmonella enterica enterica serovar Typhi Ty2
ugccgcccauccagag

SEQ ID NO: 1774368 - RNA, 19 nt, Salmonella enterica enterica serovar Typhi Ty2
ugccgcccaucgccacagc

SEQ ID NO: 1774369 - RNA, 23 nt, Salmonella enterica enterica serovar Typhi Ty2
ugccggauggcgguauaacugcc

SEQ ID NO: 1774370 - RNA, 16 nt, Salmonella enterica enterica serovar Typhi Ty2
ugccggauggcggcuu

SEQ ID NO: 1774371 - RNA, 17 nt, Salmonella enterica enterica serovar Typhi Ty2
ugccguagaacagcaug

SEQ ID NO: 1774372 - RNA, 20 nt, Salmonella enterica enterica serovar Typhi Ty2
ugccgucaaacaagccgcca

SEQ ID NO: 1774373 - RNA, 20 nt, Salmonella enterica enterica serovar Typhi Ty2
ugccgucaacacgcagaccc

SEQ ID NO: 1774374 - RNA, 20 nt, Salmonella enterica enterica serovar Typhi Ty2
ugccgucgaugucgccgccg

SEQ ID NO: 1774375 - RNA, 21 nt, Salmonella enterica enterica serovar Typhi Ty2
ugccguccggucuacaaguga

SEQ ID NO: 1774376 - RNA, 18 nt, Salmonella enterica enterica serovar Typhi Ty2
ugcgagucgucaguucca

SEQ ID NO: 1774377 - RNA, 17 nt, Salmonella enterica enterica serovar Typhi Ty2
ugcgaguagcaaauccc

SEQ ID NO: 1774378 - RNA, 15 nt, Salmonella enterica enterica serovar Typhi Ty2
ugcgaggucugguca

SEQ ID NO: 1774379 - RNA, 23 nt, Salmonella enterica enterica serovar Typhi Ty2
ugcgaggcgcgcucauuuuauug

SEQ ID NO: 1774380 - RNA, 17 nt, Salmonella enterica enterica serovar Typhi Ty2
ugcgaggucaccgggcg

SEQ ID NO: 1774381 - RNA, 17 nt, Salmonella enterica enterica serovar Typhi Ty2
ugcgagcuuuccaccag

SEQ ID NO: 1774382 - RNA, 12 nt, Salmonella enterica enterica serovar Typhi Ty2
ugcgagaaaaag

SEQ ID NO: 1774383 - RNA, 21 nt, Salmonella enterica enterica serovar Typhi Ty2
ugcgaccacggguagagcuuu

SEQ ID NO: 1774384 - RNA, 18 nt, Salmonella enterica enterica serovar Typhi Ty2
ugcgaccgcgccacggcc

SEQ ID NO: 1774385 - RNA, 11 nt, Salmonella enterica enterica serovar Typhi Ty2
ugcgagaaaaa

SEQ ID NO: 1774386 - RNA, 18 nt, Salmonella enterica enterica serovar Typhi Ty2
ugccuuuuugcagcgcgg

SEQ ID NO: 1774387 - RNA, 19 nt, Salmonella enterica enterica serovar Typhi Ty2
ugccuuuuucccacugcgc

SEQ ID NO: 1774388 - RNA, 18 nt, Salmonella enterica enterica serovar Typhi Ty2
ugcgaaaauacucccggc

SEQ ID NO: 1774389 - RNA, 21 nt, Salmonella enterica enterica serovar Typhi Ty2
ugcgaacgauaccauccccuu

SEQ ID NO: 1774390 - RNA, 19 nt, Salmonella enterica enterica serovar Typhi Ty2
ugcgacacgcugcauauaa

SEQ ID NO: 1774391 - RNA, 16 nt, Salmonella enterica enterica serovar Typhi Ty2
ugcgaauaaacacaua

SEQ ID NO: 1774392 - RNA, 16 nt, Salmonella enterica enterica serovar Typhi Ty2
ugcgaauaacaucauc

SEQ ID NO: 1774393 - RNA, 12 nt, Salmonella enterica enterica serovar Typhi Ty2
ugcgcaaacgua

SEQ ID NO: 1774394 - RNA, 12 nt, Salmonella enterica enterica serovar Typhi Ty2
ugcgcaaaugcc

SEQ ID NO: 1774395 - RNA, 19 nt, Salmonella enterica enterica serovar Typhi Ty2
ugcgaugagauccgggcug

SEQ ID NO: 1774396 - RNA, 14 nt, Salmonella enterica enterica serovar Typhi Ty2
ugcgauggccgcug

SEQ ID NO: 1774397 - RNA, 23 nt, Salmonella enterica enterica serovar Typhi Ty2
ugcgaucguaaucacccgcuucc

SEQ ID NO: 1774398 - RNA, 17 nt, Salmonella enterica enterica serovar Typhi Ty2
ugcgcagcguuuccaga

SEQ ID NO: 1774399 - RNA, 21 nt, Salmonella enterica enterica serovar Typhi Ty2
ugcgcagccccagcgccagcc

SEQ ID NO: 1774400 - RNA, 20 nt, Salmonella enterica enterica serovar Typhi Ty2
ugcgcaguuuaaaucacagg

SEQ ID NO: 1774401 - RNA, 12 nt, Salmonella enterica enterica serovar Typhi Ty2
ugcgcacucaga

SEQ ID NO: 1774402 - RNA, 16 nt, Salmonella enterica enterica serovar Typhi Ty2
ugcgcacucagaaaau

SEQ ID NO: 1774403 - RNA, 13 nt, Salmonella enterica enterica serovar Typhi Ty2
ugccgacaggcag

SEQ ID NO: 1774404 - RNA, 13 nt, Salmonella enterica enterica serovar Typhi Ty2
ugccgacggcgcu

SEQ ID NO: 1774405 - RNA, 15 nt, Salmonella enterica enterica serovar Typhi Ty2
ugccgaccuggcuug

SEQ ID NO: 1774406 - RNA, 22 nt, Salmonella enterica enterica serovar Typhi Ty2
ugccgauuccaugcccaguuca

SEQ ID NO: 1774407 - RNA, 16 nt, Salmonella enterica enterica serovar Typhi Ty2
ugccgaugacucccag

SEQ ID NO: 1774408 - RNA, 21 nt, Salmonella enterica enterica serovar Typhi Ty2
ugccgauggcgcuccugaauc

SEQ ID NO: 1774409 - RNA, 18 nt, Salmonella enterica enterica serovar Typhi Ty2
ugcccgccguuaaaucau

SEQ ID NO: 1774410 - RNA, 16 nt, Salmonella enterica enterica serovar Typhi Ty2
ugcccgguuuuuuaau

SEQ ID NO: 1774411 - RNA, 17 nt, Salmonella enterica enterica serovar Typhi Ty2
ugcccuuaaauccggcc

SEQ ID NO: 1774412 - RNA, 16 nt, Salmonella enterica enterica serovar Typhi Ty2
ugcccuuccagcagcc

SEQ ID NO: 1774413 - RNA, 17 nt, Salmonella enterica enterica serovar Typhi Ty2
ugcccuuccagcagcca

SEQ ID NO: 1774414 - RNA, 20 nt, Salmonella enterica enterica serovar Typhi Ty2
ugcccuuaucuggaugagga

SEQ ID NO: 1774415 - RNA, 16 nt, Salmonella enterica enterica serovar Typhi Ty2
ugcccuuaucuggaug

SEQ ID NO: 1774416 - RNA, 19 nt, Salmonella enterica enterica serovar Typhi Ty2
ugcccuucgaccgucagca

SEQ ID NO: 1774417 - RNA, 14 nt, Salmonella enterica enterica serovar Typhi Ty2
ugcccuuucuuaug

SEQ ID NO: 1774418 - RNA, 13 nt, Salmonella enterica enterica serovar Typhi Ty2
ugcccuuucuuau

SEQ ID NO: 1774419 - RNA, 17 nt, Salmonella enterica enterica serovar Typhi Ty2
ugcccgccagcgggccg

SEQ ID NO: 1774420 - RNA, 21 nt, Salmonella enterica enterica serovar Typhi Ty2
ugccccuuccgccacggcuuu

SEQ ID NO: 1774421 - RNA, 19 nt, Salmonella enterica enterica serovar Typhi Ty2
ugcccgaaagcaauacugu

SEQ ID NO: 1774422 - RNA, 20 nt, Salmonella enterica enterica serovar Typhi Ty2
ugcccgaaagcaauacugua

SEQ ID NO: 1774423 - RNA, 21 nt, Salmonella enterica enterica serovar Typhi Ty2
ugccccugaccgaagguuacc

SEQ ID NO: 1774424 - RNA, 15 nt, Salmonella enterica enterica serovar Typhi Ty2
ugcccauuuccugca

SEQ ID NO: 1774425 - RNA, 15 nt, Salmonella enterica enterica serovar Typhi Ty2
ugcccagcgccguca

SEQ ID NO: 1774426 - RNA, 19 nt, Salmonella enterica enterica serovar Typhi Ty2
ugcccagcgccuucuucac

SEQ ID NO: 1774427 - RNA, 18 nt, Salmonella enterica enterica serovar Typhi Ty2
ugcccagcaucccgcugg

SEQ ID NO: 1774428 - RNA, 13 nt, Salmonella enterica enterica serovar Typhi Ty2
ugcccaguuuacc

SEQ ID NO: 1774429 - RNA, 18 nt, Salmonella enterica enterica serovar Typhi Ty2
ugcccaguuuacccagcg

SEQ ID NO: 1774430 - RNA, 17 nt, Salmonella enterica enterica serovar Typhi Ty2
ugcccaucgcgccauga

SEQ ID NO: 1774431 - RNA, 14 nt, Salmonella enterica enterica serovar Typhi Ty2
ugcccaugaagcga

SEQ ID NO: 1774432 - RNA, 22 nt, Salmonella enterica enterica serovar Typhi Ty2
ugcccaucuaaccgggccugau

SEQ ID NO: 1774433 - RNA, 15 nt, Salmonella enterica enterica serovar Typhi Ty2
ugccaguagcugcuc

SEQ ID NO: 1774434 - RNA, 23 nt, Salmonella enterica enterica serovar Typhi Ty2
ugccaggaagucagcuuccugca

SEQ ID NO: 1774435 - RNA, 14 nt, Salmonella enterica enterica serovar Typhi Ty2
ugccagcgucgcug

SEQ ID NO: 1774436 - RNA, 13 nt, Salmonella enterica enterica serovar Typhi Ty2
ugccagccauagc

SEQ ID NO: 1774437 - RNA, 12 nt, Salmonella enterica enterica serovar Typhi Ty2
ugccagcaccag

SEQ ID NO: 1774438 - RNA, 13 nt, Salmonella enterica enterica serovar Typhi Ty2
ugccagcaccagc

SEQ ID NO: 1774439 - RNA, 17 nt, Salmonella enterica enterica serovar Typhi Ty2
ugccagauuuuccaggc

SEQ ID NO: 1774440 - RNA, 15 nt, Salmonella enterica enterica serovar Typhi Ty2
ugcccaccugaaaaa

SEQ ID NO: 1774441 - RNA, 17 nt, Salmonella enterica enterica serovar Typhi Ty2
ugcccaauagcgcugag

SEQ ID NO: 1774442 - RNA, 18 nt, Salmonella enterica enterica serovar Typhi Ty2
ugccauauuguucaguuu

SEQ ID NO: 1774443 - RNA, 20 nt, Salmonella enterica enterica serovar Typhi Ty2
ugccauauuguucaguuuca

SEQ ID NO: 1774444 - RNA, 23 nt, Salmonella enterica enterica serovar Typhi Ty2
ugccaguaguugaauaaccucaa

SEQ ID NO: 1774445 - RNA, 16 nt, Salmonella enterica enterica serovar Typhi Ty2
ugccaguuucucaaag

SEQ ID NO: 1774446 - RNA, 19 nt, Salmonella enterica enterica serovar Typhi Ty2
ugccaguuucucaaagcug

SEQ ID NO: 1774447 - RNA, 17 nt, Salmonella enterica enterica serovar Typhi Ty2
ugccauaaaaacaauaa

SEQ ID NO: 1774448 - RNA, 18 nt, Salmonella enterica enterica serovar Typhi Ty2
ugccauaaaaacaauaaa

SEQ ID NO: 1774449 - RNA, 20 nt, Salmonella enterica enterica serovar Typhi Ty2
ugccauaaagcggacugccu

SEQ ID NO: 1774450 - RNA, 15 nt, Salmonella enterica enterica serovar Typhi Ty2
ugccauaaaaugcug

SEQ ID NO: 1774451 - RNA, 22 nt, Salmonella enterica enterica serovar Typhi Ty2
ugccauaaucgauauaauuuua

SEQ ID NO: 1774452 - RNA, 17 nt, Salmonella enterica enterica serovar Typhi Ty2
ugcagucgguagcuuuu

SEQ ID NO: 1774453 - RNA, 14 nt, Salmonella enterica enterica serovar Typhi Ty2
ugcaguauuucaga

SEQ ID NO: 1774454 - RNA, 17 nt, Salmonella enterica enterica serovar Typhi Ty2
ugccaagcaacacggcg

SEQ ID NO: 1774455 - RNA, 14 nt, Salmonella enterica enterica serovar Typhi Ty2
ugccaaccaccgcg

SEQ ID NO: 1774456 - RNA, 14 nt, Salmonella enterica enterica serovar Typhi Ty2
ugcaguacaggcau

SEQ ID NO: 1774457 - RNA, 19 nt, Salmonella enterica enterica serovar Typhi Ty2
ugcaguacaggcauuguca

SEQ ID NO: 1774458 - RNA, 15 nt, Salmonella enterica enterica serovar Typhi Ty2
ugcagggugcagcaa

SEQ ID NO: 1774459 - RNA, 18 nt, Salmonella enterica enterica serovar Typhi Ty2
ugccaaguaauaaagaga

SEQ ID NO: 1774460 - RNA, 18 nt, Salmonella enterica enterica serovar Typhi Ty2
ugccacagccucagcacg

SEQ ID NO: 1774461 - RNA, 17 nt, Salmonella enterica enterica serovar Typhi Ty2
ugccacaggccaacaua

SEQ ID NO: 1774462 - RNA, 13 nt, Salmonella enterica enterica serovar Typhi Ty2
ugccacuccgcca

SEQ ID NO: 1774463 - RNA, 21 nt, Salmonella enterica enterica serovar Typhi Ty2
ugccacuguucagaaaucggc

SEQ ID NO: 1774464 - RNA, 20 nt, Salmonella enterica enterica serovar Typhi Ty2
ugccacuggguuucccauug

SEQ ID NO: 1774465 - RNA, 13 nt, Salmonella enterica enterica serovar Typhi Ty2
ugccacuggccuc

SEQ ID NO: 1774466 - RNA, 14 nt, Salmonella enterica enterica serovar Typhi Ty2
ugccagaagagaau

SEQ ID NO: 1774467 - RNA, 22 nt, Salmonella enterica enterica serovar Typhi Ty2
ugccagaaacaacgcgggccau

SEQ ID NO: 1774468 - RNA, 16 nt, Salmonella enterica enterica serovar Typhi Ty2
ugccacuguucagaaa

SEQ ID NO: 1774469 - RNA, 16 nt, Salmonella enterica enterica serovar Typhi Ty2
ugcguaucgcccaccg

SEQ ID NO: 1774470 - RNA, 18 nt, Salmonella enterica enterica serovar Typhi Ty2
ugcgucaugcuuuuuuuc

SEQ ID NO: 1774471 - RNA, 23 nt, Salmonella enterica enterica serovar Typhi Ty2
ugcgucaugauuaacgucacgau

SEQ ID NO: 1774472 - RNA, 16 nt, Salmonella enterica enterica serovar Typhi Ty2
ugcguucauggcgcga

SEQ ID NO: 1774473 - RNA, 20 nt, Salmonella enterica enterica serovar Typhi Ty2
ugcguucaggcggcaaaaaa

SEQ ID NO: 1774474 - RNA, 20 nt, Salmonella enterica enterica serovar Typhi Ty2
ugcguucacagcaccauguu

SEQ ID NO: 1774475 - RNA, 23 nt, Salmonella enterica enterica serovar Typhi Ty2
ugcguuaaacgcugugaccagua

SEQ ID NO: 1774476 - RNA, 23 nt, Salmonella enterica enterica serovar Typhi Ty2
ugcguuaacggcuucguuucaga

SEQ ID NO: 1774477 - RNA, 18 nt, Salmonella enterica enterica serovar Typhi Ty2
ugcgucggcaccauuccc

SEQ ID NO: 1774478 - RNA, 14 nt, Salmonella enterica enterica serovar Typhi Ty2
ugcgguagcgccga

SEQ ID NO: 1774479 - RNA, 14 nt, Salmonella enterica enterica serovar Typhi Ty2
ugcguacucagcag

SEQ ID NO: 1774480 - RNA, 19 nt, Salmonella enterica enterica serovar Typhi Ty2
ugcguagacgaugcaggcc

SEQ ID NO: 1774481 - RNA, 15 nt, Salmonella enterica enterica serovar Typhi Ty2
ugcgggccagcagcc

SEQ ID NO: 1774482 - RNA, 19 nt, Salmonella enterica enterica serovar Typhi Ty2
ugcgggccagcagccaggc

SEQ ID NO: 1774483 - RNA, 23 nt, Salmonella enterica enterica serovar Typhi Ty2
ugcgggaaauaccauccgcgccg

SEQ ID NO: 1774484 - RNA, 14 nt, Salmonella enterica enterica serovar Typhi Ty2
ugcgcuggacuggg

SEQ ID NO: 1774485 - RNA, 19 nt, Salmonella enterica enterica serovar Typhi Ty2
ugcgcuggaacugaucgug

SEQ ID NO: 1774486 - RNA, 17 nt, Salmonella enterica enterica serovar Typhi Ty2
ugcgcucuaucaccgcc

SEQ ID NO: 1774487 - RNA, 16 nt, Salmonella enterica enterica serovar Typhi Ty2
ugcgcuuaccgggccu

SEQ ID NO: 1774488 - RNA, 15 nt, Salmonella enterica enterica serovar Typhi Ty2
ugcgcugucaccagc

SEQ ID NO: 1774489 - RNA, 16 nt, Salmonella enterica enterica serovar Typhi Ty2
ugcgcugucaccagca

SEQ ID NO: 1774490 - RNA, 13 nt, Salmonella enterica enterica serovar Typhi Ty2
ugcgccaacguca

SEQ ID NO: 1774491 - RNA, 14 nt, Salmonella enterica enterica serovar Typhi Ty2
ugcgccacaucauu

SEQ ID NO: 1774492 - RNA, 20 nt, Salmonella enterica enterica serovar Typhi Ty2
ugcgccaacgaagagaccug

SEQ ID NO: 1774493 - RNA, 15 nt, Salmonella enterica enterica serovar Typhi Ty2
ugcgcuccugcuccc

SEQ ID NO: 1774494 - RNA, 18 nt, Salmonella enterica enterica serovar Typhi Ty2
ugcgcucaugcgccuggc

SEQ ID NO: 1774495 - RNA, 16 nt, Salmonella enterica enterica serovar Typhi Ty2
ugcggcuucagcgaca

SEQ ID NO: 1774496 - RNA, 22 nt, Salmonella enterica enterica serovar Typhi Ty2
ugcgcuucgaugcguucaaaaa

SEQ ID NO: 1774497 - RNA, 18 nt, Salmonella enterica enterica serovar Typhi Ty2
ugcggcaaaaauccuucu

SEQ ID NO: 1774498 - RNA, 19 nt, Salmonella enterica enterica serovar Typhi Ty2
ugcggcacacagccaaaau

SEQ ID NO: 1774499 - RNA, 18 nt, Salmonella enterica enterica serovar Typhi Ty2
ugcggcaauggcucaggc

SEQ ID NO: 1774500 - RNA, 23 nt, Salmonella enterica enterica serovar Typhi Ty2
ugcucacccauuuuauccucuuc

SEQ ID NO: 1774501 - RNA, 10 nt, Salmonella enterica enterica serovar Typhi Ty2
ugcucaccca

SEQ ID NO: 1774502 - RNA, 18 nt, Salmonella enterica enterica serovar Typhi Ty2
ugcuaugauaagccugac

SEQ ID NO: 1774503 - RNA, 22 nt, Salmonella enterica enterica serovar Typhi Ty2
ugcuagaacauuucccgaaaaa

SEQ ID NO: 1774504 - RNA, 19 nt, Salmonella enterica enterica serovar Typhi Ty2
ugcuaucaaacugaaaauc

SEQ ID NO: 1774505 - RNA, 15 nt, Salmonella enterica enterica serovar Typhi Ty2
ugcuauccgccgcca

SEQ ID NO: 1774506 - RNA, 16 nt, Salmonella enterica enterica serovar Typhi Ty2
ugcuauccgccgccag

SEQ ID NO: 1774507 - RNA, 21 nt, Salmonella enterica enterica serovar Typhi Ty2
ugcuauaugcaggcauaaaaa

SEQ ID NO: 1774508 - RNA, 23 nt, Salmonella enterica enterica serovar Typhi Ty2
ugcuauaugcaggcauaaaaaag

SEQ ID NO: 1774509 - RNA, 14 nt, Salmonella enterica enterica serovar Typhi Ty2
ugcuaacagugaaa

SEQ ID NO: 1774510 - RNA, 13 nt, Salmonella enterica enterica serovar Typhi Ty2
ugcuaaaagaagc

SEQ ID NO: 1774511 - RNA, 22 nt, Salmonella enterica enterica serovar Typhi Ty2
ugcuaccguuuucgccuuugcg

SEQ ID NO: 1774512 - RNA, 12 nt, Salmonella enterica enterica serovar Typhi Ty2
ugcuacgcgcca

SEQ ID NO: 1774513 - RNA, 13 nt, Salmonella enterica enterica serovar Typhi Ty2
ugcucuuuaacaa

SEQ ID NO: 1774514 - RNA, 17 nt, Salmonella enterica enterica serovar Typhi Ty2
ugcugaauagccagccc

SEQ ID NO: 1774515 - RNA, 15 nt, Salmonella enterica enterica serovar Typhi Ty2
ugcucugccagcgcc

SEQ ID NO: 1774516 - RNA, 14 nt, Salmonella enterica enterica serovar Typhi Ty2
ugcucuccuggcau

SEQ ID NO: 1774517 - RNA, 17 nt, Salmonella enterica enterica serovar Typhi Ty2
ugcucuaccaacugagc

SEQ ID NO: 1774518 - RNA, 19 nt, Salmonella enterica enterica serovar Typhi Ty2
ugcucagcuuguagaaagg

SEQ ID NO: 1774519 - RNA, 18 nt, Salmonella enterica enterica serovar Typhi Ty2
ugcucagccaaacuccuc

SEQ ID NO: 1774520 - RNA, 22 nt, Salmonella enterica enterica serovar Typhi Ty2
ugcucaaccaguaccgggccuc

SEQ ID NO: 1774521 - RNA, 13 nt, Salmonella enterica enterica serovar Typhi Ty2
ugcucaggcaaca

SEQ ID NO: 1774522 - RNA, 21 nt, Salmonella enterica enterica serovar Typhi Ty2
ugcucagggcauccgccgccg

SEQ ID NO: 1774523 - RNA, 12 nt, Salmonella enterica enterica serovar Typhi Ty2
ugcuccaugauc

SEQ ID NO: 1774524 - RNA, 14 nt, Salmonella enterica enterica serovar Typhi Ty2
ugcuccaugcuguc

SEQ ID NO: 1774525 - RNA, 15 nt, Salmonella enterica enterica serovar Typhi Ty2
uggaccgcagcuuau

SEQ ID NO: 1774526 - RNA, 19 nt, Salmonella enterica enterica serovar Typhi Ty2
uggacgcgaaugucauccg

SEQ ID NO: 1774527 - RNA, 15 nt, Salmonella enterica enterica serovar Typhi Ty2
uggacagauuuccac

SEQ ID NO: 1774528 - RNA, 19 nt, Salmonella enterica enterica serovar Typhi Ty2
uggacagguaaaccgguca

SEQ ID NO: 1774529 - RNA, 15 nt, Salmonella enterica enterica serovar Typhi Ty2
uggacaaaaaaggaa

SEQ ID NO: 1774530 - RNA, 15 nt, Salmonella enterica enterica serovar Typhi Ty2
uggaaugcccacucc

SEQ ID NO: 1774531 - RNA, 12 nt, Salmonella enterica enterica serovar Typhi Ty2
uggaauuuugca

SEQ ID NO: 1774532 - RNA, 14 nt, Salmonella enterica enterica serovar Typhi Ty2
uggaauuuuuccag

SEQ ID NO: 1774533 - RNA, 24 nt, Salmonella enterica enterica serovar Typhi Ty2
uggaauuugucgucaugcgccagg

SEQ ID NO: 1774534 - RNA, 14 nt, Salmonella enterica enterica serovar Typhi Ty2
uggaauaaauauaa

SEQ ID NO: 1774535 - RNA, 18 nt, Salmonella enterica enterica serovar Typhi Ty2
uggaauaaacgguaagag

SEQ ID NO: 1774536 - RNA, 20 nt, Salmonella enterica enterica serovar Typhi Ty2
uggaaguugaagaaaaaccc

SEQ ID NO: 1774537 - RNA, 23 nt, Salmonella enterica enterica serovar Typhi Ty2
uggaaguagucgcgaaugcgcaa

SEQ ID NO: 1774538 - RNA, 14 nt, Salmonella enterica enterica serovar Typhi Ty2
uggaaguacuggau

SEQ ID NO: 1774539 - RNA, 19 nt, Salmonella enterica enterica serovar Typhi Ty2
uggaagcguuacuggccuu

SEQ ID NO: 1774540 - RNA, 21 nt, Salmonella enterica enterica serovar Typhi Ty2
uggaagcguuacuggccuucu

SEQ ID NO: 1774541 - RNA, 19 nt, Salmonella enterica enterica serovar Typhi Ty2
uggaacauccucuccugaa

SEQ ID NO: 1774542 - RNA, 18 nt, Salmonella enterica enterica serovar Typhi Ty2
uggaaccaaacaccagau

SEQ ID NO: 1774543 - RNA, 15 nt, Salmonella enterica enterica serovar Typhi Ty2
uggaaccgccggaga

SEQ ID NO: 1774544 - RNA, 21 nt, Salmonella enterica enterica serovar Typhi Ty2
ugcuuuuucagcgaggaaaac

SEQ ID NO: 1774545 - RNA, 16 nt, Salmonella enterica enterica serovar Typhi Ty2
ugcuuuuuauuuuucu

SEQ ID NO: 1774546 - RNA, 23 nt, Salmonella enterica enterica serovar Typhi Ty2
ugcuuuuuuuauuugugauaaag

SEQ ID NO: 1774547 - RNA, 17 nt, Salmonella enterica enterica serovar Typhi Ty2
ugcuuuuuuucucuguc

SEQ ID NO: 1774548 - RNA, 18 nt, Salmonella enterica enterica serovar Typhi Ty2
uggaaaccgcagaagguc

SEQ ID NO: 1774549 - RNA, 21 nt, Salmonella enterica enterica serovar Typhi Ty2
uggaaacagccaaucauaaac

SEQ ID NO: 1774550 - RNA, 16 nt, Salmonella enterica enterica serovar Typhi Ty2
uggaaacuaugcaaaa

SEQ ID NO: 1774551 - RNA, 16 nt, Salmonella enterica enterica serovar Typhi Ty2
uggaaauaaagguuca

SEQ ID NO: 1774552 - RNA, 19 nt, Salmonella enterica enterica serovar Typhi Ty2
uggaaauaaucuguagauu

SEQ ID NO: 1774553 - RNA, 15 nt, Salmonella enterica enterica serovar Typhi Ty2
uggaaauauucucag

SEQ ID NO: 1774554 - RNA, 19 nt, Salmonella enterica enterica serovar Typhi Ty2
uggaaaugcguggcauuaa

SEQ ID NO: 1774555 - RNA, 15 nt, Salmonella enterica enterica serovar Typhi Ty2
ugcuuucuggaugau

SEQ ID NO: 1774556 - RNA, 13 nt, Salmonella enterica enterica serovar Typhi Ty2
ugcuuaacuucug

SEQ ID NO: 1774557 - RNA, 21 nt, Salmonella enterica enterica serovar Typhi Ty2
ugcuguuuuuuguugauuuua

SEQ ID NO: 1774558 - RNA, 19 nt, Salmonella enterica enterica serovar Typhi Ty2
ugcuuaccuuguucuucca

SEQ ID NO: 1774559 - RNA, 15 nt, Salmonella enterica enterica serovar Typhi Ty2
ugcuuccaaagagcu

SEQ ID NO: 1774560 - RNA, 13 nt, Salmonella enterica enterica serovar Typhi Ty2
ugcuuccagcucc

SEQ ID NO: 1774561 - RNA, 19 nt, Salmonella enterica enterica serovar Typhi Ty2
ugcuuccagcuccauccac

SEQ ID NO: 1774562 - RNA, 23 nt, Salmonella enterica enterica serovar Typhi Ty2
ugcuucgccacgaccuacaccgu

SEQ ID NO: 1774563 - RNA, 13 nt, Salmonella enterica enterica serovar Typhi Ty2
ugcuucucuucaa

SEQ ID NO: 1774564 - RNA, 20 nt, Salmonella enterica enterica serovar Typhi Ty2
ugcuucguggcaaucagcaa

SEQ ID NO: 1774565 - RNA, 22 nt, Salmonella enterica enterica serovar Typhi Ty2
ugcuggauucucucccaggcau

SEQ ID NO: 1774566 - RNA, 14 nt, Salmonella enterica enterica serovar Typhi Ty2
ugcugcgcuuuguc

SEQ ID NO: 1774567 - RNA, 11 nt, Salmonella enterica enterica serovar Typhi Ty2
ugcuggcagau

SEQ ID NO: 1774568 - RNA, 15 nt, Salmonella enterica enterica serovar Typhi Ty2
ugcugcucccucacg

SEQ ID NO: 1774569 - RNA, 22 nt, Salmonella enterica enterica serovar Typhi Ty2
ugcugcgguuauaauaauaauu

SEQ ID NO: 1774570 - RNA, 16 nt, Salmonella enterica enterica serovar Typhi Ty2
ugcugacaaucugcug

SEQ ID NO: 1774571 - RNA, 21 nt, Salmonella enterica enterica serovar Typhi Ty2
ugcugacaaaauaaagugaaa

SEQ ID NO: 1774572 - RNA, 19 nt, Salmonella enterica enterica serovar Typhi Ty2
ugcugaauauuaucggcgu

SEQ ID NO: 1774573 - RNA, 20 nt, Salmonella enterica enterica serovar Typhi Ty2
ugcugacaucucuuuuaauu

SEQ ID NO: 1774574 - RNA, 23 nt, Salmonella enterica enterica serovar Typhi Ty2
ugcugacaucucuuuuaauuuuc

SEQ ID NO: 1774575 - RNA, 17 nt, Salmonella enterica enterica serovar Typhi Ty2
ugcugacacccucugcg

SEQ ID NO: 1774576 - RNA, 18 nt, Salmonella enterica enterica serovar Typhi Ty2
ugcugacaaucugcugga

SEQ ID NO: 1774577 - RNA, 13 nt, Salmonella enterica enterica serovar Typhi Ty2
ugcugcgccagcc

SEQ ID NO: 1774578 - RNA, 18 nt, Salmonella enterica enterica serovar Typhi Ty2
ugcugucgcccauugaaa

SEQ ID NO: 1774579 - RNA, 20 nt, Salmonella enterica enterica serovar Typhi Ty2
ugcuguccggcugcauauac

SEQ ID NO: 1774580 - RNA, 16 nt, Salmonella enterica enterica serovar Typhi Ty2
ugcugugccugccugu

SEQ ID NO: 1774581 - RNA, 14 nt, Salmonella enterica enterica serovar Typhi Ty2
ugcugugcauaaau

SEQ ID NO: 1774582 - RNA, 21 nt, Salmonella enterica enterica serovar Typhi Ty2
ugcugugcagacugcacuucc

SEQ ID NO: 1774583 - RNA, 16 nt, Salmonella enterica enterica serovar Typhi Ty2
ugcugucuuagugaaa

SEQ ID NO: 1774584 - RNA, 21 nt, Salmonella enterica enterica serovar Typhi Ty2
ugcugguaccuuuguggcagg

SEQ ID NO: 1774585 - RNA, 18 nt, Salmonella enterica enterica serovar Typhi Ty2
ugcuggccuguucaagug

SEQ ID NO: 1774586 - RNA, 12 nt, Salmonella enterica enterica serovar Typhi Ty2
ugcuggccgcgu

SEQ ID NO: 1774587 - RNA, 20 nt, Salmonella enterica enterica serovar Typhi Ty2
ugcuggucagcaacgccucc

SEQ ID NO: 1774588 - RNA, 13 nt, Salmonella enterica enterica serovar Typhi Ty2
uuaguaacuuaca

SEQ ID NO: 1774589 - RNA, 23 nt, Salmonella enterica enterica serovar Typhi Ty2
uuaggcggcuucacgccauccag

SEQ ID NO: 1774590 - RNA, 13 nt, Salmonella enterica enterica serovar Typhi Ty2
uuagggcgcggcu

SEQ ID NO: 1774591 - RNA, 18 nt, Salmonella enterica enterica serovar Typhi Ty2
uuaggguagaaaaaggua

SEQ ID NO: 1774592 - RNA, 19 nt, Salmonella enterica enterica serovar Typhi Ty2
uuaggguagaaaaagguaa

SEQ ID NO: 1774593 - RNA, 15 nt, Salmonella enterica enterica serovar Typhi Ty2
uuagugcucagcuug

SEQ ID NO: 1774594 - RNA, 21 nt, Salmonella enterica enterica serovar Typhi Ty2
uuaguuacgcacgccagauaa

SEQ ID NO: 1774595 - RNA, 14 nt, Salmonella enterica enterica serovar Typhi Ty2
uuaguguuauauaa

SEQ ID NO: 1774596 - RNA, 21 nt, Salmonella enterica enterica serovar Typhi Ty2
uuaguugauucgcuaauaauu

SEQ ID NO: 1774597 - RNA, 21 nt, Salmonella enterica enterica serovar Typhi Ty2
uuauaaauauuaaugaauaaa

SEQ ID NO: 1774598 - RNA, 16 nt, Salmonella enterica enterica serovar Typhi Ty2
uuauauuuaaaauucc

SEQ ID NO: 1774599 - RNA, 12 nt, Salmonella enterica enterica serovar Typhi Ty2
uuauauuuaaaa

SEQ ID NO: 1774600 - RNA, 15 nt, Salmonella enterica enterica serovar Typhi Ty2
uuauauuuaaaauuc

SEQ ID NO: 1774601 - RNA, 24 nt, Salmonella enterica enterica serovar Typhi Ty2
uuauauugcguaaaaacccuuuca

SEQ ID NO: 1774602 - RNA, 24 nt, Salmonella enterica enterica serovar Typhi Ty2
uuaucacccugaauuucaauaauc

SEQ ID NO: 1774603 - RNA, 13 nt, Salmonella enterica enterica serovar Typhi Ty2
uuauauaagcaua

SEQ ID NO: 1774604 - RNA, 20 nt, Salmonella enterica enterica serovar Typhi Ty2
uuauacuugcugcuauguaa

SEQ ID NO: 1774605 - RNA, 19 nt, Salmonella enterica enterica serovar Typhi Ty2
uuauaggugucagauccuu

SEQ ID NO: 1774606 - RNA, 21 nt, Salmonella enterica enterica serovar Typhi Ty2
uuauaggugucagauccuuca

SEQ ID NO: 1774607 - RNA, 16 nt, Salmonella enterica enterica serovar Typhi Ty2
uuauacuugcugcuau

SEQ ID NO: 1774608 - RNA, 22 nt, Salmonella enterica enterica serovar Typhi Ty2
uuauauaaaaaaugguuuuauu

SEQ ID NO: 1774609 - RNA, 13 nt, Salmonella enterica enterica serovar Typhi Ty2
uuauaguccacuu

SEQ ID NO: 1774610 - RNA, 15 nt, Salmonella enterica enterica serovar Typhi Ty2
uuauacugauaaacu

SEQ ID NO: 1774611 - RNA, 19 nt, Salmonella enterica enterica serovar Typhi Ty2
uuauaaaucaggaaaaagg

SEQ ID NO: 1774612 - RNA, 22 nt, Salmonella enterica enterica serovar Typhi Ty2
uuauaacuaaacucaucuuuau

SEQ ID NO: 1774613 - RNA, 16 nt, Salmonella enterica enterica serovar Typhi Ty2
uuaccuuguucuucca

SEQ ID NO: 1774614 - RNA, 13 nt, Salmonella enterica enterica serovar Typhi Ty2
uuacgaaaagguc

SEQ ID NO: 1774615 - RNA, 14 nt, Salmonella enterica enterica serovar Typhi Ty2
uuagauuaaucacu

SEQ ID NO: 1774616 - RNA, 14 nt, Salmonella enterica enterica serovar Typhi Ty2
uuagcaaaaaugcc

SEQ ID NO: 1774617 - RNA, 19 nt, Salmonella enterica enterica serovar Typhi Ty2
uuagcaauugccauaaaaa

SEQ ID NO: 1774618 - RNA, 17 nt, Salmonella enterica enterica serovar Typhi Ty2
uuagcccaaaaggcuca

SEQ ID NO: 1774619 - RNA, 17 nt, Salmonella enterica enterica serovar Typhi Ty2
uuagccccugacgcugc

SEQ ID NO: 1774620 - RNA, 18 nt, Salmonella enterica enterica serovar Typhi Ty2
uuagcuggccaaucagcg

SEQ ID NO: 1774621 - RNA, 14 nt, Salmonella enterica enterica serovar Typhi Ty2
uuagcgcacaaaaa

SEQ ID NO: 1774622 - RNA, 18 nt, Salmonella enterica enterica serovar Typhi Ty2
uuagccuguuauucaauu

SEQ ID NO: 1774623 - RNA, 13 nt, Salmonella enterica enterica serovar Typhi Ty2
uuagcgaaacagu

SEQ ID NO: 1774624 - RNA, 20 nt, Salmonella enterica enterica serovar Typhi Ty2
uuagcuuuuuuaugcuguag

SEQ ID NO: 1774625 - RNA, 19 nt, Salmonella enterica enterica serovar Typhi Ty2
uuaaaucgcgcaaauauua

SEQ ID NO: 1774626 - RNA, 17 nt, Salmonella enterica enterica serovar Typhi Ty2
uuaaaucaucauaauca

SEQ ID NO: 1774627 - RNA, 15 nt, Salmonella enterica enterica serovar Typhi Ty2
uuaaauaacaaauga

SEQ ID NO: 1774628 - RNA, 22 nt, Salmonella enterica enterica serovar Typhi Ty2
uuaacucuuuuucagcaaauac

SEQ ID NO: 1774629 - RNA, 22 nt, Salmonella enterica enterica serovar Typhi Ty2
uuaacuggcgacgacuucaccc

SEQ ID NO: 1774630 - RNA, 15 nt, Salmonella enterica enterica serovar Typhi Ty2
uuaaggcaucaauac

SEQ ID NO: 1774631 - RNA, 13 nt, Salmonella enterica enterica serovar Typhi Ty2
uuaagaagucugu

SEQ ID NO: 1774632 - RNA, 21 nt, Salmonella enterica enterica serovar Typhi Ty2
uuaauacaucaugcuugcuuu

SEQ ID NO: 1774633 - RNA, 12 nt, Salmonella enterica enterica serovar Typhi Ty2
uuaauccagcag

SEQ ID NO: 1774634 - RNA, 15 nt, Salmonella enterica enterica serovar Typhi Ty2
uuaaucaggcauuca

SEQ ID NO: 1774635 - RNA, 17 nt, Salmonella enterica enterica serovar Typhi Ty2
uuaauaucaauauaauu

SEQ ID NO: 1774636 - RNA, 17 nt, Salmonella enterica enterica serovar Typhi Ty2
uuaauauauucaucuuu

SEQ ID NO: 1774637 - RNA, 18 nt, Salmonella enterica enterica serovar Typhi Ty2
uuaauucuuuuaacauaa

SEQ ID NO: 1774638 - RNA, 18 nt, Salmonella enterica enterica serovar Typhi Ty2
uuaauuugugccagcgug

SEQ ID NO: 1774639 - RNA, 16 nt, Salmonella enterica enterica serovar Typhi Ty2
uuaauuugcuguuuuu

SEQ ID NO: 1774640 - RNA, 19 nt, Salmonella enterica enterica serovar Typhi Ty2
uuaauuaaaugcuugcuuu

SEQ ID NO: 1774641 - RNA, 21 nt, Salmonella enterica enterica serovar Typhi Ty2
uuaauguuuagucuuuuagua

SEQ ID NO: 1774642 - RNA, 13 nt, Salmonella enterica enterica serovar Typhi Ty2
uuaauucuuuuaa

SEQ ID NO: 1774643 - RNA, 20 nt, Salmonella enterica enterica serovar Typhi Ty2
uuaauuccuggcguaugcuu

SEQ ID NO: 1774644 - RNA, 15 nt, Salmonella enterica enterica serovar Typhi Ty2
uuaaucgcuucaauc

SEQ ID NO: 1774645 - RNA, 15 nt, Salmonella enterica enterica serovar Typhi Ty2
uuaaucgucaucccg

SEQ ID NO: 1774646 - RNA, 14 nt, Salmonella enterica enterica serovar Typhi Ty2
uuaaucgucauccc

SEQ ID NO: 1774647 - RNA, 14 nt, Salmonella enterica enterica serovar Typhi Ty2
uuaauguccagcag

SEQ ID NO: 1774648 - RNA, 20 nt, Salmonella enterica enterica serovar Typhi Ty2
uuaauccgcggauagacgau

SEQ ID NO: 1774649 - RNA, 14 nt, Salmonella enterica enterica serovar Typhi Ty2
uuaccaaucugcgu

SEQ ID NO: 1774650 - RNA, 18 nt, Salmonella enterica enterica serovar Typhi Ty2
uuaccaaugccaaaaaaa

SEQ ID NO: 1774651 - RNA, 22 nt, Salmonella enterica enterica serovar Typhi Ty2
uuaccagaccggcaucucaucu

SEQ ID NO: 1774652 - RNA, 13 nt, Salmonella enterica enterica serovar Typhi Ty2
uuaccacuuugcg

SEQ ID NO: 1774653 - RNA, 13 nt, Salmonella enterica enterica serovar Typhi Ty2
uuacaggugccug

SEQ ID NO: 1774654 - RNA, 23 nt, Salmonella enterica enterica serovar Typhi Ty2
uuacaggugccuggguuccaggc

SEQ ID NO: 1774655 - RNA, 15 nt, Salmonella enterica enterica serovar Typhi Ty2
uuacaggcgcaucag

SEQ ID NO: 1774656 - RNA, 20 nt, Salmonella enterica enterica serovar Typhi Ty2
uuacaggcgcaucagaaaaa

SEQ ID NO: 1774657 - RNA, 21 nt, Salmonella enterica enterica serovar Typhi Ty2
uuacaggcgcaucagaaaaac

SEQ ID NO: 1774658 - RNA, 19 nt, Salmonella enterica enterica serovar Typhi Ty2
uuacaggccggacaggcga

SEQ ID NO: 1774659 - RNA, 22 nt, Salmonella enterica enterica serovar Typhi Ty2
uuacaggcauccgugaccugcu

SEQ ID NO: 1774660 - RNA, 14 nt, Salmonella enterica enterica serovar Typhi Ty2
uuacaggacagaug

SEQ ID NO: 1774661 - RNA, 19 nt, Salmonella enterica enterica serovar Typhi Ty2
uuacacacccggccuauca

SEQ ID NO: 1774662 - RNA, 18 nt, Salmonella enterica enterica serovar Typhi Ty2
uuacaauuuaucugcgug

SEQ ID NO: 1774663 - RNA, 17 nt, Salmonella enterica enterica serovar Typhi Ty2
uuaccuggguagcuucu

SEQ ID NO: 1774664 - RNA, 21 nt, Salmonella enterica enterica serovar Typhi Ty2
uuaccuacuguggugugccug

SEQ ID NO: 1774665 - RNA, 19 nt, Salmonella enterica enterica serovar Typhi Ty2
uuaccguaugcaaaaggca

SEQ ID NO: 1774666 - RNA, 20 nt, Salmonella enterica enterica serovar Typhi Ty2
uuaccguaucccaccauaaa

SEQ ID NO: 1774667 - RNA, 15 nt, Salmonella enterica enterica serovar Typhi Ty2
uuaccggcuggaagc

SEQ ID NO: 1774668 - RNA, 14 nt, Salmonella enterica enterica serovar Typhi Ty2
uuaccgggcaucug

SEQ ID NO: 1774669 - RNA, 22 nt, Salmonella enterica enterica serovar Typhi Ty2
uuacccuuccccggcagccuca

SEQ ID NO: 1774670 - RNA, 16 nt, Salmonella enterica enterica serovar Typhi Ty2
uuaccgcgcucaaaug

SEQ ID NO: 1774671 - RNA, 20 nt, Salmonella enterica enterica serovar Typhi Ty2
uuacccuucagauaucccau

SEQ ID NO: 1774672 - RNA, 21 nt, Salmonella enterica enterica serovar Typhi Ty2
uuaccaguugaccaaacagca

SEQ ID NO: 1774673 - RNA, 18 nt, Salmonella enterica enterica serovar Typhi Ty2
uuacccgggccaucuuuu

SEQ ID NO: 1774674 - RNA, 19 nt, Salmonella enterica enterica serovar Typhi Ty2
uguuaaaaagaccaugaac

SEQ ID NO: 1774675 - RNA, 22 nt, Salmonella enterica enterica serovar Typhi Ty2
uguuaaccagauaagccugugc

SEQ ID NO: 1774676 - RNA, 14 nt, Salmonella enterica enterica serovar Typhi Ty2
uguguauauauugc

SEQ ID NO: 1774677 - RNA, 14 nt, Salmonella enterica enterica serovar Typhi Ty2
ugugucaaaaaguu

SEQ ID NO: 1774678 - RNA, 20 nt, Salmonella enterica enterica serovar Typhi Ty2
ugugugagcgcccgccgcga

SEQ ID NO: 1774679 - RNA, 19 nt, Salmonella enterica enterica serovar Typhi Ty2
uguggcuguguucauccca

SEQ ID NO: 1774680 - RNA, 13 nt, Salmonella enterica enterica serovar Typhi Ty2
uguggccugcuua

SEQ ID NO: 1774681 - RNA, 18 nt, Salmonella enterica enterica serovar Typhi Ty2
uguggccaggcacguuaa

SEQ ID NO: 1774682 - RNA, 14 nt, Salmonella enterica enterica serovar Typhi Ty2
uguggccaggcacg

SEQ ID NO: 1774683 - RNA, 16 nt, Salmonella enterica enterica serovar Typhi Ty2
ugugcucgauauauuu

SEQ ID NO: 1774684 - RNA, 19 nt, Salmonella enterica enterica serovar Typhi Ty2
ugugcucgauauauuuucc

SEQ ID NO: 1774685 - RNA, 14 nt, Salmonella enterica enterica serovar Typhi Ty2
ugugcgugaugggc

SEQ ID NO: 1774686 - RNA, 12 nt, Salmonella enterica enterica serovar Typhi Ty2
ugugagccauaa

SEQ ID NO: 1774687 - RNA, 23 nt, Salmonella enterica enterica serovar Typhi Ty2
ugugagaaaagcgaaaauaaacg

SEQ ID NO: 1774688 - RNA, 22 nt, Salmonella enterica enterica serovar Typhi Ty2
ugucacgccguguucgucgcca

SEQ ID NO: 1774689 - RNA, 15 nt, Salmonella enterica enterica serovar Typhi Ty2
ugugccgucauccag

SEQ ID NO: 1774690 - RNA, 17 nt, Salmonella enterica enterica serovar Typhi Ty2
ugugccggaaaucgcgg

SEQ ID NO: 1774691 - RNA, 21 nt, Salmonella enterica enterica serovar Typhi Ty2
uguugugugccgcgcuggugg

SEQ ID NO: 1774692 - RNA, 18 nt, Salmonella enterica enterica serovar Typhi Ty2
uguugucgagguuauaaa

SEQ ID NO: 1774693 - RNA, 21 nt, Salmonella enterica enterica serovar Typhi Ty2
uguuguucgucuuuugaauag

SEQ ID NO: 1774694 - RNA, 13 nt, Salmonella enterica enterica serovar Typhi Ty2
uguugguuuaaac

SEQ ID NO: 1774695 - RNA, 20 nt, Salmonella enterica enterica serovar Typhi Ty2
uguugauugaaacucgccau

SEQ ID NO: 1774696 - RNA, 20 nt, Salmonella enterica enterica serovar Typhi Ty2
uguucucgaggacagugaaa

SEQ ID NO: 1774697 - RNA, 17 nt, Salmonella enterica enterica serovar Typhi Ty2
uguucuacuacagaaag

SEQ ID NO: 1774698 - RNA, 21 nt, Salmonella enterica enterica serovar Typhi Ty2
uguugcaccuguuucugcugg

SEQ ID NO: 1774699 - RNA, 13 nt, Salmonella enterica enterica serovar Typhi Ty2
uguugcuccagca

SEQ ID NO: 1774700 - RNA, 16 nt, Salmonella enterica enterica serovar Typhi Ty2
uguugcuccagcauca

SEQ ID NO: 1774701 - RNA, 23 nt, Salmonella enterica enterica serovar Typhi Ty2
uguucuaaaaaguucauguaagu

SEQ ID NO: 1774702 - RNA, 13 nt, Salmonella enterica enterica serovar Typhi Ty2
uguucuaaacguu

SEQ ID NO: 1774703 - RNA, 14 nt, Salmonella enterica enterica serovar Typhi Ty2
uguuccugcaauau

SEQ ID NO: 1774704 - RNA, 16 nt, Salmonella enterica enterica serovar Typhi Ty2
uguuccugcgggaaca

SEQ ID NO: 1774705 - RNA, 12 nt, Salmonella enterica enterica serovar Typhi Ty2
uguuccucuuuc

SEQ ID NO: 1774706 - RNA, 22 nt, Salmonella enterica enterica serovar Typhi Ty2
uguuccggcgaggacuguacaa

SEQ ID NO: 1774707 - RNA, 14 nt, Salmonella enterica enterica serovar Typhi Ty2
uguucagccagcaa

SEQ ID NO: 1774708 - RNA, 20 nt, Salmonella enterica enterica serovar Typhi Ty2
uguucagaaaucggcagcac

SEQ ID NO: 1774709 - RNA, 16 nt, Salmonella enterica enterica serovar Typhi Ty2
uguuauccuaaaucug

SEQ ID NO: 1774710 - RNA, 21 nt, Salmonella enterica enterica serovar Typhi Ty2
uguuaucaugugaucuauaua

SEQ ID NO: 1774711 - RNA, 16 nt, Salmonella enterica enterica serovar Typhi Ty2
uguuuuuuaauauauu

SEQ ID NO: 1774712 - RNA, 14 nt, Salmonella enterica enterica serovar Typhi Ty2
uguuuuuguaccag

SEQ ID NO: 1774713 - RNA, 11 nt, Salmonella enterica enterica serovar Typhi Ty2
uguuuuuucau

SEQ ID NO: 1774714 - RNA, 18 nt, Salmonella enterica enterica serovar Typhi Ty2
uguuuuugcuuuaauauu

SEQ ID NO: 1774715 - RNA, 16 nt, Salmonella enterica enterica serovar Typhi Ty2
uguuuuugaaaaugug

SEQ ID NO: 1774716 - RNA, 16 nt, Salmonella enterica enterica serovar Typhi Ty2
uguuuuuauuuuucuu

SEQ ID NO: 1774717 - RNA, 22 nt, Salmonella enterica enterica serovar Typhi Ty2
uuaaaaacagguugcguaacgc

SEQ ID NO: 1774718 - RNA, 12 nt, Salmonella enterica enterica serovar Typhi Ty2
uuaaaaacauca

SEQ ID NO: 1774719 - RNA, 22 nt, Salmonella enterica enterica serovar Typhi Ty2
uuaaaaauauccuguaacucau

SEQ ID NO: 1774720 - RNA, 21 nt, Salmonella enterica enterica serovar Typhi Ty2
uuaaaagcgccuuaaaccguc

SEQ ID NO: 1774721 - RNA, 17 nt, Salmonella enterica enterica serovar Typhi Ty2
uuaaaagggaguauuua

SEQ ID NO: 1774722 - RNA, 23 nt, Salmonella enterica enterica serovar Typhi Ty2
uuaaaauaaaugaggcuguuuuu

SEQ ID NO: 1774723 - RNA, 20 nt, Salmonella enterica enterica serovar Typhi Ty2
uuaaaauuccaauauuuauu

SEQ ID NO: 1774724 - RNA, 22 nt, Salmonella enterica enterica serovar Typhi Ty2
uuaaaaucggggucuuccagca

SEQ ID NO: 1774725 - RNA, 22 nt, Salmonella enterica enterica serovar Typhi Ty2
uuaaagcgcucaagcggcacca

SEQ ID NO: 1774726 - RNA, 17 nt, Salmonella enterica enterica serovar Typhi Ty2
uuaaagcccugacagaa

SEQ ID NO: 1774727 - RNA, 19 nt, Salmonella enterica enterica serovar Typhi Ty2
uuaaagccaauccagaaua

SEQ ID NO: 1774728 - RNA, 11 nt, Salmonella enterica enterica serovar Typhi Ty2
uuaaagccacg

SEQ ID NO: 1774729 - RNA, 23 nt, Salmonella enterica enterica serovar Typhi Ty2
uuaaagcacaagaacuuaaauua

SEQ ID NO: 1774730 - RNA, 21 nt, Salmonella enterica enterica serovar Typhi Ty2
uuaaaguuaguaccgaacagc

SEQ ID NO: 1774731 - RNA, 13 nt, Salmonella enterica enterica serovar Typhi Ty2
uuaaacugccuuc

SEQ ID NO: 1774732 - RNA, 19 nt, Salmonella enterica enterica serovar Typhi Ty2
uguuucgacaguuucuucu

SEQ ID NO: 1774733 - RNA, 15 nt, Salmonella enterica enterica serovar Typhi Ty2
uguuucaguucggag

SEQ ID NO: 1774734 - RNA, 18 nt, Salmonella enterica enterica serovar Typhi Ty2
uguuucaucgucagcucc

SEQ ID NO: 1774735 - RNA, 16 nt, Salmonella enterica enterica serovar Typhi Ty2
uguuucaucucaucaa

SEQ ID NO: 1774736 - RNA, 15 nt, Salmonella enterica enterica serovar Typhi Ty2
uguuucauggagauc

SEQ ID NO: 1774737 - RNA, 20 nt, Salmonella enterica enterica serovar Typhi Ty2
uguuuauucuucgucagaug

SEQ ID NO: 1774738 - RNA, 16 nt, Salmonella enterica enterica serovar Typhi Ty2
uguuuaugacccugcg

SEQ ID NO: 1774739 - RNA, 19 nt, Salmonella enterica enterica serovar Typhi Ty2
uguuuauccccgcuggcgc

SEQ ID NO: 1774740 - RNA, 23 nt, Salmonella enterica enterica serovar Typhi Ty2
uguuuaguacgcaaggaaauauu

SEQ ID NO: 1774741 - RNA, 14 nt, Salmonella enterica enterica serovar Typhi Ty2
uguuuacgccgcca

SEQ ID NO: 1774742 - RNA, 14 nt, Salmonella enterica enterica serovar Typhi Ty2
uguuuaccuuuacg

SEQ ID NO: 1774743 - RNA, 23 nt, Salmonella enterica enterica serovar Typhi Ty2
uguuuagccuuauagagguguua

SEQ ID NO: 1774744 - RNA, 19 nt, Salmonella enterica enterica serovar Typhi Ty2
uguuuaagcgccuccacaa

SEQ ID NO: 1774745 - RNA, 18 nt, Salmonella enterica enterica serovar Typhi Ty2
uguuuaauggcagaauaa

SEQ ID NO: 1774746 - RNA, 19 nt, Salmonella enterica enterica serovar Typhi Ty2
uguuuaccaagcaccgcca

SEQ ID NO: 1774747 - RNA, 16 nt, Salmonella enterica enterica serovar Typhi Ty2
uguuuuauuaccuccu

SEQ ID NO: 1774748 - RNA, 20 nt, Salmonella enterica enterica serovar Typhi Ty2
uguuuuauacucaaaaaauc

SEQ ID NO: 1774749 - RNA, 15 nt, Salmonella enterica enterica serovar Typhi Ty2
uguuugcugauaaga

SEQ ID NO: 1774750 - RNA, 15 nt, Salmonella enterica enterica serovar Typhi Ty2
uguuucugcuggccu

SEQ ID NO: 1774751 - RNA, 12 nt, Salmonella enterica enterica serovar Typhi Ty2
uguuugaugagg

SEQ ID NO: 1774752 - RNA, 21 nt, Salmonella enterica enterica serovar Typhi Ty2
uggauuuuccguuaagcugga

SEQ ID NO: 1774753 - RNA, 18 nt, Salmonella enterica enterica serovar Typhi Ty2
uggauuuuugacuaaagu

SEQ ID NO: 1774754 - RNA, 19 nt, Salmonella enterica enterica serovar Typhi Ty2
uggauuucacgaucaucgc

SEQ ID NO: 1774755 - RNA, 21 nt, Salmonella enterica enterica serovar Typhi Ty2
uggcaaaaaaggccagacuca

SEQ ID NO: 1774756 - RNA, 22 nt, Salmonella enterica enterica serovar Typhi Ty2
uggcaaaaaaggccagacucau

SEQ ID NO: 1774757 - RNA, 18 nt, Salmonella enterica enterica serovar Typhi Ty2
uggcaaaaacaccuaacc

SEQ ID NO: 1774758 - RNA, 16 nt, Salmonella enterica enterica serovar Typhi Ty2
uggcaaaacgcaucca

SEQ ID NO: 1774759 - RNA, 14 nt, Salmonella enterica enterica serovar Typhi Ty2
uggcaaaauccaac

SEQ ID NO: 1774760 - RNA, 20 nt, Salmonella enterica enterica serovar Typhi Ty2
uggcaaaaggggcguuucuc

SEQ ID NO: 1774761 - RNA, 15 nt, Salmonella enterica enterica serovar Typhi Ty2
uggcaaaccccugcu

SEQ ID NO: 1774762 - RNA, 18 nt, Salmonella enterica enterica serovar Typhi Ty2
uggcaacaaagccugcug

SEQ ID NO: 1774763 - RNA, 16 nt, Salmonella enterica enterica serovar Typhi Ty2
uggcaacaugaccagc

SEQ ID NO: 1774764 - RNA, 22 nt, Salmonella enterica enterica serovar Typhi Ty2
uggcaaaugaagcgacgcuggc

SEQ ID NO: 1774765 - RNA, 19 nt, Salmonella enterica enterica serovar Typhi Ty2
uggcaagaauuauuucagg

SEQ ID NO: 1774766 - RNA, 17 nt, Salmonella enterica enterica serovar Typhi Ty2
uggcaagcgcuaagcaa

SEQ ID NO: 1774767 - RNA, 20 nt, Salmonella enterica enterica serovar Typhi Ty2
uggcaagaaccgcuuuuccu

SEQ ID NO: 1774768 - RNA, 17 nt, Salmonella enterica enterica serovar Typhi Ty2
uggcaacggcagccagc

SEQ ID NO: 1774769 - RNA, 17 nt, Salmonella enterica enterica serovar Typhi Ty2
uggcaauuaaauuagaa

SEQ ID NO: 1774770 - RNA, 23 nt, Salmonella enterica enterica serovar Typhi Ty2
uggcaaucauaccgucagauucu

SEQ ID NO: 1774771 - RNA, 17 nt, Salmonella enterica enterica serovar Typhi Ty2
uggcaagauuaaccagc

SEQ ID NO: 1774772 - RNA, 20 nt, Salmonella enterica enterica serovar Typhi Ty2
uggcaaucaaauccagcuca

SEQ ID NO: 1774773 - RNA, 14 nt, Salmonella enterica enterica serovar Typhi Ty2
uggcacagcgcagc

SEQ ID NO: 1774774 - RNA, 16 nt, Salmonella enterica enterica serovar Typhi Ty2
uggcacgauaaccaga

SEQ ID NO: 1774775 - RNA, 15 nt, Salmonella enterica enterica serovar Typhi Ty2
uggcacuucgcgcca

SEQ ID NO: 1774776 - RNA, 13 nt, Salmonella enterica enterica serovar Typhi Ty2
uggcacuggcagc

SEQ ID NO: 1774777 - RNA, 21 nt, Salmonella enterica enterica serovar Typhi Ty2
uggcacuggcagccucguccu

SEQ ID NO: 1774778 - RNA, 13 nt, Salmonella enterica enterica serovar Typhi Ty2
uggcacgcuggua

SEQ ID NO: 1774779 - RNA, 15 nt, Salmonella enterica enterica serovar Typhi Ty2
uggcagaugaacaua

SEQ ID NO: 1774780 - RNA, 14 nt, Salmonella enterica enterica serovar Typhi Ty2
uggcagacagccau

SEQ ID NO: 1774781 - RNA, 15 nt, Salmonella enterica enterica serovar Typhi Ty2
uggcagauaaaccac

SEQ ID NO: 1774782 - RNA, 18 nt, Salmonella enterica enterica serovar Typhi Ty2
uggcagcggcaguaaauu

SEQ ID NO: 1774783 - RNA, 17 nt, Salmonella enterica enterica serovar Typhi Ty2
uggcagccccugaaaua

SEQ ID NO: 1774784 - RNA, 16 nt, Salmonella enterica enterica serovar Typhi Ty2
uggcagccucguccug

SEQ ID NO: 1774785 - RNA, 21 nt, Salmonella enterica enterica serovar Typhi Ty2
uggcauaaccgcagcgcggcc

SEQ ID NO: 1774786 - RNA, 15 nt, Salmonella enterica enterica serovar Typhi Ty2
uggcauagccaaaga

SEQ ID NO: 1774787 - RNA, 20 nt, Salmonella enterica enterica serovar Typhi Ty2
uggcauauuugccccuuccg

SEQ ID NO: 1774788 - RNA, 22 nt, Salmonella enterica enterica serovar Typhi Ty2
uggcauauuugccccuuccgcc

SEQ ID NO: 1774789 - RNA, 15 nt, Salmonella enterica enterica serovar Typhi Ty2
uggcagugauggaug

SEQ ID NO: 1774790 - RNA, 22 nt, Salmonella enterica enterica serovar Typhi Ty2
uggcaguauaaauaccuuauuc

SEQ ID NO: 1774791 - RNA, 19 nt, Salmonella enterica enterica serovar Typhi Ty2
uggcauaaccgcagcgcgg

SEQ ID NO: 1774792 - RNA, 22 nt, Salmonella enterica enterica serovar Typhi Ty2
uggaugcgcugaauagcgcugc

SEQ ID NO: 1774793 - RNA, 23 nt, Salmonella enterica enterica serovar Typhi Ty2
uggaugcccaccugaaaaagggu

SEQ ID NO: 1774794 - RNA, 14 nt, Salmonella enterica enterica serovar Typhi Ty2
uggaugaacucaau

SEQ ID NO: 1774795 - RNA, 13 nt, Salmonella enterica enterica serovar Typhi Ty2
uggaugcguucaa

SEQ ID NO: 1774796 - RNA, 15 nt, Salmonella enterica enterica serovar Typhi Ty2
uggauggacuguuuc

SEQ ID NO: 1774797 - RNA, 15 nt, Salmonella enterica enterica serovar Typhi Ty2
uggaugguuucuucg

SEQ ID NO: 1774798 - RNA, 18 nt, Salmonella enterica enterica serovar Typhi Ty2
uggaucagacgccgcgcu

SEQ ID NO: 1774799 - RNA, 16 nt, Salmonella enterica enterica serovar Typhi Ty2
uggaucaucggcucag

SEQ ID NO: 1774800 - RNA, 16 nt, Salmonella enterica enterica serovar Typhi Ty2
uggaucccccuggccc

SEQ ID NO: 1774801 - RNA, 23 nt, Salmonella enterica enterica serovar Typhi Ty2
uggauaagacgacgguuaaaaag

SEQ ID NO: 1774802 - RNA, 18 nt, Salmonella enterica enterica serovar Typhi Ty2
uggauaaggcgugagcca

SEQ ID NO: 1774803 - RNA, 18 nt, Salmonella enterica enterica serovar Typhi Ty2
uggauaaagccaauggug

SEQ ID NO: 1774804 - RNA, 15 nt, Salmonella enterica enterica serovar Typhi Ty2
uggauaacagcgcgg

SEQ ID NO: 1774805 - RNA, 23 nt, Salmonella enterica enterica serovar Typhi Ty2
uggaguuaucauuauauagucuu

SEQ ID NO: 1774806 - RNA, 23 nt, Salmonella enterica enterica serovar Typhi Ty2
uggaguuuaaacacucuccacca

SEQ ID NO: 1774807 - RNA, 15 nt, Salmonella enterica enterica serovar Typhi Ty2
uggauagucuucaag

SEQ ID NO: 1774808 - RNA, 17 nt, Salmonella enterica enterica serovar Typhi Ty2
uggauagcaauuucagc

SEQ ID NO: 1774809 - RNA, 16 nt, Salmonella enterica enterica serovar Typhi Ty2
uggauagcaauuucag

SEQ ID NO: 1774810 - RNA, 16 nt, Salmonella enterica enterica serovar Typhi Ty2
uggauacguuccagca

SEQ ID NO: 1774811 - RNA, 14 nt, Salmonella enterica enterica serovar Typhi Ty2
uggauaccgcgcca

SEQ ID NO: 1774812 - RNA, 16 nt, Salmonella enterica enterica serovar Typhi Ty2
uggacggcaucaggaa

SEQ ID NO: 1774813 - RNA, 21 nt, Salmonella enterica enterica serovar Typhi Ty2
uggacguggguuucaauauag

SEQ ID NO: 1774814 - RNA, 19 nt, Salmonella enterica enterica serovar Typhi Ty2
uggagaggccaccagcgcc

SEQ ID NO: 1774815 - RNA, 15 nt, Salmonella enterica enterica serovar Typhi Ty2
uggagguuucuucau

SEQ ID NO: 1774816 - RNA, 15 nt, Salmonella enterica enterica serovar Typhi Ty2
uggaggaacagcgcc

SEQ ID NO: 1774817 - RNA, 17 nt, Salmonella enterica enterica serovar Typhi Ty2
uggaggaacagcgccgu

SEQ ID NO: 1774818 - RNA, 14 nt, Salmonella enterica enterica serovar Typhi Ty2
uggagucugaaaau

SEQ ID NO: 1774819 - RNA, 20 nt, Salmonella enterica enterica serovar Typhi Ty2
uggcggaauccaucccccug

SEQ ID NO: 1774820 - RNA, 14 nt, Salmonella enterica enterica serovar Typhi Ty2
uggcgcgaaaacag

SEQ ID NO: 1774821 - RNA, 18 nt, Salmonella enterica enterica serovar Typhi Ty2
uggcgccuuuuggcagca

SEQ ID NO: 1774822 - RNA, 18 nt, Salmonella enterica enterica serovar Typhi Ty2
uggcgccgcaaaccagac

SEQ ID NO: 1774823 - RNA, 16 nt, Salmonella enterica enterica serovar Typhi Ty2
uggcgccaugagccug

SEQ ID NO: 1774824 - RNA, 19 nt, Salmonella enterica enterica serovar Typhi Ty2
uggcgcagcauacgcugca

SEQ ID NO: 1774825 - RNA, 13 nt, Salmonella enterica enterica serovar Typhi Ty2
uggcgcagcgcgg

SEQ ID NO: 1774826 - RNA, 12 nt, Salmonella enterica enterica serovar Typhi Ty2
uggcgcagcgcu

SEQ ID NO: 1774827 - RNA, 18 nt, Salmonella enterica enterica serovar Typhi Ty2
uggcgcaguggcgggugc

SEQ ID NO: 1774828 - RNA, 14 nt, Salmonella enterica enterica serovar Typhi Ty2
uggcgauuuccagc

SEQ ID NO: 1774829 - RNA, 20 nt, Salmonella enterica enterica serovar Typhi Ty2
uggcgcacaguacgcgaccg

SEQ ID NO: 1774830 - RNA, 13 nt, Salmonella enterica enterica serovar Typhi Ty2
uggcgagcaacuu

SEQ ID NO: 1774831 - RNA, 16 nt, Salmonella enterica enterica serovar Typhi Ty2
uggcgacgaccgguca

SEQ ID NO: 1774832 - RNA, 21 nt, Salmonella enterica enterica serovar Typhi Ty2
uggcgacgacgcuguuuaugc

SEQ ID NO: 1774833 - RNA, 19 nt, Salmonella enterica enterica serovar Typhi Ty2
uggcgacgaucagcgccac

SEQ ID NO: 1774834 - RNA, 14 nt, Salmonella enterica enterica serovar Typhi Ty2
uggcgaccgggucg

SEQ ID NO: 1774835 - RNA, 15 nt, Salmonella enterica enterica serovar Typhi Ty2
uggcgaccgggucga

SEQ ID NO: 1774836 - RNA, 17 nt, Salmonella enterica enterica serovar Typhi Ty2
uggcgaauuuacgggcg

SEQ ID NO: 1774837 - RNA, 20 nt, Salmonella enterica enterica serovar Typhi Ty2
uggcgaauacuguuccaggc

SEQ ID NO: 1774838 - RNA, 15 nt, Salmonella enterica enterica serovar Typhi Ty2
uggcgaccagcagau

SEQ ID NO: 1774839 - RNA, 21 nt, Salmonella enterica enterica serovar Typhi Ty2
uggcgaauaaaauucagcgca

SEQ ID NO: 1774840 - RNA, 13 nt, Salmonella enterica enterica serovar Typhi Ty2
uggcgaauacugu

SEQ ID NO: 1774841 - RNA, 16 nt, Salmonella enterica enterica serovar Typhi Ty2
uggcgauauccgugcc

SEQ ID NO: 1774842 - RNA, 18 nt, Salmonella enterica enterica serovar Typhi Ty2
uggcgaggaacaucagcc

SEQ ID NO: 1774843 - RNA, 16 nt, Salmonella enterica enterica serovar Typhi Ty2
uggccucccaguuccc

SEQ ID NO: 1774844 - RNA, 21 nt, Salmonella enterica enterica serovar Typhi Ty2
uggccugcagaccuauauggc

SEQ ID NO: 1774845 - RNA, 12 nt, Salmonella enterica enterica serovar Typhi Ty2
uggccuucuuuc

SEQ ID NO: 1774846 - RNA, 13 nt, Salmonella enterica enterica serovar Typhi Ty2
uggccuucuccac

SEQ ID NO: 1774847 - RNA, 15 nt, Salmonella enterica enterica serovar Typhi Ty2
uggccgcgugcucgc

SEQ ID NO: 1774848 - RNA, 18 nt, Salmonella enterica enterica serovar Typhi Ty2
uggccgggauauccugcu

SEQ ID NO: 1774849 - RNA, 20 nt, Salmonella enterica enterica serovar Typhi Ty2
uggccacggagugcgcggcg

SEQ ID NO: 1774850 - RNA, 15 nt, Salmonella enterica enterica serovar Typhi Ty2
uggccaggaauaaag

SEQ ID NO: 1774851 - RNA, 17 nt, Salmonella enterica enterica serovar Typhi Ty2
uggccagggcaggcagu

SEQ ID NO: 1774852 - RNA, 13 nt, Salmonella enterica enterica serovar Typhi Ty2
uggccaguuucaa

SEQ ID NO: 1774853 - RNA, 19 nt, Salmonella enterica enterica serovar Typhi Ty2
uggccaucuuccagcauca

SEQ ID NO: 1774854 - RNA, 18 nt, Salmonella enterica enterica serovar Typhi Ty2
uggcauuacgcuggcccc

SEQ ID NO: 1774855 - RNA, 15 nt, Salmonella enterica enterica serovar Typhi Ty2
uggcauggugcagcc

SEQ ID NO: 1774856 - RNA, 17 nt, Salmonella enterica enterica serovar Typhi Ty2
uggcaucugaucuacaa

SEQ ID NO: 1774857 - RNA, 19 nt, Salmonella enterica enterica serovar Typhi Ty2
uggcaucauaaaaggcauc

SEQ ID NO: 1774858 - RNA, 20 nt, Salmonella enterica enterica serovar Typhi Ty2
uggcauugccggaaaccaac

SEQ ID NO: 1774859 - RNA, 16 nt, Salmonella enterica enterica serovar Typhi Ty2
uggcauucuuacgaua

SEQ ID NO: 1774860 - RNA, 16 nt, Salmonella enterica enterica serovar Typhi Ty2
uggcauuggcaucugu

SEQ ID NO: 1774861 - RNA, 15 nt, Salmonella enterica enterica serovar Typhi Ty2
uggccaagaugcuga

SEQ ID NO: 1774862 - RNA, 14 nt, Salmonella enterica enterica serovar Typhi Ty2
uggccaaucagcgg

SEQ ID NO: 1774863 - RNA, 13 nt, Salmonella enterica enterica serovar Typhi Ty2
uggccaaauaacc

SEQ ID NO: 1774864 - RNA, 19 nt, Salmonella enterica enterica serovar Typhi Ty2
uggcccaguuaacagaaug

SEQ ID NO: 1774865 - RNA, 17 nt, Salmonella enterica enterica serovar Typhi Ty2
uggcccagcgcgguggc

SEQ ID NO: 1774866 - RNA, 17 nt, Salmonella enterica enterica serovar Typhi Ty2
uggcccagcuaaaccac

SEQ ID NO: 1774867 - RNA, 22 nt, Salmonella enterica enterica serovar Typhi Ty2
uggccgauaugaauaauuucgg

SEQ ID NO: 1774868 - RNA, 22 nt, Salmonella enterica enterica serovar Typhi Ty2
uggccgaugucaauuacgcacc

SEQ ID NO: 1774869 - RNA, 14 nt, Salmonella enterica enterica serovar Typhi Ty2
uggcccucccuggc

SEQ ID NO: 1774870 - RNA, 15 nt, Salmonella enterica enterica serovar Typhi Ty2
uguacgugaagggaa

SEQ ID NO: 1774871 - RNA, 22 nt, Salmonella enterica enterica serovar Typhi Ty2
uguacggcgucagccacgguuc

SEQ ID NO: 1774872 - RNA, 13 nt, Salmonella enterica enterica serovar Typhi Ty2
uguacgcccagcc

SEQ ID NO: 1774873 - RNA, 19 nt, Salmonella enterica enterica serovar Typhi Ty2
uguacccucgcgccaguga

SEQ ID NO: 1774874 - RNA, 17 nt, Salmonella enterica enterica serovar Typhi Ty2
uguaccauugucaaaaa

SEQ ID NO: 1774875 - RNA, 15 nt, Salmonella enterica enterica serovar Typhi Ty2
uguacuuuugcuucc

SEQ ID NO: 1774876 - RNA, 16 nt, Salmonella enterica enterica serovar Typhi Ty2
uguacuuuugcuucca

SEQ ID NO: 1774877 - RNA, 18 nt, Salmonella enterica enterica serovar Typhi Ty2
uguacuuuugcuuccagu

SEQ ID NO: 1774878 - RNA, 15 nt, Salmonella enterica enterica serovar Typhi Ty2
uguacuccugauagg

SEQ ID NO: 1774879 - RNA, 17 nt, Salmonella enterica enterica serovar Typhi Ty2
uguaauuuauaaaguaa

SEQ ID NO: 1774880 - RNA, 17 nt, Salmonella enterica enterica serovar Typhi Ty2
uguaauugcgccaggcc

SEQ ID NO: 1774881 - RNA, 15 nt, Salmonella enterica enterica serovar Typhi Ty2
uguacaagaagggua

SEQ ID NO: 1774882 - RNA, 18 nt, Salmonella enterica enterica serovar Typhi Ty2
uguaaaggugagcucuuu

SEQ ID NO: 1774883 - RNA, 22 nt, Salmonella enterica enterica serovar Typhi Ty2
uguaaagucggccauuuuuuua

SEQ ID NO: 1774884 - RNA, 18 nt, Salmonella enterica enterica serovar Typhi Ty2
ugguucaacaucagcgcu

SEQ ID NO: 1774885 - RNA, 22 nt, Salmonella enterica enterica serovar Typhi Ty2
ugguuauuccgcuggaggccaa

SEQ ID NO: 1774886 - RNA, 18 nt, Salmonella enterica enterica serovar Typhi Ty2
ugguuaucgaauccagca

SEQ ID NO: 1774887 - RNA, 19 nt, Salmonella enterica enterica serovar Typhi Ty2
ugguuauacgguaauaacu

SEQ ID NO: 1774888 - RNA, 22 nt, Salmonella enterica enterica serovar Typhi Ty2
uguaaaagggauacgguuuuuu

SEQ ID NO: 1774889 - RNA, 16 nt, Salmonella enterica enterica serovar Typhi Ty2
uguaaaccguuuuucc

SEQ ID NO: 1774890 - RNA, 21 nt, Salmonella enterica enterica serovar Typhi Ty2
uguaaacccgauucugccagu

SEQ ID NO: 1774891 - RNA, 15 nt, Salmonella enterica enterica serovar Typhi Ty2
uguaaagaaugaaaa

SEQ ID NO: 1774892 - RNA, 20 nt, Salmonella enterica enterica serovar Typhi Ty2
uguaaagaaauuuaaagaua

SEQ ID NO: 1774893 - RNA, 16 nt, Salmonella enterica enterica serovar Typhi Ty2
uguaaacguuccugcc

SEQ ID NO: 1774894 - RNA, 15 nt, Salmonella enterica enterica serovar Typhi Ty2
uguauaaacucagca

SEQ ID NO: 1774895 - RNA, 13 nt, Salmonella enterica enterica serovar Typhi Ty2
uguauaaaauauu

SEQ ID NO: 1774896 - RNA, 17 nt, Salmonella enterica enterica serovar Typhi Ty2
uguaguuauaaauuuau

SEQ ID NO: 1774897 - RNA, 21 nt, Salmonella enterica enterica serovar Typhi Ty2
uguaggccugauagcacagcg

SEQ ID NO: 1774898 - RNA, 14 nt, Salmonella enterica enterica serovar Typhi Ty2
uguaggccgaauaa

SEQ ID NO: 1774899 - RNA, 16 nt, Salmonella enterica enterica serovar Typhi Ty2
uguagcaacugccagg

SEQ ID NO: 1774900 - RNA, 16 nt, Salmonella enterica enterica serovar Typhi Ty2
uguagcagauagauaa

SEQ ID NO: 1774901 - RNA, 18 nt, Salmonella enterica enterica serovar Typhi Ty2
uguagcggcaacagcacc

SEQ ID NO: 1774902 - RNA, 15 nt, Salmonella enterica enterica serovar Typhi Ty2
uguagcagcgccagc

SEQ ID NO: 1774903 - RNA, 13 nt, Salmonella enterica enterica serovar Typhi Ty2
uguagcaaauuuc

SEQ ID NO: 1774904 - RNA, 20 nt, Salmonella enterica enterica serovar Typhi Ty2
uguagaaaagaaggggcugg

SEQ ID NO: 1774905 - RNA, 21 nt, Salmonella enterica enterica serovar Typhi Ty2
uguagagauucugcaggccaa

SEQ ID NO: 1774906 - RNA, 20 nt, Salmonella enterica enterica serovar Typhi Ty2
uguauaauccaacauuauca

SEQ ID NO: 1774907 - RNA, 21 nt, Salmonella enterica enterica serovar Typhi Ty2
uguauaauccaacauuaucaa

SEQ ID NO: 1774908 - RNA, 13 nt, Salmonella enterica enterica serovar Typhi Ty2
uguauccacccgg

SEQ ID NO: 1774909 - RNA, 21 nt, Salmonella enterica enterica serovar Typhi Ty2
uguauuugaauuuuagauccc

SEQ ID NO: 1774910 - RNA, 18 nt, Salmonella enterica enterica serovar Typhi Ty2
uguauuugaauuuuagau

SEQ ID NO: 1774911 - RNA, 19 nt, Salmonella enterica enterica serovar Typhi Ty2
uggguuuauguaggguggc

SEQ ID NO: 1774912 - RNA, 15 nt, Salmonella enterica enterica serovar Typhi Ty2
uggguuuauuuggua

SEQ ID NO: 1774913 - RNA, 22 nt, Salmonella enterica enterica serovar Typhi Ty2
uggguuugugucguaguggcau

SEQ ID NO: 1774914 - RNA, 18 nt, Salmonella enterica enterica serovar Typhi Ty2
ugguaccaaacagcagaa

SEQ ID NO: 1774915 - RNA, 13 nt, Salmonella enterica enterica serovar Typhi Ty2
ugguaaaauccuu

SEQ ID NO: 1774916 - RNA, 20 nt, Salmonella enterica enterica serovar Typhi Ty2
uggguuauggguguuuucac

SEQ ID NO: 1774917 - RNA, 12 nt, Salmonella enterica enterica serovar Typhi Ty2
uggucagcgcaa

SEQ ID NO: 1774918 - RNA, 15 nt, Salmonella enterica enterica serovar Typhi Ty2
uggucaggcuaaaug

SEQ ID NO: 1774919 - RNA, 20 nt, Salmonella enterica enterica serovar Typhi Ty2
uggucagcucacgcgccagc

SEQ ID NO: 1774920 - RNA, 16 nt, Salmonella enterica enterica serovar Typhi Ty2
ugguacguccauccgc

SEQ ID NO: 1774921 - RNA, 22 nt, Salmonella enterica enterica serovar Typhi Ty2
ugguaccggauuuagcggcagc

SEQ ID NO: 1774922 - RNA, 21 nt, Salmonella enterica enterica serovar Typhi Ty2
ugguacgauuucauuacgccu

SEQ ID NO: 1774923 - RNA, 22 nt, Salmonella enterica enterica serovar Typhi Ty2
ugguaccgccaucggcgccggg

SEQ ID NO: 1774924 - RNA, 14 nt, Salmonella enterica enterica serovar Typhi Ty2
ugguacucaacauc

SEQ ID NO: 1774925 - RNA, 22 nt, Salmonella enterica enterica serovar Typhi Ty2
ugguaucaaaaagcgcagaccc

SEQ ID NO: 1774926 - RNA, 16 nt, Salmonella enterica enterica serovar Typhi Ty2
ugguauaggccaggcu

SEQ ID NO: 1774927 - RNA, 16 nt, Salmonella enterica enterica serovar Typhi Ty2
uggugaguggccuguc

SEQ ID NO: 1774928 - RNA, 17 nt, Salmonella enterica enterica serovar Typhi Ty2
uggugauauaaacgggc

SEQ ID NO: 1774929 - RNA, 18 nt, Salmonella enterica enterica serovar Typhi Ty2
uggugagcuccagcccgc

SEQ ID NO: 1774930 - RNA, 19 nt, Salmonella enterica enterica serovar Typhi Ty2
uggugagguugagauccug

SEQ ID NO: 1774931 - RNA, 21 nt, Salmonella enterica enterica serovar Typhi Ty2
uggugagagcacguaggccug

SEQ ID NO: 1774932 - RNA, 23 nt, Salmonella enterica enterica serovar Typhi Ty2
ugguggauauccagcauaauaug

SEQ ID NO: 1774933 - RNA, 17 nt, Salmonella enterica enterica serovar Typhi Ty2
ugguggcuauagcucag

SEQ ID NO: 1774934 - RNA, 19 nt, Salmonella enterica enterica serovar Typhi Ty2
uggugucaaucgccugcug

SEQ ID NO: 1774935 - RNA, 15 nt, Salmonella enterica enterica serovar Typhi Ty2
ugguguugguacaca

SEQ ID NO: 1774936 - RNA, 15 nt, Salmonella enterica enterica serovar Typhi Ty2
uggugugcauggugu

SEQ ID NO: 1774937 - RNA, 18 nt, Salmonella enterica enterica serovar Typhi Ty2
uggugucucgucgccagg

SEQ ID NO: 1774938 - RNA, 15 nt, Salmonella enterica enterica serovar Typhi Ty2
uggucgagauacugc

SEQ ID NO: 1774939 - RNA, 20 nt, Salmonella enterica enterica serovar Typhi Ty2
uggucaguagcguucuuucc

SEQ ID NO: 1774940 - RNA, 21 nt, Salmonella enterica enterica serovar Typhi Ty2
uggucguuagccagauggcug

SEQ ID NO: 1774941 - RNA, 18 nt, Salmonella enterica enterica serovar Typhi Ty2
uggucuccgccuggaacc

SEQ ID NO: 1774942 - RNA, 16 nt, Salmonella enterica enterica serovar Typhi Ty2
uggucugaaucugcuc

SEQ ID NO: 1774943 - RNA, 20 nt, Salmonella enterica enterica serovar Typhi Ty2
uggugacguuuuuuggcaga

SEQ ID NO: 1774944 - RNA, 21 nt, Salmonella enterica enterica serovar Typhi Ty2
ugggcucaucaaacagcggca

SEQ ID NO: 1774945 - RNA, 16 nt, Salmonella enterica enterica serovar Typhi Ty2
ugggcuaugaagagaa

SEQ ID NO: 1774946 - RNA, 15 nt, Salmonella enterica enterica serovar Typhi Ty2
ugggcugagaaaaau

SEQ ID NO: 1774947 - RNA, 15 nt, Salmonella enterica enterica serovar Typhi Ty2
uggggcaagcucagc

SEQ ID NO: 1774948 - RNA, 15 nt, Salmonella enterica enterica serovar Typhi Ty2
uggggcaagcucuuc

SEQ ID NO: 1774949 - RNA, 20 nt, Salmonella enterica enterica serovar Typhi Ty2
uggguauuuuuuagcgccaa

SEQ ID NO: 1774950 - RNA, 15 nt, Salmonella enterica enterica serovar Typhi Ty2
uggguagaguaaccc

SEQ ID NO: 1774951 - RNA, 18 nt, Salmonella enterica enterica serovar Typhi Ty2
uggguauccacgccuggc

SEQ ID NO: 1774952 - RNA, 17 nt, Salmonella enterica enterica serovar Typhi Ty2
ugggauuugaugcccaa

SEQ ID NO: 1774953 - RNA, 22 nt, Salmonella enterica enterica serovar Typhi Ty2
ugggaucuucaaugaacaauaa

SEQ ID NO: 1774954 - RNA, 14 nt, Salmonella enterica enterica serovar Typhi Ty2
ugggcaaucaucag

SEQ ID NO: 1774955 - RNA, 20 nt, Salmonella enterica enterica serovar Typhi Ty2
ugggcagugcucgccaaaac

SEQ ID NO: 1774956 - RNA, 12 nt, Salmonella enterica enterica serovar Typhi Ty2
uggcggcaaaaa

SEQ ID NO: 1774957 - RNA, 19 nt, Salmonella enterica enterica serovar Typhi Ty2
uggcggaauaucgcggaaa

SEQ ID NO: 1774958 - RNA, 17 nt, Salmonella enterica enterica serovar Typhi Ty2
uggcggagggauuuuaa

SEQ ID NO: 1774959 - RNA, 18 nt, Salmonella enterica enterica serovar Typhi Ty2
ugggauauuacagaucuu

SEQ ID NO: 1774960 - RNA, 14 nt, Salmonella enterica enterica serovar Typhi Ty2
ugggauauuacaga

SEQ ID NO: 1774961 - RNA, 21 nt, Salmonella enterica enterica serovar Typhi Ty2
ugggaaaauuaaucccaaccc

SEQ ID NO: 1774962 - RNA, 22 nt, Salmonella enterica enterica serovar Typhi Ty2
ugggauaggcucuuauucaauc

SEQ ID NO: 1774963 - RNA, 18 nt, Salmonella enterica enterica serovar Typhi Ty2
ucugcgccgcuugugccg

SEQ ID NO: 1774964 - RNA, 16 nt, Salmonella enterica enterica serovar Typhi Ty2
ucugcuguuccuucag

SEQ ID NO: 1774965 - RNA, 15 nt, Salmonella enterica enterica serovar Typhi Ty2
ucuggaucaguuccg

SEQ ID NO: 1774966 - RNA, 18 nt, Salmonella enterica enterica serovar Typhi Ty2
ucuggauagcgguuugca

SEQ ID NO: 1774967 - RNA, 14 nt, Salmonella enterica enterica serovar Typhi Ty2
ucugcuuuucucac

SEQ ID NO: 1774968 - RNA, 23 nt, Salmonella enterica enterica serovar Typhi Ty2
ucugcuuuuugauacagcagcac

SEQ ID NO: 1774969 - RNA, 18 nt, Salmonella enterica enterica serovar Typhi Ty2
ucuggcgacgccaaucgg

SEQ ID NO: 1774970 - RNA, 14 nt, Salmonella enterica enterica serovar Typhi Ty2
ucuggcgagaacac

SEQ ID NO: 1774971 - RNA, 14 nt, Salmonella enterica enterica serovar Typhi Ty2
ucuggccauuucau

SEQ ID NO: 1774972 - RNA, 13 nt, Salmonella enterica enterica serovar Typhi Ty2
ucuggcaauaagg

SEQ ID NO: 1774973 - RNA, 17 nt, Salmonella enterica enterica serovar Typhi Ty2
ucuggccaauuuuucac

SEQ ID NO: 1774974 - RNA, 22 nt, Salmonella enterica enterica serovar Typhi Ty2
ucugguaagacgggugcgccca

SEQ ID NO: 1774975 - RNA, 20 nt, Salmonella enterica enterica serovar Typhi Ty2
ucugguacggccaccaggcc

SEQ ID NO: 1774976 - RNA, 18 nt, Salmonella enterica enterica serovar Typhi Ty2
ucuggguuagcuguaucc

SEQ ID NO: 1774977 - RNA, 14 nt, Salmonella enterica enterica serovar Typhi Ty2
ucuggucaaguauu

SEQ ID NO: 1774978 - RNA, 15 nt, Salmonella enterica enterica serovar Typhi Ty2
ucugguaucgagugg

SEQ ID NO: 1774979 - RNA, 20 nt, Salmonella enterica enterica serovar Typhi Ty2
ucuggucagcgaugacgccu

SEQ ID NO: 1774980 - RNA, 22 nt, Salmonella enterica enterica serovar Typhi Ty2
ucuggucauggcuuagcgccag

SEQ ID NO: 1774981 - RNA, 18 nt, Salmonella enterica enterica serovar Typhi Ty2
ucuguauaaaauauuugg

SEQ ID NO: 1774982 - RNA, 17 nt, Salmonella enterica enterica serovar Typhi Ty2
ucuguaugacaacauaa

SEQ ID NO: 1774983 - RNA, 13 nt, Salmonella enterica enterica serovar Typhi Ty2
ucuguauuuaaua

SEQ ID NO: 1774984 - RNA, 16 nt, Salmonella enterica enterica serovar Typhi Ty2
ucugugagugcgccag

SEQ ID NO: 1774985 - RNA, 18 nt, Salmonella enterica enterica serovar Typhi Ty2
ucugugaaaguuucagga

SEQ ID NO: 1774986 - RNA, 19 nt, Salmonella enterica enterica serovar Typhi Ty2
ucugugaaaguuucaggau

SEQ ID NO: 1774987 - RNA, 16 nt, Salmonella enterica enterica serovar Typhi Ty2
ucugugaaaguuucag

SEQ ID NO: 1774988 - RNA, 15 nt, Salmonella enterica enterica serovar Typhi Ty2
ucugugauuauccca

SEQ ID NO: 1774989 - RNA, 13 nt, Salmonella enterica enterica serovar Typhi Ty2
ucugugaugaugc

SEQ ID NO: 1774990 - RNA, 14 nt, Salmonella enterica enterica serovar Typhi Ty2
ucuuaaaucaugaa

SEQ ID NO: 1774991 - RNA, 23 nt, Salmonella enterica enterica serovar Typhi Ty2
ucuguuuuuggaaacuaugcaaa

SEQ ID NO: 1774992 - RNA, 23 nt, Salmonella enterica enterica serovar Typhi Ty2
ucuguggccgcgcauguuugccu

SEQ ID NO: 1774993 - RNA, 18 nt, Salmonella enterica enterica serovar Typhi Ty2
ucuguucuacuacagaaa

SEQ ID NO: 1774994 - RNA, 21 nt, Salmonella enterica enterica serovar Typhi Ty2
ucuguucuacuacagaaagcc

SEQ ID NO: 1774995 - RNA, 23 nt, Salmonella enterica enterica serovar Typhi Ty2
ucuguucuacuacagaaagccau

SEQ ID NO: 1774996 - RNA, 14 nt, Salmonella enterica enterica serovar Typhi Ty2
ucuguuuguucgca

SEQ ID NO: 1774997 - RNA, 21 nt, Salmonella enterica enterica serovar Typhi Ty2
ucuguuucauggagauccagu

SEQ ID NO: 1774998 - RNA, 21 nt, Salmonella enterica enterica serovar Typhi Ty2
ucuguuucaguucggagauca

SEQ ID NO: 1774999 - RNA, 21 nt, Salmonella enterica enterica serovar Typhi Ty2
ucugcaggcgggugcgcagcc

SEQ ID NO: 1775000 - RNA, 17 nt, Salmonella enterica enterica serovar Typhi Ty2
ucugcaguauuaccgaa

SEQ ID NO: 1775001 - RNA, 12 nt, Salmonella enterica enterica serovar Typhi Ty2
ucugccagguuc

SEQ ID NO: 1775002 - RNA, 17 nt, Salmonella enterica enterica serovar Typhi Ty2
ucugcauguaguaagcc

SEQ ID NO: 1775003 - RNA, 14 nt, Salmonella enterica enterica serovar Typhi Ty2
ucugccuuuuuuaa

SEQ ID NO: 1775004 - RNA, 22 nt, Salmonella enterica enterica serovar Typhi Ty2
ucugccuuuacugaaucucaga

SEQ ID NO: 1775005 - RNA, 15 nt, Salmonella enterica enterica serovar Typhi Ty2
ucugccugcagaccc

SEQ ID NO: 1775006 - RNA, 21 nt, Salmonella enterica enterica serovar Typhi Ty2
ucucgcuauauacccccugca

SEQ ID NO: 1775007 - RNA, 14 nt, Salmonella enterica enterica serovar Typhi Ty2
ucucgcucgcccgc

SEQ ID NO: 1775008 - RNA, 12 nt, Salmonella enterica enterica serovar Typhi Ty2
ucugaaaugcuc

SEQ ID NO: 1775009 - RNA, 16 nt, Salmonella enterica enterica serovar Typhi Ty2
ucucgcgaccagagac

SEQ ID NO: 1775010 - RNA, 17 nt, Salmonella enterica enterica serovar Typhi Ty2
ucucgccaaaccacacc

SEQ ID NO: 1775011 - RNA, 15 nt, Salmonella enterica enterica serovar Typhi Ty2
ucuccuuucggccac

SEQ ID NO: 1775012 - RNA, 15 nt, Salmonella enterica enterica serovar Typhi Ty2
ucugaggauuuuuac

SEQ ID NO: 1775013 - RNA, 19 nt, Salmonella enterica enterica serovar Typhi Ty2
ucugaugccugaaggcgcu

SEQ ID NO: 1775014 - RNA, 19 nt, Salmonella enterica enterica serovar Typhi Ty2
ucugauacugcuccggcgc

SEQ ID NO: 1775015 - RNA, 15 nt, Salmonella enterica enterica serovar Typhi Ty2
ucugauucaguaaga

SEQ ID NO: 1775016 - RNA, 13 nt, Salmonella enterica enterica serovar Typhi Ty2
ucugacccgcgaa

SEQ ID NO: 1775017 - RNA, 11 nt, Salmonella enterica enterica serovar Typhi Ty2
ucugacaucag

SEQ ID NO: 1775018 - RNA, 22 nt, Salmonella enterica enterica serovar Typhi Ty2
ucugaauuuccugcgcuuuuug

SEQ ID NO: 1775019 - RNA, 19 nt, Salmonella enterica enterica serovar Typhi Ty2
ucuucuguaauacgcugua

SEQ ID NO: 1775020 - RNA, 17 nt, Salmonella enterica enterica serovar Typhi Ty2
ucuucuggcguuuuaau

SEQ ID NO: 1775021 - RNA, 21 nt, Salmonella enterica enterica serovar Typhi Ty2
ucuucugauggcuuugcuguc

SEQ ID NO: 1775022 - RNA, 15 nt, Salmonella enterica enterica serovar Typhi Ty2
ucuucucuucuucaa

SEQ ID NO: 1775023 - RNA, 19 nt, Salmonella enterica enterica serovar Typhi Ty2
ucuucuuuagauaauuucg

SEQ ID NO: 1775024 - RNA, 15 nt, Salmonella enterica enterica serovar Typhi Ty2
ucuugauaucaucau

SEQ ID NO: 1775025 - RNA, 16 nt, Salmonella enterica enterica serovar Typhi Ty2
ucuuuagauaauuucg

SEQ ID NO: 1775026 - RNA, 15 nt, Salmonella enterica enterica serovar Typhi Ty2
ucuuuacuaauaccu

SEQ ID NO: 1775027 - RNA, 16 nt, Salmonella enterica enterica serovar Typhi Ty2
ucuuuacgcagcaaga

SEQ ID NO: 1775028 - RNA, 21 nt, Salmonella enterica enterica serovar Typhi Ty2
ucuuuagcgcuaauuccuguc

SEQ ID NO: 1775029 - RNA, 16 nt, Salmonella enterica enterica serovar Typhi Ty2
ucuuuaaauuucaggg

SEQ ID NO: 1775030 - RNA, 21 nt, Salmonella enterica enterica serovar Typhi Ty2
ucuugguuuuaucuguaauua

SEQ ID NO: 1775031 - RNA, 13 nt, Salmonella enterica enterica serovar Typhi Ty2
ucuugccacuggc

SEQ ID NO: 1775032 - RNA, 15 nt, Salmonella enterica enterica serovar Typhi Ty2
ucuugccacuggccu

SEQ ID NO: 1775033 - RNA, 19 nt, Salmonella enterica enterica serovar Typhi Ty2
ucuugcacaauacuuuuug

SEQ ID NO: 1775034 - RNA, 23 nt, Salmonella enterica enterica serovar Typhi Ty2
ucuugcaacccauauucgucuuc

SEQ ID NO: 1775035 - RNA, 23 nt, Salmonella enterica enterica serovar Typhi Ty2
ucuucucaggcgagcccugugcg

SEQ ID NO: 1775036 - RNA, 13 nt, Salmonella enterica enterica serovar Typhi Ty2
ucuucuaccaccu

SEQ ID NO: 1775037 - RNA, 15 nt, Salmonella enterica enterica serovar Typhi Ty2
ucuucuaaaucauac

SEQ ID NO: 1775038 - RNA, 16 nt, Salmonella enterica enterica serovar Typhi Ty2
ucuucuaccaccuuau

SEQ ID NO: 1775039 - RNA, 22 nt, Salmonella enterica enterica serovar Typhi Ty2
ucuucggcgggaucuccagaag

SEQ ID NO: 1775040 - RNA, 23 nt, Salmonella enterica enterica serovar Typhi Ty2
ucuucggcgcgccgcuggcgaug

SEQ ID NO: 1775041 - RNA, 20 nt, Salmonella enterica enterica serovar Typhi Ty2
ucuucgggaucaauuuugcu

SEQ ID NO: 1775042 - RNA, 21 nt, Salmonella enterica enterica serovar Typhi Ty2
ucuucgggaucaauuuugcuc

SEQ ID NO: 1775043 - RNA, 20 nt, Salmonella enterica enterica serovar Typhi Ty2
ucuucgugacccgccagcau

SEQ ID NO: 1775044 - RNA, 18 nt, Salmonella enterica enterica serovar Typhi Ty2
ucuucgccgucauaaaac

SEQ ID NO: 1775045 - RNA, 22 nt, Salmonella enterica enterica serovar Typhi Ty2
ucuucgccgaagugugccagca

SEQ ID NO: 1775046 - RNA, 17 nt, Salmonella enterica enterica serovar Typhi Ty2
ucuucgcaguagauucu

SEQ ID NO: 1775047 - RNA, 21 nt, Salmonella enterica enterica serovar Typhi Ty2
ucuucgcccauugccacccau

SEQ ID NO: 1775048 - RNA, 14 nt, Salmonella enterica enterica serovar Typhi Ty2
ucuucgccauuaca

SEQ ID NO: 1775049 - RNA, 22 nt, Salmonella enterica enterica serovar Typhi Ty2
ucuucgcuggcggaaagaagca

SEQ ID NO: 1775050 - RNA, 16 nt, Salmonella enterica enterica serovar Typhi Ty2
ucuucggcaaaauauu

SEQ ID NO: 1775051 - RNA, 20 nt, Salmonella enterica enterica serovar Typhi Ty2
ucuucgacauauuuacgugc

SEQ ID NO: 1775052 - RNA, 18 nt, Salmonella enterica enterica serovar Typhi Ty2
ucuucgacacauuucagc

SEQ ID NO: 1775053 - RNA, 14 nt, Salmonella enterica enterica serovar Typhi Ty2
ucuucgauaaaggg

SEQ ID NO: 1775054 - RNA, 16 nt, Salmonella enterica enterica serovar Typhi Ty2
ucuucaguaauuucga

SEQ ID NO: 1775055 - RNA, 14 nt, Salmonella enterica enterica serovar Typhi Ty2
ucuucaguaaccag

SEQ ID NO: 1775056 - RNA, 22 nt, Salmonella enterica enterica serovar Typhi Ty2
ucuucaguaauuucgaugauga

SEQ ID NO: 1775057 - RNA, 16 nt, Salmonella enterica enterica serovar Typhi Ty2
ucuuacacuuagcaca

SEQ ID NO: 1775058 - RNA, 17 nt, Salmonella enterica enterica serovar Typhi Ty2
ucuuacacuuagcacaa

SEQ ID NO: 1775059 - RNA, 12 nt, Salmonella enterica enterica serovar Typhi Ty2
ucuuacauaaga

SEQ ID NO: 1775060 - RNA, 15 nt, Salmonella enterica enterica serovar Typhi Ty2
ucuucaggcguauau

SEQ ID NO: 1775061 - RNA, 19 nt, Salmonella enterica enterica serovar Typhi Ty2
ucuuaauuccucagaaucc

SEQ ID NO: 1775062 - RNA, 18 nt, Salmonella enterica enterica serovar Typhi Ty2
ucuuccgccugauaaaac

SEQ ID NO: 1775063 - RNA, 23 nt, Salmonella enterica enterica serovar Typhi Ty2
ucuuccgccauacccggcuccca

SEQ ID NO: 1775064 - RNA, 12 nt, Salmonella enterica enterica serovar Typhi Ty2
ucuuccggcguc

SEQ ID NO: 1775065 - RNA, 16 nt, Salmonella enterica enterica serovar Typhi Ty2
ucuuccgggucaguuu

SEQ ID NO: 1775066 - RNA, 18 nt, Salmonella enterica enterica serovar Typhi Ty2
ucuuccgucagcgaaucg

SEQ ID NO: 1775067 - RNA, 21 nt, Salmonella enterica enterica serovar Typhi Ty2
ucuuccggugugaccagcgcg

SEQ ID NO: 1775068 - RNA, 15 nt, Salmonella enterica enterica serovar Typhi Ty2
ucuuccucacagccu

SEQ ID NO: 1775069 - RNA, 15 nt, Salmonella enterica enterica serovar Typhi Ty2
ucuuccucugugccg

SEQ ID NO: 1775070 - RNA, 20 nt, Salmonella enterica enterica serovar Typhi Ty2
ucgucugguaucugucaugc

SEQ ID NO: 1775071 - RNA, 14 nt, Salmonella enterica enterica serovar Typhi Ty2
ucgucuuauuucgu

SEQ ID NO: 1775072 - RNA, 23 nt, Salmonella enterica enterica serovar Typhi Ty2
ucgucuuguguggagguuucuuc

SEQ ID NO: 1775073 - RNA, 18 nt, Salmonella enterica enterica serovar Typhi Ty2
ucgugcaaccgccugcac

SEQ ID NO: 1775074 - RNA, 12 nt, Salmonella enterica enterica serovar Typhi Ty2
ucguccugcaau

SEQ ID NO: 1775075 - RNA, 19 nt, Salmonella enterica enterica serovar Typhi Ty2
ucgucauuaacgggaaacu

SEQ ID NO: 1775076 - RNA, 21 nt, Salmonella enterica enterica serovar Typhi Ty2
ucgugugcgguauagaucaga

SEQ ID NO: 1775077 - RNA, 18 nt, Salmonella enterica enterica serovar Typhi Ty2
ucgugguuagacaucacg

SEQ ID NO: 1775078 - RNA, 19 nt, Salmonella enterica enterica serovar Typhi Ty2
ucguggcgcuguucuugcu

SEQ ID NO: 1775079 - RNA, 20 nt, Salmonella enterica enterica serovar Typhi Ty2
ucgugcaggauucgaaccug

SEQ ID NO: 1775080 - RNA, 20 nt, Salmonella enterica enterica serovar Typhi Ty2
ucgucauaaauacacgaggc

SEQ ID NO: 1775081 - RNA, 22 nt, Salmonella enterica enterica serovar Typhi Ty2
ucgucacaauaugguuauccag

SEQ ID NO: 1775082 - RNA, 16 nt, Salmonella enterica enterica serovar Typhi Ty2
ucguagccaccaucuu

SEQ ID NO: 1775083 - RNA, 18 nt, Salmonella enterica enterica serovar Typhi Ty2
ucguagccaccaucuuuu

SEQ ID NO: 1775084 - RNA, 16 nt, Salmonella enterica enterica serovar Typhi Ty2
ucgguuuauccccgcu

SEQ ID NO: 1775085 - RNA, 20 nt, Salmonella enterica enterica serovar Typhi Ty2
ucggcauagcgggagauuga

SEQ ID NO: 1775086 - RNA, 18 nt, Salmonella enterica enterica serovar Typhi Ty2
ucggccaaccgccacaau

SEQ ID NO: 1775087 - RNA, 12 nt, Salmonella enterica enterica serovar Typhi Ty2
ucgguugaacca

SEQ ID NO: 1775088 - RNA, 23 nt, Salmonella enterica enterica serovar Typhi Ty2
ucggcauacaccgccagcgucug

SEQ ID NO: 1775089 - RNA, 16 nt, Salmonella enterica enterica serovar Typhi Ty2
ucggcagucacuuuca

SEQ ID NO: 1775090 - RNA, 12 nt, Salmonella enterica enterica serovar Typhi Ty2
ucggcagcgcga

SEQ ID NO: 1775091 - RNA, 17 nt, Salmonella enterica enterica serovar Typhi Ty2
ucggcagcuuccagcaa

SEQ ID NO: 1775092 - RNA, 17 nt, Salmonella enterica enterica serovar Typhi Ty2
ucggcaugcaucucuuc

SEQ ID NO: 1775093 - RNA, 13 nt, Salmonella enterica enterica serovar Typhi Ty2
ucggcauaucgcc

SEQ ID NO: 1775094 - RNA, 22 nt, Salmonella enterica enterica serovar Typhi Ty2
ucggcaugauggcgaacagccc

SEQ ID NO: 1775095 - RNA, 13 nt, Salmonella enterica enterica serovar Typhi Ty2
ucguuuuccgcaa

SEQ ID NO: 1775096 - RNA, 12 nt, Salmonella enterica enterica serovar Typhi Ty2
ucguugcgccug

SEQ ID NO: 1775097 - RNA, 23 nt, Salmonella enterica enterica serovar Typhi Ty2
ucuaaaauuauuuuuacuuaaaa

SEQ ID NO: 1775098 - RNA, 23 nt, Salmonella enterica enterica serovar Typhi Ty2
ucuaaagagacagaaucaggcca

SEQ ID NO: 1775099 - RNA, 21 nt, Salmonella enterica enterica serovar Typhi Ty2
ucuaauugacggccaccauga

SEQ ID NO: 1775100 - RNA, 23 nt, Salmonella enterica enterica serovar Typhi Ty2
ucuaauucccaguaaccuauuuu

SEQ ID NO: 1775101 - RNA, 15 nt, Salmonella enterica enterica serovar Typhi Ty2
ucuaaucgggagcag

SEQ ID NO: 1775102 - RNA, 14 nt, Salmonella enterica enterica serovar Typhi Ty2
ucuacgguaucugc

SEQ ID NO: 1775103 - RNA, 15 nt, Salmonella enterica enterica serovar Typhi Ty2
ucuacgcgccagcag

SEQ ID NO: 1775104 - RNA, 19 nt, Salmonella enterica enterica serovar Typhi Ty2
ucuaccgcuucgcgcgcca

SEQ ID NO: 1775105 - RNA, 14 nt, Salmonella enterica enterica serovar Typhi Ty2
ucuacuuuccugaa

SEQ ID NO: 1775106 - RNA, 22 nt, Salmonella enterica enterica serovar Typhi Ty2
ucuacuuuucggguguccacuc

SEQ ID NO: 1775107 - RNA, 15 nt, Salmonella enterica enterica serovar Typhi Ty2
ucuacuguuauugac

SEQ ID NO: 1775108 - RNA, 19 nt, Salmonella enterica enterica serovar Typhi Ty2
ucuagaugaugauuuauga

SEQ ID NO: 1775109 - RNA, 13 nt, Salmonella enterica enterica serovar Typhi Ty2
ucuagucgccggu

SEQ ID NO: 1775110 - RNA, 13 nt, Salmonella enterica enterica serovar Typhi Ty2
ucuauauauucuu

SEQ ID NO: 1775111 - RNA, 14 nt, Salmonella enterica enterica serovar Typhi Ty2
ucuauagauuucgc

SEQ ID NO: 1775112 - RNA, 15 nt, Salmonella enterica enterica serovar Typhi Ty2
ucuauacggcgcgca

SEQ ID NO: 1775113 - RNA, 16 nt, Salmonella enterica enterica serovar Typhi Ty2
ucuaucggcaaaccau

SEQ ID NO: 1775114 - RNA, 22 nt, Salmonella enterica enterica serovar Typhi Ty2
ucuauccagacguuggauaaca

SEQ ID NO: 1775115 - RNA, 21 nt, Salmonella enterica enterica serovar Typhi Ty2
ucuauccacuggguaaggcgc

SEQ ID NO: 1775116 - RNA, 22 nt, Salmonella enterica enterica serovar Typhi Ty2
ucuaucacuucaauguuagcau

SEQ ID NO: 1775117 - RNA, 13 nt, Salmonella enterica enterica serovar Typhi Ty2
ucuaugcaaaaga

SEQ ID NO: 1775118 - RNA, 14 nt, Salmonella enterica enterica serovar Typhi Ty2
ucuaugcgcuaugu

SEQ ID NO: 1775119 - RNA, 13 nt, Salmonella enterica enterica serovar Typhi Ty2
ucuaucuuuucaa

SEQ ID NO: 1775120 - RNA, 17 nt, Salmonella enterica enterica serovar Typhi Ty2
ucuaugaaugccggaug

SEQ ID NO: 1775121 - RNA, 19 nt, Salmonella enterica enterica serovar Typhi Ty2
ucuaucuguuuuaauuccu

SEQ ID NO: 1775122 - RNA, 18 nt, Salmonella enterica enterica serovar Typhi Ty2
ucuauucguucucugaau

SEQ ID NO: 1775123 - RNA, 11 nt, Salmonella enterica enterica serovar Typhi Ty2
ucuauuauuga

SEQ ID NO: 1775124 - RNA, 14 nt, Salmonella enterica enterica serovar Typhi Ty2
ucucaaaaaauauc

SEQ ID NO: 1775125 - RNA, 16 nt, Salmonella enterica enterica serovar Typhi Ty2
ucuauuuauugaagau

SEQ ID NO: 1775126 - RNA, 13 nt, Salmonella enterica enterica serovar Typhi Ty2
ucuauugauuggc

SEQ ID NO: 1775127 - RNA, 23 nt, Salmonella enterica enterica serovar Typhi Ty2
ucuauugauuggcaagaauuauu

SEQ ID NO: 1775128 - RNA, 13 nt, Salmonella enterica enterica serovar Typhi Ty2
ucucacacauugg

SEQ ID NO: 1775129 - RNA, 13 nt, Salmonella enterica enterica serovar Typhi Ty2
ucucaaugaacag

SEQ ID NO: 1775130 - RNA, 19 nt, Salmonella enterica enterica serovar Typhi Ty2
ucucaauaucguugccgcc

SEQ ID NO: 1775131 - RNA, 19 nt, Salmonella enterica enterica serovar Typhi Ty2
ucucaaggucugucaggac

SEQ ID NO: 1775132 - RNA, 20 nt, Salmonella enterica enterica serovar Typhi Ty2
ucucagauggaaaaaaagaa

SEQ ID NO: 1775133 - RNA, 16 nt, Salmonella enterica enterica serovar Typhi Ty2
ucucaccgaccugccu

SEQ ID NO: 1775134 - RNA, 22 nt, Salmonella enterica enterica serovar Typhi Ty2
ucucaccgccuaggccagugcc

SEQ ID NO: 1775135 - RNA, 13 nt, Salmonella enterica enterica serovar Typhi Ty2
ucucaccguggca

SEQ ID NO: 1775136 - RNA, 18 nt, Salmonella enterica enterica serovar Typhi Ty2
ucuccgucucucauuuuc

SEQ ID NO: 1775137 - RNA, 20 nt, Salmonella enterica enterica serovar Typhi Ty2
ucuccgucucucauuuucuu

SEQ ID NO: 1775138 - RNA, 15 nt, Salmonella enterica enterica serovar Typhi Ty2
ucuccguuguugcac

SEQ ID NO: 1775139 - RNA, 22 nt, Salmonella enterica enterica serovar Typhi Ty2
ucuccucacgcccugaagggcg

SEQ ID NO: 1775140 - RNA, 18 nt, Salmonella enterica enterica serovar Typhi Ty2
ucuccuugagugguuuau

SEQ ID NO: 1775141 - RNA, 12 nt, Salmonella enterica enterica serovar Typhi Ty2
ucucccagcuga

SEQ ID NO: 1775142 - RNA, 17 nt, Salmonella enterica enterica serovar Typhi Ty2
ucucccaaaugaaaaau

SEQ ID NO: 1775143 - RNA, 15 nt, Salmonella enterica enterica serovar Typhi Ty2
ucucccagcugagcu

SEQ ID NO: 1775144 - RNA, 22 nt, Salmonella enterica enterica serovar Typhi Ty2
ucuccccaucugaacucuucca

SEQ ID NO: 1775145 - RNA, 22 nt, Salmonella enterica enterica serovar Typhi Ty2
ucuccaugucacuggcggcggu

SEQ ID NO: 1775146 - RNA, 20 nt, Salmonella enterica enterica serovar Typhi Ty2
ucucccagccgggcaggaaa

SEQ ID NO: 1775147 - RNA, 19 nt, Salmonella enterica enterica serovar Typhi Ty2
ucucauaaaacauuccuga

SEQ ID NO: 1775148 - RNA, 18 nt, Salmonella enterica enterica serovar Typhi Ty2
ucucauaaacgccuggag

SEQ ID NO: 1775149 - RNA, 22 nt, Salmonella enterica enterica serovar Typhi Ty2
ucucauaaaccgccgcuuugau

SEQ ID NO: 1775150 - RNA, 23 nt, Salmonella enterica enterica serovar Typhi Ty2
ucucaggguguuuuuauacaucc

SEQ ID NO: 1775151 - RNA, 14 nt, Salmonella enterica enterica serovar Typhi Ty2
ucucaggagugaac

SEQ ID NO: 1775152 - RNA, 16 nt, Salmonella enterica enterica serovar Typhi Ty2
ucucagcgucggugaa

SEQ ID NO: 1775153 - RNA, 17 nt, Salmonella enterica enterica serovar Typhi Ty2
ucucaucagaccgugaa

SEQ ID NO: 1775154 - RNA, 13 nt, Salmonella enterica enterica serovar Typhi Ty2
ucucaucagacug

SEQ ID NO: 1775155 - RNA, 16 nt, Salmonella enterica enterica serovar Typhi Ty2
ucucauccgccaaaac

SEQ ID NO: 1775156 - RNA, 13 nt, Salmonella enterica enterica serovar Typhi Ty2
uccgcucaugauu

SEQ ID NO: 1775157 - RNA, 15 nt, Salmonella enterica enterica serovar Typhi Ty2
uccgcuccacauccu

SEQ ID NO: 1775158 - RNA, 16 nt, Salmonella enterica enterica serovar Typhi Ty2
uccgcuccacauccug

SEQ ID NO: 1775159 - RNA, 14 nt, Salmonella enterica enterica serovar Typhi Ty2
uccgcuagggcauc

SEQ ID NO: 1775160 - RNA, 17 nt, Salmonella enterica enterica serovar Typhi Ty2
uccgcuagggcaucaga

SEQ ID NO: 1775161 - RNA, 23 nt, Salmonella enterica enterica serovar Typhi Ty2
uccgcuggcguccagcccgucca

SEQ ID NO: 1775162 - RNA, 18 nt, Salmonella enterica enterica serovar Typhi Ty2
uccgcuggcguccagccc

SEQ ID NO: 1775163 - RNA, 20 nt, Salmonella enterica enterica serovar Typhi Ty2
uccggaaucagugcugaaaa

SEQ ID NO: 1775164 - RNA, 18 nt, Salmonella enterica enterica serovar Typhi Ty2
uccgcuuucuucccggca

SEQ ID NO: 1775165 - RNA, 16 nt, Salmonella enterica enterica serovar Typhi Ty2
uccgcuuuucuggcuu

SEQ ID NO: 1775166 - RNA, 20 nt, Salmonella enterica enterica serovar Typhi Ty2
uccgcuuuuuuauuguuucu

SEQ ID NO: 1775167 - RNA, 15 nt, Salmonella enterica enterica serovar Typhi Ty2
uccgcgcugaugguu

SEQ ID NO: 1775168 - RNA, 14 nt, Salmonella enterica enterica serovar Typhi Ty2
uccgcggcaaaccc

SEQ ID NO: 1775169 - RNA, 18 nt, Salmonella enterica enterica serovar Typhi Ty2
uccgcgccgccgccgaag

SEQ ID NO: 1775170 - RNA, 12 nt, Salmonella enterica enterica serovar Typhi Ty2
uccgcgccgccg

SEQ ID NO: 1775171 - RNA, 15 nt, Salmonella enterica enterica serovar Typhi Ty2
uccgcgccgccgccg

SEQ ID NO: 1775172 - RNA, 17 nt, Salmonella enterica enterica serovar Typhi Ty2
uccgcgccgagugcuug

SEQ ID NO: 1775173 - RNA, 21 nt, Salmonella enterica enterica serovar Typhi Ty2
uccgcgacguacuggaacagu

SEQ ID NO: 1775174 - RNA, 23 nt, Salmonella enterica enterica serovar Typhi Ty2
uccgcgagagaaaaaaauccagu

SEQ ID NO: 1775175 - RNA, 14 nt, Salmonella enterica enterica serovar Typhi Ty2
uccgcgagcagcca

SEQ ID NO: 1775176 - RNA, 13 nt, Salmonella enterica enterica serovar Typhi Ty2
uccgcgaugugua

SEQ ID NO: 1775177 - RNA, 17 nt, Salmonella enterica enterica serovar Typhi Ty2
uccgccugaucuuucug

SEQ ID NO: 1775178 - RNA, 14 nt, Salmonella enterica enterica serovar Typhi Ty2
uccgccucguguaa

SEQ ID NO: 1775179 - RNA, 20 nt, Salmonella enterica enterica serovar Typhi Ty2
uccgccuggaacccaggcac

SEQ ID NO: 1775180 - RNA, 22 nt, Salmonella enterica enterica serovar Typhi Ty2
uccgccuggaacccaggcaccu

SEQ ID NO: 1775181 - RNA, 11 nt, Salmonella enterica enterica serovar Typhi Ty2
uccgccugcug

SEQ ID NO: 1775182 - RNA, 16 nt, Salmonella enterica enterica serovar Typhi Ty2
uccgccugcugugccg

SEQ ID NO: 1775183 - RNA, 19 nt, Salmonella enterica enterica serovar Typhi Ty2
uccgccuuaucaggccugu

SEQ ID NO: 1775184 - RNA, 16 nt, Salmonella enterica enterica serovar Typhi Ty2
uccgccagcaacacuu

SEQ ID NO: 1775185 - RNA, 18 nt, Salmonella enterica enterica serovar Typhi Ty2
uccgccagcaaugccgcc

SEQ ID NO: 1775186 - RNA, 19 nt, Salmonella enterica enterica serovar Typhi Ty2
uccgccagauacaaaucuc

SEQ ID NO: 1775187 - RNA, 19 nt, Salmonella enterica enterica serovar Typhi Ty2
uccgccagacucagccagg

SEQ ID NO: 1775188 - RNA, 15 nt, Salmonella enterica enterica serovar Typhi Ty2
uccgccagcaacacu

SEQ ID NO: 1775189 - RNA, 16 nt, Salmonella enterica enterica serovar Typhi Ty2
uccgccaggcccauga

SEQ ID NO: 1775190 - RNA, 14 nt, Salmonella enterica enterica serovar Typhi Ty2
uccgccauaucccc

SEQ ID NO: 1775191 - RNA, 14 nt, Salmonella enterica enterica serovar Typhi Ty2
uccgcccaggcggg

SEQ ID NO: 1775192 - RNA, 18 nt, Salmonella enterica enterica serovar Typhi Ty2
uccgcccaagaacaugac

SEQ ID NO: 1775193 - RNA, 11 nt, Salmonella enterica enterica serovar Typhi Ty2
uccgcaauaag

SEQ ID NO: 1775194 - RNA, 16 nt, Salmonella enterica enterica serovar Typhi Ty2
uccgcaauaagugcau

SEQ ID NO: 1775195 - RNA, 16 nt, Salmonella enterica enterica serovar Typhi Ty2
uccgcacgcgcgcccu

SEQ ID NO: 1775196 - RNA, 15 nt, Salmonella enterica enterica serovar Typhi Ty2
uccgcagauccagca

SEQ ID NO: 1775197 - RNA, 21 nt, Salmonella enterica enterica serovar Typhi Ty2
uccgcacgccugcauaaagga

SEQ ID NO: 1775198 - RNA, 12 nt, Salmonella enterica enterica serovar Typhi Ty2
uccgcaggcaac

SEQ ID NO: 1775199 - RNA, 21 nt, Salmonella enterica enterica serovar Typhi Ty2
uccgcaggcgacgugacggug

SEQ ID NO: 1775200 - RNA, 14 nt, Salmonella enterica enterica serovar Typhi Ty2
uccgccaacagccg

SEQ ID NO: 1775201 - RNA, 12 nt, Salmonella enterica enterica serovar Typhi Ty2
uccgccacggcu

SEQ ID NO: 1775202 - RNA, 18 nt, Salmonella enterica enterica serovar Typhi Ty2
uccgccacggcuuucacg

SEQ ID NO: 1775203 - RNA, 18 nt, Salmonella enterica enterica serovar Typhi Ty2
uccggugaagguaauuuu

SEQ ID NO: 1775204 - RNA, 22 nt, Salmonella enterica enterica serovar Typhi Ty2
uccgguagguuuaaaccacucc

SEQ ID NO: 1775205 - RNA, 17 nt, Salmonella enterica enterica serovar Typhi Ty2
uccgguacaccaacuac

SEQ ID NO: 1775206 - RNA, 16 nt, Salmonella enterica enterica serovar Typhi Ty2
uccggugcgcaggccg

SEQ ID NO: 1775207 - RNA, 16 nt, Salmonella enterica enterica serovar Typhi Ty2
uccgguugaccgcaua

SEQ ID NO: 1775208 - RNA, 14 nt, Salmonella enterica enterica serovar Typhi Ty2
uccgguuccagcgg

SEQ ID NO: 1775209 - RNA, 16 nt, Salmonella enterica enterica serovar Typhi Ty2
uccguauugcaaugcg

SEQ ID NO: 1775210 - RNA, 19 nt, Salmonella enterica enterica serovar Typhi Ty2
uccguauucggaauaaugu

SEQ ID NO: 1775211 - RNA, 23 nt, Salmonella enterica enterica serovar Typhi Ty2
uccgucagcgucacguuauacca

SEQ ID NO: 1775212 - RNA, 22 nt, Salmonella enterica enterica serovar Typhi Ty2
uccgucauguagcaaauuucau

SEQ ID NO: 1775213 - RNA, 12 nt, Salmonella enterica enterica serovar Typhi Ty2
uccgguuucaac

SEQ ID NO: 1775214 - RNA, 13 nt, Salmonella enterica enterica serovar Typhi Ty2
uccggguaauuuu

SEQ ID NO: 1775215 - RNA, 13 nt, Salmonella enterica enterica serovar Typhi Ty2
uccgguacaccaa

SEQ ID NO: 1775216 - RNA, 18 nt, Salmonella enterica enterica serovar Typhi Ty2
uccgguaaacgagcgcaa

SEQ ID NO: 1775217 - RNA, 20 nt, Salmonella enterica enterica serovar Typhi Ty2
uccgggaaggacgccaccgg

SEQ ID NO: 1775218 - RNA, 16 nt, Salmonella enterica enterica serovar Typhi Ty2
uccgggauagcacuac

SEQ ID NO: 1775219 - RNA, 16 nt, Salmonella enterica enterica serovar Typhi Ty2
uccgggauauaaaauu

SEQ ID NO: 1775220 - RNA, 22 nt, Salmonella enterica enterica serovar Typhi Ty2
uccggccuacggucgguuucau

SEQ ID NO: 1775221 - RNA, 16 nt, Salmonella enterica enterica serovar Typhi Ty2
uccggccugcaggcaa

SEQ ID NO: 1775222 - RNA, 17 nt, Salmonella enterica enterica serovar Typhi Ty2
uccggccuguaaggucu

SEQ ID NO: 1775223 - RNA, 13 nt, Salmonella enterica enterica serovar Typhi Ty2
uccggccugcaug

SEQ ID NO: 1775224 - RNA, 19 nt, Salmonella enterica enterica serovar Typhi Ty2
uccggccagcgccagcguu

SEQ ID NO: 1775225 - RNA, 15 nt, Salmonella enterica enterica serovar Typhi Ty2
uccggccagcgccag

SEQ ID NO: 1775226 - RNA, 12 nt, Salmonella enterica enterica serovar Typhi Ty2
uccggccagcgc

SEQ ID NO: 1775227 - RNA, 23 nt, Salmonella enterica enterica serovar Typhi Ty2
uccggcccggagguaaauuaacg

SEQ ID NO: 1775228 - RNA, 18 nt, Salmonella enterica enterica serovar Typhi Ty2
uccggcuacgguuuuaau

SEQ ID NO: 1775229 - RNA, 18 nt, Salmonella enterica enterica serovar Typhi Ty2
uccggcugcaccagcguu

SEQ ID NO: 1775230 - RNA, 17 nt, Salmonella enterica enterica serovar Typhi Ty2
uccggcggucagccagc

SEQ ID NO: 1775231 - RNA, 15 nt, Salmonella enterica enterica serovar Typhi Ty2
uccggcggugaagca

SEQ ID NO: 1775232 - RNA, 14 nt, Salmonella enterica enterica serovar Typhi Ty2
uccggcgugacuca

SEQ ID NO: 1775233 - RNA, 23 nt, Salmonella enterica enterica serovar Typhi Ty2
uccggcgucuggguuugcagcag

SEQ ID NO: 1775234 - RNA, 19 nt, Salmonella enterica enterica serovar Typhi Ty2
uccggcgggagcucuacca

SEQ ID NO: 1775235 - RNA, 21 nt, Salmonella enterica enterica serovar Typhi Ty2
uccggcgcugaugacgcgccg

SEQ ID NO: 1775236 - RNA, 16 nt, Salmonella enterica enterica serovar Typhi Ty2
uccggacgcaccagcc

SEQ ID NO: 1775237 - RNA, 14 nt, Salmonella enterica enterica serovar Typhi Ty2
uccggagccugugu

SEQ ID NO: 1775238 - RNA, 17 nt, Salmonella enterica enterica serovar Typhi Ty2
uccggcacacagcgcuu

SEQ ID NO: 1775239 - RNA, 13 nt, Salmonella enterica enterica serovar Typhi Ty2
uccggcacacagc

SEQ ID NO: 1775240 - RNA, 21 nt, Salmonella enterica enterica serovar Typhi Ty2
uccggcaacggguuagacuca

SEQ ID NO: 1775241 - RNA, 19 nt, Salmonella enterica enterica serovar Typhi Ty2
uccggcaaacucagcggcu

SEQ ID NO: 1775242 - RNA, 18 nt, Salmonella enterica enterica serovar Typhi Ty2
uccggcaucucaaggucu

SEQ ID NO: 1775243 - RNA, 16 nt, Salmonella enterica enterica serovar Typhi Ty2
uccggcauccagcgcu

SEQ ID NO: 1775244 - RNA, 19 nt, Salmonella enterica enterica serovar Typhi Ty2
uccggcauaaaaagccucu

SEQ ID NO: 1775245 - RNA, 18 nt, Salmonella enterica enterica serovar Typhi Ty2
uccggcacgauaaauugc

SEQ ID NO: 1775246 - RNA, 14 nt, Salmonella enterica enterica serovar Typhi Ty2
uccggcagaaauga

SEQ ID NO: 1775247 - RNA, 12 nt, Salmonella enterica enterica serovar Typhi Ty2
uccggcaggcaa

SEQ ID NO: 1775248 - RNA, 13 nt, Salmonella enterica enterica serovar Typhi Ty2
uccguccagaccg

SEQ ID NO: 1775249 - RNA, 20 nt, Salmonella enterica enterica serovar Typhi Ty2
uccgucguuaaucagcgcgg

SEQ ID NO: 1775250 - RNA, 15 nt, Salmonella enterica enterica serovar Typhi Ty2
uccgucguguagccu

SEQ ID NO: 1775251 - RNA, 16 nt, Salmonella enterica enterica serovar Typhi Ty2
uccgucuccggacguu

SEQ ID NO: 1775252 - RNA, 19 nt, Salmonella enterica enterica serovar Typhi Ty2
uccgucggcuggaagccuu

SEQ ID NO: 1775253 - RNA, 13 nt, Salmonella enterica enterica serovar Typhi Ty2
uccgugaccugcu

SEQ ID NO: 1775254 - RNA, 21 nt, Salmonella enterica enterica serovar Typhi Ty2
uccgugaaugccaagcgcaua

SEQ ID NO: 1775255 - RNA, 13 nt, Salmonella enterica enterica serovar Typhi Ty2
uccguuauuucac

SEQ ID NO: 1775256 - RNA, 18 nt, Salmonella enterica enterica serovar Typhi Ty2
uccguuuguaacauauuu

SEQ ID NO: 1775257 - RNA, 16 nt, Salmonella enterica enterica serovar Typhi Ty2
uccguucccaaugcuu

SEQ ID NO: 1775258 - RNA, 18 nt, Salmonella enterica enterica serovar Typhi Ty2
uccguucaucggcauaca

SEQ ID NO: 1775259 - RNA, 23 nt, Salmonella enterica enterica serovar Typhi Ty2
uccuaccacgccgcuacugccgc

SEQ ID NO: 1775260 - RNA, 19 nt, Salmonella enterica enterica serovar Typhi Ty2
uccuccggcguaaaggcuu

SEQ ID NO: 1775261 - RNA, 23 nt, Salmonella enterica enterica serovar Typhi Ty2
uccuccggcguaaaggcuuguuu

SEQ ID NO: 1775262 - RNA, 22 nt, Salmonella enterica enterica serovar Typhi Ty2
uccuccggcgacugaaugccuu

SEQ ID NO: 1775263 - RNA, 15 nt, Salmonella enterica enterica serovar Typhi Ty2
uccuccucauucagc

SEQ ID NO: 1775264 - RNA, 16 nt, Salmonella enterica enterica serovar Typhi Ty2
uccuccgguuucaacu

SEQ ID NO: 1775265 - RNA, 16 nt, Salmonella enterica enterica serovar Typhi Ty2
uccuccaacgugcaga

SEQ ID NO: 1775266 - RNA, 16 nt, Salmonella enterica enterica serovar Typhi Ty2
uccucauucagcggcu

SEQ ID NO: 1775267 - RNA, 20 nt, Salmonella enterica enterica serovar Typhi Ty2
uccucagcgaauaucucuau

SEQ ID NO: 1775268 - RNA, 17 nt, Salmonella enterica enterica serovar Typhi Ty2
uccucagaauccgucag

SEQ ID NO: 1775269 - RNA, 12 nt, Salmonella enterica enterica serovar Typhi Ty2
uccucacgcccu

SEQ ID NO: 1775270 - RNA, 16 nt, Salmonella enterica enterica serovar Typhi Ty2
uccucaacucguuccc

SEQ ID NO: 1775271 - RNA, 20 nt, Salmonella enterica enterica serovar Typhi Ty2
uccucgcggguggccugcag

SEQ ID NO: 1775272 - RNA, 15 nt, Salmonella enterica enterica serovar Typhi Ty2
uccucuauccagacg

SEQ ID NO: 1775273 - RNA, 19 nt, Salmonella enterica enterica serovar Typhi Ty2
uccucgucgcgcgccgccu

SEQ ID NO: 1775274 - RNA, 21 nt, Salmonella enterica enterica serovar Typhi Ty2
uccugaccaugccacaacaga

SEQ ID NO: 1775275 - RNA, 12 nt, Salmonella enterica enterica serovar Typhi Ty2
uccugacgcuga

SEQ ID NO: 1775276 - RNA, 18 nt, Salmonella enterica enterica serovar Typhi Ty2
uccugaauugcaaggcga

SEQ ID NO: 1775277 - RNA, 14 nt, Salmonella enterica enterica serovar Typhi Ty2
uccugaaccagcgg

SEQ ID NO: 1775278 - RNA, 22 nt, Salmonella enterica enterica serovar Typhi Ty2
uccugaagaugggucagugcau

SEQ ID NO: 1775279 - RNA, 19 nt, Salmonella enterica enterica serovar Typhi Ty2
uccugaaggacaagcugcg

SEQ ID NO: 1775280 - RNA, 16 nt, Salmonella enterica enterica serovar Typhi Ty2
uccugaaaaaauuccc

SEQ ID NO: 1775281 - RNA, 13 nt, Salmonella enterica enterica serovar Typhi Ty2
uccucuuucccuu

SEQ ID NO: 1775282 - RNA, 19 nt, Salmonella enterica enterica serovar Typhi Ty2
uccucuuccgacaaaccuu

SEQ ID NO: 1775283 - RNA, 19 nt, Salmonella enterica enterica serovar Typhi Ty2
uccuggcgccacccaacau

SEQ ID NO: 1775284 - RNA, 16 nt, Salmonella enterica enterica serovar Typhi Ty2
uccugccugacaauga

SEQ ID NO: 1775285 - RNA, 14 nt, Salmonella enterica enterica serovar Typhi Ty2
uccuggcuugccag

SEQ ID NO: 1775286 - RNA, 16 nt, Salmonella enterica enterica serovar Typhi Ty2
uccuggcuugccagau

SEQ ID NO: 1775287 - RNA, 12 nt, Salmonella enterica enterica serovar Typhi Ty2
uccuggcuucaa

SEQ ID NO: 1775288 - RNA, 16 nt, Salmonella enterica enterica serovar Typhi Ty2
uccuggcuuaccugcu

SEQ ID NO: 1775289 - RNA, 21 nt, Salmonella enterica enterica serovar Typhi Ty2
uccugggcaaaauagcccggc

SEQ ID NO: 1775290 - RNA, 22 nt, Salmonella enterica enterica serovar Typhi Ty2
uccugggcaaaauagcccggcu

SEQ ID NO: 1775291 - RNA, 18 nt, Salmonella enterica enterica serovar Typhi Ty2
uccugguccggcagguag

SEQ ID NO: 1775292 - RNA, 15 nt, Salmonella enterica enterica serovar Typhi Ty2
uccuggugugguuau

SEQ ID NO: 1775293 - RNA, 12 nt, Salmonella enterica enterica serovar Typhi Ty2
uccuguuccuga

SEQ ID NO: 1775294 - RNA, 15 nt, Salmonella enterica enterica serovar Typhi Ty2
uccuguaacaacugu

SEQ ID NO: 1775295 - RNA, 14 nt, Salmonella enterica enterica serovar Typhi Ty2
uccugugucggcag

SEQ ID NO: 1775296 - RNA, 12 nt, Salmonella enterica enterica serovar Typhi Ty2
uccugauaaccu

SEQ ID NO: 1775297 - RNA, 22 nt, Salmonella enterica enterica serovar Typhi Ty2
uccugagcgaauguauaaucca

SEQ ID NO: 1775298 - RNA, 19 nt, Salmonella enterica enterica serovar Typhi Ty2
uccugauagcaaucauccu

SEQ ID NO: 1775299 - RNA, 17 nt, Salmonella enterica enterica serovar Typhi Ty2
uccugaucuucaaccuc

SEQ ID NO: 1775300 - RNA, 20 nt, Salmonella enterica enterica serovar Typhi Ty2
uccugauuaaguuuuuuuaa

SEQ ID NO: 1775301 - RNA, 20 nt, Salmonella enterica enterica serovar Typhi Ty2
uccugcccuggugagcucca

SEQ ID NO: 1775302 - RNA, 22 nt, Salmonella enterica enterica serovar Typhi Ty2
uccugccgacaggcagguugcc

SEQ ID NO: 1775303 - RNA, 16 nt, Salmonella enterica enterica serovar Typhi Ty2
uccugccgacaggcag

SEQ ID NO: 1775304 - RNA, 15 nt, Salmonella enterica enterica serovar Typhi Ty2
uccugccagacccca

SEQ ID NO: 1775305 - RNA, 17 nt, Salmonella enterica enterica serovar Typhi Ty2
ucgauuaaacgccuggg

SEQ ID NO: 1775306 - RNA, 23 nt, Salmonella enterica enterica serovar Typhi Ty2
ucgauuagaccguaaauccuaac

SEQ ID NO: 1775307 - RNA, 18 nt, Salmonella enterica enterica serovar Typhi Ty2
ucgauaauugcucaccca

SEQ ID NO: 1775308 - RNA, 18 nt, Salmonella enterica enterica serovar Typhi Ty2
ucgauacgcugaagcuug

SEQ ID NO: 1775309 - RNA, 22 nt, Salmonella enterica enterica serovar Typhi Ty2
ucgauacucacgacuuucacca

SEQ ID NO: 1775310 - RNA, 14 nt, Salmonella enterica enterica serovar Typhi Ty2
ucgaucccggcaaa

SEQ ID NO: 1775311 - RNA, 22 nt, Salmonella enterica enterica serovar Typhi Ty2
ucgauccccucuuccaucagcc

SEQ ID NO: 1775312 - RNA, 17 nt, Salmonella enterica enterica serovar Typhi Ty2
ucgauccacuucccauu

SEQ ID NO: 1775313 - RNA, 18 nt, Salmonella enterica enterica serovar Typhi Ty2
ucgagcgugucagugcca

SEQ ID NO: 1775314 - RNA, 11 nt, Salmonella enterica enterica serovar Typhi Ty2
ucgagcgcgga

SEQ ID NO: 1775315 - RNA, 23 nt, Salmonella enterica enterica serovar Typhi Ty2
ucgauaaucgguagcacuuuaaa

SEQ ID NO: 1775316 - RNA, 16 nt, Salmonella enterica enterica serovar Typhi Ty2
ucgauaaucgcgcgcu

SEQ ID NO: 1775317 - RNA, 14 nt, Salmonella enterica enterica serovar Typhi Ty2
ucgccagccccagc

SEQ ID NO: 1775318 - RNA, 16 nt, Salmonella enterica enterica serovar Typhi Ty2
ucgccagccccagccc

SEQ ID NO: 1775319 - RNA, 22 nt, Salmonella enterica enterica serovar Typhi Ty2
ucgccagcauacgucugcgcug

SEQ ID NO: 1775320 - RNA, 19 nt, Salmonella enterica enterica serovar Typhi Ty2
ucgccagccauucaccacu

SEQ ID NO: 1775321 - RNA, 18 nt, Salmonella enterica enterica serovar Typhi Ty2
ucgccagcaacgcccaga

SEQ ID NO: 1775322 - RNA, 17 nt, Salmonella enterica enterica serovar Typhi Ty2
ucgccagaaggcaggcu

SEQ ID NO: 1775323 - RNA, 17 nt, Salmonella enterica enterica serovar Typhi Ty2
ucgccagacccagcgcu

SEQ ID NO: 1775324 - RNA, 18 nt, Salmonella enterica enterica serovar Typhi Ty2
ucgccagaccgaaaagcc

SEQ ID NO: 1775325 - RNA, 19 nt, Salmonella enterica enterica serovar Typhi Ty2
ucgccacaugcggcaggcu

SEQ ID NO: 1775326 - RNA, 23 nt, Salmonella enterica enterica serovar Typhi Ty2
ucgccacccggcuuuuuuauugc

SEQ ID NO: 1775327 - RNA, 13 nt, Salmonella enterica enterica serovar Typhi Ty2
ucgccaccgcauu

SEQ ID NO: 1775328 - RNA, 18 nt, Salmonella enterica enterica serovar Typhi Ty2
ucgccaccgcauuuucag

SEQ ID NO: 1775329 - RNA, 15 nt, Salmonella enterica enterica serovar Typhi Ty2
ucgccaccaccagcg

SEQ ID NO: 1775330 - RNA, 22 nt, Salmonella enterica enterica serovar Typhi Ty2
ucgccacguauuucgcagcggu

SEQ ID NO: 1775331 - RNA, 17 nt, Salmonella enterica enterica serovar Typhi Ty2
ucgcaaacggaauaaac

SEQ ID NO: 1775332 - RNA, 20 nt, Salmonella enterica enterica serovar Typhi Ty2
ucgcaaaauagcgguucaau

SEQ ID NO: 1775333 - RNA, 13 nt, Salmonella enterica enterica serovar Typhi Ty2
ucgauuuuuucga

SEQ ID NO: 1775334 - RNA, 24 nt, Salmonella enterica enterica serovar Typhi Ty2
ucgcagcgcuuugccgcugcugcc

SEQ ID NO: 1775335 - RNA, 15 nt, Salmonella enterica enterica serovar Typhi Ty2
ucgcauccuccaucc

SEQ ID NO: 1775336 - RNA, 16 nt, Salmonella enterica enterica serovar Typhi Ty2
ucgcagccuuuggcaa

SEQ ID NO: 1775337 - RNA, 21 nt, Salmonella enterica enterica serovar Typhi Ty2
ucgcaggccaaacagcggcuc

SEQ ID NO: 1775338 - RNA, 20 nt, Salmonella enterica enterica serovar Typhi Ty2
ucgcauguugacugcgcucc

SEQ ID NO: 1775339 - RNA, 20 nt, Salmonella enterica enterica serovar Typhi Ty2
uccuguuuaagcccggccuu

SEQ ID NO: 1775340 - RNA, 22 nt, Salmonella enterica enterica serovar Typhi Ty2
uccuguugaugauggcuccugu

SEQ ID NO: 1775341 - RNA, 19 nt, Salmonella enterica enterica serovar Typhi Ty2
ucgaagccgaccaccaucc

SEQ ID NO: 1775342 - RNA, 22 nt, Salmonella enterica enterica serovar Typhi Ty2
ucgacaguucccggcaacagua

SEQ ID NO: 1775343 - RNA, 22 nt, Salmonella enterica enterica serovar Typhi Ty2
ucgacauaauuuccggccagua

SEQ ID NO: 1775344 - RNA, 15 nt, Salmonella enterica enterica serovar Typhi Ty2
ucgacaaagccgacg

SEQ ID NO: 1775345 - RNA, 15 nt, Salmonella enterica enterica serovar Typhi Ty2
ucgacaggaguauag

SEQ ID NO: 1775346 - RNA, 22 nt, Salmonella enterica enterica serovar Typhi Ty2
ucgacagccagcauuuccagcu

SEQ ID NO: 1775347 - RNA, 20 nt, Salmonella enterica enterica serovar Typhi Ty2
ucgacagccagcauuuccag

SEQ ID NO: 1775348 - RNA, 14 nt, Salmonella enterica enterica serovar Typhi Ty2
ucgacaaaggcaag

SEQ ID NO: 1775349 - RNA, 18 nt, Salmonella enterica enterica serovar Typhi Ty2
ucgacaugguuggccacc

SEQ ID NO: 1775350 - RNA, 14 nt, Salmonella enterica enterica serovar Typhi Ty2
ucgacauuacccau

SEQ ID NO: 1775351 - RNA, 17 nt, Salmonella enterica enterica serovar Typhi Ty2
ucgacaugcagaucgcg

SEQ ID NO: 1775352 - RNA, 20 nt, Salmonella enterica enterica serovar Typhi Ty2
ucgaccucuucguucauccg

SEQ ID NO: 1775353 - RNA, 12 nt, Salmonella enterica enterica serovar Typhi Ty2
ucgacuuucauu

SEQ ID NO: 1775354 - RNA, 20 nt, Salmonella enterica enterica serovar Typhi Ty2
ucgacguucagcauauccag

SEQ ID NO: 1775355 - RNA, 19 nt, Salmonella enterica enterica serovar Typhi Ty2
ucgacuaauuuuaggaaga

SEQ ID NO: 1775356 - RNA, 16 nt, Salmonella enterica enterica serovar Typhi Ty2
ucgacguccagcgcgu

SEQ ID NO: 1775357 - RNA, 21 nt, Salmonella enterica enterica serovar Typhi Ty2
ucgacgggacgaauuuccagc

SEQ ID NO: 1775358 - RNA, 19 nt, Salmonella enterica enterica serovar Typhi Ty2
ucgacgauaaaaaaaguau

SEQ ID NO: 1775359 - RNA, 17 nt, Salmonella enterica enterica serovar Typhi Ty2
ucgacgauaaaaaaagu

SEQ ID NO: 1775360 - RNA, 16 nt, Salmonella enterica enterica serovar Typhi Ty2
ucgacgaaauggugug

SEQ ID NO: 1775361 - RNA, 13 nt, Salmonella enterica enterica serovar Typhi Ty2
ucgacgaaauggu

SEQ ID NO: 1775362 - RNA, 17 nt, Salmonella enterica enterica serovar Typhi Ty2
ucgaccuucaucucuuu

SEQ ID NO: 1775363 - RNA, 21 nt, Salmonella enterica enterica serovar Typhi Ty2
ucgaccugcguuaacggcuuc

SEQ ID NO: 1775364 - RNA, 19 nt, Salmonella enterica enterica serovar Typhi Ty2
ucgagcaucuccagcgcau

SEQ ID NO: 1775365 - RNA, 13 nt, Salmonella enterica enterica serovar Typhi Ty2
ucgcgcuggcagu

SEQ ID NO: 1775366 - RNA, 19 nt, Salmonella enterica enterica serovar Typhi Ty2
ucgcgcugucugccggcgu

SEQ ID NO: 1775367 - RNA, 21 nt, Salmonella enterica enterica serovar Typhi Ty2
ucgcgcuuacacagacugcuu

SEQ ID NO: 1775368 - RNA, 20 nt, Salmonella enterica enterica serovar Typhi Ty2
ucgcggaagcgaccggcguc

SEQ ID NO: 1775369 - RNA, 19 nt, Salmonella enterica enterica serovar Typhi Ty2
ucgcggauaugcagcagcc

SEQ ID NO: 1775370 - RNA, 17 nt, Salmonella enterica enterica serovar Typhi Ty2
ucgcgcucaagcgaaaa

SEQ ID NO: 1775371 - RNA, 17 nt, Salmonella enterica enterica serovar Typhi Ty2
ucgcgccgugcccagca

SEQ ID NO: 1775372 - RNA, 15 nt, Salmonella enterica enterica serovar Typhi Ty2
ucgcgccauuuagcg

SEQ ID NO: 1775373 - RNA, 20 nt, Salmonella enterica enterica serovar Typhi Ty2
ucgcgcauccgggccgcuag

SEQ ID NO: 1775374 - RNA, 17 nt, Salmonella enterica enterica serovar Typhi Ty2
ucgcgcauggcagggcg

SEQ ID NO: 1775375 - RNA, 18 nt, Salmonella enterica enterica serovar Typhi Ty2
ucgcgccaaaagaggcag

SEQ ID NO: 1775376 - RNA, 20 nt, Salmonella enterica enterica serovar Typhi Ty2
ucgcgccaaaagaggcagca

SEQ ID NO: 1775377 - RNA, 19 nt, Salmonella enterica enterica serovar Typhi Ty2
ucgcgccaaaagaggcagc

SEQ ID NO: 1775378 - RNA, 14 nt, Salmonella enterica enterica serovar Typhi Ty2
ucgcgauccagccc

SEQ ID NO: 1775379 - RNA, 13 nt, Salmonella enterica enterica serovar Typhi Ty2
ucgcgauuuagcg

SEQ ID NO: 1775380 - RNA, 15 nt, Salmonella enterica enterica serovar Typhi Ty2
ucgcgauuuuuuucc

SEQ ID NO: 1775381 - RNA, 14 nt, Salmonella enterica enterica serovar Typhi Ty2
ucgccugacaggag

SEQ ID NO: 1775382 - RNA, 15 nt, Salmonella enterica enterica serovar Typhi Ty2
ucgccuuucaccagc

SEQ ID NO: 1775383 - RNA, 16 nt, Salmonella enterica enterica serovar Typhi Ty2
ucgccuuucaccagcg

SEQ ID NO: 1775384 - RNA, 15 nt, Salmonella enterica enterica serovar Typhi Ty2
ucgccucccugccua

SEQ ID NO: 1775385 - RNA, 15 nt, Salmonella enterica enterica serovar Typhi Ty2
ucgcgaauaauuauu

SEQ ID NO: 1775386 - RNA, 22 nt, Salmonella enterica enterica serovar Typhi Ty2
ucgcgaauagugcaggaaggcg

SEQ ID NO: 1775387 - RNA, 22 nt, Salmonella enterica enterica serovar Typhi Ty2
ucgcgagcacuuuuuccuccug

SEQ ID NO: 1775388 - RNA, 20 nt, Salmonella enterica enterica serovar Typhi Ty2
ucgcgagaaaauagaggaaa

SEQ ID NO: 1775389 - RNA, 20 nt, Salmonella enterica enterica serovar Typhi Ty2
ucgcgauaaucaacucuccu

SEQ ID NO: 1775390 - RNA, 18 nt, Salmonella enterica enterica serovar Typhi Ty2
ucgccgcccaaccagccc

SEQ ID NO: 1775391 - RNA, 22 nt, Salmonella enterica enterica serovar Typhi Ty2
ucgccgccgccagauuauccag

SEQ ID NO: 1775392 - RNA, 19 nt, Salmonella enterica enterica serovar Typhi Ty2
ucgccauaucuucgcgcgu

SEQ ID NO: 1775393 - RNA, 18 nt, Salmonella enterica enterica serovar Typhi Ty2
ucgccauauguuccaccg

SEQ ID NO: 1775394 - RNA, 20 nt, Salmonella enterica enterica serovar Typhi Ty2
ucgccauaaagcuguaccug

SEQ ID NO: 1775395 - RNA, 15 nt, Salmonella enterica enterica serovar Typhi Ty2
ucgccgggcggcgca

SEQ ID NO: 1775396 - RNA, 21 nt, Salmonella enterica enterica serovar Typhi Ty2
ucgccgcgacgcgcgagcgca

SEQ ID NO: 1775397 - RNA, 17 nt, Salmonella enterica enterica serovar Typhi Ty2
ucggcaauaugcuguuu

SEQ ID NO: 1775398 - RNA, 21 nt, Salmonella enterica enterica serovar Typhi Ty2
ucggcaauaugcuguuuaugg

SEQ ID NO: 1775399 - RNA, 17 nt, Salmonella enterica enterica serovar Typhi Ty2
ucggcaauauugccgca

SEQ ID NO: 1775400 - RNA, 19 nt, Salmonella enterica enterica serovar Typhi Ty2
ucggcaagaauuucaauca

SEQ ID NO: 1775401 - RNA, 23 nt, Salmonella enterica enterica serovar Typhi Ty2
ucggagaaauagacgagcgaaaa

SEQ ID NO: 1775402 - RNA, 19 nt, Salmonella enterica enterica serovar Typhi Ty2
ucggcacagccaguaagaa

SEQ ID NO: 1775403 - RNA, 18 nt, Salmonella enterica enterica serovar Typhi Ty2
ucggcaauggccagauga

SEQ ID NO: 1775404 - RNA, 19 nt, Salmonella enterica enterica serovar Typhi Ty2
ucggcaccauucccacgca

SEQ ID NO: 1775405 - RNA, 21 nt, Salmonella enterica enterica serovar Typhi Ty2
ucggcacugacucuuccgggc

SEQ ID NO: 1775406 - RNA, 22 nt, Salmonella enterica enterica serovar Typhi Ty2
ucggaaguauacauccacuggu

SEQ ID NO: 1775407 - RNA, 18 nt, Salmonella enterica enterica serovar Typhi Ty2
ucggaagacuggcgcagc

SEQ ID NO: 1775408 - RNA, 20 nt, Salmonella enterica enterica serovar Typhi Ty2
ucggaauaauguaaaaaaau

SEQ ID NO: 1775409 - RNA, 21 nt, Salmonella enterica enterica serovar Typhi Ty2
ucggaauauugguaccgagga

SEQ ID NO: 1775410 - RNA, 18 nt, Salmonella enterica enterica serovar Typhi Ty2
ucggaacgcgacucccag

SEQ ID NO: 1775411 - RNA, 16 nt, Salmonella enterica enterica serovar Typhi Ty2
ucgcugccgaccuggc

SEQ ID NO: 1775412 - RNA, 22 nt, Salmonella enterica enterica serovar Typhi Ty2
ucgcuuaacggcccaggcaucg

SEQ ID NO: 1775413 - RNA, 19 nt, Salmonella enterica enterica serovar Typhi Ty2
ucgcuugcccagcauauua

SEQ ID NO: 1775414 - RNA, 18 nt, Salmonella enterica enterica serovar Typhi Ty2
ucgcugaauuucucguga

SEQ ID NO: 1775415 - RNA, 22 nt, Salmonella enterica enterica serovar Typhi Ty2
ucgcucuaucgccuggagcuga

SEQ ID NO: 1775416 - RNA, 19 nt, Salmonella enterica enterica serovar Typhi Ty2
ucgcucuuuuuuuugcuua

SEQ ID NO: 1775417 - RNA, 21 nt, Salmonella enterica enterica serovar Typhi Ty2
ucgcugacgccgaccaccgcc

SEQ ID NO: 1775418 - RNA, 22 nt, Salmonella enterica enterica serovar Typhi Ty2
ucgcugacgccgaccaccgccc

SEQ ID NO: 1775419 - RNA, 17 nt, Salmonella enterica enterica serovar Typhi Ty2
ucgcucuauauccugcc

SEQ ID NO: 1775420 - RNA, 11 nt, Salmonella enterica enterica serovar Typhi Ty2
ucgcuccuccc

SEQ ID NO: 1775421 - RNA, 21 nt, Salmonella enterica enterica serovar Typhi Ty2
ucgcucgacauagguucugcg

SEQ ID NO: 1775422 - RNA, 17 nt, Salmonella enterica enterica serovar Typhi Ty2
ucgcuaccuuuuuucag

SEQ ID NO: 1775423 - RNA, 23 nt, Salmonella enterica enterica serovar Typhi Ty2
ucgcuaagagugacgguuuucac

SEQ ID NO: 1775424 - RNA, 16 nt, Salmonella enterica enterica serovar Typhi Ty2
ucgcuauauacccccu

SEQ ID NO: 1775425 - RNA, 23 nt, Salmonella enterica enterica serovar Typhi Ty2
ucgcuaucugacagccaaacugc

SEQ ID NO: 1775426 - RNA, 22 nt, Salmonella enterica enterica serovar Typhi Ty2
ucgcuauccgcauauguuuagu

SEQ ID NO: 1775427 - RNA, 15 nt, Salmonella enterica enterica serovar Typhi Ty2
ucgcuaacccaggcc

SEQ ID NO: 1775428 - RNA, 20 nt, Salmonella enterica enterica serovar Typhi Ty2
ucgcuacaaccagcgcggcc

SEQ ID NO: 1775429 - RNA, 22 nt, Salmonella enterica enterica serovar Typhi Ty2
ucgcuaagcgucagacacaaua

SEQ ID NO: 1775430 - RNA, 14 nt, Salmonella enterica enterica serovar Typhi Ty2
ucgcuaauaaauuc

SEQ ID NO: 1775431 - RNA, 18 nt, Salmonella enterica enterica serovar Typhi Ty2
ucgcgguaacggccuggc

SEQ ID NO: 1775432 - RNA, 19 nt, Salmonella enterica enterica serovar Typhi Ty2
ucgcgguaacggccuggcu

SEQ ID NO: 1775433 - RNA, 16 nt, Salmonella enterica enterica serovar Typhi Ty2
ucgcgguacuucugac

SEQ ID NO: 1775434 - RNA, 14 nt, Salmonella enterica enterica serovar Typhi Ty2
ucgcgguaaaaagc

SEQ ID NO: 1775435 - RNA, 17 nt, Salmonella enterica enterica serovar Typhi Ty2
ucgcgguugacgcugcu

SEQ ID NO: 1775436 - RNA, 21 nt, Salmonella enterica enterica serovar Typhi Ty2
ucgcguacagcgccaugaaga

SEQ ID NO: 1775437 - RNA, 20 nt, Salmonella enterica enterica serovar Typhi Ty2
ucgcgucaauauuaaugcug

SEQ ID NO: 1775438 - RNA, 18 nt, Salmonella enterica enterica serovar Typhi Ty2
ucgcguuauagccgccaa

SEQ ID NO: 1775439 - RNA, 20 nt, Salmonella enterica enterica serovar Typhi Ty2
uccgaucuacgcuauuucca

SEQ ID NO: 1775440 - RNA, 22 nt, Salmonella enterica enterica serovar Typhi Ty2
uccgcaaagacaacgaccagug

SEQ ID NO: 1775441 - RNA, 12 nt, Salmonella enterica enterica serovar Typhi Ty2
uccgcaaagugg

SEQ ID NO: 1775442 - RNA, 11 nt, Salmonella enterica enterica serovar Typhi Ty2
uccgcaacaag

SEQ ID NO: 1775443 - RNA, 19 nt, Salmonella enterica enterica serovar Typhi Ty2
uccgauuucaugcgcagca

SEQ ID NO: 1775444 - RNA, 23 nt, Salmonella enterica enterica serovar Typhi Ty2
uccgaggaacgugaguccuucaa

SEQ ID NO: 1775445 - RNA, 19 nt, Salmonella enterica enterica serovar Typhi Ty2
uccgaggcguaucccagua

SEQ ID NO: 1775446 - RNA, 18 nt, Salmonella enterica enterica serovar Typhi Ty2
uccgagacucaaagaaaa

SEQ ID NO: 1775447 - RNA, 21 nt, Salmonella enterica enterica serovar Typhi Ty2
uccgacguuugcguaaagcug

SEQ ID NO: 1775448 - RNA, 18 nt, Salmonella enterica enterica serovar Typhi Ty2
uccgacugaccagacaga

SEQ ID NO: 1775449 - RNA, 13 nt, Salmonella enterica enterica serovar Typhi Ty2
uccgacauuagcg

SEQ ID NO: 1775450 - RNA, 14 nt, Salmonella enterica enterica serovar Typhi Ty2
uccgacauuguucu

SEQ ID NO: 1775451 - RNA, 21 nt, Salmonella enterica enterica serovar Typhi Ty2
uccgaauauuuagcuuuucgg

SEQ ID NO: 1775452 - RNA, 16 nt, Salmonella enterica enterica serovar Typhi Ty2
uccgacacgcacaucc

SEQ ID NO: 1775453 - RNA, 20 nt, Salmonella enterica enterica serovar Typhi Ty2
ucccuuccgccaccagguuc

SEQ ID NO: 1775454 - RNA, 18 nt, Salmonella enterica enterica serovar Typhi Ty2
ucccuuccgccaccaggu

SEQ ID NO: 1775455 - RNA, 21 nt, Salmonella enterica enterica serovar Typhi Ty2
ucccuuccgccaccagguuca

SEQ ID NO: 1775456 - RNA, 16 nt, Salmonella enterica enterica serovar Typhi Ty2
ucccuggauaaaauau

SEQ ID NO: 1775457 - RNA, 17 nt, Salmonella enterica enterica serovar Typhi Ty2
ucccuggcgugucauca

SEQ ID NO: 1775458 - RNA, 10 nt, Salmonella enterica enterica serovar Typhi Ty2
ucccuggccg

SEQ ID NO: 1775459 - RNA, 16 nt, Salmonella enterica enterica serovar Typhi Ty2
ucccugagucuugccu

SEQ ID NO: 1775460 - RNA, 18 nt, Salmonella enterica enterica serovar Typhi Ty2
ucccugaccuuccaucca

SEQ ID NO: 1775461 - RNA, 13 nt, Salmonella enterica enterica serovar Typhi Ty2
ucccugacgcgca

SEQ ID NO: 1775462 - RNA, 16 nt, Salmonella enterica enterica serovar Typhi Ty2
ucccucuccagggcaa

SEQ ID NO: 1775463 - RNA, 16 nt, Salmonella enterica enterica serovar Typhi Ty2
ucccucugaaacgcuu

SEQ ID NO: 1775464 - RNA, 13 nt, Salmonella enterica enterica serovar Typhi Ty2
ucccugaagaaaa

SEQ ID NO: 1775465 - RNA, 14 nt, Salmonella enterica enterica serovar Typhi Ty2
ucccuccugcucca

SEQ ID NO: 1775466 - RNA, 17 nt, Salmonella enterica enterica serovar Typhi Ty2
ucccucauauuuguauc

SEQ ID NO: 1775467 - RNA, 13 nt, Salmonella enterica enterica serovar Typhi Ty2
ucccuaauaaaau

SEQ ID NO: 1775468 - RNA, 17 nt, Salmonella enterica enterica serovar Typhi Ty2
ucccguuucagccccuu

SEQ ID NO: 1775469 - RNA, 18 nt, Salmonella enterica enterica serovar Typhi Ty2
ucccguuuucgucccagc

SEQ ID NO: 1775470 - RNA, 23 nt, Salmonella enterica enterica serovar Typhi Ty2
ucccuacugcuuagcucaucagc

SEQ ID NO: 1775471 - RNA, 17 nt, Salmonella enterica enterica serovar Typhi Ty2
ucccguaaaagaagaaa

SEQ ID NO: 1775472 - RNA, 22 nt, Salmonella enterica enterica serovar Typhi Ty2
ucccgguuuaugcgguucuccc

SEQ ID NO: 1775473 - RNA, 23 nt, Salmonella enterica enterica serovar Typhi Ty2
ucccgggcgauaaaccagcccca

SEQ ID NO: 1775474 - RNA, 22 nt, Salmonella enterica enterica serovar Typhi Ty2
ucccggcuuaaauuuuuaauaa

SEQ ID NO: 1775475 - RNA, 14 nt, Salmonella enterica enterica serovar Typhi Ty2
ucccggcagugcau

SEQ ID NO: 1775476 - RNA, 14 nt, Salmonella enterica enterica serovar Typhi Ty2
ucccggcauuauaa

SEQ ID NO: 1775477 - RNA, 17 nt, Salmonella enterica enterica serovar Typhi Ty2
ucccggcgauuaauaaa

SEQ ID NO: 1775478 - RNA, 18 nt, Salmonella enterica enterica serovar Typhi Ty2
ucccgcggcggacagcgg

SEQ ID NO: 1775479 - RNA, 21 nt, Salmonella enterica enterica serovar Typhi Ty2
ucccgcguucgcgcaguucau

SEQ ID NO: 1775480 - RNA, 17 nt, Salmonella enterica enterica serovar Typhi Ty2
ucccgcgcuucauccga

SEQ ID NO: 1775481 - RNA, 13 nt, Salmonella enterica enterica serovar Typhi Ty2
ucccgcgcggucg

SEQ ID NO: 1775482 - RNA, 21 nt, Salmonella enterica enterica serovar Typhi Ty2
ucccggaacaaaagaaagcaa

SEQ ID NO: 1775483 - RNA, 12 nt, Salmonella enterica enterica serovar Typhi Ty2
ucccgcuggcug

SEQ ID NO: 1775484 - RNA, 15 nt, Salmonella enterica enterica serovar Typhi Ty2
uccccugcuccugcc

SEQ ID NO: 1775485 - RNA, 12 nt, Salmonella enterica enterica serovar Typhi Ty2
uccccugcuccu

SEQ ID NO: 1775486 - RNA, 13 nt, Salmonella enterica enterica serovar Typhi Ty2
ucccgaacaugcc

SEQ ID NO: 1775487 - RNA, 19 nt, Salmonella enterica enterica serovar Typhi Ty2
uccccuucuguaagcaauu

SEQ ID NO: 1775488 - RNA, 15 nt, Salmonella enterica enterica serovar Typhi Ty2
uccccuucugguagc

SEQ ID NO: 1775489 - RNA, 12 nt, Salmonella enterica enterica serovar Typhi Ty2
uccccgggaaca

SEQ ID NO: 1775490 - RNA, 13 nt, Salmonella enterica enterica serovar Typhi Ty2
uccccggcuucca

SEQ ID NO: 1775491 - RNA, 17 nt, Salmonella enterica enterica serovar Typhi Ty2
uccccggcgaaagaaaa

SEQ ID NO: 1775492 - RNA, 17 nt, Salmonella enterica enterica serovar Typhi Ty2
uccccuauacgccaucu

SEQ ID NO: 1775493 - RNA, 16 nt, Salmonella enterica enterica serovar Typhi Ty2
uccccguuccaccgcc

SEQ ID NO: 1775494 - RNA, 17 nt, Salmonella enterica enterica serovar Typhi Ty2
ucccgccuugcggcgcc

SEQ ID NO: 1775495 - RNA, 14 nt, Salmonella enterica enterica serovar Typhi Ty2
ucccgccugcugca

SEQ ID NO: 1775496 - RNA, 11 nt, Salmonella enterica enterica serovar Typhi Ty2
ucccgccgcca

SEQ ID NO: 1775497 - RNA, 21 nt, Salmonella enterica enterica serovar Typhi Ty2
ucccgccgguucaauaaauca

SEQ ID NO: 1775498 - RNA, 13 nt, Salmonella enterica enterica serovar Typhi Ty2
ucccgccagcugc

SEQ ID NO: 1775499 - RNA, 22 nt, Salmonella enterica enterica serovar Typhi Ty2
ucccgcacgcuggcaucaauau

SEQ ID NO: 1775500 - RNA, 23 nt, Salmonella enterica enterica serovar Typhi Ty2
ucccgcacccgggaaagcggauc

SEQ ID NO: 1775501 - RNA, 20 nt, Salmonella enterica enterica serovar Typhi Ty2
ucccgcaaacuggccacagc

SEQ ID NO: 1775502 - RNA, 15 nt, Salmonella enterica enterica serovar Typhi Ty2
ucccgauauaaaggu

SEQ ID NO: 1775503 - RNA, 17 nt, Salmonella enterica enterica serovar Typhi Ty2
ucccgaugguggcgucg

SEQ ID NO: 1775504 - RNA, 15 nt, Salmonella enterica enterica serovar Typhi Ty2
ucccgauacgguugc

SEQ ID NO: 1775505 - RNA, 17 nt, Salmonella enterica enterica serovar Typhi Ty2
ucccgauacgguugcgc

SEQ ID NO: 1775506 - RNA, 13 nt, Salmonella enterica enterica serovar Typhi Ty2
ucccacucuucca

SEQ ID NO: 1775507 - RNA, 14 nt, Salmonella enterica enterica serovar Typhi Ty2
ucccacucuuccag

SEQ ID NO: 1775508 - RNA, 20 nt, Salmonella enterica enterica serovar Typhi Ty2
ucccacucuucaaccggcag

SEQ ID NO: 1775509 - RNA, 13 nt, Salmonella enterica enterica serovar Typhi Ty2
ucccagaccauuc

SEQ ID NO: 1775510 - RNA, 13 nt, Salmonella enterica enterica serovar Typhi Ty2
ucccagacaaaau

SEQ ID NO: 1775511 - RNA, 12 nt, Salmonella enterica enterica serovar Typhi Ty2
ucccaccagcag

SEQ ID NO: 1775512 - RNA, 13 nt, Salmonella enterica enterica serovar Typhi Ty2
ucccaccacgcag

SEQ ID NO: 1775513 - RNA, 13 nt, Salmonella enterica enterica serovar Typhi Ty2
ucccaccgggcca

SEQ ID NO: 1775514 - RNA, 15 nt, Salmonella enterica enterica serovar Typhi Ty2
ucccacgcauagucc

SEQ ID NO: 1775515 - RNA, 14 nt, Salmonella enterica enterica serovar Typhi Ty2
ucccacgacauguu

SEQ ID NO: 1775516 - RNA, 14 nt, Salmonella enterica enterica serovar Typhi Ty2
ucccacaccacacg

SEQ ID NO: 1775517 - RNA, 13 nt, Salmonella enterica enterica serovar Typhi Ty2
ucccaaugcuuuc

SEQ ID NO: 1775518 - RNA, 13 nt, Salmonella enterica enterica serovar Typhi Ty2
ucccaauucgugu

SEQ ID NO: 1775519 - RNA, 17 nt, Salmonella enterica enterica serovar Typhi Ty2
ucccaaugcggaaacca

SEQ ID NO: 1775520 - RNA, 16 nt, Salmonella enterica enterica serovar Typhi Ty2
ucccaauaccggcgua

SEQ ID NO: 1775521 - RNA, 21 nt, Salmonella enterica enterica serovar Typhi Ty2
ucccaacccgaccaggacaaa

SEQ ID NO: 1775522 - RNA, 12 nt, Salmonella enterica enterica serovar Typhi Ty2
uccauuuuccua

SEQ ID NO: 1775523 - RNA, 21 nt, Salmonella enterica enterica serovar Typhi Ty2
uccauuuuggggaaaauaccg

SEQ ID NO: 1775524 - RNA, 17 nt, Salmonella enterica enterica serovar Typhi Ty2
uccauuuuuuaucugac

SEQ ID NO: 1775525 - RNA, 17 nt, Salmonella enterica enterica serovar Typhi Ty2
uccauuuuaaauacacc

SEQ ID NO: 1775526 - RNA, 14 nt, Salmonella enterica enterica serovar Typhi Ty2
uccauucaucgauu

SEQ ID NO: 1775527 - RNA, 19 nt, Salmonella enterica enterica serovar Typhi Ty2
uccauucggcgaaagaagc

SEQ ID NO: 1775528 - RNA, 16 nt, Salmonella enterica enterica serovar Typhi Ty2
uccauugcgagaaaaa

SEQ ID NO: 1775529 - RNA, 18 nt, Salmonella enterica enterica serovar Typhi Ty2
uccauugcgagaaaaaac

SEQ ID NO: 1775530 - RNA, 22 nt, Salmonella enterica enterica serovar Typhi Ty2
uccauucucaucagaccgugaa

SEQ ID NO: 1775531 - RNA, 22 nt, Salmonella enterica enterica serovar Typhi Ty2
uccauuagcgccugaugcacau

SEQ ID NO: 1775532 - RNA, 19 nt, Salmonella enterica enterica serovar Typhi Ty2
uccauuacucucauguuca

SEQ ID NO: 1775533 - RNA, 15 nt, Salmonella enterica enterica serovar Typhi Ty2
uccauguaaacucca

SEQ ID NO: 1775534 - RNA, 20 nt, Salmonella enterica enterica serovar Typhi Ty2
uccauggucucuuuuuuagg

SEQ ID NO: 1775535 - RNA, 18 nt, Salmonella enterica enterica serovar Typhi Ty2
uccauguacgcaggcgac

SEQ ID NO: 1775536 - RNA, 16 nt, Salmonella enterica enterica serovar Typhi Ty2
uccaugagaagaaaaa

SEQ ID NO: 1775537 - RNA, 15 nt, Salmonella enterica enterica serovar Typhi Ty2
uccaugagaagaaaa

SEQ ID NO: 1775538 - RNA, 19 nt, Salmonella enterica enterica serovar Typhi Ty2
uccaucgggcucggcgcuu

SEQ ID NO: 1775539 - RNA, 17 nt, Salmonella enterica enterica serovar Typhi Ty2
uccaucgguucucugcc

SEQ ID NO: 1775540 - RNA, 18 nt, Salmonella enterica enterica serovar Typhi Ty2
uccaugcuuucaauaaau

SEQ ID NO: 1775541 - RNA, 21 nt, Salmonella enterica enterica serovar Typhi Ty2
uccaugccuuuggccuggaga

SEQ ID NO: 1775542 - RNA, 17 nt, Salmonella enterica enterica serovar Typhi Ty2
uccaugccuuuggccug

SEQ ID NO: 1775543 - RNA, 14 nt, Salmonella enterica enterica serovar Typhi Ty2
uccauggcaaaauu

SEQ ID NO: 1775544 - RNA, 13 nt, Salmonella enterica enterica serovar Typhi Ty2
uccaugcuucgau

SEQ ID NO: 1775545 - RNA, 19 nt, Salmonella enterica enterica serovar Typhi Ty2
ucccagauuaaaucauccu

SEQ ID NO: 1775546 - RNA, 14 nt, Salmonella enterica enterica serovar Typhi Ty2
ucccagccgggcag

SEQ ID NO: 1775547 - RNA, 22 nt, Salmonella enterica enterica serovar Typhi Ty2
ucccagccuuccuggucugcca

SEQ ID NO: 1775548 - RNA, 19 nt, Salmonella enterica enterica serovar Typhi Ty2
ucccagccuuccuggucug

SEQ ID NO: 1775549 - RNA, 23 nt, Salmonella enterica enterica serovar Typhi Ty2
ucccagccgggcaggaaaagcug

SEQ ID NO: 1775550 - RNA, 20 nt, Salmonella enterica enterica serovar Typhi Ty2
ucccagcgcgcgcgcaaagc

SEQ ID NO: 1775551 - RNA, 23 nt, Salmonella enterica enterica serovar Typhi Ty2
ucccaguaguuaccguaaucauc

SEQ ID NO: 1775552 - RNA, 19 nt, Salmonella enterica enterica serovar Typhi Ty2
ucccaggcgcgcagcugcc

SEQ ID NO: 1775553 - RNA, 19 nt, Salmonella enterica enterica serovar Typhi Ty2
ucccaggccgccaccgccu

SEQ ID NO: 1775554 - RNA, 16 nt, Salmonella enterica enterica serovar Typhi Ty2
ucccagugucaacugc

SEQ ID NO: 1775555 - RNA, 17 nt, Salmonella enterica enterica serovar Typhi Ty2
ucccaguuggcagggcu

SEQ ID NO: 1775556 - RNA, 14 nt, Salmonella enterica enterica serovar Typhi Ty2
ucccaguggcgucg

SEQ ID NO: 1775557 - RNA, 18 nt, Salmonella enterica enterica serovar Typhi Ty2
ucccagucauccgguuca

SEQ ID NO: 1775558 - RNA, 13 nt, Salmonella enterica enterica serovar Typhi Ty2
ucccagugucaac

SEQ ID NO: 1775559 - RNA, 18 nt, Salmonella enterica enterica serovar Typhi Ty2
ucccauuccugcaagaag

SEQ ID NO: 1775560 - RNA, 21 nt, Salmonella enterica enterica serovar Typhi Ty2
ucccauuccugcaagaagcgu

SEQ ID NO: 1775561 - RNA, 16 nt, Salmonella enterica enterica serovar Typhi Ty2
ucccauuccugcaaga

SEQ ID NO: 1775562 - RNA, 13 nt, Salmonella enterica enterica serovar Typhi Ty2
uccccaaacugcu

SEQ ID NO: 1775563 - RNA, 16 nt, Salmonella enterica enterica serovar Typhi Ty2
uccccaacagcgacca

SEQ ID NO: 1775564 - RNA, 15 nt, Salmonella enterica enterica serovar Typhi Ty2
ucccauucacguagc

SEQ ID NO: 1775565 - RNA, 19 nt, Salmonella enterica enterica serovar Typhi Ty2
ucccaugacgacagguuua

SEQ ID NO: 1775566 - RNA, 18 nt, Salmonella enterica enterica serovar Typhi Ty2
ucccauauuuuuucugcc

SEQ ID NO: 1775567 - RNA, 22 nt, Salmonella enterica enterica serovar Typhi Ty2
ucccaucgcuuugcagaaaauc

SEQ ID NO: 1775568 - RNA, 21 nt, Salmonella enterica enterica serovar Typhi Ty2
ucccauaccuguaucaaacca

SEQ ID NO: 1775569 - RNA, 14 nt, Salmonella enterica enterica serovar Typhi Ty2
uccccaccaccgcc

SEQ ID NO: 1775570 - RNA, 15 nt, Salmonella enterica enterica serovar Typhi Ty2
uccccaccaccgcca

SEQ ID NO: 1775571 - RNA, 17 nt, Salmonella enterica enterica serovar Typhi Ty2
uccccaccaccgccacu

SEQ ID NO: 1775572 - RNA, 14 nt, Salmonella enterica enterica serovar Typhi Ty2
uccccaccaggaau

SEQ ID NO: 1775573 - RNA, 19 nt, Salmonella enterica enterica serovar Typhi Ty2
uccccaggcgcuauuccca

SEQ ID NO: 1775574 - RNA, 23 nt, Salmonella enterica enterica serovar Typhi Ty2
uccccagcguaccacgccgcaca

SEQ ID NO: 1775575 - RNA, 18 nt, Salmonella enterica enterica serovar Typhi Ty2
uccccagcguaccacgcc

SEQ ID NO: 1775576 - RNA, 12 nt, Salmonella enterica enterica serovar Typhi Ty2
uccccauguuga

SEQ ID NO: 1775577 - RNA, 21 nt, Salmonella enterica enterica serovar Typhi Ty2
uccccauaaucgaccguaucc

SEQ ID NO: 1775578 - RNA, 15 nt, Salmonella enterica enterica serovar Typhi Ty2
uccccaucccagacc

SEQ ID NO: 1775579 - RNA, 13 nt, Salmonella enterica enterica serovar Typhi Ty2
uccccauaucccg

SEQ ID NO: 1775580 - RNA, 17 nt, Salmonella enterica enterica serovar Typhi Ty2
uccccgccgccaucacc

SEQ ID NO: 1775581 - RNA, 12 nt, Salmonella enterica enterica serovar Typhi Ty2
uccccgccgcca

SEQ ID NO: 1775582 - RNA, 20 nt, Salmonella enterica enterica serovar Typhi Ty2
uccccgccgagaaaauaccg

SEQ ID NO: 1775583 - RNA, 19 nt, Salmonella enterica enterica serovar Typhi Ty2
uccccgauucgcaugaauu

SEQ ID NO: 1775584 - RNA, 13 nt, Salmonella enterica enterica serovar Typhi Ty2
uccccggcagccu

SEQ ID NO: 1775585 - RNA, 22 nt, Salmonella enterica enterica serovar Typhi Ty2
uccccggcaaccuuaaacaucg

SEQ ID NO: 1775586 - RNA, 14 nt, Salmonella enterica enterica serovar Typhi Ty2
uccccggcaggcuc

SEQ ID NO: 1775587 - RNA, 17 nt, Salmonella enterica enterica serovar Typhi Ty2
uccccccucugauuggc

SEQ ID NO: 1775588 - RNA, 21 nt, Salmonella enterica enterica serovar Typhi Ty2
ucccccuggccugcucaucag

SEQ ID NO: 1775589 - RNA, 21 nt, Salmonella enterica enterica serovar Typhi Ty2
uccacaaacuccagacgauga

SEQ ID NO: 1775590 - RNA, 13 nt, Salmonella enterica enterica serovar Typhi Ty2
uccacaaucaauu

SEQ ID NO: 1775591 - RNA, 22 nt, Salmonella enterica enterica serovar Typhi Ty2
uccacaaaaggauacagcgccg

SEQ ID NO: 1775592 - RNA, 21 nt, Salmonella enterica enterica serovar Typhi Ty2
uccaauauuuauuuaauguuu

SEQ ID NO: 1775593 - RNA, 13 nt, Salmonella enterica enterica serovar Typhi Ty2
uccaauauuuauu

SEQ ID NO: 1775594 - RNA, 17 nt, Salmonella enterica enterica serovar Typhi Ty2
uccaaucucuuuugcgg

SEQ ID NO: 1775595 - RNA, 12 nt, Salmonella enterica enterica serovar Typhi Ty2
uccaccagaacc

SEQ ID NO: 1775596 - RNA, 12 nt, Salmonella enterica enterica serovar Typhi Ty2
uccaccaccucc

SEQ ID NO: 1775597 - RNA, 21 nt, Salmonella enterica enterica serovar Typhi Ty2
uccacauugguuuugccauuc

SEQ ID NO: 1775598 - RNA, 14 nt, Salmonella enterica enterica serovar Typhi Ty2
uccacauuccagac

SEQ ID NO: 1775599 - RNA, 16 nt, Salmonella enterica enterica serovar Typhi Ty2
uccacagcgaauuccg

SEQ ID NO: 1775600 - RNA, 17 nt, Salmonella enterica enterica serovar Typhi Ty2
uccacaguaaccccaua

SEQ ID NO: 1775601 - RNA, 15 nt, Salmonella enterica enterica serovar Typhi Ty2
uccacagauagucgc

SEQ ID NO: 1775602 - RNA, 20 nt, Salmonella enterica enterica serovar Typhi Ty2
uccacacguccauccgggua

SEQ ID NO: 1775603 - RNA, 19 nt, Salmonella enterica enterica serovar Typhi Ty2
uccaccagcccaucuuucg

SEQ ID NO: 1775604 - RNA, 13 nt, Salmonella enterica enterica serovar Typhi Ty2
uccaccagcgcca

SEQ ID NO: 1775605 - RNA, 22 nt, Salmonella enterica enterica serovar Typhi Ty2
uccaccagauuucgcagcagca

SEQ ID NO: 1775606 - RNA, 16 nt, Salmonella enterica enterica serovar Typhi Ty2
uccaccagcuuaucug

SEQ ID NO: 1775607 - RNA, 17 nt, Salmonella enterica enterica serovar Typhi Ty2
uccaccaggcaugcagc

SEQ ID NO: 1775608 - RNA, 22 nt, Salmonella enterica enterica serovar Typhi Ty2
uccaccuggcccugcaucagcu

SEQ ID NO: 1775609 - RNA, 15 nt, Salmonella enterica enterica serovar Typhi Ty2
uccaccucuucugca

SEQ ID NO: 1775610 - RNA, 15 nt, Salmonella enterica enterica serovar Typhi Ty2
uccaccuaugcggau

SEQ ID NO: 1775611 - RNA, 18 nt, Salmonella enterica enterica serovar Typhi Ty2
uccaccuggcccugcauc

SEQ ID NO: 1775612 - RNA, 21 nt, Salmonella enterica enterica serovar Typhi Ty2
uccacggcgcuccugucaggc

SEQ ID NO: 1775613 - RNA, 17 nt, Salmonella enterica enterica serovar Typhi Ty2
uccacgguucucaccgu

SEQ ID NO: 1775614 - RNA, 15 nt, Salmonella enterica enterica serovar Typhi Ty2
uccacugguuguccg

SEQ ID NO: 1775615 - RNA, 14 nt, Salmonella enterica enterica serovar Typhi Ty2
uccacuucagcagc

SEQ ID NO: 1775616 - RNA, 17 nt, Salmonella enterica enterica serovar Typhi Ty2
uccacgucgcacgccau

SEQ ID NO: 1775617 - RNA, 16 nt, Salmonella enterica enterica serovar Typhi Ty2
uccacguuuuacuucc

SEQ ID NO: 1775618 - RNA, 15 nt, Salmonella enterica enterica serovar Typhi Ty2
uccagacguugcucu

SEQ ID NO: 1775619 - RNA, 19 nt, Salmonella enterica enterica serovar Typhi Ty2
uccagacggcgcuguuguu

SEQ ID NO: 1775620 - RNA, 18 nt, Salmonella enterica enterica serovar Typhi Ty2
uccagaguacauucucuu

SEQ ID NO: 1775621 - RNA, 22 nt, Salmonella enterica enterica serovar Typhi Ty2
uccagaggaucuggacgccaau

SEQ ID NO: 1775622 - RNA, 17 nt, Salmonella enterica enterica serovar Typhi Ty2
uccagaggcauuauugc

SEQ ID NO: 1775623 - RNA, 12 nt, Salmonella enterica enterica serovar Typhi Ty2
uccagaucuuca

SEQ ID NO: 1775624 - RNA, 16 nt, Salmonella enterica enterica serovar Typhi Ty2
uccagauagcgcugcg

SEQ ID NO: 1775625 - RNA, 18 nt, Salmonella enterica enterica serovar Typhi Ty2
uccagauagggccaggcg

SEQ ID NO: 1775626 - RNA, 16 nt, Salmonella enterica enterica serovar Typhi Ty2
uccagauauggcaaac

SEQ ID NO: 1775627 - RNA, 17 nt, Salmonella enterica enterica serovar Typhi Ty2
uccagaauacgccgccg

SEQ ID NO: 1775628 - RNA, 18 nt, Salmonella enterica enterica serovar Typhi Ty2
uccagacccagacaaccg

SEQ ID NO: 1775629 - RNA, 12 nt, Salmonella enterica enterica serovar Typhi Ty2
uccagacagcuu

SEQ ID NO: 1775630 - RNA, 22 nt, Salmonella enterica enterica serovar Typhi Ty2
uccagaccaaacaugcggcuuu

SEQ ID NO: 1775631 - RNA, 24 nt, Salmonella enterica enterica serovar Typhi Ty2
uccagaacgaauuuacucgccaau

SEQ ID NO: 1775632 - RNA, 12 nt, Salmonella enterica enterica serovar Typhi Ty2
uccagaagaucu

SEQ ID NO: 1775633 - RNA, 22 nt, Salmonella enterica enterica serovar Typhi Ty2
uccagcacgauauccagcaccu

SEQ ID NO: 1775634 - RNA, 20 nt, Salmonella enterica enterica serovar Typhi Ty2
uccagcacgagcgccagccc

SEQ ID NO: 1775635 - RNA, 13 nt, Salmonella enterica enterica serovar Typhi Ty2
uccagcacgaccu

SEQ ID NO: 1775636 - RNA, 22 nt, Salmonella enterica enterica serovar Typhi Ty2
uccagcaccgcgaccaguucac

SEQ ID NO: 1775637 - RNA, 13 nt, Salmonella enterica enterica serovar Typhi Ty2
uccagcacgccca

SEQ ID NO: 1775638 - RNA, 16 nt, Salmonella enterica enterica serovar Typhi Ty2
uccagcagccagccgu

SEQ ID NO: 1775639 - RNA, 22 nt, Salmonella enterica enterica serovar Typhi Ty2
uccagcagacucauggacaaaa

SEQ ID NO: 1775640 - RNA, 20 nt, Salmonella enterica enterica serovar Typhi Ty2
uccagcagccaugccagcgc

SEQ ID NO: 1775641 - RNA, 19 nt, Salmonella enterica enterica serovar Typhi Ty2
uccagcagcagcaccggcu

SEQ ID NO: 1775642 - RNA, 21 nt, Salmonella enterica enterica serovar Typhi Ty2
uccagaugcgccagauucaug

SEQ ID NO: 1775643 - RNA, 20 nt, Salmonella enterica enterica serovar Typhi Ty2
uccagaugcggcgccaacgc

SEQ ID NO: 1775644 - RNA, 17 nt, Salmonella enterica enterica serovar Typhi Ty2
uccagaucgcauaaaau

SEQ ID NO: 1775645 - RNA, 16 nt, Salmonella enterica enterica serovar Typhi Ty2
uccagaugaagcgcau

SEQ ID NO: 1775646 - RNA, 16 nt, Salmonella enterica enterica serovar Typhi Ty2
uccagauugagacaaa

SEQ ID NO: 1775647 - RNA, 21 nt, Salmonella enterica enterica serovar Typhi Ty2
uccagauugagacaaauaacu

SEQ ID NO: 1775648 - RNA, 21 nt, Salmonella enterica enterica serovar Typhi Ty2
uccagcaacagugggcuauga

SEQ ID NO: 1775649 - RNA, 23 nt, Salmonella enterica enterica serovar Typhi Ty2
uccagccagcguuucuggaagua

SEQ ID NO: 1775650 - RNA, 18 nt, Salmonella enterica enterica serovar Typhi Ty2
uccagccccuucgcuguc

SEQ ID NO: 1775651 - RNA, 15 nt, Salmonella enterica enterica serovar Typhi Ty2
uccagcccgccgccc

SEQ ID NO: 1775652 - RNA, 15 nt, Salmonella enterica enterica serovar Typhi Ty2
uccagcaucagcaau

SEQ ID NO: 1775653 - RNA, 18 nt, Salmonella enterica enterica serovar Typhi Ty2
uccagcagguggaucuga

SEQ ID NO: 1775654 - RNA, 18 nt, Salmonella enterica enterica serovar Typhi Ty2
uccagccguaccacccgg

SEQ ID NO: 1775655 - RNA, 16 nt, Salmonella enterica enterica serovar Typhi Ty2
uccagccgguguuaac

SEQ ID NO: 1775656 - RNA, 22 nt, Salmonella enterica enterica serovar Typhi Ty2
uccagccguuuaaucucuucau

SEQ ID NO: 1775657 - RNA, 18 nt, Salmonella enterica enterica serovar Typhi Ty2
uccagccgcuuuucgcuu

SEQ ID NO: 1775658 - RNA, 15 nt, Salmonella enterica enterica serovar Typhi Ty2
uccagcgccagcgcc

SEQ ID NO: 1775659 - RNA, 16 nt, Salmonella enterica enterica serovar Typhi Ty2
uccagcgccagcucca

SEQ ID NO: 1775660 - RNA, 14 nt, Salmonella enterica enterica serovar Typhi Ty2
uccagcgccagcgc

SEQ ID NO: 1775661 - RNA, 17 nt, Salmonella enterica enterica serovar Typhi Ty2
uccagcgagcaggaaua

SEQ ID NO: 1775662 - RNA, 15 nt, Salmonella enterica enterica serovar Typhi Ty2
uccagcgaauaauga

SEQ ID NO: 1775663 - RNA, 14 nt, Salmonella enterica enterica serovar Typhi Ty2
uccagcgcaaaggg

SEQ ID NO: 1775664 - RNA, 14 nt, Salmonella enterica enterica serovar Typhi Ty2
uccagcgauaaacg

SEQ ID NO: 1775665 - RNA, 22 nt, Salmonella enterica enterica serovar Typhi Ty2
uccagcgcguccuuauaaugcu

SEQ ID NO: 1775666 - RNA, 20 nt, Salmonella enterica enterica serovar Typhi Ty2
uccagcggcaggauccccau

SEQ ID NO: 1775667 - RNA, 23 nt, Salmonella enterica enterica serovar Typhi Ty2
uccagcgccugcuguaaaauauc

SEQ ID NO: 1775668 - RNA, 17 nt, Salmonella enterica enterica serovar Typhi Ty2
uccaggacggacauauu

SEQ ID NO: 1775669 - RNA, 23 nt, Salmonella enterica enterica serovar Typhi Ty2
uccagcuugccgucacaggcggc

SEQ ID NO: 1775670 - RNA, 23 nt, Salmonella enterica enterica serovar Typhi Ty2
uccaggccaagcgccuguucaac

SEQ ID NO: 1775671 - RNA, 16 nt, Salmonella enterica enterica serovar Typhi Ty2
uccaggccgccagcgu

SEQ ID NO: 1775672 - RNA, 21 nt, Salmonella enterica enterica serovar Typhi Ty2
uccaggccgucggcgccagcc

SEQ ID NO: 1775673 - RNA, 19 nt, Salmonella enterica enterica serovar Typhi Ty2
uccagcuccagccgcugcc

SEQ ID NO: 1775674 - RNA, 20 nt, Salmonella enterica enterica serovar Typhi Ty2
uccagcucuuugguccauaa

SEQ ID NO: 1775675 - RNA, 14 nt, Salmonella enterica enterica serovar Typhi Ty2
uccagcucuucuuc

SEQ ID NO: 1775676 - RNA, 17 nt, Salmonella enterica enterica serovar Typhi Ty2
uccagcuguaccaucac

SEQ ID NO: 1775677 - RNA, 12 nt, Salmonella enterica enterica serovar Typhi Ty2
uccagcuggcug

SEQ ID NO: 1775678 - RNA, 18 nt, Salmonella enterica enterica serovar Typhi Ty2
uccagcucaguuuccagc

SEQ ID NO: 1775679 - RNA, 13 nt, Salmonella enterica enterica serovar Typhi Ty2
uccagcuccagcc

SEQ ID NO: 1775680 - RNA, 20 nt, Salmonella enterica enterica serovar Typhi Ty2
uccagcuaaguuuguaaaau

SEQ ID NO: 1775681 - RNA, 23 nt, Salmonella enterica enterica serovar Typhi Ty2
uccagcguuucaugaaugccggg

SEQ ID NO: 1775682 - RNA, 15 nt, Salmonella enterica enterica serovar Typhi Ty2
uccagcgucgggccg

SEQ ID NO: 1775683 - RNA, 16 nt, Salmonella enterica enterica serovar Typhi Ty2
uccagucagcaauuaa

SEQ ID NO: 1775684 - RNA, 16 nt, Salmonella enterica enterica serovar Typhi Ty2
uccaguacuuucuuuu

SEQ ID NO: 1775685 - RNA, 22 nt, Salmonella enterica enterica serovar Typhi Ty2
uccaguaauucccggcaggcgu

SEQ ID NO: 1775686 - RNA, 18 nt, Salmonella enterica enterica serovar Typhi Ty2
uccaguaauucccggcag

SEQ ID NO: 1775687 - RNA, 21 nt, Salmonella enterica enterica serovar Typhi Ty2
uccaguaaaaucggaccuccg

SEQ ID NO: 1775688 - RNA, 21 nt, Salmonella enterica enterica serovar Typhi Ty2
uccagggcugcuggccuucca

SEQ ID NO: 1775689 - RNA, 17 nt, Salmonella enterica enterica serovar Typhi Ty2
uccagguaacauacaaa

SEQ ID NO: 1775690 - RNA, 16 nt, Salmonella enterica enterica serovar Typhi Ty2
uccaggguaauuaacg

SEQ ID NO: 1775691 - RNA, 20 nt, Salmonella enterica enterica serovar Typhi Ty2
uccagguucaucacuuucac

SEQ ID NO: 1775692 - RNA, 18 nt, Salmonella enterica enterica serovar Typhi Ty2
uccaguguuguucucuga

SEQ ID NO: 1775693 - RNA, 13 nt, Salmonella enterica enterica serovar Typhi Ty2
uccaguucgagcc

SEQ ID NO: 1775694 - RNA, 22 nt, Salmonella enterica enterica serovar Typhi Ty2
uccaguugaaaaccacaaucac

SEQ ID NO: 1775695 - RNA, 18 nt, Salmonella enterica enterica serovar Typhi Ty2
uccaguucauaagucauc

SEQ ID NO: 1775696 - RNA, 21 nt, Salmonella enterica enterica serovar Typhi Ty2
uccaguucauaagucauccag

SEQ ID NO: 1775697 - RNA, 15 nt, Salmonella enterica enterica serovar Typhi Ty2
uccaguugcggcauc

SEQ ID NO: 1775698 - RNA, 14 nt, Salmonella enterica enterica serovar Typhi Ty2
uccaguugcauaca

SEQ ID NO: 1775699 - RNA, 18 nt, Salmonella enterica enterica serovar Typhi Ty2
uccaguugcuuaccuugu

SEQ ID NO: 1775700 - RNA, 13 nt, Salmonella enterica enterica serovar Typhi Ty2
uccagugaaaccg

SEQ ID NO: 1775701 - RNA, 16 nt, Salmonella enterica enterica serovar Typhi Ty2
uccagucgcuccacca

SEQ ID NO: 1775702 - RNA, 14 nt, Salmonella enterica enterica serovar Typhi Ty2
uccagucgcuccac

SEQ ID NO: 1775703 - RNA, 16 nt, Salmonella enterica enterica serovar Typhi Ty2
uccaguguuguucucu

SEQ ID NO: 1775704 - RNA, 23 nt, Salmonella enterica enterica serovar Typhi Ty2
uccaucacgguaaaccuguuugu

SEQ ID NO: 1775705 - RNA, 18 nt, Salmonella enterica enterica serovar Typhi Ty2
uccaucacgguaaaccug

SEQ ID NO: 1775706 - RNA, 22 nt, Salmonella enterica enterica serovar Typhi Ty2
uccauauaaucaaacccuuccg

SEQ ID NO: 1775707 - RNA, 14 nt, Salmonella enterica enterica serovar Typhi Ty2
uccaucccccugcc

SEQ ID NO: 1775708 - RNA, 14 nt, Salmonella enterica enterica serovar Typhi Ty2
uccaucgaauaaag

SEQ ID NO: 1775709 - RNA, 15 nt, Salmonella enterica enterica serovar Typhi Ty2
uccaucgguucucug

SEQ ID NO: 1775710 - RNA, 17 nt, Salmonella enterica enterica serovar Typhi Ty2
uccaucagcgcuuugau

SEQ ID NO: 1775711 - RNA, 13 nt, Salmonella enterica enterica serovar Typhi Ty2
uccaguuuuuucc

SEQ ID NO: 1775712 - RNA, 21 nt, Salmonella enterica enterica serovar Typhi Ty2
uccauaaaauaaagucagcaa

SEQ ID NO: 1775713 - RNA, 14 nt, Salmonella enterica enterica serovar Typhi Ty2
uccauaaauaacau

SEQ ID NO: 1775714 - RNA, 16 nt, Salmonella enterica enterica serovar Typhi Ty2
uccauaaauaacauuu

SEQ ID NO: 1775715 - RNA, 20 nt, Salmonella enterica enterica serovar Typhi Ty2
uccauacacugcauaaauau

SEQ ID NO: 1775716 - RNA, 18 nt, Salmonella enterica enterica serovar Typhi Ty2
uccauaccguuucaacug

SEQ ID NO: 1775717 - RNA, 22 nt, Salmonella enterica enterica serovar Typhi Ty2
uccauaccggacuccaggcaac

SEQ ID NO: 1775718 - RNA, 21 nt, Salmonella enterica enterica serovar Typhi Ty2
uccauaccggacuccaggcaa

SEQ ID NO: 1775719 - RNA, 23 nt, Salmonella enterica enterica serovar Typhi Ty2
uccauaccguuucaacugccccu

SEQ ID NO: 1775720 - RNA, 14 nt, Salmonella enterica enterica serovar Typhi Ty2
uccauagaacgcuu

SEQ ID NO: 1775721 - RNA, 18 nt, Salmonella enterica enterica serovar Typhi Ty2
ucauuuuaucgauaauau

SEQ ID NO: 1775722 - RNA, 15 nt, Salmonella enterica enterica serovar Typhi Ty2
ucauuuguacaaaaa

SEQ ID NO: 1775723 - RNA, 17 nt, Salmonella enterica enterica serovar Typhi Ty2
ucauuugcgcuuuuaau

SEQ ID NO: 1775724 - RNA, 13 nt, Salmonella enterica enterica serovar Typhi Ty2
ucauuucugccug

SEQ ID NO: 1775725 - RNA, 18 nt, Salmonella enterica enterica serovar Typhi Ty2
ucauuggggaaccuggca

SEQ ID NO: 1775726 - RNA, 17 nt, Salmonella enterica enterica serovar Typhi Ty2
ucauuggggggaaauua

SEQ ID NO: 1775727 - RNA, 17 nt, Salmonella enterica enterica serovar Typhi Ty2
ucauuggauuaacggca

SEQ ID NO: 1775728 - RNA, 21 nt, Salmonella enterica enterica serovar Typhi Ty2
ucauuggaagagacacgcuga

SEQ ID NO: 1775729 - RNA, 16 nt, Salmonella enterica enterica serovar Typhi Ty2
ucauugcguucaggcg

SEQ ID NO: 1775730 - RNA, 16 nt, Salmonella enterica enterica serovar Typhi Ty2
uccaaagcgaagcugc

SEQ ID NO: 1775731 - RNA, 12 nt, Salmonella enterica enterica serovar Typhi Ty2
uccaaaauaaua

SEQ ID NO: 1775732 - RNA, 15 nt, Salmonella enterica enterica serovar Typhi Ty2
uccaaaaauaaacac

SEQ ID NO: 1775733 - RNA, 22 nt, Salmonella enterica enterica serovar Typhi Ty2
uccaaauggcguacuaaauagg

SEQ ID NO: 1775734 - RNA, 14 nt, Salmonella enterica enterica serovar Typhi Ty2
uccaacgugcagau

SEQ ID NO: 1775735 - RNA, 13 nt, Salmonella enterica enterica serovar Typhi Ty2
uccaacccuugcu

SEQ ID NO: 1775736 - RNA, 12 nt, Salmonella enterica enterica serovar Typhi Ty2
uccaacauagcu

SEQ ID NO: 1775737 - RNA, 16 nt, Salmonella enterica enterica serovar Typhi Ty2
uccaacagaaggcuuc

SEQ ID NO: 1775738 - RNA, 21 nt, Salmonella enterica enterica serovar Typhi Ty2
ucauguugcggguuucugaau

SEQ ID NO: 1775739 - RNA, 19 nt, Salmonella enterica enterica serovar Typhi Ty2
ucauguugcggguuucuga

SEQ ID NO: 1775740 - RNA, 23 nt, Salmonella enterica enterica serovar Typhi Ty2
ucauguuauaagcgcgcagguag

SEQ ID NO: 1775741 - RNA, 13 nt, Salmonella enterica enterica serovar Typhi Ty2
ucauuaaaaaacc

SEQ ID NO: 1775742 - RNA, 14 nt, Salmonella enterica enterica serovar Typhi Ty2
ucauuaaaauugaa

SEQ ID NO: 1775743 - RNA, 17 nt, Salmonella enterica enterica serovar Typhi Ty2
ucauuaacgggaaacug

SEQ ID NO: 1775744 - RNA, 18 nt, Salmonella enterica enterica serovar Typhi Ty2
ucauuaacguaggccgga

SEQ ID NO: 1775745 - RNA, 14 nt, Salmonella enterica enterica serovar Typhi Ty2
ucauuaccaguuga

SEQ ID NO: 1775746 - RNA, 13 nt, Salmonella enterica enterica serovar Typhi Ty2
ucauuaccuuuuc

SEQ ID NO: 1775747 - RNA, 22 nt, Salmonella enterica enterica serovar Typhi Ty2
ucauuaauuuucacgcucugac

SEQ ID NO: 1775748 - RNA, 21 nt, Salmonella enterica enterica serovar Typhi Ty2
ucauuaauuauacugucgcuc

SEQ ID NO: 1775749 - RNA, 12 nt, Salmonella enterica enterica serovar Typhi Ty2
ucauuacaggcg

SEQ ID NO: 1775750 - RNA, 16 nt, Salmonella enterica enterica serovar Typhi Ty2
ucauuaccaacguaaa

SEQ ID NO: 1775751 - RNA, 16 nt, Salmonella enterica enterica serovar Typhi Ty2
ucaugcuuccaaagag

SEQ ID NO: 1775752 - RNA, 14 nt, Salmonella enterica enterica serovar Typhi Ty2
ucaugggaaaucac

SEQ ID NO: 1775753 - RNA, 15 nt, Salmonella enterica enterica serovar Typhi Ty2
ucaugguaaaugccg

SEQ ID NO: 1775754 - RNA, 18 nt, Salmonella enterica enterica serovar Typhi Ty2
ucaugguaaaauccuuuu

SEQ ID NO: 1775755 - RNA, 13 nt, Salmonella enterica enterica serovar Typhi Ty2
ucauguaaaggcg

SEQ ID NO: 1775756 - RNA, 13 nt, Salmonella enterica enterica serovar Typhi Ty2
ucauguccccagg

SEQ ID NO: 1775757 - RNA, 19 nt, Salmonella enterica enterica serovar Typhi Ty2
ucaugugcagcauccagcu

SEQ ID NO: 1775758 - RNA, 17 nt, Salmonella enterica enterica serovar Typhi Ty2
ucauucgucaaauucac

SEQ ID NO: 1775759 - RNA, 18 nt, Salmonella enterica enterica serovar Typhi Ty2
ucauucgcgaauagugca

SEQ ID NO: 1775760 - RNA, 24 nt, Salmonella enterica enterica serovar Typhi Ty2
ucauuccgaggguggacaugauaa

SEQ ID NO: 1775761 - RNA, 18 nt, Salmonella enterica enterica serovar Typhi Ty2
ucauugaguuugcaaucc

SEQ ID NO: 1775762 - RNA, 20 nt, Salmonella enterica enterica serovar Typhi Ty2
ucauugaggcgcgaaaaaua

SEQ ID NO: 1775763 - RNA, 18 nt, Salmonella enterica enterica serovar Typhi Ty2
ucauugacccgaucgcua

SEQ ID NO: 1775764 - RNA, 17 nt, Salmonella enterica enterica serovar Typhi Ty2
ucauugccguaaauuga

SEQ ID NO: 1775765 - RNA, 20 nt, Salmonella enterica enterica serovar Typhi Ty2
ucauucugcuuaccagaccg

SEQ ID NO: 1775766 - RNA, 13 nt, Salmonella enterica enterica serovar Typhi Ty2
ucauuagcgcggu

SEQ ID NO: 1775767 - RNA, 23 nt, Salmonella enterica enterica serovar Typhi Ty2
ucauuacuggaucgcuccauucu

SEQ ID NO: 1775768 - RNA, 18 nt, Salmonella enterica enterica serovar Typhi Ty2
ucauuauuuuuaaauaac

SEQ ID NO: 1775769 - RNA, 21 nt, Salmonella enterica enterica serovar Typhi Ty2
ucauucacccaauaaauaaua

SEQ ID NO: 1775770 - RNA, 17 nt, Salmonella enterica enterica serovar Typhi Ty2
ucauucagaucaaaaau

SEQ ID NO: 1775771 - RNA, 19 nt, Salmonella enterica enterica serovar Typhi Ty2
ucaugaguaaaugaacguu

SEQ ID NO: 1775772 - RNA, 22 nt, Salmonella enterica enterica serovar Typhi Ty2
ucaugagucgcgcgcgccaguc

SEQ ID NO: 1775773 - RNA, 17 nt, Salmonella enterica enterica serovar Typhi Ty2
ucaugacucuuguuucu

SEQ ID NO: 1775774 - RNA, 19 nt, Salmonella enterica enterica serovar Typhi Ty2
ucaugaucuuuccuuuuuc

SEQ ID NO: 1775775 - RNA, 20 nt, Salmonella enterica enterica serovar Typhi Ty2
ucaugaucuuuccuuuuuca

SEQ ID NO: 1775776 - RNA, 14 nt, Salmonella enterica enterica serovar Typhi Ty2
ucaugaucuuuccu

SEQ ID NO: 1775777 - RNA, 16 nt, Salmonella enterica enterica serovar Typhi Ty2
ucaugaaaaauauaaa

SEQ ID NO: 1775778 - RNA, 16 nt, Salmonella enterica enterica serovar Typhi Ty2
ucaugaaguuaccaga

SEQ ID NO: 1775779 - RNA, 22 nt, Salmonella enterica enterica serovar Typhi Ty2
ucaugcgcggucauucauuguc

SEQ ID NO: 1775780 - RNA, 18 nt, Salmonella enterica enterica serovar Typhi Ty2
ucaugcgagguauacgcc

SEQ ID NO: 1775781 - RNA, 22 nt, Salmonella enterica enterica serovar Typhi Ty2
ucaugccuucuuugccuuuuuc

SEQ ID NO: 1775782 - RNA, 17 nt, Salmonella enterica enterica serovar Typhi Ty2
ucaugcgguuaaaccag

SEQ ID NO: 1775783 - RNA, 16 nt, Salmonella enterica enterica serovar Typhi Ty2
ucaugcggucuucacu

SEQ ID NO: 1775784 - RNA, 23 nt, Salmonella enterica enterica serovar Typhi Ty2
ucaugcgcgucccggcagugcau

SEQ ID NO: 1775785 - RNA, 13 nt, Salmonella enterica enterica serovar Typhi Ty2
ucaugcgccgcga

SEQ ID NO: 1775786 - RNA, 23 nt, Salmonella enterica enterica serovar Typhi Ty2
ucaugcugcgguuauaauaauaa

SEQ ID NO: 1775787 - RNA, 23 nt, Salmonella enterica enterica serovar Typhi Ty2
ucaugcuguauaaacucagcaau

SEQ ID NO: 1775788 - RNA, 22 nt, Salmonella enterica enterica serovar Typhi Ty2
ucaugcuggcgaugaguaaaau

SEQ ID NO: 1775789 - RNA, 22 nt, Salmonella enterica enterica serovar Typhi Ty2
ucaugaugaucuucagcccguu

SEQ ID NO: 1775790 - RNA, 16 nt, Salmonella enterica enterica serovar Typhi Ty2
ucaugcagccggcgau

SEQ ID NO: 1775791 - RNA, 21 nt, Salmonella enterica enterica serovar Typhi Ty2
ucaugcauuaaugggcgaaaa

SEQ ID NO: 1775792 - RNA, 12 nt, Salmonella enterica enterica serovar Typhi Ty2
ucaugcaauaau

SEQ ID NO: 1775793 - RNA, 21 nt, Salmonella enterica enterica serovar Typhi Ty2
ucaugauuucuugagcggcau

SEQ ID NO: 1775794 - RNA, 21 nt, Salmonella enterica enterica serovar Typhi Ty2
ucaugcaacuucaccucaguc

SEQ ID NO: 1775795 - RNA, 19 nt, Salmonella enterica enterica serovar Typhi Ty2
ucaugccgaccagggcauc

SEQ ID NO: 1775796 - RNA, 15 nt, Salmonella enterica enterica serovar Typhi Ty2
ucaucuucacuucac

SEQ ID NO: 1775797 - RNA, 14 nt, Salmonella enterica enterica serovar Typhi Ty2
ucaucuucccgaau

SEQ ID NO: 1775798 - RNA, 17 nt, Salmonella enterica enterica serovar Typhi Ty2
ucaucuucaccuuucca

SEQ ID NO: 1775799 - RNA, 18 nt, Salmonella enterica enterica serovar Typhi Ty2
ucaucuucaccuuuccag

SEQ ID NO: 1775800 - RNA, 11 nt, Salmonella enterica enterica serovar Typhi Ty2
ucaucuucuuu

SEQ ID NO: 1775801 - RNA, 15 nt, Salmonella enterica enterica serovar Typhi Ty2
ucaucucccaggccg

SEQ ID NO: 1775802 - RNA, 17 nt, Salmonella enterica enterica serovar Typhi Ty2
ucaucuguggcaauuuu

SEQ ID NO: 1775803 - RNA, 20 nt, Salmonella enterica enterica serovar Typhi Ty2
ucaucggucaguuugcccca

SEQ ID NO: 1775804 - RNA, 17 nt, Salmonella enterica enterica serovar Typhi Ty2
ucaucgguuacuccuua

SEQ ID NO: 1775805 - RNA, 16 nt, Salmonella enterica enterica serovar Typhi Ty2
ucaucgguguucacaa

SEQ ID NO: 1775806 - RNA, 23 nt, Salmonella enterica enterica serovar Typhi Ty2
ucaucguaaaaucaacagcaaaa

SEQ ID NO: 1775807 - RNA, 23 nt, Salmonella enterica enterica serovar Typhi Ty2
ucaucgcuuaacggcccaggcau

SEQ ID NO: 1775808 - RNA, 22 nt, Salmonella enterica enterica serovar Typhi Ty2
ucaucguuugcgcuacgcugcg

SEQ ID NO: 1775809 - RNA, 18 nt, Salmonella enterica enterica serovar Typhi Ty2
ucaucgugaaauuauucc

SEQ ID NO: 1775810 - RNA, 17 nt, Salmonella enterica enterica serovar Typhi Ty2
ucaucuaucugcuucug

SEQ ID NO: 1775811 - RNA, 13 nt, Salmonella enterica enterica serovar Typhi Ty2
ucaucuacacgca

SEQ ID NO: 1775812 - RNA, 21 nt, Salmonella enterica enterica serovar Typhi Ty2
ucaucagaccgugaauaagau

SEQ ID NO: 1775813 - RNA, 15 nt, Salmonella enterica enterica serovar Typhi Ty2
ucaucagcacaaaau

SEQ ID NO: 1775814 - RNA, 20 nt, Salmonella enterica enterica serovar Typhi Ty2
ucaucagaccgagacccagc

SEQ ID NO: 1775815 - RNA, 15 nt, Salmonella enterica enterica serovar Typhi Ty2
ucaucaggcaauaaa

SEQ ID NO: 1775816 - RNA, 21 nt, Salmonella enterica enterica serovar Typhi Ty2
ucaucagccgaccaauugcag

SEQ ID NO: 1775817 - RNA, 22 nt, Salmonella enterica enterica serovar Typhi Ty2
ucaucagccguuacuuccccca

SEQ ID NO: 1775818 - RNA, 13 nt, Salmonella enterica enterica serovar Typhi Ty2
ucaucacccaguc

SEQ ID NO: 1775819 - RNA, 16 nt, Salmonella enterica enterica serovar Typhi Ty2
ucaucaccagcagcag

SEQ ID NO: 1775820 - RNA, 22 nt, Salmonella enterica enterica serovar Typhi Ty2
ucaucaucuuguccucaucauu

SEQ ID NO: 1775821 - RNA, 21 nt, Salmonella enterica enterica serovar Typhi Ty2
ucaucaucucugucgaccauc

SEQ ID NO: 1775822 - RNA, 18 nt, Salmonella enterica enterica serovar Typhi Ty2
ucaucaucggcacagcca

SEQ ID NO: 1775823 - RNA, 16 nt, Salmonella enterica enterica serovar Typhi Ty2
ucaucaucggcacagc

SEQ ID NO: 1775824 - RNA, 15 nt, Salmonella enterica enterica serovar Typhi Ty2
ucaucaguuuaaccg

SEQ ID NO: 1775825 - RNA, 15 nt, Salmonella enterica enterica serovar Typhi Ty2
ucaucaggccugggc

SEQ ID NO: 1775826 - RNA, 19 nt, Salmonella enterica enterica serovar Typhi Ty2
ucaucauacugaagauaaa

SEQ ID NO: 1775827 - RNA, 21 nt, Salmonella enterica enterica serovar Typhi Ty2
ucaucaugaaaaacaguaccg

SEQ ID NO: 1775828 - RNA, 16 nt, Salmonella enterica enterica serovar Typhi Ty2
ucaucaugauauaauu

SEQ ID NO: 1775829 - RNA, 23 nt, Salmonella enterica enterica serovar Typhi Ty2
ucaucauugaggcgcgaaaaaua

SEQ ID NO: 1775830 - RNA, 17 nt, Salmonella enterica enterica serovar Typhi Ty2
ucaucauuaccuuuucc

SEQ ID NO: 1775831 - RNA, 14 nt, Salmonella enterica enterica serovar Typhi Ty2
ucaucgcauccagg

SEQ ID NO: 1775832 - RNA, 16 nt, Salmonella enterica enterica serovar Typhi Ty2
ucaucgcaaauucugu

SEQ ID NO: 1775833 - RNA, 15 nt, Salmonella enterica enterica serovar Typhi Ty2
ucaucgccuucaucc

SEQ ID NO: 1775834 - RNA, 18 nt, Salmonella enterica enterica serovar Typhi Ty2
ucaucgccuuaacucuua

SEQ ID NO: 1775835 - RNA, 16 nt, Salmonella enterica enterica serovar Typhi Ty2
ucaucgccacaugcgg

SEQ ID NO: 1775836 - RNA, 13 nt, Salmonella enterica enterica serovar Typhi Ty2
ucaucgccagccc

SEQ ID NO: 1775837 - RNA, 14 nt, Salmonella enterica enterica serovar Typhi Ty2
ucaucgcgccuccc

SEQ ID NO: 1775838 - RNA, 22 nt, Salmonella enterica enterica serovar Typhi Ty2
ucaucgacauuaacaaugccuu

SEQ ID NO: 1775839 - RNA, 12 nt, Salmonella enterica enterica serovar Typhi Ty2
ucauccuucccc

SEQ ID NO: 1775840 - RNA, 17 nt, Salmonella enterica enterica serovar Typhi Ty2
ucauccugauuuuacug

SEQ ID NO: 1775841 - RNA, 22 nt, Salmonella enterica enterica serovar Typhi Ty2
ucauccuuacuucgauggccuc

SEQ ID NO: 1775842 - RNA, 21 nt, Salmonella enterica enterica serovar Typhi Ty2
ucauccagcaauaacaccggc

SEQ ID NO: 1775843 - RNA, 16 nt, Salmonella enterica enterica serovar Typhi Ty2
ucauccagcagcagca

SEQ ID NO: 1775844 - RNA, 19 nt, Salmonella enterica enterica serovar Typhi Ty2
ucauccagcguuucaugaa

SEQ ID NO: 1775845 - RNA, 19 nt, Salmonella enterica enterica serovar Typhi Ty2
ucaucccacuccaucgccu

SEQ ID NO: 1775846 - RNA, 12 nt, Salmonella enterica enterica serovar Typhi Ty2
ucauccgcuucg

SEQ ID NO: 1775847 - RNA, 19 nt, Salmonella enterica enterica serovar Typhi Ty2
ucauccggguuaaaccagc

SEQ ID NO: 1775848 - RNA, 16 nt, Salmonella enterica enterica serovar Typhi Ty2
ucauagccgacccgca

SEQ ID NO: 1775849 - RNA, 14 nt, Salmonella enterica enterica serovar Typhi Ty2
ucauagacugcgcu

SEQ ID NO: 1775850 - RNA, 20 nt, Salmonella enterica enterica serovar Typhi Ty2
ucauagacgcgguuaucucu

SEQ ID NO: 1775851 - RNA, 18 nt, Salmonella enterica enterica serovar Typhi Ty2
ucauacgcuuuacgcuua

SEQ ID NO: 1775852 - RNA, 14 nt, Salmonella enterica enterica serovar Typhi Ty2
ucauacgcuuucug

SEQ ID NO: 1775853 - RNA, 23 nt, Salmonella enterica enterica serovar Typhi Ty2
ucauacggcaugccaucucuuaa

SEQ ID NO: 1775854 - RNA, 17 nt, Salmonella enterica enterica serovar Typhi Ty2
ucauaacgaccaaacaa

SEQ ID NO: 1775855 - RNA, 16 nt, Salmonella enterica enterica serovar Typhi Ty2
ucauaauaaacugcau

SEQ ID NO: 1775856 - RNA, 20 nt, Salmonella enterica enterica serovar Typhi Ty2
ucauaauaagcgcucaggca

SEQ ID NO: 1775857 - RNA, 20 nt, Salmonella enterica enterica serovar Typhi Ty2
ucauaaugucccugccacgc

SEQ ID NO: 1775858 - RNA, 12 nt, Salmonella enterica enterica serovar Typhi Ty2
ucauaauguucg

SEQ ID NO: 1775859 - RNA, 15 nt, Salmonella enterica enterica serovar Typhi Ty2
ucauaauuaaaaagg

SEQ ID NO: 1775860 - RNA, 21 nt, Salmonella enterica enterica serovar Typhi Ty2
ucauauggaagcuguuaauuu

SEQ ID NO: 1775861 - RNA, 19 nt, Salmonella enterica enterica serovar Typhi Ty2
ucauauuaaauuccggcuc

SEQ ID NO: 1775862 - RNA, 15 nt, Salmonella enterica enterica serovar Typhi Ty2
ucauaugugccgaug

SEQ ID NO: 1775863 - RNA, 16 nt, Salmonella enterica enterica serovar Typhi Ty2
ucauaguuuuccagcc

SEQ ID NO: 1775864 - RNA, 15 nt, Salmonella enterica enterica serovar Typhi Ty2
ucauauaagaaauag

SEQ ID NO: 1775865 - RNA, 21 nt, Salmonella enterica enterica serovar Typhi Ty2
ucauaucccggcugacauaau

SEQ ID NO: 1775866 - RNA, 15 nt, Salmonella enterica enterica serovar Typhi Ty2
ucauauugcgccgca

SEQ ID NO: 1775867 - RNA, 20 nt, Salmonella enterica enterica serovar Typhi Ty2
ucaucaaaaucaucgccacg

SEQ ID NO: 1775868 - RNA, 13 nt, Salmonella enterica enterica serovar Typhi Ty2
ucaucaaauuauc

SEQ ID NO: 1775869 - RNA, 14 nt, Salmonella enterica enterica serovar Typhi Ty2
ucaucaaccaugau

SEQ ID NO: 1775870 - RNA, 20 nt, Salmonella enterica enterica serovar Typhi Ty2
ucaucaaccaugaucaccau

SEQ ID NO: 1775871 - RNA, 22 nt, Salmonella enterica enterica serovar Typhi Ty2
ucauaaauguacugcaauaacc

SEQ ID NO: 1775872 - RNA, 19 nt, Salmonella enterica enterica serovar Typhi Ty2
ucauaacaccaauacguga

SEQ ID NO: 1775873 - RNA, 21 nt, Salmonella enterica enterica serovar Typhi Ty2
ucauaaaaucaaucugcaugu

SEQ ID NO: 1775874 - RNA, 13 nt, Salmonella enterica enterica serovar Typhi Ty2
ucaguuucggccc

SEQ ID NO: 1775875 - RNA, 15 nt, Salmonella enterica enterica serovar Typhi Ty2
ucaguuugucgguaa

SEQ ID NO: 1775876 - RNA, 23 nt, Salmonella enterica enterica serovar Typhi Ty2
ucaguuugucgguaauccccgcc

SEQ ID NO: 1775877 - RNA, 18 nt, Salmonella enterica enterica serovar Typhi Ty2
ucaguuuuggcaaucaca

SEQ ID NO: 1775878 - RNA, 21 nt, Salmonella enterica enterica serovar Typhi Ty2
ucaguguuuccauacauuuuu

SEQ ID NO: 1775879 - RNA, 12 nt, Salmonella enterica enterica serovar Typhi Ty2
ucaguucagaaa

SEQ ID NO: 1775880 - RNA, 16 nt, Salmonella enterica enterica serovar Typhi Ty2
ucaguucggagaucag

SEQ ID NO: 1775881 - RNA, 12 nt, Salmonella enterica enterica serovar Typhi Ty2
ucagugauaaag

SEQ ID NO: 1775882 - RNA, 17 nt, Salmonella enterica enterica serovar Typhi Ty2
ucagugaacacccugcc

SEQ ID NO: 1775883 - RNA, 22 nt, Salmonella enterica enterica serovar Typhi Ty2
ucagugauaaagcacagcccca

SEQ ID NO: 1775884 - RNA, 17 nt, Salmonella enterica enterica serovar Typhi Ty2
ucaguggcggcaaaaaa

SEQ ID NO: 1775885 - RNA, 14 nt, Salmonella enterica enterica serovar Typhi Ty2
ucaguggaaaacag

SEQ ID NO: 1775886 - RNA, 14 nt, Salmonella enterica enterica serovar Typhi Ty2
ucagugaacacccu

SEQ ID NO: 1775887 - RNA, 20 nt, Salmonella enterica enterica serovar Typhi Ty2
ucagugaaaagcuggaggug

SEQ ID NO: 1775888 - RNA, 16 nt, Salmonella enterica enterica serovar Typhi Ty2
ucaguccccacauuac

SEQ ID NO: 1775889 - RNA, 23 nt, Salmonella enterica enterica serovar Typhi Ty2
ucaguccccagcguaccacgccg

SEQ ID NO: 1775890 - RNA, 22 nt, Salmonella enterica enterica serovar Typhi Ty2
ucagucccgggcuaaucgcaaa

SEQ ID NO: 1775891 - RNA, 23 nt, Salmonella enterica enterica serovar Typhi Ty2
ucaguagcuuuuccgcuggaaua

SEQ ID NO: 1775892 - RNA, 18 nt, Salmonella enterica enterica serovar Typhi Ty2
ucaguacagccaaaaaua

SEQ ID NO: 1775893 - RNA, 20 nt, Salmonella enterica enterica serovar Typhi Ty2
ucaguagccgccgcaggaca

SEQ ID NO: 1775894 - RNA, 21 nt, Salmonella enterica enterica serovar Typhi Ty2
ucaguagccgccgcaggacag

SEQ ID NO: 1775895 - RNA, 18 nt, Salmonella enterica enterica serovar Typhi Ty2
ucaguaaaggaugccacu

SEQ ID NO: 1775896 - RNA, 16 nt, Salmonella enterica enterica serovar Typhi Ty2
ucaguaaaagcccgcc

SEQ ID NO: 1775897 - RNA, 11 nt, Salmonella enterica enterica serovar Typhi Ty2
ucagguuuuuu

SEQ ID NO: 1775898 - RNA, 21 nt, Salmonella enterica enterica serovar Typhi Ty2
ucagguuuuuugugaguucau

SEQ ID NO: 1775899 - RNA, 20 nt, Salmonella enterica enterica serovar Typhi Ty2
ucagguuuuuaagcugccca

SEQ ID NO: 1775900 - RNA, 17 nt, Salmonella enterica enterica serovar Typhi Ty2
ucagguucgaauccugu

SEQ ID NO: 1775901 - RNA, 20 nt, Salmonella enterica enterica serovar Typhi Ty2
ucagcugaacagucccacca

SEQ ID NO: 1775902 - RNA, 19 nt, Salmonella enterica enterica serovar Typhi Ty2
ucagcugaacagucccacc

SEQ ID NO: 1775903 - RNA, 20 nt, Salmonella enterica enterica serovar Typhi Ty2
ucagcucuucaauuuccauc

SEQ ID NO: 1775904 - RNA, 12 nt, Salmonella enterica enterica serovar Typhi Ty2
ucagcuggcuuu

SEQ ID NO: 1775905 - RNA, 14 nt, Salmonella enterica enterica serovar Typhi Ty2
ucagcuacuuuaaa

SEQ ID NO: 1775906 - RNA, 22 nt, Salmonella enterica enterica serovar Typhi Ty2
ucagcuccuuucggacuuccug

SEQ ID NO: 1775907 - RNA, 13 nt, Salmonella enterica enterica serovar Typhi Ty2
ucagcucgcugcc

SEQ ID NO: 1775908 - RNA, 18 nt, Salmonella enterica enterica serovar Typhi Ty2
ucaggaaaacgcuuucca

SEQ ID NO: 1775909 - RNA, 15 nt, Salmonella enterica enterica serovar Typhi Ty2
ucaggaaaacaaauu

SEQ ID NO: 1775910 - RNA, 13 nt, Salmonella enterica enterica serovar Typhi Ty2
ucaggaaaacaaa

SEQ ID NO: 1775911 - RNA, 16 nt, Salmonella enterica enterica serovar Typhi Ty2
ucaggaaaucuuccag

SEQ ID NO: 1775912 - RNA, 21 nt, Salmonella enterica enterica serovar Typhi Ty2
ucaggaaauucucagaaacaa

SEQ ID NO: 1775913 - RNA, 15 nt, Salmonella enterica enterica serovar Typhi Ty2
ucaggaaugccacga

SEQ ID NO: 1775914 - RNA, 13 nt, Salmonella enterica enterica serovar Typhi Ty2
ucaggacaucaaa

SEQ ID NO: 1775915 - RNA, 21 nt, Salmonella enterica enterica serovar Typhi Ty2
ucaggacuagcgcgauuuucu

SEQ ID NO: 1775916 - RNA, 17 nt, Salmonella enterica enterica serovar Typhi Ty2
ucagcgcgccaauggcc

SEQ ID NO: 1775917 - RNA, 12 nt, Salmonella enterica enterica serovar Typhi Ty2
ucagcgcgcgcu

SEQ ID NO: 1775918 - RNA, 12 nt, Salmonella enterica enterica serovar Typhi Ty2
ucagcgcgcucc

SEQ ID NO: 1775919 - RNA, 17 nt, Salmonella enterica enterica serovar Typhi Ty2
ucagcgccaccacaaac

SEQ ID NO: 1775920 - RNA, 18 nt, Salmonella enterica enterica serovar Typhi Ty2
ucagcgccauugcuagga

SEQ ID NO: 1775921 - RNA, 14 nt, Salmonella enterica enterica serovar Typhi Ty2
ucagcgccaccaca

SEQ ID NO: 1775922 - RNA, 21 nt, Salmonella enterica enterica serovar Typhi Ty2
uaucuucccgauaacugaagg

SEQ ID NO: 1775923 - RNA, 22 nt, Salmonella enterica enterica serovar Typhi Ty2
ucagcguaaaacuuuucugcgu

SEQ ID NO: 1775924 - RNA, 16 nt, Salmonella enterica enterica serovar Typhi Ty2
ucagcguaccgaagaa

SEQ ID NO: 1775925 - RNA, 17 nt, Salmonella enterica enterica serovar Typhi Ty2
ucagcgucggugaagaa

SEQ ID NO: 1775926 - RNA, 15 nt, Salmonella enterica enterica serovar Typhi Ty2
ucagcgucuauagau

SEQ ID NO: 1775927 - RNA, 18 nt, Salmonella enterica enterica serovar Typhi Ty2
ucagcguugucccgccuu

SEQ ID NO: 1775928 - RNA, 14 nt, Salmonella enterica enterica serovar Typhi Ty2
ucagcggccagggc

SEQ ID NO: 1775929 - RNA, 19 nt, Salmonella enterica enterica serovar Typhi Ty2
ucagcgcguuuuccaucau

SEQ ID NO: 1775930 - RNA, 14 nt, Salmonella enterica enterica serovar Typhi Ty2
ucaggcaucugaaa

SEQ ID NO: 1775931 - RNA, 18 nt, Salmonella enterica enterica serovar Typhi Ty2
ucaggccgauuucauuca

SEQ ID NO: 1775932 - RNA, 16 nt, Salmonella enterica enterica serovar Typhi Ty2
ucaggccgccagcaaa

SEQ ID NO: 1775933 - RNA, 18 nt, Salmonella enterica enterica serovar Typhi Ty2
ucaggccgccgcacaggc

SEQ ID NO: 1775934 - RNA, 16 nt, Salmonella enterica enterica serovar Typhi Ty2
ucaggcgagacgcgcc

SEQ ID NO: 1775935 - RNA, 16 nt, Salmonella enterica enterica serovar Typhi Ty2
ucaggcgcauaucgcc

SEQ ID NO: 1775936 - RNA, 16 nt, Salmonella enterica enterica serovar Typhi Ty2
ucaggcgaucccggcc

SEQ ID NO: 1775937 - RNA, 16 nt, Salmonella enterica enterica serovar Typhi Ty2
ucaggccuaccaucgc

SEQ ID NO: 1775938 - RNA, 19 nt, Salmonella enterica enterica serovar Typhi Ty2
ucaggccuauagacaccuu

SEQ ID NO: 1775939 - RNA, 17 nt, Salmonella enterica enterica serovar Typhi Ty2
ucaggccuauagacacc

SEQ ID NO: 1775940 - RNA, 16 nt, Salmonella enterica enterica serovar Typhi Ty2
ucaggaggccugaaua

SEQ ID NO: 1775941 - RNA, 19 nt, Salmonella enterica enterica serovar Typhi Ty2
ucaggagcaugguccggug

SEQ ID NO: 1775942 - RNA, 15 nt, Salmonella enterica enterica serovar Typhi Ty2
ucaggaggccugaau

SEQ ID NO: 1775943 - RNA, 22 nt, Salmonella enterica enterica serovar Typhi Ty2
ucaggaggccugaauaaugacc

SEQ ID NO: 1775944 - RNA, 22 nt, Salmonella enterica enterica serovar Typhi Ty2
ucaggaugcugauuaaugauuu

SEQ ID NO: 1775945 - RNA, 17 nt, Salmonella enterica enterica serovar Typhi Ty2
ucaggcaaaaaaaaacc

SEQ ID NO: 1775946 - RNA, 17 nt, Salmonella enterica enterica serovar Typhi Ty2
ucaggcauccugcccug

SEQ ID NO: 1775947 - RNA, 14 nt, Salmonella enterica enterica serovar Typhi Ty2
ucaggcauccugcc

SEQ ID NO: 1775948 - RNA, 21 nt, Salmonella enterica enterica serovar Typhi Ty2
ucaggcauguugcgcaaucac

SEQ ID NO: 1775949 - RNA, 17 nt, Salmonella enterica enterica serovar Typhi Ty2
ucaggcaauaaacauca

SEQ ID NO: 1775950 - RNA, 23 nt, Salmonella enterica enterica serovar Typhi Ty2
ucaggcaaucuuuaacgcuggca

SEQ ID NO: 1775951 - RNA, 22 nt, Salmonella enterica enterica serovar Typhi Ty2
ucaggcaaagcauaggccacga

SEQ ID NO: 1775952 - RNA, 15 nt, Salmonella enterica enterica serovar Typhi Ty2
ucaggcagaaauaac

SEQ ID NO: 1775953 - RNA, 14 nt, Salmonella enterica enterica serovar Typhi Ty2
ucagguaucccgcc

SEQ ID NO: 1775954 - RNA, 21 nt, Salmonella enterica enterica serovar Typhi Ty2
ucaggguuuucuaccgcagcc

SEQ ID NO: 1775955 - RNA, 14 nt, Salmonella enterica enterica serovar Typhi Ty2
ucaggguaucuaac

SEQ ID NO: 1775956 - RNA, 19 nt, Salmonella enterica enterica serovar Typhi Ty2
ucaggguuauccuccagcc

SEQ ID NO: 1775957 - RNA, 21 nt, Salmonella enterica enterica serovar Typhi Ty2
ucaggguuauuuccgcuggcc

SEQ ID NO: 1775958 - RNA, 15 nt, Salmonella enterica enterica serovar Typhi Ty2
ucagguauugguaug

SEQ ID NO: 1775959 - RNA, 16 nt, Salmonella enterica enterica serovar Typhi Ty2
ucagguauuuccugcu

SEQ ID NO: 1775960 - RNA, 15 nt, Salmonella enterica enterica serovar Typhi Ty2
ucaggucauacggca

SEQ ID NO: 1775961 - RNA, 17 nt, Salmonella enterica enterica serovar Typhi Ty2
ucaggucgcuaaaaccc

SEQ ID NO: 1775962 - RNA, 19 nt, Salmonella enterica enterica serovar Typhi Ty2
ucaggugacaguccgggcc

SEQ ID NO: 1775963 - RNA, 22 nt, Salmonella enterica enterica serovar Typhi Ty2
ucagggcaaaaaugaucacuuc

SEQ ID NO: 1775964 - RNA, 19 nt, Salmonella enterica enterica serovar Typhi Ty2
ucagggcaaaaaugaucac

SEQ ID NO: 1775965 - RNA, 17 nt, Salmonella enterica enterica serovar Typhi Ty2
ucaggggcgaacccauc

SEQ ID NO: 1775966 - RNA, 17 nt, Salmonella enterica enterica serovar Typhi Ty2
ucagggaguggguaccu

SEQ ID NO: 1775967 - RNA, 15 nt, Salmonella enterica enterica serovar Typhi Ty2
ucaggcgugaugacu

SEQ ID NO: 1775968 - RNA, 21 nt, Salmonella enterica enterica serovar Typhi Ty2
ucaggcguuacagacgcugcg

SEQ ID NO: 1775969 - RNA, 14 nt, Salmonella enterica enterica serovar Typhi Ty2
ucaggcuaaauggc

SEQ ID NO: 1775970 - RNA, 18 nt, Salmonella enterica enterica serovar Typhi Ty2
ucaggcucgcaaauaauc

SEQ ID NO: 1775971 - RNA, 22 nt, Salmonella enterica enterica serovar Typhi Ty2
ucaggcucgucgccuuccagcg

SEQ ID NO: 1775972 - RNA, 18 nt, Salmonella enterica enterica serovar Typhi Ty2
ucaggcuguuguucuuuu

SEQ ID NO: 1775973 - RNA, 14 nt, Salmonella enterica enterica serovar Typhi Ty2
ucaggcuugucgcg

SEQ ID NO: 1775974 - RNA, 12 nt, Salmonella enterica enterica serovar Typhi Ty2
ucagggaaaaau

SEQ ID NO: 1775975 - RNA, 11 nt, Salmonella enterica enterica serovar Typhi Ty2
ggauugucuua

SEQ ID NO: 1775976 - RNA, 16 nt, Salmonella enterica enterica serovar Typhi Ty2
ggauuaucgaaauagc

SEQ ID NO: 1775977 - RNA, 15 nt, Salmonella enterica enterica serovar Typhi Ty2
ggauuacgacccaca

SEQ ID NO: 1775978 - RNA, 12 nt, Salmonella enterica enterica serovar Typhi Ty2
ggauggcggcgc

SEQ ID NO: 1775979 - RNA, 15 nt, Salmonella enterica enterica serovar Typhi Ty2
ggauggccugcucaa

SEQ ID NO: 1775980 - RNA, 15 nt, Salmonella enterica enterica serovar Typhi Ty2
ggauguugccacagg

SEQ ID NO: 1775981 - RNA, 20 nt, Salmonella enterica enterica serovar Typhi Ty2
ggauggcuggggaaguuaug

SEQ ID NO: 1775982 - RNA, 21 nt, Salmonella enterica enterica serovar Typhi Ty2
ggauggcgucgcuacgggcgc

SEQ ID NO: 1775983 - RNA, 13 nt, Salmonella enterica enterica serovar Typhi Ty2
ggauggcaaaaac

SEQ ID NO: 1775984 - RNA, 15 nt, Salmonella enterica enterica serovar Typhi Ty2
ggauggccucugcca

SEQ ID NO: 1775985 - RNA, 23 nt, Salmonella enterica enterica serovar Typhi Ty2
ggauggccagcaccagcauuagc

SEQ ID NO: 1775986 - RNA, 20 nt, Salmonella enterica enterica serovar Typhi Ty2
ggauggccagcaccagcauu

SEQ ID NO: 1775987 - RNA, 16 nt, Salmonella enterica enterica serovar Typhi Ty2
ggaucaauuuuucgcc

SEQ ID NO: 1775988 - RNA, 17 nt, Salmonella enterica enterica serovar Typhi Ty2
ggaucaagcaaugccag

SEQ ID NO: 1775989 - RNA, 20 nt, Salmonella enterica enterica serovar Typhi Ty2
ggaucaccugaaugcaaaga

SEQ ID NO: 1775990 - RNA, 22 nt, Salmonella enterica enterica serovar Typhi Ty2
ggaucugcuuaugaucgcccag

SEQ ID NO: 1775991 - RNA, 23 nt, Salmonella enterica enterica serovar Typhi Ty2
ggaucugcuuaugaucgcccagc

SEQ ID NO: 1775992 - RNA, 20 nt, Salmonella enterica enterica serovar Typhi Ty2
ggaucugauacggaaauagc

SEQ ID NO: 1775993 - RNA, 16 nt, Salmonella enterica enterica serovar Typhi Ty2
ggaugcauaaaaaaac

SEQ ID NO: 1775994 - RNA, 19 nt, Salmonella enterica enterica serovar Typhi Ty2
ggcaaauuaucccuuccuc

SEQ ID NO: 1775995 - RNA, 14 nt, Salmonella enterica enterica serovar Typhi Ty2
ggcaacauaaauaa

SEQ ID NO: 1775996 - RNA, 22 nt, Salmonella enterica enterica serovar Typhi Ty2
ggcaacagccauuuuaaaaaua

SEQ ID NO: 1775997 - RNA, 23 nt, Salmonella enterica enterica serovar Typhi Ty2
ggcaacagccauuuuaaaaauau

SEQ ID NO: 1775998 - RNA, 17 nt, Salmonella enterica enterica serovar Typhi Ty2
ggcaaccuucgacgagg

SEQ ID NO: 1775999 - RNA, 16 nt, Salmonella enterica enterica serovar Typhi Ty2
ggcaacgccgccagcu

SEQ ID NO: 1776000 - RNA, 20 nt, Salmonella enterica enterica serovar Typhi Ty2
ggcaacggccagcgcaggcu

SEQ ID NO: 1776001 - RNA, 19 nt, Salmonella enterica enterica serovar Typhi Ty2
ggcaacggccagcgcaggc

SEQ ID NO: 1776002 - RNA, 20 nt, Salmonella enterica enterica serovar Typhi Ty2
ggauuuuccguuaagcugga

SEQ ID NO: 1776003 - RNA, 11 nt, Salmonella enterica enterica serovar Typhi Ty2
ggauuuuaaau

SEQ ID NO: 1776004 - RNA, 17 nt, Salmonella enterica enterica serovar Typhi Ty2
ggauuuuaaauugguua

SEQ ID NO: 1776005 - RNA, 17 nt, Salmonella enterica enterica serovar Typhi Ty2
ggauuuaaaccgccccg

SEQ ID NO: 1776006 - RNA, 20 nt, Salmonella enterica enterica serovar Typhi Ty2
ggcaaaaaucagccaaagcg

SEQ ID NO: 1776007 - RNA, 21 nt, Salmonella enterica enterica serovar Typhi Ty2
ggcaaaacgccgcagaaaaug

SEQ ID NO: 1776008 - RNA, 17 nt, Salmonella enterica enterica serovar Typhi Ty2
ggcaaaacgggcggcgg

SEQ ID NO: 1776009 - RNA, 18 nt, Salmonella enterica enterica serovar Typhi Ty2
ggcaaaacgggcggcggc

SEQ ID NO: 1776010 - RNA, 14 nt, Salmonella enterica enterica serovar Typhi Ty2
ggcaaaucaacauu

SEQ ID NO: 1776011 - RNA, 22 nt, Salmonella enterica enterica serovar Typhi Ty2
ggcaaauagcguguguuuuccu

SEQ ID NO: 1776012 - RNA, 22 nt, Salmonella enterica enterica serovar Typhi Ty2
ggcaaagcucaacgcaggcugg

SEQ ID NO: 1776013 - RNA, 16 nt, Salmonella enterica enterica serovar Typhi Ty2
ggcaaaggaaugcuuu

SEQ ID NO: 1776014 - RNA, 17 nt, Salmonella enterica enterica serovar Typhi Ty2
ggcaagaugcccgucgg

SEQ ID NO: 1776015 - RNA, 15 nt, Salmonella enterica enterica serovar Typhi Ty2
ggcaagaauuaaaua

SEQ ID NO: 1776016 - RNA, 17 nt, Salmonella enterica enterica serovar Typhi Ty2
ggcaagaauuucaauca

SEQ ID NO: 1776017 - RNA, 13 nt, Salmonella enterica enterica serovar Typhi Ty2
ggcaagccagcau

SEQ ID NO: 1776018 - RNA, 19 nt, Salmonella enterica enterica serovar Typhi Ty2
ggcaagccgaucagcgugu

SEQ ID NO: 1776019 - RNA, 20 nt, Salmonella enterica enterica serovar Typhi Ty2
ggcaaggcggcaagaaagug

SEQ ID NO: 1776020 - RNA, 13 nt, Salmonella enterica enterica serovar Typhi Ty2
ggcaaucaaaucc

SEQ ID NO: 1776021 - RNA, 14 nt, Salmonella enterica enterica serovar Typhi Ty2
ggcaauaaaguuua

SEQ ID NO: 1776022 - RNA, 23 nt, Salmonella enterica enterica serovar Typhi Ty2
ggcaauagaccagcggcccgcgc

SEQ ID NO: 1776023 - RNA, 19 nt, Salmonella enterica enterica serovar Typhi Ty2
ggcaauaugcuguuuaugg

SEQ ID NO: 1776024 - RNA, 17 nt, Salmonella enterica enterica serovar Typhi Ty2
ggcaauauuaaaugacg

SEQ ID NO: 1776025 - RNA, 12 nt, Salmonella enterica enterica serovar Typhi Ty2
ggcaauaaacuc

SEQ ID NO: 1776026 - RNA, 12 nt, Salmonella enterica enterica serovar Typhi Ty2
ggcaaugccccc

SEQ ID NO: 1776027 - RNA, 17 nt, Salmonella enterica enterica serovar Typhi Ty2
ggcaaugacgguaagca

SEQ ID NO: 1776028 - RNA, 23 nt, Salmonella enterica enterica serovar Typhi Ty2
ggcaauggccagaugaaacugca

SEQ ID NO: 1776029 - RNA, 21 nt, Salmonella enterica enterica serovar Typhi Ty2
ggcaauucgcguucagaaaug

SEQ ID NO: 1776030 - RNA, 19 nt, Salmonella enterica enterica serovar Typhi Ty2
ggcacaaccuggcuugccg

SEQ ID NO: 1776031 - RNA, 21 nt, Salmonella enterica enterica serovar Typhi Ty2
ggcaauuuuuacaaauuuaaa

SEQ ID NO: 1776032 - RNA, 19 nt, Salmonella enterica enterica serovar Typhi Ty2
ggcacaauagcgcuaaaca

SEQ ID NO: 1776033 - RNA, 17 nt, Salmonella enterica enterica serovar Typhi Ty2
ggcacaauagcgcuaaa

SEQ ID NO: 1776034 - RNA, 14 nt, Salmonella enterica enterica serovar Typhi Ty2
ggcacaauagcgcu

SEQ ID NO: 1776035 - RNA, 21 nt, Salmonella enterica enterica serovar Typhi Ty2
ggcacaaccuggcuugccggg

SEQ ID NO: 1776036 - RNA, 17 nt, Salmonella enterica enterica serovar Typhi Ty2
ggcacaacggccagcaa

SEQ ID NO: 1776037 - RNA, 14 nt, Salmonella enterica enterica serovar Typhi Ty2
ggcacacagcacua

SEQ ID NO: 1776038 - RNA, 23 nt, Salmonella enterica enterica serovar Typhi Ty2
ggcacacaggccgccgggucagc

SEQ ID NO: 1776039 - RNA, 19 nt, Salmonella enterica enterica serovar Typhi Ty2
ggcaccuggagcgccuccc

SEQ ID NO: 1776040 - RNA, 18 nt, Salmonella enterica enterica serovar Typhi Ty2
ggcacggucaaucaucag

SEQ ID NO: 1776041 - RNA, 23 nt, Salmonella enterica enterica serovar Typhi Ty2
ggcacgcuccugcuccugcggcg

SEQ ID NO: 1776042 - RNA, 12 nt, Salmonella enterica enterica serovar Typhi Ty2
ggagugaacacg

SEQ ID NO: 1776043 - RNA, 17 nt, Salmonella enterica enterica serovar Typhi Ty2
ggagucugaaaauaauu

SEQ ID NO: 1776044 - RNA, 13 nt, Salmonella enterica enterica serovar Typhi Ty2
ggagucugaaaau

SEQ ID NO: 1776045 - RNA, 13 nt, Salmonella enterica enterica serovar Typhi Ty2
ggaguccagcaac

SEQ ID NO: 1776046 - RNA, 15 nt, Salmonella enterica enterica serovar Typhi Ty2
ggauacguucauccu

SEQ ID NO: 1776047 - RNA, 17 nt, Salmonella enterica enterica serovar Typhi Ty2
ggauagagaucuuccgc

SEQ ID NO: 1776048 - RNA, 17 nt, Salmonella enterica enterica serovar Typhi Ty2
ggauagaugaagacaac

SEQ ID NO: 1776049 - RNA, 14 nt, Salmonella enterica enterica serovar Typhi Ty2
ggauagcgaccagc

SEQ ID NO: 1776050 - RNA, 23 nt, Salmonella enterica enterica serovar Typhi Ty2
ggaguaguguaauaccacugccc

SEQ ID NO: 1776051 - RNA, 16 nt, Salmonella enterica enterica serovar Typhi Ty2
ggaggcgcguuuacug

SEQ ID NO: 1776052 - RNA, 16 nt, Salmonella enterica enterica serovar Typhi Ty2
ggaggccugaauaaug

SEQ ID NO: 1776053 - RNA, 16 nt, Salmonella enterica enterica serovar Typhi Ty2
ggagauauggcgggga

SEQ ID NO: 1776054 - RNA, 22 nt, Salmonella enterica enterica serovar Typhi Ty2
ggagagguuagcgcagggggga

SEQ ID NO: 1776055 - RNA, 17 nt, Salmonella enterica enterica serovar Typhi Ty2
ggagauuaacagcgcga

SEQ ID NO: 1776056 - RNA, 12 nt, Salmonella enterica enterica serovar Typhi Ty2
ggacuuucgcuu

SEQ ID NO: 1776057 - RNA, 17 nt, Salmonella enterica enterica serovar Typhi Ty2
ggacuuucgcuucacga

SEQ ID NO: 1776058 - RNA, 17 nt, Salmonella enterica enterica serovar Typhi Ty2
ggagaaaacgcggccug

SEQ ID NO: 1776059 - RNA, 13 nt, Salmonella enterica enterica serovar Typhi Ty2
ggacugggcugau

SEQ ID NO: 1776060 - RNA, 16 nt, Salmonella enterica enterica serovar Typhi Ty2
ggacugcggccugcaa

SEQ ID NO: 1776061 - RNA, 22 nt, Salmonella enterica enterica serovar Typhi Ty2
ggacugaucccacuuaggcagc

SEQ ID NO: 1776062 - RNA, 20 nt, Salmonella enterica enterica serovar Typhi Ty2
ggacggguauuacugauaaa

SEQ ID NO: 1776063 - RNA, 21 nt, Salmonella enterica enterica serovar Typhi Ty2
ggacggcuaauaugccaggcu

SEQ ID NO: 1776064 - RNA, 15 nt, Salmonella enterica enterica serovar Typhi Ty2
ggacgccaccacgcc

SEQ ID NO: 1776065 - RNA, 20 nt, Salmonella enterica enterica serovar Typhi Ty2
ggacgauaaccaugcucagc

SEQ ID NO: 1776066 - RNA, 20 nt, Salmonella enterica enterica serovar Typhi Ty2
ggacgagcgcgucagcgccu

SEQ ID NO: 1776067 - RNA, 24 nt, Salmonella enterica enterica serovar Typhi Ty2
ggaaucggacacuugcaacucgca

SEQ ID NO: 1776068 - RNA, 23 nt, Salmonella enterica enterica serovar Typhi Ty2
ggaauaagggugagaggggaucu

SEQ ID NO: 1776069 - RNA, 18 nt, Salmonella enterica enterica serovar Typhi Ty2
ggaauagauaaguccuaa

SEQ ID NO: 1776070 - RNA, 19 nt, Salmonella enterica enterica serovar Typhi Ty2
ggaauagacagugauuuac

SEQ ID NO: 1776071 - RNA, 15 nt, Salmonella enterica enterica serovar Typhi Ty2
gcucgguaaaaaguu

SEQ ID NO: 1776072 - RNA, 15 nt, Salmonella enterica enterica serovar Typhi Ty2
ggaagucagcuuccu

SEQ ID NO: 1776073 - RNA, 20 nt, Salmonella enterica enterica serovar Typhi Ty2
ggaauaagggugagagggga

SEQ ID NO: 1776074 - RNA, 15 nt, Salmonella enterica enterica serovar Typhi Ty2
ggaauaacuccagug

SEQ ID NO: 1776075 - RNA, 22 nt, Salmonella enterica enterica serovar Typhi Ty2
ggacgaacaacaucagacagua

SEQ ID NO: 1776076 - RNA, 23 nt, Salmonella enterica enterica serovar Typhi Ty2
ggaccuguguauucugcgccagc

SEQ ID NO: 1776077 - RNA, 18 nt, Salmonella enterica enterica serovar Typhi Ty2
ggaccaugauaucgccaa

SEQ ID NO: 1776078 - RNA, 17 nt, Salmonella enterica enterica serovar Typhi Ty2
ggaccggcaaucgccug

SEQ ID NO: 1776079 - RNA, 20 nt, Salmonella enterica enterica serovar Typhi Ty2
ggacagcgacacuccgcgca

SEQ ID NO: 1776080 - RNA, 15 nt, Salmonella enterica enterica serovar Typhi Ty2
ggaccagcacaaaaa

SEQ ID NO: 1776081 - RNA, 17 nt, Salmonella enterica enterica serovar Typhi Ty2
ggcauccaguuucuucg

SEQ ID NO: 1776082 - RNA, 18 nt, Salmonella enterica enterica serovar Typhi Ty2
ggcauccaguuucuucgg

SEQ ID NO: 1776083 - RNA, 17 nt, Salmonella enterica enterica serovar Typhi Ty2
ggcaucagacgguggcc

SEQ ID NO: 1776084 - RNA, 14 nt, Salmonella enterica enterica serovar Typhi Ty2
ggcaguuuauucag

SEQ ID NO: 1776085 - RNA, 20 nt, Salmonella enterica enterica serovar Typhi Ty2
ggcaguuuaagcgccgauaa

SEQ ID NO: 1776086 - RNA, 17 nt, Salmonella enterica enterica serovar Typhi Ty2
ggcauaaaaagccaucc

SEQ ID NO: 1776087 - RNA, 23 nt, Salmonella enterica enterica serovar Typhi Ty2
ggcagguuuuuuuauaacauaaa

SEQ ID NO: 1776088 - RNA, 17 nt, Salmonella enterica enterica serovar Typhi Ty2
ggcagguaucgauacag

SEQ ID NO: 1776089 - RNA, 18 nt, Salmonella enterica enterica serovar Typhi Ty2
ggcagggaugacagaaag

SEQ ID NO: 1776090 - RNA, 18 nt, Salmonella enterica enterica serovar Typhi Ty2
ggcagaaaaaucagcauu

SEQ ID NO: 1776091 - RNA, 10 nt, Salmonella enterica enterica serovar Typhi Ty2
ggcagaaccu

SEQ ID NO: 1776092 - RNA, 17 nt, Salmonella enterica enterica serovar Typhi Ty2
ggcauuccgcuggugcg

SEQ ID NO: 1776093 - RNA, 22 nt, Salmonella enterica enterica serovar Typhi Ty2
ggcaugauguccagcgcgccgg

SEQ ID NO: 1776094 - RNA, 16 nt, Salmonella enterica enterica serovar Typhi Ty2
ggcaugauuaaagcca

SEQ ID NO: 1776095 - RNA, 18 nt, Salmonella enterica enterica serovar Typhi Ty2
ggcauccgugaccugcug

SEQ ID NO: 1776096 - RNA, 19 nt, Salmonella enterica enterica serovar Typhi Ty2
ggcaucuuaaagcgggcuu

SEQ ID NO: 1776097 - RNA, 15 nt, Salmonella enterica enterica serovar Typhi Ty2
ggcaugaagaaaaua

SEQ ID NO: 1776098 - RNA, 19 nt, Salmonella enterica enterica serovar Typhi Ty2
ggcaucucaucuugcagga

SEQ ID NO: 1776099 - RNA, 15 nt, Salmonella enterica enterica serovar Typhi Ty2
ggcauuucaggcacu

SEQ ID NO: 1776100 - RNA, 18 nt, Salmonella enterica enterica serovar Typhi Ty2
ggcauuuuauuaccuggu

SEQ ID NO: 1776101 - RNA, 20 nt, Salmonella enterica enterica serovar Typhi Ty2
ggccaaaacccaccagcagg

SEQ ID NO: 1776102 - RNA, 13 nt, Salmonella enterica enterica serovar Typhi Ty2
ggccaagcgccug

SEQ ID NO: 1776103 - RNA, 17 nt, Salmonella enterica enterica serovar Typhi Ty2
ggccaagcgccuguuca

SEQ ID NO: 1776104 - RNA, 21 nt, Salmonella enterica enterica serovar Typhi Ty2
ggccaacauagcggcaaggaa

SEQ ID NO: 1776105 - RNA, 12 nt, Salmonella enterica enterica serovar Typhi Ty2
ggccagcuccgc

SEQ ID NO: 1776106 - RNA, 19 nt, Salmonella enterica enterica serovar Typhi Ty2
ggccagcguggaugaacuc

SEQ ID NO: 1776107 - RNA, 17 nt, Salmonella enterica enterica serovar Typhi Ty2
ggccagcguaccugcgg

SEQ ID NO: 1776108 - RNA, 16 nt, Salmonella enterica enterica serovar Typhi Ty2
ggccagggacaggaga

SEQ ID NO: 1776109 - RNA, 13 nt, Salmonella enterica enterica serovar Typhi Ty2
ggccagggcaggc

SEQ ID NO: 1776110 - RNA, 15 nt, Salmonella enterica enterica serovar Typhi Ty2
ggccauuugucucuu

SEQ ID NO: 1776111 - RNA, 21 nt, Salmonella enterica enterica serovar Typhi Ty2
ggccaguagcgggggccggcu

SEQ ID NO: 1776112 - RNA, 16 nt, Salmonella enterica enterica serovar Typhi Ty2
ggccaguagcgggggc

SEQ ID NO: 1776113 - RNA, 15 nt, Salmonella enterica enterica serovar Typhi Ty2
ggccagucgcagaug

SEQ ID NO: 1776114 - RNA, 17 nt, Salmonella enterica enterica serovar Typhi Ty2
ggccaucuuccagcauc

SEQ ID NO: 1776115 - RNA, 21 nt, Salmonella enterica enterica serovar Typhi Ty2
ggccaucuuccagcaucagca

SEQ ID NO: 1776116 - RNA, 16 nt, Salmonella enterica enterica serovar Typhi Ty2
ggccagcgcaggcugg

SEQ ID NO: 1776117 - RNA, 22 nt, Salmonella enterica enterica serovar Typhi Ty2
ggccagccguaacgagugagga

SEQ ID NO: 1776118 - RNA, 20 nt, Salmonella enterica enterica serovar Typhi Ty2
ggccagaaguagcagagaaa

SEQ ID NO: 1776119 - RNA, 12 nt, Salmonella enterica enterica serovar Typhi Ty2
ggccaccacaua

SEQ ID NO: 1776120 - RNA, 21 nt, Salmonella enterica enterica serovar Typhi Ty2
ggccacgguguggcccagcgc

SEQ ID NO: 1776121 - RNA, 13 nt, Salmonella enterica enterica serovar Typhi Ty2
ggccaauccugca

SEQ ID NO: 1776122 - RNA, 16 nt, Salmonella enterica enterica serovar Typhi Ty2
ggcccguugucuucac

SEQ ID NO: 1776123 - RNA, 21 nt, Salmonella enterica enterica serovar Typhi Ty2
ggcccgguaagcgcuagcgcc

SEQ ID NO: 1776124 - RNA, 20 nt, Salmonella enterica enterica serovar Typhi Ty2
ggcccgguaagcgcagcgcc

SEQ ID NO: 1776125 - RNA, 20 nt, Salmonella enterica enterica serovar Typhi Ty2
ggcccgguggcguggcgcca

SEQ ID NO: 1776126 - RNA, 18 nt, Salmonella enterica enterica serovar Typhi Ty2
ggcccgguaagcgcagcg

SEQ ID NO: 1776127 - RNA, 14 nt, Salmonella enterica enterica serovar Typhi Ty2
ggcccgcggcgacg

SEQ ID NO: 1776128 - RNA, 18 nt, Salmonella enterica enterica serovar Typhi Ty2
ggcccgccgcuggcuggc

SEQ ID NO: 1776129 - RNA, 18 nt, Salmonella enterica enterica serovar Typhi Ty2
ggccgccaaugacaauaa

SEQ ID NO: 1776130 - RNA, 20 nt, Salmonella enterica enterica serovar Typhi Ty2
ggccgcgcugaugugcggcc

SEQ ID NO: 1776131 - RNA, 14 nt, Salmonella enterica enterica serovar Typhi Ty2
ggccgucggcgcca

SEQ ID NO: 1776132 - RNA, 20 nt, Salmonella enterica enterica serovar Typhi Ty2
ggccgcgugcucgcggcgga

SEQ ID NO: 1776133 - RNA, 23 nt, Salmonella enterica enterica serovar Typhi Ty2
ggccgcuuaauaauaagcggccu

SEQ ID NO: 1776134 - RNA, 20 nt, Salmonella enterica enterica serovar Typhi Ty2
ggccgcuuacugugccgccg

SEQ ID NO: 1776135 - RNA, 22 nt, Salmonella enterica enterica serovar Typhi Ty2
ggccgcucgccauaucuucuac

SEQ ID NO: 1776136 - RNA, 21 nt, Salmonella enterica enterica serovar Typhi Ty2
ggccggauaaggcgcuagccg

SEQ ID NO: 1776137 - RNA, 16 nt, Salmonella enterica enterica serovar Typhi Ty2
ggccggaugaggcgca

SEQ ID NO: 1776138 - RNA, 18 nt, Salmonella enterica enterica serovar Typhi Ty2
ggcgauuuucauagcugg

SEQ ID NO: 1776139 - RNA, 21 nt, Salmonella enterica enterica serovar Typhi Ty2
ggcgauuuccagcgccgcgcg

SEQ ID NO: 1776140 - RNA, 17 nt, Salmonella enterica enterica serovar Typhi Ty2
ggcgauugcggaggccg

SEQ ID NO: 1776141 - RNA, 22 nt, Salmonella enterica enterica serovar Typhi Ty2
ggcgcaaacgcgugcugguguc

SEQ ID NO: 1776142 - RNA, 21 nt, Salmonella enterica enterica serovar Typhi Ty2
ggcgcaaagcaauguaaaacu

SEQ ID NO: 1776143 - RNA, 16 nt, Salmonella enterica enterica serovar Typhi Ty2
ggcgcaaccgacgggc

SEQ ID NO: 1776144 - RNA, 20 nt, Salmonella enterica enterica serovar Typhi Ty2
ggcgauguaacgccuuugcc

SEQ ID NO: 1776145 - RNA, 17 nt, Salmonella enterica enterica serovar Typhi Ty2
ggcgaguagcgcagcuu

SEQ ID NO: 1776146 - RNA, 12 nt, Salmonella enterica enterica serovar Typhi Ty2
ggcgauaaucuc

SEQ ID NO: 1776147 - RNA, 17 nt, Salmonella enterica enterica serovar Typhi Ty2
ggcgauaaaccagcccc

SEQ ID NO: 1776148 - RNA, 21 nt, Salmonella enterica enterica serovar Typhi Ty2
ggcgauaaaccaacagccgcc

SEQ ID NO: 1776149 - RNA, 22 nt, Salmonella enterica enterica serovar Typhi Ty2
ggcgauaaaccaacagccgccu

SEQ ID NO: 1776150 - RNA, 20 nt, Salmonella enterica enterica serovar Typhi Ty2
ggcgaguuuggugcccgcgu

SEQ ID NO: 1776151 - RNA, 16 nt, Salmonella enterica enterica serovar Typhi Ty2
ggcgaucagacgcugg

SEQ ID NO: 1776152 - RNA, 19 nt, Salmonella enterica enterica serovar Typhi Ty2
ggcgaucagcgccaccaca

SEQ ID NO: 1776153 - RNA, 17 nt, Salmonella enterica enterica serovar Typhi Ty2
ggcgauagcgccccaaa

SEQ ID NO: 1776154 - RNA, 14 nt, Salmonella enterica enterica serovar Typhi Ty2
ggcgauagccccag

SEQ ID NO: 1776155 - RNA, 14 nt, Salmonella enterica enterica serovar Typhi Ty2
ggcgauaucuucgg

SEQ ID NO: 1776156 - RNA, 18 nt, Salmonella enterica enterica serovar Typhi Ty2
ggcgcauacgaucugaca

SEQ ID NO: 1776157 - RNA, 16 nt, Salmonella enterica enterica serovar Typhi Ty2
ggcgcaguucgccgcc

SEQ ID NO: 1776158 - RNA, 20 nt, Salmonella enterica enterica serovar Typhi Ty2
ggcgcaguucgccgccagga

SEQ ID NO: 1776159 - RNA, 21 nt, Salmonella enterica enterica serovar Typhi Ty2
ggcgcaguauggcgaccagga

SEQ ID NO: 1776160 - RNA, 23 nt, Salmonella enterica enterica serovar Typhi Ty2
ggcgcauaaugacguccaggccg

SEQ ID NO: 1776161 - RNA, 12 nt, Salmonella enterica enterica serovar Typhi Ty2
ggcgcaucagaa

SEQ ID NO: 1776162 - RNA, 13 nt, Salmonella enterica enterica serovar Typhi Ty2
ggcgcagcgcggg

SEQ ID NO: 1776163 - RNA, 14 nt, Salmonella enterica enterica serovar Typhi Ty2
ggcgcagcgcggga

SEQ ID NO: 1776164 - RNA, 11 nt, Salmonella enterica enterica serovar Typhi Ty2
ggcgcaggcaa

SEQ ID NO: 1776165 - RNA, 20 nt, Salmonella enterica enterica serovar Typhi Ty2
ggcgcaggcauuaaaaaaac

SEQ ID NO: 1776166 - RNA, 21 nt, Salmonella enterica enterica serovar Typhi Ty2
ggcgcacgcgucaucggcgcg

SEQ ID NO: 1776167 - RNA, 16 nt, Salmonella enterica enterica serovar Typhi Ty2
ggcgcagcgcccagca

SEQ ID NO: 1776168 - RNA, 21 nt, Salmonella enterica enterica serovar Typhi Ty2
ggcgcaauccgcgccgcaucu

SEQ ID NO: 1776169 - RNA, 19 nt, Salmonella enterica enterica serovar Typhi Ty2
ggcgcaaucuuugccgcaa

SEQ ID NO: 1776170 - RNA, 20 nt, Salmonella enterica enterica serovar Typhi Ty2
ggcgcaacguuugccagcgu

SEQ ID NO: 1776171 - RNA, 22 nt, Salmonella enterica enterica serovar Typhi Ty2
ggcgcacauuuacgccagccag

SEQ ID NO: 1776172 - RNA, 18 nt, Salmonella enterica enterica serovar Typhi Ty2
ggcgcaccaaagugcgcc

SEQ ID NO: 1776173 - RNA, 13 nt, Salmonella enterica enterica serovar Typhi Ty2
ggcgcacagcgcc

SEQ ID NO: 1776174 - RNA, 17 nt, Salmonella enterica enterica serovar Typhi Ty2
ggcgccgaagcaggcgg

SEQ ID NO: 1776175 - RNA, 16 nt, Salmonella enterica enterica serovar Typhi Ty2
ggcgccgcaaaccaga

SEQ ID NO: 1776176 - RNA, 15 nt, Salmonella enterica enterica serovar Typhi Ty2
ggcgcccauccgccc

SEQ ID NO: 1776177 - RNA, 15 nt, Salmonella enterica enterica serovar Typhi Ty2
ggcgccaucgccucc

SEQ ID NO: 1776178 - RNA, 17 nt, Salmonella enterica enterica serovar Typhi Ty2
ggcgccaucgccuccag

SEQ ID NO: 1776179 - RNA, 11 nt, Salmonella enterica enterica serovar Typhi Ty2
ggcgccaguac

SEQ ID NO: 1776180 - RNA, 22 nt, Salmonella enterica enterica serovar Typhi Ty2
ggcgcgaaacugcugccgcagc

SEQ ID NO: 1776181 - RNA, 15 nt, Salmonella enterica enterica serovar Typhi Ty2
ggcgccucgcgcggc

SEQ ID NO: 1776182 - RNA, 16 nt, Salmonella enterica enterica serovar Typhi Ty2
ggcgccggggcagcaa

SEQ ID NO: 1776183 - RNA, 18 nt, Salmonella enterica enterica serovar Typhi Ty2
ggccuccuuuccugugcu

SEQ ID NO: 1776184 - RNA, 13 nt, Salmonella enterica enterica serovar Typhi Ty2
ggccuccuggcuu

SEQ ID NO: 1776185 - RNA, 14 nt, Salmonella enterica enterica serovar Typhi Ty2
ggccucauccgcau

SEQ ID NO: 1776186 - RNA, 20 nt, Salmonella enterica enterica serovar Typhi Ty2
ggccucuucacgcagcgccu

SEQ ID NO: 1776187 - RNA, 20 nt, Salmonella enterica enterica serovar Typhi Ty2
ggccugaauaaugaccucca

SEQ ID NO: 1776188 - RNA, 17 nt, Salmonella enterica enterica serovar Typhi Ty2
ggccuacagacuguacc

SEQ ID NO: 1776189 - RNA, 20 nt, Salmonella enterica enterica serovar Typhi Ty2
ggccuacacucugcgcgcga

SEQ ID NO: 1776190 - RNA, 23 nt, Salmonella enterica enterica serovar Typhi Ty2
ggccuacaaaaucgcccaggccu

SEQ ID NO: 1776191 - RNA, 23 nt, Salmonella enterica enterica serovar Typhi Ty2
ggccuacauuuuuacaguuacca

SEQ ID NO: 1776192 - RNA, 15 nt, Salmonella enterica enterica serovar Typhi Ty2
ggccguuuucccggc

SEQ ID NO: 1776193 - RNA, 20 nt, Salmonella enterica enterica serovar Typhi Ty2
ggccuacggauucgcugcug

SEQ ID NO: 1776194 - RNA, 23 nt, Salmonella enterica enterica serovar Typhi Ty2
ggccguucauucgccccagcaua

SEQ ID NO: 1776195 - RNA, 23 nt, Salmonella enterica enterica serovar Typhi Ty2
ggccugugccugacagcaaugag

SEQ ID NO: 1776196 - RNA, 16 nt, Salmonella enterica enterica serovar Typhi Ty2
ggccugucacguaaaa

SEQ ID NO: 1776197 - RNA, 15 nt, Salmonella enterica enterica serovar Typhi Ty2
ggccugucaggccug

SEQ ID NO: 1776198 - RNA, 18 nt, Salmonella enterica enterica serovar Typhi Ty2
ggccuggcugagaaaaau

SEQ ID NO: 1776199 - RNA, 19 nt, Salmonella enterica enterica serovar Typhi Ty2
ggccuggcuuguuacugca

SEQ ID NO: 1776200 - RNA, 14 nt, Salmonella enterica enterica serovar Typhi Ty2
ggccuuauuuuuca

SEQ ID NO: 1776201 - RNA, 12 nt, Salmonella enterica enterica serovar Typhi Ty2
ggccuucugcua

SEQ ID NO: 1776202 - RNA, 17 nt, Salmonella enterica enterica serovar Typhi Ty2
ggccuugccagcgagaa

SEQ ID NO: 1776203 - RNA, 22 nt, Salmonella enterica enterica serovar Typhi Ty2
ggccuugaaguuauccagcgcc

SEQ ID NO: 1776204 - RNA, 12 nt, Salmonella enterica enterica serovar Typhi Ty2
ggccugcuccgu

SEQ ID NO: 1776205 - RNA, 15 nt, Salmonella enterica enterica serovar Typhi Ty2
ggccugcggaaaaag

SEQ ID NO: 1776206 - RNA, 19 nt, Salmonella enterica enterica serovar Typhi Ty2
ggccugcacaagaaacaug

SEQ ID NO: 1776207 - RNA, 22 nt, Salmonella enterica enterica serovar Typhi Ty2
ggccugauaagacgcaucgcgu

SEQ ID NO: 1776208 - RNA, 15 nt, Salmonella enterica enterica serovar Typhi Ty2
ggcgagcacugccca

SEQ ID NO: 1776209 - RNA, 22 nt, Salmonella enterica enterica serovar Typhi Ty2
ggcgagagaauuaacagcgcga

SEQ ID NO: 1776210 - RNA, 22 nt, Salmonella enterica enterica serovar Typhi Ty2
ggcgagagcauugccugauucg

SEQ ID NO: 1776211 - RNA, 20 nt, Salmonella enterica enterica serovar Typhi Ty2
ggcgagauguuuuaccagua

SEQ ID NO: 1776212 - RNA, 18 nt, Salmonella enterica enterica serovar Typhi Ty2
ggcgacuagucgcccgcu

SEQ ID NO: 1776213 - RNA, 19 nt, Salmonella enterica enterica serovar Typhi Ty2
ggcgacuggaacaggccaa

SEQ ID NO: 1776214 - RNA, 23 nt, Salmonella enterica enterica serovar Typhi Ty2
ggcgagcggcaccggacauccca

SEQ ID NO: 1776215 - RNA, 16 nt, Salmonella enterica enterica serovar Typhi Ty2
ggcgacgauacaacuc

SEQ ID NO: 1776216 - RNA, 17 nt, Salmonella enterica enterica serovar Typhi Ty2
ggcgacgucagacgagg

SEQ ID NO: 1776217 - RNA, 18 nt, Salmonella enterica enterica serovar Typhi Ty2
ggcgacggcggucgccgc

SEQ ID NO: 1776218 - RNA, 22 nt, Salmonella enterica enterica serovar Typhi Ty2
ggcgacgguacaaaccccaccc

SEQ ID NO: 1776219 - RNA, 21 nt, Salmonella enterica enterica serovar Typhi Ty2
ggcgaauauagcuaaugcaau

SEQ ID NO: 1776220 - RNA, 14 nt, Salmonella enterica enterica serovar Typhi Ty2
ggcgaaucgccugu

SEQ ID NO: 1776221 - RNA, 16 nt, Salmonella enterica enterica serovar Typhi Ty2
ggcgaauccuaaacuc

SEQ ID NO: 1776222 - RNA, 15 nt, Salmonella enterica enterica serovar Typhi Ty2
ggcgaaggcggcggc

SEQ ID NO: 1776223 - RNA, 20 nt, Salmonella enterica enterica serovar Typhi Ty2
ggcgacagggauauuccaua

SEQ ID NO: 1776224 - RNA, 13 nt, Salmonella enterica enterica serovar Typhi Ty2
ggcgacagccgcg

SEQ ID NO: 1776225 - RNA, 16 nt, Salmonella enterica enterica serovar Typhi Ty2
ggcgacaaacagcgcc

SEQ ID NO: 1776226 - RNA, 19 nt, Salmonella enterica enterica serovar Typhi Ty2
ggcgaccaguuuagcuaaa

SEQ ID NO: 1776227 - RNA, 18 nt, Salmonella enterica enterica serovar Typhi Ty2
ggcgaacuucauccacgc

SEQ ID NO: 1776228 - RNA, 23 nt, Salmonella enterica enterica serovar Typhi Ty2
ggcgaacguuuuuucgcacgccu

SEQ ID NO: 1776229 - RNA, 12 nt, Salmonella enterica enterica serovar Typhi Ty2
ggcgaacauaag

SEQ ID NO: 1776230 - RNA, 14 nt, Salmonella enterica enterica serovar Typhi Ty2
ggcgaacaggcuca

SEQ ID NO: 1776231 - RNA, 15 nt, Salmonella enterica enterica serovar Typhi Ty2
ggcgaacaggcucag

SEQ ID NO: 1776232 - RNA, 17 nt, Salmonella enterica enterica serovar Typhi Ty2
ggcuauuaccggcugga

SEQ ID NO: 1776233 - RNA, 21 nt, Salmonella enterica enterica serovar Typhi Ty2
ggcuaugaagcuggagccaca

SEQ ID NO: 1776234 - RNA, 15 nt, Salmonella enterica enterica serovar Typhi Ty2
ggcuaugaagagaaa

SEQ ID NO: 1776235 - RNA, 21 nt, Salmonella enterica enterica serovar Typhi Ty2
ggcuaucgcacuggcgccugc

SEQ ID NO: 1776236 - RNA, 15 nt, Salmonella enterica enterica serovar Typhi Ty2
ggcuaucaauguuua

SEQ ID NO: 1776237 - RNA, 17 nt, Salmonella enterica enterica serovar Typhi Ty2
ggcuaauaugccaggcu

SEQ ID NO: 1776238 - RNA, 17 nt, Salmonella enterica enterica serovar Typhi Ty2
ggcuaagccagaagaua

SEQ ID NO: 1776239 - RNA, 13 nt, Salmonella enterica enterica serovar Typhi Ty2
ggcuacccagaca

SEQ ID NO: 1776240 - RNA, 21 nt, Salmonella enterica enterica serovar Typhi Ty2
ggcuacguacacagucaaaca

SEQ ID NO: 1776241 - RNA, 12 nt, Salmonella enterica enterica serovar Typhi Ty2
ggcuacccauga

SEQ ID NO: 1776242 - RNA, 19 nt, Salmonella enterica enterica serovar Typhi Ty2
ggcguuuauauaaaaauag

SEQ ID NO: 1776243 - RNA, 21 nt, Salmonella enterica enterica serovar Typhi Ty2
ggcguugcgccgccaggcaug

SEQ ID NO: 1776244 - RNA, 21 nt, Salmonella enterica enterica serovar Typhi Ty2
ggcguuccgcacauaaucacc

SEQ ID NO: 1776245 - RNA, 20 nt, Salmonella enterica enterica serovar Typhi Ty2
ggcguugcgccgccaggcau

SEQ ID NO: 1776246 - RNA, 19 nt, Salmonella enterica enterica serovar Typhi Ty2
ggcguugcgcccaggccaa

SEQ ID NO: 1776247 - RNA, 17 nt, Salmonella enterica enterica serovar Typhi Ty2
ggcguuaucuugacaug

SEQ ID NO: 1776248 - RNA, 18 nt, Salmonella enterica enterica serovar Typhi Ty2
ggcguuaucuugacauga

SEQ ID NO: 1776249 - RNA, 23 nt, Salmonella enterica enterica serovar Typhi Ty2
ggcguuacuccgcgguagagcgc

SEQ ID NO: 1776250 - RNA, 23 nt, Salmonella enterica enterica serovar Typhi Ty2
ggcguuacuggcgaccggcagcc

SEQ ID NO: 1776251 - RNA, 21 nt, Salmonella enterica enterica serovar Typhi Ty2
ggcguccggccacuauuucgg

SEQ ID NO: 1776252 - RNA, 21 nt, Salmonella enterica enterica serovar Typhi Ty2
ggcgucgugcugggcgcgccu

SEQ ID NO: 1776253 - RNA, 17 nt, Salmonella enterica enterica serovar Typhi Ty2
ggcgugccgggcuggcg

SEQ ID NO: 1776254 - RNA, 12 nt, Salmonella enterica enterica serovar Typhi Ty2
ggcguguaacug

SEQ ID NO: 1776255 - RNA, 21 nt, Salmonella enterica enterica serovar Typhi Ty2
ggcgugucaucaaaaucgggc

SEQ ID NO: 1776256 - RNA, 23 nt, Salmonella enterica enterica serovar Typhi Ty2
ggcguuaaugcgcgcuucuucau

SEQ ID NO: 1776257 - RNA, 17 nt, Salmonella enterica enterica serovar Typhi Ty2
ggcgugucgccggggcg

SEQ ID NO: 1776258 - RNA, 17 nt, Salmonella enterica enterica serovar Typhi Ty2
ggcguguugaaauccuc

SEQ ID NO: 1776259 - RNA, 20 nt, Salmonella enterica enterica serovar Typhi Ty2
ggcggugaagacgacgggaa

SEQ ID NO: 1776260 - RNA, 18 nt, Salmonella enterica enterica serovar Typhi Ty2
ggcgguuugacggcugca

SEQ ID NO: 1776261 - RNA, 17 nt, Salmonella enterica enterica serovar Typhi Ty2
ggcguaaaaaggcgcau

SEQ ID NO: 1776262 - RNA, 13 nt, Salmonella enterica enterica serovar Typhi Ty2
ggcguaaaacugg

SEQ ID NO: 1776263 - RNA, 21 nt, Salmonella enterica enterica serovar Typhi Ty2
ggcguaaaagcgauaaagaca

SEQ ID NO: 1776264 - RNA, 13 nt, Salmonella enterica enterica serovar Typhi Ty2
ggcguaagaaaag

SEQ ID NO: 1776265 - RNA, 12 nt, Salmonella enterica enterica serovar Typhi Ty2
ggcguaccagaa

SEQ ID NO: 1776266 - RNA, 17 nt, Salmonella enterica enterica serovar Typhi Ty2
ggcguauagccgccccc

SEQ ID NO: 1776267 - RNA, 14 nt, Salmonella enterica enterica serovar Typhi Ty2
ggcgucaaaauccc

SEQ ID NO: 1776268 - RNA, 17 nt, Salmonella enterica enterica serovar Typhi Ty2
ggcguagccgccgagcg

SEQ ID NO: 1776269 - RNA, 21 nt, Salmonella enterica enterica serovar Typhi Ty2
ggcguacuaaauaggcggcau

SEQ ID NO: 1776270 - RNA, 19 nt, Salmonella enterica enterica serovar Typhi Ty2
ggcgucacguucgucgccg

SEQ ID NO: 1776271 - RNA, 22 nt, Salmonella enterica enterica serovar Typhi Ty2
ggcgucauagccgcgcgucagc

SEQ ID NO: 1776272 - RNA, 16 nt, Salmonella enterica enterica serovar Typhi Ty2
ggcgucauccugcagg

SEQ ID NO: 1776273 - RNA, 15 nt, Salmonella enterica enterica serovar Typhi Ty2
ggcgggaucggggcg

SEQ ID NO: 1776274 - RNA, 14 nt, Salmonella enterica enterica serovar Typhi Ty2
ggcgggcagcagca

SEQ ID NO: 1776275 - RNA, 20 nt, Salmonella enterica enterica serovar Typhi Ty2
ggcgggcagcagcaggcugg

SEQ ID NO: 1776276 - RNA, 20 nt, Salmonella enterica enterica serovar Typhi Ty2
ggcgggcgauagagaccgcu

SEQ ID NO: 1776277 - RNA, 20 nt, Salmonella enterica enterica serovar Typhi Ty2
ggcgggcugaaaucacgcca

SEQ ID NO: 1776278 - RNA, 16 nt, Salmonella enterica enterica serovar Typhi Ty2
ggcggggcagaaccug

SEQ ID NO: 1776279 - RNA, 20 nt, Salmonella enterica enterica serovar Typhi Ty2
ggcgguaaauacgcggcacg

SEQ ID NO: 1776280 - RNA, 18 nt, Salmonella enterica enterica serovar Typhi Ty2
ggcgggugcgcagcccca

SEQ ID NO: 1776281 - RNA, 14 nt, Salmonella enterica enterica serovar Typhi Ty2
ggcgguaugaaagc

SEQ ID NO: 1776282 - RNA, 14 nt, Salmonella enterica enterica serovar Typhi Ty2
ggcgcugaagccug

SEQ ID NO: 1776283 - RNA, 23 nt, Salmonella enterica enterica serovar Typhi Ty2
ggcgcucggaugugcauugacua

SEQ ID NO: 1776284 - RNA, 13 nt, Salmonella enterica enterica serovar Typhi Ty2
ggcgcuaaugcuu

SEQ ID NO: 1776285 - RNA, 17 nt, Salmonella enterica enterica serovar Typhi Ty2
ggcgcucaauagccaga

SEQ ID NO: 1776286 - RNA, 14 nt, Salmonella enterica enterica serovar Typhi Ty2
ggcgcuauucccag

SEQ ID NO: 1776287 - RNA, 19 nt, Salmonella enterica enterica serovar Typhi Ty2
ggcgcuacgccaucaggca

SEQ ID NO: 1776288 - RNA, 20 nt, Salmonella enterica enterica serovar Typhi Ty2
ggcgcugcuggcagcgcuga

SEQ ID NO: 1776289 - RNA, 15 nt, Salmonella enterica enterica serovar Typhi Ty2
ggcgcuuccugcagu

SEQ ID NO: 1776290 - RNA, 14 nt, Salmonella enterica enterica serovar Typhi Ty2
ggcggaauggcggg

SEQ ID NO: 1776291 - RNA, 23 nt, Salmonella enterica enterica serovar Typhi Ty2
ggcggaaguagccuccggcggug

SEQ ID NO: 1776292 - RNA, 12 nt, Salmonella enterica enterica serovar Typhi Ty2
ggcggaagaggc

SEQ ID NO: 1776293 - RNA, 18 nt, Salmonella enterica enterica serovar Typhi Ty2
ggcggaaaauagccagaa

SEQ ID NO: 1776294 - RNA, 13 nt, Salmonella enterica enterica serovar Typhi Ty2
ggcggaaaucaac

SEQ ID NO: 1776295 - RNA, 17 nt, Salmonella enterica enterica serovar Typhi Ty2
ggcgcuuuuccagcacg

SEQ ID NO: 1776296 - RNA, 11 nt, Salmonella enterica enterica serovar Typhi Ty2
ggcgcgcuggc

SEQ ID NO: 1776297 - RNA, 13 nt, Salmonella enterica enterica serovar Typhi Ty2
ggcgcggaaggga

SEQ ID NO: 1776298 - RNA, 13 nt, Salmonella enterica enterica serovar Typhi Ty2
ggcgcgcguacug

SEQ ID NO: 1776299 - RNA, 15 nt, Salmonella enterica enterica serovar Typhi Ty2
ggcgcggggaacaca

SEQ ID NO: 1776300 - RNA, 22 nt, Salmonella enterica enterica serovar Typhi Ty2
ggcgcgucuucccggcgcucgg

SEQ ID NO: 1776301 - RNA, 14 nt, Salmonella enterica enterica serovar Typhi Ty2
ggcggcguccggca

SEQ ID NO: 1776302 - RNA, 14 nt, Salmonella enterica enterica serovar Typhi Ty2
ggcggcggcgggaa

SEQ ID NO: 1776303 - RNA, 14 nt, Salmonella enterica enterica serovar Typhi Ty2
ggcggcgcgcaggc

SEQ ID NO: 1776304 - RNA, 14 nt, Salmonella enterica enterica serovar Typhi Ty2
ggcggcgcgcugcc

SEQ ID NO: 1776305 - RNA, 20 nt, Salmonella enterica enterica serovar Typhi Ty2
ggcggcgacuggcuaaacaa

SEQ ID NO: 1776306 - RNA, 21 nt, Salmonella enterica enterica serovar Typhi Ty2
ggcggacccaaaagaaguggc

SEQ ID NO: 1776307 - RNA, 20 nt, Salmonella enterica enterica serovar Typhi Ty2
ggcggacaacgcuccagcag

SEQ ID NO: 1776308 - RNA, 13 nt, Salmonella enterica enterica serovar Typhi Ty2
ggcggacagcggc

SEQ ID NO: 1776309 - RNA, 16 nt, Salmonella enterica enterica serovar Typhi Ty2
ggcggagggauuuuaa

SEQ ID NO: 1776310 - RNA, 21 nt, Salmonella enterica enterica serovar Typhi Ty2
ggcggauacagcggcgcgcca

SEQ ID NO: 1776311 - RNA, 12 nt, Salmonella enterica enterica serovar Typhi Ty2
ggcggcaaaaaa

SEQ ID NO: 1776312 - RNA, 13 nt, Salmonella enterica enterica serovar Typhi Ty2
ggcggcaaagaaa

SEQ ID NO: 1776313 - RNA, 19 nt, Salmonella enterica enterica serovar Typhi Ty2
ggcggcaagggagugaguc

SEQ ID NO: 1776314 - RNA, 22 nt, Salmonella enterica enterica serovar Typhi Ty2
ggcggauuccaguagcgcgccc

SEQ ID NO: 1776315 - RNA, 19 nt, Salmonella enterica enterica serovar Typhi Ty2
gucaguagcguucuuucca

SEQ ID NO: 1776316 - RNA, 15 nt, Salmonella enterica enterica serovar Typhi Ty2
gucaguaauaugaau

SEQ ID NO: 1776317 - RNA, 15 nt, Salmonella enterica enterica serovar Typhi Ty2
gucagguuuucuauc

SEQ ID NO: 1776318 - RNA, 20 nt, Salmonella enterica enterica serovar Typhi Ty2
gucaggugggaccaccgcgc

SEQ ID NO: 1776319 - RNA, 23 nt, Salmonella enterica enterica serovar Typhi Ty2
gucagggucuuauuucuccugcg

SEQ ID NO: 1776320 - RNA, 21 nt, Salmonella enterica enterica serovar Typhi Ty2
gucagggugaauaccagcggc

SEQ ID NO: 1776321 - RNA, 19 nt, Salmonella enterica enterica serovar Typhi Ty2
gucagguaagcuauuacaa

SEQ ID NO: 1776322 - RNA, 22 nt, Salmonella enterica enterica serovar Typhi Ty2
gucagucgccagaaggcaggcu

SEQ ID NO: 1776323 - RNA, 14 nt, Salmonella enterica enterica serovar Typhi Ty2
gucaguggaaaaca

SEQ ID NO: 1776324 - RNA, 14 nt, Salmonella enterica enterica serovar Typhi Ty2
gucaguuccauaau

SEQ ID NO: 1776325 - RNA, 19 nt, Salmonella enterica enterica serovar Typhi Ty2
gucagugagcccuccucca

SEQ ID NO: 1776326 - RNA, 19 nt, Salmonella enterica enterica serovar Typhi Ty2
gucauuacgguauuuauca

SEQ ID NO: 1776327 - RNA, 19 nt, Salmonella enterica enterica serovar Typhi Ty2
gucaugccaucauuaauuu

SEQ ID NO: 1776328 - RNA, 17 nt, Salmonella enterica enterica serovar Typhi Ty2
gucaugccaucauuaau

SEQ ID NO: 1776329 - RNA, 17 nt, Salmonella enterica enterica serovar Typhi Ty2
gucaugacgcuggaagu

SEQ ID NO: 1776330 - RNA, 12 nt, Salmonella enterica enterica serovar Typhi Ty2
gucauaaaacug

SEQ ID NO: 1776331 - RNA, 13 nt, Salmonella enterica enterica serovar Typhi Ty2
gucauaauuaaaa

SEQ ID NO: 1776332 - RNA, 23 nt, Salmonella enterica enterica serovar Typhi Ty2
gucauaacgcuuuguacagacaa

SEQ ID NO: 1776333 - RNA, 14 nt, Salmonella enterica enterica serovar Typhi Ty2
gucauaauuaaaaa

SEQ ID NO: 1776334 - RNA, 23 nt, Salmonella enterica enterica serovar Typhi Ty2
gucauacuucaaguugcaggugu

SEQ ID NO: 1776335 - RNA, 16 nt, Salmonella enterica enterica serovar Typhi Ty2
gucauacugugcguga

SEQ ID NO: 1776336 - RNA, 14 nt, Salmonella enterica enterica serovar Typhi Ty2
gucaucugccaguu

SEQ ID NO: 1776337 - RNA, 22 nt, Salmonella enterica enterica serovar Typhi Ty2
gucaugaaaagcuauauuuaua

SEQ ID NO: 1776338 - RNA, 16 nt, Salmonella enterica enterica serovar Typhi Ty2
gucagcauuucaucca

SEQ ID NO: 1776339 - RNA, 22 nt, Salmonella enterica enterica serovar Typhi Ty2
gucagccccguacaaggucggc

SEQ ID NO: 1776340 - RNA, 15 nt, Salmonella enterica enterica serovar Typhi Ty2
gucagcaguuuuauc

SEQ ID NO: 1776341 - RNA, 19 nt, Salmonella enterica enterica serovar Typhi Ty2
gucagcauaauauccugca

SEQ ID NO: 1776342 - RNA, 13 nt, Salmonella enterica enterica serovar Typhi Ty2
gucagcaagauua

SEQ ID NO: 1776343 - RNA, 22 nt, Salmonella enterica enterica serovar Typhi Ty2
gucagcggcugacacucaucca

SEQ ID NO: 1776344 - RNA, 14 nt, Salmonella enterica enterica serovar Typhi Ty2
gucagcggcgcgcc

SEQ ID NO: 1776345 - RNA, 21 nt, Salmonella enterica enterica serovar Typhi Ty2
gucagcgggguucagaccaga

SEQ ID NO: 1776346 - RNA, 21 nt, Salmonella enterica enterica serovar Typhi Ty2
gucaggcaacaggauguccug

SEQ ID NO: 1776347 - RNA, 17 nt, Salmonella enterica enterica serovar Typhi Ty2
gucaggaggccugaaua

SEQ ID NO: 1776348 - RNA, 22 nt, Salmonella enterica enterica serovar Typhi Ty2
gucaggauaaaauccugcacgc

SEQ ID NO: 1776349 - RNA, 22 nt, Salmonella enterica enterica serovar Typhi Ty2
gucagcucgguggcgguaucaa

SEQ ID NO: 1776350 - RNA, 15 nt, Salmonella enterica enterica serovar Typhi Ty2
gucagcuccgguauc

SEQ ID NO: 1776351 - RNA, 13 nt, Salmonella enterica enterica serovar Typhi Ty2
gucagcuuccugc

SEQ ID NO: 1776352 - RNA, 15 nt, Salmonella enterica enterica serovar Typhi Ty2
gucaggcagaaauaa

SEQ ID NO: 1776353 - RNA, 20 nt, Salmonella enterica enterica serovar Typhi Ty2
gucaggccgccgcacaggcg

SEQ ID NO: 1776354 - RNA, 18 nt, Salmonella enterica enterica serovar Typhi Ty2
gucaggccgccgcaaaag

SEQ ID NO: 1776355 - RNA, 19 nt, Salmonella enterica enterica serovar Typhi Ty2
gucaggccgccgcacaggc

SEQ ID NO: 1776356 - RNA, 13 nt, Salmonella enterica enterica serovar Typhi Ty2
gucaggcggcugc

SEQ ID NO: 1776357 - RNA, 15 nt, Salmonella enterica enterica serovar Typhi Ty2
gucagggcgcggcgc

SEQ ID NO: 1776358 - RNA, 20 nt, Salmonella enterica enterica serovar Typhi Ty2
gucacccgccggcagcagcu

SEQ ID NO: 1776359 - RNA, 22 nt, Salmonella enterica enterica serovar Typhi Ty2
gucacccgcuuuuccuguucug

SEQ ID NO: 1776360 - RNA, 14 nt, Salmonella enterica enterica serovar Typhi Ty2
gucaccgggcgcug

SEQ ID NO: 1776361 - RNA, 18 nt, Salmonella enterica enterica serovar Typhi Ty2
gucacgcgcaaagcugcg

SEQ ID NO: 1776362 - RNA, 11 nt, Salmonella enterica enterica serovar Typhi Ty2
gucacuucaac

SEQ ID NO: 1776363 - RNA, 23 nt, Salmonella enterica enterica serovar Typhi Ty2
gucacuucaaccuuuaucuguug

SEQ ID NO: 1776364 - RNA, 17 nt, Salmonella enterica enterica serovar Typhi Ty2
gucacuuacuuucuugc

SEQ ID NO: 1776365 - RNA, 23 nt, Salmonella enterica enterica serovar Typhi Ty2
gucagaccuucaacccagcagca

SEQ ID NO: 1776366 - RNA, 19 nt, Salmonella enterica enterica serovar Typhi Ty2
gucagaucguaugcgccug

SEQ ID NO: 1776367 - RNA, 17 nt, Salmonella enterica enterica serovar Typhi Ty2
gucaacugcucuaccaa

SEQ ID NO: 1776368 - RNA, 18 nt, Salmonella enterica enterica serovar Typhi Ty2
gucaacguuaacugcugc

SEQ ID NO: 1776369 - RNA, 21 nt, Salmonella enterica enterica serovar Typhi Ty2
gucaacguccaguucguucug

SEQ ID NO: 1776370 - RNA, 16 nt, Salmonella enterica enterica serovar Typhi Ty2
gucaacgccaagcgcg

SEQ ID NO: 1776371 - RNA, 22 nt, Salmonella enterica enterica serovar Typhi Ty2
gucaacgaggugaauaaauccu

SEQ ID NO: 1776372 - RNA, 17 nt, Salmonella enterica enterica serovar Typhi Ty2
gucaacacgcagaccca

SEQ ID NO: 1776373 - RNA, 13 nt, Salmonella enterica enterica serovar Typhi Ty2
gucaacaggcuga

SEQ ID NO: 1776374 - RNA, 22 nt, Salmonella enterica enterica serovar Typhi Ty2
gucaacauagcuauauuuagcc

SEQ ID NO: 1776375 - RNA, 17 nt, Salmonella enterica enterica serovar Typhi Ty2
gucaagaucgcgcagca

SEQ ID NO: 1776376 - RNA, 21 nt, Salmonella enterica enterica serovar Typhi Ty2
gucaagaucgcgcagcaggcc

SEQ ID NO: 1776377 - RNA, 19 nt, Salmonella enterica enterica serovar Typhi Ty2
gucaacucuuucaggcgag

SEQ ID NO: 1776378 - RNA, 15 nt, Salmonella enterica enterica serovar Typhi Ty2
gucaaugaucaguuu

SEQ ID NO: 1776379 - RNA, 18 nt, Salmonella enterica enterica serovar Typhi Ty2
guauaaucccgcggcgga

SEQ ID NO: 1776380 - RNA, 14 nt, Salmonella enterica enterica serovar Typhi Ty2
guauacacuuucca

SEQ ID NO: 1776381 - RNA, 20 nt, Salmonella enterica enterica serovar Typhi Ty2
guauaucuuucuuaucccac

SEQ ID NO: 1776382 - RNA, 15 nt, Salmonella enterica enterica serovar Typhi Ty2
guauaugaauauacg

SEQ ID NO: 1776383 - RNA, 22 nt, Salmonella enterica enterica serovar Typhi Ty2
gucaaaacuuauuuuauuuuua

SEQ ID NO: 1776384 - RNA, 12 nt, Salmonella enterica enterica serovar Typhi Ty2
gucaaaagcugc

SEQ ID NO: 1776385 - RNA, 19 nt, Salmonella enterica enterica serovar Typhi Ty2
gucaaaaaguugucuuccu

SEQ ID NO: 1776386 - RNA, 18 nt, Salmonella enterica enterica serovar Typhi Ty2
gucaaaaaaucagcaauc

SEQ ID NO: 1776387 - RNA, 21 nt, Salmonella enterica enterica serovar Typhi Ty2
guccucacacugauggcagac

SEQ ID NO: 1776388 - RNA, 22 nt, Salmonella enterica enterica serovar Typhi Ty2
guccuauugcaacgccgaugcu

SEQ ID NO: 1776389 - RNA, 20 nt, Salmonella enterica enterica serovar Typhi Ty2
guccucacacugauggcaga

SEQ ID NO: 1776390 - RNA, 16 nt, Salmonella enterica enterica serovar Typhi Ty2
guccugaucggcggcc

SEQ ID NO: 1776391 - RNA, 19 nt, Salmonella enterica enterica serovar Typhi Ty2
guccggcgaaaaccgagca

SEQ ID NO: 1776392 - RNA, 23 nt, Salmonella enterica enterica serovar Typhi Ty2
guccggcgaacaaacucuuucac

SEQ ID NO: 1776393 - RNA, 17 nt, Salmonella enterica enterica serovar Typhi Ty2
guccggccccaaacugg

SEQ ID NO: 1776394 - RNA, 15 nt, Salmonella enterica enterica serovar Typhi Ty2
guccgggaaggacgc

SEQ ID NO: 1776395 - RNA, 15 nt, Salmonella enterica enterica serovar Typhi Ty2
guccgcacgccugca

SEQ ID NO: 1776396 - RNA, 20 nt, Salmonella enterica enterica serovar Typhi Ty2
guccgcaaagacaacgacca

SEQ ID NO: 1776397 - RNA, 12 nt, Salmonella enterica enterica serovar Typhi Ty2
gucccagccuuc

SEQ ID NO: 1776398 - RNA, 15 nt, Salmonella enterica enterica serovar Typhi Ty2
gucccagccuuccug

SEQ ID NO: 1776399 - RNA, 22 nt, Salmonella enterica enterica serovar Typhi Ty2
gucccagccccacauuggaaaa

SEQ ID NO: 1776400 - RNA, 16 nt, Salmonella enterica enterica serovar Typhi Ty2
gucccagccuuccugg

SEQ ID NO: 1776401 - RNA, 23 nt, Salmonella enterica enterica serovar Typhi Ty2
gucccaucguaacgccgucgaca

SEQ ID NO: 1776402 - RNA, 16 nt, Salmonella enterica enterica serovar Typhi Ty2
gucccagugucaacug

SEQ ID NO: 1776403 - RNA, 19 nt, Salmonella enterica enterica serovar Typhi Ty2
guccccagcguaccacgcc

SEQ ID NO: 1776404 - RNA, 21 nt, Salmonella enterica enterica serovar Typhi Ty2
gucauuuucuuucaucaaacg

SEQ ID NO: 1776405 - RNA, 13 nt, Salmonella enterica enterica serovar Typhi Ty2
gucauuuuuucaa

SEQ ID NO: 1776406 - RNA, 14 nt, Salmonella enterica enterica serovar Typhi Ty2
guccauauucaguu

SEQ ID NO: 1776407 - RNA, 18 nt, Salmonella enterica enterica serovar Typhi Ty2
gucauuugaaucugcggu

SEQ ID NO: 1776408 - RNA, 14 nt, Salmonella enterica enterica serovar Typhi Ty2
gucauuuauuuucg

SEQ ID NO: 1776409 - RNA, 15 nt, Salmonella enterica enterica serovar Typhi Ty2
gucauuguaaaaccg

SEQ ID NO: 1776410 - RNA, 21 nt, Salmonella enterica enterica serovar Typhi Ty2
gucauuggggacgcgcaaacg

SEQ ID NO: 1776411 - RNA, 13 nt, Salmonella enterica enterica serovar Typhi Ty2
gucauugagccgc

SEQ ID NO: 1776412 - RNA, 14 nt, Salmonella enterica enterica serovar Typhi Ty2
gucauucaggucua

SEQ ID NO: 1776413 - RNA, 22 nt, Salmonella enterica enterica serovar Typhi Ty2
gucauuccugcguugaccagcg

SEQ ID NO: 1776414 - RNA, 22 nt, Salmonella enterica enterica serovar Typhi Ty2
gucgcaagacgaaaaaugaaua

SEQ ID NO: 1776415 - RNA, 16 nt, Salmonella enterica enterica serovar Typhi Ty2
gucgauuuugccuuca

SEQ ID NO: 1776416 - RNA, 16 nt, Salmonella enterica enterica serovar Typhi Ty2
gucgaucacgguggug

SEQ ID NO: 1776417 - RNA, 20 nt, Salmonella enterica enterica serovar Typhi Ty2
gucgcagcggcggucugcgc

SEQ ID NO: 1776418 - RNA, 15 nt, Salmonella enterica enterica serovar Typhi Ty2
gucgcagcggcugcg

SEQ ID NO: 1776419 - RNA, 13 nt, Salmonella enterica enterica serovar Typhi Ty2
gucgcauacuucc

SEQ ID NO: 1776420 - RNA, 17 nt, Salmonella enterica enterica serovar Typhi Ty2
gucgcauacuuccucac

SEQ ID NO: 1776421 - RNA, 16 nt, Salmonella enterica enterica serovar Typhi Ty2
gucgcagcaaacggca

SEQ ID NO: 1776422 - RNA, 14 nt, Salmonella enterica enterica serovar Typhi Ty2
gucgcacuccucug

SEQ ID NO: 1776423 - RNA, 14 nt, Salmonella enterica enterica serovar Typhi Ty2
gucgaggaagcugc

SEQ ID NO: 1776424 - RNA, 18 nt, Salmonella enterica enterica serovar Typhi Ty2
guccuucacaaacuucuc

SEQ ID NO: 1776425 - RNA, 13 nt, Salmonella enterica enterica serovar Typhi Ty2
guccuucuccuuc

SEQ ID NO: 1776426 - RNA, 21 nt, Salmonella enterica enterica serovar Typhi Ty2
guccuuaaccagcucgcugau

SEQ ID NO: 1776427 - RNA, 13 nt, Salmonella enterica enterica serovar Typhi Ty2
gucgcgcgcgcca

SEQ ID NO: 1776428 - RNA, 14 nt, Salmonella enterica enterica serovar Typhi Ty2
gucgcgcgccgcaa

SEQ ID NO: 1776429 - RNA, 15 nt, Salmonella enterica enterica serovar Typhi Ty2
gucgcggcuuucagc

SEQ ID NO: 1776430 - RNA, 14 nt, Salmonella enterica enterica serovar Typhi Ty2
gucgcggcuuucag

SEQ ID NO: 1776431 - RNA, 15 nt, Salmonella enterica enterica serovar Typhi Ty2
gucgccggggcgcug

SEQ ID NO: 1776432 - RNA, 18 nt, Salmonella enterica enterica serovar Typhi Ty2
gucgccggggcgcuggcg

SEQ ID NO: 1776433 - RNA, 22 nt, Salmonella enterica enterica serovar Typhi Ty2
gucgccgcgcccagcagcagaa

SEQ ID NO: 1776434 - RNA, 18 nt, Salmonella enterica enterica serovar Typhi Ty2
gucgccacgcgacgccag

SEQ ID NO: 1776435 - RNA, 19 nt, Salmonella enterica enterica serovar Typhi Ty2
gucgccaccaugcugguug

SEQ ID NO: 1776436 - RNA, 13 nt, Salmonella enterica enterica serovar Typhi Ty2
gucgcauccggca

SEQ ID NO: 1776437 - RNA, 16 nt, Salmonella enterica enterica serovar Typhi Ty2
gucgcauggcuaaaag

SEQ ID NO: 1776438 - RNA, 16 nt, Salmonella enterica enterica serovar Typhi Ty2
gucgcccagccauaau

SEQ ID NO: 1776439 - RNA, 23 nt, Salmonella enterica enterica serovar Typhi Ty2
gucgccaggcaagguuaacguca

SEQ ID NO: 1776440 - RNA, 21 nt, Salmonella enterica enterica serovar Typhi Ty2
gucgccauauccaagccccuc

SEQ ID NO: 1776441 - RNA, 23 nt, Salmonella enterica enterica serovar Typhi Ty2
gucgcccgcuaacggcaccagca

SEQ ID NO: 1776442 - RNA, 17 nt, Salmonella enterica enterica serovar Typhi Ty2
guauaaacucagcaaua

SEQ ID NO: 1776443 - RNA, 19 nt, Salmonella enterica enterica serovar Typhi Ty2
guauaaaauggcaaagucg

SEQ ID NO: 1776444 - RNA, 19 nt, Salmonella enterica enterica serovar Typhi Ty2
guauaaaucccggugggga

SEQ ID NO: 1776445 - RNA, 18 nt, Salmonella enterica enterica serovar Typhi Ty2
guauaaauuuccgcagcc

SEQ ID NO: 1776446 - RNA, 21 nt, Salmonella enterica enterica serovar Typhi Ty2
guauaaauuuccgcagccaga

SEQ ID NO: 1776447 - RNA, 20 nt, Salmonella enterica enterica serovar Typhi Ty2
guaguguuuaagcgucaggc

SEQ ID NO: 1776448 - RNA, 15 nt, Salmonella enterica enterica serovar Typhi Ty2
guaguguaauaccac

SEQ ID NO: 1776449 - RNA, 16 nt, Salmonella enterica enterica serovar Typhi Ty2
guaguuggugggugau

SEQ ID NO: 1776450 - RNA, 19 nt, Salmonella enterica enterica serovar Typhi Ty2
guaguuccuguagcgugac

SEQ ID NO: 1776451 - RNA, 14 nt, Salmonella enterica enterica serovar Typhi Ty2
guaguaucauccau

SEQ ID NO: 1776452 - RNA, 18 nt, Salmonella enterica enterica serovar Typhi Ty2
guagucaaauuccagcaa

SEQ ID NO: 1776453 - RNA, 19 nt, Salmonella enterica enterica serovar Typhi Ty2
guagugcuucucuucaaac

SEQ ID NO: 1776454 - RNA, 17 nt, Salmonella enterica enterica serovar Typhi Ty2
guagucuuacacuuagc

SEQ ID NO: 1776455 - RNA, 17 nt, Salmonella enterica enterica serovar Typhi Ty2
guagucucccuccugcu

SEQ ID NO: 1776456 - RNA, 19 nt, Salmonella enterica enterica serovar Typhi Ty2
guagucucccuccugcucc

SEQ ID NO: 1776457 - RNA, 14 nt, Salmonella enterica enterica serovar Typhi Ty2
guaguccuguaucu

SEQ ID NO: 1776458 - RNA, 14 nt, Salmonella enterica enterica serovar Typhi Ty2
guaguccaaauaag

SEQ ID NO: 1776459 - RNA, 20 nt, Salmonella enterica enterica serovar Typhi Ty2
guagcgagaagccgauggaa

SEQ ID NO: 1776460 - RNA, 21 nt, Salmonella enterica enterica serovar Typhi Ty2
guagcgucucaucaaaaaggc

SEQ ID NO: 1776461 - RNA, 14 nt, Salmonella enterica enterica serovar Typhi Ty2
guagcgcggcagcg

SEQ ID NO: 1776462 - RNA, 17 nt, Salmonella enterica enterica serovar Typhi Ty2
guagcgccaucaggcau

SEQ ID NO: 1776463 - RNA, 17 nt, Salmonella enterica enterica serovar Typhi Ty2
guagcuccagacaggac

SEQ ID NO: 1776464 - RNA, 16 nt, Salmonella enterica enterica serovar Typhi Ty2
guagcugagcgucagg

SEQ ID NO: 1776465 - RNA, 13 nt, Salmonella enterica enterica serovar Typhi Ty2
guaggccaggcau

SEQ ID NO: 1776466 - RNA, 21 nt, Salmonella enterica enterica serovar Typhi Ty2
guaggcccgguaagcgcagcg

SEQ ID NO: 1776467 - RNA, 17 nt, Salmonella enterica enterica serovar Typhi Ty2
guaggccgaauaagcca

SEQ ID NO: 1776468 - RNA, 20 nt, Salmonella enterica enterica serovar Typhi Ty2
guaggccugauagcacagcg

SEQ ID NO: 1776469 - RNA, 19 nt, Salmonella enterica enterica serovar Typhi Ty2
guaggcucuccgguugcug

SEQ ID NO: 1776470 - RNA, 17 nt, Salmonella enterica enterica serovar Typhi Ty2
guaccugaagccauccu

SEQ ID NO: 1776471 - RNA, 15 nt, Salmonella enterica enterica serovar Typhi Ty2
guacgcuccagggcu

SEQ ID NO: 1776472 - RNA, 12 nt, Salmonella enterica enterica serovar Typhi Ty2
guacggcauauu

SEQ ID NO: 1776473 - RNA, 14 nt, Salmonella enterica enterica serovar Typhi Ty2
guacggcauggcgu

SEQ ID NO: 1776474 - RNA, 19 nt, Salmonella enterica enterica serovar Typhi Ty2
guacggcuuucuuucucca

SEQ ID NO: 1776475 - RNA, 13 nt, Salmonella enterica enterica serovar Typhi Ty2
guacggcgcgcca

SEQ ID NO: 1776476 - RNA, 23 nt, Salmonella enterica enterica serovar Typhi Ty2
guaccgggcaggaaaagacuacu

SEQ ID NO: 1776477 - RNA, 21 nt, Salmonella enterica enterica serovar Typhi Ty2
guaccgggccuccuuuccugu

SEQ ID NO: 1776478 - RNA, 12 nt, Salmonella enterica enterica serovar Typhi Ty2
guaccucaugcc

SEQ ID NO: 1776479 - RNA, 18 nt, Salmonella enterica enterica serovar Typhi Ty2
guacguaaugugaaaaac

SEQ ID NO: 1776480 - RNA, 17 nt, Salmonella enterica enterica serovar Typhi Ty2
guagagaucgacaaacc

SEQ ID NO: 1776481 - RNA, 20 nt, Salmonella enterica enterica serovar Typhi Ty2
guagagauucugcaggccaa

SEQ ID NO: 1776482 - RNA, 16 nt, Salmonella enterica enterica serovar Typhi Ty2
guagagcgcggucagg

SEQ ID NO: 1776483 - RNA, 22 nt, Salmonella enterica enterica serovar Typhi Ty2
guacuggaucaccugaaugcaa

SEQ ID NO: 1776484 - RNA, 20 nt, Salmonella enterica enterica serovar Typhi Ty2
guacuccccuuuuuucuguu

SEQ ID NO: 1776485 - RNA, 18 nt, Salmonella enterica enterica serovar Typhi Ty2
guacucaccaguccggca

SEQ ID NO: 1776486 - RNA, 14 nt, Salmonella enterica enterica serovar Typhi Ty2
guacuucagagcug

SEQ ID NO: 1776487 - RNA, 22 nt, Salmonella enterica enterica serovar Typhi Ty2
guacuucagcauacaggucuuu

SEQ ID NO: 1776488 - RNA, 16 nt, Salmonella enterica enterica serovar Typhi Ty2
guaccgccgccgggcc

SEQ ID NO: 1776489 - RNA, 17 nt, Salmonella enterica enterica serovar Typhi Ty2
guaccgcuacgcaggcc

SEQ ID NO: 1776490 - RNA, 22 nt, Salmonella enterica enterica serovar Typhi Ty2
guaccgcuacgcaggccauuuc

SEQ ID NO: 1776491 - RNA, 13 nt, Salmonella enterica enterica serovar Typhi Ty2
guaccgggcagac

SEQ ID NO: 1776492 - RNA, 23 nt, Salmonella enterica enterica serovar Typhi Ty2
guaccggcaggacaaucauaaua

SEQ ID NO: 1776493 - RNA, 21 nt, Salmonella enterica enterica serovar Typhi Ty2
guaccgaagaacauaaacagc

SEQ ID NO: 1776494 - RNA, 20 nt, Salmonella enterica enterica serovar Typhi Ty2
guaccgacgccauuccccag

SEQ ID NO: 1776495 - RNA, 14 nt, Salmonella enterica enterica serovar Typhi Ty2
guacccucugcacc

SEQ ID NO: 1776496 - RNA, 18 nt, Salmonella enterica enterica serovar Typhi Ty2
guaccgaacagccaggcu

SEQ ID NO: 1776497 - RNA, 23 nt, Salmonella enterica enterica serovar Typhi Ty2
guaccgauuguuuggugcugaaa

SEQ ID NO: 1776498 - RNA, 23 nt, Salmonella enterica enterica serovar Typhi Ty2
guacccggcuuacaacauuguua

SEQ ID NO: 1776499 - RNA, 15 nt, Salmonella enterica enterica serovar Typhi Ty2
guacccgccgcuggc

SEQ ID NO: 1776500 - RNA, 15 nt, Salmonella enterica enterica serovar Typhi Ty2
guaccccgccugacg

SEQ ID NO: 1776501 - RNA, 18 nt, Salmonella enterica enterica serovar Typhi Ty2
guaccauugucaaaaaua

SEQ ID NO: 1776502 - RNA, 22 nt, Salmonella enterica enterica serovar Typhi Ty2
guaccauaccggugcgccccag

SEQ ID NO: 1776503 - RNA, 15 nt, Salmonella enterica enterica serovar Typhi Ty2
guaccaauacccagc

SEQ ID NO: 1776504 - RNA, 18 nt, Salmonella enterica enterica serovar Typhi Ty2
guaaugucuggugcagca

SEQ ID NO: 1776505 - RNA, 20 nt, Salmonella enterica enterica serovar Typhi Ty2
guaauggcgggaaaagguuu

SEQ ID NO: 1776506 - RNA, 22 nt, Salmonella enterica enterica serovar Typhi Ty2
guaauguugcugcaucuccagc

SEQ ID NO: 1776507 - RNA, 17 nt, Salmonella enterica enterica serovar Typhi Ty2
guaccaaaacagaaaag

SEQ ID NO: 1776508 - RNA, 12 nt, Salmonella enterica enterica serovar Typhi Ty2
guaccaaacagc

SEQ ID NO: 1776509 - RNA, 22 nt, Salmonella enterica enterica serovar Typhi Ty2
guaaugcucgcccagaauuucc

SEQ ID NO: 1776510 - RNA, 13 nt, Salmonella enterica enterica serovar Typhi Ty2
guaauggccuaca

SEQ ID NO: 1776511 - RNA, 15 nt, Salmonella enterica enterica serovar Typhi Ty2
guaauggcauaacgc

SEQ ID NO: 1776512 - RNA, 13 nt, Salmonella enterica enterica serovar Typhi Ty2
guaaucuaaaauu

SEQ ID NO: 1776513 - RNA, 14 nt, Salmonella enterica enterica serovar Typhi Ty2
guaaucgccugaau

SEQ ID NO: 1776514 - RNA, 13 nt, Salmonella enterica enterica serovar Typhi Ty2
guaaucgccguau

SEQ ID NO: 1776515 - RNA, 16 nt, Salmonella enterica enterica serovar Typhi Ty2
guaaaauggacuuccg

SEQ ID NO: 1776516 - RNA, 14 nt, Salmonella enterica enterica serovar Typhi Ty2
guaaaauuagacaa

SEQ ID NO: 1776517 - RNA, 13 nt, Salmonella enterica enterica serovar Typhi Ty2
guaaacaccaccg

SEQ ID NO: 1776518 - RNA, 18 nt, Salmonella enterica enterica serovar Typhi Ty2
guaaacacgacgcugcca

SEQ ID NO: 1776519 - RNA, 15 nt, Salmonella enterica enterica serovar Typhi Ty2
gguuaacgucagauu

SEQ ID NO: 1776520 - RNA, 12 nt, Salmonella enterica enterica serovar Typhi Ty2
gguuaacucuuu

SEQ ID NO: 1776521 - RNA, 18 nt, Salmonella enterica enterica serovar Typhi Ty2
gguuaacgucagauuuuc

SEQ ID NO: 1776522 - RNA, 23 nt, Salmonella enterica enterica serovar Typhi Ty2
gguuaaauuaaauaacaaaugaa

SEQ ID NO: 1776523 - RNA, 23 nt, Salmonella enterica enterica serovar Typhi Ty2
gguuaaagcccugacagaaauag

SEQ ID NO: 1776524 - RNA, 18 nt, Salmonella enterica enterica serovar Typhi Ty2
gguuaaaaacagccagca

SEQ ID NO: 1776525 - RNA, 16 nt, Salmonella enterica enterica serovar Typhi Ty2
guaaacgugccacagu

SEQ ID NO: 1776526 - RNA, 15 nt, Salmonella enterica enterica serovar Typhi Ty2
guaaacggaaccaaa

SEQ ID NO: 1776527 - RNA, 23 nt, Salmonella enterica enterica serovar Typhi Ty2
guaaacgugcuggauggcagaca

SEQ ID NO: 1776528 - RNA, 16 nt, Salmonella enterica enterica serovar Typhi Ty2
guaaacguuccugcca

SEQ ID NO: 1776529 - RNA, 13 nt, Salmonella enterica enterica serovar Typhi Ty2
guaaagaucuggc

SEQ ID NO: 1776530 - RNA, 14 nt, Salmonella enterica enterica serovar Typhi Ty2
guaaagcagugcag

SEQ ID NO: 1776531 - RNA, 18 nt, Salmonella enterica enterica serovar Typhi Ty2
guaaagcagugcaguauu

SEQ ID NO: 1776532 - RNA, 15 nt, Salmonella enterica enterica serovar Typhi Ty2
guaaacaggcaggcc

SEQ ID NO: 1776533 - RNA, 13 nt, Salmonella enterica enterica serovar Typhi Ty2
guaaacagaugcu

SEQ ID NO: 1776534 - RNA, 14 nt, Salmonella enterica enterica serovar Typhi Ty2
guaaaccaggccag

SEQ ID NO: 1776535 - RNA, 19 nt, Salmonella enterica enterica serovar Typhi Ty2
guaaaccauuucuccugca

SEQ ID NO: 1776536 - RNA, 16 nt, Salmonella enterica enterica serovar Typhi Ty2
guaaaccauuucuccu

SEQ ID NO: 1776537 - RNA, 23 nt, Salmonella enterica enterica serovar Typhi Ty2
guaaaccucaaggcucagcagag

SEQ ID NO: 1776538 - RNA, 15 nt, Salmonella enterica enterica serovar Typhi Ty2
guaaacgcgaccagc

SEQ ID NO: 1776539 - RNA, 22 nt, Salmonella enterica enterica serovar Typhi Ty2
guaaacgcaacaccaucccgcu

SEQ ID NO: 1776540 - RNA, 21 nt, Salmonella enterica enterica serovar Typhi Ty2
guaaacaauggaacuaucaau

SEQ ID NO: 1776541 - RNA, 14 nt, Salmonella enterica enterica serovar Typhi Ty2
guaaauugacugga

SEQ ID NO: 1776542 - RNA, 21 nt, Salmonella enterica enterica serovar Typhi Ty2
guaaauucucuauacugcuga

SEQ ID NO: 1776543 - RNA, 21 nt, Salmonella enterica enterica serovar Typhi Ty2
guaaauuccgcaggcaacaca

SEQ ID NO: 1776544 - RNA, 18 nt, Salmonella enterica enterica serovar Typhi Ty2
guaacaacuguuuuucac

SEQ ID NO: 1776545 - RNA, 20 nt, Salmonella enterica enterica serovar Typhi Ty2
guaaaucaggccaagcaaca

SEQ ID NO: 1776546 - RNA, 17 nt, Salmonella enterica enterica serovar Typhi Ty2
guaaaucagaauaccgc

SEQ ID NO: 1776547 - RNA, 22 nt, Salmonella enterica enterica serovar Typhi Ty2
guaaaucauuuguacaaaaaau

SEQ ID NO: 1776548 - RNA, 22 nt, Salmonella enterica enterica serovar Typhi Ty2
guaaaucugccgucaucgacuu

SEQ ID NO: 1776549 - RNA, 21 nt, Salmonella enterica enterica serovar Typhi Ty2
guaaaucgcgagccuucaaca

SEQ ID NO: 1776550 - RNA, 15 nt, Salmonella enterica enterica serovar Typhi Ty2
guaaauauugauuaa

SEQ ID NO: 1776551 - RNA, 18 nt, Salmonella enterica enterica serovar Typhi Ty2
guaaauauugauuaaucg

SEQ ID NO: 1776552 - RNA, 13 nt, Salmonella enterica enterica serovar Typhi Ty2
guaaauacccagg

SEQ ID NO: 1776553 - RNA, 22 nt, Salmonella enterica enterica serovar Typhi Ty2
guaaauagaaaauaauucuuaa

SEQ ID NO: 1776554 - RNA, 18 nt, Salmonella enterica enterica serovar Typhi Ty2
guaaauagagaaaucaac

SEQ ID NO: 1776555 - RNA, 13 nt, Salmonella enterica enterica serovar Typhi Ty2
guaaauagcccgg

SEQ ID NO: 1776556 - RNA, 16 nt, Salmonella enterica enterica serovar Typhi Ty2
guaaaggggagcccag

SEQ ID NO: 1776557 - RNA, 14 nt, Salmonella enterica enterica serovar Typhi Ty2
guaacauauuuuua

SEQ ID NO: 1776558 - RNA, 17 nt, Salmonella enterica enterica serovar Typhi Ty2
guaaccccugcccgcga

SEQ ID NO: 1776559 - RNA, 23 nt, Salmonella enterica enterica serovar Typhi Ty2
guaaccgaacuggguaugcagug

SEQ ID NO: 1776560 - RNA, 16 nt, Salmonella enterica enterica serovar Typhi Ty2
guaaccuauuuuacaa

SEQ ID NO: 1776561 - RNA, 21 nt, Salmonella enterica enterica serovar Typhi Ty2
guaacgccuggcgcauuuuaa

SEQ ID NO: 1776562 - RNA, 16 nt, Salmonella enterica enterica serovar Typhi Ty2
guaacgccuuugcccg

SEQ ID NO: 1776563 - RNA, 14 nt, Salmonella enterica enterica serovar Typhi Ty2
guaacgccuccacc

SEQ ID NO: 1776564 - RNA, 16 nt, Salmonella enterica enterica serovar Typhi Ty2
guaacggacucaggcc

SEQ ID NO: 1776565 - RNA, 18 nt, Salmonella enterica enterica serovar Typhi Ty2
guaacguuguccagcaga

SEQ ID NO: 1776566 - RNA, 14 nt, Salmonella enterica enterica serovar Typhi Ty2
guaacuauuucuau

SEQ ID NO: 1776567 - RNA, 13 nt, Salmonella enterica enterica serovar Typhi Ty2
guaacuuauccac

SEQ ID NO: 1776568 - RNA, 14 nt, Salmonella enterica enterica serovar Typhi Ty2
guaacugucagauc

SEQ ID NO: 1776569 - RNA, 17 nt, Salmonella enterica enterica serovar Typhi Ty2
guaacuggcuccacggg

SEQ ID NO: 1776570 - RNA, 21 nt, Salmonella enterica enterica serovar Typhi Ty2
guaacugcaccuuuuuuucca

SEQ ID NO: 1776571 - RNA, 18 nt, Salmonella enterica enterica serovar Typhi Ty2
guaagaaaaacagcgaga

SEQ ID NO: 1776572 - RNA, 19 nt, Salmonella enterica enterica serovar Typhi Ty2
guaagagcguuacccagac

SEQ ID NO: 1776573 - RNA, 20 nt, Salmonella enterica enterica serovar Typhi Ty2
guaagagagccuuacaggcg

SEQ ID NO: 1776574 - RNA, 14 nt, Salmonella enterica enterica serovar Typhi Ty2
guaagcacaacgca

SEQ ID NO: 1776575 - RNA, 21 nt, Salmonella enterica enterica serovar Typhi Ty2
guaauaacaaaaaacauauau

SEQ ID NO: 1776576 - RNA, 22 nt, Salmonella enterica enterica serovar Typhi Ty2
guaaguuugcguacucagcaga

SEQ ID NO: 1776577 - RNA, 14 nt, Salmonella enterica enterica serovar Typhi Ty2
guaaguuuugcucc

SEQ ID NO: 1776578 - RNA, 15 nt, Salmonella enterica enterica serovar Typhi Ty2
guaaguuuugcuccc

SEQ ID NO: 1776579 - RNA, 17 nt, Salmonella enterica enterica serovar Typhi Ty2
guaauaugaauauccgc

SEQ ID NO: 1776580 - RNA, 19 nt, Salmonella enterica enterica serovar Typhi Ty2
guaauagucugcucgucgg

SEQ ID NO: 1776581 - RNA, 18 nt, Salmonella enterica enterica serovar Typhi Ty2
guaauauaaucuaccauu

SEQ ID NO: 1776582 - RNA, 17 nt, Salmonella enterica enterica serovar Typhi Ty2
guaauaaccguggcggc

SEQ ID NO: 1776583 - RNA, 12 nt, Salmonella enterica enterica serovar Typhi Ty2
guaauauuaaaa

SEQ ID NO: 1776584 - RNA, 23 nt, Salmonella enterica enterica serovar Typhi Ty2
guaaucaaacauacgccuuuacc

SEQ ID NO: 1776585 - RNA, 15 nt, Salmonella enterica enterica serovar Typhi Ty2
guaaggcaaauaugc

SEQ ID NO: 1776586 - RNA, 22 nt, Salmonella enterica enterica serovar Typhi Ty2
guaagggaggugcucucccagc

SEQ ID NO: 1776587 - RNA, 21 nt, Salmonella enterica enterica serovar Typhi Ty2
guaagggaggugcucucccag

SEQ ID NO: 1776588 - RNA, 13 nt, Salmonella enterica enterica serovar Typhi Ty2
guaagguccaggg

SEQ ID NO: 1776589 - RNA, 17 nt, Salmonella enterica enterica serovar Typhi Ty2
guaagcgcccguccaug

SEQ ID NO: 1776590 - RNA, 22 nt, Salmonella enterica enterica serovar Typhi Ty2
guaagcgcccguccaugaguag

SEQ ID NO: 1776591 - RNA, 16 nt, Salmonella enterica enterica serovar Typhi Ty2
guaagcuauuccugua

SEQ ID NO: 1776592 - RNA, 23 nt, Salmonella enterica enterica serovar Typhi Ty2
guaagcggguauacuuaacccug

SEQ ID NO: 1776593 - RNA, 18 nt, Salmonella enterica enterica serovar Typhi Ty2
guaagcggcggaccagcg

SEQ ID NO: 1776594 - RNA, 22 nt, Salmonella enterica enterica serovar Typhi Ty2
guaagcauagcgccuucaggca

SEQ ID NO: 1776595 - RNA, 20 nt, Salmonella enterica enterica serovar Typhi Ty2
ggucuguaugacaacauaaa

SEQ ID NO: 1776596 - RNA, 13 nt, Salmonella enterica enterica serovar Typhi Ty2
ggucuuuuucgca

SEQ ID NO: 1776597 - RNA, 20 nt, Salmonella enterica enterica serovar Typhi Ty2
ggugaaaaaucauuaucacu

SEQ ID NO: 1776598 - RNA, 17 nt, Salmonella enterica enterica serovar Typhi Ty2
ggugacggaaaccagca

SEQ ID NO: 1776599 - RNA, 13 nt, Salmonella enterica enterica serovar Typhi Ty2
ggugauagcgcgc

SEQ ID NO: 1776600 - RNA, 14 nt, Salmonella enterica enterica serovar Typhi Ty2
ggugauagcccguu

SEQ ID NO: 1776601 - RNA, 21 nt, Salmonella enterica enterica serovar Typhi Ty2
ggugaacaaaggcagccaaca

SEQ ID NO: 1776602 - RNA, 16 nt, Salmonella enterica enterica serovar Typhi Ty2
ggugaaauaggggaga

SEQ ID NO: 1776603 - RNA, 15 nt, Salmonella enterica enterica serovar Typhi Ty2
ggucaguacgcgcgu

SEQ ID NO: 1776604 - RNA, 23 nt, Salmonella enterica enterica serovar Typhi Ty2
ggucaguacgcgcguauccgccg

SEQ ID NO: 1776605 - RNA, 21 nt, Salmonella enterica enterica serovar Typhi Ty2
ggucgacguuguccggcgacc

SEQ ID NO: 1776606 - RNA, 20 nt, Salmonella enterica enterica serovar Typhi Ty2
ggucaggcugcggacauuaa

SEQ ID NO: 1776607 - RNA, 22 nt, Salmonella enterica enterica serovar Typhi Ty2
ggucagggugaauaccagcggc

SEQ ID NO: 1776608 - RNA, 13 nt, Salmonella enterica enterica serovar Typhi Ty2
ggucaggccagcc

SEQ ID NO: 1776609 - RNA, 21 nt, Salmonella enterica enterica serovar Typhi Ty2
ggucagcucacgcgccagcac

SEQ ID NO: 1776610 - RNA, 14 nt, Salmonella enterica enterica serovar Typhi Ty2
ggucagcggcgcgc

SEQ ID NO: 1776611 - RNA, 12 nt, Salmonella enterica enterica serovar Typhi Ty2
ggucgccagcau

SEQ ID NO: 1776612 - RNA, 13 nt, Salmonella enterica enterica serovar Typhi Ty2
ggucgccagcgcc

SEQ ID NO: 1776613 - RNA, 14 nt, Salmonella enterica enterica serovar Typhi Ty2
ggugcgccccagca

SEQ ID NO: 1776614 - RNA, 20 nt, Salmonella enterica enterica serovar Typhi Ty2
ggugcgauucagcgcaggca

SEQ ID NO: 1776615 - RNA, 15 nt, Salmonella enterica enterica serovar Typhi Ty2
ggugcgcagccccag

SEQ ID NO: 1776616 - RNA, 23 nt, Salmonella enterica enterica serovar Typhi Ty2
ggugcgcagccccagcgccagcc

SEQ ID NO: 1776617 - RNA, 14 nt, Salmonella enterica enterica serovar Typhi Ty2
ggugcgacgccaga

SEQ ID NO: 1776618 - RNA, 17 nt, Salmonella enterica enterica serovar Typhi Ty2
ggugccuguugcgggcc

SEQ ID NO: 1776619 - RNA, 21 nt, Salmonella enterica enterica serovar Typhi Ty2
ggugccuguugcgggccagca

SEQ ID NO: 1776620 - RNA, 17 nt, Salmonella enterica enterica serovar Typhi Ty2
ggugccgaaaucaucaa

SEQ ID NO: 1776621 - RNA, 15 nt, Salmonella enterica enterica serovar Typhi Ty2
ggugccgacgccagc

SEQ ID NO: 1776622 - RNA, 16 nt, Salmonella enterica enterica serovar Typhi Ty2
ggugcagaccucugca

SEQ ID NO: 1776623 - RNA, 15 nt, Salmonella enterica enterica serovar Typhi Ty2
ggugcagaacaucaa

SEQ ID NO: 1776624 - RNA, 18 nt, Salmonella enterica enterica serovar Typhi Ty2
gguggaucccccuggccc

SEQ ID NO: 1776625 - RNA, 20 nt, Salmonella enterica enterica serovar Typhi Ty2
gguggcgcaguuuacgcagc

SEQ ID NO: 1776626 - RNA, 20 nt, Salmonella enterica enterica serovar Typhi Ty2
gguggucaucgcggccagca

SEQ ID NO: 1776627 - RNA, 22 nt, Salmonella enterica enterica serovar Typhi Ty2
gguggucaucgcggccagcaug

SEQ ID NO: 1776628 - RNA, 15 nt, Salmonella enterica enterica serovar Typhi Ty2
gguggucuggagccu

SEQ ID NO: 1776629 - RNA, 17 nt, Salmonella enterica enterica serovar Typhi Ty2
gguggugggcggcacca

SEQ ID NO: 1776630 - RNA, 14 nt, Salmonella enterica enterica serovar Typhi Ty2
gguggugggcggca

SEQ ID NO: 1776631 - RNA, 13 nt, Salmonella enterica enterica serovar Typhi Ty2
gguggugggcggc

SEQ ID NO: 1776632 - RNA, 18 nt, Salmonella enterica enterica serovar Typhi Ty2
gguauucaccaaaaggca

SEQ ID NO: 1776633 - RNA, 19 nt, Salmonella enterica enterica serovar Typhi Ty2
gguaugccuuccagaaaua

SEQ ID NO: 1776634 - RNA, 19 nt, Salmonella enterica enterica serovar Typhi Ty2
gguaugaacgccggcggcg

SEQ ID NO: 1776635 - RNA, 16 nt, Salmonella enterica enterica serovar Typhi Ty2
gguaugaaacauauau

SEQ ID NO: 1776636 - RNA, 12 nt, Salmonella enterica enterica serovar Typhi Ty2
gguaugaaacau

SEQ ID NO: 1776637 - RNA, 23 nt, Salmonella enterica enterica serovar Typhi Ty2
ggucagcauuucauccauuaaac

SEQ ID NO: 1776638 - RNA, 15 nt, Salmonella enterica enterica serovar Typhi Ty2
ggucaccugaaaaug

SEQ ID NO: 1776639 - RNA, 19 nt, Salmonella enterica enterica serovar Typhi Ty2
gguagucacggagagucgc

SEQ ID NO: 1776640 - RNA, 16 nt, Salmonella enterica enterica serovar Typhi Ty2
gguaaugacuuuuaaa

SEQ ID NO: 1776641 - RNA, 17 nt, Salmonella enterica enterica serovar Typhi Ty2
gguaauuaaaggcagcg

SEQ ID NO: 1776642 - RNA, 17 nt, Salmonella enterica enterica serovar Typhi Ty2
gguaaguuuuucucuua

SEQ ID NO: 1776643 - RNA, 13 nt, Salmonella enterica enterica serovar Typhi Ty2
gguaaguugaaag

SEQ ID NO: 1776644 - RNA, 22 nt, Salmonella enterica enterica serovar Typhi Ty2
gguaauacuaaucucacccaua

SEQ ID NO: 1776645 - RNA, 19 nt, Salmonella enterica enterica serovar Typhi Ty2
gguacaccaggaguuaaac

SEQ ID NO: 1776646 - RNA, 14 nt, Salmonella enterica enterica serovar Typhi Ty2
gguacaggccgccg

SEQ ID NO: 1776647 - RNA, 17 nt, Salmonella enterica enterica serovar Typhi Ty2
gguaauuagaucggcaa

SEQ ID NO: 1776648 - RNA, 22 nt, Salmonella enterica enterica serovar Typhi Ty2
gguaauuucaaagggcccgugg

SEQ ID NO: 1776649 - RNA, 21 nt, Salmonella enterica enterica serovar Typhi Ty2
gguaauuuucaccuccgggug

SEQ ID NO: 1776650 - RNA, 13 nt, Salmonella enterica enterica serovar Typhi Ty2
gguacgcuccagg

SEQ ID NO: 1776651 - RNA, 15 nt, Salmonella enterica enterica serovar Typhi Ty2
gguacggccagcgcg

SEQ ID NO: 1776652 - RNA, 15 nt, Salmonella enterica enterica serovar Typhi Ty2
gguacgacgcggcuc

SEQ ID NO: 1776653 - RNA, 21 nt, Salmonella enterica enterica serovar Typhi Ty2
gguacucgucccgauauaaag

SEQ ID NO: 1776654 - RNA, 16 nt, Salmonella enterica enterica serovar Typhi Ty2
gguacucuuccagcug

SEQ ID NO: 1776655 - RNA, 15 nt, Salmonella enterica enterica serovar Typhi Ty2
gguacucaacaucau

SEQ ID NO: 1776656 - RNA, 23 nt, Salmonella enterica enterica serovar Typhi Ty2
gguacuugacgucgccauaucca

SEQ ID NO: 1776657 - RNA, 16 nt, Salmonella enterica enterica serovar Typhi Ty2
gguacugcuggccuau

SEQ ID NO: 1776658 - RNA, 22 nt, Salmonella enterica enterica serovar Typhi Ty2
gguacuuuucauccacagcgcc

SEQ ID NO: 1776659 - RNA, 20 nt, Salmonella enterica enterica serovar Typhi Ty2
gguagacccggcauugaaac

SEQ ID NO: 1776660 - RNA, 19 nt, Salmonella enterica enterica serovar Typhi Ty2
gguaaccuuaauuugugau

SEQ ID NO: 1776661 - RNA, 22 nt, Salmonella enterica enterica serovar Typhi Ty2
gguaacgcucuuaccgcuaaaa

SEQ ID NO: 1776662 - RNA, 20 nt, Salmonella enterica enterica serovar Typhi Ty2
gguaaauuuaugguuccuga

SEQ ID NO: 1776663 - RNA, 18 nt, Salmonella enterica enterica serovar Typhi Ty2
gguaacaucgcccgcacc

SEQ ID NO: 1776664 - RNA, 20 nt, Salmonella enterica enterica serovar Typhi Ty2
gguaagagcguuacccagac

SEQ ID NO: 1776665 - RNA, 22 nt, Salmonella enterica enterica serovar Typhi Ty2
gguaaagaaaccagaguccggc

SEQ ID NO: 1776666 - RNA, 12 nt, Salmonella enterica enterica serovar Typhi Ty2
gguaaacgugcu

SEQ ID NO: 1776667 - RNA, 21 nt, Salmonella enterica enterica serovar Typhi Ty2
gguaaacgcuccggcaggcaa

SEQ ID NO: 1776668 - RNA, 14 nt, Salmonella enterica enterica serovar Typhi Ty2
gguaaauaacuuuu

SEQ ID NO: 1776669 - RNA, 22 nt, Salmonella enterica enterica serovar Typhi Ty2
gguaaaauggacuuccgcacgc

SEQ ID NO: 1776670 - RNA, 16 nt, Salmonella enterica enterica serovar Typhi Ty2
gguaaaaccagauacg

SEQ ID NO: 1776671 - RNA, 13 nt, Salmonella enterica enterica serovar Typhi Ty2
gguaaaacgcugg

SEQ ID NO: 1776672 - RNA, 15 nt, Salmonella enterica enterica serovar Typhi Ty2
ggguucguaauaagg

SEQ ID NO: 1776673 - RNA, 14 nt, Salmonella enterica enterica serovar Typhi Ty2
ggguuaaagcccug

SEQ ID NO: 1776674 - RNA, 13 nt, Salmonella enterica enterica serovar Typhi Ty2
ggguucacugcca

SEQ ID NO: 1776675 - RNA, 17 nt, Salmonella enterica enterica serovar Typhi Ty2
ggguucaaguccccccc

SEQ ID NO: 1776676 - RNA, 24 nt, Salmonella enterica enterica serovar Typhi Ty2
ggguuccaggcggagaccacggua

SEQ ID NO: 1776677 - RNA, 14 nt, Salmonella enterica enterica serovar Typhi Ty2
ggguucgcccggca

SEQ ID NO: 1776678 - RNA, 22 nt, Salmonella enterica enterica serovar Typhi Ty2
gggucuuauuucuccugcgcca

SEQ ID NO: 1776679 - RNA, 19 nt, Salmonella enterica enterica serovar Typhi Ty2
gggucguacuaaagagcgc

SEQ ID NO: 1776680 - RNA, 14 nt, Salmonella enterica enterica serovar Typhi Ty2
gggugcgcagcccc

SEQ ID NO: 1776681 - RNA, 14 nt, Salmonella enterica enterica serovar Typhi Ty2
gggugcgcccagac

SEQ ID NO: 1776682 - RNA, 13 nt, Salmonella enterica enterica serovar Typhi Ty2
ggguaugcagugg

SEQ ID NO: 1776683 - RNA, 23 nt, Salmonella enterica enterica serovar Typhi Ty2
ggguaucccgacgcacgagaucc

SEQ ID NO: 1776684 - RNA, 11 nt, Salmonella enterica enterica serovar Typhi Ty2
ggguaguuuug

SEQ ID NO: 1776685 - RNA, 16 nt, Salmonella enterica enterica serovar Typhi Ty2
ggguauugaauccaua

SEQ ID NO: 1776686 - RNA, 13 nt, Salmonella enterica enterica serovar Typhi Ty2
ggguaggccggau

SEQ ID NO: 1776687 - RNA, 15 nt, Salmonella enterica enterica serovar Typhi Ty2
gggcauggcucuccg

SEQ ID NO: 1776688 - RNA, 15 nt, Salmonella enterica enterica serovar Typhi Ty2
gggcagugcucgcca

SEQ ID NO: 1776689 - RNA, 12 nt, Salmonella enterica enterica serovar Typhi Ty2
gggcauccgccg

SEQ ID NO: 1776690 - RNA, 18 nt, Salmonella enterica enterica serovar Typhi Ty2
gggcaggcgucaaaacag

SEQ ID NO: 1776691 - RNA, 17 nt, Salmonella enterica enterica serovar Typhi Ty2
gggccaccugccaggcu

SEQ ID NO: 1776692 - RNA, 14 nt, Salmonella enterica enterica serovar Typhi Ty2
gggccagcagccag

SEQ ID NO: 1776693 - RNA, 17 nt, Salmonella enterica enterica serovar Typhi Ty2
gggcccguggcccaggc

SEQ ID NO: 1776694 - RNA, 18 nt, Salmonella enterica enterica serovar Typhi Ty2
gggauaaugacauccaga

SEQ ID NO: 1776695 - RNA, 13 nt, Salmonella enterica enterica serovar Typhi Ty2
gggauauaaaauu

SEQ ID NO: 1776696 - RNA, 21 nt, Salmonella enterica enterica serovar Typhi Ty2
gggaucguucugcugauaaua

SEQ ID NO: 1776697 - RNA, 16 nt, Salmonella enterica enterica serovar Typhi Ty2
gggaggcggcgagcgg

SEQ ID NO: 1776698 - RNA, 13 nt, Salmonella enterica enterica serovar Typhi Ty2
gggaggggcuuuc

SEQ ID NO: 1776699 - RNA, 23 nt, Salmonella enterica enterica serovar Typhi Ty2
gggaguaguguaauaccacugcc

SEQ ID NO: 1776700 - RNA, 12 nt, Salmonella enterica enterica serovar Typhi Ty2
gggaacacuaaa

SEQ ID NO: 1776701 - RNA, 13 nt, Salmonella enterica enterica serovar Typhi Ty2
gggaacacucuaa

SEQ ID NO: 1776702 - RNA, 19 nt, Salmonella enterica enterica serovar Typhi Ty2
gggaaaucucccuggcagu

SEQ ID NO: 1776703 - RNA, 18 nt, Salmonella enterica enterica serovar Typhi Ty2
gggaaacggauucucuaa

SEQ ID NO: 1776704 - RNA, 12 nt, Salmonella enterica enterica serovar Typhi Ty2
gggaaagggggg

SEQ ID NO: 1776705 - RNA, 15 nt, Salmonella enterica enterica serovar Typhi Ty2
gggcgauaaaccagc

SEQ ID NO: 1776706 - RNA, 23 nt, Salmonella enterica enterica serovar Typhi Ty2
gggcgauaaaccagccccacggu

SEQ ID NO: 1776707 - RNA, 22 nt, Salmonella enterica enterica serovar Typhi Ty2
gggcgcaaaaucgcaaacgcca

SEQ ID NO: 1776708 - RNA, 15 nt, Salmonella enterica enterica serovar Typhi Ty2
gggcgcacagcgcca

SEQ ID NO: 1776709 - RNA, 18 nt, Salmonella enterica enterica serovar Typhi Ty2
gggccggaagagcgcaga

SEQ ID NO: 1776710 - RNA, 21 nt, Salmonella enterica enterica serovar Typhi Ty2
gggcgaacccaucagggaaaa

SEQ ID NO: 1776711 - RNA, 23 nt, Salmonella enterica enterica serovar Typhi Ty2
gggcgagauguuuuaccaguaca

SEQ ID NO: 1776712 - RNA, 23 nt, Salmonella enterica enterica serovar Typhi Ty2
gggcuuuugagucgcauccagug

SEQ ID NO: 1776713 - RNA, 23 nt, Salmonella enterica enterica serovar Typhi Ty2
ggggaacacuaaaacaccgguug

SEQ ID NO: 1776714 - RNA, 22 nt, Salmonella enterica enterica serovar Typhi Ty2
ggggaacggcagacagccgcgg

SEQ ID NO: 1776715 - RNA, 17 nt, Salmonella enterica enterica serovar Typhi Ty2
ggggaauguuuggcgcc

SEQ ID NO: 1776716 - RNA, 15 nt, Salmonella enterica enterica serovar Typhi Ty2
gggcgugacgcgcca

SEQ ID NO: 1776717 - RNA, 15 nt, Salmonella enterica enterica serovar Typhi Ty2
gggcguccacuuucu

SEQ ID NO: 1776718 - RNA, 17 nt, Salmonella enterica enterica serovar Typhi Ty2
gggcguauagccaggca

SEQ ID NO: 1776719 - RNA, 16 nt, Salmonella enterica enterica serovar Typhi Ty2
gggcguauagccaggc

SEQ ID NO: 1776720 - RNA, 13 nt, Salmonella enterica enterica serovar Typhi Ty2
gggaaaaccccac

SEQ ID NO: 1776721 - RNA, 12 nt, Salmonella enterica enterica serovar Typhi Ty2
ggcuuuuuucuc

SEQ ID NO: 1776722 - RNA, 13 nt, Salmonella enterica enterica serovar Typhi Ty2
ggcuuuaaugcuu

SEQ ID NO: 1776723 - RNA, 19 nt, Salmonella enterica enterica serovar Typhi Ty2
ggcuuccggcacuuucaga

SEQ ID NO: 1776724 - RNA, 13 nt, Salmonella enterica enterica serovar Typhi Ty2
ggcuuaccugcuc

SEQ ID NO: 1776725 - RNA, 22 nt, Salmonella enterica enterica serovar Typhi Ty2
ggcuuccaguugaaaaccacaa

SEQ ID NO: 1776726 - RNA, 16 nt, Salmonella enterica enterica serovar Typhi Ty2
ggcuguuaguaagcug

SEQ ID NO: 1776727 - RNA, 20 nt, Salmonella enterica enterica serovar Typhi Ty2
ggcuguucacguaccaggca

SEQ ID NO: 1776728 - RNA, 16 nt, Salmonella enterica enterica serovar Typhi Ty2
ggcugguaagagagcc

SEQ ID NO: 1776729 - RNA, 12 nt, Salmonella enterica enterica serovar Typhi Ty2
ggcuguggcugu

SEQ ID NO: 1776730 - RNA, 23 nt, Salmonella enterica enterica serovar Typhi Ty2
ggcuguauguaggguacagcgcg

SEQ ID NO: 1776731 - RNA, 11 nt, Salmonella enterica enterica serovar Typhi Ty2
ggcuguauaca

SEQ ID NO: 1776732 - RNA, 13 nt, Salmonella enterica enterica serovar Typhi Ty2
ggcuggggaaguu

SEQ ID NO: 1776733 - RNA, 16 nt, Salmonella enterica enterica serovar Typhi Ty2
ggcuggcaauuugaua

SEQ ID NO: 1776734 - RNA, 13 nt, Salmonella enterica enterica serovar Typhi Ty2
ggcugcccugcgg

SEQ ID NO: 1776735 - RNA, 19 nt, Salmonella enterica enterica serovar Typhi Ty2
ggcugccgacaacgccucc

SEQ ID NO: 1776736 - RNA, 20 nt, Salmonella enterica enterica serovar Typhi Ty2
ggcugccgucgaugucgccg

SEQ ID NO: 1776737 - RNA, 16 nt, Salmonella enterica enterica serovar Typhi Ty2
ggcugccccagacgcc

SEQ ID NO: 1776738 - RNA, 17 nt, Salmonella enterica enterica serovar Typhi Ty2
ggcugcgcugccagcug

SEQ ID NO: 1776739 - RNA, 18 nt, Salmonella enterica enterica serovar Typhi Ty2
ggcugcguaaaaucagca

SEQ ID NO: 1776740 - RNA, 23 nt, Salmonella enterica enterica serovar Typhi Ty2
ggcugauaggccuggauagacga

SEQ ID NO: 1776741 - RNA, 18 nt, Salmonella enterica enterica serovar Typhi Ty2
ggcugaggccgcucgcca

SEQ ID NO: 1776742 - RNA, 14 nt, Salmonella enterica enterica serovar Typhi Ty2
ggcugagaaaaaua

SEQ ID NO: 1776743 - RNA, 22 nt, Salmonella enterica enterica serovar Typhi Ty2
ggcugacguuacgcggcgcgcc

SEQ ID NO: 1776744 - RNA, 16 nt, Salmonella enterica enterica serovar Typhi Ty2
ggcugaacgccaggcc

SEQ ID NO: 1776745 - RNA, 16 nt, Salmonella enterica enterica serovar Typhi Ty2
ggcucuaaaaaggaaa

SEQ ID NO: 1776746 - RNA, 19 nt, Salmonella enterica enterica serovar Typhi Ty2
ggcucuaaauuagcucccg

SEQ ID NO: 1776747 - RNA, 13 nt, Salmonella enterica enterica serovar Typhi Ty2
ggcucguuuuugu

SEQ ID NO: 1776748 - RNA, 22 nt, Salmonella enterica enterica serovar Typhi Ty2
ggcucgucguugaaaucgucag

SEQ ID NO: 1776749 - RNA, 18 nt, Salmonella enterica enterica serovar Typhi Ty2
ggcuccagcgccagcucc

SEQ ID NO: 1776750 - RNA, 14 nt, Salmonella enterica enterica serovar Typhi Ty2
ggcuccagcgccag

SEQ ID NO: 1776751 - RNA, 18 nt, Salmonella enterica enterica serovar Typhi Ty2
ggcuccgaccaucgccgc

SEQ ID NO: 1776752 - RNA, 14 nt, Salmonella enterica enterica serovar Typhi Ty2
ggcucccgcagcca

SEQ ID NO: 1776753 - RNA, 16 nt, Salmonella enterica enterica serovar Typhi Ty2
ggcucccacucuucca

SEQ ID NO: 1776754 - RNA, 17 nt, Salmonella enterica enterica serovar Typhi Ty2
ggcucgcagaugcccgc

SEQ ID NO: 1776755 - RNA, 20 nt, Salmonella enterica enterica serovar Typhi Ty2
ggcuccuggugagguuucag

SEQ ID NO: 1776756 - RNA, 17 nt, Salmonella enterica enterica serovar Typhi Ty2
ggcuccaauauuucagc

SEQ ID NO: 1776757 - RNA, 22 nt, Salmonella enterica enterica serovar Typhi Ty2
ggcucaucaaacagcggcacuu

SEQ ID NO: 1776758 - RNA, 20 nt, Salmonella enterica enterica serovar Typhi Ty2
ggcucaucaaacagcggcac

SEQ ID NO: 1776759 - RNA, 21 nt, Salmonella enterica enterica serovar Typhi Ty2
ggcucaggaaaacaaauugca

SEQ ID NO: 1776760 - RNA, 14 nt, Salmonella enterica enterica serovar Typhi Ty2
uaauucaugcugua

SEQ ID NO: 1776761 - RNA, 14 nt, Salmonella enterica enterica serovar Typhi Ty2
uaauuauaaauauu

SEQ ID NO: 1776762 - RNA, 13 nt, Salmonella enterica enterica serovar Typhi Ty2
uaauuagagacau

SEQ ID NO: 1776763 - RNA, 19 nt, Salmonella enterica enterica serovar Typhi Ty2
uaauucuuaacccacaaga

SEQ ID NO: 1776764 - RNA, 21 nt, Salmonella enterica enterica serovar Typhi Ty2
uaauugcuuugcaauguucaa

SEQ ID NO: 1776765 - RNA, 18 nt, Salmonella enterica enterica serovar Typhi Ty2
uaauugcuuuuuuccaca

SEQ ID NO: 1776766 - RNA, 13 nt, Salmonella enterica enterica serovar Typhi Ty2
uaauuggcuuacc

SEQ ID NO: 1776767 - RNA, 16 nt, Salmonella enterica enterica serovar Typhi Ty2
uaaugucuggugcagc

SEQ ID NO: 1776768 - RNA, 17 nt, Salmonella enterica enterica serovar Typhi Ty2
uaauguuaggaguaaau

SEQ ID NO: 1776769 - RNA, 16 nt, Salmonella enterica enterica serovar Typhi Ty2
uaaugcuaucccaggc

SEQ ID NO: 1776770 - RNA, 13 nt, Salmonella enterica enterica serovar Typhi Ty2
uaaugucaucauc

SEQ ID NO: 1776771 - RNA, 17 nt, Salmonella enterica enterica serovar Typhi Ty2
uaauguaaaaaaauaaa

SEQ ID NO: 1776772 - RNA, 18 nt, Salmonella enterica enterica serovar Typhi Ty2
uaauggcagaauaaaaca

SEQ ID NO: 1776773 - RNA, 21 nt, Salmonella enterica enterica serovar Typhi Ty2
uaauggauucucgcgccgggg

SEQ ID NO: 1776774 - RNA, 19 nt, Salmonella enterica enterica serovar Typhi Ty2
uaaucugucgcuaaagcac

SEQ ID NO: 1776775 - RNA, 23 nt, Salmonella enterica enterica serovar Typhi Ty2
uaaucguuagcgagguucccgcc

SEQ ID NO: 1776776 - RNA, 16 nt, Salmonella enterica enterica serovar Typhi Ty2
uaaucuaaaauuauuu

SEQ ID NO: 1776777 - RNA, 13 nt, Salmonella enterica enterica serovar Typhi Ty2
uaaucuacaaacg

SEQ ID NO: 1776778 - RNA, 17 nt, Salmonella enterica enterica serovar Typhi Ty2
uaaucucaaacuuggcc

SEQ ID NO: 1776779 - RNA, 17 nt, Salmonella enterica enterica serovar Typhi Ty2
uaaucggcgucauuuuc

SEQ ID NO: 1776780 - RNA, 15 nt, Salmonella enterica enterica serovar Typhi Ty2
uaaucgcuucaauca

SEQ ID NO: 1776781 - RNA, 21 nt, Salmonella enterica enterica serovar Typhi Ty2
uaaucgccugcauauuagcaa

SEQ ID NO: 1776782 - RNA, 18 nt, Salmonella enterica enterica serovar Typhi Ty2
uaaucgcgagaaaauaga

SEQ ID NO: 1776783 - RNA, 21 nt, Salmonella enterica enterica serovar Typhi Ty2
uaaucgcgauacugccgccca

SEQ ID NO: 1776784 - RNA, 15 nt, Salmonella enterica enterica serovar Typhi Ty2
uaaucgauacuaaaa

SEQ ID NO: 1776785 - RNA, 18 nt, Salmonella enterica enterica serovar Typhi Ty2
uaauccaggaauuuuccc

SEQ ID NO: 1776786 - RNA, 19 nt, Salmonella enterica enterica serovar Typhi Ty2
uaauccaggaauuuuccca

SEQ ID NO: 1776787 - RNA, 19 nt, Salmonella enterica enterica serovar Typhi Ty2
uaauaugcgcaaucaccuc

SEQ ID NO: 1776788 - RNA, 13 nt, Salmonella enterica enterica serovar Typhi Ty2
uaauaugccaggc

SEQ ID NO: 1776789 - RNA, 14 nt, Salmonella enterica enterica serovar Typhi Ty2
uaauagauugcgcc

SEQ ID NO: 1776790 - RNA, 21 nt, Salmonella enterica enterica serovar Typhi Ty2
uaauagagauccuggcgaaag

SEQ ID NO: 1776791 - RNA, 16 nt, Salmonella enterica enterica serovar Typhi Ty2
uaauagaugcgucgca

SEQ ID NO: 1776792 - RNA, 19 nt, Salmonella enterica enterica serovar Typhi Ty2
uaauagccucauccccagc

SEQ ID NO: 1776793 - RNA, 16 nt, Salmonella enterica enterica serovar Typhi Ty2
uaauauuaagcagcuu

SEQ ID NO: 1776794 - RNA, 14 nt, Salmonella enterica enterica serovar Typhi Ty2
uaauauuaagcagc

SEQ ID NO: 1776795 - RNA, 20 nt, Salmonella enterica enterica serovar Typhi Ty2
uaaucaauaaguuuuuucuu

SEQ ID NO: 1776796 - RNA, 12 nt, Salmonella enterica enterica serovar Typhi Ty2
uaaucaauaagu

SEQ ID NO: 1776797 - RNA, 13 nt, Salmonella enterica enterica serovar Typhi Ty2
uaaucaauaaguu

SEQ ID NO: 1776798 - RNA, 15 nt, Salmonella enterica enterica serovar Typhi Ty2
uaaucaacucuccuu

SEQ ID NO: 1776799 - RNA, 16 nt, Salmonella enterica enterica serovar Typhi Ty2
uaaucauauaagaaau

SEQ ID NO: 1776800 - RNA, 20 nt, Salmonella enterica enterica serovar Typhi Ty2
uaaucaucaccguuuuccag

SEQ ID NO: 1776801 - RNA, 21 nt, Salmonella enterica enterica serovar Typhi Ty2
uaauccagaggguaauuucuu

SEQ ID NO: 1776802 - RNA, 16 nt, Salmonella enterica enterica serovar Typhi Ty2
uaaucaggagggcugc

SEQ ID NO: 1776803 - RNA, 22 nt, Salmonella enterica enterica serovar Typhi Ty2
uaaggaugaacucuaugcaaaa

SEQ ID NO: 1776804 - RNA, 23 nt, Salmonella enterica enterica serovar Typhi Ty2
uaaggaucggaagacuggcgcag

SEQ ID NO: 1776805 - RNA, 20 nt, Salmonella enterica enterica serovar Typhi Ty2
uaaggacuuuaucuuuacca

SEQ ID NO: 1776806 - RNA, 12 nt, Salmonella enterica enterica serovar Typhi Ty2
uaaggcagccau

SEQ ID NO: 1776807 - RNA, 21 nt, Salmonella enterica enterica serovar Typhi Ty2
uaaggcaaguucuuguuucau

SEQ ID NO: 1776808 - RNA, 18 nt, Salmonella enterica enterica serovar Typhi Ty2
uaaggcaugaugccacga

SEQ ID NO: 1776809 - RNA, 19 nt, Salmonella enterica enterica serovar Typhi Ty2
uaaggccugccguccugau

SEQ ID NO: 1776810 - RNA, 20 nt, Salmonella enterica enterica serovar Typhi Ty2
uaaggcgauucaacagggca

SEQ ID NO: 1776811 - RNA, 21 nt, Salmonella enterica enterica serovar Typhi Ty2
uaaggcgauucaacagggcaa

SEQ ID NO: 1776812 - RNA, 19 nt, Salmonella enterica enterica serovar Typhi Ty2
uaaggcgcuugcgccgcca

SEQ ID NO: 1776813 - RNA, 16 nt, Salmonella enterica enterica serovar Typhi Ty2
uaaggcuggcacguuc

SEQ ID NO: 1776814 - RNA, 18 nt, Salmonella enterica enterica serovar Typhi Ty2
uaaggcucucuuaccagc

SEQ ID NO: 1776815 - RNA, 14 nt, Salmonella enterica enterica serovar Typhi Ty2
uaaguaaguugauc

SEQ ID NO: 1776816 - RNA, 19 nt, Salmonella enterica enterica serovar Typhi Ty2
uaaguacgccugaaaacag

SEQ ID NO: 1776817 - RNA, 20 nt, Salmonella enterica enterica serovar Typhi Ty2
uaagguaacgcgaaaaaaga

SEQ ID NO: 1776818 - RNA, 19 nt, Salmonella enterica enterica serovar Typhi Ty2
uaagguauccuaaugccac

SEQ ID NO: 1776819 - RNA, 19 nt, Salmonella enterica enterica serovar Typhi Ty2
uaaggucgcuauccagcag

SEQ ID NO: 1776820 - RNA, 21 nt, Salmonella enterica enterica serovar Typhi Ty2
uaagguucuggcauuggcauc

SEQ ID NO: 1776821 - RNA, 14 nt, Salmonella enterica enterica serovar Typhi Ty2
uaagucauccagac

SEQ ID NO: 1776822 - RNA, 20 nt, Salmonella enterica enterica serovar Typhi Ty2
uaaguaucagcgcgcuuuuu

SEQ ID NO: 1776823 - RNA, 22 nt, Salmonella enterica enterica serovar Typhi Ty2
uaaguccgcgggcaaaagggcc

SEQ ID NO: 1776824 - RNA, 19 nt, Salmonella enterica enterica serovar Typhi Ty2
uaagucgccgcagcuccau

SEQ ID NO: 1776825 - RNA, 14 nt, Salmonella enterica enterica serovar Typhi Ty2
uaagugcaggcuga

SEQ ID NO: 1776826 - RNA, 16 nt, Salmonella enterica enterica serovar Typhi Ty2
uaaguucaaacucauu

SEQ ID NO: 1776827 - RNA, 17 nt, Salmonella enterica enterica serovar Typhi Ty2
uaaguuggacaaggcac

SEQ ID NO: 1776828 - RNA, 15 nt, Salmonella enterica enterica serovar Typhi Ty2
uaaguugaccacauc

SEQ ID NO: 1776829 - RNA, 11 nt, Salmonella enterica enterica serovar Typhi Ty2
uaauaaagaaa

SEQ ID NO: 1776830 - RNA, 11 nt, Salmonella enterica enterica serovar Typhi Ty2
uaauaaauauu

SEQ ID NO: 1776831 - RNA, 18 nt, Salmonella enterica enterica serovar Typhi Ty2
uaauaaaaucuaagagcc

SEQ ID NO: 1776832 - RNA, 13 nt, Salmonella enterica enterica serovar Typhi Ty2
uaauaaaauaacu

SEQ ID NO: 1776833 - RNA, 9 nt, Salmonella enterica enterica serovar Typhi Ty2
uaauaacgg

SEQ ID NO: 1776834 - RNA, 22 nt, Salmonella enterica enterica serovar Typhi Ty2
uaauaauacaccgccauauauu

SEQ ID NO: 1776835 - RNA, 22 nt, Salmonella enterica enterica serovar Typhi Ty2
uaauaauugagcgcaaaacgcu

SEQ ID NO: 1776836 - RNA, 19 nt, Salmonella enterica enterica serovar Typhi Ty2
uaauaauuagcauccagca

SEQ ID NO: 1776837 - RNA, 15 nt, Salmonella enterica enterica serovar Typhi Ty2
uaauacauaucauuu

SEQ ID NO: 1776838 - RNA, 17 nt, Salmonella enterica enterica serovar Typhi Ty2
uaauacaucaugcuugc

SEQ ID NO: 1776839 - RNA, 16 nt, Salmonella enterica enterica serovar Typhi Ty2
uaauacaggccagcau

SEQ ID NO: 1776840 - RNA, 20 nt, Salmonella enterica enterica serovar Typhi Ty2
uaauacaccgccauauauuu

SEQ ID NO: 1776841 - RNA, 13 nt, Salmonella enterica enterica serovar Typhi Ty2
uaauacugccgca

SEQ ID NO: 1776842 - RNA, 22 nt, Salmonella enterica enterica serovar Typhi Ty2
uaauacuggcgccuuuuggcag

SEQ ID NO: 1776843 - RNA, 15 nt, Salmonella enterica enterica serovar Typhi Ty2
uaauacuggcgccuu

SEQ ID NO: 1776844 - RNA, 19 nt, Salmonella enterica enterica serovar Typhi Ty2
uaauaccaucuccaucggg

SEQ ID NO: 1776845 - RNA, 19 nt, Salmonella enterica enterica serovar Typhi Ty2
uaauacguaaaccgcucac

SEQ ID NO: 1776846 - RNA, 13 nt, Salmonella enterica enterica serovar Typhi Ty2
uacguucaaauug

SEQ ID NO: 1776847 - RNA, 20 nt, Salmonella enterica enterica serovar Typhi Ty2
uacguucaccccgucauauu

SEQ ID NO: 1776848 - RNA, 18 nt, Salmonella enterica enterica serovar Typhi Ty2
uacguugauuaucaccca

SEQ ID NO: 1776849 - RNA, 17 nt, Salmonella enterica enterica serovar Typhi Ty2
uacuaaugaauuuaaua

SEQ ID NO: 1776850 - RNA, 21 nt, Salmonella enterica enterica serovar Typhi Ty2
uacuaaucucacccauagaua

SEQ ID NO: 1776851 - RNA, 13 nt, Salmonella enterica enterica serovar Typhi Ty2
uacuaauaaaauu

SEQ ID NO: 1776852 - RNA, 21 nt, Salmonella enterica enterica serovar Typhi Ty2
uacguaacugcgguaaauaau

SEQ ID NO: 1776853 - RNA, 22 nt, Salmonella enterica enterica serovar Typhi Ty2
uacgguuuauccccgcuggugc

SEQ ID NO: 1776854 - RNA, 14 nt, Salmonella enterica enterica serovar Typhi Ty2
uacguaauaaaauu

SEQ ID NO: 1776855 - RNA, 16 nt, Salmonella enterica enterica serovar Typhi Ty2
uacgugcucucaccau

SEQ ID NO: 1776856 - RNA, 15 nt, Salmonella enterica enterica serovar Typhi Ty2
uacgccugaaaacag

SEQ ID NO: 1776857 - RNA, 15 nt, Salmonella enterica enterica serovar Typhi Ty2
uacgcuggugcagcc

SEQ ID NO: 1776858 - RNA, 18 nt, Salmonella enterica enterica serovar Typhi Ty2
uacgcuguagcuggcugc

SEQ ID NO: 1776859 - RNA, 19 nt, Salmonella enterica enterica serovar Typhi Ty2
uaccugucguacgccuaaa

SEQ ID NO: 1776860 - RNA, 14 nt, Salmonella enterica enterica serovar Typhi Ty2
uaccuguuuaucug

SEQ ID NO: 1776861 - RNA, 15 nt, Salmonella enterica enterica serovar Typhi Ty2
uaccuuaaugaugug

SEQ ID NO: 1776862 - RNA, 16 nt, Salmonella enterica enterica serovar Typhi Ty2
uaccuuauucagccca

SEQ ID NO: 1776863 - RNA, 17 nt, Salmonella enterica enterica serovar Typhi Ty2
uacgcaaaaaaagccau

SEQ ID NO: 1776864 - RNA, 23 nt, Salmonella enterica enterica serovar Typhi Ty2
uacgaggugggcucagcgaccug

SEQ ID NO: 1776865 - RNA, 18 nt, Salmonella enterica enterica serovar Typhi Ty2
uacgauucagguuuugcu

SEQ ID NO: 1776866 - RNA, 17 nt, Salmonella enterica enterica serovar Typhi Ty2
uacgacgcgccaccauc

SEQ ID NO: 1776867 - RNA, 18 nt, Salmonella enterica enterica serovar Typhi Ty2
uacgagaaccaacugcca

SEQ ID NO: 1776868 - RNA, 19 nt, Salmonella enterica enterica serovar Typhi Ty2
uacgagcauccagaucggc

SEQ ID NO: 1776869 - RNA, 15 nt, Salmonella enterica enterica serovar Typhi Ty2
uacgccgccgcccag

SEQ ID NO: 1776870 - RNA, 20 nt, Salmonella enterica enterica serovar Typhi Ty2
uacgcccaucagcccgcaaa

SEQ ID NO: 1776871 - RNA, 17 nt, Salmonella enterica enterica serovar Typhi Ty2
uacgcccuauccggccg

SEQ ID NO: 1776872 - RNA, 14 nt, Salmonella enterica enterica serovar Typhi Ty2
uacgccccugcugg

SEQ ID NO: 1776873 - RNA, 18 nt, Salmonella enterica enterica serovar Typhi Ty2
uacgcccgugacgccagg

SEQ ID NO: 1776874 - RNA, 21 nt, Salmonella enterica enterica serovar Typhi Ty2
uacgcgaugagauaauaaaug

SEQ ID NO: 1776875 - RNA, 23 nt, Salmonella enterica enterica serovar Typhi Ty2
uacgcgauaaaaacccaccagcg

SEQ ID NO: 1776876 - RNA, 24 nt, Salmonella enterica enterica serovar Typhi Ty2
uacgccuaaauuuaacucguccug

SEQ ID NO: 1776877 - RNA, 17 nt, Salmonella enterica enterica serovar Typhi Ty2
uacgcaaggaaauauua

SEQ ID NO: 1776878 - RNA, 16 nt, Salmonella enterica enterica serovar Typhi Ty2
uacgcaaaaaaagcca

SEQ ID NO: 1776879 - RNA, 12 nt, Salmonella enterica enterica serovar Typhi Ty2
uacgcaaaucac

SEQ ID NO: 1776880 - RNA, 18 nt, Salmonella enterica enterica serovar Typhi Ty2
uacgccaucuuucuuuuc

SEQ ID NO: 1776881 - RNA, 15 nt, Salmonella enterica enterica serovar Typhi Ty2
uacgccagccuaucg

SEQ ID NO: 1776882 - RNA, 19 nt, Salmonella enterica enterica serovar Typhi Ty2
uacgccagcagacagguga

SEQ ID NO: 1776883 - RNA, 16 nt, Salmonella enterica enterica serovar Typhi Ty2
uacgccagcagacagg

SEQ ID NO: 1776884 - RNA, 14 nt, Salmonella enterica enterica serovar Typhi Ty2
uacgccaagcugca

SEQ ID NO: 1776885 - RNA, 20 nt, Salmonella enterica enterica serovar Typhi Ty2
uacgccacggcaauuuacaa

SEQ ID NO: 1776886 - RNA, 22 nt, Salmonella enterica enterica serovar Typhi Ty2
uacccagcgccaacgccacugc

SEQ ID NO: 1776887 - RNA, 21 nt, Salmonella enterica enterica serovar Typhi Ty2
uacccagcgccaacgccacug

SEQ ID NO: 1776888 - RNA, 18 nt, Salmonella enterica enterica serovar Typhi Ty2
uacccauaguagcuaaug

SEQ ID NO: 1776889 - RNA, 18 nt, Salmonella enterica enterica serovar Typhi Ty2
uacccagcgaaugcugca

SEQ ID NO: 1776890 - RNA, 14 nt, Salmonella enterica enterica serovar Typhi Ty2
uaccauucagcuua

SEQ ID NO: 1776891 - RNA, 21 nt, Salmonella enterica enterica serovar Typhi Ty2
uacccgguguaaaaaaugggu

SEQ ID NO: 1776892 - RNA, 20 nt, Salmonella enterica enterica serovar Typhi Ty2
uacccggcgcaaacuucaca

SEQ ID NO: 1776893 - RNA, 16 nt, Salmonella enterica enterica serovar Typhi Ty2
uacccgcugcuucacg

SEQ ID NO: 1776894 - RNA, 20 nt, Salmonella enterica enterica serovar Typhi Ty2
uacccauuucuucuucaagc

SEQ ID NO: 1776895 - RNA, 17 nt, Salmonella enterica enterica serovar Typhi Ty2
uaccccacgccauaaug

SEQ ID NO: 1776896 - RNA, 21 nt, Salmonella enterica enterica serovar Typhi Ty2
uacccgcacgcuuucuucguu

SEQ ID NO: 1776897 - RNA, 18 nt, Salmonella enterica enterica serovar Typhi Ty2
uacccgccgcuggcuguu

SEQ ID NO: 1776898 - RNA, 19 nt, Salmonella enterica enterica serovar Typhi Ty2
uacccgcgcaucccacacc

SEQ ID NO: 1776899 - RNA, 16 nt, Salmonella enterica enterica serovar Typhi Ty2
uaccauccauuaaaau

SEQ ID NO: 1776900 - RNA, 21 nt, Salmonella enterica enterica serovar Typhi Ty2
uaccauaucgccgcugccgcu

SEQ ID NO: 1776901 - RNA, 22 nt, Salmonella enterica enterica serovar Typhi Ty2
uaccauaccggugcgccccagc

SEQ ID NO: 1776902 - RNA, 17 nt, Salmonella enterica enterica serovar Typhi Ty2
uaccaguaccgaaacca

SEQ ID NO: 1776903 - RNA, 18 nt, Salmonella enterica enterica serovar Typhi Ty2
uaccacacaugcaaaaaa

SEQ ID NO: 1776904 - RNA, 21 nt, Salmonella enterica enterica serovar Typhi Ty2
uaccguugaugauuacugcug

SEQ ID NO: 1776905 - RNA, 22 nt, Salmonella enterica enterica serovar Typhi Ty2
uaccguuucaacugccccuugu

SEQ ID NO: 1776906 - RNA, 22 nt, Salmonella enterica enterica serovar Typhi Ty2
uaccuauuuuaaauucccagcg

SEQ ID NO: 1776907 - RNA, 20 nt, Salmonella enterica enterica serovar Typhi Ty2
uaccuauuuuaaauucccag

SEQ ID NO: 1776908 - RNA, 22 nt, Salmonella enterica enterica serovar Typhi Ty2
uaccucagguaucauaugugcc

SEQ ID NO: 1776909 - RNA, 19 nt, Salmonella enterica enterica serovar Typhi Ty2
uaccuccuggcguuaucau

SEQ ID NO: 1776910 - RNA, 14 nt, Salmonella enterica enterica serovar Typhi Ty2
uaccuccuggcguu

SEQ ID NO: 1776911 - RNA, 17 nt, Salmonella enterica enterica serovar Typhi Ty2
uaccugccugucacgca

SEQ ID NO: 1776912 - RNA, 21 nt, Salmonella enterica enterica serovar Typhi Ty2
uaccugcaaaaacgccagacc

SEQ ID NO: 1776913 - RNA, 12 nt, Salmonella enterica enterica serovar Typhi Ty2
uaccugaugagc

SEQ ID NO: 1776914 - RNA, 17 nt, Salmonella enterica enterica serovar Typhi Ty2
uaccugaugagcaggcc

SEQ ID NO: 1776915 - RNA, 22 nt, Salmonella enterica enterica serovar Typhi Ty2
uaccugauccagcucuucuucg

SEQ ID NO: 1776916 - RNA, 16 nt, Salmonella enterica enterica serovar Typhi Ty2
uaccucuuauccggcu

SEQ ID NO: 1776917 - RNA, 21 nt, Salmonella enterica enterica serovar Typhi Ty2
uaccgaggacgggacuugaac

SEQ ID NO: 1776918 - RNA, 19 nt, Salmonella enterica enterica serovar Typhi Ty2
uaccgauaauuaagccggu

SEQ ID NO: 1776919 - RNA, 15 nt, Salmonella enterica enterica serovar Typhi Ty2
uaccgauagcgcgga

SEQ ID NO: 1776920 - RNA, 23 nt, Salmonella enterica enterica serovar Typhi Ty2
uaccgcugggaugaccugaaauc

SEQ ID NO: 1776921 - RNA, 23 nt, Salmonella enterica enterica serovar Typhi Ty2
uaccgcuugggccaccugccagg

SEQ ID NO: 1776922 - RNA, 17 nt, Salmonella enterica enterica serovar Typhi Ty2
uaccgcuuugccgcgcu

SEQ ID NO: 1776923 - RNA, 16 nt, Salmonella enterica enterica serovar Typhi Ty2
uaccgacacaucaucg

SEQ ID NO: 1776924 - RNA, 15 nt, Salmonella enterica enterica serovar Typhi Ty2
uaccgaacagccagg

SEQ ID NO: 1776925 - RNA, 14 nt, Salmonella enterica enterica serovar Typhi Ty2
uaccgaagaacaua

SEQ ID NO: 1776926 - RNA, 19 nt, Salmonella enterica enterica serovar Typhi Ty2
uaccguccagacuccuuuu

SEQ ID NO: 1776927 - RNA, 14 nt, Salmonella enterica enterica serovar Typhi Ty2
uaccguccagacuc

SEQ ID NO: 1776928 - RNA, 20 nt, Salmonella enterica enterica serovar Typhi Ty2
uaccggaucgaucccggcaa

SEQ ID NO: 1776929 - RNA, 20 nt, Salmonella enterica enterica serovar Typhi Ty2
uaccggaaucgccugcgucg

SEQ ID NO: 1776930 - RNA, 14 nt, Salmonella enterica enterica serovar Typhi Ty2
uaccggcacaccgg

SEQ ID NO: 1776931 - RNA, 17 nt, Salmonella enterica enterica serovar Typhi Ty2
uaccggcaacgccgggg

SEQ ID NO: 1776932 - RNA, 23 nt, Salmonella enterica enterica serovar Typhi Ty2
uaccggcaggugauggcggcuug

SEQ ID NO: 1776933 - RNA, 18 nt, Salmonella enterica enterica serovar Typhi Ty2
uacauauuguuuucuauu

SEQ ID NO: 1776934 - RNA, 15 nt, Salmonella enterica enterica serovar Typhi Ty2
uacaucagaguaauu

SEQ ID NO: 1776935 - RNA, 18 nt, Salmonella enterica enterica serovar Typhi Ty2
uacaggcuuaacacccgg

SEQ ID NO: 1776936 - RNA, 18 nt, Salmonella enterica enterica serovar Typhi Ty2
uacaggggauuguuaacg

SEQ ID NO: 1776937 - RNA, 17 nt, Salmonella enterica enterica serovar Typhi Ty2
uacaggccgauauauug

SEQ ID NO: 1776938 - RNA, 18 nt, Salmonella enterica enterica serovar Typhi Ty2
uacauccaugccauccag

SEQ ID NO: 1776939 - RNA, 18 nt, Salmonella enterica enterica serovar Typhi Ty2
uacauccaucacuccuua

SEQ ID NO: 1776940 - RNA, 14 nt, Salmonella enterica enterica serovar Typhi Ty2
uacaucgucugcuu

SEQ ID NO: 1776941 - RNA, 18 nt, Salmonella enterica enterica serovar Typhi Ty2
uacaucuacuucagcacg

SEQ ID NO: 1776942 - RNA, 12 nt, Salmonella enterica enterica serovar Typhi Ty2
uacaugaauaau

SEQ ID NO: 1776943 - RNA, 14 nt, Salmonella enterica enterica serovar Typhi Ty2
uacaugaauaauaa

SEQ ID NO: 1776944 - RNA, 15 nt, Salmonella enterica enterica serovar Typhi Ty2
uacaugcuacaggca

SEQ ID NO: 1776945 - RNA, 13 nt, Salmonella enterica enterica serovar Typhi Ty2
uacauugccaguc

SEQ ID NO: 1776946 - RNA, 22 nt, Salmonella enterica enterica serovar Typhi Ty2
uacauuugaauaauucuguacc

SEQ ID NO: 1776947 - RNA, 18 nt, Salmonella enterica enterica serovar Typhi Ty2
uacauuucgucaucgcuu

SEQ ID NO: 1776948 - RNA, 24 nt, Salmonella enterica enterica serovar Typhi Ty2
uacauuuucguaaaauauauauuu

SEQ ID NO: 1776949 - RNA, 15 nt, Salmonella enterica enterica serovar Typhi Ty2
uaccaauacccagcg

SEQ ID NO: 1776950 - RNA, 14 nt, Salmonella enterica enterica serovar Typhi Ty2
uaccaauacccagc

SEQ ID NO: 1776951 - RNA, 21 nt, Salmonella enterica enterica serovar Typhi Ty2
uaccaauaagaacuuuaucac

SEQ ID NO: 1776952 - RNA, 22 nt, Salmonella enterica enterica serovar Typhi Ty2
uaccacaaauuuugauaaaaac

SEQ ID NO: 1776953 - RNA, 18 nt, Salmonella enterica enterica serovar Typhi Ty2
uaccaauacccagcgcca

SEQ ID NO: 1776954 - RNA, 18 nt, Salmonella enterica enterica serovar Typhi Ty2
uaccaaaacagaaaagau

SEQ ID NO: 1776955 - RNA, 16 nt, Salmonella enterica enterica serovar Typhi Ty2
uaccaaaacagaaaag

SEQ ID NO: 1776956 - RNA, 17 nt, Salmonella enterica enterica serovar Typhi Ty2
uaccaaagucaucaauu

SEQ ID NO: 1776957 - RNA, 19 nt, Salmonella enterica enterica serovar Typhi Ty2
uaccaaagugguuccaggc

SEQ ID NO: 1776958 - RNA, 19 nt, Salmonella enterica enterica serovar Typhi Ty2
uaccaaacccuuuggcaaa

SEQ ID NO: 1776959 - RNA, 19 nt, Salmonella enterica enterica serovar Typhi Ty2
uaccaaccgccagucaccc

SEQ ID NO: 1776960 - RNA, 20 nt, Salmonella enterica enterica serovar Typhi Ty2
uaccaaccgccagucacccu

SEQ ID NO: 1776961 - RNA, 15 nt, Salmonella enterica enterica serovar Typhi Ty2
uaccaacguaaauua

SEQ ID NO: 1776962 - RNA, 22 nt, Salmonella enterica enterica serovar Typhi Ty2
uacaaucgucuucagcaauuac

SEQ ID NO: 1776963 - RNA, 21 nt, Salmonella enterica enterica serovar Typhi Ty2
uacaauccaggacgucuugca

SEQ ID NO: 1776964 - RNA, 13 nt, Salmonella enterica enterica serovar Typhi Ty2
uacaaccgcaccg

SEQ ID NO: 1776965 - RNA, 22 nt, Salmonella enterica enterica serovar Typhi Ty2
uacaaccguggcguuuucauua

SEQ ID NO: 1776966 - RNA, 21 nt, Salmonella enterica enterica serovar Typhi Ty2
uacaacgacuacguucaucag

SEQ ID NO: 1776967 - RNA, 22 nt, Salmonella enterica enterica serovar Typhi Ty2
uacaacgacuacguucaucagg

SEQ ID NO: 1776968 - RNA, 22 nt, Salmonella enterica enterica serovar Typhi Ty2
uacaacuacucguaaucuaaaa

SEQ ID NO: 1776969 - RNA, 16 nt, Salmonella enterica enterica serovar Typhi Ty2
uacaacucauccaccu

SEQ ID NO: 1776970 - RNA, 19 nt, Salmonella enterica enterica serovar Typhi Ty2
uacaaagggcaauauauua

SEQ ID NO: 1776971 - RNA, 19 nt, Salmonella enterica enterica serovar Typhi Ty2
uaauuguggaaauaagagu

SEQ ID NO: 1776972 - RNA, 13 nt, Salmonella enterica enterica serovar Typhi Ty2
uacagcgccauga

SEQ ID NO: 1776973 - RNA, 17 nt, Salmonella enterica enterica serovar Typhi Ty2
uacagcaauaaaaggaa

SEQ ID NO: 1776974 - RNA, 20 nt, Salmonella enterica enterica serovar Typhi Ty2
uacagcccgccagcaccagg

SEQ ID NO: 1776975 - RNA, 19 nt, Salmonella enterica enterica serovar Typhi Ty2
uacaauuucuggccccuga

SEQ ID NO: 1776976 - RNA, 14 nt, Salmonella enterica enterica serovar Typhi Ty2
uacaauggcaggca

SEQ ID NO: 1776977 - RNA, 12 nt, Salmonella enterica enterica serovar Typhi Ty2
uacacagcacaa

SEQ ID NO: 1776978 - RNA, 17 nt, Salmonella enterica enterica serovar Typhi Ty2
uacagaaaaccggcaaa

SEQ ID NO: 1776979 - RNA, 15 nt, Salmonella enterica enterica serovar Typhi Ty2
uagaaugcuucuucg

SEQ ID NO: 1776980 - RNA, 19 nt, Salmonella enterica enterica serovar Typhi Ty2
uagaauuuucacuuauaaa

SEQ ID NO: 1776981 - RNA, 14 nt, Salmonella enterica enterica serovar Typhi Ty2
uagaauuuucacuu

SEQ ID NO: 1776982 - RNA, 20 nt, Salmonella enterica enterica serovar Typhi Ty2
uagacaacaucccagaaaau

SEQ ID NO: 1776983 - RNA, 11 nt, Salmonella enterica enterica serovar Typhi Ty2
uagacaaacag

SEQ ID NO: 1776984 - RNA, 15 nt, Salmonella enterica enterica serovar Typhi Ty2
uagaauagcgccgug

SEQ ID NO: 1776985 - RNA, 16 nt, Salmonella enterica enterica serovar Typhi Ty2
uagaacggaaguugca

SEQ ID NO: 1776986 - RNA, 21 nt, Salmonella enterica enterica serovar Typhi Ty2
uagaauagaaucaauuucucu

SEQ ID NO: 1776987 - RNA, 16 nt, Salmonella enterica enterica serovar Typhi Ty2
uagaagccacaaucug

SEQ ID NO: 1776988 - RNA, 19 nt, Salmonella enterica enterica serovar Typhi Ty2
uagaaaguggcauaucaug

SEQ ID NO: 1776989 - RNA, 22 nt, Salmonella enterica enterica serovar Typhi Ty2
uagaaagauuucaucaggcuga

SEQ ID NO: 1776990 - RNA, 17 nt, Salmonella enterica enterica serovar Typhi Ty2
uagaaagauuucaucag

SEQ ID NO: 1776991 - RNA, 14 nt, Salmonella enterica enterica serovar Typhi Ty2
uagaacagcaugaa

SEQ ID NO: 1776992 - RNA, 16 nt, Salmonella enterica enterica serovar Typhi Ty2
uagagugcuucugcaa

SEQ ID NO: 1776993 - RNA, 20 nt, Salmonella enterica enterica serovar Typhi Ty2
uagagaguaaaaccggcaca

SEQ ID NO: 1776994 - RNA, 18 nt, Salmonella enterica enterica serovar Typhi Ty2
uagagcaggucaaagacg

SEQ ID NO: 1776995 - RNA, 18 nt, Salmonella enterica enterica serovar Typhi Ty2
uagagcguggucauuagg

SEQ ID NO: 1776996 - RNA, 13 nt, Salmonella enterica enterica serovar Typhi Ty2
uagagaaaucaac

SEQ ID NO: 1776997 - RNA, 14 nt, Salmonella enterica enterica serovar Typhi Ty2
uagagaaaauaaca

SEQ ID NO: 1776998 - RNA, 21 nt, Salmonella enterica enterica serovar Typhi Ty2
uagacuuuggcgcagucacag

SEQ ID NO: 1776999 - RNA, 21 nt, Salmonella enterica enterica serovar Typhi Ty2
uagagaacagcaucaccggcc

SEQ ID NO: 1777000 - RNA, 16 nt, Salmonella enterica enterica serovar Typhi Ty2
uagagaccgcuuuagc

SEQ ID NO: 1777001 - RNA, 23 nt, Salmonella enterica enterica serovar Typhi Ty2
uagacgucgcguacaauugcuuc

SEQ ID NO: 1777002 - RNA, 18 nt, Salmonella enterica enterica serovar Typhi Ty2
uagacgcgcuagcuucag

SEQ ID NO: 1777003 - RNA, 15 nt, Salmonella enterica enterica serovar Typhi Ty2
uagacggccugcaaa

SEQ ID NO: 1777004 - RNA, 21 nt, Salmonella enterica enterica serovar Typhi Ty2
uagacaacaucccagaaaaug

SEQ ID NO: 1777005 - RNA, 20 nt, Salmonella enterica enterica serovar Typhi Ty2
uagacagcggcuaauuuauu

SEQ ID NO: 1777006 - RNA, 19 nt, Salmonella enterica enterica serovar Typhi Ty2
uagacagcaccaucaugca

SEQ ID NO: 1777007 - RNA, 22 nt, Salmonella enterica enterica serovar Typhi Ty2
uagacaguuuuuucguuccaga

SEQ ID NO: 1777008 - RNA, 18 nt, Salmonella enterica enterica serovar Typhi Ty2
uagaccugaaaucagccu

SEQ ID NO: 1777009 - RNA, 22 nt, Salmonella enterica enterica serovar Typhi Ty2
uagaccugaaaucagccugcua

SEQ ID NO: 1777010 - RNA, 16 nt, Salmonella enterica enterica serovar Typhi Ty2
uagaccagcggcccgc

SEQ ID NO: 1777011 - RNA, 19 nt, Salmonella enterica enterica serovar Typhi Ty2
uaggaguaaauaauuuugu

SEQ ID NO: 1777012 - RNA, 17 nt, Salmonella enterica enterica serovar Typhi Ty2
uaggaucaaccaccuuc

SEQ ID NO: 1777013 - RNA, 17 nt, Salmonella enterica enterica serovar Typhi Ty2
uaggcgaggaaaacauu

SEQ ID NO: 1777014 - RNA, 18 nt, Salmonella enterica enterica serovar Typhi Ty2
uaggccugguaagcguag

SEQ ID NO: 1777015 - RNA, 12 nt, Salmonella enterica enterica serovar Typhi Ty2
uaggccggauaa

SEQ ID NO: 1777016 - RNA, 15 nt, Salmonella enterica enterica serovar Typhi Ty2
uaggguggcuuucua

SEQ ID NO: 1777017 - RNA, 18 nt, Salmonella enterica enterica serovar Typhi Ty2
uagggugcagugaaccau

SEQ ID NO: 1777018 - RNA, 13 nt, Salmonella enterica enterica serovar Typhi Ty2
uagggcaucagac

SEQ ID NO: 1777019 - RNA, 16 nt, Salmonella enterica enterica serovar Typhi Ty2
uaggaaaggcagagaa

SEQ ID NO: 1777020 - RNA, 16 nt, Salmonella enterica enterica serovar Typhi Ty2
uagcucgucuguuuug

SEQ ID NO: 1777021 - RNA, 20 nt, Salmonella enterica enterica serovar Typhi Ty2
uagcucuucaucuuuuucau

SEQ ID NO: 1777022 - RNA, 21 nt, Salmonella enterica enterica serovar Typhi Ty2
uagcucuuucauuucugccug

SEQ ID NO: 1777023 - RNA, 22 nt, Salmonella enterica enterica serovar Typhi Ty2
uagcucuuucauuucugccugc

SEQ ID NO: 1777024 - RNA, 20 nt, Salmonella enterica enterica serovar Typhi Ty2
uagcugcgcaagaaacauca

SEQ ID NO: 1777025 - RNA, 16 nt, Salmonella enterica enterica serovar Typhi Ty2
uagcugcggcucgcca

SEQ ID NO: 1777026 - RNA, 13 nt, Salmonella enterica enterica serovar Typhi Ty2
uagcguucugguu

SEQ ID NO: 1777027 - RNA, 14 nt, Salmonella enterica enterica serovar Typhi Ty2
uagcguuuuccagc

SEQ ID NO: 1777028 - RNA, 16 nt, Salmonella enterica enterica serovar Typhi Ty2
uagcguuucgaacucu

SEQ ID NO: 1777029 - RNA, 18 nt, Salmonella enterica enterica serovar Typhi Ty2
uagcguucauucccgcca

SEQ ID NO: 1777030 - RNA, 13 nt, Salmonella enterica enterica serovar Typhi Ty2
uagcucagcgcgg

SEQ ID NO: 1777031 - RNA, 20 nt, Salmonella enterica enterica serovar Typhi Ty2
uagcuccgaauaauccuucc

SEQ ID NO: 1777032 - RNA, 15 nt, Salmonella enterica enterica serovar Typhi Ty2
uagcaaucucgccaa

SEQ ID NO: 1777033 - RNA, 23 nt, Salmonella enterica enterica serovar Typhi Ty2
uagcaauuauauugcguaaaaac

SEQ ID NO: 1777034 - RNA, 19 nt, Salmonella enterica enterica serovar Typhi Ty2
uagcaauugccauaaaaac

SEQ ID NO: 1777035 - RNA, 22 nt, Salmonella enterica enterica serovar Typhi Ty2
uagauauaacccaguucaaauc

SEQ ID NO: 1777036 - RNA, 14 nt, Salmonella enterica enterica serovar Typhi Ty2
uagauauuccccac

SEQ ID NO: 1777037 - RNA, 12 nt, Salmonella enterica enterica serovar Typhi Ty2
uagcaucaccag

SEQ ID NO: 1777038 - RNA, 20 nt, Salmonella enterica enterica serovar Typhi Ty2
uagccaaacucugaaaaaau

SEQ ID NO: 1777039 - RNA, 15 nt, Salmonella enterica enterica serovar Typhi Ty2
uagccaacacauaag

SEQ ID NO: 1777040 - RNA, 20 nt, Salmonella enterica enterica serovar Typhi Ty2
uagccaacacauaagccacu

SEQ ID NO: 1777041 - RNA, 12 nt, Salmonella enterica enterica serovar Typhi Ty2
uagcacagcgcu

SEQ ID NO: 1777042 - RNA, 12 nt, Salmonella enterica enterica serovar Typhi Ty2
uagcaccagacc

SEQ ID NO: 1777043 - RNA, 14 nt, Salmonella enterica enterica serovar Typhi Ty2
uagcaccaggccaa

SEQ ID NO: 1777044 - RNA, 15 nt, Salmonella enterica enterica serovar Typhi Ty2
uagcacuuuaaacac

SEQ ID NO: 1777045 - RNA, 19 nt, Salmonella enterica enterica serovar Typhi Ty2
uagccaucaaaguagaugu

SEQ ID NO: 1777046 - RNA, 22 nt, Salmonella enterica enterica serovar Typhi Ty2
uagccgccagcuaauuuuacuu

SEQ ID NO: 1777047 - RNA, 19 nt, Salmonella enterica enterica serovar Typhi Ty2
uagccgcgcucaagcuggg

SEQ ID NO: 1777048 - RNA, 16 nt, Salmonella enterica enterica serovar Typhi Ty2
uagccaguuuuccgcc

SEQ ID NO: 1777049 - RNA, 22 nt, Salmonella enterica enterica serovar Typhi Ty2
uagccagccauggcccuuuugc

SEQ ID NO: 1777050 - RNA, 20 nt, Salmonella enterica enterica serovar Typhi Ty2
uagccagcgauccugcggca

SEQ ID NO: 1777051 - RNA, 14 nt, Salmonella enterica enterica serovar Typhi Ty2
uagccuuuauugau

SEQ ID NO: 1777052 - RNA, 24 nt, Salmonella enterica enterica serovar Typhi Ty2
uagccuugacgcaauagaguaaug

SEQ ID NO: 1777053 - RNA, 19 nt, Salmonella enterica enterica serovar Typhi Ty2
uagcgaaacugccuaaauu

SEQ ID NO: 1777054 - RNA, 20 nt, Salmonella enterica enterica serovar Typhi Ty2
uagcgaaacugccuaaauug

SEQ ID NO: 1777055 - RNA, 18 nt, Salmonella enterica enterica serovar Typhi Ty2
uagccuucccggggaaca

SEQ ID NO: 1777056 - RNA, 22 nt, Salmonella enterica enterica serovar Typhi Ty2
uagccuucccggggaacagaag

SEQ ID NO: 1777057 - RNA, 18 nt, Salmonella enterica enterica serovar Typhi Ty2
uagccuguuauucaauuc

SEQ ID NO: 1777058 - RNA, 21 nt, Salmonella enterica enterica serovar Typhi Ty2
uagccucaagagaugcagaca

SEQ ID NO: 1777059 - RNA, 14 nt, Salmonella enterica enterica serovar Typhi Ty2
uagccguucuccag

SEQ ID NO: 1777060 - RNA, 18 nt, Salmonella enterica enterica serovar Typhi Ty2
uagccguuaccgccgagc

SEQ ID NO: 1777061 - RNA, 13 nt, Salmonella enterica enterica serovar Typhi Ty2
uaucgauaaucaa

SEQ ID NO: 1777062 - RNA, 16 nt, Salmonella enterica enterica serovar Typhi Ty2
uaucgauaucugccug

SEQ ID NO: 1777063 - RNA, 18 nt, Salmonella enterica enterica serovar Typhi Ty2
uaucgcacuggcgccugc

SEQ ID NO: 1777064 - RNA, 19 nt, Salmonella enterica enterica serovar Typhi Ty2
uaucuguaauuauaaauau

SEQ ID NO: 1777065 - RNA, 14 nt, Salmonella enterica enterica serovar Typhi Ty2
uaucugaugaacua

SEQ ID NO: 1777066 - RNA, 14 nt, Salmonella enterica enterica serovar Typhi Ty2
uaucucuauugcuu

SEQ ID NO: 1777067 - RNA, 17 nt, Salmonella enterica enterica serovar Typhi Ty2
uaucugaccaugccagc

SEQ ID NO: 1777068 - RNA, 22 nt, Salmonella enterica enterica serovar Typhi Ty2
uaucucuacuuuccugaaggua

SEQ ID NO: 1777069 - RNA, 16 nt, Salmonella enterica enterica serovar Typhi Ty2
uauccagauagcgauc

SEQ ID NO: 1777070 - RNA, 18 nt, Salmonella enterica enterica serovar Typhi Ty2
uauccagcgcccgcuuca

SEQ ID NO: 1777071 - RNA, 23 nt, Salmonella enterica enterica serovar Typhi Ty2
uauccagcagguaacguuucagu

SEQ ID NO: 1777072 - RNA, 17 nt, Salmonella enterica enterica serovar Typhi Ty2
uauccagcggcaaaggc

SEQ ID NO: 1777073 - RNA, 18 nt, Salmonella enterica enterica serovar Typhi Ty2
uauccagcggcaaaggca

SEQ ID NO: 1777074 - RNA, 19 nt, Salmonella enterica enterica serovar Typhi Ty2
uauccagcggcaaaggcau

SEQ ID NO: 1777075 - RNA, 18 nt, Salmonella enterica enterica serovar Typhi Ty2
uaucaugcugaugacuaa

SEQ ID NO: 1777076 - RNA, 15 nt, Salmonella enterica enterica serovar Typhi Ty2
uaucccuuucaaaaa

SEQ ID NO: 1777077 - RNA, 14 nt, Salmonella enterica enterica serovar Typhi Ty2
uaucccugcugagu

SEQ ID NO: 1777078 - RNA, 19 nt, Salmonella enterica enterica serovar Typhi Ty2
uauccaguuucugacguaa

SEQ ID NO: 1777079 - RNA, 21 nt, Salmonella enterica enterica serovar Typhi Ty2
uaucccauacguuuuuauuau

SEQ ID NO: 1777080 - RNA, 14 nt, Salmonella enterica enterica serovar Typhi Ty2
uauccaguugauga

SEQ ID NO: 1777081 - RNA, 19 nt, Salmonella enterica enterica serovar Typhi Ty2
uauccagucagcguuacug

SEQ ID NO: 1777082 - RNA, 14 nt, Salmonella enterica enterica serovar Typhi Ty2
uaucccuauucuga

SEQ ID NO: 1777083 - RNA, 24 nt, Salmonella enterica enterica serovar Typhi Ty2
uauccccugacagagcucgucaaa

SEQ ID NO: 1777084 - RNA, 14 nt, Salmonella enterica enterica serovar Typhi Ty2
uaucgaaagagcaa

SEQ ID NO: 1777085 - RNA, 18 nt, Salmonella enterica enterica serovar Typhi Ty2
uaucgacgcuauuuuuca

SEQ ID NO: 1777086 - RNA, 18 nt, Salmonella enterica enterica serovar Typhi Ty2
uauccuuaucagacucag

SEQ ID NO: 1777087 - RNA, 15 nt, Salmonella enterica enterica serovar Typhi Ty2
uauagccuuuuucuu

SEQ ID NO: 1777088 - RNA, 13 nt, Salmonella enterica enterica serovar Typhi Ty2
uauaggaaaauga

SEQ ID NO: 1777089 - RNA, 22 nt, Salmonella enterica enterica serovar Typhi Ty2
uauagcucagcgcggcagccgg

SEQ ID NO: 1777090 - RNA, 12 nt, Salmonella enterica enterica serovar Typhi Ty2
uauaggccaggc

SEQ ID NO: 1777091 - RNA, 14 nt, Salmonella enterica enterica serovar Typhi Ty2
uauaggggccaagc

SEQ ID NO: 1777092 - RNA, 15 nt, Salmonella enterica enterica serovar Typhi Ty2
uauaucgcgauaaac

SEQ ID NO: 1777093 - RNA, 20 nt, Salmonella enterica enterica serovar Typhi Ty2
uauaucggcugcuguaacag

SEQ ID NO: 1777094 - RNA, 18 nt, Salmonella enterica enterica serovar Typhi Ty2
uauauuaguguuauauaa

SEQ ID NO: 1777095 - RNA, 14 nt, Salmonella enterica enterica serovar Typhi Ty2
uauaugagcgggcc

SEQ ID NO: 1777096 - RNA, 23 nt, Salmonella enterica enterica serovar Typhi Ty2
uauaugagcgggccgucaggccc

SEQ ID NO: 1777097 - RNA, 16 nt, Salmonella enterica enterica serovar Typhi Ty2
uauaugacaacacuca

SEQ ID NO: 1777098 - RNA, 13 nt, Salmonella enterica enterica serovar Typhi Ty2
uauauuacuggcu

SEQ ID NO: 1777099 - RNA, 19 nt, Salmonella enterica enterica serovar Typhi Ty2
uauauuccgcaggcaagaa

SEQ ID NO: 1777100 - RNA, 15 nt, Salmonella enterica enterica serovar Typhi Ty2
uauauuccagccagg

SEQ ID NO: 1777101 - RNA, 13 nt, Salmonella enterica enterica serovar Typhi Ty2
uauauucagaauu

SEQ ID NO: 1777102 - RNA, 15 nt, Salmonella enterica enterica serovar Typhi Ty2
uauauugaaaaggga

SEQ ID NO: 1777103 - RNA, 23 nt, Salmonella enterica enterica serovar Typhi Ty2
uauauucugggcuuacuuuccaa

SEQ ID NO: 1777104 - RNA, 21 nt, Salmonella enterica enterica serovar Typhi Ty2
uauauucgcgaugcucaacca

SEQ ID NO: 1777105 - RNA, 11 nt, Salmonella enterica enterica serovar Typhi Ty2
uaucacacccg

SEQ ID NO: 1777106 - RNA, 17 nt, Salmonella enterica enterica serovar Typhi Ty2
uaucaauuucauauuau

SEQ ID NO: 1777107 - RNA, 19 nt, Salmonella enterica enterica serovar Typhi Ty2
uaucaauuucauauuauua

SEQ ID NO: 1777108 - RNA, 15 nt, Salmonella enterica enterica serovar Typhi Ty2
uaucaauuucauauu

SEQ ID NO: 1777109 - RNA, 17 nt, Salmonella enterica enterica serovar Typhi Ty2
uaucaaucaccucuucc

SEQ ID NO: 1777110 - RNA, 13 nt, Salmonella enterica enterica serovar Typhi Ty2
uauauuuaaaauu

SEQ ID NO: 1777111 - RNA, 15 nt, Salmonella enterica enterica serovar Typhi Ty2
uauauugcauuuuau

SEQ ID NO: 1777112 - RNA, 23 nt, Salmonella enterica enterica serovar Typhi Ty2
uaucaagauaaaaagacagauag

SEQ ID NO: 1777113 - RNA, 12 nt, Salmonella enterica enterica serovar Typhi Ty2
uaucaagccuac

SEQ ID NO: 1777114 - RNA, 15 nt, Salmonella enterica enterica serovar Typhi Ty2
uaucaagccuacacc

SEQ ID NO: 1777115 - RNA, 21 nt, Salmonella enterica enterica serovar Typhi Ty2
uauauuuacugaauaaauagu

SEQ ID NO: 1777116 - RNA, 19 nt, Salmonella enterica enterica serovar Typhi Ty2
uaucaccaaguagacagag

SEQ ID NO: 1777117 - RNA, 19 nt, Salmonella enterica enterica serovar Typhi Ty2
uaucagggcuuuuuucucg

SEQ ID NO: 1777118 - RNA, 20 nt, Salmonella enterica enterica serovar Typhi Ty2
uaucaggccgacaaaugacg

SEQ ID NO: 1777119 - RNA, 14 nt, Salmonella enterica enterica serovar Typhi Ty2
uaucaggccgacaa

SEQ ID NO: 1777120 - RNA, 18 nt, Salmonella enterica enterica serovar Typhi Ty2
uaucagcgcguuuuccau

SEQ ID NO: 1777121 - RNA, 14 nt, Salmonella enterica enterica serovar Typhi Ty2
uaucauaaaaggcu

SEQ ID NO: 1777122 - RNA, 15 nt, Salmonella enterica enterica serovar Typhi Ty2
uaucagguaacauau

SEQ ID NO: 1777123 - RNA, 14 nt, Salmonella enterica enterica serovar Typhi Ty2
uaguuugcauaacc

SEQ ID NO: 1777124 - RNA, 22 nt, Salmonella enterica enterica serovar Typhi Ty2
uaguuuccgccgcgguauucau

SEQ ID NO: 1777125 - RNA, 24 nt, Salmonella enterica enterica serovar Typhi Ty2
uaguuuauugagauaauuuaugau

SEQ ID NO: 1777126 - RNA, 19 nt, Salmonella enterica enterica serovar Typhi Ty2
uaguuucuauuaaaucaga

SEQ ID NO: 1777127 - RNA, 16 nt, Salmonella enterica enterica serovar Typhi Ty2
uaguuucuauuaaauc

SEQ ID NO: 1777128 - RNA, 18 nt, Salmonella enterica enterica serovar Typhi Ty2
uaguuucuauuaaaucag

SEQ ID NO: 1777129 - RNA, 14 nt, Salmonella enterica enterica serovar Typhi Ty2
uaguuucuauuaaa

SEQ ID NO: 1777130 - RNA, 21 nt, Salmonella enterica enterica serovar Typhi Ty2
uaguucaaguuuagaaaaaau

SEQ ID NO: 1777131 - RNA, 14 nt, Salmonella enterica enterica serovar Typhi Ty2
uauaaauaucauug

SEQ ID NO: 1777132 - RNA, 11 nt, Salmonella enterica enterica serovar Typhi Ty2
uauaaauauag

SEQ ID NO: 1777133 - RNA, 13 nt, Salmonella enterica enterica serovar Typhi Ty2
uauaaauauuaau

SEQ ID NO: 1777134 - RNA, 12 nt, Salmonella enterica enterica serovar Typhi Ty2
uauaaaucaaua

SEQ ID NO: 1777135 - RNA, 20 nt, Salmonella enterica enterica serovar Typhi Ty2
uauaaauaaccgguaacugu

SEQ ID NO: 1777136 - RNA, 21 nt, Salmonella enterica enterica serovar Typhi Ty2
uaguuauaaauuuauuuuuug

SEQ ID NO: 1777137 - RNA, 20 nt, Salmonella enterica enterica serovar Typhi Ty2
uaguuauacauuuuuuucuu

SEQ ID NO: 1777138 - RNA, 20 nt, Salmonella enterica enterica serovar Typhi Ty2
uagugcuucucuucaaacuc

SEQ ID NO: 1777139 - RNA, 13 nt, Salmonella enterica enterica serovar Typhi Ty2
uaguguaauucuc

SEQ ID NO: 1777140 - RNA, 15 nt, Salmonella enterica enterica serovar Typhi Ty2
uagugugcugauugu

SEQ ID NO: 1777141 - RNA, 14 nt, Salmonella enterica enterica serovar Typhi Ty2
uaguggcgaucuga

SEQ ID NO: 1777142 - RNA, 22 nt, Salmonella enterica enterica serovar Typhi Ty2
uagucuuaauuugcuguuuuuu

SEQ ID NO: 1777143 - RNA, 17 nt, Salmonella enterica enterica serovar Typhi Ty2
uagucucccuccugcuc

SEQ ID NO: 1777144 - RNA, 15 nt, Salmonella enterica enterica serovar Typhi Ty2
uagucucccuccugc

SEQ ID NO: 1777145 - RNA, 12 nt, Salmonella enterica enterica serovar Typhi Ty2
uagucucccucc

SEQ ID NO: 1777146 - RNA, 14 nt, Salmonella enterica enterica serovar Typhi Ty2
uagguauccagcag

SEQ ID NO: 1777147 - RNA, 16 nt, Salmonella enterica enterica serovar Typhi Ty2
uagucggcaaugcucu

SEQ ID NO: 1777148 - RNA, 14 nt, Salmonella enterica enterica serovar Typhi Ty2
uauaauuauuuguu

SEQ ID NO: 1777149 - RNA, 19 nt, Salmonella enterica enterica serovar Typhi Ty2
uauaauucgucaauaccua

SEQ ID NO: 1777150 - RNA, 14 nt, Salmonella enterica enterica serovar Typhi Ty2
uauaauuaacauuu

SEQ ID NO: 1777151 - RNA, 18 nt, Salmonella enterica enterica serovar Typhi Ty2
uauaauuaagaccauacu

SEQ ID NO: 1777152 - RNA, 20 nt, Salmonella enterica enterica serovar Typhi Ty2
uauacaaaacccauaucccc

SEQ ID NO: 1777153 - RNA, 14 nt, Salmonella enterica enterica serovar Typhi Ty2
uauacacucaacca

SEQ ID NO: 1777154 - RNA, 19 nt, Salmonella enterica enterica serovar Typhi Ty2
uauacuccgcgacgaccug

SEQ ID NO: 1777155 - RNA, 13 nt, Salmonella enterica enterica serovar Typhi Ty2
uauacugugacga

SEQ ID NO: 1777156 - RNA, 12 nt, Salmonella enterica enterica serovar Typhi Ty2
uauacucaaaaa

SEQ ID NO: 1777157 - RNA, 15 nt, Salmonella enterica enterica serovar Typhi Ty2
uauacucaaaaaauc

SEQ ID NO: 1777158 - RNA, 21 nt, Salmonella enterica enterica serovar Typhi Ty2
uauaccauaaaugaaaccuca

SEQ ID NO: 1777159 - RNA, 15 nt, Salmonella enterica enterica serovar Typhi Ty2
uauaccaugcugcca

SEQ ID NO: 1777160 - RNA, 12 nt, Salmonella enterica enterica serovar Typhi Ty2
uauacauuucac

SEQ ID NO: 1777161 - RNA, 19 nt, Salmonella enterica enterica serovar Typhi Ty2
uauacggcggcaaugccgc

SEQ ID NO: 1777162 - RNA, 15 nt, Salmonella enterica enterica serovar Typhi Ty2
uauacguugauuggc

SEQ ID NO: 1777163 - RNA, 16 nt, Salmonella enterica enterica serovar Typhi Ty2
uauagaauacuuccug

SEQ ID NO: 1777164 - RNA, 15 nt, Salmonella enterica enterica serovar Typhi Ty2
uauagcaacccacuu

SEQ ID NO: 1777165 - RNA, 16 nt, Salmonella enterica enterica serovar Typhi Ty2
uauagcaacuuaauaa

SEQ ID NO: 1777166 - RNA, 13 nt, Salmonella enterica enterica serovar Typhi Ty2
uauagcccacgca

SEQ ID NO: 1777167 - RNA, 13 nt, Salmonella enterica enterica serovar Typhi Ty2
uauagccaggcag

SEQ ID NO: 1777168 - RNA, 22 nt, Salmonella enterica enterica serovar Typhi Ty2
uaagagagccuuacaggcgcau

SEQ ID NO: 1777169 - RNA, 14 nt, Salmonella enterica enterica serovar Typhi Ty2
uaagagacugacaa

SEQ ID NO: 1777170 - RNA, 20 nt, Salmonella enterica enterica serovar Typhi Ty2
uaagaggguggcgagcaacu

SEQ ID NO: 1777171 - RNA, 19 nt, Salmonella enterica enterica serovar Typhi Ty2
uaagaguccauucggccug

SEQ ID NO: 1777172 - RNA, 14 nt, Salmonella enterica enterica serovar Typhi Ty2
uaagagcuggccgg

SEQ ID NO: 1777173 - RNA, 16 nt, Salmonella enterica enterica serovar Typhi Ty2
uaagaggcauaaaaaa

SEQ ID NO: 1777174 - RNA, 20 nt, Salmonella enterica enterica serovar Typhi Ty2
uaagauauuuuguuuuaaau

SEQ ID NO: 1777175 - RNA, 21 nt, Salmonella enterica enterica serovar Typhi Ty2
uaagaaugcgcgucaggccag

SEQ ID NO: 1777176 - RNA, 20 nt, Salmonella enterica enterica serovar Typhi Ty2
uaagacgcuuacaucgccau

SEQ ID NO: 1777177 - RNA, 18 nt, Salmonella enterica enterica serovar Typhi Ty2
uaacuucgcgguuagaaa

SEQ ID NO: 1777178 - RNA, 21 nt, Salmonella enterica enterica serovar Typhi Ty2
uaacuucggcaaauucuuuuc

SEQ ID NO: 1777179 - RNA, 15 nt, Salmonella enterica enterica serovar Typhi Ty2
uaacuucugcaggga

SEQ ID NO: 1777180 - RNA, 13 nt, Salmonella enterica enterica serovar Typhi Ty2
uaacuuauccacu

SEQ ID NO: 1777181 - RNA, 22 nt, Salmonella enterica enterica serovar Typhi Ty2
uaacuuucccgcuauccaucau

SEQ ID NO: 1777182 - RNA, 14 nt, Salmonella enterica enterica serovar Typhi Ty2
uaagcaauauggcu

SEQ ID NO: 1777183 - RNA, 14 nt, Salmonella enterica enterica serovar Typhi Ty2
uaagcaagcgccau

SEQ ID NO: 1777184 - RNA, 16 nt, Salmonella enterica enterica serovar Typhi Ty2
uaagauuuaaaacaag

SEQ ID NO: 1777185 - RNA, 16 nt, Salmonella enterica enterica serovar Typhi Ty2
uaagauuuacaacaga

SEQ ID NO: 1777186 - RNA, 15 nt, Salmonella enterica enterica serovar Typhi Ty2
uaagauuuaaaacaa

SEQ ID NO: 1777187 - RNA, 19 nt, Salmonella enterica enterica serovar Typhi Ty2
uaagaucggguggccuaac

SEQ ID NO: 1777188 - RNA, 12 nt, Salmonella enterica enterica serovar Typhi Ty2
uaagauguuuua

SEQ ID NO: 1777189 - RNA, 23 nt, Salmonella enterica enterica serovar Typhi Ty2
uaagauucccccgcaugaaaugc

SEQ ID NO: 1777190 - RNA, 20 nt, Salmonella enterica enterica serovar Typhi Ty2
uaagcagcugcuuaacuucu

SEQ ID NO: 1777191 - RNA, 13 nt, Salmonella enterica enterica serovar Typhi Ty2
uaagcacaccauu

SEQ ID NO: 1777192 - RNA, 14 nt, Salmonella enterica enterica serovar Typhi Ty2
uaagcacaggccau

SEQ ID NO: 1777193 - RNA, 21 nt, Salmonella enterica enterica serovar Typhi Ty2
uaagcaauccauuuuaaauac

SEQ ID NO: 1777194 - RNA, 22 nt, Salmonella enterica enterica serovar Typhi Ty2
uaagcaauccauuuuaaauaca

SEQ ID NO: 1777195 - RNA, 20 nt, Salmonella enterica enterica serovar Typhi Ty2
uaagcccauggcaggcagca

SEQ ID NO: 1777196 - RNA, 14 nt, Salmonella enterica enterica serovar Typhi Ty2
uaagccagcgauga

SEQ ID NO: 1777197 - RNA, 21 nt, Salmonella enterica enterica serovar Typhi Ty2
uaagccaguccugccaccagc

SEQ ID NO: 1777198 - RNA, 23 nt, Salmonella enterica enterica serovar Typhi Ty2
uaagcccauggcaggcagcacaa

SEQ ID NO: 1777199 - RNA, 21 nt, Salmonella enterica enterica serovar Typhi Ty2
uaagcccauggcaggcagcac

SEQ ID NO: 1777200 - RNA, 13 nt, Salmonella enterica enterica serovar Typhi Ty2
uaagcguagcgcc

SEQ ID NO: 1777201 - RNA, 17 nt, Salmonella enterica enterica serovar Typhi Ty2
uaagcguuacggaaaaa

SEQ ID NO: 1777202 - RNA, 23 nt, Salmonella enterica enterica serovar Typhi Ty2
uaagcuaguaaagaaauuuugca

SEQ ID NO: 1777203 - RNA, 11 nt, Salmonella enterica enterica serovar Typhi Ty2
uaagcguucag

SEQ ID NO: 1777204 - RNA, 19 nt, Salmonella enterica enterica serovar Typhi Ty2
uaagcggcggaccagcgug

SEQ ID NO: 1777205 - RNA, 15 nt, Salmonella enterica enterica serovar Typhi Ty2
uaagcggcagcgcca

SEQ ID NO: 1777206 - RNA, 17 nt, Salmonella enterica enterica serovar Typhi Ty2
uaagcggguugcacauu

SEQ ID NO: 1777207 - RNA, 16 nt, Salmonella enterica enterica serovar Typhi Ty2
uaagcgcgaaauuuau

SEQ ID NO: 1777208 - RNA, 14 nt, Salmonella enterica enterica serovar Typhi Ty2
uaagcgcucaggca

SEQ ID NO: 1777209 - RNA, 14 nt, Salmonella enterica enterica serovar Typhi Ty2
uaagcgaaugcugu

SEQ ID NO: 1777210 - RNA, 19 nt, Salmonella enterica enterica serovar Typhi Ty2
uaagcuauuccuguauaau

SEQ ID NO: 1777211 - RNA, 16 nt, Salmonella enterica enterica serovar Typhi Ty2
uaagcuaguaaagaaa

SEQ ID NO: 1777212 - RNA, 16 nt, Salmonella enterica enterica serovar Typhi Ty2
uaagcuauguuuuuau

SEQ ID NO: 1777213 - RNA, 20 nt, Salmonella enterica enterica serovar Typhi Ty2
uaagcugcgaagccaccgga

SEQ ID NO: 1777214 - RNA, 18 nt, Salmonella enterica enterica serovar Typhi Ty2
uaagcuuaggauaagaau

SEQ ID NO: 1777215 - RNA, 20 nt, Salmonella enterica enterica serovar Typhi Ty2
uaagcuuccgccaugguugg

SEQ ID NO: 1777216 - RNA, 20 nt, Salmonella enterica enterica serovar Typhi Ty2
uaagcuuuaaccacagccuu

SEQ ID NO: 1777217 - RNA, 14 nt, Salmonella enterica enterica serovar Typhi Ty2
uaaccucgcuacug

SEQ ID NO: 1777218 - RNA, 17 nt, Salmonella enterica enterica serovar Typhi Ty2
uaaccucuauaguaaau

SEQ ID NO: 1777219 - RNA, 19 nt, Salmonella enterica enterica serovar Typhi Ty2
uaacccaguucaaaucgau

SEQ ID NO: 1777220 - RNA, 21 nt, Salmonella enterica enterica serovar Typhi Ty2
uaaccuucuucguuaugaaug

SEQ ID NO: 1777221 - RNA, 18 nt, Salmonella enterica enterica serovar Typhi Ty2
uaacgcauacauucuguu

SEQ ID NO: 1777222 - RNA, 17 nt, Salmonella enterica enterica serovar Typhi Ty2
uaaccuguaaauaauag

SEQ ID NO: 1777223 - RNA, 19 nt, Salmonella enterica enterica serovar Typhi Ty2
uaaccuguaucugcugaca

SEQ ID NO: 1777224 - RNA, 13 nt, Salmonella enterica enterica serovar Typhi Ty2
uaacgcgccaucu

SEQ ID NO: 1777225 - RNA, 23 nt, Salmonella enterica enterica serovar Typhi Ty2
uaacgcguccaacuggcuuucau

SEQ ID NO: 1777226 - RNA, 16 nt, Salmonella enterica enterica serovar Typhi Ty2
uaacgcgaaaaaagau

SEQ ID NO: 1777227 - RNA, 15 nt, Salmonella enterica enterica serovar Typhi Ty2
uaacgcgagaagaag

SEQ ID NO: 1777228 - RNA, 21 nt, Salmonella enterica enterica serovar Typhi Ty2
uaacgcgagugucauccugcg

SEQ ID NO: 1777229 - RNA, 22 nt, Salmonella enterica enterica serovar Typhi Ty2
uaacggcugacgcccaucagca

SEQ ID NO: 1777230 - RNA, 15 nt, Salmonella enterica enterica serovar Typhi Ty2
uaacuaaacucaucu

SEQ ID NO: 1777231 - RNA, 22 nt, Salmonella enterica enterica serovar Typhi Ty2
uaacguuuggcaucaaaguuau

SEQ ID NO: 1777232 - RNA, 13 nt, Salmonella enterica enterica serovar Typhi Ty2
uaacguuuaaacu

SEQ ID NO: 1777233 - RNA, 23 nt, Salmonella enterica enterica serovar Typhi Ty2
uaacgcgccaucuuucacccauu

SEQ ID NO: 1777234 - RNA, 23 nt, Salmonella enterica enterica serovar Typhi Ty2
uaacuauuucuaucagguaacau

SEQ ID NO: 1777235 - RNA, 19 nt, Salmonella enterica enterica serovar Typhi Ty2
uaacucaagcgaauccaga

SEQ ID NO: 1777236 - RNA, 13 nt, Salmonella enterica enterica serovar Typhi Ty2
uaacuauuucuau

SEQ ID NO: 1777237 - RNA, 18 nt, Salmonella enterica enterica serovar Typhi Ty2
uaacucaauagcggugcu

SEQ ID NO: 1777238 - RNA, 22 nt, Salmonella enterica enterica serovar Typhi Ty2
uaacuccuucuaauuccaggau

SEQ ID NO: 1777239 - RNA, 19 nt, Salmonella enterica enterica serovar Typhi Ty2
uaacuccuucuaauuccag

SEQ ID NO: 1777240 - RNA, 23 nt, Salmonella enterica enterica serovar Typhi Ty2
uaacuccagugcagaaaguguga

SEQ ID NO: 1777241 - RNA, 17 nt, Salmonella enterica enterica serovar Typhi Ty2
uaacugaagguuuuucc

SEQ ID NO: 1777242 - RNA, 12 nt, Salmonella enterica enterica serovar Typhi Ty2
uaacugacagac

SEQ ID NO: 1777243 - RNA, 23 nt, Salmonella enterica enterica serovar Typhi Ty2
uaacucuuuuucagcaaauacag

SEQ ID NO: 1777244 - RNA, 19 nt, Salmonella enterica enterica serovar Typhi Ty2
uaacucuuuuucagcaaau

SEQ ID NO: 1777245 - RNA, 20 nt, Salmonella enterica enterica serovar Typhi Ty2
uaacucuuuuucagcaaaua

SEQ ID NO: 1777246 - RNA, 17 nt, Salmonella enterica enterica serovar Typhi Ty2
uaacucuuaauuauaaa

SEQ ID NO: 1777247 - RNA, 19 nt, Salmonella enterica enterica serovar Typhi Ty2
uaacucuuccgcaaucaca

SEQ ID NO: 1777248 - RNA, 19 nt, Salmonella enterica enterica serovar Typhi Ty2
uaacugcauuacauucaua

SEQ ID NO: 1777249 - RNA, 18 nt, Salmonella enterica enterica serovar Typhi Ty2
uaacugcccguuacgcau

SEQ ID NO: 1777250 - RNA, 21 nt, Salmonella enterica enterica serovar Typhi Ty2
uaacugcccguuacgcauuuc

SEQ ID NO: 1777251 - RNA, 19 nt, Salmonella enterica enterica serovar Typhi Ty2
uaacugccuuauccggccu

SEQ ID NO: 1777252 - RNA, 11 nt, Salmonella enterica enterica serovar Typhi Ty2
uaacugcggua

SEQ ID NO: 1777253 - RNA, 21 nt, Salmonella enterica enterica serovar Typhi Ty2
uaacuggaaaaagaccaauac

SEQ ID NO: 1777254 - RNA, 12 nt, Salmonella enterica enterica serovar Typhi Ty2
uaacugcugcuc

SEQ ID NO: 1777255 - RNA, 13 nt, Salmonella enterica enterica serovar Typhi Ty2
uaacuggaaaaag

SEQ ID NO: 1777256 - RNA, 15 nt, Salmonella enterica enterica serovar Typhi Ty2
uaacuggcaaucaug

SEQ ID NO: 1777257 - RNA, 15 nt, Salmonella enterica enterica serovar Typhi Ty2
uaacugucuuauccg

SEQ ID NO: 1777258 - RNA, 23 nt, Salmonella enterica enterica serovar Typhi Ty2
uaaccaccggcgcgccagcgcau

SEQ ID NO: 1777259 - RNA, 14 nt, Salmonella enterica enterica serovar Typhi Ty2
uaaccacagccuua

SEQ ID NO: 1777260 - RNA, 21 nt, Salmonella enterica enterica serovar Typhi Ty2
uaaccagaaaaccgacagcaa

SEQ ID NO: 1777261 - RNA, 12 nt, Salmonella enterica enterica serovar Typhi Ty2
uaaccagcaguc

SEQ ID NO: 1777262 - RNA, 16 nt, Salmonella enterica enterica serovar Typhi Ty2
uaacaucguaaaucaa

SEQ ID NO: 1777263 - RNA, 16 nt, Salmonella enterica enterica serovar Typhi Ty2
uaaccaaagcaccauu

SEQ ID NO: 1777264 - RNA, 13 nt, Salmonella enterica enterica serovar Typhi Ty2
uaaccaaaccaga

SEQ ID NO: 1777265 - RNA, 18 nt, Salmonella enterica enterica serovar Typhi Ty2
uaaccaacaggaggaucg

SEQ ID NO: 1777266 - RNA, 17 nt, Salmonella enterica enterica serovar Typhi Ty2
uaacauaaauaguauua

SEQ ID NO: 1777267 - RNA, 22 nt, Salmonella enterica enterica serovar Typhi Ty2
uaacauaaauaguauuaguuga

SEQ ID NO: 1777268 - RNA, 12 nt, Salmonella enterica enterica serovar Typhi Ty2
uaacauaaccgg

SEQ ID NO: 1777269 - RNA, 20 nt, Salmonella enterica enterica serovar Typhi Ty2
uaacauaagugauacaugcu

SEQ ID NO: 1777270 - RNA, 14 nt, Salmonella enterica enterica serovar Typhi Ty2
uaacaucaaguaca

SEQ ID NO: 1777271 - RNA, 23 nt, Salmonella enterica enterica serovar Typhi Ty2
uaacauaucgacauaaguaaaua

SEQ ID NO: 1777272 - RNA, 21 nt, Salmonella enterica enterica serovar Typhi Ty2
uaacaggcgccggggcagcaa

SEQ ID NO: 1777273 - RNA, 19 nt, Salmonella enterica enterica serovar Typhi Ty2
uaacaggcgccggggcagc

SEQ ID NO: 1777274 - RNA, 21 nt, Salmonella enterica enterica serovar Typhi Ty2
uaacagggugauggugucaau

SEQ ID NO: 1777275 - RNA, 18 nt, Salmonella enterica enterica serovar Typhi Ty2
uaacaggcaccagcguau

SEQ ID NO: 1777276 - RNA, 19 nt, Salmonella enterica enterica serovar Typhi Ty2
uaacagcuugaucaucagg

SEQ ID NO: 1777277 - RNA, 13 nt, Salmonella enterica enterica serovar Typhi Ty2
uaacaaaaaacau

SEQ ID NO: 1777278 - RNA, 15 nt, Salmonella enterica enterica serovar Typhi Ty2
uaaauuuuuuaacag

SEQ ID NO: 1777279 - RNA, 16 nt, Salmonella enterica enterica serovar Typhi Ty2
uaaaugucaggaucag

SEQ ID NO: 1777280 - RNA, 16 nt, Salmonella enterica enterica serovar Typhi Ty2
uaaaugcauagcccca

SEQ ID NO: 1777281 - RNA, 14 nt, Salmonella enterica enterica serovar Typhi Ty2
uaacacggcuggca

SEQ ID NO: 1777282 - RNA, 13 nt, Salmonella enterica enterica serovar Typhi Ty2
uaacacugccgaa

SEQ ID NO: 1777283 - RNA, 17 nt, Salmonella enterica enterica serovar Typhi Ty2
uaacaacuguuuuucac

SEQ ID NO: 1777284 - RNA, 15 nt, Salmonella enterica enterica serovar Typhi Ty2
uaacaacuguuuuuc

SEQ ID NO: 1777285 - RNA, 18 nt, Salmonella enterica enterica serovar Typhi Ty2
uaacaauauuaaauaaau

SEQ ID NO: 1777286 - RNA, 17 nt, Salmonella enterica enterica serovar Typhi Ty2
uaacaauagaccugaaa

SEQ ID NO: 1777287 - RNA, 16 nt, Salmonella enterica enterica serovar Typhi Ty2
uaaacuguuuccaguu

SEQ ID NO: 1777288 - RNA, 12 nt, Salmonella enterica enterica serovar Typhi Ty2
uaaagaaaaacg

SEQ ID NO: 1777289 - RNA, 11 nt, Salmonella enterica enterica serovar Typhi Ty2
uaaagaaaaac

SEQ ID NO: 1777290 - RNA, 13 nt, Salmonella enterica enterica serovar Typhi Ty2
uaaagaaauuuaa

SEQ ID NO: 1777291 - RNA, 15 nt, Salmonella enterica enterica serovar Typhi Ty2
uaaagaaauuuaaag

SEQ ID NO: 1777292 - RNA, 13 nt, Salmonella enterica enterica serovar Typhi Ty2
uaaagaucugaug

SEQ ID NO: 1777293 - RNA, 16 nt, Salmonella enterica enterica serovar Typhi Ty2
uaaaggauaauagugu

SEQ ID NO: 1777294 - RNA, 14 nt, Salmonella enterica enterica serovar Typhi Ty2
uaaaggaugccacu

SEQ ID NO: 1777295 - RNA, 23 nt, Salmonella enterica enterica serovar Typhi Ty2
uaaagauuagcguuuuuaucuuu

SEQ ID NO: 1777296 - RNA, 18 nt, Salmonella enterica enterica serovar Typhi Ty2
uaaagauuggcaucugca

SEQ ID NO: 1777297 - RNA, 19 nt, Salmonella enterica enterica serovar Typhi Ty2
uaaacucuguguuaugaau

SEQ ID NO: 1777298 - RNA, 13 nt, Salmonella enterica enterica serovar Typhi Ty2
uaaacugccuucg

SEQ ID NO: 1777299 - RNA, 19 nt, Salmonella enterica enterica serovar Typhi Ty2
uaaacuccauuaaauuacu

SEQ ID NO: 1777300 - RNA, 18 nt, Salmonella enterica enterica serovar Typhi Ty2
uaaacucaucuuuauuca

SEQ ID NO: 1777301 - RNA, 13 nt, Salmonella enterica enterica serovar Typhi Ty2
uaaacgccugcac

SEQ ID NO: 1777302 - RNA, 15 nt, Salmonella enterica enterica serovar Typhi Ty2
uaaacgccugcacca

SEQ ID NO: 1777303 - RNA, 14 nt, Salmonella enterica enterica serovar Typhi Ty2
uaaacgccccuucg

SEQ ID NO: 1777304 - RNA, 22 nt, Salmonella enterica enterica serovar Typhi Ty2
uaaacggcagccgccaccacaa

SEQ ID NO: 1777305 - RNA, 19 nt, Salmonella enterica enterica serovar Typhi Ty2
uaaacgcgccaaguaaauu

SEQ ID NO: 1777306 - RNA, 13 nt, Salmonella enterica enterica serovar Typhi Ty2
uaaacuaucgucu

SEQ ID NO: 1777307 - RNA, 15 nt, Salmonella enterica enterica serovar Typhi Ty2
uaaacaggcaggccc

SEQ ID NO: 1777308 - RNA, 16 nt, Salmonella enterica enterica serovar Typhi Ty2
uaaacagguaaaacaa

SEQ ID NO: 1777309 - RNA, 17 nt, Salmonella enterica enterica serovar Typhi Ty2
uaaacaggcgcggcgcg

SEQ ID NO: 1777310 - RNA, 16 nt, Salmonella enterica enterica serovar Typhi Ty2
uaaacagcuugucgcc

SEQ ID NO: 1777311 - RNA, 12 nt, Salmonella enterica enterica serovar Typhi Ty2
uaaacagcagcg

SEQ ID NO: 1777312 - RNA, 13 nt, Salmonella enterica enterica serovar Typhi Ty2
uaaaccaggccag

SEQ ID NO: 1777313 - RNA, 13 nt, Salmonella enterica enterica serovar Typhi Ty2
uaaagucucaggg

SEQ ID NO: 1777314 - RNA, 13 nt, Salmonella enterica enterica serovar Typhi Ty2
uaaagucagcaag

SEQ ID NO: 1777315 - RNA, 20 nt, Salmonella enterica enterica serovar Typhi Ty2
uaaaggggagcccaguagcc

SEQ ID NO: 1777316 - RNA, 14 nt, Salmonella enterica enterica serovar Typhi Ty2
uaaauaacaggaau

SEQ ID NO: 1777317 - RNA, 14 nt, Salmonella enterica enterica serovar Typhi Ty2
uaaagugaguguua

SEQ ID NO: 1777318 - RNA, 19 nt, Salmonella enterica enterica serovar Typhi Ty2
uaaagugaguguuacucuu

SEQ ID NO: 1777319 - RNA, 20 nt, Salmonella enterica enterica serovar Typhi Ty2
uaaauaccuucgugaugugg

SEQ ID NO: 1777320 - RNA, 16 nt, Salmonella enterica enterica serovar Typhi Ty2
uaaauaguaaauagaa

SEQ ID NO: 1777321 - RNA, 19 nt, Salmonella enterica enterica serovar Typhi Ty2
uaaauaguaaauagaaaau

SEQ ID NO: 1777322 - RNA, 13 nt, Salmonella enterica enterica serovar Typhi Ty2
uaaauacacgagg

SEQ ID NO: 1777323 - RNA, 19 nt, Salmonella enterica enterica serovar Typhi Ty2
uaaaucauuuguacaaaaa

SEQ ID NO: 1777324 - RNA, 14 nt, Salmonella enterica enterica serovar Typhi Ty2
uaaaucaucauaau

SEQ ID NO: 1777325 - RNA, 17 nt, Salmonella enterica enterica serovar Typhi Ty2
uaaaucaggccaagcaa

SEQ ID NO: 1777326 - RNA, 15 nt, Salmonella enterica enterica serovar Typhi Ty2
uaaaucaggaaaaag

SEQ ID NO: 1777327 - RNA, 15 nt, Salmonella enterica enterica serovar Typhi Ty2
uaaaucagauaacaa

SEQ ID NO: 1777328 - RNA, 20 nt, Salmonella enterica enterica serovar Typhi Ty2
uaaaucagcgcggcaaggau

SEQ ID NO: 1777329 - RNA, 20 nt, Salmonella enterica enterica serovar Typhi Ty2
uaaauauuggcggcaaagaa

SEQ ID NO: 1777330 - RNA, 20 nt, Salmonella enterica enterica serovar Typhi Ty2
uaaauauucaucaaaaugca

SEQ ID NO: 1777331 - RNA, 16 nt, Salmonella enterica enterica serovar Typhi Ty2
uaaauauaagaucuau

SEQ ID NO: 1777332 - RNA, 16 nt, Salmonella enterica enterica serovar Typhi Ty2
uaaaucgcuaagcaga

SEQ ID NO: 1777333 - RNA, 19 nt, Salmonella enterica enterica serovar Typhi Ty2
uaaaucgcgcaaauauuac

SEQ ID NO: 1777334 - RNA, 16 nt, Salmonella enterica enterica serovar Typhi Ty2
uaaaucgcgcaaauau

SEQ ID NO: 1777335 - RNA, 17 nt, Salmonella enterica enterica serovar Typhi Ty2
uaaaucgcgcaaauauu

SEQ ID NO: 1777336 - RNA, 14 nt, Salmonella enterica enterica serovar Typhi Ty2
uaaauccuucgccg

SEQ ID NO: 1777337 - RNA, 21 nt, Salmonella enterica enterica serovar Typhi Ty2
uaaauccaauagacuucacuu

SEQ ID NO: 1777338 - RNA, 15 nt, Salmonella enterica enterica serovar Typhi Ty2
uaaaucauuacuuau

SEQ ID NO: 1777339 - RNA, 22 nt, Salmonella enterica enterica serovar Typhi Ty2
uaaaucuacccaauugaauuua

SEQ ID NO: 1777340 - RNA, 20 nt, Salmonella enterica enterica serovar Typhi Ty2
uaaaauauccaugcuuucaa

SEQ ID NO: 1777341 - RNA, 12 nt, Salmonella enterica enterica serovar Typhi Ty2
uaaaauaagaau

SEQ ID NO: 1777342 - RNA, 15 nt, Salmonella enterica enterica serovar Typhi Ty2
uaaaauaacuauaau

SEQ ID NO: 1777343 - RNA, 23 nt, Salmonella enterica enterica serovar Typhi Ty2
uaaaauguuuuuguuguuaauuu

SEQ ID NO: 1777344 - RNA, 15 nt, Salmonella enterica enterica serovar Typhi Ty2
uaaaaugucuuuucg

SEQ ID NO: 1777345 - RNA, 12 nt, Salmonella enterica enterica serovar Typhi Ty2
uaaaaugucugu

SEQ ID NO: 1777346 - RNA, 17 nt, Salmonella enterica enterica serovar Typhi Ty2
uaaaauggcuugugaau

SEQ ID NO: 1777347 - RNA, 23 nt, Salmonella enterica enterica serovar Typhi Ty2
uaaaaucggggucuuccagcaga

SEQ ID NO: 1777348 - RNA, 19 nt, Salmonella enterica enterica serovar Typhi Ty2
uaaaauccggcugccugcc

SEQ ID NO: 1777349 - RNA, 23 nt, Salmonella enterica enterica serovar Typhi Ty2
uaaaauuauuggcuuuguaaaua

SEQ ID NO: 1777350 - RNA, 17 nt, Salmonella enterica enterica serovar Typhi Ty2
uaaaauuauuuuuacuu

SEQ ID NO: 1777351 - RNA, 17 nt, Salmonella enterica enterica serovar Typhi Ty2
uaaaauugcucagccaa

SEQ ID NO: 1777352 - RNA, 16 nt, Salmonella enterica enterica serovar Typhi Ty2
uaaacagacaauuagc

SEQ ID NO: 1777353 - RNA, 19 nt, Salmonella enterica enterica serovar Typhi Ty2
uaaacacucuccaccaaau

SEQ ID NO: 1777354 - RNA, 21 nt, Salmonella enterica enterica serovar Typhi Ty2
uaaacacucuccaccaaaucc

SEQ ID NO: 1777355 - RNA, 20 nt, Salmonella enterica enterica serovar Typhi Ty2
uaaacaccggggcauuucca

SEQ ID NO: 1777356 - RNA, 19 nt, Salmonella enterica enterica serovar Typhi Ty2
uaaacacagcaaacauccc

SEQ ID NO: 1777357 - RNA, 17 nt, Salmonella enterica enterica serovar Typhi Ty2
uaaaaauuguuccugua

SEQ ID NO: 1777358 - RNA, 14 nt, Salmonella enterica enterica serovar Typhi Ty2
uaaaacgcauacug

SEQ ID NO: 1777359 - RNA, 17 nt, Salmonella enterica enterica serovar Typhi Ty2
uaaaaccggcacaucca

SEQ ID NO: 1777360 - RNA, 18 nt, Salmonella enterica enterica serovar Typhi Ty2
uaaaacgguaugaaacau

SEQ ID NO: 1777361 - RNA, 23 nt, Salmonella enterica enterica serovar Typhi Ty2
uaaaagaagaaaccgcagaaaaa

SEQ ID NO: 1777362 - RNA, 17 nt, Salmonella enterica enterica serovar Typhi Ty2
uaaaaagcguacaaaaa

SEQ ID NO: 1777363 - RNA, 11 nt, Salmonella enterica enterica serovar Typhi Ty2
uaaaaaggaaa

SEQ ID NO: 1777364 - RNA, 16 nt, Salmonella enterica enterica serovar Typhi Ty2
uaaaaagcugcauaau

SEQ ID NO: 1777365 - RNA, 10 nt, Salmonella enterica enterica serovar Typhi Ty2
uaaaaaggaa

SEQ ID NO: 1777366 - RNA, 18 nt, Salmonella enterica enterica serovar Typhi Ty2
uaaaaagccagcguaaau

SEQ ID NO: 1777367 - RNA, 22 nt, Salmonella enterica enterica serovar Typhi Ty2
uaaaaauaacgcgauaaucccc

SEQ ID NO: 1777368 - RNA, 22 nt, Salmonella enterica enterica serovar Typhi Ty2
guuugaggaaaccuuucuucuc

SEQ ID NO: 1777369 - RNA, 16 nt, Salmonella enterica enterica serovar Typhi Ty2
uaaaaacccaccagcg

SEQ ID NO: 1777370 - RNA, 12 nt, Salmonella enterica enterica serovar Typhi Ty2
uaaaaaccaggc

SEQ ID NO: 1777371 - RNA, 21 nt, Salmonella enterica enterica serovar Typhi Ty2
uaaaaaccaggcaaaaauagg

SEQ ID NO: 1777372 - RNA, 16 nt, Salmonella enterica enterica serovar Typhi Ty2
uaaaaacccugccgaa

SEQ ID NO: 1777373 - RNA, 17 nt, Salmonella enterica enterica serovar Typhi Ty2
uaaaaaccagaauuucc

SEQ ID NO: 1777374 - RNA, 18 nt, Salmonella enterica enterica serovar Typhi Ty2
uaaaaagaccaugaacac

SEQ ID NO: 1777375 - RNA, 18 nt, Salmonella enterica enterica serovar Typhi Ty2
uaaaaacugcuaaaagaa

SEQ ID NO: 1777376 - RNA, 15 nt, Salmonella enterica enterica serovar Typhi Ty2
guuuaaaagcggaua

SEQ ID NO: 1777377 - RNA, 12 nt, Salmonella enterica enterica serovar Typhi Ty2
guuuaaaccacu

SEQ ID NO: 1777378 - RNA, 18 nt, Salmonella enterica enterica serovar Typhi Ty2
guuguuuggguaacacaa

SEQ ID NO: 1777379 - RNA, 21 nt, Salmonella enterica enterica serovar Typhi Ty2
guuguuuuauuaccuccugca

SEQ ID NO: 1777380 - RNA, 16 nt, Salmonella enterica enterica serovar Typhi Ty2
guuguaggcucaaagu

SEQ ID NO: 1777381 - RNA, 15 nt, Salmonella enterica enterica serovar Typhi Ty2
guugucaaaaaauca

SEQ ID NO: 1777382 - RNA, 21 nt, Salmonella enterica enterica serovar Typhi Ty2
guuuaaccguuccaacgcguu

SEQ ID NO: 1777383 - RNA, 14 nt, Salmonella enterica enterica serovar Typhi Ty2
guuuaauuucugac

SEQ ID NO: 1777384 - RNA, 16 nt, Salmonella enterica enterica serovar Typhi Ty2
guuuaaaucgcuaagc

SEQ ID NO: 1777385 - RNA, 20 nt, Salmonella enterica enterica serovar Typhi Ty2
guuuaccauuacgcuauaaa

SEQ ID NO: 1777386 - RNA, 19 nt, Salmonella enterica enterica serovar Typhi Ty2
guuuacccagcgaaugcug

SEQ ID NO: 1777387 - RNA, 14 nt, Salmonella enterica enterica serovar Typhi Ty2
guuuauauaaaaau

SEQ ID NO: 1777388 - RNA, 17 nt, Salmonella enterica enterica serovar Typhi Ty2
guuuauauaaaaauagc

SEQ ID NO: 1777389 - RNA, 22 nt, Salmonella enterica enterica serovar Typhi Ty2
guuuauaugcguguagcagaua

SEQ ID NO: 1777390 - RNA, 21 nt, Salmonella enterica enterica serovar Typhi Ty2
guuuacgagugcguucuucca

SEQ ID NO: 1777391 - RNA, 22 nt, Salmonella enterica enterica serovar Typhi Ty2
guuuacgagccauuaaugcagg

SEQ ID NO: 1777392 - RNA, 17 nt, Salmonella enterica enterica serovar Typhi Ty2
guuuagcgccagcagca

SEQ ID NO: 1777393 - RNA, 21 nt, Salmonella enterica enterica serovar Typhi Ty2
guuucucgccgguagccagcc

SEQ ID NO: 1777394 - RNA, 22 nt, Salmonella enterica enterica serovar Typhi Ty2
guuucucuugugcuuccagcuc

SEQ ID NO: 1777395 - RNA, 18 nt, Salmonella enterica enterica serovar Typhi Ty2
guuucuagaugaugauuu

SEQ ID NO: 1777396 - RNA, 13 nt, Salmonella enterica enterica serovar Typhi Ty2
guuucgccaggcc

SEQ ID NO: 1777397 - RNA, 19 nt, Salmonella enterica enterica serovar Typhi Ty2
guuugagaaaaacaucaug

SEQ ID NO: 1777398 - RNA, 17 nt, Salmonella enterica enterica serovar Typhi Ty2
guuucuuuucguuucuu

SEQ ID NO: 1777399 - RNA, 15 nt, Salmonella enterica enterica serovar Typhi Ty2
guuuauuauaaacac

SEQ ID NO: 1777400 - RNA, 13 nt, Salmonella enterica enterica serovar Typhi Ty2
guuucccagguuu

SEQ ID NO: 1777401 - RNA, 21 nt, Salmonella enterica enterica serovar Typhi Ty2
guuucccaacaaugccacgcc

SEQ ID NO: 1777402 - RNA, 17 nt, Salmonella enterica enterica serovar Typhi Ty2
guuuaucugaugccuga

SEQ ID NO: 1777403 - RNA, 21 nt, Salmonella enterica enterica serovar Typhi Ty2
guuuaucuggcuuacaggcac

SEQ ID NO: 1777404 - RNA, 17 nt, Salmonella enterica enterica serovar Typhi Ty2
guuuauccccgcuggug

SEQ ID NO: 1777405 - RNA, 16 nt, Salmonella enterica enterica serovar Typhi Ty2
guuucgauagcaggca

SEQ ID NO: 1777406 - RNA, 17 nt, Salmonella enterica enterica serovar Typhi Ty2
guuuccgcuagggcauc

SEQ ID NO: 1777407 - RNA, 19 nt, Salmonella enterica enterica serovar Typhi Ty2
guuuccguuuguaacauau

SEQ ID NO: 1777408 - RNA, 21 nt, Salmonella enterica enterica serovar Typhi Ty2
guuucccgcgcggaaggcgcc

SEQ ID NO: 1777409 - RNA, 18 nt, Salmonella enterica enterica serovar Typhi Ty2
guuggcguaaaucaggcc

SEQ ID NO: 1777410 - RNA, 19 nt, Salmonella enterica enterica serovar Typhi Ty2
guuggcugcgcucagaaac

SEQ ID NO: 1777411 - RNA, 23 nt, Salmonella enterica enterica serovar Typhi Ty2
guugggauaaugucgacgcgcuc

SEQ ID NO: 1777412 - RNA, 23 nt, Salmonella enterica enterica serovar Typhi Ty2
guugggcagaaacguaccugaga

SEQ ID NO: 1777413 - RNA, 13 nt, Salmonella enterica enterica serovar Typhi Ty2
guugguauucaac

SEQ ID NO: 1777414 - RNA, 23 nt, Salmonella enterica enterica serovar Typhi Ty2
guugguauugcgaaacggcagcg

SEQ ID NO: 1777415 - RNA, 20 nt, Salmonella enterica enterica serovar Typhi Ty2
guugguaaauuuaugguucc

SEQ ID NO: 1777416 - RNA, 14 nt, Salmonella enterica enterica serovar Typhi Ty2
guugguuguagcac

SEQ ID NO: 1777417 - RNA, 16 nt, Salmonella enterica enterica serovar Typhi Ty2
guugcuuuauaaaaag

SEQ ID NO: 1777418 - RNA, 16 nt, Salmonella enterica enterica serovar Typhi Ty2
guuggaguaauguuca

SEQ ID NO: 1777419 - RNA, 23 nt, Salmonella enterica enterica serovar Typhi Ty2
guuggcauucuuacgauacccca

SEQ ID NO: 1777420 - RNA, 21 nt, Salmonella enterica enterica serovar Typhi Ty2
guuggcauucgaauccuccug

SEQ ID NO: 1777421 - RNA, 17 nt, Salmonella enterica enterica serovar Typhi Ty2
guuggcauccugcgggu

SEQ ID NO: 1777422 - RNA, 19 nt, Salmonella enterica enterica serovar Typhi Ty2
guuggcgacauacgcgcuc

SEQ ID NO: 1777423 - RNA, 18 nt, Salmonella enterica enterica serovar Typhi Ty2
guuggcgaaggcggcggc

SEQ ID NO: 1777424 - RNA, 22 nt, Salmonella enterica enterica serovar Typhi Ty2
guugccggaaacgaaucuuuua

SEQ ID NO: 1777425 - RNA, 14 nt, Salmonella enterica enterica serovar Typhi Ty2
guugccaguacagc

SEQ ID NO: 1777426 - RNA, 16 nt, Salmonella enterica enterica serovar Typhi Ty2
guugccagcggccagg

SEQ ID NO: 1777427 - RNA, 13 nt, Salmonella enterica enterica serovar Typhi Ty2
guugccacaggcu

SEQ ID NO: 1777428 - RNA, 18 nt, Salmonella enterica enterica serovar Typhi Ty2
guugccaugauccaucuc

SEQ ID NO: 1777429 - RNA, 18 nt, Salmonella enterica enterica serovar Typhi Ty2
guugccaguacagcagcg

SEQ ID NO: 1777430 - RNA, 17 nt, Salmonella enterica enterica serovar Typhi Ty2
guugccuuugucaucca

SEQ ID NO: 1777431 - RNA, 21 nt, Salmonella enterica enterica serovar Typhi Ty2
guugcgacuguucaucaaaga

SEQ ID NO: 1777432 - RNA, 13 nt, Salmonella enterica enterica serovar Typhi Ty2
guugcgccgccag

SEQ ID NO: 1777433 - RNA, 15 nt, Salmonella enterica enterica serovar Typhi Ty2
guugcggauaaccga

SEQ ID NO: 1777434 - RNA, 21 nt, Salmonella enterica enterica serovar Typhi Ty2
guugcuccuguaagucaggua

SEQ ID NO: 1777435 - RNA, 14 nt, Salmonella enterica enterica serovar Typhi Ty2
guugcuccagcauc

SEQ ID NO: 1777436 - RNA, 15 nt, Salmonella enterica enterica serovar Typhi Ty2
guugcguaaauaaau

SEQ ID NO: 1777437 - RNA, 13 nt, Salmonella enterica enterica serovar Typhi Ty2
guugcuaaaucca

SEQ ID NO: 1777438 - RNA, 18 nt, Salmonella enterica enterica serovar Typhi Ty2
guugaugauuacugcuga

SEQ ID NO: 1777439 - RNA, 18 nt, Salmonella enterica enterica serovar Typhi Ty2
guugauuuuaugaugcau

SEQ ID NO: 1777440 - RNA, 20 nt, Salmonella enterica enterica serovar Typhi Ty2
guugauucgcuaauaauucu

SEQ ID NO: 1777441 - RNA, 18 nt, Salmonella enterica enterica serovar Typhi Ty2
guugacugcgcuccgacu

SEQ ID NO: 1777442 - RNA, 21 nt, Salmonella enterica enterica serovar Typhi Ty2
guugacgccccauguggccag

SEQ ID NO: 1777443 - RNA, 20 nt, Salmonella enterica enterica serovar Typhi Ty2
guugacggcuaccccggcgc

SEQ ID NO: 1777444 - RNA, 14 nt, Salmonella enterica enterica serovar Typhi Ty2
guugacgcuucaag

SEQ ID NO: 1777445 - RNA, 19 nt, Salmonella enterica enterica serovar Typhi Ty2
guugagccauuccagcgua

SEQ ID NO: 1777446 - RNA, 17 nt, Salmonella enterica enterica serovar Typhi Ty2
guugaucggccagcaag

SEQ ID NO: 1777447 - RNA, 23 nt, Salmonella enterica enterica serovar Typhi Ty2
guugauacagaaaaccggcaaau

SEQ ID NO: 1777448 - RNA, 19 nt, Salmonella enterica enterica serovar Typhi Ty2
guugauacaggaauaacca

SEQ ID NO: 1777449 - RNA, 20 nt, Salmonella enterica enterica serovar Typhi Ty2
guugauaaaacacucuuuuu

SEQ ID NO: 1777450 - RNA, 19 nt, Salmonella enterica enterica serovar Typhi Ty2
guugaauaucgcuuuuucu

SEQ ID NO: 1777451 - RNA, 18 nt, Salmonella enterica enterica serovar Typhi Ty2
guugaauaucgcuuuuuc

SEQ ID NO: 1777452 - RNA, 16 nt, Salmonella enterica enterica serovar Typhi Ty2
guucuuuucuuucagc

SEQ ID NO: 1777453 - RNA, 18 nt, Salmonella enterica enterica serovar Typhi Ty2
guucuuugauuagcucau

SEQ ID NO: 1777454 - RNA, 20 nt, Salmonella enterica enterica serovar Typhi Ty2
guugaagcgaccagcgcgcc

SEQ ID NO: 1777455 - RNA, 14 nt, Salmonella enterica enterica serovar Typhi Ty2
guugaaauccucua

SEQ ID NO: 1777456 - RNA, 22 nt, Salmonella enterica enterica serovar Typhi Ty2
guugaacauuucaucuaucugc

SEQ ID NO: 1777457 - RNA, 14 nt, Salmonella enterica enterica serovar Typhi Ty2
guugaaagccccgg

SEQ ID NO: 1777458 - RNA, 14 nt, Salmonella enterica enterica serovar Typhi Ty2
guucuuuccaguuc

SEQ ID NO: 1777459 - RNA, 13 nt, Salmonella enterica enterica serovar Typhi Ty2
guucuuucauuuu

SEQ ID NO: 1777460 - RNA, 22 nt, Salmonella enterica enterica serovar Typhi Ty2
guucuuucaccauuaagacagg

SEQ ID NO: 1777461 - RNA, 15 nt, Salmonella enterica enterica serovar Typhi Ty2
guucaugcgcggcgg

SEQ ID NO: 1777462 - RNA, 21 nt, Salmonella enterica enterica serovar Typhi Ty2
guucauuucaggcaaaggaau

SEQ ID NO: 1777463 - RNA, 15 nt, Salmonella enterica enterica serovar Typhi Ty2
guucauugcuuucuu

SEQ ID NO: 1777464 - RNA, 16 nt, Salmonella enterica enterica serovar Typhi Ty2
guucauugcuuucuug

SEQ ID NO: 1777465 - RNA, 21 nt, Salmonella enterica enterica serovar Typhi Ty2
guucauugaugaugaagcugc

SEQ ID NO: 1777466 - RNA, 18 nt, Salmonella enterica enterica serovar Typhi Ty2
guucauaagucauccaga

SEQ ID NO: 1777467 - RNA, 12 nt, Salmonella enterica enterica serovar Typhi Ty2
guucaguuucaa

SEQ ID NO: 1777468 - RNA, 19 nt, Salmonella enterica enterica serovar Typhi Ty2
guucaggcacgugcauaaa

SEQ ID NO: 1777469 - RNA, 17 nt, Salmonella enterica enterica serovar Typhi Ty2
guucaggcggcaaaaaa

SEQ ID NO: 1777470 - RNA, 17 nt, Salmonella enterica enterica serovar Typhi Ty2
guucacuaacgcggcau

SEQ ID NO: 1777471 - RNA, 15 nt, Salmonella enterica enterica serovar Typhi Ty2
guuagcaaaaaugcc

SEQ ID NO: 1777472 - RNA, 15 nt, Salmonella enterica enterica serovar Typhi Ty2
guucacguaaucgcc

SEQ ID NO: 1777473 - RNA, 20 nt, Salmonella enterica enterica serovar Typhi Ty2
guuagauuagguacguacau

SEQ ID NO: 1777474 - RNA, 22 nt, Salmonella enterica enterica serovar Typhi Ty2
guuagagcacaucacucauaau

SEQ ID NO: 1777475 - RNA, 17 nt, Salmonella enterica enterica serovar Typhi Ty2
guucacuccuaagagaa

SEQ ID NO: 1777476 - RNA, 20 nt, Salmonella enterica enterica serovar Typhi Ty2
guucagaaauguauucuccc

SEQ ID NO: 1777477 - RNA, 18 nt, Salmonella enterica enterica serovar Typhi Ty2
guucagcgacaggcuguc

SEQ ID NO: 1777478 - RNA, 14 nt, Salmonella enterica enterica serovar Typhi Ty2
guucagccgccagu

SEQ ID NO: 1777479 - RNA, 12 nt, Salmonella enterica enterica serovar Typhi Ty2
guucagccagca

SEQ ID NO: 1777480 - RNA, 12 nt, Salmonella enterica enterica serovar Typhi Ty2
guuccaccugcg

SEQ ID NO: 1777481 - RNA, 18 nt, Salmonella enterica enterica serovar Typhi Ty2
guuccaccgccaauaaaa

SEQ ID NO: 1777482 - RNA, 15 nt, Salmonella enterica enterica serovar Typhi Ty2
guucccaugcuucca

SEQ ID NO: 1777483 - RNA, 18 nt, Salmonella enterica enterica serovar Typhi Ty2
guuccacacguccauccg

SEQ ID NO: 1777484 - RNA, 22 nt, Salmonella enterica enterica serovar Typhi Ty2
guuccacaaucaaauggcuggc

SEQ ID NO: 1777485 - RNA, 15 nt, Salmonella enterica enterica serovar Typhi Ty2
guucccgccugcugc

SEQ ID NO: 1777486 - RNA, 16 nt, Salmonella enterica enterica serovar Typhi Ty2
guuccccgugcccggc

SEQ ID NO: 1777487 - RNA, 14 nt, Salmonella enterica enterica serovar Typhi Ty2
guucccgaaaaucc

SEQ ID NO: 1777488 - RNA, 22 nt, Salmonella enterica enterica serovar Typhi Ty2
guuccccaacagcgaccacgcc

SEQ ID NO: 1777489 - RNA, 17 nt, Salmonella enterica enterica serovar Typhi Ty2
guucccgcgccagcguc

SEQ ID NO: 1777490 - RNA, 15 nt, Salmonella enterica enterica serovar Typhi Ty2
guucgcgcaguucau

SEQ ID NO: 1777491 - RNA, 17 nt, Salmonella enterica enterica serovar Typhi Ty2
guucgcgcaguucaucc

SEQ ID NO: 1777492 - RNA, 16 nt, Salmonella enterica enterica serovar Typhi Ty2
guucgcgauuuucauc

SEQ ID NO: 1777493 - RNA, 15 nt, Salmonella enterica enterica serovar Typhi Ty2
guucgcgcauaccuu

SEQ ID NO: 1777494 - RNA, 18 nt, Salmonella enterica enterica serovar Typhi Ty2
guucgcgcaauucuucua

SEQ ID NO: 1777495 - RNA, 17 nt, Salmonella enterica enterica serovar Typhi Ty2
guucgccggcaaucugu

SEQ ID NO: 1777496 - RNA, 19 nt, Salmonella enterica enterica serovar Typhi Ty2
guucgccuucguuauaagg

SEQ ID NO: 1777497 - RNA, 15 nt, Salmonella enterica enterica serovar Typhi Ty2
guucggaagacugcu

SEQ ID NO: 1777498 - RNA, 23 nt, Salmonella enterica enterica serovar Typhi Ty2
guucggaagacugcuccggcaag

SEQ ID NO: 1777499 - RNA, 18 nt, Salmonella enterica enterica serovar Typhi Ty2
guucggagaucagcggau

SEQ ID NO: 1777500 - RNA, 15 nt, Salmonella enterica enterica serovar Typhi Ty2
guucggauaaacgcu

SEQ ID NO: 1777501 - RNA, 19 nt, Salmonella enterica enterica serovar Typhi Ty2
guuccugcacccgaauaaa

SEQ ID NO: 1777502 - RNA, 16 nt, Salmonella enterica enterica serovar Typhi Ty2
guuccugcuggcaaaa

SEQ ID NO: 1777503 - RNA, 15 nt, Salmonella enterica enterica serovar Typhi Ty2
guucgccagugacaa

SEQ ID NO: 1777504 - RNA, 20 nt, Salmonella enterica enterica serovar Typhi Ty2
guucgauaaucccggcgcgc

SEQ ID NO: 1777505 - RNA, 15 nt, Salmonella enterica enterica serovar Typhi Ty2
guucgaucagcuggc

SEQ ID NO: 1777506 - RNA, 18 nt, Salmonella enterica enterica serovar Typhi Ty2
guuacaaauagcggcaca

SEQ ID NO: 1777507 - RNA, 14 nt, Salmonella enterica enterica serovar Typhi Ty2
guuaauuugauuua

SEQ ID NO: 1777508 - RNA, 19 nt, Salmonella enterica enterica serovar Typhi Ty2
guuaauacaguggaaagua

SEQ ID NO: 1777509 - RNA, 11 nt, Salmonella enterica enterica serovar Typhi Ty2
guuaauacuga

SEQ ID NO: 1777510 - RNA, 18 nt, Salmonella enterica enterica serovar Typhi Ty2
guuaauaccguggucucc

SEQ ID NO: 1777511 - RNA, 15 nt, Salmonella enterica enterica serovar Typhi Ty2
guuaauauacauuca

SEQ ID NO: 1777512 - RNA, 18 nt, Salmonella enterica enterica serovar Typhi Ty2
guuaaagcccugacagaa

SEQ ID NO: 1777513 - RNA, 22 nt, Salmonella enterica enterica serovar Typhi Ty2
guuaaacguaaguuaaaacgcc

SEQ ID NO: 1777514 - RNA, 19 nt, Salmonella enterica enterica serovar Typhi Ty2
guuaaaccugguauuacaa

SEQ ID NO: 1777515 - RNA, 20 nt, Salmonella enterica enterica serovar Typhi Ty2
guuaaauagugacuucugcu

SEQ ID NO: 1777516 - RNA, 23 nt, Salmonella enterica enterica serovar Typhi Ty2
guuaaggccgcaaacagcacgcc

SEQ ID NO: 1777517 - RNA, 16 nt, Salmonella enterica enterica serovar Typhi Ty2
guuaaauauaucuguu

SEQ ID NO: 1777518 - RNA, 21 nt, Salmonella enterica enterica serovar Typhi Ty2
guuaaggcaucaauaccuguc

SEQ ID NO: 1777519 - RNA, 15 nt, Salmonella enterica enterica serovar Typhi Ty2
guuacuauuuuucac

SEQ ID NO: 1777520 - RNA, 23 nt, Salmonella enterica enterica serovar Typhi Ty2
guuacggcugaagcugccguccc

SEQ ID NO: 1777521 - RNA, 13 nt, Salmonella enterica enterica serovar Typhi Ty2
guuacgcgccacg

SEQ ID NO: 1777522 - RNA, 16 nt, Salmonella enterica enterica serovar Typhi Ty2
guuacucuuccaccau

SEQ ID NO: 1777523 - RNA, 14 nt, Salmonella enterica enterica serovar Typhi Ty2
guuacucgauggca

SEQ ID NO: 1777524 - RNA, 19 nt, Salmonella enterica enterica serovar Typhi Ty2
guuacgcauuucaagcagg

SEQ ID NO: 1777525 - RNA, 14 nt, Salmonella enterica enterica serovar Typhi Ty2
guuacugguuuuuu

SEQ ID NO: 1777526 - RNA, 18 nt, Salmonella enterica enterica serovar Typhi Ty2
guuacuggccuucuuucu

SEQ ID NO: 1777527 - RNA, 18 nt, Salmonella enterica enterica serovar Typhi Ty2
guuaccguaaucaucgcg

SEQ ID NO: 1777528 - RNA, 17 nt, Salmonella enterica enterica serovar Typhi Ty2
guuacaggcuccaagua

SEQ ID NO: 1777529 - RNA, 20 nt, Salmonella enterica enterica serovar Typhi Ty2
guuaccggcuccggcaaauu

SEQ ID NO: 1777530 - RNA, 19 nt, Salmonella enterica enterica serovar Typhi Ty2
guuaccucguuucacgucc

SEQ ID NO: 1777531 - RNA, 23 nt, Salmonella enterica enterica serovar Typhi Ty2
guuaccucaaaaaccaguugcca

SEQ ID NO: 1777532 - RNA, 20 nt, Salmonella enterica enterica serovar Typhi Ty2
guuacgcacgccagauaaau

SEQ ID NO: 1777533 - RNA, 14 nt, Salmonella enterica enterica serovar Typhi Ty2
gugugcagugacag

SEQ ID NO: 1777534 - RNA, 13 nt, Salmonella enterica enterica serovar Typhi Ty2
gugugccagcaga

SEQ ID NO: 1777535 - RNA, 17 nt, Salmonella enterica enterica serovar Typhi Ty2
gugugguuucaagcggc

SEQ ID NO: 1777536 - RNA, 14 nt, Salmonella enterica enterica serovar Typhi Ty2
guguaaaagccagc

SEQ ID NO: 1777537 - RNA, 13 nt, Salmonella enterica enterica serovar Typhi Ty2
guguaaaaauuuu

SEQ ID NO: 1777538 - RNA, 12 nt, Salmonella enterica enterica serovar Typhi Ty2
guguacauccag

SEQ ID NO: 1777539 - RNA, 16 nt, Salmonella enterica enterica serovar Typhi Ty2
gugucugcuucgucug

SEQ ID NO: 1777540 - RNA, 15 nt, Salmonella enterica enterica serovar Typhi Ty2
guguuaaucauuuuc

SEQ ID NO: 1777541 - RNA, 18 nt, Salmonella enterica enterica serovar Typhi Ty2
guguguuuuuuaauauaa

SEQ ID NO: 1777542 - RNA, 14 nt, Salmonella enterica enterica serovar Typhi Ty2
guguucguaaagca

SEQ ID NO: 1777543 - RNA, 14 nt, Salmonella enterica enterica serovar Typhi Ty2
guguugauugaaac

SEQ ID NO: 1777544 - RNA, 22 nt, Salmonella enterica enterica serovar Typhi Ty2
guguuggaugaaccauaucaaa

SEQ ID NO: 1777545 - RNA, 19 nt, Salmonella enterica enterica serovar Typhi Ty2
guguuucaucucaucaaug

SEQ ID NO: 1777546 - RNA, 19 nt, Salmonella enterica enterica serovar Typhi Ty2
guguugguacacagcacaa

SEQ ID NO: 1777547 - RNA, 20 nt, Salmonella enterica enterica serovar Typhi Ty2
guguuguacagcaauaaaag

SEQ ID NO: 1777548 - RNA, 21 nt, Salmonella enterica enterica serovar Typhi Ty2
guggugucucgucgccagggc

SEQ ID NO: 1777549 - RNA, 18 nt, Salmonella enterica enterica serovar Typhi Ty2
gugguuaucgaauccagc

SEQ ID NO: 1777550 - RNA, 17 nt, Salmonella enterica enterica serovar Typhi Ty2
gugguuaacagcgcagg

SEQ ID NO: 1777551 - RNA, 15 nt, Salmonella enterica enterica serovar Typhi Ty2
gugguggucaacguu

SEQ ID NO: 1777552 - RNA, 16 nt, Salmonella enterica enterica serovar Typhi Ty2
gugguuuccggcagcu

SEQ ID NO: 1777553 - RNA, 23 nt, Salmonella enterica enterica serovar Typhi Ty2
guggugcaagcaccuuauccggc

SEQ ID NO: 1777554 - RNA, 22 nt, Salmonella enterica enterica serovar Typhi Ty2
guggucauauugucgcgcccgu

SEQ ID NO: 1777555 - RNA, 22 nt, Salmonella enterica enterica serovar Typhi Ty2
guggggaauguauuucagacuu

SEQ ID NO: 1777556 - RNA, 14 nt, Salmonella enterica enterica serovar Typhi Ty2
guggguaaauccgc

SEQ ID NO: 1777557 - RNA, 13 nt, Salmonella enterica enterica serovar Typhi Ty2
gugggguucccga

SEQ ID NO: 1777558 - RNA, 17 nt, Salmonella enterica enterica serovar Typhi Ty2
gugguacaccaguacau

SEQ ID NO: 1777559 - RNA, 18 nt, Salmonella enterica enterica serovar Typhi Ty2
guggcccagcgcgguggc

SEQ ID NO: 1777560 - RNA, 19 nt, Salmonella enterica enterica serovar Typhi Ty2
guggcccgcacugccgagu

SEQ ID NO: 1777561 - RNA, 16 nt, Salmonella enterica enterica serovar Typhi Ty2
guggcccagcgcggug

SEQ ID NO: 1777562 - RNA, 15 nt, Salmonella enterica enterica serovar Typhi Ty2
guggccaucuuccag

SEQ ID NO: 1777563 - RNA, 20 nt, Salmonella enterica enterica serovar Typhi Ty2
guggcgacgcguggcaucuu

SEQ ID NO: 1777564 - RNA, 14 nt, Salmonella enterica enterica serovar Typhi Ty2
guggcgaccagcag

SEQ ID NO: 1777565 - RNA, 22 nt, Salmonella enterica enterica serovar Typhi Ty2
guggcgaacaggcucagcgcca

SEQ ID NO: 1777566 - RNA, 21 nt, Salmonella enterica enterica serovar Typhi Ty2
guggcuauagcucaguuggua

SEQ ID NO: 1777567 - RNA, 18 nt, Salmonella enterica enterica serovar Typhi Ty2
guggcggauacgcuucca

SEQ ID NO: 1777568 - RNA, 15 nt, Salmonella enterica enterica serovar Typhi Ty2
guggcggaauuggua

SEQ ID NO: 1777569 - RNA, 19 nt, Salmonella enterica enterica serovar Typhi Ty2
guggcggaaaugcgcggug

SEQ ID NO: 1777570 - RNA, 22 nt, Salmonella enterica enterica serovar Typhi Ty2
guggcgcuguucuugcugcugc

SEQ ID NO: 1777571 - RNA, 13 nt, Salmonella enterica enterica serovar Typhi Ty2
guggcgcuguucu

SEQ ID NO: 1777572 - RNA, 20 nt, Salmonella enterica enterica serovar Typhi Ty2
guggcgcaguuuacgcagcg

SEQ ID NO: 1777573 - RNA, 17 nt, Salmonella enterica enterica serovar Typhi Ty2
gugcuugcguuucuaga

SEQ ID NO: 1777574 - RNA, 16 nt, Salmonella enterica enterica serovar Typhi Ty2
gugcuuccagcuccau

SEQ ID NO: 1777575 - RNA, 13 nt, Salmonella enterica enterica serovar Typhi Ty2
gugcugguggugg

SEQ ID NO: 1777576 - RNA, 13 nt, Salmonella enterica enterica serovar Typhi Ty2
gugcuuccagcuc

SEQ ID NO: 1777577 - RNA, 11 nt, Salmonella enterica enterica serovar Typhi Ty2
guggcaaauac

SEQ ID NO: 1777578 - RNA, 18 nt, Salmonella enterica enterica serovar Typhi Ty2
guggccagcaugcccgcc

SEQ ID NO: 1777579 - RNA, 19 nt, Salmonella enterica enterica serovar Typhi Ty2
gugcccauaaaaaucccaa

SEQ ID NO: 1777580 - RNA, 18 nt, Salmonella enterica enterica serovar Typhi Ty2
gugcccgcgguuugacug

SEQ ID NO: 1777581 - RNA, 15 nt, Salmonella enterica enterica serovar Typhi Ty2
gugcagacugcacuu

SEQ ID NO: 1777582 - RNA, 17 nt, Salmonella enterica enterica serovar Typhi Ty2
gugcagcaagcggcugu

SEQ ID NO: 1777583 - RNA, 14 nt, Salmonella enterica enterica serovar Typhi Ty2
gugcagcaaauaau

SEQ ID NO: 1777584 - RNA, 22 nt, Salmonella enterica enterica serovar Typhi Ty2
gugccagaaacaagaagcacga

SEQ ID NO: 1777585 - RNA, 17 nt, Salmonella enterica enterica serovar Typhi Ty2
gugccaccagccggagc

SEQ ID NO: 1777586 - RNA, 18 nt, Salmonella enterica enterica serovar Typhi Ty2
gugccaaucuccagcauc

SEQ ID NO: 1777587 - RNA, 22 nt, Salmonella enterica enterica serovar Typhi Ty2
gugauuggcuggacauguuccg

SEQ ID NO: 1777588 - RNA, 18 nt, Salmonella enterica enterica serovar Typhi Ty2
gugauggugcagccccgg

SEQ ID NO: 1777589 - RNA, 13 nt, Salmonella enterica enterica serovar Typhi Ty2
gugaugugccggu

SEQ ID NO: 1777590 - RNA, 14 nt, Salmonella enterica enterica serovar Typhi Ty2
gugauuguccaacu

SEQ ID NO: 1777591 - RNA, 12 nt, Salmonella enterica enterica serovar Typhi Ty2
gugcaagcaccu

SEQ ID NO: 1777592 - RNA, 24 nt, Salmonella enterica enterica serovar Typhi Ty2
gugcaaucccggaacagcggagcg

SEQ ID NO: 1777593 - RNA, 23 nt, Salmonella enterica enterica serovar Typhi Ty2
gugcaauccugucgucaccagca

SEQ ID NO: 1777594 - RNA, 16 nt, Salmonella enterica enterica serovar Typhi Ty2
gugauggguauuagaa

SEQ ID NO: 1777595 - RNA, 20 nt, Salmonella enterica enterica serovar Typhi Ty2
gugaugggcaaugccauauu

SEQ ID NO: 1777596 - RNA, 15 nt, Salmonella enterica enterica serovar Typhi Ty2
gugauggguauuaga

SEQ ID NO: 1777597 - RNA, 17 nt, Salmonella enterica enterica serovar Typhi Ty2
gugauggguauuagaau

SEQ ID NO: 1777598 - RNA, 18 nt, Salmonella enterica enterica serovar Typhi Ty2
gugaugcaucagaacaaa

SEQ ID NO: 1777599 - RNA, 16 nt, Salmonella enterica enterica serovar Typhi Ty2
gugaugcggacgcuga

SEQ ID NO: 1777600 - RNA, 14 nt, Salmonella enterica enterica serovar Typhi Ty2
gugcguucuuccac

SEQ ID NO: 1777601 - RNA, 13 nt, Salmonella enterica enterica serovar Typhi Ty2
gugcguucuucca

SEQ ID NO: 1777602 - RNA, 14 nt, Salmonella enterica enterica serovar Typhi Ty2
gugcguaaacaggc

SEQ ID NO: 1777603 - RNA, 16 nt, Salmonella enterica enterica serovar Typhi Ty2
gugcucagccccuggg

SEQ ID NO: 1777604 - RNA, 14 nt, Salmonella enterica enterica serovar Typhi Ty2
gugcuacgggcgcu

SEQ ID NO: 1777605 - RNA, 22 nt, Salmonella enterica enterica serovar Typhi Ty2
gugcuauacaguaaaacgccaa

SEQ ID NO: 1777606 - RNA, 14 nt, Salmonella enterica enterica serovar Typhi Ty2
gugcucgcggcgga

SEQ ID NO: 1777607 - RNA, 21 nt, Salmonella enterica enterica serovar Typhi Ty2
gugcucucccagcugagcuaa

SEQ ID NO: 1777608 - RNA, 13 nt, Salmonella enterica enterica serovar Typhi Ty2
gugcuggcggccg

SEQ ID NO: 1777609 - RNA, 18 nt, Salmonella enterica enterica serovar Typhi Ty2
gugcgccccuugcagcaa

SEQ ID NO: 1777610 - RNA, 12 nt, Salmonella enterica enterica serovar Typhi Ty2
gugcgccccagc

SEQ ID NO: 1777611 - RNA, 16 nt, Salmonella enterica enterica serovar Typhi Ty2
gugcggcaaccaccag

SEQ ID NO: 1777612 - RNA, 16 nt, Salmonella enterica enterica serovar Typhi Ty2
gugcgcgggaggcggu

SEQ ID NO: 1777613 - RNA, 22 nt, Salmonella enterica enterica serovar Typhi Ty2
gugcgcggucauaucuggacgg

SEQ ID NO: 1777614 - RNA, 20 nt, Salmonella enterica enterica serovar Typhi Ty2
gugcgccguccugcaaggca

SEQ ID NO: 1777615 - RNA, 22 nt, Salmonella enterica enterica serovar Typhi Ty2
gugcggcauauucaggagcaug

SEQ ID NO: 1777616 - RNA, 20 nt, Salmonella enterica enterica serovar Typhi Ty2
gugcggcauauucaggagca

SEQ ID NO: 1777617 - RNA, 14 nt, Salmonella enterica enterica serovar Typhi Ty2
gugcggggaacacu

SEQ ID NO: 1777618 - RNA, 19 nt, Salmonella enterica enterica serovar Typhi Ty2
gugcgggaggaauaaaaga

SEQ ID NO: 1777619 - RNA, 15 nt, Salmonella enterica enterica serovar Typhi Ty2
gccuucgccuucacg

SEQ ID NO: 1777620 - RNA, 19 nt, Salmonella enterica enterica serovar Typhi Ty2
gccuucggcgucgugcugg

SEQ ID NO: 1777621 - RNA, 12 nt, Salmonella enterica enterica serovar Typhi Ty2
gccuuccagcaa

SEQ ID NO: 1777622 - RNA, 14 nt, Salmonella enterica enterica serovar Typhi Ty2
gccuucgccgccgc

SEQ ID NO: 1777623 - RNA, 13 nt, Salmonella enterica enterica serovar Typhi Ty2
gccuucauaauga

SEQ ID NO: 1777624 - RNA, 13 nt, Salmonella enterica enterica serovar Typhi Ty2
gccuuccagaaau

SEQ ID NO: 1777625 - RNA, 16 nt, Salmonella enterica enterica serovar Typhi Ty2
gccuuccagaaauaaa

SEQ ID NO: 1777626 - RNA, 14 nt, Salmonella enterica enterica serovar Typhi Ty2
gccuucauuaauuu

SEQ ID NO: 1777627 - RNA, 15 nt, Salmonella enterica enterica serovar Typhi Ty2
gccuucaggcaucag

SEQ ID NO: 1777628 - RNA, 15 nt, Salmonella enterica enterica serovar Typhi Ty2
gccuucagcgcgccc

SEQ ID NO: 1777629 - RNA, 22 nt, Salmonella enterica enterica serovar Typhi Ty2
gccuuauccggccuacaacuca

SEQ ID NO: 1777630 - RNA, 19 nt, Salmonella enterica enterica serovar Typhi Ty2
gccuuaucaggccuguggu

SEQ ID NO: 1777631 - RNA, 23 nt, Salmonella enterica enterica serovar Typhi Ty2
gccuuauggccagggacaggaga

SEQ ID NO: 1777632 - RNA, 13 nt, Salmonella enterica enterica serovar Typhi Ty2
gccuuauccggcc

SEQ ID NO: 1777633 - RNA, 23 nt, Salmonella enterica enterica serovar Typhi Ty2
gccuuaucgagugucaauaagcc

SEQ ID NO: 1777634 - RNA, 18 nt, Salmonella enterica enterica serovar Typhi Ty2
gccuucaaauauauugaa

SEQ ID NO: 1777635 - RNA, 21 nt, Salmonella enterica enterica serovar Typhi Ty2
gccuucaauuugaccugaccu

SEQ ID NO: 1777636 - RNA, 23 nt, Salmonella enterica enterica serovar Typhi Ty2
gccuuacaggcgcaucagaaaaa

SEQ ID NO: 1777637 - RNA, 15 nt, Salmonella enterica enterica serovar Typhi Ty2
gccuuacaggcgcau

SEQ ID NO: 1777638 - RNA, 14 nt, Salmonella enterica enterica serovar Typhi Ty2
gccuuacccggccu

SEQ ID NO: 1777639 - RNA, 16 nt, Salmonella enterica enterica serovar Typhi Ty2
gccuguuuaagcuuuu

SEQ ID NO: 1777640 - RNA, 19 nt, Salmonella enterica enterica serovar Typhi Ty2
gccuguuagggcgcggcug

SEQ ID NO: 1777641 - RNA, 18 nt, Salmonella enterica enterica serovar Typhi Ty2
gccuguucuucaguaauu

SEQ ID NO: 1777642 - RNA, 14 nt, Salmonella enterica enterica serovar Typhi Ty2
gccuguucuuuuuc

SEQ ID NO: 1777643 - RNA, 23 nt, Salmonella enterica enterica serovar Typhi Ty2
gccuguucuuuuucggcuggcag

SEQ ID NO: 1777644 - RNA, 14 nt, Salmonella enterica enterica serovar Typhi Ty2
gccuguugauuacg

SEQ ID NO: 1777645 - RNA, 21 nt, Salmonella enterica enterica serovar Typhi Ty2
gccuuguaggccugauagcac

SEQ ID NO: 1777646 - RNA, 15 nt, Salmonella enterica enterica serovar Typhi Ty2
gccuugcggcggcgu

SEQ ID NO: 1777647 - RNA, 16 nt, Salmonella enterica enterica serovar Typhi Ty2
gccuugcggcgccagg

SEQ ID NO: 1777648 - RNA, 21 nt, Salmonella enterica enterica serovar Typhi Ty2
gccuugaaguuauccagcgcc

SEQ ID NO: 1777649 - RNA, 20 nt, Salmonella enterica enterica serovar Typhi Ty2
gccuucguuauaaggccugc

SEQ ID NO: 1777650 - RNA, 18 nt, Salmonella enterica enterica serovar Typhi Ty2
gccuucuucgcaaucucc

SEQ ID NO: 1777651 - RNA, 12 nt, Salmonella enterica enterica serovar Typhi Ty2
gccuucuuucuc

SEQ ID NO: 1777652 - RNA, 13 nt, Salmonella enterica enterica serovar Typhi Ty2
gcgacagcgcgcc

SEQ ID NO: 1777653 - RNA, 21 nt, Salmonella enterica enterica serovar Typhi Ty2
gcgaccaguuauucggcauau

SEQ ID NO: 1777654 - RNA, 15 nt, Salmonella enterica enterica serovar Typhi Ty2
gcgaccucaucaaac

SEQ ID NO: 1777655 - RNA, 13 nt, Salmonella enterica enterica serovar Typhi Ty2
gcgaccuucuccc

SEQ ID NO: 1777656 - RNA, 19 nt, Salmonella enterica enterica serovar Typhi Ty2
gcgacaacaaguccaagua

SEQ ID NO: 1777657 - RNA, 20 nt, Salmonella enterica enterica serovar Typhi Ty2
gcgacacgcgcgcugcgccu

SEQ ID NO: 1777658 - RNA, 23 nt, Salmonella enterica enterica serovar Typhi Ty2
gcgacacgcgcgcugcgccugga

SEQ ID NO: 1777659 - RNA, 19 nt, Salmonella enterica enterica serovar Typhi Ty2
gcgacacgcgcgcugcgcc

SEQ ID NO: 1777660 - RNA, 20 nt, Salmonella enterica enterica serovar Typhi Ty2
gcgaauuuuauuaagcaggc

SEQ ID NO: 1777661 - RNA, 17 nt, Salmonella enterica enterica serovar Typhi Ty2
gcgaauuugccccagau

SEQ ID NO: 1777662 - RNA, 20 nt, Salmonella enterica enterica serovar Typhi Ty2
gcgaaggggcgggcagcagc

SEQ ID NO: 1777663 - RNA, 23 nt, Salmonella enterica enterica serovar Typhi Ty2
gcgaaguagauuacgaaugugca

SEQ ID NO: 1777664 - RNA, 13 nt, Salmonella enterica enterica serovar Typhi Ty2
gccuuuccgcaug

SEQ ID NO: 1777665 - RNA, 14 nt, Salmonella enterica enterica serovar Typhi Ty2
gccuuuaugcaguu

SEQ ID NO: 1777666 - RNA, 15 nt, Salmonella enterica enterica serovar Typhi Ty2
gccuuuaccacccgu

SEQ ID NO: 1777667 - RNA, 23 nt, Salmonella enterica enterica serovar Typhi Ty2
gccuuuuaucaaugcacugacuu

SEQ ID NO: 1777668 - RNA, 22 nt, Salmonella enterica enterica serovar Typhi Ty2
gccuuuucauauggaagcuguu

SEQ ID NO: 1777669 - RNA, 18 nt, Salmonella enterica enterica serovar Typhi Ty2
gccuuuucccccagcauu

SEQ ID NO: 1777670 - RNA, 20 nt, Salmonella enterica enterica serovar Typhi Ty2
gccuuuucccccagcauuuu

SEQ ID NO: 1777671 - RNA, 20 nt, Salmonella enterica enterica serovar Typhi Ty2
gcgaacggcuuuccagcagc

SEQ ID NO: 1777672 - RNA, 20 nt, Salmonella enterica enterica serovar Typhi Ty2
gcgaaauuuaauauaugaac

SEQ ID NO: 1777673 - RNA, 20 nt, Salmonella enterica enterica serovar Typhi Ty2
gcgaaccggaccagcacaaa

SEQ ID NO: 1777674 - RNA, 21 nt, Salmonella enterica enterica serovar Typhi Ty2
gcgaacgacucacgcgcgcuu

SEQ ID NO: 1777675 - RNA, 21 nt, Salmonella enterica enterica serovar Typhi Ty2
gcgaaaucaaagaccuccgcc

SEQ ID NO: 1777676 - RNA, 23 nt, Salmonella enterica enterica serovar Typhi Ty2
gcgaaaacguugacuuaaaaagc

SEQ ID NO: 1777677 - RNA, 17 nt, Salmonella enterica enterica serovar Typhi Ty2
gccuuuuuuaauccagg

SEQ ID NO: 1777678 - RNA, 18 nt, Salmonella enterica enterica serovar Typhi Ty2
gccuuuuuuaauccagga

SEQ ID NO: 1777679 - RNA, 20 nt, Salmonella enterica enterica serovar Typhi Ty2
gccuuuuugcagcgcggcca

SEQ ID NO: 1777680 - RNA, 20 nt, Salmonella enterica enterica serovar Typhi Ty2
gccuuuuuuaauccaggaau

SEQ ID NO: 1777681 - RNA, 18 nt, Salmonella enterica enterica serovar Typhi Ty2
gccuuuuuucaccugcaa

SEQ ID NO: 1777682 - RNA, 12 nt, Salmonella enterica enterica serovar Typhi Ty2
gcgaaaaagccg

SEQ ID NO: 1777683 - RNA, 16 nt, Salmonella enterica enterica serovar Typhi Ty2
gcgcaauaccuguaaa

SEQ ID NO: 1777684 - RNA, 21 nt, Salmonella enterica enterica serovar Typhi Ty2
gcgcaauaaauucgaaauaaa

SEQ ID NO: 1777685 - RNA, 12 nt, Salmonella enterica enterica serovar Typhi Ty2
gcgcaaauauua

SEQ ID NO: 1777686 - RNA, 18 nt, Salmonella enterica enterica serovar Typhi Ty2
gcgcaaccgacgggcgcu

SEQ ID NO: 1777687 - RNA, 24 nt, Salmonella enterica enterica serovar Typhi Ty2
gcgauuuuuuuccgcccgccuucu

SEQ ID NO: 1777688 - RNA, 21 nt, Salmonella enterica enterica serovar Typhi Ty2
gcgauuguuauccccccgccg

SEQ ID NO: 1777689 - RNA, 21 nt, Salmonella enterica enterica serovar Typhi Ty2
gcgcaaagcaauguaaaacug

SEQ ID NO: 1777690 - RNA, 18 nt, Salmonella enterica enterica serovar Typhi Ty2
gcgcaaacuaccgggccu

SEQ ID NO: 1777691 - RNA, 22 nt, Salmonella enterica enterica serovar Typhi Ty2
gcgcaaacuucacauuuuuauc

SEQ ID NO: 1777692 - RNA, 18 nt, Salmonella enterica enterica serovar Typhi Ty2
gcgcaaacggaucuucca

SEQ ID NO: 1777693 - RNA, 18 nt, Salmonella enterica enterica serovar Typhi Ty2
gcgcaaacgcgugcuggu

SEQ ID NO: 1777694 - RNA, 11 nt, Salmonella enterica enterica serovar Typhi Ty2
gcgaugguagg

SEQ ID NO: 1777695 - RNA, 16 nt, Salmonella enterica enterica serovar Typhi Ty2
gcgauguccgguccgg

SEQ ID NO: 1777696 - RNA, 20 nt, Salmonella enterica enterica serovar Typhi Ty2
gcgauguucuugccgccauc

SEQ ID NO: 1777697 - RNA, 16 nt, Salmonella enterica enterica serovar Typhi Ty2
gcgauguuggguuucg

SEQ ID NO: 1777698 - RNA, 16 nt, Salmonella enterica enterica serovar Typhi Ty2
gcgauguuuauugaaa

SEQ ID NO: 1777699 - RNA, 22 nt, Salmonella enterica enterica serovar Typhi Ty2
gcgauguuuucccucgccccgg

SEQ ID NO: 1777700 - RNA, 18 nt, Salmonella enterica enterica serovar Typhi Ty2
gcgcagcaugaucggcug

SEQ ID NO: 1777701 - RNA, 18 nt, Salmonella enterica enterica serovar Typhi Ty2
gcgcagcaucucauccac

SEQ ID NO: 1777702 - RNA, 15 nt, Salmonella enterica enterica serovar Typhi Ty2
gcgcagcgcgcgacc

SEQ ID NO: 1777703 - RNA, 15 nt, Salmonella enterica enterica serovar Typhi Ty2
gcgcagccccagcgc

SEQ ID NO: 1777704 - RNA, 16 nt, Salmonella enterica enterica serovar Typhi Ty2
gcgcagccagcgcccc

SEQ ID NO: 1777705 - RNA, 15 nt, Salmonella enterica enterica serovar Typhi Ty2
gcgcagcgucaucag

SEQ ID NO: 1777706 - RNA, 16 nt, Salmonella enterica enterica serovar Typhi Ty2
gcgcagcugggccugc

SEQ ID NO: 1777707 - RNA, 22 nt, Salmonella enterica enterica serovar Typhi Ty2
gcgcagcgcuuuugccgcgccc

SEQ ID NO: 1777708 - RNA, 19 nt, Salmonella enterica enterica serovar Typhi Ty2
gcgcagcgcgucggcgggc

SEQ ID NO: 1777709 - RNA, 16 nt, Salmonella enterica enterica serovar Typhi Ty2
gcgcacucagaaaauu

SEQ ID NO: 1777710 - RNA, 14 nt, Salmonella enterica enterica serovar Typhi Ty2
gcgcacgcgcgcgc

SEQ ID NO: 1777711 - RNA, 16 nt, Salmonella enterica enterica serovar Typhi Ty2
gcgcaauaugcggcgc

SEQ ID NO: 1777712 - RNA, 22 nt, Salmonella enterica enterica serovar Typhi Ty2
gcgcaauaugcagaucgacggu

SEQ ID NO: 1777713 - RNA, 14 nt, Salmonella enterica enterica serovar Typhi Ty2
gcgcaauaugguau

SEQ ID NO: 1777714 - RNA, 16 nt, Salmonella enterica enterica serovar Typhi Ty2
gcgcaauccgcgccgc

SEQ ID NO: 1777715 - RNA, 19 nt, Salmonella enterica enterica serovar Typhi Ty2
gcgacgacgcuguuuaugc

SEQ ID NO: 1777716 - RNA, 13 nt, Salmonella enterica enterica serovar Typhi Ty2
gcgacgacgccag

SEQ ID NO: 1777717 - RNA, 18 nt, Salmonella enterica enterica serovar Typhi Ty2
gcgacgacacggcgcaga

SEQ ID NO: 1777718 - RNA, 16 nt, Salmonella enterica enterica serovar Typhi Ty2
gcgacugaaaaucaaa

SEQ ID NO: 1777719 - RNA, 18 nt, Salmonella enterica enterica serovar Typhi Ty2
gcgagaguaagcccaaag

SEQ ID NO: 1777720 - RNA, 15 nt, Salmonella enterica enterica serovar Typhi Ty2
gcgagagaaaaaaau

SEQ ID NO: 1777721 - RNA, 23 nt, Salmonella enterica enterica serovar Typhi Ty2
gcgagagaauuaacagcgcgacc

SEQ ID NO: 1777722 - RNA, 18 nt, Salmonella enterica enterica serovar Typhi Ty2
gcgacuggaacgucauca

SEQ ID NO: 1777723 - RNA, 12 nt, Salmonella enterica enterica serovar Typhi Ty2
gcgacugccgca

SEQ ID NO: 1777724 - RNA, 14 nt, Salmonella enterica enterica serovar Typhi Ty2
gcgacugccgcaga

SEQ ID NO: 1777725 - RNA, 14 nt, Salmonella enterica enterica serovar Typhi Ty2
gcgacuucauucag

SEQ ID NO: 1777726 - RNA, 12 nt, Salmonella enterica enterica serovar Typhi Ty2
gcgaggacugua

SEQ ID NO: 1777727 - RNA, 22 nt, Salmonella enterica enterica serovar Typhi Ty2
gcgaggaacaucagccagcagc

SEQ ID NO: 1777728 - RNA, 15 nt, Salmonella enterica enterica serovar Typhi Ty2
gcgagccuucaacaa

SEQ ID NO: 1777729 - RNA, 20 nt, Salmonella enterica enterica serovar Typhi Ty2
gcgaucgcgccggucgccag

SEQ ID NO: 1777730 - RNA, 17 nt, Salmonella enterica enterica serovar Typhi Ty2
gcgaugaccaucaaaua

SEQ ID NO: 1777731 - RNA, 23 nt, Salmonella enterica enterica serovar Typhi Ty2
gcgaugaguaaaauuuuuuucau

SEQ ID NO: 1777732 - RNA, 21 nt, Salmonella enterica enterica serovar Typhi Ty2
gcgauggaagcguuacuggcc

SEQ ID NO: 1777733 - RNA, 21 nt, Salmonella enterica enterica serovar Typhi Ty2
gcgauccagccccagcgccag

SEQ ID NO: 1777734 - RNA, 17 nt, Salmonella enterica enterica serovar Typhi Ty2
gcgauccaggucuuccg

SEQ ID NO: 1777735 - RNA, 22 nt, Salmonella enterica enterica serovar Typhi Ty2
gcgaucccaguugaucggccag

SEQ ID NO: 1777736 - RNA, 21 nt, Salmonella enterica enterica serovar Typhi Ty2
gcgauccgcgagacgccuggg

SEQ ID NO: 1777737 - RNA, 21 nt, Salmonella enterica enterica serovar Typhi Ty2
gcgaucgccgucguucagcca

SEQ ID NO: 1777738 - RNA, 11 nt, Salmonella enterica enterica serovar Typhi Ty2
gcgaucgccag

SEQ ID NO: 1777739 - RNA, 19 nt, Salmonella enterica enterica serovar Typhi Ty2
gcgagggauuuccuggcag

SEQ ID NO: 1777740 - RNA, 17 nt, Salmonella enterica enterica serovar Typhi Ty2
gcgauaccgugacugac

SEQ ID NO: 1777741 - RNA, 15 nt, Salmonella enterica enterica serovar Typhi Ty2
gcgaggucgagcuca

SEQ ID NO: 1777742 - RNA, 18 nt, Salmonella enterica enterica serovar Typhi Ty2
gcgauacucugcccgccg

SEQ ID NO: 1777743 - RNA, 22 nt, Salmonella enterica enterica serovar Typhi Ty2
gcgauacgcgcguucguugaug

SEQ ID NO: 1777744 - RNA, 19 nt, Salmonella enterica enterica serovar Typhi Ty2
gcgauaccgugacugacca

SEQ ID NO: 1777745 - RNA, 21 nt, Salmonella enterica enterica serovar Typhi Ty2
gcgauagagaccgcuuuagcc

SEQ ID NO: 1777746 - RNA, 20 nt, Salmonella enterica enterica serovar Typhi Ty2
gcgccagcgaccaccguccc

SEQ ID NO: 1777747 - RNA, 17 nt, Salmonella enterica enterica serovar Typhi Ty2
gcgccagcgauggggca

SEQ ID NO: 1777748 - RNA, 16 nt, Salmonella enterica enterica serovar Typhi Ty2
gcgccagcgccgccuc

SEQ ID NO: 1777749 - RNA, 14 nt, Salmonella enterica enterica serovar Typhi Ty2
gcgccagcggcggc

SEQ ID NO: 1777750 - RNA, 15 nt, Salmonella enterica enterica serovar Typhi Ty2
gcgccagcggcugcu

SEQ ID NO: 1777751 - RNA, 16 nt, Salmonella enterica enterica serovar Typhi Ty2
gcgccacuucacuggc

SEQ ID NO: 1777752 - RNA, 14 nt, Salmonella enterica enterica serovar Typhi Ty2
gcgccagacgcgca

SEQ ID NO: 1777753 - RNA, 22 nt, Salmonella enterica enterica serovar Typhi Ty2
gcgccagaaagguauuaaguga

SEQ ID NO: 1777754 - RNA, 17 nt, Salmonella enterica enterica serovar Typhi Ty2
gcgccacuuuuccggca

SEQ ID NO: 1777755 - RNA, 15 nt, Salmonella enterica enterica serovar Typhi Ty2
gcgcaggcgagcggc

SEQ ID NO: 1777756 - RNA, 20 nt, Salmonella enterica enterica serovar Typhi Ty2
gcgccaguaaugccgugccg

SEQ ID NO: 1777757 - RNA, 21 nt, Salmonella enterica enterica serovar Typhi Ty2
gcgccagcgugcuaagcugga

SEQ ID NO: 1777758 - RNA, 19 nt, Salmonella enterica enterica serovar Typhi Ty2
gcgccagcguaaucggcag

SEQ ID NO: 1777759 - RNA, 22 nt, Salmonella enterica enterica serovar Typhi Ty2
gcgccauguucauaaagugcca

SEQ ID NO: 1777760 - RNA, 23 nt, Salmonella enterica enterica serovar Typhi Ty2
gcgccauguugcguaaauaaaua

SEQ ID NO: 1777761 - RNA, 20 nt, Salmonella enterica enterica serovar Typhi Ty2
gcgccauggcuucuccuuca

SEQ ID NO: 1777762 - RNA, 18 nt, Salmonella enterica enterica serovar Typhi Ty2
gcgccauuaacgcgguga

SEQ ID NO: 1777763 - RNA, 19 nt, Salmonella enterica enterica serovar Typhi Ty2
gcgccauuccugccgccgc

SEQ ID NO: 1777764 - RNA, 20 nt, Salmonella enterica enterica serovar Typhi Ty2
gcgccauuccugccgccgca

SEQ ID NO: 1777765 - RNA, 19 nt, Salmonella enterica enterica serovar Typhi Ty2
gcgccauguucauaaagug

SEQ ID NO: 1777766 - RNA, 23 nt, Salmonella enterica enterica serovar Typhi Ty2
gcgcccugggcuucgucgagcag

SEQ ID NO: 1777767 - RNA, 16 nt, Salmonella enterica enterica serovar Typhi Ty2
gcgcccguccaugagu

SEQ ID NO: 1777768 - RNA, 13 nt, Salmonella enterica enterica serovar Typhi Ty2
gcgcccuauccag

SEQ ID NO: 1777769 - RNA, 23 nt, Salmonella enterica enterica serovar Typhi Ty2
gcgccccagcaugagccagcccu

SEQ ID NO: 1777770 - RNA, 12 nt, Salmonella enterica enterica serovar Typhi Ty2
gcgccccagcac

SEQ ID NO: 1777771 - RNA, 13 nt, Salmonella enterica enterica serovar Typhi Ty2
gcgccccagcaca

SEQ ID NO: 1777772 - RNA, 12 nt, Salmonella enterica enterica serovar Typhi Ty2
gcgccccgccgc

SEQ ID NO: 1777773 - RNA, 18 nt, Salmonella enterica enterica serovar Typhi Ty2
gcgccccgccgcgcggcc

SEQ ID NO: 1777774 - RNA, 15 nt, Salmonella enterica enterica serovar Typhi Ty2
gcgcccgccaccagc

SEQ ID NO: 1777775 - RNA, 19 nt, Salmonella enterica enterica serovar Typhi Ty2
gcgcccgccaucgcccggc

SEQ ID NO: 1777776 - RNA, 17 nt, Salmonella enterica enterica serovar Typhi Ty2
gcgcccgccaucgcccg

SEQ ID NO: 1777777 - RNA, 14 nt, Salmonella enterica enterica serovar Typhi Ty2
gcgccccggcggcg

SEQ ID NO: 1777778 - RNA, 19 nt, Salmonella enterica enterica serovar Typhi Ty2
gcgcccgaucguccgccuc

SEQ ID NO: 1777779 - RNA, 21 nt, Salmonella enterica enterica serovar Typhi Ty2
gcgccgcucaucaccagcagc

SEQ ID NO: 1777780 - RNA, 18 nt, Salmonella enterica enterica serovar Typhi Ty2
gcgccggaucgggcuucc

SEQ ID NO: 1777781 - RNA, 16 nt, Salmonella enterica enterica serovar Typhi Ty2
gcgccggauuuaccag

SEQ ID NO: 1777782 - RNA, 19 nt, Salmonella enterica enterica serovar Typhi Ty2
gcgccggaucgggcuucca

SEQ ID NO: 1777783 - RNA, 18 nt, Salmonella enterica enterica serovar Typhi Ty2
gcgccguagcggcaggga

SEQ ID NO: 1777784 - RNA, 13 nt, Salmonella enterica enterica serovar Typhi Ty2
gcgccgucauccg

SEQ ID NO: 1777785 - RNA, 21 nt, Salmonella enterica enterica serovar Typhi Ty2
gcgccgucaggcuugccgcgc

SEQ ID NO: 1777786 - RNA, 17 nt, Salmonella enterica enterica serovar Typhi Ty2
gcgccgugcccagcauc

SEQ ID NO: 1777787 - RNA, 20 nt, Salmonella enterica enterica serovar Typhi Ty2
gcgccggccgguuucaccau

SEQ ID NO: 1777788 - RNA, 16 nt, Salmonella enterica enterica serovar Typhi Ty2
gcgccgguuucuccag

SEQ ID NO: 1777789 - RNA, 16 nt, Salmonella enterica enterica serovar Typhi Ty2
gcgccggucgccagca

SEQ ID NO: 1777790 - RNA, 18 nt, Salmonella enterica enterica serovar Typhi Ty2
gcgccgaagcaggcggag

SEQ ID NO: 1777791 - RNA, 21 nt, Salmonella enterica enterica serovar Typhi Ty2
gcgccgagaaaaucagugaac

SEQ ID NO: 1777792 - RNA, 20 nt, Salmonella enterica enterica serovar Typhi Ty2
gcgccgauaaauccuccggc

SEQ ID NO: 1777793 - RNA, 20 nt, Salmonella enterica enterica serovar Typhi Ty2
gcgccgauaacacggcuggc

SEQ ID NO: 1777794 - RNA, 15 nt, Salmonella enterica enterica serovar Typhi Ty2
gcgccgaucaucccg

SEQ ID NO: 1777795 - RNA, 18 nt, Salmonella enterica enterica serovar Typhi Ty2
gcgccgcaaugccgccug

SEQ ID NO: 1777796 - RNA, 22 nt, Salmonella enterica enterica serovar Typhi Ty2
gcgccgccagcgacauggcggu

SEQ ID NO: 1777797 - RNA, 17 nt, Salmonella enterica enterica serovar Typhi Ty2
gcgccgccaacgccaac

SEQ ID NO: 1777798 - RNA, 18 nt, Salmonella enterica enterica serovar Typhi Ty2
gcgcuccugucaggcgag

SEQ ID NO: 1777799 - RNA, 22 nt, Salmonella enterica enterica serovar Typhi Ty2
gcgcuccaccaaccaggcaaac

SEQ ID NO: 1777800 - RNA, 16 nt, Salmonella enterica enterica serovar Typhi Ty2
gcgcuccggcgcuggc

SEQ ID NO: 1777801 - RNA, 16 nt, Salmonella enterica enterica serovar Typhi Ty2
gcgcuccugucaggcg

SEQ ID NO: 1777802 - RNA, 12 nt, Salmonella enterica enterica serovar Typhi Ty2
gcgcuccaggau

SEQ ID NO: 1777803 - RNA, 22 nt, Salmonella enterica enterica serovar Typhi Ty2
gcgcuccaucauaucgcgcagc

SEQ ID NO: 1777804 - RNA, 20 nt, Salmonella enterica enterica serovar Typhi Ty2
gcgcuggggguaggauaaaa

SEQ ID NO: 1777805 - RNA, 22 nt, Salmonella enterica enterica serovar Typhi Ty2
gcgcugcgguuuacgccaugca

SEQ ID NO: 1777806 - RNA, 15 nt, Salmonella enterica enterica serovar Typhi Ty2
gcgcugcgcggcgug

SEQ ID NO: 1777807 - RNA, 13 nt, Salmonella enterica enterica serovar Typhi Ty2
gcgcugcgcggcg

SEQ ID NO: 1777808 - RNA, 18 nt, Salmonella enterica enterica serovar Typhi Ty2
gcgcugcgcuuacccagu

SEQ ID NO: 1777809 - RNA, 22 nt, Salmonella enterica enterica serovar Typhi Ty2
gcgcugccgucaaugccuggca

SEQ ID NO: 1777810 - RNA, 23 nt, Salmonella enterica enterica serovar Typhi Ty2
gcgcugccgucaaugccuggcag

SEQ ID NO: 1777811 - RNA, 19 nt, Salmonella enterica enterica serovar Typhi Ty2
gcgcucuaucaccgcccgc

SEQ ID NO: 1777812 - RNA, 17 nt, Salmonella enterica enterica serovar Typhi Ty2
gcgcucuaucgccgccc

SEQ ID NO: 1777813 - RNA, 17 nt, Salmonella enterica enterica serovar Typhi Ty2
gcgcugaugcagcuugc

SEQ ID NO: 1777814 - RNA, 21 nt, Salmonella enterica enterica serovar Typhi Ty2
gcgcugauuuucuccagcaga

SEQ ID NO: 1777815 - RNA, 17 nt, Salmonella enterica enterica serovar Typhi Ty2
gcgcuaucgguaucaug

SEQ ID NO: 1777816 - RNA, 18 nt, Salmonella enterica enterica serovar Typhi Ty2
gcgcuaugcgcuccagga

SEQ ID NO: 1777817 - RNA, 23 nt, Salmonella enterica enterica serovar Typhi Ty2
gcgcuauucccaggcaaaugauu

SEQ ID NO: 1777818 - RNA, 14 nt, Salmonella enterica enterica serovar Typhi Ty2
gcgcucaaaugguc

SEQ ID NO: 1777819 - RNA, 21 nt, Salmonella enterica enterica serovar Typhi Ty2
gcgcucauauacccugcggcg

SEQ ID NO: 1777820 - RNA, 22 nt, Salmonella enterica enterica serovar Typhi Ty2
gcgcuaagcguuacggaaaaaa

SEQ ID NO: 1777821 - RNA, 20 nt, Salmonella enterica enterica serovar Typhi Ty2
gcgcguuuagcgccagcagc

SEQ ID NO: 1777822 - RNA, 22 nt, Salmonella enterica enterica serovar Typhi Ty2
gcgcguugccaucggcgggcgu

SEQ ID NO: 1777823 - RNA, 20 nt, Salmonella enterica enterica serovar Typhi Ty2
gcgcuacauccgccagccgc

SEQ ID NO: 1777824 - RNA, 16 nt, Salmonella enterica enterica serovar Typhi Ty2
gcgcuacauccgccag

SEQ ID NO: 1777825 - RNA, 13 nt, Salmonella enterica enterica serovar Typhi Ty2
gcgcuaccagcgc

SEQ ID NO: 1777826 - RNA, 17 nt, Salmonella enterica enterica serovar Typhi Ty2
gcgcuaauguggauagu

SEQ ID NO: 1777827 - RNA, 21 nt, Salmonella enterica enterica serovar Typhi Ty2
gcgcuaauguacgccuaaaaa

SEQ ID NO: 1777828 - RNA, 20 nt, Salmonella enterica enterica serovar Typhi Ty2
gcgcuacgcuuaucgggccu

SEQ ID NO: 1777829 - RNA, 14 nt, Salmonella enterica enterica serovar Typhi Ty2
gcgcuaccagcgcg

SEQ ID NO: 1777830 - RNA, 13 nt, Salmonella enterica enterica serovar Typhi Ty2
gcgcguggcuucc

SEQ ID NO: 1777831 - RNA, 22 nt, Salmonella enterica enterica serovar Typhi Ty2
gcgcgugaccccaggcauagaa

SEQ ID NO: 1777832 - RNA, 18 nt, Salmonella enterica enterica serovar Typhi Ty2
gcgcgucuucccggcgcu

SEQ ID NO: 1777833 - RNA, 15 nt, Salmonella enterica enterica serovar Typhi Ty2
gcgcggggaacacag

SEQ ID NO: 1777834 - RNA, 14 nt, Salmonella enterica enterica serovar Typhi Ty2
gcgcggggaacaca

SEQ ID NO: 1777835 - RNA, 15 nt, Salmonella enterica enterica serovar Typhi Ty2
gcgcggggaacacac

SEQ ID NO: 1777836 - RNA, 16 nt, Salmonella enterica enterica serovar Typhi Ty2
gcgcgcugagcggcuc

SEQ ID NO: 1777837 - RNA, 19 nt, Salmonella enterica enterica serovar Typhi Ty2
gcgcgccgggcuucauacc

SEQ ID NO: 1777838 - RNA, 13 nt, Salmonella enterica enterica serovar Typhi Ty2
gcgcgccgccaac

SEQ ID NO: 1777839 - RNA, 12 nt, Salmonella enterica enterica serovar Typhi Ty2
gcgcgccgcagc

SEQ ID NO: 1777840 - RNA, 12 nt, Salmonella enterica enterica serovar Typhi Ty2
gcgcgccgccug

SEQ ID NO: 1777841 - RNA, 11 nt, Salmonella enterica enterica serovar Typhi Ty2
gcgcgccgcgc

SEQ ID NO: 1777842 - RNA, 15 nt, Salmonella enterica enterica serovar Typhi Ty2
gcgcgccgcgcagca

SEQ ID NO: 1777843 - RNA, 15 nt, Salmonella enterica enterica serovar Typhi Ty2
gcgcgcuucuucaug

SEQ ID NO: 1777844 - RNA, 17 nt, Salmonella enterica enterica serovar Typhi Ty2
gcgcgcuugcauugcuc

SEQ ID NO: 1777845 - RNA, 24 nt, Salmonella enterica enterica serovar Typhi Ty2
gcgcggaaggcgccucgcgcggcg

SEQ ID NO: 1777846 - RNA, 17 nt, Salmonella enterica enterica serovar Typhi Ty2
gcgcggauauggcggcg

SEQ ID NO: 1777847 - RNA, 12 nt, Salmonella enterica enterica serovar Typhi Ty2
gcgcgcuggagg

SEQ ID NO: 1777848 - RNA, 15 nt, Salmonella enterica enterica serovar Typhi Ty2
gcgcgcugccgcccu

SEQ ID NO: 1777849 - RNA, 19 nt, Salmonella enterica enterica serovar Typhi Ty2
gcgcgcuucguuuuccgca

SEQ ID NO: 1777850 - RNA, 10 nt, Salmonella enterica enterica serovar Typhi Ty2
gcgcggcgga

SEQ ID NO: 1777851 - RNA, 19 nt, Salmonella enterica enterica serovar Typhi Ty2
gcgcggauauggcggcggc

SEQ ID NO: 1777852 - RNA, 23 nt, Salmonella enterica enterica serovar Typhi Ty2
gcgcggcaggccuuucggcagcg

SEQ ID NO: 1777853 - RNA, 16 nt, Salmonella enterica enterica serovar Typhi Ty2
gcgcggcagcgcgcac

SEQ ID NO: 1777854 - RNA, 11 nt, Salmonella enterica enterica serovar Typhi Ty2
gcgcggcagca

SEQ ID NO: 1777855 - RNA, 23 nt, Salmonella enterica enterica serovar Typhi Ty2
gcgcggcacacaacacggcggcu

SEQ ID NO: 1777856 - RNA, 13 nt, Salmonella enterica enterica serovar Typhi Ty2
gcgcggccagcgc

SEQ ID NO: 1777857 - RNA, 17 nt, Salmonella enterica enterica serovar Typhi Ty2
gcgcggcaucgccgccc

SEQ ID NO: 1777858 - RNA, 20 nt, Salmonella enterica enterica serovar Typhi Ty2
gcgcggcaucgccgcccagu

SEQ ID NO: 1777859 - RNA, 15 nt, Salmonella enterica enterica serovar Typhi Ty2
gcgcgacgacgccag

SEQ ID NO: 1777860 - RNA, 22 nt, Salmonella enterica enterica serovar Typhi Ty2
gcgcgacauccgcuuuugguuu

SEQ ID NO: 1777861 - RNA, 23 nt, Salmonella enterica enterica serovar Typhi Ty2
gcgcgaaaucaaagaccuccgcc

SEQ ID NO: 1777862 - RNA, 15 nt, Salmonella enterica enterica serovar Typhi Ty2
gcgccuagcgcgcgc

SEQ ID NO: 1777863 - RNA, 17 nt, Salmonella enterica enterica serovar Typhi Ty2
gcgccguugaaaucggu

SEQ ID NO: 1777864 - RNA, 21 nt, Salmonella enterica enterica serovar Typhi Ty2
gcgcgagaaguucucacccau

SEQ ID NO: 1777865 - RNA, 14 nt, Salmonella enterica enterica serovar Typhi Ty2
gcgcgagagucaag

SEQ ID NO: 1777866 - RNA, 14 nt, Salmonella enterica enterica serovar Typhi Ty2
gcgcgacggcggcg

SEQ ID NO: 1777867 - RNA, 18 nt, Salmonella enterica enterica serovar Typhi Ty2
gcgcgauacgcagcaccg

SEQ ID NO: 1777868 - RNA, 17 nt, Salmonella enterica enterica serovar Typhi Ty2
gcgcgauacgcgacggc

SEQ ID NO: 1777869 - RNA, 15 nt, Salmonella enterica enterica serovar Typhi Ty2
gcgcgauacgcagca

SEQ ID NO: 1777870 - RNA, 17 nt, Salmonella enterica enterica serovar Typhi Ty2
gcgcgauauccaccuga

SEQ ID NO: 1777871 - RNA, 19 nt, Salmonella enterica enterica serovar Typhi Ty2
gcgcgcaucgggccguccg

SEQ ID NO: 1777872 - RNA, 12 nt, Salmonella enterica enterica serovar Typhi Ty2
gcgcgccagcgc

SEQ ID NO: 1777873 - RNA, 20 nt, Salmonella enterica enterica serovar Typhi Ty2
gcgcgccaguaaucggcgcg

SEQ ID NO: 1777874 - RNA, 15 nt, Salmonella enterica enterica serovar Typhi Ty2
gcgcgccaguuuggu

SEQ ID NO: 1777875 - RNA, 19 nt, Salmonella enterica enterica serovar Typhi Ty2
gcgcgccaauggccgcccc

SEQ ID NO: 1777876 - RNA, 17 nt, Salmonella enterica enterica serovar Typhi Ty2
gcguugaccagcgacgg

SEQ ID NO: 1777877 - RNA, 24 nt, Salmonella enterica enterica serovar Typhi Ty2
gcguugaccagccuaccugccgcc

SEQ ID NO: 1777878 - RNA, 14 nt, Salmonella enterica enterica serovar Typhi Ty2
gcguucuuuccagu

SEQ ID NO: 1777879 - RNA, 16 nt, Salmonella enterica enterica serovar Typhi Ty2
gcguuuuggcagacag

SEQ ID NO: 1777880 - RNA, 18 nt, Salmonella enterica enterica serovar Typhi Ty2
gcguuucuagaugaugau

SEQ ID NO: 1777881 - RNA, 20 nt, Salmonella enterica enterica serovar Typhi Ty2
gcguuugggcgcaacaguca

SEQ ID NO: 1777882 - RNA, 14 nt, Salmonella enterica enterica serovar Typhi Ty2
gcguuacuggccuu

SEQ ID NO: 1777883 - RNA, 22 nt, Salmonella enterica enterica serovar Typhi Ty2
gcguuaaugcgcgcuucuucau

SEQ ID NO: 1777884 - RNA, 17 nt, Salmonella enterica enterica serovar Typhi Ty2
gcgugucaucaaaauca

SEQ ID NO: 1777885 - RNA, 24 nt, Salmonella enterica enterica serovar Typhi Ty2
gcguggugucucgucgccagggcg

SEQ ID NO: 1777886 - RNA, 21 nt, Salmonella enterica enterica serovar Typhi Ty2
gcgugguggauauccagcaua

SEQ ID NO: 1777887 - RNA, 21 nt, Salmonella enterica enterica serovar Typhi Ty2
gcgugguauuacaagcaguua

SEQ ID NO: 1777888 - RNA, 20 nt, Salmonella enterica enterica serovar Typhi Ty2
gcguucgcgcaguucaucca

SEQ ID NO: 1777889 - RNA, 17 nt, Salmonella enterica enterica serovar Typhi Ty2
gcguuauuugcauuuuc

SEQ ID NO: 1777890 - RNA, 17 nt, Salmonella enterica enterica serovar Typhi Ty2
gcgugcugacggagcug

SEQ ID NO: 1777891 - RNA, 18 nt, Salmonella enterica enterica serovar Typhi Ty2
gcgugcuucaacggugcu

SEQ ID NO: 1777892 - RNA, 17 nt, Salmonella enterica enterica serovar Typhi Ty2
gcgugggguugcuucug

SEQ ID NO: 1777893 - RNA, 15 nt, Salmonella enterica enterica serovar Typhi Ty2
gcgugcccaguaauu

SEQ ID NO: 1777894 - RNA, 15 nt, Salmonella enterica enterica serovar Typhi Ty2
gcgugcaugggcagc

SEQ ID NO: 1777895 - RNA, 16 nt, Salmonella enterica enterica serovar Typhi Ty2
gcgugcgguuuuccug

SEQ ID NO: 1777896 - RNA, 17 nt, Salmonella enterica enterica serovar Typhi Ty2
gcgucuucaucagccag

SEQ ID NO: 1777897 - RNA, 21 nt, Salmonella enterica enterica serovar Typhi Ty2
gcgucuuauccggccuaccug

SEQ ID NO: 1777898 - RNA, 22 nt, Salmonella enterica enterica serovar Typhi Ty2
gcgucuggcgacuaaccagcgc

SEQ ID NO: 1777899 - RNA, 23 nt, Salmonella enterica enterica serovar Typhi Ty2
gcgugaacgucuuauccggccug

SEQ ID NO: 1777900 - RNA, 15 nt, Salmonella enterica enterica serovar Typhi Ty2
gcgucugcaccggua

SEQ ID NO: 1777901 - RNA, 23 nt, Salmonella enterica enterica serovar Typhi Ty2
gcguaucucgcgguugacgcugc

SEQ ID NO: 1777902 - RNA, 15 nt, Salmonella enterica enterica serovar Typhi Ty2
gcguauagccaggca

SEQ ID NO: 1777903 - RNA, 16 nt, Salmonella enterica enterica serovar Typhi Ty2
gcguauaacgccgccc

SEQ ID NO: 1777904 - RNA, 21 nt, Salmonella enterica enterica serovar Typhi Ty2
gcuaccgucgacgucuuucuu

SEQ ID NO: 1777905 - RNA, 16 nt, Salmonella enterica enterica serovar Typhi Ty2
gcuaccgucgccgaca

SEQ ID NO: 1777906 - RNA, 22 nt, Salmonella enterica enterica serovar Typhi Ty2
gcuaccucguaucccgccuggc

SEQ ID NO: 1777907 - RNA, 17 nt, Salmonella enterica enterica serovar Typhi Ty2
gcuaccuucuucccaua

SEQ ID NO: 1777908 - RNA, 23 nt, Salmonella enterica enterica serovar Typhi Ty2
gcuacgauaaagcugaguaagga

SEQ ID NO: 1777909 - RNA, 22 nt, Salmonella enterica enterica serovar Typhi Ty2
gcuacgauaaagcugaguaagg

SEQ ID NO: 1777910 - RNA, 12 nt, Salmonella enterica enterica serovar Typhi Ty2
gcuacccagaca

SEQ ID NO: 1777911 - RNA, 15 nt, Salmonella enterica enterica serovar Typhi Ty2
gcuacguuuaucugg

SEQ ID NO: 1777912 - RNA, 19 nt, Salmonella enterica enterica serovar Typhi Ty2
gcuacguuuaucuggcuua

SEQ ID NO: 1777913 - RNA, 18 nt, Salmonella enterica enterica serovar Typhi Ty2
gcuacucaggagaucggc

SEQ ID NO: 1777914 - RNA, 17 nt, Salmonella enterica enterica serovar Typhi Ty2
gcuacgggccgcggcgg

SEQ ID NO: 1777915 - RNA, 14 nt, Salmonella enterica enterica serovar Typhi Ty2
gcuacgguuuuaau

SEQ ID NO: 1777916 - RNA, 21 nt, Salmonella enterica enterica serovar Typhi Ty2
gcuacgucgucgaucgcgcca

SEQ ID NO: 1777917 - RNA, 22 nt, Salmonella enterica enterica serovar Typhi Ty2
gcuacgcugcgcguucugcucc

SEQ ID NO: 1777918 - RNA, 14 nt, Salmonella enterica enterica serovar Typhi Ty2
gcuacgcgucgcca

SEQ ID NO: 1777919 - RNA, 17 nt, Salmonella enterica enterica serovar Typhi Ty2
gcuacgcuuaucaggcc

SEQ ID NO: 1777920 - RNA, 11 nt, Salmonella enterica enterica serovar Typhi Ty2
gcuaauguacg

SEQ ID NO: 1777921 - RNA, 22 nt, Salmonella enterica enterica serovar Typhi Ty2
gcuacagacaucuuugccaaac

SEQ ID NO: 1777922 - RNA, 20 nt, Salmonella enterica enterica serovar Typhi Ty2
gcuacagacaucuuugccaa

SEQ ID NO: 1777923 - RNA, 22 nt, Salmonella enterica enterica serovar Typhi Ty2
gcuacauccgccagccgccauu

SEQ ID NO: 1777924 - RNA, 18 nt, Salmonella enterica enterica serovar Typhi Ty2
gcuaccagcgcggcgcca

SEQ ID NO: 1777925 - RNA, 23 nt, Salmonella enterica enterica serovar Typhi Ty2
gcuaaaugacaaauagaagccac

SEQ ID NO: 1777926 - RNA, 13 nt, Salmonella enterica enterica serovar Typhi Ty2
gcuaaagcacggg

SEQ ID NO: 1777927 - RNA, 16 nt, Salmonella enterica enterica serovar Typhi Ty2
gcuaaccuguucagcc

SEQ ID NO: 1777928 - RNA, 18 nt, Salmonella enterica enterica serovar Typhi Ty2
gcuaaccuguaucugcug

SEQ ID NO: 1777929 - RNA, 21 nt, Salmonella enterica enterica serovar Typhi Ty2
gcuaaaacacccgcaaacuaa

SEQ ID NO: 1777930 - RNA, 20 nt, Salmonella enterica enterica serovar Typhi Ty2
gcuaaacaauuugcccagcg

SEQ ID NO: 1777931 - RNA, 12 nt, Salmonella enterica enterica serovar Typhi Ty2
gcuaaaauaccc

SEQ ID NO: 1777932 - RNA, 19 nt, Salmonella enterica enterica serovar Typhi Ty2
gcuaaaccacaugaccagc

SEQ ID NO: 1777933 - RNA, 17 nt, Salmonella enterica enterica serovar Typhi Ty2
gcuaaacaauuugccca

SEQ ID NO: 1777934 - RNA, 19 nt, Salmonella enterica enterica serovar Typhi Ty2
gcuaaaccgucauuuacca

SEQ ID NO: 1777935 - RNA, 18 nt, Salmonella enterica enterica serovar Typhi Ty2
gcuaaacguagcauuucc

SEQ ID NO: 1777936 - RNA, 18 nt, Salmonella enterica enterica serovar Typhi Ty2
gcuaaagcgcuggcggcg

SEQ ID NO: 1777937 - RNA, 14 nt, Salmonella enterica enterica serovar Typhi Ty2
gcuaaagcgcuggc

SEQ ID NO: 1777938 - RNA, 14 nt, Salmonella enterica enterica serovar Typhi Ty2
gcuaaagcaucggg

SEQ ID NO: 1777939 - RNA, 17 nt, Salmonella enterica enterica serovar Typhi Ty2
gcuaacgcgccccaggu

SEQ ID NO: 1777940 - RNA, 19 nt, Salmonella enterica enterica serovar Typhi Ty2
gcuaacggcaccagcaaca

SEQ ID NO: 1777941 - RNA, 16 nt, Salmonella enterica enterica serovar Typhi Ty2
gcuaacgcgccccagg

SEQ ID NO: 1777942 - RNA, 18 nt, Salmonella enterica enterica serovar Typhi Ty2
gcuaaugaggaaaaagcc

SEQ ID NO: 1777943 - RNA, 18 nt, Salmonella enterica enterica serovar Typhi Ty2
gcuaaugauuaucuuuuu

SEQ ID NO: 1777944 - RNA, 18 nt, Salmonella enterica enterica serovar Typhi Ty2
gcuaauccccccuuuuuu

SEQ ID NO: 1777945 - RNA, 13 nt, Salmonella enterica enterica serovar Typhi Ty2
gcuaaucaccacc

SEQ ID NO: 1777946 - RNA, 20 nt, Salmonella enterica enterica serovar Typhi Ty2
gcuaaucaggacaucaaagg

SEQ ID NO: 1777947 - RNA, 21 nt, Salmonella enterica enterica serovar Typhi Ty2
gcuaaucgugauaaauugcug

SEQ ID NO: 1777948 - RNA, 12 nt, Salmonella enterica enterica serovar Typhi Ty2
gcuaauaauucu

SEQ ID NO: 1777949 - RNA, 16 nt, Salmonella enterica enterica serovar Typhi Ty2
gcuaauaugccaggcu

SEQ ID NO: 1777950 - RNA, 11 nt, Salmonella enterica enterica serovar Typhi Ty2
gcuaauaucca

SEQ ID NO: 1777951 - RNA, 20 nt, Salmonella enterica enterica serovar Typhi Ty2
gcuaauaugaauuauuuucu

SEQ ID NO: 1777952 - RNA, 14 nt, Salmonella enterica enterica serovar Typhi Ty2
gcucaggcgcgcgc

SEQ ID NO: 1777953 - RNA, 13 nt, Salmonella enterica enterica serovar Typhi Ty2
gcucagggucaga

SEQ ID NO: 1777954 - RNA, 23 nt, Salmonella enterica enterica serovar Typhi Ty2
gcucagggucagaauacagaauc

SEQ ID NO: 1777955 - RNA, 15 nt, Salmonella enterica enterica serovar Typhi Ty2
gcucaggcuccgcgc

SEQ ID NO: 1777956 - RNA, 22 nt, Salmonella enterica enterica serovar Typhi Ty2
gcucaggcuccgcgcaggguga

SEQ ID NO: 1777957 - RNA, 22 nt, Salmonella enterica enterica serovar Typhi Ty2
gcucagugaaucgcaucauaaa

SEQ ID NO: 1777958 - RNA, 18 nt, Salmonella enterica enterica serovar Typhi Ty2
gcucaguccagccgccgc

SEQ ID NO: 1777959 - RNA, 16 nt, Salmonella enterica enterica serovar Typhi Ty2
gcucauccagcaacag

SEQ ID NO: 1777960 - RNA, 13 nt, Salmonella enterica enterica serovar Typhi Ty2
gcucauccagcaa

SEQ ID NO: 1777961 - RNA, 19 nt, Salmonella enterica enterica serovar Typhi Ty2
gcucaucagcgccauugcu

SEQ ID NO: 1777962 - RNA, 17 nt, Salmonella enterica enterica serovar Typhi Ty2
gcucaucaggcgugccc

SEQ ID NO: 1777963 - RNA, 14 nt, Salmonella enterica enterica serovar Typhi Ty2
gcuccagcaucaca

SEQ ID NO: 1777964 - RNA, 15 nt, Salmonella enterica enterica serovar Typhi Ty2
gcuccagcccgccgc

SEQ ID NO: 1777965 - RNA, 17 nt, Salmonella enterica enterica serovar Typhi Ty2
gcuccagcgccagcucc

SEQ ID NO: 1777966 - RNA, 13 nt, Salmonella enterica enterica serovar Typhi Ty2
gcucauuucccaa

SEQ ID NO: 1777967 - RNA, 17 nt, Salmonella enterica enterica serovar Typhi Ty2
gcucauuuuauccaaca

SEQ ID NO: 1777968 - RNA, 15 nt, Salmonella enterica enterica serovar Typhi Ty2
gcucauuauuuggau

SEQ ID NO: 1777969 - RNA, 18 nt, Salmonella enterica enterica serovar Typhi Ty2
gcucaccgacuccucaac

SEQ ID NO: 1777970 - RNA, 15 nt, Salmonella enterica enterica serovar Typhi Ty2
gcucaccagcccaac

SEQ ID NO: 1777971 - RNA, 15 nt, Salmonella enterica enterica serovar Typhi Ty2
gcucaccgacuccuc

SEQ ID NO: 1777972 - RNA, 13 nt, Salmonella enterica enterica serovar Typhi Ty2
gcucaccagccca

SEQ ID NO: 1777973 - RNA, 19 nt, Salmonella enterica enterica serovar Typhi Ty2
gcucaggagcgccugacag

SEQ ID NO: 1777974 - RNA, 21 nt, Salmonella enterica enterica serovar Typhi Ty2
gcucaggaucgccggauuguu

SEQ ID NO: 1777975 - RNA, 15 nt, Salmonella enterica enterica serovar Typhi Ty2
gcucagaaauauuca

SEQ ID NO: 1777976 - RNA, 19 nt, Salmonella enterica enterica serovar Typhi Ty2
gcucagaccauauucacgc

SEQ ID NO: 1777977 - RNA, 22 nt, Salmonella enterica enterica serovar Typhi Ty2
gcucacugcuaaggagauaacu

SEQ ID NO: 1777978 - RNA, 23 nt, Salmonella enterica enterica serovar Typhi Ty2
gcuagcugugguugcccgcaggc

SEQ ID NO: 1777979 - RNA, 15 nt, Salmonella enterica enterica serovar Typhi Ty2
gcuagggcaucagac

SEQ ID NO: 1777980 - RNA, 21 nt, Salmonella enterica enterica serovar Typhi Ty2
gcucaauccuucuaccuucac

SEQ ID NO: 1777981 - RNA, 14 nt, Salmonella enterica enterica serovar Typhi Ty2
gcucaauccaggug

SEQ ID NO: 1777982 - RNA, 14 nt, Salmonella enterica enterica serovar Typhi Ty2
gcucaauuuuuuuc

SEQ ID NO: 1777983 - RNA, 12 nt, Salmonella enterica enterica serovar Typhi Ty2
gcucaauuuuuu

SEQ ID NO: 1777984 - RNA, 22 nt, Salmonella enterica enterica serovar Typhi Ty2
gcucaauguagcgucagccggc

SEQ ID NO: 1777985 - RNA, 17 nt, Salmonella enterica enterica serovar Typhi Ty2
gcuccaucuccggcagc

SEQ ID NO: 1777986 - RNA, 13 nt, Salmonella enterica enterica serovar Typhi Ty2
gcuccgaauaauc

SEQ ID NO: 1777987 - RNA, 20 nt, Salmonella enterica enterica serovar Typhi Ty2
gcuccgaauaauccuucccg

SEQ ID NO: 1777988 - RNA, 23 nt, Salmonella enterica enterica serovar Typhi Ty2
gcuccgaauaauccuucccgcua

SEQ ID NO: 1777989 - RNA, 21 nt, Salmonella enterica enterica serovar Typhi Ty2
gcucccuucccccagaaugcc

SEQ ID NO: 1777990 - RNA, 22 nt, Salmonella enterica enterica serovar Typhi Ty2
gcuccaucacgguaaaccuguu

SEQ ID NO: 1777991 - RNA, 18 nt, Salmonella enterica enterica serovar Typhi Ty2
gcuccauccaccagcccc

SEQ ID NO: 1777992 - RNA, 20 nt, Salmonella enterica enterica serovar Typhi Ty2
gcuccaguuguuccagcagc

SEQ ID NO: 1777993 - RNA, 23 nt, Salmonella enterica enterica serovar Typhi Ty2
gcuccaguggucguuagccagau

SEQ ID NO: 1777994 - RNA, 22 nt, Salmonella enterica enterica serovar Typhi Ty2
gcuccgccagcaaugccgccgc

SEQ ID NO: 1777995 - RNA, 18 nt, Salmonella enterica enterica serovar Typhi Ty2
gcucgcaggccauaaaac

SEQ ID NO: 1777996 - RNA, 20 nt, Salmonella enterica enterica serovar Typhi Ty2
gcucgccagcauacgucugc

SEQ ID NO: 1777997 - RNA, 19 nt, Salmonella enterica enterica serovar Typhi Ty2
gcucgccguuuuuuaaccg

SEQ ID NO: 1777998 - RNA, 13 nt, Salmonella enterica enterica serovar Typhi Ty2
gcucgcggcggac

SEQ ID NO: 1777999 - RNA, 20 nt, Salmonella enterica enterica serovar Typhi Ty2
gcucgcggcggaccgcaacg

SEQ ID NO: 1778000 - RNA, 23 nt, Salmonella enterica enterica serovar Typhi Ty2
gcucgcggcagauaucgcugacc

SEQ ID NO: 1778001 - RNA, 12 nt, Salmonella enterica enterica serovar Typhi Ty2
gcucgcggcgga

SEQ ID NO: 1778002 - RNA, 11 nt, Salmonella enterica enterica serovar Typhi Ty2
gcucgcuggug

SEQ ID NO: 1778003 - RNA, 18 nt, Salmonella enterica enterica serovar Typhi Ty2
gcucgcuaccuuuuuuca

SEQ ID NO: 1778004 - RNA, 22 nt, Salmonella enterica enterica serovar Typhi Ty2
gcggcauuggcguuaccggcag

SEQ ID NO: 1778005 - RNA, 18 nt, Salmonella enterica enterica serovar Typhi Ty2
gcggccaccgccaguucg

SEQ ID NO: 1778006 - RNA, 12 nt, Salmonella enterica enterica serovar Typhi Ty2
gcggccagcaug

SEQ ID NO: 1778007 - RNA, 16 nt, Salmonella enterica enterica serovar Typhi Ty2
gcggccaugaucgccg

SEQ ID NO: 1778008 - RNA, 11 nt, Salmonella enterica enterica serovar Typhi Ty2
gcggcccaaug

SEQ ID NO: 1778009 - RNA, 13 nt, Salmonella enterica enterica serovar Typhi Ty2
gcggccauccugc

SEQ ID NO: 1778010 - RNA, 20 nt, Salmonella enterica enterica serovar Typhi Ty2
gcggccaguuguucuuucac

SEQ ID NO: 1778011 - RNA, 16 nt, Salmonella enterica enterica serovar Typhi Ty2
gcggccagcgggcguc

SEQ ID NO: 1778012 - RNA, 13 nt, Salmonella enterica enterica serovar Typhi Ty2
gcggccagcgggc

SEQ ID NO: 1778013 - RNA, 20 nt, Salmonella enterica enterica serovar Typhi Ty2
gcggcccauucaacgggcga

SEQ ID NO: 1778014 - RNA, 19 nt, Salmonella enterica enterica serovar Typhi Ty2
gcggcacuggcguagucuc

SEQ ID NO: 1778015 - RNA, 19 nt, Salmonella enterica enterica serovar Typhi Ty2
gcggcagaauuaacucauc

SEQ ID NO: 1778016 - RNA, 21 nt, Salmonella enterica enterica serovar Typhi Ty2
gcggcagauaucgcugaccaa

SEQ ID NO: 1778017 - RNA, 22 nt, Salmonella enterica enterica serovar Typhi Ty2
gcgcuguucuugcugcugcuga

SEQ ID NO: 1778018 - RNA, 17 nt, Salmonella enterica enterica serovar Typhi Ty2
gcgcuguucuugcugcu

SEQ ID NO: 1778019 - RNA, 18 nt, Salmonella enterica enterica serovar Typhi Ty2
gcgcuguguccgccugcu

SEQ ID NO: 1778020 - RNA, 14 nt, Salmonella enterica enterica serovar Typhi Ty2
gcgcuuaacgcgcu

SEQ ID NO: 1778021 - RNA, 18 nt, Salmonella enterica enterica serovar Typhi Ty2
gcgcuggugacaucgccg

SEQ ID NO: 1778022 - RNA, 15 nt, Salmonella enterica enterica serovar Typhi Ty2
gcgcugucugccggc

SEQ ID NO: 1778023 - RNA, 17 nt, Salmonella enterica enterica serovar Typhi Ty2
gcgcuguggucgucugg

SEQ ID NO: 1778024 - RNA, 16 nt, Salmonella enterica enterica serovar Typhi Ty2
gcgcuguacgccucuu

SEQ ID NO: 1778025 - RNA, 21 nt, Salmonella enterica enterica serovar Typhi Ty2
gcggcagucccaaugcggaaa

SEQ ID NO: 1778026 - RNA, 18 nt, Salmonella enterica enterica serovar Typhi Ty2
gcggcauacuuucgcgcg

SEQ ID NO: 1778027 - RNA, 12 nt, Salmonella enterica enterica serovar Typhi Ty2
gcggcagggcag

SEQ ID NO: 1778028 - RNA, 17 nt, Salmonella enterica enterica serovar Typhi Ty2
gcggcagggcagcgagc

SEQ ID NO: 1778029 - RNA, 20 nt, Salmonella enterica enterica serovar Typhi Ty2
gcggcagggcggucugguac

SEQ ID NO: 1778030 - RNA, 19 nt, Salmonella enterica enterica serovar Typhi Ty2
gcggcaggugagggcgucg

SEQ ID NO: 1778031 - RNA, 14 nt, Salmonella enterica enterica serovar Typhi Ty2
gcggcagccaugcu

SEQ ID NO: 1778032 - RNA, 15 nt, Salmonella enterica enterica serovar Typhi Ty2
gcggcaggaucccca

SEQ ID NO: 1778033 - RNA, 22 nt, Salmonella enterica enterica serovar Typhi Ty2
gcggcaggauccccaucccaau

SEQ ID NO: 1778034 - RNA, 16 nt, Salmonella enterica enterica serovar Typhi Ty2
gcggcagcucugccug

SEQ ID NO: 1778035 - RNA, 14 nt, Salmonella enterica enterica serovar Typhi Ty2
gcggccugcaaaga

SEQ ID NO: 1778036 - RNA, 17 nt, Salmonella enterica enterica serovar Typhi Ty2
gcggccugcgugcgccg

SEQ ID NO: 1778037 - RNA, 16 nt, Salmonella enterica enterica serovar Typhi Ty2
gcggccuuuauccagc

SEQ ID NO: 1778038 - RNA, 11 nt, Salmonella enterica enterica serovar Typhi Ty2
gcggccuugcc

SEQ ID NO: 1778039 - RNA, 22 nt, Salmonella enterica enterica serovar Typhi Ty2
gcggcgaauauagcuaaugcaa

SEQ ID NO: 1778040 - RNA, 18 nt, Salmonella enterica enterica serovar Typhi Ty2
gcggcgcucgccagcccg

SEQ ID NO: 1778041 - RNA, 14 nt, Salmonella enterica enterica serovar Typhi Ty2
gcggcgcgcuggcg

SEQ ID NO: 1778042 - RNA, 19 nt, Salmonella enterica enterica serovar Typhi Ty2
gcggcgcgauaugucucuc

SEQ ID NO: 1778043 - RNA, 20 nt, Salmonella enterica enterica serovar Typhi Ty2
gcggcgaguuguuucaacau

SEQ ID NO: 1778044 - RNA, 19 nt, Salmonella enterica enterica serovar Typhi Ty2
gcgguuuucaauaauaaaa

SEQ ID NO: 1778045 - RNA, 18 nt, Salmonella enterica enterica serovar Typhi Ty2
gcgguuuacuucuucagu

SEQ ID NO: 1778046 - RNA, 18 nt, Salmonella enterica enterica serovar Typhi Ty2
gcguaacgccuccaccgu

SEQ ID NO: 1778047 - RNA, 22 nt, Salmonella enterica enterica serovar Typhi Ty2
gcguaacagcgcuaucaggaag

SEQ ID NO: 1778048 - RNA, 14 nt, Salmonella enterica enterica serovar Typhi Ty2
gcguaacgccacau

SEQ ID NO: 1778049 - RNA, 12 nt, Salmonella enterica enterica serovar Typhi Ty2
gcguaaacuucc

SEQ ID NO: 1778050 - RNA, 12 nt, Salmonella enterica enterica serovar Typhi Ty2
gcguaaagaggg

SEQ ID NO: 1778051 - RNA, 12 nt, Salmonella enterica enterica serovar Typhi Ty2
gcguaaagcugu

SEQ ID NO: 1778052 - RNA, 15 nt, Salmonella enterica enterica serovar Typhi Ty2
gcgguugcagcaaaa

SEQ ID NO: 1778053 - RNA, 14 nt, Salmonella enterica enterica serovar Typhi Ty2
gcgguucuuuugcu

SEQ ID NO: 1778054 - RNA, 17 nt, Salmonella enterica enterica serovar Typhi Ty2
gcguaauuuuuccaguu

SEQ ID NO: 1778055 - RNA, 22 nt, Salmonella enterica enterica serovar Typhi Ty2
gcguaauuuugccacccacuuc

SEQ ID NO: 1778056 - RNA, 13 nt, Salmonella enterica enterica serovar Typhi Ty2
gcguaauuauuac

SEQ ID NO: 1778057 - RNA, 17 nt, Salmonella enterica enterica serovar Typhi Ty2
gcguaaugcgccaggca

SEQ ID NO: 1778058 - RNA, 16 nt, Salmonella enterica enterica serovar Typhi Ty2
gcguaaucagcuuuuc

SEQ ID NO: 1778059 - RNA, 18 nt, Salmonella enterica enterica serovar Typhi Ty2
gcguaaucggcaggccaa

SEQ ID NO: 1778060 - RNA, 21 nt, Salmonella enterica enterica serovar Typhi Ty2
gcguaauccggccuggcgcag

SEQ ID NO: 1778061 - RNA, 20 nt, Salmonella enterica enterica serovar Typhi Ty2
gcguaccagaaacagcgcgc

SEQ ID NO: 1778062 - RNA, 19 nt, Salmonella enterica enterica serovar Typhi Ty2
gcguacauugccggauggc

SEQ ID NO: 1778063 - RNA, 18 nt, Salmonella enterica enterica serovar Typhi Ty2
gcguaacgccacauauaa

SEQ ID NO: 1778064 - RNA, 14 nt, Salmonella enterica enterica serovar Typhi Ty2
gcguacagcgccau

SEQ ID NO: 1778065 - RNA, 18 nt, Salmonella enterica enterica serovar Typhi Ty2
gcguaccgcuaucgccaa

SEQ ID NO: 1778066 - RNA, 15 nt, Salmonella enterica enterica serovar Typhi Ty2
gcguaccgcgcgccc

SEQ ID NO: 1778067 - RNA, 12 nt, Salmonella enterica enterica serovar Typhi Ty2
gcguacccgcgg

SEQ ID NO: 1778068 - RNA, 15 nt, Salmonella enterica enterica serovar Typhi Ty2
gcguagucucccucc

SEQ ID NO: 1778069 - RNA, 19 nt, Salmonella enterica enterica serovar Typhi Ty2
gcguacuuucgccaguuca

SEQ ID NO: 1778070 - RNA, 19 nt, Salmonella enterica enterica serovar Typhi Ty2
gcguacuuucacuaccacu

SEQ ID NO: 1778071 - RNA, 15 nt, Salmonella enterica enterica serovar Typhi Ty2
gcggguucccccacu

SEQ ID NO: 1778072 - RNA, 13 nt, Salmonella enterica enterica serovar Typhi Ty2
gcggucaggccag

SEQ ID NO: 1778073 - RNA, 16 nt, Salmonella enterica enterica serovar Typhi Ty2
gcggucaucgcccauc

SEQ ID NO: 1778074 - RNA, 21 nt, Salmonella enterica enterica serovar Typhi Ty2
gcgguccaauaaacgccaggu

SEQ ID NO: 1778075 - RNA, 16 nt, Salmonella enterica enterica serovar Typhi Ty2
gcgggcaauggcgcuc

SEQ ID NO: 1778076 - RNA, 17 nt, Salmonella enterica enterica serovar Typhi Ty2
gcgggcaaaagggccau

SEQ ID NO: 1778077 - RNA, 20 nt, Salmonella enterica enterica serovar Typhi Ty2
gcgggcaggucgucuucuug

SEQ ID NO: 1778078 - RNA, 22 nt, Salmonella enterica enterica serovar Typhi Ty2
gcggcuugaguuuuccgccauu

SEQ ID NO: 1778079 - RNA, 19 nt, Salmonella enterica enterica serovar Typhi Ty2
gcggcuucgccagauccgg

SEQ ID NO: 1778080 - RNA, 17 nt, Salmonella enterica enterica serovar Typhi Ty2
gcggcuucagcgacauc

SEQ ID NO: 1778081 - RNA, 15 nt, Salmonella enterica enterica serovar Typhi Ty2
gcggcuucacgccau

SEQ ID NO: 1778082 - RNA, 21 nt, Salmonella enterica enterica serovar Typhi Ty2
gcgggaugcuauaccgcccgc

SEQ ID NO: 1778083 - RNA, 13 nt, Salmonella enterica enterica serovar Typhi Ty2
gcggcggaaugcu

SEQ ID NO: 1778084 - RNA, 20 nt, Salmonella enterica enterica serovar Typhi Ty2
gcggcggacaacgcuccagc

SEQ ID NO: 1778085 - RNA, 22 nt, Salmonella enterica enterica serovar Typhi Ty2
gcggcggacaugguaauaacgc

SEQ ID NO: 1778086 - RNA, 19 nt, Salmonella enterica enterica serovar Typhi Ty2
gcggcgcuuugcuucucgc

SEQ ID NO: 1778087 - RNA, 16 nt, Salmonella enterica enterica serovar Typhi Ty2
gcggcugacacucauc

SEQ ID NO: 1778088 - RNA, 13 nt, Salmonella enterica enterica serovar Typhi Ty2
gcggggaaacucu

SEQ ID NO: 1778089 - RNA, 21 nt, Salmonella enterica enterica serovar Typhi Ty2
gcgggcuuuuuuugcccgcuc

SEQ ID NO: 1778090 - RNA, 17 nt, Salmonella enterica enterica serovar Typhi Ty2
gcggggauaaucagcag

SEQ ID NO: 1778091 - RNA, 16 nt, Salmonella enterica enterica serovar Typhi Ty2
gcgggcgaucggcugu

SEQ ID NO: 1778092 - RNA, 20 nt, Salmonella enterica enterica serovar Typhi Ty2
gccugcuguaaccccugcgc

SEQ ID NO: 1778093 - RNA, 15 nt, Salmonella enterica enterica serovar Typhi Ty2
gccugcuggucugaa

SEQ ID NO: 1778094 - RNA, 18 nt, Salmonella enterica enterica serovar Typhi Ty2
gccugcuggaaaggccgc

SEQ ID NO: 1778095 - RNA, 14 nt, Salmonella enterica enterica serovar Typhi Ty2
gccugcuggagccg

SEQ ID NO: 1778096 - RNA, 21 nt, Salmonella enterica enterica serovar Typhi Ty2
gccuggaaagggaaugcgccg

SEQ ID NO: 1778097 - RNA, 22 nt, Salmonella enterica enterica serovar Typhi Ty2
gccuggcauggugcagccgcca

SEQ ID NO: 1778098 - RNA, 18 nt, Salmonella enterica enterica serovar Typhi Ty2
gccuggcauggugcagcc

SEQ ID NO: 1778099 - RNA, 21 nt, Salmonella enterica enterica serovar Typhi Ty2
gccuggcccggcaguugcugg

SEQ ID NO: 1778100 - RNA, 22 nt, Salmonella enterica enterica serovar Typhi Ty2
gccugcgguauauucccccugc

SEQ ID NO: 1778101 - RNA, 14 nt, Salmonella enterica enterica serovar Typhi Ty2
gccugcgugcgccg

SEQ ID NO: 1778102 - RNA, 18 nt, Salmonella enterica enterica serovar Typhi Ty2
gccugcguugcuauggca

SEQ ID NO: 1778103 - RNA, 19 nt, Salmonella enterica enterica serovar Typhi Ty2
gccugcucaauacuuuccg

SEQ ID NO: 1778104 - RNA, 14 nt, Salmonella enterica enterica serovar Typhi Ty2
gccugcugccugca

SEQ ID NO: 1778105 - RNA, 15 nt, Salmonella enterica enterica serovar Typhi Ty2
gccugcgucgcccca

SEQ ID NO: 1778106 - RNA, 21 nt, Salmonella enterica enterica serovar Typhi Ty2
gccugcgcucauauacccugc

SEQ ID NO: 1778107 - RNA, 21 nt, Salmonella enterica enterica serovar Typhi Ty2
gccugcgcggcaauuuccgcu

SEQ ID NO: 1778108 - RNA, 21 nt, Salmonella enterica enterica serovar Typhi Ty2
gccugcgcuggaaucauccac

SEQ ID NO: 1778109 - RNA, 21 nt, Salmonella enterica enterica serovar Typhi Ty2
gccugguggcgacgcguggca

SEQ ID NO: 1778110 - RNA, 21 nt, Salmonella enterica enterica serovar Typhi Ty2
gccugguuaacaauauugcgc

SEQ ID NO: 1778111 - RNA, 14 nt, Salmonella enterica enterica serovar Typhi Ty2
gccuggcgcugggu

SEQ ID NO: 1778112 - RNA, 18 nt, Salmonella enterica enterica serovar Typhi Ty2
gccuggcuuguuacugca

SEQ ID NO: 1778113 - RNA, 16 nt, Salmonella enterica enterica serovar Typhi Ty2
gccuguaaacguuccu

SEQ ID NO: 1778114 - RNA, 17 nt, Salmonella enterica enterica serovar Typhi Ty2
gccuguaaggcucucuu

SEQ ID NO: 1778115 - RNA, 19 nt, Salmonella enterica enterica serovar Typhi Ty2
gccuguaaacguuccugcc

SEQ ID NO: 1778116 - RNA, 17 nt, Salmonella enterica enterica serovar Typhi Ty2
gccuguaguacaugcca

SEQ ID NO: 1778117 - RNA, 16 nt, Salmonella enterica enterica serovar Typhi Ty2
gccuguacuugcgccg

SEQ ID NO: 1778118 - RNA, 19 nt, Salmonella enterica enterica serovar Typhi Ty2
gccugucacguaaaauuag

SEQ ID NO: 1778119 - RNA, 16 nt, Salmonella enterica enterica serovar Typhi Ty2
gccugucuccagcgcc

SEQ ID NO: 1778120 - RNA, 15 nt, Salmonella enterica enterica serovar Typhi Ty2
gccugucuccucagc

SEQ ID NO: 1778121 - RNA, 15 nt, Salmonella enterica enterica serovar Typhi Ty2
gccugucuauuguuu

SEQ ID NO: 1778122 - RNA, 22 nt, Salmonella enterica enterica serovar Typhi Ty2
gccuguagcagcgccagcgugc

SEQ ID NO: 1778123 - RNA, 18 nt, Salmonella enterica enterica serovar Typhi Ty2
gccuguuagggcgcggcu

SEQ ID NO: 1778124 - RNA, 14 nt, Salmonella enterica enterica serovar Typhi Ty2
gccuguguaaugaa

SEQ ID NO: 1778125 - RNA, 17 nt, Salmonella enterica enterica serovar Typhi Ty2
gccugugccagcucguu

SEQ ID NO: 1778126 - RNA, 13 nt, Salmonella enterica enterica serovar Typhi Ty2
gccucugauuuuu

SEQ ID NO: 1778127 - RNA, 16 nt, Salmonella enterica enterica serovar Typhi Ty2
gccucuaucuucucag

SEQ ID NO: 1778128 - RNA, 13 nt, Salmonella enterica enterica serovar Typhi Ty2
gccucucccgaac

SEQ ID NO: 1778129 - RNA, 21 nt, Salmonella enterica enterica serovar Typhi Ty2
gccucuucuggcucccgcagc

SEQ ID NO: 1778130 - RNA, 14 nt, Salmonella enterica enterica serovar Typhi Ty2
gccucuuccgccug

SEQ ID NO: 1778131 - RNA, 14 nt, Salmonella enterica enterica serovar Typhi Ty2
gccucuuacagggc

SEQ ID NO: 1778132 - RNA, 16 nt, Salmonella enterica enterica serovar Typhi Ty2
gccucucccagcauga

SEQ ID NO: 1778133 - RNA, 13 nt, Salmonella enterica enterica serovar Typhi Ty2
gccugaauaauga

SEQ ID NO: 1778134 - RNA, 22 nt, Salmonella enterica enterica serovar Typhi Ty2
gccugaaugcagaccucugcuu

SEQ ID NO: 1778135 - RNA, 12 nt, Salmonella enterica enterica serovar Typhi Ty2
gccugaaugcuc

SEQ ID NO: 1778136 - RNA, 17 nt, Salmonella enterica enterica serovar Typhi Ty2
gccucuuuugcauuaca

SEQ ID NO: 1778137 - RNA, 22 nt, Salmonella enterica enterica serovar Typhi Ty2
gccucuuuugucguccccugga

SEQ ID NO: 1778138 - RNA, 21 nt, Salmonella enterica enterica serovar Typhi Ty2
gccucuuuuuucgccacgcca

SEQ ID NO: 1778139 - RNA, 18 nt, Salmonella enterica enterica serovar Typhi Ty2
gccucuuucagaucgccg

SEQ ID NO: 1778140 - RNA, 21 nt, Salmonella enterica enterica serovar Typhi Ty2
gccucuuucagaucgccgccg

SEQ ID NO: 1778141 - RNA, 13 nt, Salmonella enterica enterica serovar Typhi Ty2
gccucuuucagau

SEQ ID NO: 1778142 - RNA, 22 nt, Salmonella enterica enterica serovar Typhi Ty2
gccucuuggaugauuuucuucu

SEQ ID NO: 1778143 - RNA, 21 nt, Salmonella enterica enterica serovar Typhi Ty2
gccugauaaauaugucggccc

SEQ ID NO: 1778144 - RNA, 22 nt, Salmonella enterica enterica serovar Typhi Ty2
gccugauaagcauagcgccauc

SEQ ID NO: 1778145 - RNA, 21 nt, Salmonella enterica enterica serovar Typhi Ty2
gccugacgaaagucauccagu

SEQ ID NO: 1778146 - RNA, 20 nt, Salmonella enterica enterica serovar Typhi Ty2
gccugaugcgccgccuuggc

SEQ ID NO: 1778147 - RNA, 15 nt, Salmonella enterica enterica serovar Typhi Ty2
gccugaugcgccgcc

SEQ ID NO: 1778148 - RNA, 13 nt, Salmonella enterica enterica serovar Typhi Ty2
gccugauggcgcu

SEQ ID NO: 1778149 - RNA, 24 nt, Salmonella enterica enterica serovar Typhi Ty2
gccugaugcgcguuuagcgccagc

SEQ ID NO: 1778150 - RNA, 17 nt, Salmonella enterica enterica serovar Typhi Ty2
gccugaugacgcugcgc

SEQ ID NO: 1778151 - RNA, 13 nt, Salmonella enterica enterica serovar Typhi Ty2
gccugaucgccac

SEQ ID NO: 1778152 - RNA, 15 nt, Salmonella enterica enterica serovar Typhi Ty2
gccugaucuuucugg

SEQ ID NO: 1778153 - RNA, 21 nt, Salmonella enterica enterica serovar Typhi Ty2
gccugauggcgcuacgccauc

SEQ ID NO: 1778154 - RNA, 22 nt, Salmonella enterica enterica serovar Typhi Ty2
gccugauggucgcucuggucga

SEQ ID NO: 1778155 - RNA, 21 nt, Salmonella enterica enterica serovar Typhi Ty2
gccugauucgugacaucaagc

SEQ ID NO: 1778156 - RNA, 17 nt, Salmonella enterica enterica serovar Typhi Ty2
gccugauggcgcugcgc

SEQ ID NO: 1778157 - RNA, 16 nt, Salmonella enterica enterica serovar Typhi Ty2
gccugauucauuccca

SEQ ID NO: 1778158 - RNA, 17 nt, Salmonella enterica enterica serovar Typhi Ty2
gccugauuucccaguug

SEQ ID NO: 1778159 - RNA, 15 nt, Salmonella enterica enterica serovar Typhi Ty2
gccugcgccagcgcc

SEQ ID NO: 1778160 - RNA, 14 nt, Salmonella enterica enterica serovar Typhi Ty2
gccugcgccgcagg

SEQ ID NO: 1778161 - RNA, 15 nt, Salmonella enterica enterica serovar Typhi Ty2
gccugccugaagcgc

SEQ ID NO: 1778162 - RNA, 15 nt, Salmonella enterica enterica serovar Typhi Ty2
gccugccguccugau

SEQ ID NO: 1778163 - RNA, 16 nt, Salmonella enterica enterica serovar Typhi Ty2
gccugccgcgccgccg

SEQ ID NO: 1778164 - RNA, 14 nt, Salmonella enterica enterica serovar Typhi Ty2
gccugccgcgcccg

SEQ ID NO: 1778165 - RNA, 13 nt, Salmonella enterica enterica serovar Typhi Ty2
gccugccgggccu

SEQ ID NO: 1778166 - RNA, 21 nt, Salmonella enterica enterica serovar Typhi Ty2
gccugccgucgcggcuuucag

SEQ ID NO: 1778167 - RNA, 22 nt, Salmonella enterica enterica serovar Typhi Ty2
gccugccgucuuuuagcaucag

SEQ ID NO: 1778168 - RNA, 23 nt, Salmonella enterica enterica serovar Typhi Ty2
gccugccguaaacaggcaggccc

SEQ ID NO: 1778169 - RNA, 12 nt, Salmonella enterica enterica serovar Typhi Ty2
gccugcccaucu

SEQ ID NO: 1778170 - RNA, 20 nt, Salmonella enterica enterica serovar Typhi Ty2
gccugcaucaccucagaauu

SEQ ID NO: 1778171 - RNA, 21 nt, Salmonella enterica enterica serovar Typhi Ty2
gccugcauacguuucaccagc

SEQ ID NO: 1778172 - RNA, 18 nt, Salmonella enterica enterica serovar Typhi Ty2
gccugcauaauugcugac

SEQ ID NO: 1778173 - RNA, 20 nt, Salmonella enterica enterica serovar Typhi Ty2
gccugccagcaacccaccug

SEQ ID NO: 1778174 - RNA, 21 nt, Salmonella enterica enterica serovar Typhi Ty2
gccugccagauccaacacauc

SEQ ID NO: 1778175 - RNA, 14 nt, Salmonella enterica enterica serovar Typhi Ty2
gccugccaaccggc

SEQ ID NO: 1778176 - RNA, 16 nt, Salmonella enterica enterica serovar Typhi Ty2
gccuaagaccagcacc

SEQ ID NO: 1778177 - RNA, 15 nt, Salmonella enterica enterica serovar Typhi Ty2
gccuaccugccgcca

SEQ ID NO: 1778178 - RNA, 21 nt, Salmonella enterica enterica serovar Typhi Ty2
gccuacaaaaucgcccaggcc

SEQ ID NO: 1778179 - RNA, 14 nt, Salmonella enterica enterica serovar Typhi Ty2
gccuaaugagccag

SEQ ID NO: 1778180 - RNA, 16 nt, Salmonella enterica enterica serovar Typhi Ty2
gccuacagaacugcac

SEQ ID NO: 1778181 - RNA, 22 nt, Salmonella enterica enterica serovar Typhi Ty2
gccuacagaacugcacgaaaug

SEQ ID NO: 1778182 - RNA, 18 nt, Salmonella enterica enterica serovar Typhi Ty2
gccuacgcgcucacggca

SEQ ID NO: 1778183 - RNA, 12 nt, Salmonella enterica enterica serovar Typhi Ty2
gccuaucgccau

SEQ ID NO: 1778184 - RNA, 18 nt, Salmonella enterica enterica serovar Typhi Ty2
gccuagcgcgcgcaguuu

SEQ ID NO: 1778185 - RNA, 18 nt, Salmonella enterica enterica serovar Typhi Ty2
gccuauuuucucuuccac

SEQ ID NO: 1778186 - RNA, 19 nt, Salmonella enterica enterica serovar Typhi Ty2
gccuaugcugucgcaauuu

SEQ ID NO: 1778187 - RNA, 21 nt, Salmonella enterica enterica serovar Typhi Ty2
gccgguaagaagaaccagcgc

SEQ ID NO: 1778188 - RNA, 17 nt, Salmonella enterica enterica serovar Typhi Ty2
gccggguuugccgugcg

SEQ ID NO: 1778189 - RNA, 17 nt, Salmonella enterica enterica serovar Typhi Ty2
gccgucgucaccgccgc

SEQ ID NO: 1778190 - RNA, 15 nt, Salmonella enterica enterica serovar Typhi Ty2
gccggguaaacgcag

SEQ ID NO: 1778191 - RNA, 16 nt, Salmonella enterica enterica serovar Typhi Ty2
gccggggcuggcggcg

SEQ ID NO: 1778192 - RNA, 16 nt, Salmonella enterica enterica serovar Typhi Ty2
gccguguucuuaccca

SEQ ID NO: 1778193 - RNA, 20 nt, Salmonella enterica enterica serovar Typhi Ty2
gccgugucgaccggcaccau

SEQ ID NO: 1778194 - RNA, 18 nt, Salmonella enterica enterica serovar Typhi Ty2
gccguguucuuacccacu

SEQ ID NO: 1778195 - RNA, 16 nt, Salmonella enterica enterica serovar Typhi Ty2
gccguuaacuggcgca

SEQ ID NO: 1778196 - RNA, 23 nt, Salmonella enterica enterica serovar Typhi Ty2
gccguuaacuggcgcaucugguc

SEQ ID NO: 1778197 - RNA, 23 nt, Salmonella enterica enterica serovar Typhi Ty2
gccgucguuaacaucaucaggcc

SEQ ID NO: 1778198 - RNA, 17 nt, Salmonella enterica enterica serovar Typhi Ty2
gccgucguucagccagc

SEQ ID NO: 1778199 - RNA, 13 nt, Salmonella enterica enterica serovar Typhi Ty2
gccgugaucccaa

SEQ ID NO: 1778200 - RNA, 19 nt, Salmonella enterica enterica serovar Typhi Ty2
gccgucgucaccgccgcgc

SEQ ID NO: 1778201 - RNA, 18 nt, Salmonella enterica enterica serovar Typhi Ty2
gccgugccugcuccgcca

SEQ ID NO: 1778202 - RNA, 15 nt, Salmonella enterica enterica serovar Typhi Ty2
gccgugccuggcgcu

SEQ ID NO: 1778203 - RNA, 19 nt, Salmonella enterica enterica serovar Typhi Ty2
gccuccaccaccucuuucg

SEQ ID NO: 1778204 - RNA, 11 nt, Salmonella enterica enterica serovar Typhi Ty2
gccucauugau

SEQ ID NO: 1778205 - RNA, 22 nt, Salmonella enterica enterica serovar Typhi Ty2
gccuccagacuggcgaccgcca

SEQ ID NO: 1778206 - RNA, 12 nt, Salmonella enterica enterica serovar Typhi Ty2
gccuccagcagc

SEQ ID NO: 1778207 - RNA, 10 nt, Salmonella enterica enterica serovar Typhi Ty2
gccucaggcg

SEQ ID NO: 1778208 - RNA, 16 nt, Salmonella enterica enterica serovar Typhi Ty2
gccucaucggcguugc

SEQ ID NO: 1778209 - RNA, 20 nt, Salmonella enterica enterica serovar Typhi Ty2
gccucaucgacagacuucac

SEQ ID NO: 1778210 - RNA, 14 nt, Salmonella enterica enterica serovar Typhi Ty2
gccucaucugcuuc

SEQ ID NO: 1778211 - RNA, 18 nt, Salmonella enterica enterica serovar Typhi Ty2
gccuccggaugacgccgc

SEQ ID NO: 1778212 - RNA, 21 nt, Salmonella enterica enterica serovar Typhi Ty2
gccuccgcguagcccagcgcc

SEQ ID NO: 1778213 - RNA, 16 nt, Salmonella enterica enterica serovar Typhi Ty2
gccuccggaucgacag

SEQ ID NO: 1778214 - RNA, 15 nt, Salmonella enterica enterica serovar Typhi Ty2
gccuccgcuuccugc

SEQ ID NO: 1778215 - RNA, 16 nt, Salmonella enterica enterica serovar Typhi Ty2
gccuccguaugaccgc

SEQ ID NO: 1778216 - RNA, 13 nt, Salmonella enterica enterica serovar Typhi Ty2
gccuccccugccg

SEQ ID NO: 1778217 - RNA, 12 nt, Salmonella enterica enterica serovar Typhi Ty2
gccucccugccu

SEQ ID NO: 1778218 - RNA, 18 nt, Salmonella enterica enterica serovar Typhi Ty2
gccucccaguucccccgg

SEQ ID NO: 1778219 - RNA, 20 nt, Salmonella enterica enterica serovar Typhi Ty2
gccuccauuuuggggaaaau

SEQ ID NO: 1778220 - RNA, 18 nt, Salmonella enterica enterica serovar Typhi Ty2
gccucgccaaagcgcugc

SEQ ID NO: 1778221 - RNA, 22 nt, Salmonella enterica enterica serovar Typhi Ty2
gccucgcgcauccgggccgcua

SEQ ID NO: 1778222 - RNA, 22 nt, Salmonella enterica enterica serovar Typhi Ty2
gccucgcugauacgcaccagcu

SEQ ID NO: 1778223 - RNA, 17 nt, Salmonella enterica enterica serovar Typhi Ty2
gccucuacccaugaagc

SEQ ID NO: 1778224 - RNA, 22 nt, Salmonella enterica enterica serovar Typhi Ty2
gccucguguaaggcuuccggca

SEQ ID NO: 1778225 - RNA, 21 nt, Salmonella enterica enterica serovar Typhi Ty2
gccucguaucugucccagccu

SEQ ID NO: 1778226 - RNA, 17 nt, Salmonella enterica enterica serovar Typhi Ty2
gccucggguggcaucug

SEQ ID NO: 1778227 - RNA, 23 nt, Salmonella enterica enterica serovar Typhi Ty2
gccgcucucuucgugacccgcca

SEQ ID NO: 1778228 - RNA, 16 nt, Salmonella enterica enterica serovar Typhi Ty2
gccgcuagcggcggcc

SEQ ID NO: 1778229 - RNA, 23 nt, Salmonella enterica enterica serovar Typhi Ty2
gccgcguuuaagucccuggcgcg

SEQ ID NO: 1778230 - RNA, 16 nt, Salmonella enterica enterica serovar Typhi Ty2
gccgcguuucucgccg

SEQ ID NO: 1778231 - RNA, 23 nt, Salmonella enterica enterica serovar Typhi Ty2
gccgcguaaucuucgcggcugcc

SEQ ID NO: 1778232 - RNA, 16 nt, Salmonella enterica enterica serovar Typhi Ty2
gccgcgccagacgcca

SEQ ID NO: 1778233 - RNA, 13 nt, Salmonella enterica enterica serovar Typhi Ty2
gccgcgcccagca

SEQ ID NO: 1778234 - RNA, 18 nt, Salmonella enterica enterica serovar Typhi Ty2
gccggauaaccuucgggc

SEQ ID NO: 1778235 - RNA, 18 nt, Salmonella enterica enterica serovar Typhi Ty2
gccggagggcgaacuggc

SEQ ID NO: 1778236 - RNA, 16 nt, Salmonella enterica enterica serovar Typhi Ty2
gccggagguuuuucug

SEQ ID NO: 1778237 - RNA, 22 nt, Salmonella enterica enterica serovar Typhi Ty2
gccggauaaggcggagccgcca

SEQ ID NO: 1778238 - RNA, 20 nt, Salmonella enterica enterica serovar Typhi Ty2
gccggauagacaugaccgga

SEQ ID NO: 1778239 - RNA, 17 nt, Salmonella enterica enterica serovar Typhi Ty2
gccggauaagcguuagc

SEQ ID NO: 1778240 - RNA, 16 nt, Salmonella enterica enterica serovar Typhi Ty2
gccggauaaggccacg

SEQ ID NO: 1778241 - RNA, 20 nt, Salmonella enterica enterica serovar Typhi Ty2
gccggcaaagguugccgcaa

SEQ ID NO: 1778242 - RNA, 13 nt, Salmonella enterica enterica serovar Typhi Ty2
gccggcaaagcca

SEQ ID NO: 1778243 - RNA, 21 nt, Salmonella enterica enterica serovar Typhi Ty2
gccggauauggcguccggcca

SEQ ID NO: 1778244 - RNA, 19 nt, Salmonella enterica enterica serovar Typhi Ty2
gccggcaucauucugcagg

SEQ ID NO: 1778245 - RNA, 15 nt, Salmonella enterica enterica serovar Typhi Ty2
gccggcaucauucug

SEQ ID NO: 1778246 - RNA, 23 nt, Salmonella enterica enterica serovar Typhi Ty2
gccggcaucauucugcaggcggg

SEQ ID NO: 1778247 - RNA, 14 nt, Salmonella enterica enterica serovar Typhi Ty2
gccggacaggcgac

SEQ ID NO: 1778248 - RNA, 16 nt, Salmonella enterica enterica serovar Typhi Ty2
gccggacgccacgcuc

SEQ ID NO: 1778249 - RNA, 18 nt, Salmonella enterica enterica serovar Typhi Ty2
gccgcugucgccagaaug

SEQ ID NO: 1778250 - RNA, 20 nt, Salmonella enterica enterica serovar Typhi Ty2
gccggaaaggcgcaacgucg

SEQ ID NO: 1778251 - RNA, 21 nt, Salmonella enterica enterica serovar Typhi Ty2
gccggaaagggugcccgccug

SEQ ID NO: 1778252 - RNA, 19 nt, Salmonella enterica enterica serovar Typhi Ty2
gccggaaaagcgcuggcug

SEQ ID NO: 1778253 - RNA, 21 nt, Salmonella enterica enterica serovar Typhi Ty2
gccggaaaagcgcuggcuggc

SEQ ID NO: 1778254 - RNA, 20 nt, Salmonella enterica enterica serovar Typhi Ty2
gccggaaaaaaugggcugga

SEQ ID NO: 1778255 - RNA, 22 nt, Salmonella enterica enterica serovar Typhi Ty2
gccggaaaaaaugggcuggaaa

SEQ ID NO: 1778256 - RNA, 19 nt, Salmonella enterica enterica serovar Typhi Ty2
gccgcuuuugccgcgacuu

SEQ ID NO: 1778257 - RNA, 19 nt, Salmonella enterica enterica serovar Typhi Ty2
gccggcgcguaauuccgca

SEQ ID NO: 1778258 - RNA, 14 nt, Salmonella enterica enterica serovar Typhi Ty2
gccggggcgcuggc

SEQ ID NO: 1778259 - RNA, 21 nt, Salmonella enterica enterica serovar Typhi Ty2
gccgggcagacaucgccgugc

SEQ ID NO: 1778260 - RNA, 20 nt, Salmonella enterica enterica serovar Typhi Ty2
gccgggcauugugccgggua

SEQ ID NO: 1778261 - RNA, 12 nt, Salmonella enterica enterica serovar Typhi Ty2
gccggcgcagcg

SEQ ID NO: 1778262 - RNA, 19 nt, Salmonella enterica enterica serovar Typhi Ty2
gccgaucuuuaccucaggu

SEQ ID NO: 1778263 - RNA, 18 nt, Salmonella enterica enterica serovar Typhi Ty2
gcccuggugagcuccagc

SEQ ID NO: 1778264 - RNA, 18 nt, Salmonella enterica enterica serovar Typhi Ty2
gccgauagcaucgcugau

SEQ ID NO: 1778265 - RNA, 13 nt, Salmonella enterica enterica serovar Typhi Ty2
gccgauacugccc

SEQ ID NO: 1778266 - RNA, 21 nt, Salmonella enterica enterica serovar Typhi Ty2
gccgcaccagucggcaaagac

SEQ ID NO: 1778267 - RNA, 16 nt, Salmonella enterica enterica serovar Typhi Ty2
gccgcacgccugcggc

SEQ ID NO: 1778268 - RNA, 14 nt, Salmonella enterica enterica serovar Typhi Ty2
gccgcacuucacgc

SEQ ID NO: 1778269 - RNA, 20 nt, Salmonella enterica enterica serovar Typhi Ty2
gccgcaggaaagugccuggg

SEQ ID NO: 1778270 - RNA, 22 nt, Salmonella enterica enterica serovar Typhi Ty2
gccgcaggaaagugccugggga

SEQ ID NO: 1778271 - RNA, 16 nt, Salmonella enterica enterica serovar Typhi Ty2
gccgcaggacagcgac

SEQ ID NO: 1778272 - RNA, 15 nt, Salmonella enterica enterica serovar Typhi Ty2
gccgcagcccgccca

SEQ ID NO: 1778273 - RNA, 14 nt, Salmonella enterica enterica serovar Typhi Ty2
gccgcagcccgccc

SEQ ID NO: 1778274 - RNA, 18 nt, Salmonella enterica enterica serovar Typhi Ty2
gccgcagccgcucagggu

SEQ ID NO: 1778275 - RNA, 23 nt, Salmonella enterica enterica serovar Typhi Ty2
gccgcaucauaguuuuuccccau

SEQ ID NO: 1778276 - RNA, 24 nt, Salmonella enterica enterica serovar Typhi Ty2
gccgccagaaucaccucuuucucc

SEQ ID NO: 1778277 - RNA, 12 nt, Salmonella enterica enterica serovar Typhi Ty2
gccgccagaauc

SEQ ID NO: 1778278 - RNA, 13 nt, Salmonella enterica enterica serovar Typhi Ty2
gccgccagcaaua

SEQ ID NO: 1778279 - RNA, 14 nt, Salmonella enterica enterica serovar Typhi Ty2
gccgccagcaaacu

SEQ ID NO: 1778280 - RNA, 17 nt, Salmonella enterica enterica serovar Typhi Ty2
gccgccagcaccgccgc

SEQ ID NO: 1778281 - RNA, 14 nt, Salmonella enterica enterica serovar Typhi Ty2
gccgccaccgccuc

SEQ ID NO: 1778282 - RNA, 17 nt, Salmonella enterica enterica serovar Typhi Ty2
gccgccaaagcgcccga

SEQ ID NO: 1778283 - RNA, 17 nt, Salmonella enterica enterica serovar Typhi Ty2
gccgccaacgccagcag

SEQ ID NO: 1778284 - RNA, 16 nt, Salmonella enterica enterica serovar Typhi Ty2
gccgccaacgccagca

SEQ ID NO: 1778285 - RNA, 15 nt, Salmonella enterica enterica serovar Typhi Ty2
gccgccaacgccagc

SEQ ID NO: 1778286 - RNA, 18 nt, Salmonella enterica enterica serovar Typhi Ty2
gccgccgcaccacugcug

SEQ ID NO: 1778287 - RNA, 12 nt, Salmonella enterica enterica serovar Typhi Ty2
gccgccgcagca

SEQ ID NO: 1778288 - RNA, 11 nt, Salmonella enterica enterica serovar Typhi Ty2
gccgccgcagg

SEQ ID NO: 1778289 - RNA, 15 nt, Salmonella enterica enterica serovar Typhi Ty2
gccgccgcagcagau

SEQ ID NO: 1778290 - RNA, 14 nt, Salmonella enterica enterica serovar Typhi Ty2
gccgccgcaggaca

SEQ ID NO: 1778291 - RNA, 16 nt, Salmonella enterica enterica serovar Typhi Ty2
gccgcgacgcgcgagc

SEQ ID NO: 1778292 - RNA, 20 nt, Salmonella enterica enterica serovar Typhi Ty2
gccgcgaacguucaaaauca

SEQ ID NO: 1778293 - RNA, 14 nt, Salmonella enterica enterica serovar Typhi Ty2
gccgcgaccagcag

SEQ ID NO: 1778294 - RNA, 15 nt, Salmonella enterica enterica serovar Typhi Ty2
gccgccugaugcugg

SEQ ID NO: 1778295 - RNA, 18 nt, Salmonella enterica enterica serovar Typhi Ty2
gccgccuccagcauacug

SEQ ID NO: 1778296 - RNA, 14 nt, Salmonella enterica enterica serovar Typhi Ty2
gccgccucccccuc

SEQ ID NO: 1778297 - RNA, 20 nt, Salmonella enterica enterica serovar Typhi Ty2
gccgccgugauaaauacgcu

SEQ ID NO: 1778298 - RNA, 16 nt, Salmonella enterica enterica serovar Typhi Ty2
gccgccguuuuauuug

SEQ ID NO: 1778299 - RNA, 23 nt, Salmonella enterica enterica serovar Typhi Ty2
gccgcccgcaugguaaacgcauc

SEQ ID NO: 1778300 - RNA, 20 nt, Salmonella enterica enterica serovar Typhi Ty2
gccgcccaggccaugcgccg

SEQ ID NO: 1778301 - RNA, 11 nt, Salmonella enterica enterica serovar Typhi Ty2
gccgcccaggc

SEQ ID NO: 1778302 - RNA, 18 nt, Salmonella enterica enterica serovar Typhi Ty2
gccgcccaucgccacagc

SEQ ID NO: 1778303 - RNA, 19 nt, Salmonella enterica enterica serovar Typhi Ty2
gccgcccaucgccacagcg

SEQ ID NO: 1778304 - RNA, 22 nt, Salmonella enterica enterica serovar Typhi Ty2
gccgcccauuaauaucagcccc

SEQ ID NO: 1778305 - RNA, 23 nt, Salmonella enterica enterica serovar Typhi Ty2
gccgcccauuaauaucagcccca

SEQ ID NO: 1778306 - RNA, 18 nt, Salmonella enterica enterica serovar Typhi Ty2
gccgcccccaugccgccu

SEQ ID NO: 1778307 - RNA, 22 nt, Salmonella enterica enterica serovar Typhi Ty2
gccgccaguaauuuuucuccca

SEQ ID NO: 1778308 - RNA, 17 nt, Salmonella enterica enterica serovar Typhi Ty2
gccgccaggcaaauucu

SEQ ID NO: 1778309 - RNA, 14 nt, Salmonella enterica enterica serovar Typhi Ty2
gccgcccaaccagc

SEQ ID NO: 1778310 - RNA, 18 nt, Salmonella enterica enterica serovar Typhi Ty2
gccgccaucgucgccacc

SEQ ID NO: 1778311 - RNA, 12 nt, Salmonella enterica enterica serovar Typhi Ty2
gccgccauggcg

SEQ ID NO: 1778312 - RNA, 21 nt, Salmonella enterica enterica serovar Typhi Ty2
gccaccgggcaacacacgcuu

SEQ ID NO: 1778313 - RNA, 17 nt, Salmonella enterica enterica serovar Typhi Ty2
gccaccgggcaacccgg

SEQ ID NO: 1778314 - RNA, 16 nt, Salmonella enterica enterica serovar Typhi Ty2
gccaccgccagccaug

SEQ ID NO: 1778315 - RNA, 14 nt, Salmonella enterica enterica serovar Typhi Ty2
gccaccgccgccac

SEQ ID NO: 1778316 - RNA, 15 nt, Salmonella enterica enterica serovar Typhi Ty2
gccaccgccagcagu

SEQ ID NO: 1778317 - RNA, 22 nt, Salmonella enterica enterica serovar Typhi Ty2
gccaccuuaaucgacuucaugc

SEQ ID NO: 1778318 - RNA, 15 nt, Salmonella enterica enterica serovar Typhi Ty2
gccaccuuucugcuc

SEQ ID NO: 1778319 - RNA, 20 nt, Salmonella enterica enterica serovar Typhi Ty2
gccacgcagauaucuuccag

SEQ ID NO: 1778320 - RNA, 16 nt, Salmonella enterica enterica serovar Typhi Ty2
gccacgcaagcagcac

SEQ ID NO: 1778321 - RNA, 21 nt, Salmonella enterica enterica serovar Typhi Ty2
gccacgcagauaucuuccagc

SEQ ID NO: 1778322 - RNA, 16 nt, Salmonella enterica enterica serovar Typhi Ty2
gccacgaucggcaaug

SEQ ID NO: 1778323 - RNA, 20 nt, Salmonella enterica enterica serovar Typhi Ty2
gccacgagaaauccacauua

SEQ ID NO: 1778324 - RNA, 14 nt, Salmonella enterica enterica serovar Typhi Ty2
gccacgccgcccgc

SEQ ID NO: 1778325 - RNA, 14 nt, Salmonella enterica enterica serovar Typhi Ty2
gccacgcccgccgc

SEQ ID NO: 1778326 - RNA, 12 nt, Salmonella enterica enterica serovar Typhi Ty2
gccacgccgcca

SEQ ID NO: 1778327 - RNA, 22 nt, Salmonella enterica enterica serovar Typhi Ty2
gccacgccgaggcauucagcca

SEQ ID NO: 1778328 - RNA, 22 nt, Salmonella enterica enterica serovar Typhi Ty2
gccacgccccuaaggcagcaag

SEQ ID NO: 1778329 - RNA, 15 nt, Salmonella enterica enterica serovar Typhi Ty2
gccacgcccacgcug

SEQ ID NO: 1778330 - RNA, 14 nt, Salmonella enterica enterica serovar Typhi Ty2
gccacgccauugcu

SEQ ID NO: 1778331 - RNA, 11 nt, Salmonella enterica enterica serovar Typhi Ty2
gccacgccaau

SEQ ID NO: 1778332 - RNA, 17 nt, Salmonella enterica enterica serovar Typhi Ty2
gccacgccaccgggccg

SEQ ID NO: 1778333 - RNA, 15 nt, Salmonella enterica enterica serovar Typhi Ty2
gccaccacgcccaac

SEQ ID NO: 1778334 - RNA, 12 nt, Salmonella enterica enterica serovar Typhi Ty2
gccacauugacc

SEQ ID NO: 1778335 - RNA, 23 nt, Salmonella enterica enterica serovar Typhi Ty2
gcauagccggauaauuuauccag

SEQ ID NO: 1778336 - RNA, 19 nt, Salmonella enterica enterica serovar Typhi Ty2
gcauagcgucaucaacaua

SEQ ID NO: 1778337 - RNA, 18 nt, Salmonella enterica enterica serovar Typhi Ty2
gcauagcuguuccgcaac

SEQ ID NO: 1778338 - RNA, 17 nt, Salmonella enterica enterica serovar Typhi Ty2
gccacauagcauccaga

SEQ ID NO: 1778339 - RNA, 12 nt, Salmonella enterica enterica serovar Typhi Ty2
gccacauacugc

SEQ ID NO: 1778340 - RNA, 15 nt, Salmonella enterica enterica serovar Typhi Ty2
gccacauacugcuuu

SEQ ID NO: 1778341 - RNA, 18 nt, Salmonella enterica enterica serovar Typhi Ty2
gccacaggcggcaugggu

SEQ ID NO: 1778342 - RNA, 23 nt, Salmonella enterica enterica serovar Typhi Ty2
gcauaccggccacgagcugucac

SEQ ID NO: 1778343 - RNA, 20 nt, Salmonella enterica enterica serovar Typhi Ty2
gcauaccgugugcagugaca

SEQ ID NO: 1778344 - RNA, 16 nt, Salmonella enterica enterica serovar Typhi Ty2
gcauagccccagcgca

SEQ ID NO: 1778345 - RNA, 19 nt, Salmonella enterica enterica serovar Typhi Ty2
gcauacaggucuuuccgac

SEQ ID NO: 1778346 - RNA, 23 nt, Salmonella enterica enterica serovar Typhi Ty2
gcauacagcgauaaccgccgccg

SEQ ID NO: 1778347 - RNA, 23 nt, Salmonella enterica enterica serovar Typhi Ty2
gcauaccaaguuuggcaaucaaa

SEQ ID NO: 1778348 - RNA, 17 nt, Salmonella enterica enterica serovar Typhi Ty2
gccagauaaucgccgcc

SEQ ID NO: 1778349 - RNA, 18 nt, Salmonella enterica enterica serovar Typhi Ty2
gccagauaaagcagcgac

SEQ ID NO: 1778350 - RNA, 19 nt, Salmonella enterica enterica serovar Typhi Ty2
gccagauaaagcagcgaca

SEQ ID NO: 1778351 - RNA, 15 nt, Salmonella enterica enterica serovar Typhi Ty2
gccagauaaauagcg

SEQ ID NO: 1778352 - RNA, 14 nt, Salmonella enterica enterica serovar Typhi Ty2
gccagauucaccac

SEQ ID NO: 1778353 - RNA, 17 nt, Salmonella enterica enterica serovar Typhi Ty2
gccagaaugcccagcaa

SEQ ID NO: 1778354 - RNA, 14 nt, Salmonella enterica enterica serovar Typhi Ty2
gccagaccaauaga

SEQ ID NO: 1778355 - RNA, 19 nt, Salmonella enterica enterica serovar Typhi Ty2
gccagacagauaacaccag

SEQ ID NO: 1778356 - RNA, 22 nt, Salmonella enterica enterica serovar Typhi Ty2
gccagacagcccuauaacagcg

SEQ ID NO: 1778357 - RNA, 19 nt, Salmonella enterica enterica serovar Typhi Ty2
gccagaggcgugcaugggc

SEQ ID NO: 1778358 - RNA, 23 nt, Salmonella enterica enterica serovar Typhi Ty2
gccacgucugaugcguggcugaa

SEQ ID NO: 1778359 - RNA, 14 nt, Salmonella enterica enterica serovar Typhi Ty2
gccacguucuucca

SEQ ID NO: 1778360 - RNA, 19 nt, Salmonella enterica enterica serovar Typhi Ty2
gccacucacggcaaguaua

SEQ ID NO: 1778361 - RNA, 16 nt, Salmonella enterica enterica serovar Typhi Ty2
gccacgguuggcccag

SEQ ID NO: 1778362 - RNA, 19 nt, Salmonella enterica enterica serovar Typhi Ty2
gccacgguguggcccagcg

SEQ ID NO: 1778363 - RNA, 20 nt, Salmonella enterica enterica serovar Typhi Ty2
gccacgucacgcaacaggcc

SEQ ID NO: 1778364 - RNA, 16 nt, Salmonella enterica enterica serovar Typhi Ty2
gccacgguacggcuuu

SEQ ID NO: 1778365 - RNA, 16 nt, Salmonella enterica enterica serovar Typhi Ty2
gccacgccgcccgcgu

SEQ ID NO: 1778366 - RNA, 22 nt, Salmonella enterica enterica serovar Typhi Ty2
gccacgccgcuccacagcaaau

SEQ ID NO: 1778367 - RNA, 14 nt, Salmonella enterica enterica serovar Typhi Ty2
gccacgcgacgcca

SEQ ID NO: 1778368 - RNA, 16 nt, Salmonella enterica enterica serovar Typhi Ty2
gccacgcgccagccgu

SEQ ID NO: 1778369 - RNA, 19 nt, Salmonella enterica enterica serovar Typhi Ty2
gccacgcucgcuggugcca

SEQ ID NO: 1778370 - RNA, 15 nt, Salmonella enterica enterica serovar Typhi Ty2
gccacggauggccuc

SEQ ID NO: 1778371 - RNA, 20 nt, Salmonella enterica enterica serovar Typhi Ty2
gccacggagcauaauuuucc

SEQ ID NO: 1778372 - RNA, 22 nt, Salmonella enterica enterica serovar Typhi Ty2
gccacggcguguugaaauccuc

SEQ ID NO: 1778373 - RNA, 21 nt, Salmonella enterica enterica serovar Typhi Ty2
gccacggcguguugaaauccu

SEQ ID NO: 1778374 - RNA, 20 nt, Salmonella enterica enterica serovar Typhi Ty2
gccauccggcacuacagcgu

SEQ ID NO: 1778375 - RNA, 16 nt, Salmonella enterica enterica serovar Typhi Ty2
gccauccggcaacaaa

SEQ ID NO: 1778376 - RNA, 22 nt, Salmonella enterica enterica serovar Typhi Ty2
gccauccggcaaacucagcggc

SEQ ID NO: 1778377 - RNA, 20 nt, Salmonella enterica enterica serovar Typhi Ty2
gccauccggcaaauccucca

SEQ ID NO: 1778378 - RNA, 11 nt, Salmonella enterica enterica serovar Typhi Ty2
gccauccggca

SEQ ID NO: 1778379 - RNA, 21 nt, Salmonella enterica enterica serovar Typhi Ty2
gccaucggcuaagccaaaaau

SEQ ID NO: 1778380 - RNA, 14 nt, Salmonella enterica enterica serovar Typhi Ty2
gccaucgccucgau

SEQ ID NO: 1778381 - RNA, 15 nt, Salmonella enterica enterica serovar Typhi Ty2
gccaugccagcaguu

SEQ ID NO: 1778382 - RNA, 14 nt, Salmonella enterica enterica serovar Typhi Ty2
gccaugccagcagu

SEQ ID NO: 1778383 - RNA, 14 nt, Salmonella enterica enterica serovar Typhi Ty2
gccaugccaucggc

SEQ ID NO: 1778384 - RNA, 23 nt, Salmonella enterica enterica serovar Typhi Ty2
gccaugcaccacgacggccggac

SEQ ID NO: 1778385 - RNA, 12 nt, Salmonella enterica enterica serovar Typhi Ty2
gccaugauucau

SEQ ID NO: 1778386 - RNA, 16 nt, Salmonella enterica enterica serovar Typhi Ty2
gccaugaugagcgcca

SEQ ID NO: 1778387 - RNA, 13 nt, Salmonella enterica enterica serovar Typhi Ty2
gccauagaaagau

SEQ ID NO: 1778388 - RNA, 17 nt, Salmonella enterica enterica serovar Typhi Ty2
gccauaaucgcuuuuuc

SEQ ID NO: 1778389 - RNA, 13 nt, Salmonella enterica enterica serovar Typhi Ty2
gccauaauuguuc

SEQ ID NO: 1778390 - RNA, 21 nt, Salmonella enterica enterica serovar Typhi Ty2
gccauaacggcuguccauccg

SEQ ID NO: 1778391 - RNA, 17 nt, Salmonella enterica enterica serovar Typhi Ty2
gccauccgacaaccggc

SEQ ID NO: 1778392 - RNA, 16 nt, Salmonella enterica enterica serovar Typhi Ty2
gccaucccugacaaua

SEQ ID NO: 1778393 - RNA, 19 nt, Salmonella enterica enterica serovar Typhi Ty2
gccaucccaugcaccaguc

SEQ ID NO: 1778394 - RNA, 18 nt, Salmonella enterica enterica serovar Typhi Ty2
gccauaucggcacugcuu

SEQ ID NO: 1778395 - RNA, 22 nt, Salmonella enterica enterica serovar Typhi Ty2
gccauaguuugcucaggcuccg

SEQ ID NO: 1778396 - RNA, 18 nt, Salmonella enterica enterica serovar Typhi Ty2
gccauauugccgcacaug

SEQ ID NO: 1778397 - RNA, 13 nt, Salmonella enterica enterica serovar Typhi Ty2
gccauauugcugu

SEQ ID NO: 1778398 - RNA, 18 nt, Salmonella enterica enterica serovar Typhi Ty2
gccaguccugccaccagc

SEQ ID NO: 1778399 - RNA, 17 nt, Salmonella enterica enterica serovar Typhi Ty2
gccagucgcagcaaacg

SEQ ID NO: 1778400 - RNA, 15 nt, Salmonella enterica enterica serovar Typhi Ty2
gccagucgccaggca

SEQ ID NO: 1778401 - RNA, 20 nt, Salmonella enterica enterica serovar Typhi Ty2
gccaguagauggcgcuaaaa

SEQ ID NO: 1778402 - RNA, 18 nt, Salmonella enterica enterica serovar Typhi Ty2
gccaguacagcagcgacg

SEQ ID NO: 1778403 - RNA, 15 nt, Salmonella enterica enterica serovar Typhi Ty2
gccaguaccgccgcc

SEQ ID NO: 1778404 - RNA, 21 nt, Salmonella enterica enterica serovar Typhi Ty2
gccagugggcgucaaaauccc

SEQ ID NO: 1778405 - RNA, 18 nt, Salmonella enterica enterica serovar Typhi Ty2
gccagucuuauuguccug

SEQ ID NO: 1778406 - RNA, 15 nt, Salmonella enterica enterica serovar Typhi Ty2
gccaguuggccggau

SEQ ID NO: 1778407 - RNA, 12 nt, Salmonella enterica enterica serovar Typhi Ty2
gccaguuuacgc

SEQ ID NO: 1778408 - RNA, 20 nt, Salmonella enterica enterica serovar Typhi Ty2
gccaguuuucgacauauuug

SEQ ID NO: 1778409 - RNA, 16 nt, Salmonella enterica enterica serovar Typhi Ty2
gccaguuuuccgccug

SEQ ID NO: 1778410 - RNA, 15 nt, Salmonella enterica enterica serovar Typhi Ty2
gccaguuuguaacca

SEQ ID NO: 1778411 - RNA, 17 nt, Salmonella enterica enterica serovar Typhi Ty2
gccaguucacgccgccg

SEQ ID NO: 1778412 - RNA, 15 nt, Salmonella enterica enterica serovar Typhi Ty2
gccaguucacgccgc

SEQ ID NO: 1778413 - RNA, 17 nt, Salmonella enterica enterica serovar Typhi Ty2
gccaguuaucaggacau

SEQ ID NO: 1778414 - RNA, 20 nt, Salmonella enterica enterica serovar Typhi Ty2
gccagugggcgucaaaaucc

SEQ ID NO: 1778415 - RNA, 13 nt, Salmonella enterica enterica serovar Typhi Ty2
gccagcuccgcgc

SEQ ID NO: 1778416 - RNA, 20 nt, Salmonella enterica enterica serovar Typhi Ty2
gccagcucaugcgcggcggg

SEQ ID NO: 1778417 - RNA, 17 nt, Salmonella enterica enterica serovar Typhi Ty2
gccagcuccugcgggcu

SEQ ID NO: 1778418 - RNA, 21 nt, Salmonella enterica enterica serovar Typhi Ty2
gccaggcauugauaaagcgcu

SEQ ID NO: 1778419 - RNA, 13 nt, Salmonella enterica enterica serovar Typhi Ty2
gccaggcccagcc

SEQ ID NO: 1778420 - RNA, 23 nt, Salmonella enterica enterica serovar Typhi Ty2
gccaggaaccgcggucggcaggc

SEQ ID NO: 1778421 - RNA, 20 nt, Salmonella enterica enterica serovar Typhi Ty2
gccaggaaccgcggucggca

SEQ ID NO: 1778422 - RNA, 19 nt, Salmonella enterica enterica serovar Typhi Ty2
gccaggaagucagcuuccu

SEQ ID NO: 1778423 - RNA, 13 nt, Salmonella enterica enterica serovar Typhi Ty2
gccaggaauaaag

SEQ ID NO: 1778424 - RNA, 17 nt, Salmonella enterica enterica serovar Typhi Ty2
gccaggaauggcuacug

SEQ ID NO: 1778425 - RNA, 12 nt, Salmonella enterica enterica serovar Typhi Ty2
gccagggcggca

SEQ ID NO: 1778426 - RNA, 22 nt, Salmonella enterica enterica serovar Typhi Ty2
gccaggcccgguggcgccacgc

SEQ ID NO: 1778427 - RNA, 16 nt, Salmonella enterica enterica serovar Typhi Ty2
gccaggcccaugauca

SEQ ID NO: 1778428 - RNA, 20 nt, Salmonella enterica enterica serovar Typhi Ty2
gccagggaaauggcgaacag

SEQ ID NO: 1778429 - RNA, 18 nt, Salmonella enterica enterica serovar Typhi Ty2
gccagggcggaagcagau

SEQ ID NO: 1778430 - RNA, 13 nt, Salmonella enterica enterica serovar Typhi Ty2
gccagggcaggca

SEQ ID NO: 1778431 - RNA, 16 nt, Salmonella enterica enterica serovar Typhi Ty2
gccagggcaggcagug

SEQ ID NO: 1778432 - RNA, 14 nt, Salmonella enterica enterica serovar Typhi Ty2
gccagcgcauccac

SEQ ID NO: 1778433 - RNA, 14 nt, Salmonella enterica enterica serovar Typhi Ty2
gccagcgcauacuu

SEQ ID NO: 1778434 - RNA, 15 nt, Salmonella enterica enterica serovar Typhi Ty2
gccagcgccagcagc

SEQ ID NO: 1778435 - RNA, 21 nt, Salmonella enterica enterica serovar Typhi Ty2
gccagcggcguuuuuuccugc

SEQ ID NO: 1778436 - RNA, 14 nt, Salmonella enterica enterica serovar Typhi Ty2
gccagcgcgggcga

SEQ ID NO: 1778437 - RNA, 18 nt, Salmonella enterica enterica serovar Typhi Ty2
gccagcagggucaggaac

SEQ ID NO: 1778438 - RNA, 21 nt, Salmonella enterica enterica serovar Typhi Ty2
gccagccgcucugcuguuccu

SEQ ID NO: 1778439 - RNA, 19 nt, Salmonella enterica enterica serovar Typhi Ty2
gccagccggauacugcgcu

SEQ ID NO: 1778440 - RNA, 16 nt, Salmonella enterica enterica serovar Typhi Ty2
gccagcagguuaaaca

SEQ ID NO: 1778441 - RNA, 21 nt, Salmonella enterica enterica serovar Typhi Ty2
gccagcgauuccgucaggaac

SEQ ID NO: 1778442 - RNA, 14 nt, Salmonella enterica enterica serovar Typhi Ty2
gcccccgcgcaggc

SEQ ID NO: 1778443 - RNA, 17 nt, Salmonella enterica enterica serovar Typhi Ty2
gccccgccacagccgca

SEQ ID NO: 1778444 - RNA, 23 nt, Salmonella enterica enterica serovar Typhi Ty2
gccccagguuugaggcuugcagc

SEQ ID NO: 1778445 - RNA, 16 nt, Salmonella enterica enterica serovar Typhi Ty2
gccccauguggccagc

SEQ ID NO: 1778446 - RNA, 17 nt, Salmonella enterica enterica serovar Typhi Ty2
gccccauguggccagcg

SEQ ID NO: 1778447 - RNA, 20 nt, Salmonella enterica enterica serovar Typhi Ty2
gccccagcaugagccagccc

SEQ ID NO: 1778448 - RNA, 18 nt, Salmonella enterica enterica serovar Typhi Ty2
gccccagcaugagccagc

SEQ ID NO: 1778449 - RNA, 21 nt, Salmonella enterica enterica serovar Typhi Ty2
gccccagcaugagccagcccu

SEQ ID NO: 1778450 - RNA, 17 nt, Salmonella enterica enterica serovar Typhi Ty2
gccccagcccugugccg

SEQ ID NO: 1778451 - RNA, 16 nt, Salmonella enterica enterica serovar Typhi Ty2
gccccagcaccagagc

SEQ ID NO: 1778452 - RNA, 14 nt, Salmonella enterica enterica serovar Typhi Ty2
gccccagcacaauc

SEQ ID NO: 1778453 - RNA, 12 nt, Salmonella enterica enterica serovar Typhi Ty2
gccccagcacca

SEQ ID NO: 1778454 - RNA, 11 nt, Salmonella enterica enterica serovar Typhi Ty2
gccccacuggc

SEQ ID NO: 1778455 - RNA, 13 nt, Salmonella enterica enterica serovar Typhi Ty2
gccccacuggccc

SEQ ID NO: 1778456 - RNA, 12 nt, Salmonella enterica enterica serovar Typhi Ty2
gccccaccgcca

SEQ ID NO: 1778457 - RNA, 17 nt, Salmonella enterica enterica serovar Typhi Ty2
gccccacacggccacca

SEQ ID NO: 1778458 - RNA, 18 nt, Salmonella enterica enterica serovar Typhi Ty2
gccccacacggccaccau

SEQ ID NO: 1778459 - RNA, 18 nt, Salmonella enterica enterica serovar Typhi Ty2
gcccauuccgccaacggu

SEQ ID NO: 1778460 - RNA, 16 nt, Salmonella enterica enterica serovar Typhi Ty2
gcccauuauugaucuc

SEQ ID NO: 1778461 - RNA, 15 nt, Salmonella enterica enterica serovar Typhi Ty2
gcccauucaacgggc

SEQ ID NO: 1778462 - RNA, 17 nt, Salmonella enterica enterica serovar Typhi Ty2
gcccauggaugcgccgc

SEQ ID NO: 1778463 - RNA, 17 nt, Salmonella enterica enterica serovar Typhi Ty2
gcccauggcaggcagca

SEQ ID NO: 1778464 - RNA, 20 nt, Salmonella enterica enterica serovar Typhi Ty2
gcccauggcaggcagcacaa

SEQ ID NO: 1778465 - RNA, 15 nt, Salmonella enterica enterica serovar Typhi Ty2
gcccaugccgcccag

SEQ ID NO: 1778466 - RNA, 13 nt, Salmonella enterica enterica serovar Typhi Ty2
gcccagccugccu

SEQ ID NO: 1778467 - RNA, 14 nt, Salmonella enterica enterica serovar Typhi Ty2
gcccagcccggaaa

SEQ ID NO: 1778468 - RNA, 14 nt, Salmonella enterica enterica serovar Typhi Ty2
gcccagcagcagaa

SEQ ID NO: 1778469 - RNA, 15 nt, Salmonella enterica enterica serovar Typhi Ty2
gcccagcuauuuuuc

SEQ ID NO: 1778470 - RNA, 22 nt, Salmonella enterica enterica serovar Typhi Ty2
gcccagcucaugauagggcagc

SEQ ID NO: 1778471 - RNA, 19 nt, Salmonella enterica enterica serovar Typhi Ty2
gcccagcaacacagccagc

SEQ ID NO: 1778472 - RNA, 18 nt, Salmonella enterica enterica serovar Typhi Ty2
gcccagaaagaucagcag

SEQ ID NO: 1778473 - RNA, 20 nt, Salmonella enterica enterica serovar Typhi Ty2
gcccacuauuuuucauggca

SEQ ID NO: 1778474 - RNA, 16 nt, Salmonella enterica enterica serovar Typhi Ty2
gcccacucauccagca

SEQ ID NO: 1778475 - RNA, 17 nt, Salmonella enterica enterica serovar Typhi Ty2
gcccacuguggcgccac

SEQ ID NO: 1778476 - RNA, 14 nt, Salmonella enterica enterica serovar Typhi Ty2
gccaugcucaucca

SEQ ID NO: 1778477 - RNA, 16 nt, Salmonella enterica enterica serovar Typhi Ty2
gccaugcucauccaac

SEQ ID NO: 1778478 - RNA, 19 nt, Salmonella enterica enterica serovar Typhi Ty2
gccaugcucauccaacugc

SEQ ID NO: 1778479 - RNA, 22 nt, Salmonella enterica enterica serovar Typhi Ty2
gccaugcucauccaacugcgcc

SEQ ID NO: 1778480 - RNA, 18 nt, Salmonella enterica enterica serovar Typhi Ty2
gccaugccuuugacucug

SEQ ID NO: 1778481 - RNA, 19 nt, Salmonella enterica enterica serovar Typhi Ty2
gccaugcuggcucuugguu

SEQ ID NO: 1778482 - RNA, 13 nt, Salmonella enterica enterica serovar Typhi Ty2
gcccaggccugau

SEQ ID NO: 1778483 - RNA, 23 nt, Salmonella enterica enterica serovar Typhi Ty2
gcccaggcggguagucccaggau

SEQ ID NO: 1778484 - RNA, 15 nt, Salmonella enterica enterica serovar Typhi Ty2
gcccauccgucagga

SEQ ID NO: 1778485 - RNA, 14 nt, Salmonella enterica enterica serovar Typhi Ty2
gcccaucgccacag

SEQ ID NO: 1778486 - RNA, 21 nt, Salmonella enterica enterica serovar Typhi Ty2
gcccaucgcgccaugauucau

SEQ ID NO: 1778487 - RNA, 14 nt, Salmonella enterica enterica serovar Typhi Ty2
gcccauccagagca

SEQ ID NO: 1778488 - RNA, 16 nt, Salmonella enterica enterica serovar Typhi Ty2
gcccauccagagcagu

SEQ ID NO: 1778489 - RNA, 13 nt, Salmonella enterica enterica serovar Typhi Ty2
gcccauccagcac

SEQ ID NO: 1778490 - RNA, 17 nt, Salmonella enterica enterica serovar Typhi Ty2
gcccaucaucaucggca

SEQ ID NO: 1778491 - RNA, 19 nt, Salmonella enterica enterica serovar Typhi Ty2
gcccaucagcgccagcccu

SEQ ID NO: 1778492 - RNA, 14 nt, Salmonella enterica enterica serovar Typhi Ty2
gcccaucagcgcca

SEQ ID NO: 1778493 - RNA, 11 nt, Salmonella enterica enterica serovar Typhi Ty2
gcccauaucca

SEQ ID NO: 1778494 - RNA, 11 nt, Salmonella enterica enterica serovar Typhi Ty2
gcccauacugg

SEQ ID NO: 1778495 - RNA, 16 nt, Salmonella enterica enterica serovar Typhi Ty2
gcccauauucuuugcg

SEQ ID NO: 1778496 - RNA, 15 nt, Salmonella enterica enterica serovar Typhi Ty2
gcccauauccagcuc

SEQ ID NO: 1778497 - RNA, 19 nt, Salmonella enterica enterica serovar Typhi Ty2
gcccauaccacaacagaau

SEQ ID NO: 1778498 - RNA, 19 nt, Salmonella enterica enterica serovar Typhi Ty2
gcccucuuuaucaaacaaa

SEQ ID NO: 1778499 - RNA, 19 nt, Salmonella enterica enterica serovar Typhi Ty2
gcccucuuccagcgccaaa

SEQ ID NO: 1778500 - RNA, 12 nt, Salmonella enterica enterica serovar Typhi Ty2
gcccucugucca

SEQ ID NO: 1778501 - RNA, 23 nt, Salmonella enterica enterica serovar Typhi Ty2
gcccugaagggcggcuggauaaa

SEQ ID NO: 1778502 - RNA, 15 nt, Salmonella enterica enterica serovar Typhi Ty2
gcccguuuuuuccag

SEQ ID NO: 1778503 - RNA, 18 nt, Salmonella enterica enterica serovar Typhi Ty2
gcccguuuuuuccagcgc

SEQ ID NO: 1778504 - RNA, 19 nt, Salmonella enterica enterica serovar Typhi Ty2
gcccguuuuaaugaacagc

SEQ ID NO: 1778505 - RNA, 15 nt, Salmonella enterica enterica serovar Typhi Ty2
gcccuaacaggcgca

SEQ ID NO: 1778506 - RNA, 18 nt, Salmonella enterica enterica serovar Typhi Ty2
gcccuaaaaauagcacca

SEQ ID NO: 1778507 - RNA, 21 nt, Salmonella enterica enterica serovar Typhi Ty2
gcccgcuaucaccgcccaaug

SEQ ID NO: 1778508 - RNA, 22 nt, Salmonella enterica enterica serovar Typhi Ty2
gcccgcuucauuggcgucugcu

SEQ ID NO: 1778509 - RNA, 21 nt, Salmonella enterica enterica serovar Typhi Ty2
gcccggcguucucccgggccg

SEQ ID NO: 1778510 - RNA, 21 nt, Salmonella enterica enterica serovar Typhi Ty2
gcccgucaucuucuaccugga

SEQ ID NO: 1778511 - RNA, 12 nt, Salmonella enterica enterica serovar Typhi Ty2
gcccgucagggg

SEQ ID NO: 1778512 - RNA, 16 nt, Salmonella enterica enterica serovar Typhi Ty2
gcccguagcucagcug

SEQ ID NO: 1778513 - RNA, 17 nt, Salmonella enterica enterica serovar Typhi Ty2
gcccgcguaacagcggu

SEQ ID NO: 1778514 - RNA, 16 nt, Salmonella enterica enterica serovar Typhi Ty2
gcccgccgcaaaaaau

SEQ ID NO: 1778515 - RNA, 13 nt, Salmonella enterica enterica serovar Typhi Ty2
gcccgccagcacc

SEQ ID NO: 1778516 - RNA, 18 nt, Salmonella enterica enterica serovar Typhi Ty2
gcccgccgccugaugcug

SEQ ID NO: 1778517 - RNA, 21 nt, Salmonella enterica enterica serovar Typhi Ty2
gcccgacgcgccacuuccagc

SEQ ID NO: 1778518 - RNA, 18 nt, Salmonella enterica enterica serovar Typhi Ty2
gcccgagcgacgcccugc

SEQ ID NO: 1778519 - RNA, 16 nt, Salmonella enterica enterica serovar Typhi Ty2
gcccgcauucgcggca

SEQ ID NO: 1778520 - RNA, 12 nt, Salmonella enterica enterica serovar Typhi Ty2
gccccggcggcg

SEQ ID NO: 1778521 - RNA, 12 nt, Salmonella enterica enterica serovar Typhi Ty2
gccccgccgcgc

SEQ ID NO: 1778522 - RNA, 22 nt, Salmonella enterica enterica serovar Typhi Ty2
gccccgcuucccgaaaggaagc

SEQ ID NO: 1778523 - RNA, 15 nt, Salmonella enterica enterica serovar Typhi Ty2
gccccugggcgaaaa

SEQ ID NO: 1778524 - RNA, 17 nt, Salmonella enterica enterica serovar Typhi Ty2
gccccggucaacgcgcc

SEQ ID NO: 1778525 - RNA, 18 nt, Salmonella enterica enterica serovar Typhi Ty2
gccccggucaacgcgccg

SEQ ID NO: 1778526 - RNA, 14 nt, Salmonella enterica enterica serovar Typhi Ty2
gccccugcuggcga

SEQ ID NO: 1778527 - RNA, 14 nt, Salmonella enterica enterica serovar Typhi Ty2
gccccuuccgccac

SEQ ID NO: 1778528 - RNA, 17 nt, Salmonella enterica enterica serovar Typhi Ty2
gccccuuccgccacggc

SEQ ID NO: 1778529 - RNA, 14 nt, Salmonella enterica enterica serovar Typhi Ty2
gcaaccgccugcac

SEQ ID NO: 1778530 - RNA, 18 nt, Salmonella enterica enterica serovar Typhi Ty2
gcaaccgcucuccgcaau

SEQ ID NO: 1778531 - RNA, 15 nt, Salmonella enterica enterica serovar Typhi Ty2
gcaacccgcuccaga

SEQ ID NO: 1778532 - RNA, 21 nt, Salmonella enterica enterica serovar Typhi Ty2
gcaacccugccgucucaacca

SEQ ID NO: 1778533 - RNA, 15 nt, Salmonella enterica enterica serovar Typhi Ty2
gcaacccuuuuucaa

SEQ ID NO: 1778534 - RNA, 13 nt, Salmonella enterica enterica serovar Typhi Ty2
gcaacccauacag

SEQ ID NO: 1778535 - RNA, 21 nt, Salmonella enterica enterica serovar Typhi Ty2
gcaaccccuugcggugcagca

SEQ ID NO: 1778536 - RNA, 16 nt, Salmonella enterica enterica serovar Typhi Ty2
gcaaccguccgcucac

SEQ ID NO: 1778537 - RNA, 19 nt, Salmonella enterica enterica serovar Typhi Ty2
gcaaccgguacucuuccag

SEQ ID NO: 1778538 - RNA, 14 nt, Salmonella enterica enterica serovar Typhi Ty2
gcaaccugagcgcg

SEQ ID NO: 1778539 - RNA, 18 nt, Salmonella enterica enterica serovar Typhi Ty2
gcaaccugacgcugcgcc

SEQ ID NO: 1778540 - RNA, 14 nt, Salmonella enterica enterica serovar Typhi Ty2
gcaaccuuacguuu

SEQ ID NO: 1778541 - RNA, 21 nt, Salmonella enterica enterica serovar Typhi Ty2
gcaacgagaacccacuuugcu

SEQ ID NO: 1778542 - RNA, 19 nt, Salmonella enterica enterica serovar Typhi Ty2
gcaacggccagcgcaggcu

SEQ ID NO: 1778543 - RNA, 23 nt, Salmonella enterica enterica serovar Typhi Ty2
gcaacgggcagucuggcggcagc

SEQ ID NO: 1778544 - RNA, 15 nt, Salmonella enterica enterica serovar Typhi Ty2
gcaacgggcagucug

SEQ ID NO: 1778545 - RNA, 21 nt, Salmonella enterica enterica serovar Typhi Ty2
gcaacggguuagacucagcga

SEQ ID NO: 1778546 - RNA, 18 nt, Salmonella enterica enterica serovar Typhi Ty2
gcaacggaaggaaauaac

SEQ ID NO: 1778547 - RNA, 15 nt, Salmonella enterica enterica serovar Typhi Ty2
gcaacgcuuccaccu

SEQ ID NO: 1778548 - RNA, 22 nt, Salmonella enterica enterica serovar Typhi Ty2
gcaacgcuuuagugccgccauu

SEQ ID NO: 1778549 - RNA, 22 nt, Salmonella enterica enterica serovar Typhi Ty2
gcaacgauucguaaauugacug

SEQ ID NO: 1778550 - RNA, 21 nt, Salmonella enterica enterica serovar Typhi Ty2
gcaacgaucccuaauaaaaua

SEQ ID NO: 1778551 - RNA, 21 nt, Salmonella enterica enterica serovar Typhi Ty2
gcaacgccaucagcaaaauac

SEQ ID NO: 1778552 - RNA, 23 nt, Salmonella enterica enterica serovar Typhi Ty2
gcaacgccguacuccagcccauc

SEQ ID NO: 1778553 - RNA, 15 nt, Salmonella enterica enterica serovar Typhi Ty2
gcaacgccggugccu

SEQ ID NO: 1778554 - RNA, 19 nt, Salmonella enterica enterica serovar Typhi Ty2
gcaacgccuccagcgggcu

SEQ ID NO: 1778555 - RNA, 18 nt, Salmonella enterica enterica serovar Typhi Ty2
gcaacaguugcuggagca

SEQ ID NO: 1778556 - RNA, 22 nt, Salmonella enterica enterica serovar Typhi Ty2
gcaacagggugauuucgcccgc

SEQ ID NO: 1778557 - RNA, 13 nt, Salmonella enterica enterica serovar Typhi Ty2
gcaacaugcccac

SEQ ID NO: 1778558 - RNA, 16 nt, Salmonella enterica enterica serovar Typhi Ty2
gcaacaugcccaccgg

SEQ ID NO: 1778559 - RNA, 20 nt, Salmonella enterica enterica serovar Typhi Ty2
gcaacagugggcuaugaaga

SEQ ID NO: 1778560 - RNA, 17 nt, Salmonella enterica enterica serovar Typhi Ty2
gcaacauaaauaaacag

SEQ ID NO: 1778561 - RNA, 19 nt, Salmonella enterica enterica serovar Typhi Ty2
gcaacauucugcuuccaga

SEQ ID NO: 1778562 - RNA, 14 nt, Salmonella enterica enterica serovar Typhi Ty2
gcaacauggacacc

SEQ ID NO: 1778563 - RNA, 16 nt, Salmonella enterica enterica serovar Typhi Ty2
gcaacauggacaccgg

SEQ ID NO: 1778564 - RNA, 17 nt, Salmonella enterica enterica serovar Typhi Ty2
gcaacaugaccagcgca

SEQ ID NO: 1778565 - RNA, 15 nt, Salmonella enterica enterica serovar Typhi Ty2
gcaacauuacugacc

SEQ ID NO: 1778566 - RNA, 22 nt, Salmonella enterica enterica serovar Typhi Ty2
gcaacagccauuuuaaaaauau

SEQ ID NO: 1778567 - RNA, 18 nt, Salmonella enterica enterica serovar Typhi Ty2
gcaacagcaagucgcggg

SEQ ID NO: 1778568 - RNA, 18 nt, Salmonella enterica enterica serovar Typhi Ty2
gcaacacagccagcacga

SEQ ID NO: 1778569 - RNA, 11 nt, Salmonella enterica enterica serovar Typhi Ty2
gcaacaacagu

SEQ ID NO: 1778570 - RNA, 20 nt, Salmonella enterica enterica serovar Typhi Ty2
gcaaaacuaaacccggccug

SEQ ID NO: 1778571 - RNA, 19 nt, Salmonella enterica enterica serovar Typhi Ty2
gcaaaacgcauccagcgca

SEQ ID NO: 1778572 - RNA, 17 nt, Salmonella enterica enterica serovar Typhi Ty2
gcaaaacgggcggcggc

SEQ ID NO: 1778573 - RNA, 21 nt, Salmonella enterica enterica serovar Typhi Ty2
gcaaucaguacgcgcgcggcg

SEQ ID NO: 1778574 - RNA, 20 nt, Salmonella enterica enterica serovar Typhi Ty2
gcaaucaguacgcgcgcggc

SEQ ID NO: 1778575 - RNA, 18 nt, Salmonella enterica enterica serovar Typhi Ty2
gcaaucauccugauuuua

SEQ ID NO: 1778576 - RNA, 14 nt, Salmonella enterica enterica serovar Typhi Ty2
gcaauaccuguaaa

SEQ ID NO: 1778577 - RNA, 21 nt, Salmonella enterica enterica serovar Typhi Ty2
gcaaucgacguugaucgccau

SEQ ID NO: 1778578 - RNA, 13 nt, Salmonella enterica enterica serovar Typhi Ty2
gcaaggccgagcg

SEQ ID NO: 1778579 - RNA, 18 nt, Salmonella enterica enterica serovar Typhi Ty2
gcaaguugcgccacugcc

SEQ ID NO: 1778580 - RNA, 17 nt, Salmonella enterica enterica serovar Typhi Ty2
gcaauaacaccggcggc

SEQ ID NO: 1778581 - RNA, 24 nt, Salmonella enterica enterica serovar Typhi Ty2
gcaauaaacuaaguaaggaggaau

SEQ ID NO: 1778582 - RNA, 22 nt, Salmonella enterica enterica serovar Typhi Ty2
gcaauaaacucccgcauauauu

SEQ ID NO: 1778583 - RNA, 18 nt, Salmonella enterica enterica serovar Typhi Ty2
gcaauaaagcagggcggc

SEQ ID NO: 1778584 - RNA, 14 nt, Salmonella enterica enterica serovar Typhi Ty2
gcaauaaaaggaau

SEQ ID NO: 1778585 - RNA, 17 nt, Salmonella enterica enterica serovar Typhi Ty2
gcaacugccggcuuacc

SEQ ID NO: 1778586 - RNA, 19 nt, Salmonella enterica enterica serovar Typhi Ty2
gcaacugccggcuuaccag

SEQ ID NO: 1778587 - RNA, 13 nt, Salmonella enterica enterica serovar Typhi Ty2
gcaacugcugcgc

SEQ ID NO: 1778588 - RNA, 22 nt, Salmonella enterica enterica serovar Typhi Ty2
gcaacguaaucccgccagccuu

SEQ ID NO: 1778589 - RNA, 15 nt, Salmonella enterica enterica serovar Typhi Ty2
gcaacguccgcagcc

SEQ ID NO: 1778590 - RNA, 18 nt, Salmonella enterica enterica serovar Typhi Ty2
gcaacgugaacugcgccu

SEQ ID NO: 1778591 - RNA, 14 nt, Salmonella enterica enterica serovar Typhi Ty2
gcaagagaaauaac

SEQ ID NO: 1778592 - RNA, 14 nt, Salmonella enterica enterica serovar Typhi Ty2
gcaagagauucagg

SEQ ID NO: 1778593 - RNA, 14 nt, Salmonella enterica enterica serovar Typhi Ty2
gcaagaccuauccg

SEQ ID NO: 1778594 - RNA, 18 nt, Salmonella enterica enterica serovar Typhi Ty2
gcaagacccgaaccugcg

SEQ ID NO: 1778595 - RNA, 16 nt, Salmonella enterica enterica serovar Typhi Ty2
gcaagaauuaaauaac

SEQ ID NO: 1778596 - RNA, 22 nt, Salmonella enterica enterica serovar Typhi Ty2
gcaacuguuuuaccaaaucaau

SEQ ID NO: 1778597 - RNA, 15 nt, Salmonella enterica enterica serovar Typhi Ty2
gcaagcucagcggca

SEQ ID NO: 1778598 - RNA, 19 nt, Salmonella enterica enterica serovar Typhi Ty2
gcaagcguaagagaacagg

SEQ ID NO: 1778599 - RNA, 18 nt, Salmonella enterica enterica serovar Typhi Ty2
gcaaggaaauauuaauua

SEQ ID NO: 1778600 - RNA, 19 nt, Salmonella enterica enterica serovar Typhi Ty2
gcaaggaaaaccaguaacg

SEQ ID NO: 1778601 - RNA, 15 nt, Salmonella enterica enterica serovar Typhi Ty2
gcaccagcaaugaua

SEQ ID NO: 1778602 - RNA, 19 nt, Salmonella enterica enterica serovar Typhi Ty2
gcacauguuucagcaccuc

SEQ ID NO: 1778603 - RNA, 13 nt, Salmonella enterica enterica serovar Typhi Ty2
gcacauuacaggc

SEQ ID NO: 1778604 - RNA, 17 nt, Salmonella enterica enterica serovar Typhi Ty2
gcacauucgauaaccgc

SEQ ID NO: 1778605 - RNA, 13 nt, Salmonella enterica enterica serovar Typhi Ty2
gcaccagccaggc

SEQ ID NO: 1778606 - RNA, 14 nt, Salmonella enterica enterica serovar Typhi Ty2
gcaccagccaggcg

SEQ ID NO: 1778607 - RNA, 20 nt, Salmonella enterica enterica serovar Typhi Ty2
gcaccauaccuauaaaaaug

SEQ ID NO: 1778608 - RNA, 24 nt, Salmonella enterica enterica serovar Typhi Ty2
gcaccaucaacgccggugauuuua

SEQ ID NO: 1778609 - RNA, 22 nt, Salmonella enterica enterica serovar Typhi Ty2
gcaccaucuuuuccggcagggu

SEQ ID NO: 1778610 - RNA, 17 nt, Salmonella enterica enterica serovar Typhi Ty2
gcaccauucccacgcau

SEQ ID NO: 1778611 - RNA, 20 nt, Salmonella enterica enterica serovar Typhi Ty2
gcacaccggccauugccgcg

SEQ ID NO: 1778612 - RNA, 19 nt, Salmonella enterica enterica serovar Typhi Ty2
gcacaccgccguaaaggga

SEQ ID NO: 1778613 - RNA, 21 nt, Salmonella enterica enterica serovar Typhi Ty2
gcacaacgcauuggcaauuaa

SEQ ID NO: 1778614 - RNA, 16 nt, Salmonella enterica enterica serovar Typhi Ty2
gcacaacgaguccccu

SEQ ID NO: 1778615 - RNA, 15 nt, Salmonella enterica enterica serovar Typhi Ty2
gcacaaccuggcuug

SEQ ID NO: 1778616 - RNA, 12 nt, Salmonella enterica enterica serovar Typhi Ty2
gcaaugccacca

SEQ ID NO: 1778617 - RNA, 15 nt, Salmonella enterica enterica serovar Typhi Ty2
gcaaugccaccacac

SEQ ID NO: 1778618 - RNA, 18 nt, Salmonella enterica enterica serovar Typhi Ty2
gcaaugccuaccggcggc

SEQ ID NO: 1778619 - RNA, 19 nt, Salmonella enterica enterica serovar Typhi Ty2
gcaaugagcggccagcggg

SEQ ID NO: 1778620 - RNA, 19 nt, Salmonella enterica enterica serovar Typhi Ty2
gcacagccaguaagaacga

SEQ ID NO: 1778621 - RNA, 15 nt, Salmonella enterica enterica serovar Typhi Ty2
gcacagcacauagaa

SEQ ID NO: 1778622 - RNA, 18 nt, Salmonella enterica enterica serovar Typhi Ty2
gcacacgaaauccaaaca

SEQ ID NO: 1778623 - RNA, 20 nt, Salmonella enterica enterica serovar Typhi Ty2
gcacagguacaggccgccgc

SEQ ID NO: 1778624 - RNA, 18 nt, Salmonella enterica enterica serovar Typhi Ty2
gcacagggugaaaucacg

SEQ ID NO: 1778625 - RNA, 21 nt, Salmonella enterica enterica serovar Typhi Ty2
gcacagguacaggccgccgcc

SEQ ID NO: 1778626 - RNA, 18 nt, Salmonella enterica enterica serovar Typhi Ty2
gcacaguacgcccggcgg

SEQ ID NO: 1778627 - RNA, 16 nt, Salmonella enterica enterica serovar Typhi Ty2
gcacagcgcagcaacg

SEQ ID NO: 1778628 - RNA, 20 nt, Salmonella enterica enterica serovar Typhi Ty2
gcaccgcgaccaguucaccg

SEQ ID NO: 1778629 - RNA, 16 nt, Salmonella enterica enterica serovar Typhi Ty2
gcaccgcuaaaaaaca

SEQ ID NO: 1778630 - RNA, 22 nt, Salmonella enterica enterica serovar Typhi Ty2
gcacccaccaucacuuccaucc

SEQ ID NO: 1778631 - RNA, 14 nt, Salmonella enterica enterica serovar Typhi Ty2
gcacccaucuuuac

SEQ ID NO: 1778632 - RNA, 21 nt, Salmonella enterica enterica serovar Typhi Ty2
gcaccccucuucuuuaagaac

SEQ ID NO: 1778633 - RNA, 21 nt, Salmonella enterica enterica serovar Typhi Ty2
gcaccucaauaugaaauucuu

SEQ ID NO: 1778634 - RNA, 15 nt, Salmonella enterica enterica serovar Typhi Ty2
gcaccggaacagaag

SEQ ID NO: 1778635 - RNA, 16 nt, Salmonella enterica enterica serovar Typhi Ty2
gcacgacagugcuaua

SEQ ID NO: 1778636 - RNA, 13 nt, Salmonella enterica enterica serovar Typhi Ty2
gcacgacagugcu

SEQ ID NO: 1778637 - RNA, 17 nt, Salmonella enterica enterica serovar Typhi Ty2
gcacgacagagaucagg

SEQ ID NO: 1778638 - RNA, 16 nt, Salmonella enterica enterica serovar Typhi Ty2
gcacgacacaaaagca

SEQ ID NO: 1778639 - RNA, 15 nt, Salmonella enterica enterica serovar Typhi Ty2
gcacgacacaaaagc

SEQ ID NO: 1778640 - RNA, 18 nt, Salmonella enterica enterica serovar Typhi Ty2
gcacgaacauaccggagc

SEQ ID NO: 1778641 - RNA, 22 nt, Salmonella enterica enterica serovar Typhi Ty2
gcacgaacauaccggagccugg

SEQ ID NO: 1778642 - RNA, 17 nt, Salmonella enterica enterica serovar Typhi Ty2
gcaccuggguauuccac

SEQ ID NO: 1778643 - RNA, 22 nt, Salmonella enterica enterica serovar Typhi Ty2
gcacgcgacgcgccagccagcg

SEQ ID NO: 1778644 - RNA, 16 nt, Salmonella enterica enterica serovar Typhi Ty2
gcacgccacauugacc

SEQ ID NO: 1778645 - RNA, 16 nt, Salmonella enterica enterica serovar Typhi Ty2
gcagguggaucugaau

SEQ ID NO: 1778646 - RNA, 20 nt, Salmonella enterica enterica serovar Typhi Ty2
gcagguuacucacugccgcc

SEQ ID NO: 1778647 - RNA, 22 nt, Salmonella enterica enterica serovar Typhi Ty2
gcagguuacucuuccaccaucc

SEQ ID NO: 1778648 - RNA, 20 nt, Salmonella enterica enterica serovar Typhi Ty2
gcaguaacgcacuuuuccag

SEQ ID NO: 1778649 - RNA, 18 nt, Salmonella enterica enterica serovar Typhi Ty2
gcaggucgcguagcuuuu

SEQ ID NO: 1778650 - RNA, 15 nt, Salmonella enterica enterica serovar Typhi Ty2
gcaggugcggcuggg

SEQ ID NO: 1778651 - RNA, 18 nt, Salmonella enterica enterica serovar Typhi Ty2
gcagguagucauauucac

SEQ ID NO: 1778652 - RNA, 22 nt, Salmonella enterica enterica serovar Typhi Ty2
gcagguaguaaccccaguagcc

SEQ ID NO: 1778653 - RNA, 17 nt, Salmonella enterica enterica serovar Typhi Ty2
gcaggucaaagacgaaa

SEQ ID NO: 1778654 - RNA, 21 nt, Salmonella enterica enterica serovar Typhi Ty2
gcagguaacgacuacuuccag

SEQ ID NO: 1778655 - RNA, 14 nt, Salmonella enterica enterica serovar Typhi Ty2
gcagggugaagagu

SEQ ID NO: 1778656 - RNA, 20 nt, Salmonella enterica enterica serovar Typhi Ty2
gcaggggcucuaaaaaggaa

SEQ ID NO: 1778657 - RNA, 13 nt, Salmonella enterica enterica serovar Typhi Ty2
gcauaaauaaugc

SEQ ID NO: 1778658 - RNA, 18 nt, Salmonella enterica enterica serovar Typhi Ty2
gcauaaccgcagcgcggc

SEQ ID NO: 1778659 - RNA, 19 nt, Salmonella enterica enterica serovar Typhi Ty2
gcauaaccgcgcguaaauc

SEQ ID NO: 1778660 - RNA, 16 nt, Salmonella enterica enterica serovar Typhi Ty2
gcaguucccuacucuc

SEQ ID NO: 1778661 - RNA, 12 nt, Salmonella enterica enterica serovar Typhi Ty2
gcaguucaauau

SEQ ID NO: 1778662 - RNA, 17 nt, Salmonella enterica enterica serovar Typhi Ty2
gcaguugcagcguacgg

SEQ ID NO: 1778663 - RNA, 18 nt, Salmonella enterica enterica serovar Typhi Ty2
gcaguugggcgcgcgacu

SEQ ID NO: 1778664 - RNA, 19 nt, Salmonella enterica enterica serovar Typhi Ty2
gcagugaggauaaggcaag

SEQ ID NO: 1778665 - RNA, 16 nt, Salmonella enterica enterica serovar Typhi Ty2
gcagugacauuuaucu

SEQ ID NO: 1778666 - RNA, 15 nt, Salmonella enterica enterica serovar Typhi Ty2
gcagugacagaggaa

SEQ ID NO: 1778667 - RNA, 19 nt, Salmonella enterica enterica serovar Typhi Ty2
gcaguaacgcacuuuucca

SEQ ID NO: 1778668 - RNA, 15 nt, Salmonella enterica enterica serovar Typhi Ty2
gcagucuggcggcag

SEQ ID NO: 1778669 - RNA, 13 nt, Salmonella enterica enterica serovar Typhi Ty2
gcagcugggccug

SEQ ID NO: 1778670 - RNA, 16 nt, Salmonella enterica enterica serovar Typhi Ty2
gcagcugggccugcuc

SEQ ID NO: 1778671 - RNA, 15 nt, Salmonella enterica enterica serovar Typhi Ty2
gcagcuuaucuuuuu

SEQ ID NO: 1778672 - RNA, 13 nt, Salmonella enterica enterica serovar Typhi Ty2
gcagcuucagcca

SEQ ID NO: 1778673 - RNA, 12 nt, Salmonella enterica enterica serovar Typhi Ty2
gcagcuuccagc

SEQ ID NO: 1778674 - RNA, 15 nt, Salmonella enterica enterica serovar Typhi Ty2
gcaggaaguuuucug

SEQ ID NO: 1778675 - RNA, 16 nt, Salmonella enterica enterica serovar Typhi Ty2
gcaggaaggaauuaug

SEQ ID NO: 1778676 - RNA, 12 nt, Salmonella enterica enterica serovar Typhi Ty2
gcaggacccgag

SEQ ID NO: 1778677 - RNA, 14 nt, Salmonella enterica enterica serovar Typhi Ty2
gcaggacagcgaca

SEQ ID NO: 1778678 - RNA, 19 nt, Salmonella enterica enterica serovar Typhi Ty2
gcagcguugcuuuguaugu

SEQ ID NO: 1778679 - RNA, 21 nt, Salmonella enterica enterica serovar Typhi Ty2
gcagcuccuuuuaauaaagaa

SEQ ID NO: 1778680 - RNA, 23 nt, Salmonella enterica enterica serovar Typhi Ty2
gcagcuccuuuuaauaaagaaag

SEQ ID NO: 1778681 - RNA, 21 nt, Salmonella enterica enterica serovar Typhi Ty2
gcaggauuuguaucacaauca

SEQ ID NO: 1778682 - RNA, 18 nt, Salmonella enterica enterica serovar Typhi Ty2
gcaggagcgcgacgacgg

SEQ ID NO: 1778683 - RNA, 20 nt, Salmonella enterica enterica serovar Typhi Ty2
gcaggagcggagagagcgcu

SEQ ID NO: 1778684 - RNA, 19 nt, Salmonella enterica enterica serovar Typhi Ty2
gcaggagggagguucgccu

SEQ ID NO: 1778685 - RNA, 18 nt, Salmonella enterica enterica serovar Typhi Ty2
gcaggauccccaucccaa

SEQ ID NO: 1778686 - RNA, 23 nt, Salmonella enterica enterica serovar Typhi Ty2
gcaggaugucgauaauacagccu

SEQ ID NO: 1778687 - RNA, 16 nt, Salmonella enterica enterica serovar Typhi Ty2
gcaggaugcgcugcgc

SEQ ID NO: 1778688 - RNA, 23 nt, Salmonella enterica enterica serovar Typhi Ty2
gcaggaucuccagaucgccacga

SEQ ID NO: 1778689 - RNA, 20 nt, Salmonella enterica enterica serovar Typhi Ty2
gcaggcgcgaccucaucaaa

SEQ ID NO: 1778690 - RNA, 17 nt, Salmonella enterica enterica serovar Typhi Ty2
gcaggcucaccagccca

SEQ ID NO: 1778691 - RNA, 23 nt, Salmonella enterica enterica serovar Typhi Ty2
gcaggcggcaaaaaaugcauuga

SEQ ID NO: 1778692 - RNA, 14 nt, Salmonella enterica enterica serovar Typhi Ty2
gcaggcucaccagc

SEQ ID NO: 1778693 - RNA, 24 nt, Salmonella enterica enterica serovar Typhi Ty2
gcaggcuugcccauucgccgacgc

SEQ ID NO: 1778694 - RNA, 22 nt, Salmonella enterica enterica serovar Typhi Ty2
gcaggcuuccacgcacgccggc

SEQ ID NO: 1778695 - RNA, 16 nt, Salmonella enterica enterica serovar Typhi Ty2
gcaggcucuuuuucuc

SEQ ID NO: 1778696 - RNA, 17 nt, Salmonella enterica enterica serovar Typhi Ty2
gcaggcuggagagcaac

SEQ ID NO: 1778697 - RNA, 12 nt, Salmonella enterica enterica serovar Typhi Ty2
gcagcagcuuca

SEQ ID NO: 1778698 - RNA, 20 nt, Salmonella enterica enterica serovar Typhi Ty2
gcagcacuucagaacggcua

SEQ ID NO: 1778699 - RNA, 22 nt, Salmonella enterica enterica serovar Typhi Ty2
gcagcagcgcuuucuucuucac

SEQ ID NO: 1778700 - RNA, 17 nt, Salmonella enterica enterica serovar Typhi Ty2
gcagcaccgguuuuucc

SEQ ID NO: 1778701 - RNA, 21 nt, Salmonella enterica enterica serovar Typhi Ty2
gcagaugguauaaaucacgcu

SEQ ID NO: 1778702 - RNA, 20 nt, Salmonella enterica enterica serovar Typhi Ty2
gcagcaacugauucaaaagg

SEQ ID NO: 1778703 - RNA, 22 nt, Salmonella enterica enterica serovar Typhi Ty2
gcagaucccagguaaccgcuaa

SEQ ID NO: 1778704 - RNA, 13 nt, Salmonella enterica enterica serovar Typhi Ty2
gcagauccgcgau

SEQ ID NO: 1778705 - RNA, 14 nt, Salmonella enterica enterica serovar Typhi Ty2
gcagauaucuucca

SEQ ID NO: 1778706 - RNA, 17 nt, Salmonella enterica enterica serovar Typhi Ty2
gcagauagcccgccagc

SEQ ID NO: 1778707 - RNA, 23 nt, Salmonella enterica enterica serovar Typhi Ty2
gcagauagcccgccagcaccagc

SEQ ID NO: 1778708 - RNA, 23 nt, Salmonella enterica enterica serovar Typhi Ty2
gcagaucugucgccaugaccugg

SEQ ID NO: 1778709 - RNA, 18 nt, Salmonella enterica enterica serovar Typhi Ty2
gcagaucugucgccauga

SEQ ID NO: 1778710 - RNA, 18 nt, Salmonella enterica enterica serovar Typhi Ty2
gcagaucguuuacgaccu

SEQ ID NO: 1778711 - RNA, 18 nt, Salmonella enterica enterica serovar Typhi Ty2
gcagaucgcgggcaauca

SEQ ID NO: 1778712 - RNA, 21 nt, Salmonella enterica enterica serovar Typhi Ty2
gcagaucggccuguuuuucug

SEQ ID NO: 1778713 - RNA, 14 nt, Salmonella enterica enterica serovar Typhi Ty2
gcagaucgccugga

SEQ ID NO: 1778714 - RNA, 19 nt, Salmonella enterica enterica serovar Typhi Ty2
gcagaugcugcguuuuuuc

SEQ ID NO: 1778715 - RNA, 16 nt, Salmonella enterica enterica serovar Typhi Ty2
gcagccgguauccagc

SEQ ID NO: 1778716 - RNA, 17 nt, Salmonella enterica enterica serovar Typhi Ty2
gcagccgccauccggca

SEQ ID NO: 1778717 - RNA, 14 nt, Salmonella enterica enterica serovar Typhi Ty2
gcagccgccaccac

SEQ ID NO: 1778718 - RNA, 12 nt, Salmonella enterica enterica serovar Typhi Ty2
gcagccgccacc

SEQ ID NO: 1778719 - RNA, 16 nt, Salmonella enterica enterica serovar Typhi Ty2
gcagcgaaaauccagu

SEQ ID NO: 1778720 - RNA, 17 nt, Salmonella enterica enterica serovar Typhi Ty2
gcagcgacgcauugaga

SEQ ID NO: 1778721 - RNA, 14 nt, Salmonella enterica enterica serovar Typhi Ty2
gcagccucguccug

SEQ ID NO: 1778722 - RNA, 13 nt, Salmonella enterica enterica serovar Typhi Ty2
gcagccugccgca

SEQ ID NO: 1778723 - RNA, 19 nt, Salmonella enterica enterica serovar Typhi Ty2
gcagccaggccauuuuuuc

SEQ ID NO: 1778724 - RNA, 21 nt, Salmonella enterica enterica serovar Typhi Ty2
gcagccaggcaaagccccagu

SEQ ID NO: 1778725 - RNA, 19 nt, Salmonella enterica enterica serovar Typhi Ty2
gcagccaggcaaagcccca

SEQ ID NO: 1778726 - RNA, 17 nt, Salmonella enterica enterica serovar Typhi Ty2
gcagccaugccagcgcg

SEQ ID NO: 1778727 - RNA, 20 nt, Salmonella enterica enterica serovar Typhi Ty2
gcagccccauuugccgugcc

SEQ ID NO: 1778728 - RNA, 18 nt, Salmonella enterica enterica serovar Typhi Ty2
gcagccccggcauccagu

SEQ ID NO: 1778729 - RNA, 23 nt, Salmonella enterica enterica serovar Typhi Ty2
gcagccccaguugguuguagcac

SEQ ID NO: 1778730 - RNA, 14 nt, Salmonella enterica enterica serovar Typhi Ty2
gcagccccagcgcc

SEQ ID NO: 1778731 - RNA, 16 nt, Salmonella enterica enterica serovar Typhi Ty2
gcagccagaacucauc

SEQ ID NO: 1778732 - RNA, 13 nt, Salmonella enterica enterica serovar Typhi Ty2
gcagccacgccga

SEQ ID NO: 1778733 - RNA, 21 nt, Salmonella enterica enterica serovar Typhi Ty2
gcagcagggauauacaaauau

SEQ ID NO: 1778734 - RNA, 17 nt, Salmonella enterica enterica serovar Typhi Ty2
gcacuugagaaauuauu

SEQ ID NO: 1778735 - RNA, 20 nt, Salmonella enterica enterica serovar Typhi Ty2
gcacgcgucaucggcgcgcu

SEQ ID NO: 1778736 - RNA, 21 nt, Salmonella enterica enterica serovar Typhi Ty2
gcacgcgggccaauccagcua

SEQ ID NO: 1778737 - RNA, 15 nt, Salmonella enterica enterica serovar Typhi Ty2
gcacuuuuccagcca

SEQ ID NO: 1778738 - RNA, 12 nt, Salmonella enterica enterica serovar Typhi Ty2
gcacuuucauug

SEQ ID NO: 1778739 - RNA, 16 nt, Salmonella enterica enterica serovar Typhi Ty2
gcacuuucagaccacu

SEQ ID NO: 1778740 - RNA, 19 nt, Salmonella enterica enterica serovar Typhi Ty2
gcagaaucaggcacaaccc

SEQ ID NO: 1778741 - RNA, 16 nt, Salmonella enterica enterica serovar Typhi Ty2
gcagaauauuuuucuc

SEQ ID NO: 1778742 - RNA, 18 nt, Salmonella enterica enterica serovar Typhi Ty2
gcagaaucauuaauacac

SEQ ID NO: 1778743 - RNA, 15 nt, Salmonella enterica enterica serovar Typhi Ty2
gcagaagacagaagc

SEQ ID NO: 1778744 - RNA, 20 nt, Salmonella enterica enterica serovar Typhi Ty2
gcagaaauaaaauacuucca

SEQ ID NO: 1778745 - RNA, 16 nt, Salmonella enterica enterica serovar Typhi Ty2
gcagaaaaaucagcau

SEQ ID NO: 1778746 - RNA, 17 nt, Salmonella enterica enterica serovar Typhi Ty2
gcacuuuuuccuccugc

SEQ ID NO: 1778747 - RNA, 14 nt, Salmonella enterica enterica serovar Typhi Ty2
gcagagugagcagg

SEQ ID NO: 1778748 - RNA, 16 nt, Salmonella enterica enterica serovar Typhi Ty2
gcagagucgcagcggc

SEQ ID NO: 1778749 - RNA, 15 nt, Salmonella enterica enterica serovar Typhi Ty2
gcagauaaaccacgc

SEQ ID NO: 1778750 - RNA, 13 nt, Salmonella enterica enterica serovar Typhi Ty2
gcagagcccagcg

SEQ ID NO: 1778751 - RNA, 23 nt, Salmonella enterica enterica serovar Typhi Ty2
gcagagcgaacaguacggucagg

SEQ ID NO: 1778752 - RNA, 16 nt, Salmonella enterica enterica serovar Typhi Ty2
gcagagcggggaaacu

SEQ ID NO: 1778753 - RNA, 14 nt, Salmonella enterica enterica serovar Typhi Ty2
gcagaggucucagg

SEQ ID NO: 1778754 - RNA, 13 nt, Salmonella enterica enterica serovar Typhi Ty2
gcagacuauaggu

SEQ ID NO: 1778755 - RNA, 19 nt, Salmonella enterica enterica serovar Typhi Ty2
gcagacugguaaccuguuc

SEQ ID NO: 1778756 - RNA, 13 nt, Salmonella enterica enterica serovar Typhi Ty2
gcagacgccgcgg

SEQ ID NO: 1778757 - RNA, 15 nt, Salmonella enterica enterica serovar Typhi Ty2
gcagacggagaugau

SEQ ID NO: 1778758 - RNA, 16 nt, Salmonella enterica enterica serovar Typhi Ty2
gcagacggagaugauc

SEQ ID NO: 1778759 - RNA, 17 nt, Salmonella enterica enterica serovar Typhi Ty2
gcagaccggcagccugc

SEQ ID NO: 1778760 - RNA, 14 nt, Salmonella enterica enterica serovar Typhi Ty2
gcagaccuauaugg

SEQ ID NO: 1778761 - RNA, 17 nt, Salmonella enterica enterica serovar Typhi Ty2
gcagacauauuuucucu

SEQ ID NO: 1778762 - RNA, 21 nt, Salmonella enterica enterica serovar Typhi Ty2
gcagacaguggccaucuucca

SEQ ID NO: 1778763 - RNA, 21 nt, Salmonella enterica enterica serovar Typhi Ty2
gcagacccacuuucagcuccg

SEQ ID NO: 1778764 - RNA, 14 nt, Salmonella enterica enterica serovar Typhi Ty2
gcagacacugccac

SEQ ID NO: 1778765 - RNA, 19 nt, Salmonella enterica enterica serovar Typhi Ty2
gcagacaauuuucuucaug

SEQ ID NO: 1778766 - RNA, 20 nt, Salmonella enterica enterica serovar Typhi Ty2
gcagacaaaaaaccggaggc

SEQ ID NO: 1778767 - RNA, 12 nt, Salmonella enterica enterica serovar Typhi Ty2
gaguggcggcgc

SEQ ID NO: 1778768 - RNA, 16 nt, Salmonella enterica enterica serovar Typhi Ty2
gaguguuggucuuggu

SEQ ID NO: 1778769 - RNA, 23 nt, Salmonella enterica enterica serovar Typhi Ty2
gaguugcuuaaaagcggcaaggg

SEQ ID NO: 1778770 - RNA, 16 nt, Salmonella enterica enterica serovar Typhi Ty2
gaguuugcaauccaga

SEQ ID NO: 1778771 - RNA, 20 nt, Salmonella enterica enterica serovar Typhi Ty2
gagucuuauccgacugacca

SEQ ID NO: 1778772 - RNA, 21 nt, Salmonella enterica enterica serovar Typhi Ty2
gaguagcgcagcuugguagcg

SEQ ID NO: 1778773 - RNA, 10 nt, Salmonella enterica enterica serovar Typhi Ty2
gaguuuuaac

SEQ ID NO: 1778774 - RNA, 17 nt, Salmonella enterica enterica serovar Typhi Ty2
gaguuuuuuauggcaga

SEQ ID NO: 1778775 - RNA, 11 nt, Salmonella enterica enterica serovar Typhi Ty2
gauaaaaaaag

SEQ ID NO: 1778776 - RNA, 22 nt, Salmonella enterica enterica serovar Typhi Ty2
gauaaaccaacagccgccuguu

SEQ ID NO: 1778777 - RNA, 22 nt, Salmonella enterica enterica serovar Typhi Ty2
gauaaacggcuuuaguucagca

SEQ ID NO: 1778778 - RNA, 20 nt, Salmonella enterica enterica serovar Typhi Ty2
gauaaagaccggcacaaccg

SEQ ID NO: 1778779 - RNA, 19 nt, Salmonella enterica enterica serovar Typhi Ty2
gauaaacugacaucccccu

SEQ ID NO: 1778780 - RNA, 20 nt, Salmonella enterica enterica serovar Typhi Ty2
gauaacaccgcauggcuggc

SEQ ID NO: 1778781 - RNA, 14 nt, Salmonella enterica enterica serovar Typhi Ty2
gauaaauucugucu

SEQ ID NO: 1778782 - RNA, 14 nt, Salmonella enterica enterica serovar Typhi Ty2
gauaaccaggucac

SEQ ID NO: 1778783 - RNA, 14 nt, Salmonella enterica enterica serovar Typhi Ty2
gauaaccgccgcca

SEQ ID NO: 1778784 - RNA, 13 nt, Salmonella enterica enterica serovar Typhi Ty2
gauaacucuucau

SEQ ID NO: 1778785 - RNA, 23 nt, Salmonella enterica enterica serovar Typhi Ty2
gauaacugaagguuuuucccgga

SEQ ID NO: 1778786 - RNA, 22 nt, Salmonella enterica enterica serovar Typhi Ty2
gauaagacugauauccauuggg

SEQ ID NO: 1778787 - RNA, 19 nt, Salmonella enterica enterica serovar Typhi Ty2
gauaagaaguaaacagaau

SEQ ID NO: 1778788 - RNA, 19 nt, Salmonella enterica enterica serovar Typhi Ty2
gaguaauaacaaaaaacau

SEQ ID NO: 1778789 - RNA, 18 nt, Salmonella enterica enterica serovar Typhi Ty2
gaguaauccauagccaac

SEQ ID NO: 1778790 - RNA, 22 nt, Salmonella enterica enterica serovar Typhi Ty2
gaguaagcccaaaggaaagguc

SEQ ID NO: 1778791 - RNA, 17 nt, Salmonella enterica enterica serovar Typhi Ty2
gaguaacgggcagcggc

SEQ ID NO: 1778792 - RNA, 14 nt, Salmonella enterica enterica serovar Typhi Ty2
gaguaacgggcagc

SEQ ID NO: 1778793 - RNA, 23 nt, Salmonella enterica enterica serovar Typhi Ty2
gaguaauguucaguuuuuccagc

SEQ ID NO: 1778794 - RNA, 20 nt, Salmonella enterica enterica serovar Typhi Ty2
gaguaauguucaguuuuucc

SEQ ID NO: 1778795 - RNA, 18 nt, Salmonella enterica enterica serovar Typhi Ty2
gaguaaugacaaaaauua

SEQ ID NO: 1778796 - RNA, 15 nt, Salmonella enterica enterica serovar Typhi Ty2
gaguaaagccugccc

SEQ ID NO: 1778797 - RNA, 16 nt, Salmonella enterica enterica serovar Typhi Ty2
gaguaaauaaaucagc

SEQ ID NO: 1778798 - RNA, 23 nt, Salmonella enterica enterica serovar Typhi Ty2
gaggucugcauucaggccucugc

SEQ ID NO: 1778799 - RNA, 13 nt, Salmonella enterica enterica serovar Typhi Ty2
gaggucucagguu

SEQ ID NO: 1778800 - RNA, 16 nt, Salmonella enterica enterica serovar Typhi Ty2
gaggucauuauucagg

SEQ ID NO: 1778801 - RNA, 19 nt, Salmonella enterica enterica serovar Typhi Ty2
gagguaguccugcucaugc

SEQ ID NO: 1778802 - RNA, 20 nt, Salmonella enterica enterica serovar Typhi Ty2
gaggugcucucccagcugag

SEQ ID NO: 1778803 - RNA, 16 nt, Salmonella enterica enterica serovar Typhi Ty2
gaggugaauaaauccu

SEQ ID NO: 1778804 - RNA, 14 nt, Salmonella enterica enterica serovar Typhi Ty2
gaggugcugguggu

SEQ ID NO: 1778805 - RNA, 20 nt, Salmonella enterica enterica serovar Typhi Ty2
gaggcguucccgaaaugggc

SEQ ID NO: 1778806 - RNA, 14 nt, Salmonella enterica enterica serovar Typhi Ty2
gaggcuacccagac

SEQ ID NO: 1778807 - RNA, 13 nt, Salmonella enterica enterica serovar Typhi Ty2
gaggcguuuccag

SEQ ID NO: 1778808 - RNA, 21 nt, Salmonella enterica enterica serovar Typhi Ty2
gagggagguucgccucccuca

SEQ ID NO: 1778809 - RNA, 20 nt, Salmonella enterica enterica serovar Typhi Ty2
gagggcgcgccguugaaauc

SEQ ID NO: 1778810 - RNA, 19 nt, Salmonella enterica enterica serovar Typhi Ty2
gauagacggcugaauguuc

SEQ ID NO: 1778811 - RNA, 19 nt, Salmonella enterica enterica serovar Typhi Ty2
gauagaaccacgcaaaggc

SEQ ID NO: 1778812 - RNA, 16 nt, Salmonella enterica enterica serovar Typhi Ty2
gauagaaguuaugcau

SEQ ID NO: 1778813 - RNA, 20 nt, Salmonella enterica enterica serovar Typhi Ty2
gauacuccauugucggcagc

SEQ ID NO: 1778814 - RNA, 14 nt, Salmonella enterica enterica serovar Typhi Ty2
gauacgucaucaug

SEQ ID NO: 1778815 - RNA, 13 nt, Salmonella enterica enterica serovar Typhi Ty2
gauacguuccagc

SEQ ID NO: 1778816 - RNA, 14 nt, Salmonella enterica enterica serovar Typhi Ty2
gauaagcacaggcc

SEQ ID NO: 1778817 - RNA, 20 nt, Salmonella enterica enterica serovar Typhi Ty2
gauaagcaccguaaacggcu

SEQ ID NO: 1778818 - RNA, 19 nt, Salmonella enterica enterica serovar Typhi Ty2
gauaagcuaguaaagaaau

SEQ ID NO: 1778819 - RNA, 22 nt, Salmonella enterica enterica serovar Typhi Ty2
gauaaggucgcuauccagcagu

SEQ ID NO: 1778820 - RNA, 14 nt, Salmonella enterica enterica serovar Typhi Ty2
gauaaggccacgcc

SEQ ID NO: 1778821 - RNA, 23 nt, Salmonella enterica enterica serovar Typhi Ty2
gauaaggcggagccgccauccgg

SEQ ID NO: 1778822 - RNA, 14 nt, Salmonella enterica enterica serovar Typhi Ty2
gauaccgccagccc

SEQ ID NO: 1778823 - RNA, 14 nt, Salmonella enterica enterica serovar Typhi Ty2
gauaccggccgccc

SEQ ID NO: 1778824 - RNA, 22 nt, Salmonella enterica enterica serovar Typhi Ty2
gauaccggaggagugcgccagu

SEQ ID NO: 1778825 - RNA, 13 nt, Salmonella enterica enterica serovar Typhi Ty2
gauauaaagguua

SEQ ID NO: 1778826 - RNA, 23 nt, Salmonella enterica enterica serovar Typhi Ty2
gauauagaguccagccauaauca

SEQ ID NO: 1778827 - RNA, 23 nt, Salmonella enterica enterica serovar Typhi Ty2
gauauaccacccgcuaugaagac

SEQ ID NO: 1778828 - RNA, 22 nt, Salmonella enterica enterica serovar Typhi Ty2
gauauaaaacgggccacugcug

SEQ ID NO: 1778829 - RNA, 19 nt, Salmonella enterica enterica serovar Typhi Ty2
gauagugcugcgcaaauac

SEQ ID NO: 1778830 - RNA, 14 nt, Salmonella enterica enterica serovar Typhi Ty2
gauagugccugccg

SEQ ID NO: 1778831 - RNA, 12 nt, Salmonella enterica enterica serovar Typhi Ty2
gauagugcgugu

SEQ ID NO: 1778832 - RNA, 22 nt, Salmonella enterica enterica serovar Typhi Ty2
gauagucgcgauucgggccgca

SEQ ID NO: 1778833 - RNA, 18 nt, Salmonella enterica enterica serovar Typhi Ty2
gauagcgcggaauaucaa

SEQ ID NO: 1778834 - RNA, 19 nt, Salmonella enterica enterica serovar Typhi Ty2
gauagcgccauggagaaac

SEQ ID NO: 1778835 - RNA, 19 nt, Salmonella enterica enterica serovar Typhi Ty2
gauagcgcuuuccaguccc

SEQ ID NO: 1778836 - RNA, 14 nt, Salmonella enterica enterica serovar Typhi Ty2
gauagcgauuuuug

SEQ ID NO: 1778837 - RNA, 22 nt, Salmonella enterica enterica serovar Typhi Ty2
gauagcccgccagcaccagcag

SEQ ID NO: 1778838 - RNA, 17 nt, Salmonella enterica enterica serovar Typhi Ty2
gauagcccauccagcac

SEQ ID NO: 1778839 - RNA, 14 nt, Salmonella enterica enterica serovar Typhi Ty2
gauagccauuauag

SEQ ID NO: 1778840 - RNA, 14 nt, Salmonella enterica enterica serovar Typhi Ty2
gauagggccaggcg

SEQ ID NO: 1778841 - RNA, 15 nt, Salmonella enterica enterica serovar Typhi Ty2
gauagggcagcaguu

SEQ ID NO: 1778842 - RNA, 23 nt, Salmonella enterica enterica serovar Typhi Ty2
gauagcuuguuguuuauccugca

SEQ ID NO: 1778843 - RNA, 18 nt, Salmonella enterica enterica serovar Typhi Ty2
gauagcuuuguauauguu

SEQ ID NO: 1778844 - RNA, 17 nt, Salmonella enterica enterica serovar Typhi Ty2
gauaggagacgccgccc

SEQ ID NO: 1778845 - RNA, 22 nt, Salmonella enterica enterica serovar Typhi Ty2
gauaggcgcgucauaaccgcag

SEQ ID NO: 1778846 - RNA, 19 nt, Salmonella enterica enterica serovar Typhi Ty2
gaucaucacgaaauaacgc

SEQ ID NO: 1778847 - RNA, 19 nt, Salmonella enterica enterica serovar Typhi Ty2
gaucacgccguccagcacc

SEQ ID NO: 1778848 - RNA, 15 nt, Salmonella enterica enterica serovar Typhi Ty2
gaucacgccagcgcu

SEQ ID NO: 1778849 - RNA, 14 nt, Salmonella enterica enterica serovar Typhi Ty2
gaucacggugguga

SEQ ID NO: 1778850 - RNA, 15 nt, Salmonella enterica enterica serovar Typhi Ty2
gaucagaccaucggc

SEQ ID NO: 1778851 - RNA, 19 nt, Salmonella enterica enterica serovar Typhi Ty2
gaucagacgcaucaggaac

SEQ ID NO: 1778852 - RNA, 12 nt, Salmonella enterica enterica serovar Typhi Ty2
gaucagaaaacc

SEQ ID NO: 1778853 - RNA, 22 nt, Salmonella enterica enterica serovar Typhi Ty2
gaucagaaauucgcagcgcagg

SEQ ID NO: 1778854 - RNA, 13 nt, Salmonella enterica enterica serovar Typhi Ty2
gaucaucuucacu

SEQ ID NO: 1778855 - RNA, 19 nt, Salmonella enterica enterica serovar Typhi Ty2
gaucaucccgagauuguca

SEQ ID NO: 1778856 - RNA, 13 nt, Salmonella enterica enterica serovar Typhi Ty2
gauccagcucuuc

SEQ ID NO: 1778857 - RNA, 13 nt, Salmonella enterica enterica serovar Typhi Ty2
gauccagcgggcc

SEQ ID NO: 1778858 - RNA, 19 nt, Salmonella enterica enterica serovar Typhi Ty2
gaucaugaggaugagcguu

SEQ ID NO: 1778859 - RNA, 21 nt, Salmonella enterica enterica serovar Typhi Ty2
gauccaucgguucucugccau

SEQ ID NO: 1778860 - RNA, 20 nt, Salmonella enterica enterica serovar Typhi Ty2
gauccaucgguucucugcca

SEQ ID NO: 1778861 - RNA, 15 nt, Salmonella enterica enterica serovar Typhi Ty2
gauauucugcacgca

SEQ ID NO: 1778862 - RNA, 21 nt, Salmonella enterica enterica serovar Typhi Ty2
gauauuuuguuuuaaauucaa

SEQ ID NO: 1778863 - RNA, 17 nt, Salmonella enterica enterica serovar Typhi Ty2
gauaucaacccaguuuu

SEQ ID NO: 1778864 - RNA, 14 nt, Salmonella enterica enterica serovar Typhi Ty2
gauauauuuuccgu

SEQ ID NO: 1778865 - RNA, 13 nt, Salmonella enterica enterica serovar Typhi Ty2
gauauuccauaca

SEQ ID NO: 1778866 - RNA, 21 nt, Salmonella enterica enterica serovar Typhi Ty2
gauauagcaacguccgcagcc

SEQ ID NO: 1778867 - RNA, 19 nt, Salmonella enterica enterica serovar Typhi Ty2
gauauagcggugcguuucc

SEQ ID NO: 1778868 - RNA, 14 nt, Salmonella enterica enterica serovar Typhi Ty2
gauauagucgccca

SEQ ID NO: 1778869 - RNA, 19 nt, Salmonella enterica enterica serovar Typhi Ty2
gauauaggguggucacgcc

SEQ ID NO: 1778870 - RNA, 23 nt, Salmonella enterica enterica serovar Typhi Ty2
gauauaucuucaucguuucugcc

SEQ ID NO: 1778871 - RNA, 16 nt, Salmonella enterica enterica serovar Typhi Ty2
gauauauucagcaaau

SEQ ID NO: 1778872 - RNA, 14 nt, Salmonella enterica enterica serovar Typhi Ty2
gaucaauuugccuu

SEQ ID NO: 1778873 - RNA, 17 nt, Salmonella enterica enterica serovar Typhi Ty2
gaucacaaaaucauugc

SEQ ID NO: 1778874 - RNA, 21 nt, Salmonella enterica enterica serovar Typhi Ty2
gaucaauaaaauuauccaguu

SEQ ID NO: 1778875 - RNA, 14 nt, Salmonella enterica enterica serovar Typhi Ty2
gaucaccaucuuca

SEQ ID NO: 1778876 - RNA, 14 nt, Salmonella enterica enterica serovar Typhi Ty2
gaucaccagcccuu

SEQ ID NO: 1778877 - RNA, 21 nt, Salmonella enterica enterica serovar Typhi Ty2
gaucaccugaaugcaaagaag

SEQ ID NO: 1778878 - RNA, 19 nt, Salmonella enterica enterica serovar Typhi Ty2
gaucuuauaugagcgggcc

SEQ ID NO: 1778879 - RNA, 15 nt, Salmonella enterica enterica serovar Typhi Ty2
gaucugguuauccac

SEQ ID NO: 1778880 - RNA, 19 nt, Salmonella enterica enterica serovar Typhi Ty2
gaucuuaucuuucagcgcc

SEQ ID NO: 1778881 - RNA, 13 nt, Salmonella enterica enterica serovar Typhi Ty2
gaugaaaaagagg

SEQ ID NO: 1778882 - RNA, 23 nt, Salmonella enterica enterica serovar Typhi Ty2
gaucuuugccgcgcggauucucc

SEQ ID NO: 1778883 - RNA, 15 nt, Salmonella enterica enterica serovar Typhi Ty2
gaucuuuccuuuuuc

SEQ ID NO: 1778884 - RNA, 21 nt, Salmonella enterica enterica serovar Typhi Ty2
gaugaaagcggcacaaauaaa

SEQ ID NO: 1778885 - RNA, 11 nt, Salmonella enterica enterica serovar Typhi Ty2
gaugaaagguc

SEQ ID NO: 1778886 - RNA, 20 nt, Salmonella enterica enterica serovar Typhi Ty2
gaugaaaaguacgcaaacag

SEQ ID NO: 1778887 - RNA, 22 nt, Salmonella enterica enterica serovar Typhi Ty2
gaugaaacaguccggcgaaaaa

SEQ ID NO: 1778888 - RNA, 20 nt, Salmonella enterica enterica serovar Typhi Ty2
gaugaaccauaucaaacagg

SEQ ID NO: 1778889 - RNA, 16 nt, Salmonella enterica enterica serovar Typhi Ty2
gaucccgacucugacg

SEQ ID NO: 1778890 - RNA, 14 nt, Salmonella enterica enterica serovar Typhi Ty2
gaucccgacucuga

SEQ ID NO: 1778891 - RNA, 23 nt, Salmonella enterica enterica serovar Typhi Ty2
gaucguuauccagcagccacagg

SEQ ID NO: 1778892 - RNA, 19 nt, Salmonella enterica enterica serovar Typhi Ty2
gaucuaaagccaguuucuc

SEQ ID NO: 1778893 - RNA, 16 nt, Salmonella enterica enterica serovar Typhi Ty2
gaucccaggccggcau

SEQ ID NO: 1778894 - RNA, 23 nt, Salmonella enterica enterica serovar Typhi Ty2
gaucccagggcggcgucgccaga

SEQ ID NO: 1778895 - RNA, 11 nt, Salmonella enterica enterica serovar Typhi Ty2
gaucccaccag

SEQ ID NO: 1778896 - RNA, 13 nt, Salmonella enterica enterica serovar Typhi Ty2
gaucccccagaau

SEQ ID NO: 1778897 - RNA, 19 nt, Salmonella enterica enterica serovar Typhi Ty2
gauccccaacgacagcacu

SEQ ID NO: 1778898 - RNA, 15 nt, Salmonella enterica enterica serovar Typhi Ty2
gaucucaugcaacug

SEQ ID NO: 1778899 - RNA, 16 nt, Salmonella enterica enterica serovar Typhi Ty2
gaucuacggaucccuu

SEQ ID NO: 1778900 - RNA, 23 nt, Salmonella enterica enterica serovar Typhi Ty2
gaucucauaaacgccuggaguga

SEQ ID NO: 1778901 - RNA, 19 nt, Salmonella enterica enterica serovar Typhi Ty2
gaucugcgcaacauucugc

SEQ ID NO: 1778902 - RNA, 12 nt, Salmonella enterica enterica serovar Typhi Ty2
gaucucucccug

SEQ ID NO: 1778903 - RNA, 23 nt, Salmonella enterica enterica serovar Typhi Ty2
gaugaacucuaugcaaaagaaaa

SEQ ID NO: 1778904 - RNA, 18 nt, Salmonella enterica enterica serovar Typhi Ty2
gaugacccgcaauauuaa

SEQ ID NO: 1778905 - RNA, 20 nt, Salmonella enterica enterica serovar Typhi Ty2
gaugaccaguuaagcaaaaa

SEQ ID NO: 1778906 - RNA, 17 nt, Salmonella enterica enterica serovar Typhi Ty2
gaugaccauaaaugaaa

SEQ ID NO: 1778907 - RNA, 18 nt, Salmonella enterica enterica serovar Typhi Ty2
gaugagcucaaauaugau

SEQ ID NO: 1778908 - RNA, 22 nt, Salmonella enterica enterica serovar Typhi Ty2
gaugaggaccguuugugccggg

SEQ ID NO: 1778909 - RNA, 14 nt, Salmonella enterica enterica serovar Typhi Ty2
gaugauucacccuc

SEQ ID NO: 1778910 - RNA, 21 nt, Salmonella enterica enterica serovar Typhi Ty2
gaugauguuuaccugcaaaaa

SEQ ID NO: 1778911 - RNA, 19 nt, Salmonella enterica enterica serovar Typhi Ty2
gaugauuggccuccaccgu

SEQ ID NO: 1778912 - RNA, 16 nt, Salmonella enterica enterica serovar Typhi Ty2
gaugcaccuuucuccu

SEQ ID NO: 1778913 - RNA, 22 nt, Salmonella enterica enterica serovar Typhi Ty2
gaugcaccuuucuccugcgcuu

SEQ ID NO: 1778914 - RNA, 21 nt, Salmonella enterica enterica serovar Typhi Ty2
gauggcguaauuaaccgcgcc

SEQ ID NO: 1778915 - RNA, 17 nt, Salmonella enterica enterica serovar Typhi Ty2
gauggcgucacauggcg

SEQ ID NO: 1778916 - RNA, 16 nt, Salmonella enterica enterica serovar Typhi Ty2
gauggccagcaccagc

SEQ ID NO: 1778917 - RNA, 18 nt, Salmonella enterica enterica serovar Typhi Ty2
gaugcugccugccugaag

SEQ ID NO: 1778918 - RNA, 19 nt, Salmonella enterica enterica serovar Typhi Ty2
gaugcugauguccgcagcc

SEQ ID NO: 1778919 - RNA, 22 nt, Salmonella enterica enterica serovar Typhi Ty2
gaugcucgccgucggcagacug

SEQ ID NO: 1778920 - RNA, 17 nt, Salmonella enterica enterica serovar Typhi Ty2
gaugcugaauagccagc

SEQ ID NO: 1778921 - RNA, 21 nt, Salmonella enterica enterica serovar Typhi Ty2
gaugcccaccugaaaaagggu

SEQ ID NO: 1778922 - RNA, 22 nt, Salmonella enterica enterica serovar Typhi Ty2
gaugcgccgacugaacauagcc

SEQ ID NO: 1778923 - RNA, 16 nt, Salmonella enterica enterica serovar Typhi Ty2
gaugcgcugcgcgcga

SEQ ID NO: 1778924 - RNA, 13 nt, Salmonella enterica enterica serovar Typhi Ty2
gauucuacugguu

SEQ ID NO: 1778925 - RNA, 17 nt, Salmonella enterica enterica serovar Typhi Ty2
gauugauuuuguaaucu

SEQ ID NO: 1778926 - RNA, 20 nt, Salmonella enterica enterica serovar Typhi Ty2
gauugauuuauucacuggca

SEQ ID NO: 1778927 - RNA, 22 nt, Salmonella enterica enterica serovar Typhi Ty2
gauugcauaucgcuaaaccaaa

SEQ ID NO: 1778928 - RNA, 14 nt, Salmonella enterica enterica serovar Typhi Ty2
gauucggacucaua

SEQ ID NO: 1778929 - RNA, 18 nt, Salmonella enterica enterica serovar Typhi Ty2
gauucggacucauacuug

SEQ ID NO: 1778930 - RNA, 14 nt, Salmonella enterica enterica serovar Typhi Ty2
gauucgggccgcac

SEQ ID NO: 1778931 - RNA, 16 nt, Salmonella enterica enterica serovar Typhi Ty2
gauucgccguucuguu

SEQ ID NO: 1778932 - RNA, 15 nt, Salmonella enterica enterica serovar Typhi Ty2
gauuuagcguaaaua

SEQ ID NO: 1778933 - RNA, 24 nt, Salmonella enterica enterica serovar Typhi Ty2
gauuucaugcggugcaugaauauc

SEQ ID NO: 1778934 - RNA, 23 nt, Salmonella enterica enterica serovar Typhi Ty2
gauuuagcguuggcgucaucgac

SEQ ID NO: 1778935 - RNA, 18 nt, Salmonella enterica enterica serovar Typhi Ty2
gauugucuuaaauaugaa

SEQ ID NO: 1778936 - RNA, 20 nt, Salmonella enterica enterica serovar Typhi Ty2
gauugucacaccggcggagu

SEQ ID NO: 1778937 - RNA, 22 nt, Salmonella enterica enterica serovar Typhi Ty2
gauugccgccaucuuuacccug

SEQ ID NO: 1778938 - RNA, 20 nt, Salmonella enterica enterica serovar Typhi Ty2
gauugcccuccagccauaau

SEQ ID NO: 1778939 - RNA, 19 nt, Salmonella enterica enterica serovar Typhi Ty2
gauuggcugugacaauuca

SEQ ID NO: 1778940 - RNA, 23 nt, Salmonella enterica enterica serovar Typhi Ty2
gauuugcugcugcucgcuaugaa

SEQ ID NO: 1778941 - RNA, 23 nt, Salmonella enterica enterica serovar Typhi Ty2
gauuuguacguauuuacaaauga

SEQ ID NO: 1778942 - RNA, 19 nt, Salmonella enterica enterica serovar Typhi Ty2
gauuuccagcgaauaauga

SEQ ID NO: 1778943 - RNA, 16 nt, Salmonella enterica enterica serovar Typhi Ty2
gauuuccauauuaacg

SEQ ID NO: 1778944 - RNA, 22 nt, Salmonella enterica enterica serovar Typhi Ty2
gauuucggcgcuguuuuccgcu

SEQ ID NO: 1778945 - RNA, 20 nt, Salmonella enterica enterica serovar Typhi Ty2
gauuucgacgauaaaaaaag

SEQ ID NO: 1778946 - RNA, 13 nt, Salmonella enterica enterica serovar Typhi Ty2
gauuuuuuugcug

SEQ ID NO: 1778947 - RNA, 21 nt, Salmonella enterica enterica serovar Typhi Ty2
gauuuucuuauuacaagaaag

SEQ ID NO: 1778948 - RNA, 20 nt, Salmonella enterica enterica serovar Typhi Ty2
gauuuucccuucugaaauga

SEQ ID NO: 1778949 - RNA, 17 nt, Salmonella enterica enterica serovar Typhi Ty2
gauuuuccguuaagcug

SEQ ID NO: 1778950 - RNA, 16 nt, Salmonella enterica enterica serovar Typhi Ty2
gauuccccaccaggaa

SEQ ID NO: 1778951 - RNA, 22 nt, Salmonella enterica enterica serovar Typhi Ty2
gauuccggacaacgcaaacugu

SEQ ID NO: 1778952 - RNA, 16 nt, Salmonella enterica enterica serovar Typhi Ty2
gauuccgucaugguga

SEQ ID NO: 1778953 - RNA, 18 nt, Salmonella enterica enterica serovar Typhi Ty2
gauuccaugcccaguuca

SEQ ID NO: 1778954 - RNA, 16 nt, Salmonella enterica enterica serovar Typhi Ty2
gauuagcucauacgcu

SEQ ID NO: 1778955 - RNA, 13 nt, Salmonella enterica enterica serovar Typhi Ty2
gauuagccccagc

SEQ ID NO: 1778956 - RNA, 14 nt, Salmonella enterica enterica serovar Typhi Ty2
gauuagcagagcgg

SEQ ID NO: 1778957 - RNA, 22 nt, Salmonella enterica enterica serovar Typhi Ty2
gauucaacguuucgcuaucgcc

SEQ ID NO: 1778958 - RNA, 20 nt, Salmonella enterica enterica serovar Typhi Ty2
gauucaaaaggugagaaaaa

SEQ ID NO: 1778959 - RNA, 20 nt, Salmonella enterica enterica serovar Typhi Ty2
gauuauuuuaucaucagcac

SEQ ID NO: 1778960 - RNA, 15 nt, Salmonella enterica enterica serovar Typhi Ty2
gauuauuuucacgcc

SEQ ID NO: 1778961 - RNA, 13 nt, Salmonella enterica enterica serovar Typhi Ty2
gauucagcauugg

SEQ ID NO: 1778962 - RNA, 16 nt, Salmonella enterica enterica serovar Typhi Ty2
gauucaggccgccagc

SEQ ID NO: 1778963 - RNA, 17 nt, Salmonella enterica enterica serovar Typhi Ty2
gauucaccaacugcuga

SEQ ID NO: 1778964 - RNA, 21 nt, Salmonella enterica enterica serovar Typhi Ty2
gauucaauauugaacauuuuu

SEQ ID NO: 1778965 - RNA, 14 nt, Salmonella enterica enterica serovar Typhi Ty2
gaugucucagcgca

SEQ ID NO: 1778966 - RNA, 22 nt, Salmonella enterica enterica serovar Typhi Ty2
gaugugaccuuugugcaggauc

SEQ ID NO: 1778967 - RNA, 23 nt, Salmonella enterica enterica serovar Typhi Ty2
gaugugauuuuugacccgcagca

SEQ ID NO: 1778968 - RNA, 19 nt, Salmonella enterica enterica serovar Typhi Ty2
gaugugcuuuuuauuuuuc

SEQ ID NO: 1778969 - RNA, 21 nt, Salmonella enterica enterica serovar Typhi Ty2
gauuaaugauuugcuuuauuu

SEQ ID NO: 1778970 - RNA, 16 nt, Salmonella enterica enterica serovar Typhi Ty2
gauguugauacagaaa

SEQ ID NO: 1778971 - RNA, 21 nt, Salmonella enterica enterica serovar Typhi Ty2
gauguucgcgauuuucaucaa

SEQ ID NO: 1778972 - RNA, 17 nt, Salmonella enterica enterica serovar Typhi Ty2
gauguuacgacccagcg

SEQ ID NO: 1778973 - RNA, 15 nt, Salmonella enterica enterica serovar Typhi Ty2
gagccgauauccgga

SEQ ID NO: 1778974 - RNA, 20 nt, Salmonella enterica enterica serovar Typhi Ty2
gagccgcccggcgcgcugga

SEQ ID NO: 1778975 - RNA, 21 nt, Salmonella enterica enterica serovar Typhi Ty2
gagcccugugcgguauugaua

SEQ ID NO: 1778976 - RNA, 18 nt, Salmonella enterica enterica serovar Typhi Ty2
gagccgaaauccaccagc

SEQ ID NO: 1778977 - RNA, 15 nt, Salmonella enterica enterica serovar Typhi Ty2
gagccauuaaugcag

SEQ ID NO: 1778978 - RNA, 13 nt, Salmonella enterica enterica serovar Typhi Ty2
gagcccaguagcc

SEQ ID NO: 1778979 - RNA, 19 nt, Salmonella enterica enterica serovar Typhi Ty2
gagccacuauccagucagc

SEQ ID NO: 1778980 - RNA, 21 nt, Salmonella enterica enterica serovar Typhi Ty2
gagccacgcggcaucaggcau

SEQ ID NO: 1778981 - RNA, 21 nt, Salmonella enterica enterica serovar Typhi Ty2
gagcaguuuuacguggacgcc

SEQ ID NO: 1778982 - RNA, 15 nt, Salmonella enterica enterica serovar Typhi Ty2
gagcauaugcgcugc

SEQ ID NO: 1778983 - RNA, 14 nt, Salmonella enterica enterica serovar Typhi Ty2
gagcauuggaaauu

SEQ ID NO: 1778984 - RNA, 16 nt, Salmonella enterica enterica serovar Typhi Ty2
gagcauuuccgcagcc

SEQ ID NO: 1778985 - RNA, 15 nt, Salmonella enterica enterica serovar Typhi Ty2
gagccaaacacuucc

SEQ ID NO: 1778986 - RNA, 19 nt, Salmonella enterica enterica serovar Typhi Ty2
gagcagguuacucuuccac

SEQ ID NO: 1778987 - RNA, 19 nt, Salmonella enterica enterica serovar Typhi Ty2
gagcagucguugcgccugu

SEQ ID NO: 1778988 - RNA, 15 nt, Salmonella enterica enterica serovar Typhi Ty2
gagcaguucagcagc

SEQ ID NO: 1778989 - RNA, 16 nt, Salmonella enterica enterica serovar Typhi Ty2
gagcaguucagcagca

SEQ ID NO: 1778990 - RNA, 13 nt, Salmonella enterica enterica serovar Typhi Ty2
gagcaggggccgg

SEQ ID NO: 1778991 - RNA, 22 nt, Salmonella enterica enterica serovar Typhi Ty2
gagcaggggcuccugcgccgga

SEQ ID NO: 1778992 - RNA, 14 nt, Salmonella enterica enterica serovar Typhi Ty2
gagcaggaaaaguc

SEQ ID NO: 1778993 - RNA, 11 nt, Salmonella enterica enterica serovar Typhi Ty2
gagcaggccag

SEQ ID NO: 1778994 - RNA, 17 nt, Salmonella enterica enterica serovar Typhi Ty2
gagaugcaggccaagca

SEQ ID NO: 1778995 - RNA, 14 nt, Salmonella enterica enterica serovar Typhi Ty2
gagaugcaggccaa

SEQ ID NO: 1778996 - RNA, 18 nt, Salmonella enterica enterica serovar Typhi Ty2
gagaugcagacaauuucc

SEQ ID NO: 1778997 - RNA, 18 nt, Salmonella enterica enterica serovar Typhi Ty2
gagaugaucguuuccagc

SEQ ID NO: 1778998 - RNA, 16 nt, Salmonella enterica enterica serovar Typhi Ty2
gagaucgguaauuucc

SEQ ID NO: 1778999 - RNA, 17 nt, Salmonella enterica enterica serovar Typhi Ty2
gagaucgguaauuucca

SEQ ID NO: 1779000 - RNA, 20 nt, Salmonella enterica enterica serovar Typhi Ty2
gagaucgguaauuuccacgc

SEQ ID NO: 1779001 - RNA, 23 nt, Salmonella enterica enterica serovar Typhi Ty2
gagauuacugcgugcuggcggcc

SEQ ID NO: 1779002 - RNA, 20 nt, Salmonella enterica enterica serovar Typhi Ty2
gagauguuuuaccaguacaa

SEQ ID NO: 1779003 - RNA, 15 nt, Salmonella enterica enterica serovar Typhi Ty2
gagauucaauaaugu

SEQ ID NO: 1779004 - RNA, 15 nt, Salmonella enterica enterica serovar Typhi Ty2
gagaucagcaguugc

SEQ ID NO: 1779005 - RNA, 21 nt, Salmonella enterica enterica serovar Typhi Ty2
gagaucgacaaaccacugcug

SEQ ID NO: 1779006 - RNA, 15 nt, Salmonella enterica enterica serovar Typhi Ty2
gagauaauuuaugau

SEQ ID NO: 1779007 - RNA, 20 nt, Salmonella enterica enterica serovar Typhi Ty2
gagauaagccgucauaaaau

SEQ ID NO: 1779008 - RNA, 15 nt, Salmonella enterica enterica serovar Typhi Ty2
gagauagcggugccu

SEQ ID NO: 1779009 - RNA, 14 nt, Salmonella enterica enterica serovar Typhi Ty2
gagaguccagcgcc

SEQ ID NO: 1779010 - RNA, 17 nt, Salmonella enterica enterica serovar Typhi Ty2
gagcaacagaaaccaua

SEQ ID NO: 1779011 - RNA, 14 nt, Salmonella enterica enterica serovar Typhi Ty2
gagcaaauacugga

SEQ ID NO: 1779012 - RNA, 20 nt, Salmonella enterica enterica serovar Typhi Ty2
gagcaaaccgacccaaaaau

SEQ ID NO: 1779013 - RNA, 17 nt, Salmonella enterica enterica serovar Typhi Ty2
gagcaaaaccagacgcc

SEQ ID NO: 1779014 - RNA, 15 nt, Salmonella enterica enterica serovar Typhi Ty2
gagcaauggcguggc

SEQ ID NO: 1779015 - RNA, 23 nt, Salmonella enterica enterica serovar Typhi Ty2
gagcacuaauauucgauuuaaug

SEQ ID NO: 1779016 - RNA, 15 nt, Salmonella enterica enterica serovar Typhi Ty2
gaggaacaucagcca

SEQ ID NO: 1779017 - RNA, 17 nt, Salmonella enterica enterica serovar Typhi Ty2
gaggaacuguucagcca

SEQ ID NO: 1779018 - RNA, 18 nt, Salmonella enterica enterica serovar Typhi Ty2
gaggaaaaagccgccgug

SEQ ID NO: 1779019 - RNA, 18 nt, Salmonella enterica enterica serovar Typhi Ty2
gaggaaaccuuucuucuc

SEQ ID NO: 1779020 - RNA, 15 nt, Salmonella enterica enterica serovar Typhi Ty2
gaggacagugaaacg

SEQ ID NO: 1779021 - RNA, 18 nt, Salmonella enterica enterica serovar Typhi Ty2
gaggacagugaaacgggu

SEQ ID NO: 1779022 - RNA, 14 nt, Salmonella enterica enterica serovar Typhi Ty2
gaggaauucuccac

SEQ ID NO: 1779023 - RNA, 19 nt, Salmonella enterica enterica serovar Typhi Ty2
gaggacuguacaagaaggg

SEQ ID NO: 1779024 - RNA, 18 nt, Salmonella enterica enterica serovar Typhi Ty2
gagcuguagcgaagggua

SEQ ID NO: 1779025 - RNA, 18 nt, Salmonella enterica enterica serovar Typhi Ty2
gagcugugguucguucaa

SEQ ID NO: 1779026 - RNA, 18 nt, Salmonella enterica enterica serovar Typhi Ty2
gaggaucgcccagaugaa

SEQ ID NO: 1779027 - RNA, 20 nt, Salmonella enterica enterica serovar Typhi Ty2
gaggaguaguuaaaaaaggu

SEQ ID NO: 1779028 - RNA, 20 nt, Salmonella enterica enterica serovar Typhi Ty2
gaggcgcuggcuugaccgcu

SEQ ID NO: 1779029 - RNA, 16 nt, Salmonella enterica enterica serovar Typhi Ty2
gaggcgcagccgccau

SEQ ID NO: 1779030 - RNA, 23 nt, Salmonella enterica enterica serovar Typhi Ty2
gaggccguuauugucaugcuaaa

SEQ ID NO: 1779031 - RNA, 15 nt, Salmonella enterica enterica serovar Typhi Ty2
gaggccaccagcgcc

SEQ ID NO: 1779032 - RNA, 22 nt, Salmonella enterica enterica serovar Typhi Ty2
gagcgccgcgccuaccagcgcu

SEQ ID NO: 1779033 - RNA, 13 nt, Salmonella enterica enterica serovar Typhi Ty2
gagcgcgcuggca

SEQ ID NO: 1779034 - RNA, 14 nt, Salmonella enterica enterica serovar Typhi Ty2
gagcgcgccgcaca

SEQ ID NO: 1779035 - RNA, 14 nt, Salmonella enterica enterica serovar Typhi Ty2
gagcgcgcgcgccu

SEQ ID NO: 1779036 - RNA, 15 nt, Salmonella enterica enterica serovar Typhi Ty2
gagcgccggcaaagc

SEQ ID NO: 1779037 - RNA, 16 nt, Salmonella enterica enterica serovar Typhi Ty2
gagcgccucugauuuu

SEQ ID NO: 1779038 - RNA, 13 nt, Salmonella enterica enterica serovar Typhi Ty2
gagcgcaggcgag

SEQ ID NO: 1779039 - RNA, 15 nt, Salmonella enterica enterica serovar Typhi Ty2
gagcgcauccggcca

SEQ ID NO: 1779040 - RNA, 16 nt, Salmonella enterica enterica serovar Typhi Ty2
gagcgccaaaaagaaa

SEQ ID NO: 1779041 - RNA, 17 nt, Salmonella enterica enterica serovar Typhi Ty2
gagcgccagcaacagcg

SEQ ID NO: 1779042 - RNA, 23 nt, Salmonella enterica enterica serovar Typhi Ty2
gagcgaguacguaaugugaaaaa

SEQ ID NO: 1779043 - RNA, 21 nt, Salmonella enterica enterica serovar Typhi Ty2
gagcgaucauaagggagcuga

SEQ ID NO: 1779044 - RNA, 13 nt, Salmonella enterica enterica serovar Typhi Ty2
gagcgcaaacauc

SEQ ID NO: 1779045 - RNA, 16 nt, Salmonella enterica enterica serovar Typhi Ty2
gagcgaucauaaggga

SEQ ID NO: 1779046 - RNA, 23 nt, Salmonella enterica enterica serovar Typhi Ty2
gagcgaacggcuuuccagcagcc

SEQ ID NO: 1779047 - RNA, 21 nt, Salmonella enterica enterica serovar Typhi Ty2
gagcgacgguuuuauccccuu

SEQ ID NO: 1779048 - RNA, 16 nt, Salmonella enterica enterica serovar Typhi Ty2
gagcgacgcccugccc

SEQ ID NO: 1779049 - RNA, 21 nt, Salmonella enterica enterica serovar Typhi Ty2
gagccuaaaacauuaaucgcc

SEQ ID NO: 1779050 - RNA, 14 nt, Salmonella enterica enterica serovar Typhi Ty2
gagccgucgccggc

SEQ ID NO: 1779051 - RNA, 22 nt, Salmonella enterica enterica serovar Typhi Ty2
gagccuuacaggcgcaucagaa

SEQ ID NO: 1779052 - RNA, 20 nt, Salmonella enterica enterica serovar Typhi Ty2
gagcggagagagcgcuucca

SEQ ID NO: 1779053 - RNA, 19 nt, Salmonella enterica enterica serovar Typhi Ty2
gagcggagagagcgcuucc

SEQ ID NO: 1779054 - RNA, 15 nt, Salmonella enterica enterica serovar Typhi Ty2
gagcggccaaaggga

SEQ ID NO: 1779055 - RNA, 20 nt, Salmonella enterica enterica serovar Typhi Ty2
gagcguaaugguggcaaccu

SEQ ID NO: 1779056 - RNA, 22 nt, Salmonella enterica enterica serovar Typhi Ty2
gagcuaaucaauaaguuuuuuc

SEQ ID NO: 1779057 - RNA, 13 nt, Salmonella enterica enterica serovar Typhi Ty2
gagcugcgguggu

SEQ ID NO: 1779058 - RNA, 21 nt, Salmonella enterica enterica serovar Typhi Ty2
gacggguauuacugauaaagu

SEQ ID NO: 1779059 - RNA, 23 nt, Salmonella enterica enterica serovar Typhi Ty2
gacgggggcgaucagcaggucag

SEQ ID NO: 1779060 - RNA, 16 nt, Salmonella enterica enterica serovar Typhi Ty2
gacgggugcgcccaga

SEQ ID NO: 1779061 - RNA, 17 nt, Salmonella enterica enterica serovar Typhi Ty2
gacgggcccuggccgca

SEQ ID NO: 1779062 - RNA, 13 nt, Salmonella enterica enterica serovar Typhi Ty2
gacgggccaggcg

SEQ ID NO: 1779063 - RNA, 23 nt, Salmonella enterica enterica serovar Typhi Ty2
gacgggaugugaccuuugugcag

SEQ ID NO: 1779064 - RNA, 18 nt, Salmonella enterica enterica serovar Typhi Ty2
gacgggacgaauuuccag

SEQ ID NO: 1779065 - RNA, 22 nt, Salmonella enterica enterica serovar Typhi Ty2
gacguaacugucuuauccggcc

SEQ ID NO: 1779066 - RNA, 20 nt, Salmonella enterica enterica serovar Typhi Ty2
gacguauucaccucccugca

SEQ ID NO: 1779067 - RNA, 13 nt, Salmonella enterica enterica serovar Typhi Ty2
gacgguuuucacu

SEQ ID NO: 1779068 - RNA, 16 nt, Salmonella enterica enterica serovar Typhi Ty2
gacgguuauuuuucag

SEQ ID NO: 1779069 - RNA, 20 nt, Salmonella enterica enterica serovar Typhi Ty2
gacgguggucaucuggucaa

SEQ ID NO: 1779070 - RNA, 17 nt, Salmonella enterica enterica serovar Typhi Ty2
gacgguaccugaagcca

SEQ ID NO: 1779071 - RNA, 16 nt, Salmonella enterica enterica serovar Typhi Ty2
gacgguaagaauaaua

SEQ ID NO: 1779072 - RNA, 19 nt, Salmonella enterica enterica serovar Typhi Ty2
gacgguaccugaagccauc

SEQ ID NO: 1779073 - RNA, 17 nt, Salmonella enterica enterica serovar Typhi Ty2
gacguggggguucaagu

SEQ ID NO: 1779074 - RNA, 19 nt, Salmonella enterica enterica serovar Typhi Ty2
gacgugcggcagggcgguc

SEQ ID NO: 1779075 - RNA, 13 nt, Salmonella enterica enterica serovar Typhi Ty2
gacgugauaauaa

SEQ ID NO: 1779076 - RNA, 17 nt, Salmonella enterica enterica serovar Typhi Ty2
gacgugugauuguggcg

SEQ ID NO: 1779077 - RNA, 18 nt, Salmonella enterica enterica serovar Typhi Ty2
gacgugccuuccaucggc

SEQ ID NO: 1779078 - RNA, 19 nt, Salmonella enterica enterica serovar Typhi Ty2
gacguucagcauauccagc

SEQ ID NO: 1779079 - RNA, 18 nt, Salmonella enterica enterica serovar Typhi Ty2
gacguugaaaaaacgggc

SEQ ID NO: 1779080 - RNA, 18 nt, Salmonella enterica enterica serovar Typhi Ty2
gacguuugcguaaagcug

SEQ ID NO: 1779081 - RNA, 16 nt, Salmonella enterica enterica serovar Typhi Ty2
gacuaaaagacgccau

SEQ ID NO: 1779082 - RNA, 15 nt, Salmonella enterica enterica serovar Typhi Ty2
gacuaaccuugauuc

SEQ ID NO: 1779083 - RNA, 18 nt, Salmonella enterica enterica serovar Typhi Ty2
gacuauccguccucuuuc

SEQ ID NO: 1779084 - RNA, 17 nt, Salmonella enterica enterica serovar Typhi Ty2
gacuaucagaaaaaauu

SEQ ID NO: 1779085 - RNA, 16 nt, Salmonella enterica enterica serovar Typhi Ty2
gacuaucccucugaaa

SEQ ID NO: 1779086 - RNA, 16 nt, Salmonella enterica enterica serovar Typhi Ty2
gacuauuggaaucgcu

SEQ ID NO: 1779087 - RNA, 19 nt, Salmonella enterica enterica serovar Typhi Ty2
gacuauucgcuaucagaau

SEQ ID NO: 1779088 - RNA, 17 nt, Salmonella enterica enterica serovar Typhi Ty2
gacucacauaacaaaac

SEQ ID NO: 1779089 - RNA, 14 nt, Salmonella enterica enterica serovar Typhi Ty2
gacuauucuucccc

SEQ ID NO: 1779090 - RNA, 21 nt, Salmonella enterica enterica serovar Typhi Ty2
gacucaaacagauagccauca

SEQ ID NO: 1779091 - RNA, 16 nt, Salmonella enterica enterica serovar Typhi Ty2
gacuagacagccucuc

SEQ ID NO: 1779092 - RNA, 14 nt, Salmonella enterica enterica serovar Typhi Ty2
gacuacgucagaug

SEQ ID NO: 1779093 - RNA, 15 nt, Salmonella enterica enterica serovar Typhi Ty2
gacuacguucaucag

SEQ ID NO: 1779094 - RNA, 15 nt, Salmonella enterica enterica serovar Typhi Ty2
gacuaauuauuuuuc

SEQ ID NO: 1779095 - RNA, 18 nt, Salmonella enterica enterica serovar Typhi Ty2
gacucgcuacgcucgccc

SEQ ID NO: 1779096 - RNA, 22 nt, Salmonella enterica enterica serovar Typhi Ty2
gacuccggauagagaucuuccg

SEQ ID NO: 1779097 - RNA, 14 nt, Salmonella enterica enterica serovar Typhi Ty2
gacuccggcagcau

SEQ ID NO: 1779098 - RNA, 22 nt, Salmonella enterica enterica serovar Typhi Ty2
gacucccaggcgcgcagcugcc

SEQ ID NO: 1779099 - RNA, 12 nt, Salmonella enterica enterica serovar Typhi Ty2
gacucauccagc

SEQ ID NO: 1779100 - RNA, 17 nt, Salmonella enterica enterica serovar Typhi Ty2
gacucaucgccgcaaug

SEQ ID NO: 1779101 - RNA, 13 nt, Salmonella enterica enterica serovar Typhi Ty2
gacucagccaggu

SEQ ID NO: 1779102 - RNA, 12 nt, Salmonella enterica enterica serovar Typhi Ty2
gacucacgcagc

SEQ ID NO: 1779103 - RNA, 20 nt, Salmonella enterica enterica serovar Typhi Ty2
gacucaccccuucuuuaucu

SEQ ID NO: 1779104 - RNA, 16 nt, Salmonella enterica enterica serovar Typhi Ty2
gacucaggccuuuuua

SEQ ID NO: 1779105 - RNA, 22 nt, Salmonella enterica enterica serovar Typhi Ty2
gacucaggguuuuacgcuggac

SEQ ID NO: 1779106 - RNA, 12 nt, Salmonella enterica enterica serovar Typhi Ty2
gacugcggccug

SEQ ID NO: 1779107 - RNA, 21 nt, Salmonella enterica enterica serovar Typhi Ty2
gacuggcgaccgccaccaucc

SEQ ID NO: 1779108 - RNA, 12 nt, Salmonella enterica enterica serovar Typhi Ty2
gacugccgcaga

SEQ ID NO: 1779109 - RNA, 19 nt, Salmonella enterica enterica serovar Typhi Ty2
gacugccuaacuggaaaaa

SEQ ID NO: 1779110 - RNA, 17 nt, Salmonella enterica enterica serovar Typhi Ty2
gacugauuuaucaccca

SEQ ID NO: 1779111 - RNA, 14 nt, Salmonella enterica enterica serovar Typhi Ty2
gacugcacuuccug

SEQ ID NO: 1779112 - RNA, 20 nt, Salmonella enterica enterica serovar Typhi Ty2
gacugaguauuggcaagaau

SEQ ID NO: 1779113 - RNA, 14 nt, Salmonella enterica enterica serovar Typhi Ty2
gacugaaaaucaaa

SEQ ID NO: 1779114 - RNA, 11 nt, Salmonella enterica enterica serovar Typhi Ty2
gacugaacaua

SEQ ID NO: 1779115 - RNA, 19 nt, Salmonella enterica enterica serovar Typhi Ty2
gacucuguggccgcgcaug

SEQ ID NO: 1779116 - RNA, 13 nt, Salmonella enterica enterica serovar Typhi Ty2
gacucuuguuucu

SEQ ID NO: 1779117 - RNA, 15 nt, Salmonella enterica enterica serovar Typhi Ty2
gacucuguuauauau

SEQ ID NO: 1779118 - RNA, 22 nt, Salmonella enterica enterica serovar Typhi Ty2
gagacaaauaacuuuccugccu

SEQ ID NO: 1779119 - RNA, 21 nt, Salmonella enterica enterica serovar Typhi Ty2
gagacagagaaccugaacaau

SEQ ID NO: 1779120 - RNA, 17 nt, Salmonella enterica enterica serovar Typhi Ty2
gagacagagaaccugaa

SEQ ID NO: 1779121 - RNA, 18 nt, Salmonella enterica enterica serovar Typhi Ty2
gagacagcgggcaauggc

SEQ ID NO: 1779122 - RNA, 22 nt, Salmonella enterica enterica serovar Typhi Ty2
gagacaggccagaauucagcau

SEQ ID NO: 1779123 - RNA, 18 nt, Salmonella enterica enterica serovar Typhi Ty2
gagacauugccuuccagg

SEQ ID NO: 1779124 - RNA, 18 nt, Salmonella enterica enterica serovar Typhi Ty2
gagaaucaccuggcagcc

SEQ ID NO: 1779125 - RNA, 17 nt, Salmonella enterica enterica serovar Typhi Ty2
gagaaugcgagcaaaac

SEQ ID NO: 1779126 - RNA, 13 nt, Salmonella enterica enterica serovar Typhi Ty2
gagaauuuuuagc

SEQ ID NO: 1779127 - RNA, 19 nt, Salmonella enterica enterica serovar Typhi Ty2
gagaaugucgccauaucuu

SEQ ID NO: 1779128 - RNA, 16 nt, Salmonella enterica enterica serovar Typhi Ty2
gagaauggccagcaca

SEQ ID NO: 1779129 - RNA, 17 nt, Salmonella enterica enterica serovar Typhi Ty2
gagaagaagaauuauua

SEQ ID NO: 1779130 - RNA, 14 nt, Salmonella enterica enterica serovar Typhi Ty2
gagaagaagaauua

SEQ ID NO: 1779131 - RNA, 22 nt, Salmonella enterica enterica serovar Typhi Ty2
gagaacgguucauccagcagca

SEQ ID NO: 1779132 - RNA, 20 nt, Salmonella enterica enterica serovar Typhi Ty2
gagaacgccgggccugccag

SEQ ID NO: 1779133 - RNA, 15 nt, Salmonella enterica enterica serovar Typhi Ty2
gagaaggucagucca

SEQ ID NO: 1779134 - RNA, 16 nt, Salmonella enterica enterica serovar Typhi Ty2
gagaagcgcgccugcc

SEQ ID NO: 1779135 - RNA, 20 nt, Salmonella enterica enterica serovar Typhi Ty2
gagagcaauggcguggcgcu

SEQ ID NO: 1779136 - RNA, 22 nt, Salmonella enterica enterica serovar Typhi Ty2
gagagacguucauuucuuccag

SEQ ID NO: 1779137 - RNA, 19 nt, Salmonella enterica enterica serovar Typhi Ty2
gagaggccaccagcgccag

SEQ ID NO: 1779138 - RNA, 19 nt, Salmonella enterica enterica serovar Typhi Ty2
gagagccuuacaggcgcau

SEQ ID NO: 1779139 - RNA, 13 nt, Salmonella enterica enterica serovar Typhi Ty2
gagaggaggagau

SEQ ID NO: 1779140 - RNA, 15 nt, Salmonella enterica enterica serovar Typhi Ty2
gagacuguuugucuc

SEQ ID NO: 1779141 - RNA, 13 nt, Salmonella enterica enterica serovar Typhi Ty2
gagacugauaaug

SEQ ID NO: 1779142 - RNA, 14 nt, Salmonella enterica enterica serovar Typhi Ty2
gagagaaacaacac

SEQ ID NO: 1779143 - RNA, 22 nt, Salmonella enterica enterica serovar Typhi Ty2
gagacguucauuucuuccagca

SEQ ID NO: 1779144 - RNA, 13 nt, Salmonella enterica enterica serovar Typhi Ty2
gagacucaaagaa

SEQ ID NO: 1779145 - RNA, 14 nt, Salmonella enterica enterica serovar Typhi Ty2
gagacucagcagcg

SEQ ID NO: 1779146 - RNA, 18 nt, Salmonella enterica enterica serovar Typhi Ty2
gagacgcuggaaaauuuc

SEQ ID NO: 1779147 - RNA, 20 nt, Salmonella enterica enterica serovar Typhi Ty2
gagaccgggcuuuguugucu

SEQ ID NO: 1779148 - RNA, 15 nt, Salmonella enterica enterica serovar Typhi Ty2
gagaccaucaacagc

SEQ ID NO: 1779149 - RNA, 12 nt, Salmonella enterica enterica serovar Typhi Ty2
gagaaaauaccg

SEQ ID NO: 1779150 - RNA, 16 nt, Salmonella enterica enterica serovar Typhi Ty2
gagaaaacgcggccug

SEQ ID NO: 1779151 - RNA, 22 nt, Salmonella enterica enterica serovar Typhi Ty2
gagaaaaauacgccagauaacg

SEQ ID NO: 1779152 - RNA, 20 nt, Salmonella enterica enterica serovar Typhi Ty2
gagaaaauaccgcacaucac

SEQ ID NO: 1779153 - RNA, 14 nt, Salmonella enterica enterica serovar Typhi Ty2
gagaaccugaacaa

SEQ ID NO: 1779154 - RNA, 16 nt, Salmonella enterica enterica serovar Typhi Ty2
gagaacagguaguuac

SEQ ID NO: 1779155 - RNA, 23 nt, Salmonella enterica enterica serovar Typhi Ty2
gagaaauuuaggucaaaaaagcg

SEQ ID NO: 1779156 - RNA, 12 nt, Salmonella enterica enterica serovar Typhi Ty2
gagaacagcauc

SEQ ID NO: 1779157 - RNA, 11 nt, Salmonella enterica enterica serovar Typhi Ty2
gagaaaucaac

SEQ ID NO: 1779158 - RNA, 20 nt, Salmonella enterica enterica serovar Typhi Ty2
gagaaaucaacgaaaucaga

SEQ ID NO: 1779159 - RNA, 12 nt, Salmonella enterica enterica serovar Typhi Ty2
gagaaaguggug

SEQ ID NO: 1779160 - RNA, 23 nt, Salmonella enterica enterica serovar Typhi Ty2
gagaaaucaacgaaaucagagac

SEQ ID NO: 1779161 - RNA, 18 nt, Salmonella enterica enterica serovar Typhi Ty2
gagaaauuuagcaguaac

SEQ ID NO: 1779162 - RNA, 17 nt, Salmonella enterica enterica serovar Typhi Ty2
gagaaaaaaauccagua

SEQ ID NO: 1779163 - RNA, 20 nt, Salmonella enterica enterica serovar Typhi Ty2
gacuuuuuugccuuucagau

SEQ ID NO: 1779164 - RNA, 20 nt, Salmonella enterica enterica serovar Typhi Ty2
gagaaaaagcaauaauccgc

SEQ ID NO: 1779165 - RNA, 13 nt, Salmonella enterica enterica serovar Typhi Ty2
gacuuuggauaaa

SEQ ID NO: 1779166 - RNA, 20 nt, Salmonella enterica enterica serovar Typhi Ty2
gacuuuaaacgucaugcugu

SEQ ID NO: 1779167 - RNA, 20 nt, Salmonella enterica enterica serovar Typhi Ty2
gacuguagauaccuacuuua

SEQ ID NO: 1779168 - RNA, 14 nt, Salmonella enterica enterica serovar Typhi Ty2
gacuggucgcccgg

SEQ ID NO: 1779169 - RNA, 17 nt, Salmonella enterica enterica serovar Typhi Ty2
gacuuagcccuggccaa

SEQ ID NO: 1779170 - RNA, 17 nt, Salmonella enterica enterica serovar Typhi Ty2
gacuguucacauccagc

SEQ ID NO: 1779171 - RNA, 22 nt, Salmonella enterica enterica serovar Typhi Ty2
gacuuaaaguacuucacaauca

SEQ ID NO: 1779172 - RNA, 23 nt, Salmonella enterica enterica serovar Typhi Ty2
gacuguuucauuacucguccuuc

SEQ ID NO: 1779173 - RNA, 18 nt, Salmonella enterica enterica serovar Typhi Ty2
gacugucuuguuuuucug

SEQ ID NO: 1779174 - RNA, 16 nt, Salmonella enterica enterica serovar Typhi Ty2
gacugugauggcgguc

SEQ ID NO: 1779175 - RNA, 18 nt, Salmonella enterica enterica serovar Typhi Ty2
gacuuaucgaccuuuucc

SEQ ID NO: 1779176 - RNA, 15 nt, Salmonella enterica enterica serovar Typhi Ty2
gacuuauuaaaaaua

SEQ ID NO: 1779177 - RNA, 20 nt, Salmonella enterica enterica serovar Typhi Ty2
gacuucacacugugguuucu

SEQ ID NO: 1779178 - RNA, 14 nt, Salmonella enterica enterica serovar Typhi Ty2
gacuucacuuuccc

SEQ ID NO: 1779179 - RNA, 21 nt, Salmonella enterica enterica serovar Typhi Ty2
gacuucugcucgguaaaaagu

SEQ ID NO: 1779180 - RNA, 13 nt, Salmonella enterica enterica serovar Typhi Ty2
gacagugaugaau

SEQ ID NO: 1779181 - RNA, 23 nt, Salmonella enterica enterica serovar Typhi Ty2
gacagugauuuacuccaaaaaua

SEQ ID NO: 1779182 - RNA, 13 nt, Salmonella enterica enterica serovar Typhi Ty2
gacaguggcuuua

SEQ ID NO: 1779183 - RNA, 18 nt, Salmonella enterica enterica serovar Typhi Ty2
gacaguguucccugcgcu

SEQ ID NO: 1779184 - RNA, 13 nt, Salmonella enterica enterica serovar Typhi Ty2
gacaguucccggc

SEQ ID NO: 1779185 - RNA, 15 nt, Salmonella enterica enterica serovar Typhi Ty2
gacauaagaguccau

SEQ ID NO: 1779186 - RNA, 22 nt, Salmonella enterica enterica serovar Typhi Ty2
gacauagucgucuauuuccgcu

SEQ ID NO: 1779187 - RNA, 21 nt, Salmonella enterica enterica serovar Typhi Ty2
gacauaguacccucugcacca

SEQ ID NO: 1779188 - RNA, 14 nt, Salmonella enterica enterica serovar Typhi Ty2
gacaggugaccagg

SEQ ID NO: 1779189 - RNA, 17 nt, Salmonella enterica enterica serovar Typhi Ty2
gacagugaacggcauaa

SEQ ID NO: 1779190 - RNA, 11 nt, Salmonella enterica enterica serovar Typhi Ty2
gacaucuucau

SEQ ID NO: 1779191 - RNA, 14 nt, Salmonella enterica enterica serovar Typhi Ty2
gacaugaccgcaca

SEQ ID NO: 1779192 - RNA, 17 nt, Salmonella enterica enterica serovar Typhi Ty2
gacauggcaauggcuuc

SEQ ID NO: 1779193 - RNA, 15 nt, Salmonella enterica enterica serovar Typhi Ty2
gacauggcgaccggg

SEQ ID NO: 1779194 - RNA, 21 nt, Salmonella enterica enterica serovar Typhi Ty2
gacauggcggucgccauaugu

SEQ ID NO: 1779195 - RNA, 17 nt, Salmonella enterica enterica serovar Typhi Ty2
gacauuauucaccugga

SEQ ID NO: 1779196 - RNA, 12 nt, Salmonella enterica enterica serovar Typhi Ty2
gacauucccugc

SEQ ID NO: 1779197 - RNA, 14 nt, Salmonella enterica enterica serovar Typhi Ty2
gacauugcgcggcg

SEQ ID NO: 1779198 - RNA, 16 nt, Salmonella enterica enterica serovar Typhi Ty2
gacauucugacggccc

SEQ ID NO: 1779199 - RNA, 19 nt, Salmonella enterica enterica serovar Typhi Ty2
gacauuguucuaaacguuc

SEQ ID NO: 1779200 - RNA, 16 nt, Salmonella enterica enterica serovar Typhi Ty2
gaccaguuauucggca

SEQ ID NO: 1779201 - RNA, 18 nt, Salmonella enterica enterica serovar Typhi Ty2
gaccaguucaccggcggc

SEQ ID NO: 1779202 - RNA, 20 nt, Salmonella enterica enterica serovar Typhi Ty2
gaccaguuguaaucggcgcc

SEQ ID NO: 1779203 - RNA, 18 nt, Salmonella enterica enterica serovar Typhi Ty2
gaccagucggacagcgac

SEQ ID NO: 1779204 - RNA, 15 nt, Salmonella enterica enterica serovar Typhi Ty2
gaccagguacagcuu

SEQ ID NO: 1779205 - RNA, 21 nt, Salmonella enterica enterica serovar Typhi Ty2
gaccaggauggccagcaccag

SEQ ID NO: 1779206 - RNA, 15 nt, Salmonella enterica enterica serovar Typhi Ty2
gaccaggauggccag

SEQ ID NO: 1779207 - RNA, 20 nt, Salmonella enterica enterica serovar Typhi Ty2
gaccaggauuuaauggucuc

SEQ ID NO: 1779208 - RNA, 14 nt, Salmonella enterica enterica serovar Typhi Ty2
gaccaggauggcca

SEQ ID NO: 1779209 - RNA, 18 nt, Salmonella enterica enterica serovar Typhi Ty2
gaccaggcgacuauccac

SEQ ID NO: 1779210 - RNA, 12 nt, Salmonella enterica enterica serovar Typhi Ty2
gaccagcaucag

SEQ ID NO: 1779211 - RNA, 18 nt, Salmonella enterica enterica serovar Typhi Ty2
gaccagcaucagaauaau

SEQ ID NO: 1779212 - RNA, 13 nt, Salmonella enterica enterica serovar Typhi Ty2
gaccagcaucagc

SEQ ID NO: 1779213 - RNA, 16 nt, Salmonella enterica enterica serovar Typhi Ty2
gaccagcaugugccgg

SEQ ID NO: 1779214 - RNA, 17 nt, Salmonella enterica enterica serovar Typhi Ty2
gaccagcaugugccgga

SEQ ID NO: 1779215 - RNA, 23 nt, Salmonella enterica enterica serovar Typhi Ty2
gaccagcaccaucuuuuccggca

SEQ ID NO: 1779216 - RNA, 14 nt, Salmonella enterica enterica serovar Typhi Ty2
gaccagauacuuca

SEQ ID NO: 1779217 - RNA, 18 nt, Salmonella enterica enterica serovar Typhi Ty2
gaccagcgacgaugaaau

SEQ ID NO: 1779218 - RNA, 21 nt, Salmonella enterica enterica serovar Typhi Ty2
gaccagcgcaaacaacccggc

SEQ ID NO: 1779219 - RNA, 19 nt, Salmonella enterica enterica serovar Typhi Ty2
gaccagcugacgacgccag

SEQ ID NO: 1779220 - RNA, 21 nt, Salmonella enterica enterica serovar Typhi Ty2
gaccagcugacgacgccagcc

SEQ ID NO: 1779221 - RNA, 22 nt, Salmonella enterica enterica serovar Typhi Ty2
gaccagcguaccgucucggccu

SEQ ID NO: 1779222 - RNA, 21 nt, Salmonella enterica enterica serovar Typhi Ty2
gaccaauaaaggucggcugcc

SEQ ID NO: 1779223 - RNA, 21 nt, Salmonella enterica enterica serovar Typhi Ty2
gaccaauagagagcgacagcc

SEQ ID NO: 1779224 - RNA, 12 nt, Salmonella enterica enterica serovar Typhi Ty2
gaccaauauccg

SEQ ID NO: 1779225 - RNA, 22 nt, Salmonella enterica enterica serovar Typhi Ty2
gaccacaccgucaacaucaucc

SEQ ID NO: 1779226 - RNA, 14 nt, Salmonella enterica enterica serovar Typhi Ty2
gaccaacaccagcc

SEQ ID NO: 1779227 - RNA, 20 nt, Salmonella enterica enterica serovar Typhi Ty2
gaccaaaugguugguauugc

SEQ ID NO: 1779228 - RNA, 23 nt, Salmonella enterica enterica serovar Typhi Ty2
gaccaaaauggcaaguaaaauag

SEQ ID NO: 1779229 - RNA, 18 nt, Salmonella enterica enterica serovar Typhi Ty2
gaccaacuuuuguagaga

SEQ ID NO: 1779230 - RNA, 17 nt, Salmonella enterica enterica serovar Typhi Ty2
gaccaacaccuacgaua

SEQ ID NO: 1779231 - RNA, 17 nt, Salmonella enterica enterica serovar Typhi Ty2
gaccaacguuuuuccuu

SEQ ID NO: 1779232 - RNA, 14 nt, Salmonella enterica enterica serovar Typhi Ty2
gaccacgccgccgc

SEQ ID NO: 1779233 - RNA, 23 nt, Salmonella enterica enterica serovar Typhi Ty2
gaccacgccaucaacagcggaga

SEQ ID NO: 1779234 - RNA, 16 nt, Salmonella enterica enterica serovar Typhi Ty2
gaccacgaaucaggau

SEQ ID NO: 1779235 - RNA, 13 nt, Salmonella enterica enterica serovar Typhi Ty2
gacaaaaauacca

SEQ ID NO: 1779236 - RNA, 19 nt, Salmonella enterica enterica serovar Typhi Ty2
gacaaaagauuuaucaauu

SEQ ID NO: 1779237 - RNA, 20 nt, Salmonella enterica enterica serovar Typhi Ty2
gaauuuuuccagcucagaaa

SEQ ID NO: 1779238 - RNA, 17 nt, Salmonella enterica enterica serovar Typhi Ty2
gacaacaaaaagauauu

SEQ ID NO: 1779239 - RNA, 21 nt, Salmonella enterica enterica serovar Typhi Ty2
gacaaaauaaagugaaauaaa

SEQ ID NO: 1779240 - RNA, 15 nt, Salmonella enterica enterica serovar Typhi Ty2
gacaaaaggugucac

SEQ ID NO: 1779241 - RNA, 14 nt, Salmonella enterica enterica serovar Typhi Ty2
gacaaacccuguau

SEQ ID NO: 1779242 - RNA, 21 nt, Salmonella enterica enterica serovar Typhi Ty2
gacaacuucuaauuuuuccag

SEQ ID NO: 1779243 - RNA, 15 nt, Salmonella enterica enterica serovar Typhi Ty2
gacaacuauugcugc

SEQ ID NO: 1779244 - RNA, 19 nt, Salmonella enterica enterica serovar Typhi Ty2
gacaaggcgguacgccgcc

SEQ ID NO: 1779245 - RNA, 20 nt, Salmonella enterica enterica serovar Typhi Ty2
gacaacaucccagaaaauga

SEQ ID NO: 1779246 - RNA, 17 nt, Salmonella enterica enterica serovar Typhi Ty2
gacaacaucccagaaaa

SEQ ID NO: 1779247 - RNA, 19 nt, Salmonella enterica enterica serovar Typhi Ty2
gacaaccagcgaaaugacg

SEQ ID NO: 1779248 - RNA, 18 nt, Salmonella enterica enterica serovar Typhi Ty2
gacaacuagaauuuucac

SEQ ID NO: 1779249 - RNA, 22 nt, Salmonella enterica enterica serovar Typhi Ty2
gacaacguaaacggcagccgcc

SEQ ID NO: 1779250 - RNA, 14 nt, Salmonella enterica enterica serovar Typhi Ty2
gacaacgaccagug

SEQ ID NO: 1779251 - RNA, 17 nt, Salmonella enterica enterica serovar Typhi Ty2
gacaacgccgccuggca

SEQ ID NO: 1779252 - RNA, 23 nt, Salmonella enterica enterica serovar Typhi Ty2
gacaaucgucacuucaauuugcc

SEQ ID NO: 1779253 - RNA, 18 nt, Salmonella enterica enterica serovar Typhi Ty2
gacaaucaccaucccaug

SEQ ID NO: 1779254 - RNA, 20 nt, Salmonella enterica enterica serovar Typhi Ty2
gacaauccgcgaaugguuca

SEQ ID NO: 1779255 - RNA, 19 nt, Salmonella enterica enterica serovar Typhi Ty2
gacaauaacggccucaauu

SEQ ID NO: 1779256 - RNA, 18 nt, Salmonella enterica enterica serovar Typhi Ty2
gacaaggcgcgccagcgc

SEQ ID NO: 1779257 - RNA, 18 nt, Salmonella enterica enterica serovar Typhi Ty2
gacaauaaacuggcugug

SEQ ID NO: 1779258 - RNA, 16 nt, Salmonella enterica enterica serovar Typhi Ty2
gacagauuuggucagu

SEQ ID NO: 1779259 - RNA, 16 nt, Salmonella enterica enterica serovar Typhi Ty2
gacagauuuugcacuu

SEQ ID NO: 1779260 - RNA, 23 nt, Salmonella enterica enterica serovar Typhi Ty2
gacagauuuugcacuuuugccag

SEQ ID NO: 1779261 - RNA, 16 nt, Salmonella enterica enterica serovar Typhi Ty2
gacagauaacaccagc

SEQ ID NO: 1779262 - RNA, 24 nt, Salmonella enterica enterica serovar Typhi Ty2
gacagaugcagguucccgcccugc

SEQ ID NO: 1779263 - RNA, 19 nt, Salmonella enterica enterica serovar Typhi Ty2
gacagaucgguuuaucccc

SEQ ID NO: 1779264 - RNA, 17 nt, Salmonella enterica enterica serovar Typhi Ty2
gacagcaauaucagcca

SEQ ID NO: 1779265 - RNA, 22 nt, Salmonella enterica enterica serovar Typhi Ty2
gacagcaaguugcgccacugcc

SEQ ID NO: 1779266 - RNA, 19 nt, Salmonella enterica enterica serovar Typhi Ty2
gacagauuggucagcagcc

SEQ ID NO: 1779267 - RNA, 13 nt, Salmonella enterica enterica serovar Typhi Ty2
gacagaacaggau

SEQ ID NO: 1779268 - RNA, 20 nt, Salmonella enterica enterica serovar Typhi Ty2
gacacuuuccgacguuuuuc

SEQ ID NO: 1779269 - RNA, 19 nt, Salmonella enterica enterica serovar Typhi Ty2
gacagagcucgucaaaaau

SEQ ID NO: 1779270 - RNA, 14 nt, Salmonella enterica enterica serovar Typhi Ty2
gacaggaguauagc

SEQ ID NO: 1779271 - RNA, 17 nt, Salmonella enterica enterica serovar Typhi Ty2
gacagcguaaugcgcca

SEQ ID NO: 1779272 - RNA, 18 nt, Salmonella enterica enterica serovar Typhi Ty2
gacagcggggugugaagu

SEQ ID NO: 1779273 - RNA, 20 nt, Salmonella enterica enterica serovar Typhi Ty2
gacagcccggcguguuucag

SEQ ID NO: 1779274 - RNA, 17 nt, Salmonella enterica enterica serovar Typhi Ty2
gacagccuauuaaucac

SEQ ID NO: 1779275 - RNA, 22 nt, Salmonella enterica enterica serovar Typhi Ty2
gacagcgcccaacgcuucacaa

SEQ ID NO: 1779276 - RNA, 21 nt, Salmonella enterica enterica serovar Typhi Ty2
gacagcgccugaaaagagcga

SEQ ID NO: 1779277 - RNA, 18 nt, Salmonella enterica enterica serovar Typhi Ty2
gacagccagcauuuccag

SEQ ID NO: 1779278 - RNA, 19 nt, Salmonella enterica enterica serovar Typhi Ty2
gacagccagcauuuccagc

SEQ ID NO: 1779279 - RNA, 18 nt, Salmonella enterica enterica serovar Typhi Ty2
gacagcauuuuucacagu

SEQ ID NO: 1779280 - RNA, 15 nt, Salmonella enterica enterica serovar Typhi Ty2
gacaccgcaaaccgu

SEQ ID NO: 1779281 - RNA, 23 nt, Salmonella enterica enterica serovar Typhi Ty2
gacacggugugccgccaucagcg

SEQ ID NO: 1779282 - RNA, 21 nt, Salmonella enterica enterica serovar Typhi Ty2
gacacgcgcgcugcgccugga

SEQ ID NO: 1779283 - RNA, 11 nt, Salmonella enterica enterica serovar Typhi Ty2
gacacucaucc

SEQ ID NO: 1779284 - RNA, 20 nt, Salmonella enterica enterica serovar Typhi Ty2
gacacugaaacuccgcagcc

SEQ ID NO: 1779285 - RNA, 13 nt, Salmonella enterica enterica serovar Typhi Ty2
gacaccacgcagg

SEQ ID NO: 1779286 - RNA, 17 nt, Salmonella enterica enterica serovar Typhi Ty2
gacacaugaccugaaua

SEQ ID NO: 1779287 - RNA, 13 nt, Salmonella enterica enterica serovar Typhi Ty2
gacacccgcagcc

SEQ ID NO: 1779288 - RNA, 23 nt, Salmonella enterica enterica serovar Typhi Ty2
gacaauuuugauaagagaaaaua

SEQ ID NO: 1779289 - RNA, 21 nt, Salmonella enterica enterica serovar Typhi Ty2
gacacagcguacaauggcagg

SEQ ID NO: 1779290 - RNA, 20 nt, Salmonella enterica enterica serovar Typhi Ty2
gacacagucauugguaagag

SEQ ID NO: 1779291 - RNA, 18 nt, Salmonella enterica enterica serovar Typhi Ty2
gacgacgguuaaaaagua

SEQ ID NO: 1779292 - RNA, 23 nt, Salmonella enterica enterica serovar Typhi Ty2
gacgacuucacccgcgggcggcg

SEQ ID NO: 1779293 - RNA, 18 nt, Salmonella enterica enterica serovar Typhi Ty2
gacgacuucacccgcggg

SEQ ID NO: 1779294 - RNA, 14 nt, Salmonella enterica enterica serovar Typhi Ty2
gacgagcgaaaaac

SEQ ID NO: 1779295 - RNA, 16 nt, Salmonella enterica enterica serovar Typhi Ty2
gacgagcgaaaaacug

SEQ ID NO: 1779296 - RNA, 14 nt, Salmonella enterica enterica serovar Typhi Ty2
gacgaggaaaaaug

SEQ ID NO: 1779297 - RNA, 22 nt, Salmonella enterica enterica serovar Typhi Ty2
gacgaggauuagacuucuucca

SEQ ID NO: 1779298 - RNA, 15 nt, Salmonella enterica enterica serovar Typhi Ty2
gacgaucagcgccac

SEQ ID NO: 1779299 - RNA, 17 nt, Salmonella enterica enterica serovar Typhi Ty2
gacgauacgucauauca

SEQ ID NO: 1779300 - RNA, 21 nt, Salmonella enterica enterica serovar Typhi Ty2
gacgauacucagccccaggcc

SEQ ID NO: 1779301 - RNA, 13 nt, Salmonella enterica enterica serovar Typhi Ty2
gacgauaaccgga

SEQ ID NO: 1779302 - RNA, 16 nt, Salmonella enterica enterica serovar Typhi Ty2
gacgauaaccaugcuc

SEQ ID NO: 1779303 - RNA, 18 nt, Salmonella enterica enterica serovar Typhi Ty2
gacgagguuuccggcggg

SEQ ID NO: 1779304 - RNA, 14 nt, Salmonella enterica enterica serovar Typhi Ty2
gacgcacaggcgcg

SEQ ID NO: 1779305 - RNA, 13 nt, Salmonella enterica enterica serovar Typhi Ty2
gacgcaccagcca

SEQ ID NO: 1779306 - RNA, 16 nt, Salmonella enterica enterica serovar Typhi Ty2
gacgcaacucacgcca

SEQ ID NO: 1779307 - RNA, 15 nt, Salmonella enterica enterica serovar Typhi Ty2
gacgcagacaauaaa

SEQ ID NO: 1779308 - RNA, 17 nt, Salmonella enterica enterica serovar Typhi Ty2
gaccuuaucccgcugac

SEQ ID NO: 1779309 - RNA, 15 nt, Salmonella enterica enterica serovar Typhi Ty2
gacgaacggccugau

SEQ ID NO: 1779310 - RNA, 18 nt, Salmonella enterica enterica serovar Typhi Ty2
gacgaauccuauacccaa

SEQ ID NO: 1779311 - RNA, 19 nt, Salmonella enterica enterica serovar Typhi Ty2
gacgacaacgcccacauca

SEQ ID NO: 1779312 - RNA, 23 nt, Salmonella enterica enterica serovar Typhi Ty2
gacgaccguaauagcaauacuuu

SEQ ID NO: 1779313 - RNA, 16 nt, Salmonella enterica enterica serovar Typhi Ty2
gacgacccuguguagu

SEQ ID NO: 1779314 - RNA, 22 nt, Salmonella enterica enterica serovar Typhi Ty2
gacgcggugaaaggcuugcagg

SEQ ID NO: 1779315 - RNA, 20 nt, Salmonella enterica enterica serovar Typhi Ty2
gacgcucgacgaagccuucg

SEQ ID NO: 1779316 - RNA, 14 nt, Salmonella enterica enterica serovar Typhi Ty2
gacgcguuaauauc

SEQ ID NO: 1779317 - RNA, 15 nt, Salmonella enterica enterica serovar Typhi Ty2
gacgcugagagaacu

SEQ ID NO: 1779318 - RNA, 18 nt, Salmonella enterica enterica serovar Typhi Ty2
gacgcugaaccuuccauu

SEQ ID NO: 1779319 - RNA, 14 nt, Salmonella enterica enterica serovar Typhi Ty2
gacgcugaugaaaa

SEQ ID NO: 1779320 - RNA, 19 nt, Salmonella enterica enterica serovar Typhi Ty2
gacgcugcgccuggaugaa

SEQ ID NO: 1779321 - RNA, 15 nt, Salmonella enterica enterica serovar Typhi Ty2
gacgcuggaaaauuu

SEQ ID NO: 1779322 - RNA, 16 nt, Salmonella enterica enterica serovar Typhi Ty2
gacgcuggcacuggca

SEQ ID NO: 1779323 - RNA, 22 nt, Salmonella enterica enterica serovar Typhi Ty2
gacggacucgcgcagaaucagc

SEQ ID NO: 1779324 - RNA, 22 nt, Salmonella enterica enterica serovar Typhi Ty2
gacggauuggcgcucaauagcc

SEQ ID NO: 1779325 - RNA, 22 nt, Salmonella enterica enterica serovar Typhi Ty2
gacggccucuucacgcagcgcc

SEQ ID NO: 1779326 - RNA, 23 nt, Salmonella enterica enterica serovar Typhi Ty2
gacggcgaaucaauuuacgcacu

SEQ ID NO: 1779327 - RNA, 21 nt, Salmonella enterica enterica serovar Typhi Ty2
gacggcccaacagcaauguuu

SEQ ID NO: 1779328 - RNA, 17 nt, Salmonella enterica enterica serovar Typhi Ty2
gacgcccaucagcaucc

SEQ ID NO: 1779329 - RNA, 23 nt, Salmonella enterica enterica serovar Typhi Ty2
gacgccccauguggccagcggcc

SEQ ID NO: 1779330 - RNA, 13 nt, Salmonella enterica enterica serovar Typhi Ty2
gacgccagccagc

SEQ ID NO: 1779331 - RNA, 21 nt, Salmonella enterica enterica serovar Typhi Ty2
gacgccaccggguuaaagccc

SEQ ID NO: 1779332 - RNA, 16 nt, Salmonella enterica enterica serovar Typhi Ty2
gacgccaugcaaaaaa

SEQ ID NO: 1779333 - RNA, 14 nt, Salmonella enterica enterica serovar Typhi Ty2
gacgcccaaccagu

SEQ ID NO: 1779334 - RNA, 17 nt, Salmonella enterica enterica serovar Typhi Ty2
gacgccaagcugcagaa

SEQ ID NO: 1779335 - RNA, 21 nt, Salmonella enterica enterica serovar Typhi Ty2
gacgccaauuccuaucaguac

SEQ ID NO: 1779336 - RNA, 18 nt, Salmonella enterica enterica serovar Typhi Ty2
gacgccgggaaauuuuuc

SEQ ID NO: 1779337 - RNA, 12 nt, Salmonella enterica enterica serovar Typhi Ty2
gacgccugcaua

SEQ ID NO: 1779338 - RNA, 23 nt, Salmonella enterica enterica serovar Typhi Ty2
gacgccgucugguacggccacca

SEQ ID NO: 1779339 - RNA, 21 nt, Salmonella enterica enterica serovar Typhi Ty2
gacgcgcgcgaaaagaaacug

SEQ ID NO: 1779340 - RNA, 21 nt, Salmonella enterica enterica serovar Typhi Ty2
gacgcgcgagaacugcugcau

SEQ ID NO: 1779341 - RNA, 13 nt, Salmonella enterica enterica serovar Typhi Ty2
gacgcgcaggccg

SEQ ID NO: 1779342 - RNA, 21 nt, Salmonella enterica enterica serovar Typhi Ty2
gacgcgacuuuuuucacccag

SEQ ID NO: 1779343 - RNA, 19 nt, Salmonella enterica enterica serovar Typhi Ty2
gaccauaguccaugcccaa

SEQ ID NO: 1779344 - RNA, 14 nt, Salmonella enterica enterica serovar Typhi Ty2
gaccaguuaagcaa

SEQ ID NO: 1779345 - RNA, 21 nt, Salmonella enterica enterica serovar Typhi Ty2
gaccaguuuuugcgccagcgc

SEQ ID NO: 1779346 - RNA, 22 nt, Salmonella enterica enterica serovar Typhi Ty2
gaccaguuuuugcgccagcgca

SEQ ID NO: 1779347 - RNA, 21 nt, Salmonella enterica enterica serovar Typhi Ty2
gaccaguucaccggcggccag

SEQ ID NO: 1779348 - RNA, 18 nt, Salmonella enterica enterica serovar Typhi Ty2
gaccauaaauagccgacc

SEQ ID NO: 1779349 - RNA, 16 nt, Salmonella enterica enterica serovar Typhi Ty2
gaccauauaugaaauc

SEQ ID NO: 1779350 - RNA, 14 nt, Salmonella enterica enterica serovar Typhi Ty2
gaccaucaacagcg

SEQ ID NO: 1779351 - RNA, 14 nt, Salmonella enterica enterica serovar Typhi Ty2
gaccauauucacgc

SEQ ID NO: 1779352 - RNA, 19 nt, Salmonella enterica enterica serovar Typhi Ty2
gaccauauucacgcagcuu

SEQ ID NO: 1779353 - RNA, 12 nt, Salmonella enterica enterica serovar Typhi Ty2
gaccaugauauc

SEQ ID NO: 1779354 - RNA, 15 nt, Salmonella enterica enterica serovar Typhi Ty2
gaccauuccagguca

SEQ ID NO: 1779355 - RNA, 17 nt, Salmonella enterica enterica serovar Typhi Ty2
gaccauugcguauuuca

SEQ ID NO: 1779356 - RNA, 16 nt, Salmonella enterica enterica serovar Typhi Ty2
gacccacuaacugccg

SEQ ID NO: 1779357 - RNA, 17 nt, Salmonella enterica enterica serovar Typhi Ty2
gacccacgccagcagcu

SEQ ID NO: 1779358 - RNA, 19 nt, Salmonella enterica enterica serovar Typhi Ty2
gacccagcgcgaauuugcc

SEQ ID NO: 1779359 - RNA, 16 nt, Salmonella enterica enterica serovar Typhi Ty2
gacccaguacaaacaa

SEQ ID NO: 1779360 - RNA, 12 nt, Salmonella enterica enterica serovar Typhi Ty2
gacccauuuuaa

SEQ ID NO: 1779361 - RNA, 14 nt, Salmonella enterica enterica serovar Typhi Ty2
gaccccaauagcga

SEQ ID NO: 1779362 - RNA, 18 nt, Salmonella enterica enterica serovar Typhi Ty2
gaccccggccucgcccgc

SEQ ID NO: 1779363 - RNA, 18 nt, Salmonella enterica enterica serovar Typhi Ty2
gaccccaguaauccggca

SEQ ID NO: 1779364 - RNA, 22 nt, Salmonella enterica enterica serovar Typhi Ty2
gaccccauuaaacuggccccgc

SEQ ID NO: 1779365 - RNA, 14 nt, Salmonella enterica enterica serovar Typhi Ty2
gacccgaaguggug

SEQ ID NO: 1779366 - RNA, 15 nt, Salmonella enterica enterica serovar Typhi Ty2
gaccgcacagcagac

SEQ ID NO: 1779367 - RNA, 18 nt, Salmonella enterica enterica serovar Typhi Ty2
gaccgcagcuuauuccag

SEQ ID NO: 1779368 - RNA, 23 nt, Salmonella enterica enterica serovar Typhi Ty2
gaccgcccaggauaucgcgggcg

SEQ ID NO: 1779369 - RNA, 16 nt, Salmonella enterica enterica serovar Typhi Ty2
gaccgauauagccacu

SEQ ID NO: 1779370 - RNA, 22 nt, Salmonella enterica enterica serovar Typhi Ty2
gaccgaucucaugcaacuggca

SEQ ID NO: 1779371 - RNA, 13 nt, Salmonella enterica enterica serovar Typhi Ty2
gaccgagucuaca

SEQ ID NO: 1779372 - RNA, 17 nt, Salmonella enterica enterica serovar Typhi Ty2
gaccgagacccagcgcg

SEQ ID NO: 1779373 - RNA, 19 nt, Salmonella enterica enterica serovar Typhi Ty2
gaccgacauaaaacccgcc

SEQ ID NO: 1779374 - RNA, 19 nt, Salmonella enterica enterica serovar Typhi Ty2
gaccgacaagccccccgca

SEQ ID NO: 1779375 - RNA, 14 nt, Salmonella enterica enterica serovar Typhi Ty2
gacccgcagcaauc

SEQ ID NO: 1779376 - RNA, 22 nt, Salmonella enterica enterica serovar Typhi Ty2
gacccgcaaaccaggucugcgc

SEQ ID NO: 1779377 - RNA, 17 nt, Salmonella enterica enterica serovar Typhi Ty2
gacccgccgccagcacc

SEQ ID NO: 1779378 - RNA, 19 nt, Salmonella enterica enterica serovar Typhi Ty2
gacccgcuuccaguuuugc

SEQ ID NO: 1779379 - RNA, 21 nt, Salmonella enterica enterica serovar Typhi Ty2
gacccgcuuccaguuuugcca

SEQ ID NO: 1779380 - RNA, 19 nt, Salmonella enterica enterica serovar Typhi Ty2
gacccugagcucaaacgua

SEQ ID NO: 1779381 - RNA, 18 nt, Salmonella enterica enterica serovar Typhi Ty2
gacccuuaugucauucag

SEQ ID NO: 1779382 - RNA, 14 nt, Salmonella enterica enterica serovar Typhi Ty2
gacccuugcgacca

SEQ ID NO: 1779383 - RNA, 16 nt, Salmonella enterica enterica serovar Typhi Ty2
gaccugcaacuccaca

SEQ ID NO: 1779384 - RNA, 23 nt, Salmonella enterica enterica serovar Typhi Ty2
gaccugcaacuccacaaauagca

SEQ ID NO: 1779385 - RNA, 17 nt, Salmonella enterica enterica serovar Typhi Ty2
gaccugcuccaugacgu

SEQ ID NO: 1779386 - RNA, 16 nt, Salmonella enterica enterica serovar Typhi Ty2
gaccuguagaugaaac

SEQ ID NO: 1779387 - RNA, 22 nt, Salmonella enterica enterica serovar Typhi Ty2
gaccuguucuguaggcugugca

SEQ ID NO: 1779388 - RNA, 11 nt, Salmonella enterica enterica serovar Typhi Ty2
gaccuggcgcu

SEQ ID NO: 1779389 - RNA, 18 nt, Salmonella enterica enterica serovar Typhi Ty2
gaccuggcgcucaaucag

SEQ ID NO: 1779390 - RNA, 20 nt, Salmonella enterica enterica serovar Typhi Ty2
gaccguuuucaacgccgcgc

SEQ ID NO: 1779391 - RNA, 20 nt, Salmonella enterica enterica serovar Typhi Ty2
gaccgucgcgcccuccucca

SEQ ID NO: 1779392 - RNA, 19 nt, Salmonella enterica enterica serovar Typhi Ty2
gaccgucuuugucaagcac

SEQ ID NO: 1779393 - RNA, 13 nt, Salmonella enterica enterica serovar Typhi Ty2
gaccuccgccauc

SEQ ID NO: 1779394 - RNA, 18 nt, Salmonella enterica enterica serovar Typhi Ty2
gaccgucaaacguccaua

SEQ ID NO: 1779395 - RNA, 18 nt, Salmonella enterica enterica serovar Typhi Ty2
gaccggugaugugcuggc

SEQ ID NO: 1779396 - RNA, 21 nt, Salmonella enterica enterica serovar Typhi Ty2
gaccgggggcuggccacugga

SEQ ID NO: 1779397 - RNA, 17 nt, Salmonella enterica enterica serovar Typhi Ty2
gaccggacguugaaaaa

SEQ ID NO: 1779398 - RNA, 23 nt, Salmonella enterica enterica serovar Typhi Ty2
gaccggcaaaaagaaucgccagu

SEQ ID NO: 1779399 - RNA, 17 nt, Salmonella enterica enterica serovar Typhi Ty2
gaccggaacggacgugc

SEQ ID NO: 1779400 - RNA, 15 nt, Salmonella enterica enterica serovar Typhi Ty2
gaccgcuuuuuccag

SEQ ID NO: 1779401 - RNA, 22 nt, Salmonella enterica enterica serovar Typhi Ty2
gaccggcacucaccucuuccgc

SEQ ID NO: 1779402 - RNA, 13 nt, Salmonella enterica enterica serovar Typhi Ty2
gaccggcccgcuu

SEQ ID NO: 1779403 - RNA, 22 nt, Salmonella enterica enterica serovar Typhi Ty2
gaccgccgucauagcaggagau

SEQ ID NO: 1779404 - RNA, 22 nt, Salmonella enterica enterica serovar Typhi Ty2
gaccgccugcaucaccucagaa

SEQ ID NO: 1779405 - RNA, 18 nt, Salmonella enterica enterica serovar Typhi Ty2
gaccgccgaguccgaggc

SEQ ID NO: 1779406 - RNA, 21 nt, Salmonella enterica enterica serovar Typhi Ty2
cguuauaaggccugccguccu

SEQ ID NO: 1779407 - RNA, 13 nt, Salmonella enterica enterica serovar Typhi Ty2
cguccacauccag

SEQ ID NO: 1779408 - RNA, 14 nt, Salmonella enterica enterica serovar Typhi Ty2
cguuaucggccugc

SEQ ID NO: 1779409 - RNA, 17 nt, Salmonella enterica enterica serovar Typhi Ty2
cguuaucugaccuacag

SEQ ID NO: 1779410 - RNA, 16 nt, Salmonella enterica enterica serovar Typhi Ty2
cguuaucuguaauuga

SEQ ID NO: 1779411 - RNA, 18 nt, Salmonella enterica enterica serovar Typhi Ty2
cguuaucguagugccaca

SEQ ID NO: 1779412 - RNA, 15 nt, Salmonella enterica enterica serovar Typhi Ty2
cguuauccagcagcc

SEQ ID NO: 1779413 - RNA, 21 nt, Salmonella enterica enterica serovar Typhi Ty2
cgucauuaccaguugaccaaa

SEQ ID NO: 1779414 - RNA, 15 nt, Salmonella enterica enterica serovar Typhi Ty2
cguccacauccccgc

SEQ ID NO: 1779415 - RNA, 21 nt, Salmonella enterica enterica serovar Typhi Ty2
cguccacacgccuggccaggc

SEQ ID NO: 1779416 - RNA, 18 nt, Salmonella enterica enterica serovar Typhi Ty2
cguucgggguugaugguu

SEQ ID NO: 1779417 - RNA, 20 nt, Salmonella enterica enterica serovar Typhi Ty2
cguuccguucgcgucacaau

SEQ ID NO: 1779418 - RNA, 14 nt, Salmonella enterica enterica serovar Typhi Ty2
cguuccguuaauug

SEQ ID NO: 1779419 - RNA, 19 nt, Salmonella enterica enterica serovar Typhi Ty2
cguucauaguuugcauaac

SEQ ID NO: 1779420 - RNA, 16 nt, Salmonella enterica enterica serovar Typhi Ty2
cguucauugcuuucuu

SEQ ID NO: 1779421 - RNA, 19 nt, Salmonella enterica enterica serovar Typhi Ty2
cguucauucgccccagcau

SEQ ID NO: 1779422 - RNA, 15 nt, Salmonella enterica enterica serovar Typhi Ty2
cguucauucccgcca

SEQ ID NO: 1779423 - RNA, 20 nt, Salmonella enterica enterica serovar Typhi Ty2
cguuccgcgauuuccugugu

SEQ ID NO: 1779424 - RNA, 20 nt, Salmonella enterica enterica serovar Typhi Ty2
cguugccuggccuccggcgg

SEQ ID NO: 1779425 - RNA, 17 nt, Salmonella enterica enterica serovar Typhi Ty2
cguugcgaaucagguac

SEQ ID NO: 1779426 - RNA, 21 nt, Salmonella enterica enterica serovar Typhi Ty2
cguugccguaggcaacgaccc

SEQ ID NO: 1779427 - RNA, 17 nt, Salmonella enterica enterica serovar Typhi Ty2
cguugcgccuuuccggc

SEQ ID NO: 1779428 - RNA, 15 nt, Salmonella enterica enterica serovar Typhi Ty2
cguugccaaaagguu

SEQ ID NO: 1779429 - RNA, 16 nt, Salmonella enterica enterica serovar Typhi Ty2
cguugccgcaggcaac

SEQ ID NO: 1779430 - RNA, 20 nt, Salmonella enterica enterica serovar Typhi Ty2
cguucucacggucuccugaa

SEQ ID NO: 1779431 - RNA, 22 nt, Salmonella enterica enterica serovar Typhi Ty2
cguucuaucagguaucccgcca

SEQ ID NO: 1779432 - RNA, 22 nt, Salmonella enterica enterica serovar Typhi Ty2
cguugaccgcuucgccuucgcc

SEQ ID NO: 1779433 - RNA, 15 nt, Salmonella enterica enterica serovar Typhi Ty2
cguugauagacgaca

SEQ ID NO: 1779434 - RNA, 22 nt, Salmonella enterica enterica serovar Typhi Ty2
cguuuuucugaagcguaacagc

SEQ ID NO: 1779435 - RNA, 15 nt, Salmonella enterica enterica serovar Typhi Ty2
cguuuuucucaucaa

SEQ ID NO: 1779436 - RNA, 16 nt, Salmonella enterica enterica serovar Typhi Ty2
cuaaaauacccgaccc

SEQ ID NO: 1779437 - RNA, 16 nt, Salmonella enterica enterica serovar Typhi Ty2
cuaaacagcaaaucgg

SEQ ID NO: 1779438 - RNA, 17 nt, Salmonella enterica enterica serovar Typhi Ty2
cuaaagggaucuuccug

SEQ ID NO: 1779439 - RNA, 20 nt, Salmonella enterica enterica serovar Typhi Ty2
cuaaaguuuauuuaggauuu

SEQ ID NO: 1779440 - RNA, 17 nt, Salmonella enterica enterica serovar Typhi Ty2
cuaaaguaaaggaauaa

SEQ ID NO: 1779441 - RNA, 15 nt, Salmonella enterica enterica serovar Typhi Ty2
cuaaacucaucuuua

SEQ ID NO: 1779442 - RNA, 21 nt, Salmonella enterica enterica serovar Typhi Ty2
cuaaagccaguuucucuucuu

SEQ ID NO: 1779443 - RNA, 12 nt, Salmonella enterica enterica serovar Typhi Ty2
cguuuugcuguc

SEQ ID NO: 1779444 - RNA, 19 nt, Salmonella enterica enterica serovar Typhi Ty2
cguuuuggguaaauaccag

SEQ ID NO: 1779445 - RNA, 17 nt, Salmonella enterica enterica serovar Typhi Ty2
cguuuugcugccacguc

SEQ ID NO: 1779446 - RNA, 13 nt, Salmonella enterica enterica serovar Typhi Ty2
cguuuugcucuuc

SEQ ID NO: 1779447 - RNA, 17 nt, Salmonella enterica enterica serovar Typhi Ty2
cguuuugcgacuucaga

SEQ ID NO: 1779448 - RNA, 23 nt, Salmonella enterica enterica serovar Typhi Ty2
cguuuuccaggugcugccacauc

SEQ ID NO: 1779449 - RNA, 16 nt, Salmonella enterica enterica serovar Typhi Ty2
cguuuucgucaacaua

SEQ ID NO: 1779450 - RNA, 20 nt, Salmonella enterica enterica serovar Typhi Ty2
cguuuucccggcaauuaccg

SEQ ID NO: 1779451 - RNA, 13 nt, Salmonella enterica enterica serovar Typhi Ty2
cguuuugcagcgc

SEQ ID NO: 1779452 - RNA, 19 nt, Salmonella enterica enterica serovar Typhi Ty2
cguuucucgcgaccagaga

SEQ ID NO: 1779453 - RNA, 12 nt, Salmonella enterica enterica serovar Typhi Ty2
cguuucucuugu

SEQ ID NO: 1779454 - RNA, 13 nt, Salmonella enterica enterica serovar Typhi Ty2
cguuucuacaaua

SEQ ID NO: 1779455 - RNA, 16 nt, Salmonella enterica enterica serovar Typhi Ty2
cguuucucgcgaccag

SEQ ID NO: 1779456 - RNA, 21 nt, Salmonella enterica enterica serovar Typhi Ty2
cguuucuggggcaagcucuuc

SEQ ID NO: 1779457 - RNA, 14 nt, Salmonella enterica enterica serovar Typhi Ty2
cguuugaacagcag

SEQ ID NO: 1779458 - RNA, 15 nt, Salmonella enterica enterica serovar Typhi Ty2
cguuucuuucaucag

SEQ ID NO: 1779459 - RNA, 13 nt, Salmonella enterica enterica serovar Typhi Ty2
cguuuucaauaau

SEQ ID NO: 1779460 - RNA, 20 nt, Salmonella enterica enterica serovar Typhi Ty2
cguuuucauuagccgccagc

SEQ ID NO: 1779461 - RNA, 18 nt, Salmonella enterica enterica serovar Typhi Ty2
cguuguggcgaccagcag

SEQ ID NO: 1779462 - RNA, 22 nt, Salmonella enterica enterica serovar Typhi Ty2
cguugcuggacauauuccagaa

SEQ ID NO: 1779463 - RNA, 16 nt, Salmonella enterica enterica serovar Typhi Ty2
cguuguccagcggcca

SEQ ID NO: 1779464 - RNA, 14 nt, Salmonella enterica enterica serovar Typhi Ty2
cguuguccagcaga

SEQ ID NO: 1779465 - RNA, 19 nt, Salmonella enterica enterica serovar Typhi Ty2
cguugcguguuguacagca

SEQ ID NO: 1779466 - RNA, 19 nt, Salmonella enterica enterica serovar Typhi Ty2
cguuucacaaccuccacgc

SEQ ID NO: 1779467 - RNA, 16 nt, Salmonella enterica enterica serovar Typhi Ty2
cguuucagucaccagc

SEQ ID NO: 1779468 - RNA, 14 nt, Salmonella enterica enterica serovar Typhi Ty2
cguuucagccccuu

SEQ ID NO: 1779469 - RNA, 19 nt, Salmonella enterica enterica serovar Typhi Ty2
cguuucguuuagcgccugc

SEQ ID NO: 1779470 - RNA, 15 nt, Salmonella enterica enterica serovar Typhi Ty2
cguuucauguaaaug

SEQ ID NO: 1779471 - RNA, 14 nt, Salmonella enterica enterica serovar Typhi Ty2
cguuuaugcaggaa

SEQ ID NO: 1779472 - RNA, 15 nt, Salmonella enterica enterica serovar Typhi Ty2
cguuuaugccgccau

SEQ ID NO: 1779473 - RNA, 15 nt, Salmonella enterica enterica serovar Typhi Ty2
cguuuauuauaaaca

SEQ ID NO: 1779474 - RNA, 20 nt, Salmonella enterica enterica serovar Typhi Ty2
cguuucaacaaacucagcca

SEQ ID NO: 1779475 - RNA, 13 nt, Salmonella enterica enterica serovar Typhi Ty2
cguuuauuauuug

SEQ ID NO: 1779476 - RNA, 13 nt, Salmonella enterica enterica serovar Typhi Ty2
cguuuauucuuuu

SEQ ID NO: 1779477 - RNA, 20 nt, Salmonella enterica enterica serovar Typhi Ty2
cuaagguugaaaggccuaaa

SEQ ID NO: 1779478 - RNA, 14 nt, Salmonella enterica enterica serovar Typhi Ty2
cuaaguaaggagga

SEQ ID NO: 1779479 - RNA, 22 nt, Salmonella enterica enterica serovar Typhi Ty2
cuaauaaauauucaucaaaaug

SEQ ID NO: 1779480 - RNA, 20 nt, Salmonella enterica enterica serovar Typhi Ty2
cuaauaaaauaacuauaauu

SEQ ID NO: 1779481 - RNA, 19 nt, Salmonella enterica enterica serovar Typhi Ty2
cuaaggucacuacgcggcu

SEQ ID NO: 1779482 - RNA, 14 nt, Salmonella enterica enterica serovar Typhi Ty2
cuaacuggaaaaag

SEQ ID NO: 1779483 - RNA, 13 nt, Salmonella enterica enterica serovar Typhi Ty2
cuaagagaaaacc

SEQ ID NO: 1779484 - RNA, 21 nt, Salmonella enterica enterica serovar Typhi Ty2
cuaagagccugucccaccagg

SEQ ID NO: 1779485 - RNA, 21 nt, Salmonella enterica enterica serovar Typhi Ty2
cuaagagugacgguuuucacu

SEQ ID NO: 1779486 - RNA, 24 nt, Salmonella enterica enterica serovar Typhi Ty2
cuaaaucagugauggauuucacga

SEQ ID NO: 1779487 - RNA, 15 nt, Salmonella enterica enterica serovar Typhi Ty2
cuaaaucauaccagc

SEQ ID NO: 1779488 - RNA, 23 nt, Salmonella enterica enterica serovar Typhi Ty2
cuaaaucaauacaggcgaccggg

SEQ ID NO: 1779489 - RNA, 18 nt, Salmonella enterica enterica serovar Typhi Ty2
cuaaucacccacuucuca

SEQ ID NO: 1779490 - RNA, 19 nt, Salmonella enterica enterica serovar Typhi Ty2
cuaaucaauaaguuuuuuc

SEQ ID NO: 1779491 - RNA, 15 nt, Salmonella enterica enterica serovar Typhi Ty2
cuaaugaauuuaaua

SEQ ID NO: 1779492 - RNA, 17 nt, Salmonella enterica enterica serovar Typhi Ty2
cuaaugagccagaugga

SEQ ID NO: 1779493 - RNA, 17 nt, Salmonella enterica enterica serovar Typhi Ty2
cuaaugacauagugcaa

SEQ ID NO: 1779494 - RNA, 21 nt, Salmonella enterica enterica serovar Typhi Ty2
cuaaucccuggcgaauaaaau

SEQ ID NO: 1779495 - RNA, 20 nt, Salmonella enterica enterica serovar Typhi Ty2
cuaauccccauuuuuuucag

SEQ ID NO: 1779496 - RNA, 23 nt, Salmonella enterica enterica serovar Typhi Ty2
cuaaucgccacgacgcugguucc

SEQ ID NO: 1779497 - RNA, 12 nt, Salmonella enterica enterica serovar Typhi Ty2
cuaauuaucugc

SEQ ID NO: 1779498 - RNA, 14 nt, Salmonella enterica enterica serovar Typhi Ty2
cuaauuaauucuaa

SEQ ID NO: 1779499 - RNA, 15 nt, Salmonella enterica enterica serovar Typhi Ty2
cuaauguacgccuaa

SEQ ID NO: 1779500 - RNA, 16 nt, Salmonella enterica enterica serovar Typhi Ty2
cuaauguacgccuaaa

SEQ ID NO: 1779501 - RNA, 22 nt, Salmonella enterica enterica serovar Typhi Ty2
cuacacacucggugcauuuguc

SEQ ID NO: 1779502 - RNA, 18 nt, Salmonella enterica enterica serovar Typhi Ty2
cuacaccuucuucgccaa

SEQ ID NO: 1779503 - RNA, 22 nt, Salmonella enterica enterica serovar Typhi Ty2
cuacaccguauccggccugcag

SEQ ID NO: 1779504 - RNA, 14 nt, Salmonella enterica enterica serovar Typhi Ty2
cuacaccugggcuu

SEQ ID NO: 1779505 - RNA, 18 nt, Salmonella enterica enterica serovar Typhi Ty2
cuacaccguauccggccu

SEQ ID NO: 1779506 - RNA, 20 nt, Salmonella enterica enterica serovar Typhi Ty2
cuacaaucgugugaugcacc

SEQ ID NO: 1779507 - RNA, 12 nt, Salmonella enterica enterica serovar Typhi Ty2
cuacaaagcugg

SEQ ID NO: 1779508 - RNA, 18 nt, Salmonella enterica enterica serovar Typhi Ty2
cuaauuuuacuuucauuc

SEQ ID NO: 1779509 - RNA, 15 nt, Salmonella enterica enterica serovar Typhi Ty2
cuaauuuucagggug

SEQ ID NO: 1779510 - RNA, 20 nt, Salmonella enterica enterica serovar Typhi Ty2
cuaauuuauugccacgccau

SEQ ID NO: 1779511 - RNA, 13 nt, Salmonella enterica enterica serovar Typhi Ty2
cuaauuucaauuu

SEQ ID NO: 1779512 - RNA, 14 nt, Salmonella enterica enterica serovar Typhi Ty2
cuaauuucaauuuu

SEQ ID NO: 1779513 - RNA, 17 nt, Salmonella enterica enterica serovar Typhi Ty2
cuaauuugaugccuggc

SEQ ID NO: 1779514 - RNA, 13 nt, Salmonella enterica enterica serovar Typhi Ty2
cuaauuguuugua

SEQ ID NO: 1779515 - RNA, 16 nt, Salmonella enterica enterica serovar Typhi Ty2
cuaccaacugagcuaa

SEQ ID NO: 1779516 - RNA, 18 nt, Salmonella enterica enterica serovar Typhi Ty2
cuaccaauuccaccaccu

SEQ ID NO: 1779517 - RNA, 20 nt, Salmonella enterica enterica serovar Typhi Ty2
cuaccacccagccagacgcc

SEQ ID NO: 1779518 - RNA, 14 nt, Salmonella enterica enterica serovar Typhi Ty2
cuaccaggcaaagc

SEQ ID NO: 1779519 - RNA, 16 nt, Salmonella enterica enterica serovar Typhi Ty2
cuaccacgcugccgcc

SEQ ID NO: 1779520 - RNA, 19 nt, Salmonella enterica enterica serovar Typhi Ty2
cuaccacucccaaauuuug

SEQ ID NO: 1779521 - RNA, 16 nt, Salmonella enterica enterica serovar Typhi Ty2
cuaccagaucgcggua

SEQ ID NO: 1779522 - RNA, 16 nt, Salmonella enterica enterica serovar Typhi Ty2
cuaccauuacccgaac

SEQ ID NO: 1779523 - RNA, 13 nt, Salmonella enterica enterica serovar Typhi Ty2
cuaccauaaugau

SEQ ID NO: 1779524 - RNA, 13 nt, Salmonella enterica enterica serovar Typhi Ty2
cuacauaucuaua

SEQ ID NO: 1779525 - RNA, 15 nt, Salmonella enterica enterica serovar Typhi Ty2
cuacaucaagagaaa

SEQ ID NO: 1779526 - RNA, 20 nt, Salmonella enterica enterica serovar Typhi Ty2
cuacaguguaaaaauuuuug

SEQ ID NO: 1779527 - RNA, 21 nt, Salmonella enterica enterica serovar Typhi Ty2
cuacacucuuaacauggcgga

SEQ ID NO: 1779528 - RNA, 22 nt, Salmonella enterica enterica serovar Typhi Ty2
cuacagaaagccauaaaacugg

SEQ ID NO: 1779529 - RNA, 19 nt, Salmonella enterica enterica serovar Typhi Ty2
cucaguugguuagagcaca

SEQ ID NO: 1779530 - RNA, 22 nt, Salmonella enterica enterica serovar Typhi Ty2
cucauaaaacauuccugacauu

SEQ ID NO: 1779531 - RNA, 23 nt, Salmonella enterica enterica serovar Typhi Ty2
cucaggcgcgaauaaugcguccg

SEQ ID NO: 1779532 - RNA, 20 nt, Salmonella enterica enterica serovar Typhi Ty2
cucaggcuccgcgcagggug

SEQ ID NO: 1779533 - RNA, 22 nt, Salmonella enterica enterica serovar Typhi Ty2
cucaggcggggaguggugaucg

SEQ ID NO: 1779534 - RNA, 15 nt, Salmonella enterica enterica serovar Typhi Ty2
cucagcgccguagcg

SEQ ID NO: 1779535 - RNA, 22 nt, Salmonella enterica enterica serovar Typhi Ty2
cucagcgccguagcggcaggga

SEQ ID NO: 1779536 - RNA, 23 nt, Salmonella enterica enterica serovar Typhi Ty2
cucagcgccacgcccaacauaaa

SEQ ID NO: 1779537 - RNA, 19 nt, Salmonella enterica enterica serovar Typhi Ty2
cucaucuucuuuuuccgga

SEQ ID NO: 1779538 - RNA, 14 nt, Salmonella enterica enterica serovar Typhi Ty2
cucaucuugcagga

SEQ ID NO: 1779539 - RNA, 14 nt, Salmonella enterica enterica serovar Typhi Ty2
cucaugcguaaauc

SEQ ID NO: 1779540 - RNA, 17 nt, Salmonella enterica enterica serovar Typhi Ty2
cucauccagcaaaauaa

SEQ ID NO: 1779541 - RNA, 13 nt, Salmonella enterica enterica serovar Typhi Ty2
cucauccagcaac

SEQ ID NO: 1779542 - RNA, 24 nt, Salmonella enterica enterica serovar Typhi Ty2
cucauccaacugcgccugaagaua

SEQ ID NO: 1779543 - RNA, 15 nt, Salmonella enterica enterica serovar Typhi Ty2
cucauauacccugcg

SEQ ID NO: 1779544 - RNA, 16 nt, Salmonella enterica enterica serovar Typhi Ty2
cucauauuccagccac

SEQ ID NO: 1779545 - RNA, 23 nt, Salmonella enterica enterica serovar Typhi Ty2
cucaucagguaauacaggguuug

SEQ ID NO: 1779546 - RNA, 16 nt, Salmonella enterica enterica serovar Typhi Ty2
cucauucagcaacugc

SEQ ID NO: 1779547 - RNA, 15 nt, Salmonella enterica enterica serovar Typhi Ty2
cucauucagcggcug

SEQ ID NO: 1779548 - RNA, 13 nt, Salmonella enterica enterica serovar Typhi Ty2
cuccaauaaauau

SEQ ID NO: 1779549 - RNA, 14 nt, Salmonella enterica enterica serovar Typhi Ty2
cuccaauauuucag

SEQ ID NO: 1779550 - RNA, 21 nt, Salmonella enterica enterica serovar Typhi Ty2
cucaacgcccucaaguaaaau

SEQ ID NO: 1779551 - RNA, 13 nt, Salmonella enterica enterica serovar Typhi Ty2
cucaacgcccugc

SEQ ID NO: 1779552 - RNA, 15 nt, Salmonella enterica enterica serovar Typhi Ty2
cucaacgcccugcuc

SEQ ID NO: 1779553 - RNA, 23 nt, Salmonella enterica enterica serovar Typhi Ty2
cucaacgcgcccagauuggugau

SEQ ID NO: 1779554 - RNA, 21 nt, Salmonella enterica enterica serovar Typhi Ty2
cucaacacauaacgcccgaca

SEQ ID NO: 1779555 - RNA, 18 nt, Salmonella enterica enterica serovar Typhi Ty2
cucaacacauaacgcccg

SEQ ID NO: 1779556 - RNA, 17 nt, Salmonella enterica enterica serovar Typhi Ty2
cucaacauacgccgcca

SEQ ID NO: 1779557 - RNA, 18 nt, Salmonella enterica enterica serovar Typhi Ty2
cucaacauacgccgccag

SEQ ID NO: 1779558 - RNA, 19 nt, Salmonella enterica enterica serovar Typhi Ty2
cucaagacgguuauuuuuc

SEQ ID NO: 1779559 - RNA, 16 nt, Salmonella enterica enterica serovar Typhi Ty2
cucaagcggcaccaca

SEQ ID NO: 1779560 - RNA, 15 nt, Salmonella enterica enterica serovar Typhi Ty2
cuauugccuaaauaa

SEQ ID NO: 1779561 - RNA, 17 nt, Salmonella enterica enterica serovar Typhi Ty2
cuauugccuaaauaacu

SEQ ID NO: 1779562 - RNA, 19 nt, Salmonella enterica enterica serovar Typhi Ty2
cuauugaaaaagccgcgcc

SEQ ID NO: 1779563 - RNA, 19 nt, Salmonella enterica enterica serovar Typhi Ty2
cucacccaguuuuuuucug

SEQ ID NO: 1779564 - RNA, 14 nt, Salmonella enterica enterica serovar Typhi Ty2
cucacccaggcgau

SEQ ID NO: 1779565 - RNA, 19 nt, Salmonella enterica enterica serovar Typhi Ty2
cucacagaaucaucaggcu

SEQ ID NO: 1779566 - RNA, 20 nt, Salmonella enterica enterica serovar Typhi Ty2
cucacagaaucaucaggcua

SEQ ID NO: 1779567 - RNA, 18 nt, Salmonella enterica enterica serovar Typhi Ty2
cucacaauaauuuuacca

SEQ ID NO: 1779568 - RNA, 18 nt, Salmonella enterica enterica serovar Typhi Ty2
cucaauauacuuaucggc

SEQ ID NO: 1779569 - RNA, 22 nt, Salmonella enterica enterica serovar Typhi Ty2
cucaaucacuuaucaaaccagc

SEQ ID NO: 1779570 - RNA, 21 nt, Salmonella enterica enterica serovar Typhi Ty2
cucaauacgagugacauuauu

SEQ ID NO: 1779571 - RNA, 19 nt, Salmonella enterica enterica serovar Typhi Ty2
cucaauaaaaugucuguuu

SEQ ID NO: 1779572 - RNA, 15 nt, Salmonella enterica enterica serovar Typhi Ty2
cucacguuccccagc

SEQ ID NO: 1779573 - RNA, 16 nt, Salmonella enterica enterica serovar Typhi Ty2
cucacguuccccagca

SEQ ID NO: 1779574 - RNA, 21 nt, Salmonella enterica enterica serovar Typhi Ty2
cucacuacccggaggcaauau

SEQ ID NO: 1779575 - RNA, 14 nt, Salmonella enterica enterica serovar Typhi Ty2
cucacgcuggugcu

SEQ ID NO: 1779576 - RNA, 16 nt, Salmonella enterica enterica serovar Typhi Ty2
cucacggauauuaccc

SEQ ID NO: 1779577 - RNA, 15 nt, Salmonella enterica enterica serovar Typhi Ty2
cucaccgaccugccu

SEQ ID NO: 1779578 - RNA, 16 nt, Salmonella enterica enterica serovar Typhi Ty2
cucaccgaccugccuu

SEQ ID NO: 1779579 - RNA, 23 nt, Salmonella enterica enterica serovar Typhi Ty2
cuauagagagauggaacaucuuu

SEQ ID NO: 1779580 - RNA, 17 nt, Salmonella enterica enterica serovar Typhi Ty2
cuauagagagauggaac

SEQ ID NO: 1779581 - RNA, 11 nt, Salmonella enterica enterica serovar Typhi Ty2
cuauaaaaauc

SEQ ID NO: 1779582 - RNA, 16 nt, Salmonella enterica enterica serovar Typhi Ty2
cuauagcuuuucauau

SEQ ID NO: 1779583 - RNA, 16 nt, Salmonella enterica enterica serovar Typhi Ty2
cuauauuccagccagg

SEQ ID NO: 1779584 - RNA, 17 nt, Salmonella enterica enterica serovar Typhi Ty2
cuaucaagauaaaaaga

SEQ ID NO: 1779585 - RNA, 16 nt, Salmonella enterica enterica serovar Typhi Ty2
cuaucaagauaaaaag

SEQ ID NO: 1779586 - RNA, 23 nt, Salmonella enterica enterica serovar Typhi Ty2
cuaucagaauauccgguacacca

SEQ ID NO: 1779587 - RNA, 16 nt, Salmonella enterica enterica serovar Typhi Ty2
cuaucagaaaaaauua

SEQ ID NO: 1779588 - RNA, 20 nt, Salmonella enterica enterica serovar Typhi Ty2
cuaucaccgccucgaccccu

SEQ ID NO: 1779589 - RNA, 19 nt, Salmonella enterica enterica serovar Typhi Ty2
cuaucaguagcuuuuccgc

SEQ ID NO: 1779590 - RNA, 15 nt, Salmonella enterica enterica serovar Typhi Ty2
cuauccacagcgaau

SEQ ID NO: 1779591 - RNA, 18 nt, Salmonella enterica enterica serovar Typhi Ty2
cuauccacgcagacgccg

SEQ ID NO: 1779592 - RNA, 11 nt, Salmonella enterica enterica serovar Typhi Ty2
cuauccacgca

SEQ ID NO: 1779593 - RNA, 17 nt, Salmonella enterica enterica serovar Typhi Ty2
cuauccagcaguaaaua

SEQ ID NO: 1779594 - RNA, 21 nt, Salmonella enterica enterica serovar Typhi Ty2
cuauucaccagacuaaaacgu

SEQ ID NO: 1779595 - RNA, 19 nt, Salmonella enterica enterica serovar Typhi Ty2
cuauuaggcacuaccaccu

SEQ ID NO: 1779596 - RNA, 20 nt, Salmonella enterica enterica serovar Typhi Ty2
cuauuaguucugaggcuauu

SEQ ID NO: 1779597 - RNA, 17 nt, Salmonella enterica enterica serovar Typhi Ty2
cuauuaaagcacaagaa

SEQ ID NO: 1779598 - RNA, 13 nt, Salmonella enterica enterica serovar Typhi Ty2
cuauucuucaucg

SEQ ID NO: 1779599 - RNA, 16 nt, Salmonella enterica enterica serovar Typhi Ty2
cuauuccaacuaugug

SEQ ID NO: 1779600 - RNA, 20 nt, Salmonella enterica enterica serovar Typhi Ty2
cuauucccaggcaaaugauu

SEQ ID NO: 1779601 - RNA, 14 nt, Salmonella enterica enterica serovar Typhi Ty2
cuauucccaggcaa

SEQ ID NO: 1779602 - RNA, 12 nt, Salmonella enterica enterica serovar Typhi Ty2
cuauucccaggc

SEQ ID NO: 1779603 - RNA, 16 nt, Salmonella enterica enterica serovar Typhi Ty2
cuaugcaaaagaaaaa

SEQ ID NO: 1779604 - RNA, 13 nt, Salmonella enterica enterica serovar Typhi Ty2
cuaugccagaaua

SEQ ID NO: 1779605 - RNA, 18 nt, Salmonella enterica enterica serovar Typhi Ty2
cuauguacgccaagcugc

SEQ ID NO: 1779606 - RNA, 19 nt, Salmonella enterica enterica serovar Typhi Ty2
cuauguacgccaagcugca

SEQ ID NO: 1779607 - RNA, 18 nt, Salmonella enterica enterica serovar Typhi Ty2
cuauccgaugaagccugg

SEQ ID NO: 1779608 - RNA, 20 nt, Salmonella enterica enterica serovar Typhi Ty2
cuaucgcuccucccugacug

SEQ ID NO: 1779609 - RNA, 15 nt, Salmonella enterica enterica serovar Typhi Ty2
cuaucgccuggagcu

SEQ ID NO: 1779610 - RNA, 15 nt, Salmonella enterica enterica serovar Typhi Ty2
cuauccgccgccagc

SEQ ID NO: 1779611 - RNA, 21 nt, Salmonella enterica enterica serovar Typhi Ty2
cuauccgccgccagccauaaa

SEQ ID NO: 1779612 - RNA, 13 nt, Salmonella enterica enterica serovar Typhi Ty2
cuaucgcuuuaac

SEQ ID NO: 1779613 - RNA, 20 nt, Salmonella enterica enterica serovar Typhi Ty2
cuaucggcaaaccaugaucg

SEQ ID NO: 1779614 - RNA, 12 nt, Salmonella enterica enterica serovar Typhi Ty2
cuaucggccuga

SEQ ID NO: 1779615 - RNA, 20 nt, Salmonella enterica enterica serovar Typhi Ty2
cuagaugaugauuuaugaau

SEQ ID NO: 1779616 - RNA, 23 nt, Salmonella enterica enterica serovar Typhi Ty2
cuagaugaugauuuaugaauagc

SEQ ID NO: 1779617 - RNA, 20 nt, Salmonella enterica enterica serovar Typhi Ty2
cuagauuuuagaaaauaauu

SEQ ID NO: 1779618 - RNA, 21 nt, Salmonella enterica enterica serovar Typhi Ty2
cuagcuuaucgccaaagauau

SEQ ID NO: 1779619 - RNA, 14 nt, Salmonella enterica enterica serovar Typhi Ty2
cuagcugcagcgcu

SEQ ID NO: 1779620 - RNA, 23 nt, Salmonella enterica enterica serovar Typhi Ty2
cuaggcgcugcuggcagcgcuga

SEQ ID NO: 1779621 - RNA, 15 nt, Salmonella enterica enterica serovar Typhi Ty2
cuagucaauaaagac

SEQ ID NO: 1779622 - RNA, 16 nt, Salmonella enterica enterica serovar Typhi Ty2
cuaggggcucuuuuuu

SEQ ID NO: 1779623 - RNA, 15 nt, Salmonella enterica enterica serovar Typhi Ty2
cuagggcaucagacg

SEQ ID NO: 1779624 - RNA, 19 nt, Salmonella enterica enterica serovar Typhi Ty2
cuaguaaagaaauuuugca

SEQ ID NO: 1779625 - RNA, 15 nt, Salmonella enterica enterica serovar Typhi Ty2
cuacuuuauuuuucg

SEQ ID NO: 1779626 - RNA, 14 nt, Salmonella enterica enterica serovar Typhi Ty2
cuacuucagcacgg

SEQ ID NO: 1779627 - RNA, 17 nt, Salmonella enterica enterica serovar Typhi Ty2
cuacuguggugugccug

SEQ ID NO: 1779628 - RNA, 15 nt, Salmonella enterica enterica serovar Typhi Ty2
cuaccgccaccaucg

SEQ ID NO: 1779629 - RNA, 14 nt, Salmonella enterica enterica serovar Typhi Ty2
cuaccgaggcaggg

SEQ ID NO: 1779630 - RNA, 12 nt, Salmonella enterica enterica serovar Typhi Ty2
cucuuuuucuuu

SEQ ID NO: 1779631 - RNA, 20 nt, Salmonella enterica enterica serovar Typhi Ty2
cucuuuuuccgccugaucuu

SEQ ID NO: 1779632 - RNA, 13 nt, Salmonella enterica enterica serovar Typhi Ty2
cugaaaaaauucc

SEQ ID NO: 1779633 - RNA, 19 nt, Salmonella enterica enterica serovar Typhi Ty2
cugaaaaauccccccuccu

SEQ ID NO: 1779634 - RNA, 14 nt, Salmonella enterica enterica serovar Typhi Ty2
cugaaaacagaaau

SEQ ID NO: 1779635 - RNA, 13 nt, Salmonella enterica enterica serovar Typhi Ty2
cugaaaaaucccc

SEQ ID NO: 1779636 - RNA, 12 nt, Salmonella enterica enterica serovar Typhi Ty2
cugaaaaagggu

SEQ ID NO: 1779637 - RNA, 14 nt, Salmonella enterica enterica serovar Typhi Ty2
cucuuuugcuucaa

SEQ ID NO: 1779638 - RNA, 16 nt, Salmonella enterica enterica serovar Typhi Ty2
cucuuuuaauuuucug

SEQ ID NO: 1779639 - RNA, 13 nt, Salmonella enterica enterica serovar Typhi Ty2
cucuuucuccaca

SEQ ID NO: 1779640 - RNA, 17 nt, Salmonella enterica enterica serovar Typhi Ty2
cucuuucgguagccaca

SEQ ID NO: 1779641 - RNA, 20 nt, Salmonella enterica enterica serovar Typhi Ty2
cucuuucgguagccacagau

SEQ ID NO: 1779642 - RNA, 21 nt, Salmonella enterica enterica serovar Typhi Ty2
cucuuugaacagccagaagcc

SEQ ID NO: 1779643 - RNA, 16 nt, Salmonella enterica enterica serovar Typhi Ty2
cucuuugaacagccag

SEQ ID NO: 1779644 - RNA, 14 nt, Salmonella enterica enterica serovar Typhi Ty2
cugaaaaucaaaaa

SEQ ID NO: 1779645 - RNA, 12 nt, Salmonella enterica enterica serovar Typhi Ty2
cugaaaaagaac

SEQ ID NO: 1779646 - RNA, 23 nt, Salmonella enterica enterica serovar Typhi Ty2
cugaaaaucaaaucggcgccggc

SEQ ID NO: 1779647 - RNA, 21 nt, Salmonella enterica enterica serovar Typhi Ty2
cugaaaauaauugauaauaac

SEQ ID NO: 1779648 - RNA, 22 nt, Salmonella enterica enterica serovar Typhi Ty2
cugaaaaugugguauuaaccca

SEQ ID NO: 1779649 - RNA, 17 nt, Salmonella enterica enterica serovar Typhi Ty2
cugaaacggaucaaaaa

SEQ ID NO: 1779650 - RNA, 17 nt, Salmonella enterica enterica serovar Typhi Ty2
cugaaacagaauaaacg

SEQ ID NO: 1779651 - RNA, 13 nt, Salmonella enterica enterica serovar Typhi Ty2
cugaaauaacucu

SEQ ID NO: 1779652 - RNA, 22 nt, Salmonella enterica enterica serovar Typhi Ty2
cugaaauacccgacucuuuuuu

SEQ ID NO: 1779653 - RNA, 14 nt, Salmonella enterica enterica serovar Typhi Ty2
cugaagauaaaauu

SEQ ID NO: 1779654 - RNA, 21 nt, Salmonella enterica enterica serovar Typhi Ty2
cugaacuuuuugcaggagcuc

SEQ ID NO: 1779655 - RNA, 16 nt, Salmonella enterica enterica serovar Typhi Ty2
cugaagcccuuuagug

SEQ ID NO: 1779656 - RNA, 13 nt, Salmonella enterica enterica serovar Typhi Ty2
cugaagccccaac

SEQ ID NO: 1779657 - RNA, 23 nt, Salmonella enterica enterica serovar Typhi Ty2
cugaacucuuccagauacggguu

SEQ ID NO: 1779658 - RNA, 21 nt, Salmonella enterica enterica serovar Typhi Ty2
cugaacucaucaugauauaau

SEQ ID NO: 1779659 - RNA, 13 nt, Salmonella enterica enterica serovar Typhi Ty2
cugaacuguaacc

SEQ ID NO: 1779660 - RNA, 18 nt, Salmonella enterica enterica serovar Typhi Ty2
cugaacgcccggcgcgac

SEQ ID NO: 1779661 - RNA, 19 nt, Salmonella enterica enterica serovar Typhi Ty2
cugaacgggugguuucccu

SEQ ID NO: 1779662 - RNA, 19 nt, Salmonella enterica enterica serovar Typhi Ty2
cugaaccaacagcuggguc

SEQ ID NO: 1779663 - RNA, 14 nt, Salmonella enterica enterica serovar Typhi Ty2
cugaaccugccuuu

SEQ ID NO: 1779664 - RNA, 13 nt, Salmonella enterica enterica serovar Typhi Ty2
cugaaccaacagc

SEQ ID NO: 1779665 - RNA, 23 nt, Salmonella enterica enterica serovar Typhi Ty2
cugaacauacuuucucuccuuca

SEQ ID NO: 1779666 - RNA, 15 nt, Salmonella enterica enterica serovar Typhi Ty2
cugaaauuucuuuuc

SEQ ID NO: 1779667 - RNA, 19 nt, Salmonella enterica enterica serovar Typhi Ty2
cugaaauuucuuuuccaga

SEQ ID NO: 1779668 - RNA, 23 nt, Salmonella enterica enterica serovar Typhi Ty2
cucuugccccacauguuggcauu

SEQ ID NO: 1779669 - RNA, 22 nt, Salmonella enterica enterica serovar Typhi Ty2
cucuugcauaauauccaggagc

SEQ ID NO: 1779670 - RNA, 20 nt, Salmonella enterica enterica serovar Typhi Ty2
cucuucuuugagcucccggu

SEQ ID NO: 1779671 - RNA, 22 nt, Salmonella enterica enterica serovar Typhi Ty2
cucuucuuuuaauugccaggcg

SEQ ID NO: 1779672 - RNA, 21 nt, Salmonella enterica enterica serovar Typhi Ty2
cucuucguucauccgucuggc

SEQ ID NO: 1779673 - RNA, 18 nt, Salmonella enterica enterica serovar Typhi Ty2
cucuucucugaaaagagu

SEQ ID NO: 1779674 - RNA, 18 nt, Salmonella enterica enterica serovar Typhi Ty2
cucuucgggaucaauuuu

SEQ ID NO: 1779675 - RNA, 21 nt, Salmonella enterica enterica serovar Typhi Ty2
cucuucgccauuacaggacag

SEQ ID NO: 1779676 - RNA, 21 nt, Salmonella enterica enterica serovar Typhi Ty2
cucuuucaccagcgccagaau

SEQ ID NO: 1779677 - RNA, 23 nt, Salmonella enterica enterica serovar Typhi Ty2
cucuuucagccgacuaucuucuu

SEQ ID NO: 1779678 - RNA, 21 nt, Salmonella enterica enterica serovar Typhi Ty2
cucuuuaaugauguccagaau

SEQ ID NO: 1779679 - RNA, 12 nt, Salmonella enterica enterica serovar Typhi Ty2
cucuuguuucuc

SEQ ID NO: 1779680 - RNA, 13 nt, Salmonella enterica enterica serovar Typhi Ty2
cucuuuaacaauu

SEQ ID NO: 1779681 - RNA, 15 nt, Salmonella enterica enterica serovar Typhi Ty2
cucuuggucauaaua

SEQ ID NO: 1779682 - RNA, 15 nt, Salmonella enterica enterica serovar Typhi Ty2
cucuuggguuauuuc

SEQ ID NO: 1779683 - RNA, 14 nt, Salmonella enterica enterica serovar Typhi Ty2
cucuuccugcugcg

SEQ ID NO: 1779684 - RNA, 12 nt, Salmonella enterica enterica serovar Typhi Ty2
cucuucgccaau

SEQ ID NO: 1779685 - RNA, 16 nt, Salmonella enterica enterica serovar Typhi Ty2
cucuucgacaucuuca

SEQ ID NO: 1779686 - RNA, 15 nt, Salmonella enterica enterica serovar Typhi Ty2
cucuuccagcgccaa

SEQ ID NO: 1779687 - RNA, 13 nt, Salmonella enterica enterica serovar Typhi Ty2
cucuuccgccagc

SEQ ID NO: 1779688 - RNA, 20 nt, Salmonella enterica enterica serovar Typhi Ty2
cucuuccgcgguccagccgg

SEQ ID NO: 1779689 - RNA, 20 nt, Salmonella enterica enterica serovar Typhi Ty2
cucuuccccggucaguccca

SEQ ID NO: 1779690 - RNA, 16 nt, Salmonella enterica enterica serovar Typhi Ty2
cucuuccccgacaaaa

SEQ ID NO: 1779691 - RNA, 23 nt, Salmonella enterica enterica serovar Typhi Ty2
cucuucaucgcgccuccccugcc

SEQ ID NO: 1779692 - RNA, 13 nt, Salmonella enterica enterica serovar Typhi Ty2
cucuuccaccauc

SEQ ID NO: 1779693 - RNA, 18 nt, Salmonella enterica enterica serovar Typhi Ty2
cucuucagcguccggaaa

SEQ ID NO: 1779694 - RNA, 17 nt, Salmonella enterica enterica serovar Typhi Ty2
cucuucaucgcgccucc

SEQ ID NO: 1779695 - RNA, 18 nt, Salmonella enterica enterica serovar Typhi Ty2
cucuuauucaaucaauuu

SEQ ID NO: 1779696 - RNA, 15 nt, Salmonella enterica enterica serovar Typhi Ty2
cucuuacguugcauu

SEQ ID NO: 1779697 - RNA, 18 nt, Salmonella enterica enterica serovar Typhi Ty2
cucuuaccgcuaaaauac

SEQ ID NO: 1779698 - RNA, 16 nt, Salmonella enterica enterica serovar Typhi Ty2
cucuguccacacaggc

SEQ ID NO: 1779699 - RNA, 14 nt, Salmonella enterica enterica serovar Typhi Ty2
cucugucgccgccc

SEQ ID NO: 1779700 - RNA, 15 nt, Salmonella enterica enterica serovar Typhi Ty2
cucugucgccgcccg

SEQ ID NO: 1779701 - RNA, 22 nt, Salmonella enterica enterica serovar Typhi Ty2
cucugguugcagcgccagagau

SEQ ID NO: 1779702 - RNA, 16 nt, Salmonella enterica enterica serovar Typhi Ty2
cucugguuucccugcc

SEQ ID NO: 1779703 - RNA, 16 nt, Salmonella enterica enterica serovar Typhi Ty2
cugagcggcucaucca

SEQ ID NO: 1779704 - RNA, 19 nt, Salmonella enterica enterica serovar Typhi Ty2
cugagcgcgagcaugugua

SEQ ID NO: 1779705 - RNA, 18 nt, Salmonella enterica enterica serovar Typhi Ty2
cugagaucaaacaagaga

SEQ ID NO: 1779706 - RNA, 16 nt, Salmonella enterica enterica serovar Typhi Ty2
cugagcacgcccgguc

SEQ ID NO: 1779707 - RNA, 12 nt, Salmonella enterica enterica serovar Typhi Ty2
cugacuuuucca

SEQ ID NO: 1779708 - RNA, 13 nt, Salmonella enterica enterica serovar Typhi Ty2
cugagaaaaauac

SEQ ID NO: 1779709 - RNA, 19 nt, Salmonella enterica enterica serovar Typhi Ty2
cugagauaauacauaucau

SEQ ID NO: 1779710 - RNA, 17 nt, Salmonella enterica enterica serovar Typhi Ty2
cugagacgugugauugu

SEQ ID NO: 1779711 - RNA, 20 nt, Salmonella enterica enterica serovar Typhi Ty2
cugagacaggccagaauuca

SEQ ID NO: 1779712 - RNA, 16 nt, Salmonella enterica enterica serovar Typhi Ty2
cugagaauuuccaguu

SEQ ID NO: 1779713 - RNA, 12 nt, Salmonella enterica enterica serovar Typhi Ty2
cugacuuuccug

SEQ ID NO: 1779714 - RNA, 13 nt, Salmonella enterica enterica serovar Typhi Ty2
cugacugcauaau

SEQ ID NO: 1779715 - RNA, 20 nt, Salmonella enterica enterica serovar Typhi Ty2
cugacgcaauuguugcgcca

SEQ ID NO: 1779716 - RNA, 16 nt, Salmonella enterica enterica serovar Typhi Ty2
cugacgagguuaucag

SEQ ID NO: 1779717 - RNA, 23 nt, Salmonella enterica enterica serovar Typhi Ty2
cugacgccgguauucauaugcuc

SEQ ID NO: 1779718 - RNA, 16 nt, Salmonella enterica enterica serovar Typhi Ty2
cugacgcagcaguucc

SEQ ID NO: 1779719 - RNA, 17 nt, Salmonella enterica enterica serovar Typhi Ty2
cugacgccauucauucc

SEQ ID NO: 1779720 - RNA, 19 nt, Salmonella enterica enterica serovar Typhi Ty2
cugacgaagaacuuaggau

SEQ ID NO: 1779721 - RNA, 13 nt, Salmonella enterica enterica serovar Typhi Ty2
cugaccuacaggc

SEQ ID NO: 1779722 - RNA, 17 nt, Salmonella enterica enterica serovar Typhi Ty2
cugaccuuaauccagca

SEQ ID NO: 1779723 - RNA, 13 nt, Salmonella enterica enterica serovar Typhi Ty2
cugaccuuaaucc

SEQ ID NO: 1779724 - RNA, 16 nt, Salmonella enterica enterica serovar Typhi Ty2
cugacggugguaaauc

SEQ ID NO: 1779725 - RNA, 22 nt, Salmonella enterica enterica serovar Typhi Ty2
cugacggugauguuggcccgga

SEQ ID NO: 1779726 - RNA, 22 nt, Salmonella enterica enterica serovar Typhi Ty2
cugacgcguuuuuucaugaauc

SEQ ID NO: 1779727 - RNA, 16 nt, Salmonella enterica enterica serovar Typhi Ty2
cugacgcugcgccugg

SEQ ID NO: 1779728 - RNA, 16 nt, Salmonella enterica enterica serovar Typhi Ty2
cugacggcgcugucac

SEQ ID NO: 1779729 - RNA, 18 nt, Salmonella enterica enterica serovar Typhi Ty2
cugacuauccacagcgaa

SEQ ID NO: 1779730 - RNA, 13 nt, Salmonella enterica enterica serovar Typhi Ty2
cugacuauccaca

SEQ ID NO: 1779731 - RNA, 16 nt, Salmonella enterica enterica serovar Typhi Ty2
cugacuauacccaaaa

SEQ ID NO: 1779732 - RNA, 17 nt, Salmonella enterica enterica serovar Typhi Ty2
cugacguagauucugau

SEQ ID NO: 1779733 - RNA, 19 nt, Salmonella enterica enterica serovar Typhi Ty2
cugacuacgguugccuuuc

SEQ ID NO: 1779734 - RNA, 21 nt, Salmonella enterica enterica serovar Typhi Ty2
cugaaguaucgacgcagacaa

SEQ ID NO: 1779735 - RNA, 15 nt, Salmonella enterica enterica serovar Typhi Ty2
cugaaggacaagcug

SEQ ID NO: 1779736 - RNA, 17 nt, Salmonella enterica enterica serovar Typhi Ty2
cugaaggacaagcugcg

SEQ ID NO: 1779737 - RNA, 16 nt, Salmonella enterica enterica serovar Typhi Ty2
cugaaggcguaugaau

SEQ ID NO: 1779738 - RNA, 14 nt, Salmonella enterica enterica serovar Typhi Ty2
cugaagcguaaaaa

SEQ ID NO: 1779739 - RNA, 22 nt, Salmonella enterica enterica serovar Typhi Ty2
cugaagcugccgucccagcgga

SEQ ID NO: 1779740 - RNA, 17 nt, Salmonella enterica enterica serovar Typhi Ty2
cugaauagcuuucaccg

SEQ ID NO: 1779741 - RNA, 13 nt, Salmonella enterica enterica serovar Typhi Ty2
cugaauagccagc

SEQ ID NO: 1779742 - RNA, 17 nt, Salmonella enterica enterica serovar Typhi Ty2
cugaauaucgucaguau

SEQ ID NO: 1779743 - RNA, 15 nt, Salmonella enterica enterica serovar Typhi Ty2
cugaauaaauugaau

SEQ ID NO: 1779744 - RNA, 21 nt, Salmonella enterica enterica serovar Typhi Ty2
cugaauaaugguaaauuuauc

SEQ ID NO: 1779745 - RNA, 11 nt, Salmonella enterica enterica serovar Typhi Ty2
cugaauaaucg

SEQ ID NO: 1779746 - RNA, 18 nt, Salmonella enterica enterica serovar Typhi Ty2
cugaauauggccaguccc

SEQ ID NO: 1779747 - RNA, 16 nt, Salmonella enterica enterica serovar Typhi Ty2
cugaaucagcaucuua

SEQ ID NO: 1779748 - RNA, 22 nt, Salmonella enterica enterica serovar Typhi Ty2
cugaaucagugcaucuucacug

SEQ ID NO: 1779749 - RNA, 19 nt, Salmonella enterica enterica serovar Typhi Ty2
cugaaucugcggcugcgug

SEQ ID NO: 1779750 - RNA, 19 nt, Salmonella enterica enterica serovar Typhi Ty2
cugaaugcccuuuuccaga

SEQ ID NO: 1779751 - RNA, 21 nt, Salmonella enterica enterica serovar Typhi Ty2
cugaauuuaauggucuuaaau

SEQ ID NO: 1779752 - RNA, 16 nt, Salmonella enterica enterica serovar Typhi Ty2
cugaccacauuuucuc

SEQ ID NO: 1779753 - RNA, 20 nt, Salmonella enterica enterica serovar Typhi Ty2
cugaccaacgucagcaucuc

SEQ ID NO: 1779754 - RNA, 19 nt, Salmonella enterica enterica serovar Typhi Ty2
cugaccaacgucagcaucu

SEQ ID NO: 1779755 - RNA, 14 nt, Salmonella enterica enterica serovar Typhi Ty2
cugaccagacagau

SEQ ID NO: 1779756 - RNA, 17 nt, Salmonella enterica enterica serovar Typhi Ty2
cugacaucucuuuuaau

SEQ ID NO: 1779757 - RNA, 16 nt, Salmonella enterica enterica serovar Typhi Ty2
cugacagccaaacugc

SEQ ID NO: 1779758 - RNA, 17 nt, Salmonella enterica enterica serovar Typhi Ty2
cugacagccaaacugcu

SEQ ID NO: 1779759 - RNA, 23 nt, Salmonella enterica enterica serovar Typhi Ty2
cugacagagcucgucaaaaauca

SEQ ID NO: 1779760 - RNA, 13 nt, Salmonella enterica enterica serovar Typhi Ty2
cugacagauaucu

SEQ ID NO: 1779761 - RNA, 20 nt, Salmonella enterica enterica serovar Typhi Ty2
cugacauaaucaugaacguu

SEQ ID NO: 1779762 - RNA, 13 nt, Salmonella enterica enterica serovar Typhi Ty2
cugacauaaucau

SEQ ID NO: 1779763 - RNA, 18 nt, Salmonella enterica enterica serovar Typhi Ty2
cugacagggucgcaauac

SEQ ID NO: 1779764 - RNA, 20 nt, Salmonella enterica enterica serovar Typhi Ty2
cugacagagcucgucaaaaa

SEQ ID NO: 1779765 - RNA, 12 nt, Salmonella enterica enterica serovar Typhi Ty2
cugacacccucu

SEQ ID NO: 1779766 - RNA, 16 nt, Salmonella enterica enterica serovar Typhi Ty2
cugacaaacccuguau

SEQ ID NO: 1779767 - RNA, 23 nt, Salmonella enterica enterica serovar Typhi Ty2
cucuauagauuucgcgucagggc

SEQ ID NO: 1779768 - RNA, 16 nt, Salmonella enterica enterica serovar Typhi Ty2
cucuauacggcgcgca

SEQ ID NO: 1779769 - RNA, 18 nt, Salmonella enterica enterica serovar Typhi Ty2
cucuauaccauaaaugaa

SEQ ID NO: 1779770 - RNA, 17 nt, Salmonella enterica enterica serovar Typhi Ty2
cucucaccaguagcgcg

SEQ ID NO: 1779771 - RNA, 18 nt, Salmonella enterica enterica serovar Typhi Ty2
cucucauagccgacccgc

SEQ ID NO: 1779772 - RNA, 13 nt, Salmonella enterica enterica serovar Typhi Ty2
cucucauauucca

SEQ ID NO: 1779773 - RNA, 23 nt, Salmonella enterica enterica serovar Typhi Ty2
cucucaggcaguaacucaauauc

SEQ ID NO: 1779774 - RNA, 15 nt, Salmonella enterica enterica serovar Typhi Ty2
cucucguucccgccu

SEQ ID NO: 1779775 - RNA, 21 nt, Salmonella enterica enterica serovar Typhi Ty2
cucucguucccgccugcugca

SEQ ID NO: 1779776 - RNA, 19 nt, Salmonella enterica enterica serovar Typhi Ty2
cucucucaaacuauuuuua

SEQ ID NO: 1779777 - RNA, 22 nt, Salmonella enterica enterica serovar Typhi Ty2
cucuccugaauugcaaggcgac

SEQ ID NO: 1779778 - RNA, 20 nt, Salmonella enterica enterica serovar Typhi Ty2
cucucgauaucggcaauauu

SEQ ID NO: 1779779 - RNA, 19 nt, Salmonella enterica enterica serovar Typhi Ty2
cucucgccgcgcuccauca

SEQ ID NO: 1779780 - RNA, 14 nt, Salmonella enterica enterica serovar Typhi Ty2
cucugccagcgccc

SEQ ID NO: 1779781 - RNA, 20 nt, Salmonella enterica enterica serovar Typhi Ty2
cucugauuucgacgauaaaa

SEQ ID NO: 1779782 - RNA, 23 nt, Salmonella enterica enterica serovar Typhi Ty2
cucugauuucgacgauaaaaaaa

SEQ ID NO: 1779783 - RNA, 16 nt, Salmonella enterica enterica serovar Typhi Ty2
cucucuucgugacccg

SEQ ID NO: 1779784 - RNA, 20 nt, Salmonella enterica enterica serovar Typhi Ty2
cucugguaguuguaauaaac

SEQ ID NO: 1779785 - RNA, 21 nt, Salmonella enterica enterica serovar Typhi Ty2
cucuggccgcgcuuuuuuaac

SEQ ID NO: 1779786 - RNA, 13 nt, Salmonella enterica enterica serovar Typhi Ty2
cucugcuuuuuca

SEQ ID NO: 1779787 - RNA, 22 nt, Salmonella enterica enterica serovar Typhi Ty2
cucugcgcguaaacgcaacacc

SEQ ID NO: 1779788 - RNA, 21 nt, Salmonella enterica enterica serovar Typhi Ty2
cucugccuguagcagcgccag

SEQ ID NO: 1779789 - RNA, 20 nt, Salmonella enterica enterica serovar Typhi Ty2
cucugccgguugaccggccc

SEQ ID NO: 1779790 - RNA, 18 nt, Salmonella enterica enterica serovar Typhi Ty2
cucugccgguugaccggc

SEQ ID NO: 1779791 - RNA, 13 nt, Salmonella enterica enterica serovar Typhi Ty2
cucugccucagca

SEQ ID NO: 1779792 - RNA, 17 nt, Salmonella enterica enterica serovar Typhi Ty2
cucugcgccuuuuaccu

SEQ ID NO: 1779793 - RNA, 22 nt, Salmonella enterica enterica serovar Typhi Ty2
cucuaacgucagcgccacccau

SEQ ID NO: 1779794 - RNA, 15 nt, Salmonella enterica enterica serovar Typhi Ty2
cucguguaaggcuuc

SEQ ID NO: 1779795 - RNA, 14 nt, Salmonella enterica enterica serovar Typhi Ty2
cucguguaaggcuu

SEQ ID NO: 1779796 - RNA, 13 nt, Salmonella enterica enterica serovar Typhi Ty2
cucgucgcgcgcc

SEQ ID NO: 1779797 - RNA, 12 nt, Salmonella enterica enterica serovar Typhi Ty2
cucguauuauug

SEQ ID NO: 1779798 - RNA, 21 nt, Salmonella enterica enterica serovar Typhi Ty2
cucgucggcaagaauuucaau

SEQ ID NO: 1779799 - RNA, 19 nt, Salmonella enterica enterica serovar Typhi Ty2
cucgguggauaaauuuguc

SEQ ID NO: 1779800 - RNA, 21 nt, Salmonella enterica enterica serovar Typhi Ty2
cucgccuuucuccauggucag

SEQ ID NO: 1779801 - RNA, 15 nt, Salmonella enterica enterica serovar Typhi Ty2
cucgccuuucuccau

SEQ ID NO: 1779802 - RNA, 16 nt, Salmonella enterica enterica serovar Typhi Ty2
cucgcgauccgccagc

SEQ ID NO: 1779803 - RNA, 21 nt, Salmonella enterica enterica serovar Typhi Ty2
cucggcagcaauacgcccgcc

SEQ ID NO: 1779804 - RNA, 13 nt, Salmonella enterica enterica serovar Typhi Ty2
cucggcgagcagu

SEQ ID NO: 1779805 - RNA, 23 nt, Salmonella enterica enterica serovar Typhi Ty2
cucgggccuguuccggcgaggac

SEQ ID NO: 1779806 - RNA, 15 nt, Salmonella enterica enterica serovar Typhi Ty2
cucggucaacauucc

SEQ ID NO: 1779807 - RNA, 17 nt, Salmonella enterica enterica serovar Typhi Ty2
cucggcggucagccaca

SEQ ID NO: 1779808 - RNA, 21 nt, Salmonella enterica enterica serovar Typhi Ty2
cucgaggaacuguucagccag

SEQ ID NO: 1779809 - RNA, 20 nt, Salmonella enterica enterica serovar Typhi Ty2
cucgcacugauagccgccag

SEQ ID NO: 1779810 - RNA, 17 nt, Salmonella enterica enterica serovar Typhi Ty2
cucgcagguacgacacc

SEQ ID NO: 1779811 - RNA, 22 nt, Salmonella enterica enterica serovar Typhi Ty2
cucgcccuucgggccgccgcaa

SEQ ID NO: 1779812 - RNA, 15 nt, Salmonella enterica enterica serovar Typhi Ty2
cucgccgccuccccc

SEQ ID NO: 1779813 - RNA, 17 nt, Salmonella enterica enterica serovar Typhi Ty2
cucgccgccucccccuc

SEQ ID NO: 1779814 - RNA, 18 nt, Salmonella enterica enterica serovar Typhi Ty2
cucgccgccucccccuca

SEQ ID NO: 1779815 - RNA, 20 nt, Salmonella enterica enterica serovar Typhi Ty2
cucgccgacggucaaacuga

SEQ ID NO: 1779816 - RNA, 16 nt, Salmonella enterica enterica serovar Typhi Ty2
cuccuucuucgccguc

SEQ ID NO: 1779817 - RNA, 23 nt, Salmonella enterica enterica serovar Typhi Ty2
cuccuucuucgccgucauaaaac

SEQ ID NO: 1779818 - RNA, 23 nt, Salmonella enterica enterica serovar Typhi Ty2
cuccuuguaagggaggugcucuc

SEQ ID NO: 1779819 - RNA, 16 nt, Salmonella enterica enterica serovar Typhi Ty2
cuccuuguaagggagg

SEQ ID NO: 1779820 - RNA, 16 nt, Salmonella enterica enterica serovar Typhi Ty2
cucgaaacgcugcgcu

SEQ ID NO: 1779821 - RNA, 13 nt, Salmonella enterica enterica serovar Typhi Ty2
cucgaauccacuu

SEQ ID NO: 1779822 - RNA, 13 nt, Salmonella enterica enterica serovar Typhi Ty2
cuccuccggcuuc

SEQ ID NO: 1779823 - RNA, 15 nt, Salmonella enterica enterica serovar Typhi Ty2
cuccuggauuuuacc

SEQ ID NO: 1779824 - RNA, 22 nt, Salmonella enterica enterica serovar Typhi Ty2
cuccugaaucgccgucagugag

SEQ ID NO: 1779825 - RNA, 15 nt, Salmonella enterica enterica serovar Typhi Ty2
cuccugcggccuugc

SEQ ID NO: 1779826 - RNA, 21 nt, Salmonella enterica enterica serovar Typhi Ty2
cuccugcggccuugccgccag

SEQ ID NO: 1779827 - RNA, 20 nt, Salmonella enterica enterica serovar Typhi Ty2
cuccugacauagcucacgca

SEQ ID NO: 1779828 - RNA, 18 nt, Salmonella enterica enterica serovar Typhi Ty2
cuccgcguagcccagcgc

SEQ ID NO: 1779829 - RNA, 13 nt, Salmonella enterica enterica serovar Typhi Ty2
cuccggacgcacc

SEQ ID NO: 1779830 - RNA, 22 nt, Salmonella enterica enterica serovar Typhi Ty2
cuccgucucuuuauugaaaagc

SEQ ID NO: 1779831 - RNA, 17 nt, Salmonella enterica enterica serovar Typhi Ty2
cuccgguugcugauaac

SEQ ID NO: 1779832 - RNA, 12 nt, Salmonella enterica enterica serovar Typhi Ty2
cuccucagcagg

SEQ ID NO: 1779833 - RNA, 20 nt, Salmonella enterica enterica serovar Typhi Ty2
cucccguuucgacgggaggu

SEQ ID NO: 1779834 - RNA, 19 nt, Salmonella enterica enterica serovar Typhi Ty2
cuccgaauaauccuucccg

SEQ ID NO: 1779835 - RNA, 16 nt, Salmonella enterica enterica serovar Typhi Ty2
cucccgguucgccgcu

SEQ ID NO: 1779836 - RNA, 17 nt, Salmonella enterica enterica serovar Typhi Ty2
cucccgucgccuguuuc

SEQ ID NO: 1779837 - RNA, 16 nt, Salmonella enterica enterica serovar Typhi Ty2
cuccgaggaacgugag

SEQ ID NO: 1779838 - RNA, 18 nt, Salmonella enterica enterica serovar Typhi Ty2
cuccgagacucaaagaaa

SEQ ID NO: 1779839 - RNA, 13 nt, Salmonella enterica enterica serovar Typhi Ty2
cuccgcgcuggca

SEQ ID NO: 1779840 - RNA, 14 nt, Salmonella enterica enterica serovar Typhi Ty2
cuccgcgcuggcaa

SEQ ID NO: 1779841 - RNA, 19 nt, Salmonella enterica enterica serovar Typhi Ty2
cuccgcgcauguaaccaaa

SEQ ID NO: 1779842 - RNA, 21 nt, Salmonella enterica enterica serovar Typhi Ty2
cuccgcgcauguaaccaaagc

SEQ ID NO: 1779843 - RNA, 14 nt, Salmonella enterica enterica serovar Typhi Ty2
cuccgccugcgguu

SEQ ID NO: 1779844 - RNA, 14 nt, Salmonella enterica enterica serovar Typhi Ty2
cuccacaguucaau

SEQ ID NO: 1779845 - RNA, 13 nt, Salmonella enterica enterica serovar Typhi Ty2
cuccacauccugu

SEQ ID NO: 1779846 - RNA, 18 nt, Salmonella enterica enterica serovar Typhi Ty2
cuccccguuccaccgcca

SEQ ID NO: 1779847 - RNA, 21 nt, Salmonella enterica enterica serovar Typhi Ty2
cuccccggcuugcggggagaa

SEQ ID NO: 1779848 - RNA, 15 nt, Salmonella enterica enterica serovar Typhi Ty2
cuccccuuuuuucug

SEQ ID NO: 1779849 - RNA, 21 nt, Salmonella enterica enterica serovar Typhi Ty2
cucccggaugcaccaucucuu

SEQ ID NO: 1779850 - RNA, 16 nt, Salmonella enterica enterica serovar Typhi Ty2
cugugcuuaccgggcc

SEQ ID NO: 1779851 - RNA, 18 nt, Salmonella enterica enterica serovar Typhi Ty2
cugugcucgauauauuuu

SEQ ID NO: 1779852 - RNA, 18 nt, Salmonella enterica enterica serovar Typhi Ty2
cugugucguccaggccug

SEQ ID NO: 1779853 - RNA, 12 nt, Salmonella enterica enterica serovar Typhi Ty2
cugugugagcgc

SEQ ID NO: 1779854 - RNA, 13 nt, Salmonella enterica enterica serovar Typhi Ty2
cuguguacuuuua

SEQ ID NO: 1779855 - RNA, 24 nt, Salmonella enterica enterica serovar Typhi Ty2
cuguguauucugcgccagccagcu

SEQ ID NO: 1779856 - RNA, 15 nt, Salmonella enterica enterica serovar Typhi Ty2
cugugucguccaggc

SEQ ID NO: 1779857 - RNA, 16 nt, Salmonella enterica enterica serovar Typhi Ty2
cugugguucugccaga

SEQ ID NO: 1779858 - RNA, 17 nt, Salmonella enterica enterica serovar Typhi Ty2
cugugguugcccgcagg

SEQ ID NO: 1779859 - RNA, 18 nt, Salmonella enterica enterica serovar Typhi Ty2
cuguggugugccugcguu

SEQ ID NO: 1779860 - RNA, 14 nt, Salmonella enterica enterica serovar Typhi Ty2
cuguggugugccug

SEQ ID NO: 1779861 - RNA, 14 nt, Salmonella enterica enterica serovar Typhi Ty2
cugugguucugcca

SEQ ID NO: 1779862 - RNA, 13 nt, Salmonella enterica enterica serovar Typhi Ty2
cuguggugugccu

SEQ ID NO: 1779863 - RNA, 17 nt, Salmonella enterica enterica serovar Typhi Ty2
cuguucaucaaagaaaa

SEQ ID NO: 1779864 - RNA, 19 nt, Salmonella enterica enterica serovar Typhi Ty2
cuguuauugacgauauaaa

SEQ ID NO: 1779865 - RNA, 15 nt, Salmonella enterica enterica serovar Typhi Ty2
cuguuaugccuuuuu

SEQ ID NO: 1779866 - RNA, 20 nt, Salmonella enterica enterica serovar Typhi Ty2
cuguuaugcacgcgcggcgc

SEQ ID NO: 1779867 - RNA, 14 nt, Salmonella enterica enterica serovar Typhi Ty2
cuguuaauuucccg

SEQ ID NO: 1779868 - RNA, 22 nt, Salmonella enterica enterica serovar Typhi Ty2
cuguuaccaaugccaaaaaaac

SEQ ID NO: 1779869 - RNA, 12 nt, Salmonella enterica enterica serovar Typhi Ty2
cuguuaaaaaau

SEQ ID NO: 1779870 - RNA, 13 nt, Salmonella enterica enterica serovar Typhi Ty2
cuguguuuuuucg

SEQ ID NO: 1779871 - RNA, 16 nt, Salmonella enterica enterica serovar Typhi Ty2
cugugcgugacccaca

SEQ ID NO: 1779872 - RNA, 20 nt, Salmonella enterica enterica serovar Typhi Ty2
cugugcucgauauauuuucc

SEQ ID NO: 1779873 - RNA, 14 nt, Salmonella enterica enterica serovar Typhi Ty2
cugugcgugaccca

SEQ ID NO: 1779874 - RNA, 20 nt, Salmonella enterica enterica serovar Typhi Ty2
cugugccgucguacucacca

SEQ ID NO: 1779875 - RNA, 14 nt, Salmonella enterica enterica serovar Typhi Ty2
cugugcgacaaccu

SEQ ID NO: 1779876 - RNA, 15 nt, Salmonella enterica enterica serovar Typhi Ty2
cugugccugccugug

SEQ ID NO: 1779877 - RNA, 21 nt, Salmonella enterica enterica serovar Typhi Ty2
cugugccgcuggugcuacggg

SEQ ID NO: 1779878 - RNA, 17 nt, Salmonella enterica enterica serovar Typhi Ty2
cugugcaacaucuuacc

SEQ ID NO: 1779879 - RNA, 20 nt, Salmonella enterica enterica serovar Typhi Ty2
cugugccagcucguuauuuc

SEQ ID NO: 1779880 - RNA, 21 nt, Salmonella enterica enterica serovar Typhi Ty2
cugugccagcucguuauuucc

SEQ ID NO: 1779881 - RNA, 13 nt, Salmonella enterica enterica serovar Typhi Ty2
cugugccagccca

SEQ ID NO: 1779882 - RNA, 22 nt, Salmonella enterica enterica serovar Typhi Ty2
cugucgaaaccagcauaaugag

SEQ ID NO: 1779883 - RNA, 18 nt, Salmonella enterica enterica serovar Typhi Ty2
cugugagaaggugguggg

SEQ ID NO: 1779884 - RNA, 16 nt, Salmonella enterica enterica serovar Typhi Ty2
cugucuuguuuuucug

SEQ ID NO: 1779885 - RNA, 15 nt, Salmonella enterica enterica serovar Typhi Ty2
cugucuuguuuuucu

SEQ ID NO: 1779886 - RNA, 22 nt, Salmonella enterica enterica serovar Typhi Ty2
cuguagccagccugaacgggug

SEQ ID NO: 1779887 - RNA, 16 nt, Salmonella enterica enterica serovar Typhi Ty2
cuguagcagcgccagc

SEQ ID NO: 1779888 - RNA, 14 nt, Salmonella enterica enterica serovar Typhi Ty2
cuguagccagccug

SEQ ID NO: 1779889 - RNA, 18 nt, Salmonella enterica enterica serovar Typhi Ty2
cuguagauaccuacuuua

SEQ ID NO: 1779890 - RNA, 23 nt, Salmonella enterica enterica serovar Typhi Ty2
cuguagauagcuauccacgcaga

SEQ ID NO: 1779891 - RNA, 14 nt, Salmonella enterica enterica serovar Typhi Ty2
cuguaagaggcaua

SEQ ID NO: 1779892 - RNA, 13 nt, Salmonella enterica enterica serovar Typhi Ty2
cuguaaugaggca

SEQ ID NO: 1779893 - RNA, 23 nt, Salmonella enterica enterica serovar Typhi Ty2
cuguaauagauaugaaagaagga

SEQ ID NO: 1779894 - RNA, 17 nt, Salmonella enterica enterica serovar Typhi Ty2
cuguaucgacauaguac

SEQ ID NO: 1779895 - RNA, 15 nt, Salmonella enterica enterica serovar Typhi Ty2
cuguaucacuuuuua

SEQ ID NO: 1779896 - RNA, 16 nt, Salmonella enterica enterica serovar Typhi Ty2
cuguaucacuuuuuau

SEQ ID NO: 1779897 - RNA, 21 nt, Salmonella enterica enterica serovar Typhi Ty2
cuguagcguuucacgcgcgcc

SEQ ID NO: 1779898 - RNA, 20 nt, Salmonella enterica enterica serovar Typhi Ty2
cuguagcgcuuuggagguca

SEQ ID NO: 1779899 - RNA, 18 nt, Salmonella enterica enterica serovar Typhi Ty2
cuguauacauacauacca

SEQ ID NO: 1779900 - RNA, 17 nt, Salmonella enterica enterica serovar Typhi Ty2
cuguaucugcugacacc

SEQ ID NO: 1779901 - RNA, 16 nt, Salmonella enterica enterica serovar Typhi Ty2
cugguggugggcggca

SEQ ID NO: 1779902 - RNA, 22 nt, Salmonella enterica enterica serovar Typhi Ty2
cuggugguuuugggugcugguu

SEQ ID NO: 1779903 - RNA, 22 nt, Salmonella enterica enterica serovar Typhi Ty2
cugguggucuaugguacacaua

SEQ ID NO: 1779904 - RNA, 16 nt, Salmonella enterica enterica serovar Typhi Ty2
cuggugggacuguuca

SEQ ID NO: 1779905 - RNA, 17 nt, Salmonella enterica enterica serovar Typhi Ty2
cuggugcugugccugcc

SEQ ID NO: 1779906 - RNA, 16 nt, Salmonella enterica enterica serovar Typhi Ty2
cuggugcggggaacac

SEQ ID NO: 1779907 - RNA, 19 nt, Salmonella enterica enterica serovar Typhi Ty2
cuggugcggggaacacuaa

SEQ ID NO: 1779908 - RNA, 13 nt, Salmonella enterica enterica serovar Typhi Ty2
cugguggccuucg

SEQ ID NO: 1779909 - RNA, 23 nt, Salmonella enterica enterica serovar Typhi Ty2
cugguaaccguaacgcuccugga

SEQ ID NO: 1779910 - RNA, 16 nt, Salmonella enterica enterica serovar Typhi Ty2
cugguaacggcacugc

SEQ ID NO: 1779911 - RNA, 21 nt, Salmonella enterica enterica serovar Typhi Ty2
cuggguuuuuccgcuuuuccu

SEQ ID NO: 1779912 - RNA, 12 nt, Salmonella enterica enterica serovar Typhi Ty2
cugguaaaccgg

SEQ ID NO: 1779913 - RNA, 18 nt, Salmonella enterica enterica serovar Typhi Ty2
cuggguuucccauugggc

SEQ ID NO: 1779914 - RNA, 23 nt, Salmonella enterica enterica serovar Typhi Ty2
cuggguucauccagcaauaacac

SEQ ID NO: 1779915 - RNA, 15 nt, Salmonella enterica enterica serovar Typhi Ty2
cuggguaugcagugg

SEQ ID NO: 1779916 - RNA, 22 nt, Salmonella enterica enterica serovar Typhi Ty2
cugguuaaugccuucgccgccg

SEQ ID NO: 1779917 - RNA, 20 nt, Salmonella enterica enterica serovar Typhi Ty2
cugguuaaugaccugccgcg

SEQ ID NO: 1779918 - RNA, 16 nt, Salmonella enterica enterica serovar Typhi Ty2
cuggugugaacaucac

SEQ ID NO: 1779919 - RNA, 17 nt, Salmonella enterica enterica serovar Typhi Ty2
cugguucgaauccaggu

SEQ ID NO: 1779920 - RNA, 14 nt, Salmonella enterica enterica serovar Typhi Ty2
cugguuggcgcgcu

SEQ ID NO: 1779921 - RNA, 16 nt, Salmonella enterica enterica serovar Typhi Ty2
cugguuucccugccuc

SEQ ID NO: 1779922 - RNA, 12 nt, Salmonella enterica enterica serovar Typhi Ty2
cugguugucuca

SEQ ID NO: 1779923 - RNA, 15 nt, Salmonella enterica enterica serovar Typhi Ty2
cugguuguuucuuaa

SEQ ID NO: 1779924 - RNA, 21 nt, Salmonella enterica enterica serovar Typhi Ty2
cugguuucggcaucccaggcg

SEQ ID NO: 1779925 - RNA, 22 nt, Salmonella enterica enterica serovar Typhi Ty2
cugguuucuccggccagucugg

SEQ ID NO: 1779926 - RNA, 23 nt, Salmonella enterica enterica serovar Typhi Ty2
cugggcggcaacccgcuccagaa

SEQ ID NO: 1779927 - RNA, 14 nt, Salmonella enterica enterica serovar Typhi Ty2
cugggcugagaaaa

SEQ ID NO: 1779928 - RNA, 18 nt, Salmonella enterica enterica serovar Typhi Ty2
cuggguaagcgcagcgcc

SEQ ID NO: 1779929 - RNA, 21 nt, Salmonella enterica enterica serovar Typhi Ty2
cugggauucggcaacacccac

SEQ ID NO: 1779930 - RNA, 19 nt, Salmonella enterica enterica serovar Typhi Ty2
cugggagccgcugcucauu

SEQ ID NO: 1779931 - RNA, 15 nt, Salmonella enterica enterica serovar Typhi Ty2
cugggagccgcugcu

SEQ ID NO: 1779932 - RNA, 18 nt, Salmonella enterica enterica serovar Typhi Ty2
cugggauaagcagaacaa

SEQ ID NO: 1779933 - RNA, 16 nt, Salmonella enterica enterica serovar Typhi Ty2
cuggcuuugcgccggc

SEQ ID NO: 1779934 - RNA, 16 nt, Salmonella enterica enterica serovar Typhi Ty2
cuggcuuuggcuaauu

SEQ ID NO: 1779935 - RNA, 17 nt, Salmonella enterica enterica serovar Typhi Ty2
cugggaaguugcccuua

SEQ ID NO: 1779936 - RNA, 17 nt, Salmonella enterica enterica serovar Typhi Ty2
cugggaauaggccgcca

SEQ ID NO: 1779937 - RNA, 19 nt, Salmonella enterica enterica serovar Typhi Ty2
cuggcgucuguccggcgcu

SEQ ID NO: 1779938 - RNA, 13 nt, Salmonella enterica enterica serovar Typhi Ty2
cuggcgccgcaaa

SEQ ID NO: 1779939 - RNA, 13 nt, Salmonella enterica enterica serovar Typhi Ty2
cuggcgccgcaag

SEQ ID NO: 1779940 - RNA, 18 nt, Salmonella enterica enterica serovar Typhi Ty2
cuggcgcauuuuaaugau

SEQ ID NO: 1779941 - RNA, 19 nt, Salmonella enterica enterica serovar Typhi Ty2
cuggcgcagcgcuuuugcc

SEQ ID NO: 1779942 - RNA, 15 nt, Salmonella enterica enterica serovar Typhi Ty2
cuggcucggccuguc

SEQ ID NO: 1779943 - RNA, 17 nt, Salmonella enterica enterica serovar Typhi Ty2
cuggcucccgcagccac

SEQ ID NO: 1779944 - RNA, 12 nt, Salmonella enterica enterica serovar Typhi Ty2
cuggcucauucu

SEQ ID NO: 1779945 - RNA, 15 nt, Salmonella enterica enterica serovar Typhi Ty2
cuggcucaauccagg

SEQ ID NO: 1779946 - RNA, 14 nt, Salmonella enterica enterica serovar Typhi Ty2
cuggcucacugacu

SEQ ID NO: 1779947 - RNA, 11 nt, Salmonella enterica enterica serovar Typhi Ty2
cuggcucagac

SEQ ID NO: 1779948 - RNA, 19 nt, Salmonella enterica enterica serovar Typhi Ty2
cuggcucacugacuaucca

SEQ ID NO: 1779949 - RNA, 16 nt, Salmonella enterica enterica serovar Typhi Ty2
cuggcuaccacauucu

SEQ ID NO: 1779950 - RNA, 15 nt, Salmonella enterica enterica serovar Typhi Ty2
cuggcuacguacaca

SEQ ID NO: 1779951 - RNA, 18 nt, Salmonella enterica enterica serovar Typhi Ty2
cuggcuucagccugugca

SEQ ID NO: 1779952 - RNA, 15 nt, Salmonella enterica enterica serovar Typhi Ty2
cuggcuuaccugcuc

SEQ ID NO: 1779953 - RNA, 15 nt, Salmonella enterica enterica serovar Typhi Ty2
cuggcuuacucgccc

SEQ ID NO: 1779954 - RNA, 22 nt, Salmonella enterica enterica serovar Typhi Ty2
cuggcuguccuugcgccaucgg

SEQ ID NO: 1779955 - RNA, 13 nt, Salmonella enterica enterica serovar Typhi Ty2
cuggcuugccaga

SEQ ID NO: 1779956 - RNA, 21 nt, Salmonella enterica enterica serovar Typhi Ty2
cuggcuugcgcuauccgcgcu

SEQ ID NO: 1779957 - RNA, 14 nt, Salmonella enterica enterica serovar Typhi Ty2
cuggcuuuauauaa

SEQ ID NO: 1779958 - RNA, 11 nt, Salmonella enterica enterica serovar Typhi Ty2
cuggcuuuaua

SEQ ID NO: 1779959 - RNA, 17 nt, Salmonella enterica enterica serovar Typhi Ty2
cuggcuuuauauaaaaa

SEQ ID NO: 1779960 - RNA, 17 nt, Salmonella enterica enterica serovar Typhi Ty2
cuggcuggcgcugacga

SEQ ID NO: 1779961 - RNA, 17 nt, Salmonella enterica enterica serovar Typhi Ty2
cuggcugcugauggucu

SEQ ID NO: 1779962 - RNA, 14 nt, Salmonella enterica enterica serovar Typhi Ty2
cuggcugagaaaaa

SEQ ID NO: 1779963 - RNA, 14 nt, Salmonella enterica enterica serovar Typhi Ty2
cuggccagggcauc

SEQ ID NO: 1779964 - RNA, 23 nt, Salmonella enterica enterica serovar Typhi Ty2
cuggccaguucgucuuccggaua

SEQ ID NO: 1779965 - RNA, 21 nt, Salmonella enterica enterica serovar Typhi Ty2
cuggccaguuucaaugcccag

SEQ ID NO: 1779966 - RNA, 15 nt, Salmonella enterica enterica serovar Typhi Ty2
cuggccgaauagcug

SEQ ID NO: 1779967 - RNA, 18 nt, Salmonella enterica enterica serovar Typhi Ty2
cuggcagcgccugacggc

SEQ ID NO: 1779968 - RNA, 22 nt, Salmonella enterica enterica serovar Typhi Ty2
cuggcagccucguccugcaauu

SEQ ID NO: 1779969 - RNA, 16 nt, Salmonella enterica enterica serovar Typhi Ty2
cuggcagcggcaguaa

SEQ ID NO: 1779970 - RNA, 13 nt, Salmonella enterica enterica serovar Typhi Ty2
cuggcagccucgu

SEQ ID NO: 1779971 - RNA, 17 nt, Salmonella enterica enterica serovar Typhi Ty2
cuggccacggagugcgc

SEQ ID NO: 1779972 - RNA, 15 nt, Salmonella enterica enterica serovar Typhi Ty2
cuggcagaaggcaug

SEQ ID NO: 1779973 - RNA, 16 nt, Salmonella enterica enterica serovar Typhi Ty2
cuggcagaugaacaua

SEQ ID NO: 1779974 - RNA, 17 nt, Salmonella enterica enterica serovar Typhi Ty2
cuggcgaaccaccagcc

SEQ ID NO: 1779975 - RNA, 22 nt, Salmonella enterica enterica serovar Typhi Ty2
cuggcgaauaaaauucagcgca

SEQ ID NO: 1779976 - RNA, 22 nt, Salmonella enterica enterica serovar Typhi Ty2
cuggcgaccgccaccauccggc

SEQ ID NO: 1779977 - RNA, 19 nt, Salmonella enterica enterica serovar Typhi Ty2
cuggcgaccagccugccgu

SEQ ID NO: 1779978 - RNA, 18 nt, Salmonella enterica enterica serovar Typhi Ty2
cuggcgacauuaaaggac

SEQ ID NO: 1779979 - RNA, 19 nt, Salmonella enterica enterica serovar Typhi Ty2
cuggcgcacauugcugccu

SEQ ID NO: 1779980 - RNA, 17 nt, Salmonella enterica enterica serovar Typhi Ty2
cuggcgaccgccaccau

SEQ ID NO: 1779981 - RNA, 15 nt, Salmonella enterica enterica serovar Typhi Ty2
cuggccgcgauggug

SEQ ID NO: 1779982 - RNA, 18 nt, Salmonella enterica enterica serovar Typhi Ty2
cugcuucggaaugacaaa

SEQ ID NO: 1779983 - RNA, 20 nt, Salmonella enterica enterica serovar Typhi Ty2
cugcuuaugaucgcccagcc

SEQ ID NO: 1779984 - RNA, 22 nt, Salmonella enterica enterica serovar Typhi Ty2
cugcuuaugaucgcccagccac

SEQ ID NO: 1779985 - RNA, 22 nt, Salmonella enterica enterica serovar Typhi Ty2
cugcuuaucgauaucugccugc

SEQ ID NO: 1779986 - RNA, 16 nt, Salmonella enterica enterica serovar Typhi Ty2
cugcuucagccacugg

SEQ ID NO: 1779987 - RNA, 15 nt, Salmonella enterica enterica serovar Typhi Ty2
cugcuguuucugguc

SEQ ID NO: 1779988 - RNA, 23 nt, Salmonella enterica enterica serovar Typhi Ty2
cuggauucucucccaggcauccu

SEQ ID NO: 1779989 - RNA, 13 nt, Salmonella enterica enterica serovar Typhi Ty2
cuggauuccucca

SEQ ID NO: 1779990 - RNA, 14 nt, Salmonella enterica enterica serovar Typhi Ty2
cuggcaaaugaagc

SEQ ID NO: 1779991 - RNA, 17 nt, Salmonella enterica enterica serovar Typhi Ty2
cuggauggacuguuucg

SEQ ID NO: 1779992 - RNA, 12 nt, Salmonella enterica enterica serovar Typhi Ty2
cuggauggcaga

SEQ ID NO: 1779993 - RNA, 12 nt, Salmonella enterica enterica serovar Typhi Ty2
cuggaugauaaa

SEQ ID NO: 1779994 - RNA, 19 nt, Salmonella enterica enterica serovar Typhi Ty2
cugcuccguccacgcgagc

SEQ ID NO: 1779995 - RNA, 16 nt, Salmonella enterica enterica serovar Typhi Ty2
cugcgucgcgcgcguu

SEQ ID NO: 1779996 - RNA, 18 nt, Salmonella enterica enterica serovar Typhi Ty2
cugcuccggcuuaaugcc

SEQ ID NO: 1779997 - RNA, 15 nt, Salmonella enterica enterica serovar Typhi Ty2
cugcuccgccagcaa

SEQ ID NO: 1779998 - RNA, 12 nt, Salmonella enterica enterica serovar Typhi Ty2
cugcuccaugac

SEQ ID NO: 1779999 - RNA, 19 nt, Salmonella enterica enterica serovar Typhi Ty2
cugcucgcgacgcagaccc

SEQ ID NO: 1780000 - RNA, 14 nt, Salmonella enterica enterica serovar Typhi Ty2
cugcucguaaagca

SEQ ID NO: 1780001 - RNA, 17 nt, Salmonella enterica enterica serovar Typhi Ty2
cugcucgguaaaaaguu

SEQ ID NO: 1780002 - RNA, 14 nt, Salmonella enterica enterica serovar Typhi Ty2
cugcucgguaucgu

SEQ ID NO: 1780003 - RNA, 17 nt, Salmonella enterica enterica serovar Typhi Ty2
cugcugaaaugccuggu

SEQ ID NO: 1780004 - RNA, 16 nt, Salmonella enterica enterica serovar Typhi Ty2
cugcugacacccucug

SEQ ID NO: 1780005 - RNA, 23 nt, Salmonella enterica enterica serovar Typhi Ty2
cugcugacaaaaacggcuuuaau

SEQ ID NO: 1780006 - RNA, 15 nt, Salmonella enterica enterica serovar Typhi Ty2
cugcugaacacaaug

SEQ ID NO: 1780007 - RNA, 20 nt, Salmonella enterica enterica serovar Typhi Ty2
cugcucuccuugcggugaga

SEQ ID NO: 1780008 - RNA, 20 nt, Salmonella enterica enterica serovar Typhi Ty2
cugcucguuaaauccuccca

SEQ ID NO: 1780009 - RNA, 21 nt, Salmonella enterica enterica serovar Typhi Ty2
cugcucguuaaauccucccau

SEQ ID NO: 1780010 - RNA, 21 nt, Salmonella enterica enterica serovar Typhi Ty2
cugcugcguggucguaaaacu

SEQ ID NO: 1780011 - RNA, 12 nt, Salmonella enterica enterica serovar Typhi Ty2
cugcugcgccuu

SEQ ID NO: 1780012 - RNA, 15 nt, Salmonella enterica enterica serovar Typhi Ty2
cugcugccagcgccg

SEQ ID NO: 1780013 - RNA, 18 nt, Salmonella enterica enterica serovar Typhi Ty2
cugcugccagccgccgcc

SEQ ID NO: 1780014 - RNA, 15 nt, Salmonella enterica enterica serovar Typhi Ty2
cugcugccgcagcac

SEQ ID NO: 1780015 - RNA, 15 nt, Salmonella enterica enterica serovar Typhi Ty2
cugcugaugcugguu

SEQ ID NO: 1780016 - RNA, 16 nt, Salmonella enterica enterica serovar Typhi Ty2
cugcugagugacgggc

SEQ ID NO: 1780017 - RNA, 11 nt, Salmonella enterica enterica serovar Typhi Ty2
cugcugauaau

SEQ ID NO: 1780018 - RNA, 19 nt, Salmonella enterica enterica serovar Typhi Ty2
cugcugacguagauucuga

SEQ ID NO: 1780019 - RNA, 18 nt, Salmonella enterica enterica serovar Typhi Ty2
cugcugaccuuaauccag

SEQ ID NO: 1780020 - RNA, 16 nt, Salmonella enterica enterica serovar Typhi Ty2
cugcuguaacagacgc

SEQ ID NO: 1780021 - RNA, 22 nt, Salmonella enterica enterica serovar Typhi Ty2
cugcuguaacagacgcaggccg

SEQ ID NO: 1780022 - RNA, 17 nt, Salmonella enterica enterica serovar Typhi Ty2
cugcuguguccagguca

SEQ ID NO: 1780023 - RNA, 15 nt, Salmonella enterica enterica serovar Typhi Ty2
cugcuguagcugucc

SEQ ID NO: 1780024 - RNA, 16 nt, Salmonella enterica enterica serovar Typhi Ty2
cugcuguccgccagca

SEQ ID NO: 1780025 - RNA, 18 nt, Salmonella enterica enterica serovar Typhi Ty2
cugcugugacaucgcccc

SEQ ID NO: 1780026 - RNA, 17 nt, Salmonella enterica enterica serovar Typhi Ty2
cugcuggcgagcaggaa

SEQ ID NO: 1780027 - RNA, 16 nt, Salmonella enterica enterica serovar Typhi Ty2
cugcuggcgagcagga

SEQ ID NO: 1780028 - RNA, 14 nt, Salmonella enterica enterica serovar Typhi Ty2
cugcuggcgcguca

SEQ ID NO: 1780029 - RNA, 23 nt, Salmonella enterica enterica serovar Typhi Ty2
cugcuggcggaauccaucccccu

SEQ ID NO: 1780030 - RNA, 14 nt, Salmonella enterica enterica serovar Typhi Ty2
cugcuggccuucca

SEQ ID NO: 1780031 - RNA, 12 nt, Salmonella enterica enterica serovar Typhi Ty2
cugcuggaaagg

SEQ ID NO: 1780032 - RNA, 23 nt, Salmonella enterica enterica serovar Typhi Ty2
cugcugcuugcuuuucaucacca

SEQ ID NO: 1780033 - RNA, 21 nt, Salmonella enterica enterica serovar Typhi Ty2
cugcugcuugcuuuucaucac

SEQ ID NO: 1780034 - RNA, 21 nt, Salmonella enterica enterica serovar Typhi Ty2
cugccuuaauccccggcccgc

SEQ ID NO: 1780035 - RNA, 17 nt, Salmonella enterica enterica serovar Typhi Ty2
cugccuuauccggccug

SEQ ID NO: 1780036 - RNA, 19 nt, Salmonella enterica enterica serovar Typhi Ty2
cugccuuuacugaaucuca

SEQ ID NO: 1780037 - RNA, 22 nt, Salmonella enterica enterica serovar Typhi Ty2
cugccuuuaacaaauuaaaucc

SEQ ID NO: 1780038 - RNA, 19 nt, Salmonella enterica enterica serovar Typhi Ty2
cugccuuuaacaaauuaaa

SEQ ID NO: 1780039 - RNA, 19 nt, Salmonella enterica enterica serovar Typhi Ty2
cugccuuuguacagcuugc

SEQ ID NO: 1780040 - RNA, 18 nt, Salmonella enterica enterica serovar Typhi Ty2
cugccuuuuuuauugccu

SEQ ID NO: 1780041 - RNA, 21 nt, Salmonella enterica enterica serovar Typhi Ty2
cugccgccgucaucugcgccg

SEQ ID NO: 1780042 - RNA, 18 nt, Salmonella enterica enterica serovar Typhi Ty2
cugccgccagcaguugca

SEQ ID NO: 1780043 - RNA, 20 nt, Salmonella enterica enterica serovar Typhi Ty2
cugccgccauuugcgcggcu

SEQ ID NO: 1780044 - RNA, 16 nt, Salmonella enterica enterica serovar Typhi Ty2
cugccgccacgccgcu

SEQ ID NO: 1780045 - RNA, 14 nt, Salmonella enterica enterica serovar Typhi Ty2
cugccgccacgccg

SEQ ID NO: 1780046 - RNA, 15 nt, Salmonella enterica enterica serovar Typhi Ty2
cugcgaacagcgcuc

SEQ ID NO: 1780047 - RNA, 20 nt, Salmonella enterica enterica serovar Typhi Ty2
cugcgcaacauucugcuucc

SEQ ID NO: 1780048 - RNA, 13 nt, Salmonella enterica enterica serovar Typhi Ty2
cugcgcaccugca

SEQ ID NO: 1780049 - RNA, 14 nt, Salmonella enterica enterica serovar Typhi Ty2
cugcgcaaucauga

SEQ ID NO: 1780050 - RNA, 15 nt, Salmonella enterica enterica serovar Typhi Ty2
cugcgccagcggcac

SEQ ID NO: 1780051 - RNA, 16 nt, Salmonella enterica enterica serovar Typhi Ty2
cugcgccagcauggcg

SEQ ID NO: 1780052 - RNA, 14 nt, Salmonella enterica enterica serovar Typhi Ty2
cugcgccagaucag

SEQ ID NO: 1780053 - RNA, 14 nt, Salmonella enterica enterica serovar Typhi Ty2
cugcgccaucuucc

SEQ ID NO: 1780054 - RNA, 22 nt, Salmonella enterica enterica serovar Typhi Ty2
cugcgccauauccucgcugggc

SEQ ID NO: 1780055 - RNA, 14 nt, Salmonella enterica enterica serovar Typhi Ty2
cugcgccagcgccg

SEQ ID NO: 1780056 - RNA, 19 nt, Salmonella enterica enterica serovar Typhi Ty2
cugcgcuuaucaggccuac

SEQ ID NO: 1780057 - RNA, 24 nt, Salmonella enterica enterica serovar Typhi Ty2
cugcgcuuaucaggccuaccagcc

SEQ ID NO: 1780058 - RNA, 20 nt, Salmonella enterica enterica serovar Typhi Ty2
cugcgcguucugcuccagac

SEQ ID NO: 1780059 - RNA, 15 nt, Salmonella enterica enterica serovar Typhi Ty2
cugcgccugcauauc

SEQ ID NO: 1780060 - RNA, 14 nt, Salmonella enterica enterica serovar Typhi Ty2
cugcgcguucugcu

SEQ ID NO: 1780061 - RNA, 17 nt, Salmonella enterica enterica serovar Typhi Ty2
cugcgcuacuucagggg

SEQ ID NO: 1780062 - RNA, 17 nt, Salmonella enterica enterica serovar Typhi Ty2
cugcggcaguucuaaca

SEQ ID NO: 1780063 - RNA, 22 nt, Salmonella enterica enterica serovar Typhi Ty2
cugcggcauacuuucgcgcggc

SEQ ID NO: 1780064 - RNA, 13 nt, Salmonella enterica enterica serovar Typhi Ty2
cugcggccaugau

SEQ ID NO: 1780065 - RNA, 23 nt, Salmonella enterica enterica serovar Typhi Ty2
cugcggcccauaaacaggucaca

SEQ ID NO: 1780066 - RNA, 21 nt, Salmonella enterica enterica serovar Typhi Ty2
cugcggcauuacgcgccucuu

SEQ ID NO: 1780067 - RNA, 14 nt, Salmonella enterica enterica serovar Typhi Ty2
cugcggccugccca

SEQ ID NO: 1780068 - RNA, 20 nt, Salmonella enterica enterica serovar Typhi Ty2
cugcggcuauauaaaaucgg

SEQ ID NO: 1780069 - RNA, 15 nt, Salmonella enterica enterica serovar Typhi Ty2
cugcggcguggagca

SEQ ID NO: 1780070 - RNA, 15 nt, Salmonella enterica enterica serovar Typhi Ty2
cugcggcgucugccu

SEQ ID NO: 1780071 - RNA, 22 nt, Salmonella enterica enterica serovar Typhi Ty2
cugcgucaugucguuagaacca

SEQ ID NO: 1780072 - RNA, 23 nt, Salmonella enterica enterica serovar Typhi Ty2
cugcggcggcggaaaauagccag

SEQ ID NO: 1780073 - RNA, 17 nt, Salmonella enterica enterica serovar Typhi Ty2
cugaugaccgccgucau

SEQ ID NO: 1780074 - RNA, 22 nt, Salmonella enterica enterica serovar Typhi Ty2
cugaugaccgccgucauagcag

SEQ ID NO: 1780075 - RNA, 21 nt, Salmonella enterica enterica serovar Typhi Ty2
cugaugauggaacagacgccu

SEQ ID NO: 1780076 - RNA, 22 nt, Salmonella enterica enterica serovar Typhi Ty2
cugaugcguuguaccguuuucc

SEQ ID NO: 1780077 - RNA, 24 nt, Salmonella enterica enterica serovar Typhi Ty2
cugaugcgcguuuagcgccagcag

SEQ ID NO: 1780078 - RNA, 13 nt, Salmonella enterica enterica serovar Typhi Ty2
cugaugcugugca

SEQ ID NO: 1780079 - RNA, 14 nt, Salmonella enterica enterica serovar Typhi Ty2
cugaugccugaagg

SEQ ID NO: 1780080 - RNA, 22 nt, Salmonella enterica enterica serovar Typhi Ty2
cugaugcccagguuagcagcca

SEQ ID NO: 1780081 - RNA, 22 nt, Salmonella enterica enterica serovar Typhi Ty2
cugaugccauaaaaugcugggc

SEQ ID NO: 1780082 - RNA, 21 nt, Salmonella enterica enterica serovar Typhi Ty2
cugaugcagcuugcaggcaaa

SEQ ID NO: 1780083 - RNA, 18 nt, Salmonella enterica enterica serovar Typhi Ty2
cugaugauuggccuccac

SEQ ID NO: 1780084 - RNA, 13 nt, Salmonella enterica enterica serovar Typhi Ty2
cugauuuuacuga

SEQ ID NO: 1780085 - RNA, 20 nt, Salmonella enterica enterica serovar Typhi Ty2
cugcaaaaagccuugcugaa

SEQ ID NO: 1780086 - RNA, 13 nt, Salmonella enterica enterica serovar Typhi Ty2
cugcaaaagagga

SEQ ID NO: 1780087 - RNA, 16 nt, Salmonella enterica enterica serovar Typhi Ty2
cugcaaaaagccuugc

SEQ ID NO: 1780088 - RNA, 15 nt, Salmonella enterica enterica serovar Typhi Ty2
cugauuuuuuugcug

SEQ ID NO: 1780089 - RNA, 13 nt, Salmonella enterica enterica serovar Typhi Ty2
cugauuuuuccau

SEQ ID NO: 1780090 - RNA, 15 nt, Salmonella enterica enterica serovar Typhi Ty2
cugauucguuuuuac

SEQ ID NO: 1780091 - RNA, 16 nt, Salmonella enterica enterica serovar Typhi Ty2
cugauguagcucuuca

SEQ ID NO: 1780092 - RNA, 19 nt, Salmonella enterica enterica serovar Typhi Ty2
cugauguaccugcguuaaa

SEQ ID NO: 1780093 - RNA, 20 nt, Salmonella enterica enterica serovar Typhi Ty2
cugauggucgcucuggucga

SEQ ID NO: 1780094 - RNA, 12 nt, Salmonella enterica enterica serovar Typhi Ty2
cugcaccgccug

SEQ ID NO: 1780095 - RNA, 17 nt, Salmonella enterica enterica serovar Typhi Ty2
cugcacccggagagaaa

SEQ ID NO: 1780096 - RNA, 16 nt, Salmonella enterica enterica serovar Typhi Ty2
cugcaaaauauauaau

SEQ ID NO: 1780097 - RNA, 14 nt, Salmonella enterica enterica serovar Typhi Ty2
cugcaaaucugccg

SEQ ID NO: 1780098 - RNA, 21 nt, Salmonella enterica enterica serovar Typhi Ty2
cugcaaaucugccgucaucga

SEQ ID NO: 1780099 - RNA, 14 nt, Salmonella enterica enterica serovar Typhi Ty2
cugcacaaucgcca

SEQ ID NO: 1780100 - RNA, 14 nt, Salmonella enterica enterica serovar Typhi Ty2
cugcaacagcacca

SEQ ID NO: 1780101 - RNA, 20 nt, Salmonella enterica enterica serovar Typhi Ty2
cugcaacagaagaguuaacu

SEQ ID NO: 1780102 - RNA, 16 nt, Salmonella enterica enterica serovar Typhi Ty2
cugcaacagcacggga

SEQ ID NO: 1780103 - RNA, 17 nt, Salmonella enterica enterica serovar Typhi Ty2
cugcacaaucgccagcc

SEQ ID NO: 1780104 - RNA, 20 nt, Salmonella enterica enterica serovar Typhi Ty2
cugcacauucagguggcuga

SEQ ID NO: 1780105 - RNA, 22 nt, Salmonella enterica enterica serovar Typhi Ty2
cugcaccagaacucccuguucc

SEQ ID NO: 1780106 - RNA, 18 nt, Salmonella enterica enterica serovar Typhi Ty2
cugcauuugcugccgugg

SEQ ID NO: 1780107 - RNA, 15 nt, Salmonella enterica enterica serovar Typhi Ty2
cugcauuugcugccg

SEQ ID NO: 1780108 - RNA, 21 nt, Salmonella enterica enterica serovar Typhi Ty2
cugccaaccauuaacuccgga

SEQ ID NO: 1780109 - RNA, 20 nt, Salmonella enterica enterica serovar Typhi Ty2
cugccaaugaaauaauugug

SEQ ID NO: 1780110 - RNA, 19 nt, Salmonella enterica enterica serovar Typhi Ty2
cugcauccuguaccaccac

SEQ ID NO: 1780111 - RNA, 21 nt, Salmonella enterica enterica serovar Typhi Ty2
cugcaucugcggucuccugaa

SEQ ID NO: 1780112 - RNA, 16 nt, Salmonella enterica enterica serovar Typhi Ty2
cugcaucuuacugacc

SEQ ID NO: 1780113 - RNA, 21 nt, Salmonella enterica enterica serovar Typhi Ty2
cugcauacucacauucauaaa

SEQ ID NO: 1780114 - RNA, 12 nt, Salmonella enterica enterica serovar Typhi Ty2
cugcauauuuuu

SEQ ID NO: 1780115 - RNA, 17 nt, Salmonella enterica enterica serovar Typhi Ty2
cugcauauuuuucauuc

SEQ ID NO: 1780116 - RNA, 13 nt, Salmonella enterica enterica serovar Typhi Ty2
cugcaucaacagg

SEQ ID NO: 1780117 - RNA, 20 nt, Salmonella enterica enterica serovar Typhi Ty2
cugccccgccacagccgcau

SEQ ID NO: 1780118 - RNA, 21 nt, Salmonella enterica enterica serovar Typhi Ty2
cugcccuacgcuucucuccau

SEQ ID NO: 1780119 - RNA, 20 nt, Salmonella enterica enterica serovar Typhi Ty2
cugcccuacgcuucucucca

SEQ ID NO: 1780120 - RNA, 15 nt, Salmonella enterica enterica serovar Typhi Ty2
cugcccuacgcuucu

SEQ ID NO: 1780121 - RNA, 11 nt, Salmonella enterica enterica serovar Typhi Ty2
cugcccgccgc

SEQ ID NO: 1780122 - RNA, 23 nt, Salmonella enterica enterica serovar Typhi Ty2
cugccgauuuugaacaugcgcag

SEQ ID NO: 1780123 - RNA, 17 nt, Salmonella enterica enterica serovar Typhi Ty2
cugccgcaaacgccugc

SEQ ID NO: 1780124 - RNA, 17 nt, Salmonella enterica enterica serovar Typhi Ty2
cugcccuggugagcucc

SEQ ID NO: 1780125 - RNA, 21 nt, Salmonella enterica enterica serovar Typhi Ty2
cugcccuggugagcuccagcc

SEQ ID NO: 1780126 - RNA, 19 nt, Salmonella enterica enterica serovar Typhi Ty2
cugcccugcggcaggcaaa

SEQ ID NO: 1780127 - RNA, 23 nt, Salmonella enterica enterica serovar Typhi Ty2
cugcccuguucggcgcggaaggu

SEQ ID NO: 1780128 - RNA, 17 nt, Salmonella enterica enterica serovar Typhi Ty2
cugcccugacucgcacc

SEQ ID NO: 1780129 - RNA, 15 nt, Salmonella enterica enterica serovar Typhi Ty2
cugccagccgcucug

SEQ ID NO: 1780130 - RNA, 16 nt, Salmonella enterica enterica serovar Typhi Ty2
cugccacaucgccagc

SEQ ID NO: 1780131 - RNA, 17 nt, Salmonella enterica enterica serovar Typhi Ty2
cugccacacucucucca

SEQ ID NO: 1780132 - RNA, 13 nt, Salmonella enterica enterica serovar Typhi Ty2
cugccacaacggc

SEQ ID NO: 1780133 - RNA, 23 nt, Salmonella enterica enterica serovar Typhi Ty2
cugccacaacggcaauuuuuaca

SEQ ID NO: 1780134 - RNA, 13 nt, Salmonella enterica enterica serovar Typhi Ty2
cugcccacccggg

SEQ ID NO: 1780135 - RNA, 23 nt, Salmonella enterica enterica serovar Typhi Ty2
cugccauuaucaccauucccagc

SEQ ID NO: 1780136 - RNA, 13 nt, Salmonella enterica enterica serovar Typhi Ty2
cugccauucccag

SEQ ID NO: 1780137 - RNA, 17 nt, Salmonella enterica enterica serovar Typhi Ty2
cugccauuaucaccauu

SEQ ID NO: 1780138 - RNA, 18 nt, Salmonella enterica enterica serovar Typhi Ty2
cuucaucgcgccuccccu

SEQ ID NO: 1780139 - RNA, 21 nt, Salmonella enterica enterica serovar Typhi Ty2
cuucacucugggauuugcgaa

SEQ ID NO: 1780140 - RNA, 16 nt, Salmonella enterica enterica serovar Typhi Ty2
cuucaucgauggcgcc

SEQ ID NO: 1780141 - RNA, 16 nt, Salmonella enterica enterica serovar Typhi Ty2
cuucagacaacgccgc

SEQ ID NO: 1780142 - RNA, 22 nt, Salmonella enterica enterica serovar Typhi Ty2
cuucaucggauagaugaagaca

SEQ ID NO: 1780143 - RNA, 17 nt, Salmonella enterica enterica serovar Typhi Ty2
cuucaucggauagauga

SEQ ID NO: 1780144 - RNA, 19 nt, Salmonella enterica enterica serovar Typhi Ty2
cuucaugaguaaaugaacg

SEQ ID NO: 1780145 - RNA, 16 nt, Salmonella enterica enterica serovar Typhi Ty2
cuucaucuuccaguac

SEQ ID NO: 1780146 - RNA, 12 nt, Salmonella enterica enterica serovar Typhi Ty2
cuucaucuucca

SEQ ID NO: 1780147 - RNA, 14 nt, Salmonella enterica enterica serovar Typhi Ty2
cuuccagcgcgccg

SEQ ID NO: 1780148 - RNA, 20 nt, Salmonella enterica enterica serovar Typhi Ty2
cuuccagcgcguccagcccg

SEQ ID NO: 1780149 - RNA, 18 nt, Salmonella enterica enterica serovar Typhi Ty2
cuuccagcgcguccagcc

SEQ ID NO: 1780150 - RNA, 13 nt, Salmonella enterica enterica serovar Typhi Ty2
cuuccagcggcag

SEQ ID NO: 1780151 - RNA, 17 nt, Salmonella enterica enterica serovar Typhi Ty2
cuuccagcgacuccgga

SEQ ID NO: 1780152 - RNA, 15 nt, Salmonella enterica enterica serovar Typhi Ty2
cuuccagcaauucgu

SEQ ID NO: 1780153 - RNA, 22 nt, Salmonella enterica enterica serovar Typhi Ty2
cuuccagcacgauauccagcac

SEQ ID NO: 1780154 - RNA, 14 nt, Salmonella enterica enterica serovar Typhi Ty2
cuuccagcaccgcg

SEQ ID NO: 1780155 - RNA, 13 nt, Salmonella enterica enterica serovar Typhi Ty2
cuuccagcagcca

SEQ ID NO: 1780156 - RNA, 15 nt, Salmonella enterica enterica serovar Typhi Ty2
cuuccagcagccagc

SEQ ID NO: 1780157 - RNA, 17 nt, Salmonella enterica enterica serovar Typhi Ty2
cuuccacgcacgccggc

SEQ ID NO: 1780158 - RNA, 23 nt, Salmonella enterica enterica serovar Typhi Ty2
cuuccagcaaaccuuccgccagg

SEQ ID NO: 1780159 - RNA, 21 nt, Salmonella enterica enterica serovar Typhi Ty2
cuuccacccgcgcgcuuucca

SEQ ID NO: 1780160 - RNA, 16 nt, Salmonella enterica enterica serovar Typhi Ty2
cuuccacccgcgcgcu

SEQ ID NO: 1780161 - RNA, 23 nt, Salmonella enterica enterica serovar Typhi Ty2
cuuccuguacaaaaucaucauca

SEQ ID NO: 1780162 - RNA, 15 nt, Salmonella enterica enterica serovar Typhi Ty2
cuuccugccaggccg

SEQ ID NO: 1780163 - RNA, 15 nt, Salmonella enterica enterica serovar Typhi Ty2
cuuccugcgucaggc

SEQ ID NO: 1780164 - RNA, 12 nt, Salmonella enterica enterica serovar Typhi Ty2
cuuccugcugcg

SEQ ID NO: 1780165 - RNA, 14 nt, Salmonella enterica enterica serovar Typhi Ty2
cuuccucacagccu

SEQ ID NO: 1780166 - RNA, 19 nt, Salmonella enterica enterica serovar Typhi Ty2
cuuccucaccguagcucca

SEQ ID NO: 1780167 - RNA, 21 nt, Salmonella enterica enterica serovar Typhi Ty2
cuuccuccccaggcgcuauuc

SEQ ID NO: 1780168 - RNA, 22 nt, Salmonella enterica enterica serovar Typhi Ty2
cuuccucaauauugucuucguc

SEQ ID NO: 1780169 - RNA, 18 nt, Salmonella enterica enterica serovar Typhi Ty2
cuucccugaccagcgacg

SEQ ID NO: 1780170 - RNA, 14 nt, Salmonella enterica enterica serovar Typhi Ty2
cuuccgucagcgaa

SEQ ID NO: 1780171 - RNA, 14 nt, Salmonella enterica enterica serovar Typhi Ty2
cuuccguccccagc

SEQ ID NO: 1780172 - RNA, 16 nt, Salmonella enterica enterica serovar Typhi Ty2
cuuccguaaaaagaac

SEQ ID NO: 1780173 - RNA, 15 nt, Salmonella enterica enterica serovar Typhi Ty2
cuuccagcuccaucc

SEQ ID NO: 1780174 - RNA, 15 nt, Salmonella enterica enterica serovar Typhi Ty2
cuuccagcgucucca

SEQ ID NO: 1780175 - RNA, 12 nt, Salmonella enterica enterica serovar Typhi Ty2
cuuccagcucca

SEQ ID NO: 1780176 - RNA, 23 nt, Salmonella enterica enterica serovar Typhi Ty2
cuucccauauuuuuucugccagu

SEQ ID NO: 1780177 - RNA, 20 nt, Salmonella enterica enterica serovar Typhi Ty2
cuuccccuucacucuucgac

SEQ ID NO: 1780178 - RNA, 15 nt, Salmonella enterica enterica serovar Typhi Ty2
cuucccgacgcuggc

SEQ ID NO: 1780179 - RNA, 22 nt, Salmonella enterica enterica serovar Typhi Ty2
cuuccccggucagucccagcgu

SEQ ID NO: 1780180 - RNA, 20 nt, Salmonella enterica enterica serovar Typhi Ty2
cuuccccuguaacugcaccu

SEQ ID NO: 1780181 - RNA, 16 nt, Salmonella enterica enterica serovar Typhi Ty2
cuuccccgaucagaaa

SEQ ID NO: 1780182 - RNA, 23 nt, Salmonella enterica enterica serovar Typhi Ty2
cuucccgcaaacuggccacagca

SEQ ID NO: 1780183 - RNA, 14 nt, Salmonella enterica enterica serovar Typhi Ty2
cuucccgcucauua

SEQ ID NO: 1780184 - RNA, 17 nt, Salmonella enterica enterica serovar Typhi Ty2
cuucccggggaacagaa

SEQ ID NO: 1780185 - RNA, 19 nt, Salmonella enterica enterica serovar Typhi Ty2
cuucccgcgcagugcagcg

SEQ ID NO: 1780186 - RNA, 16 nt, Salmonella enterica enterica serovar Typhi Ty2
cuucccggcaggcauu

SEQ ID NO: 1780187 - RNA, 20 nt, Salmonella enterica enterica serovar Typhi Ty2
cuucgucaggcggcugcgca

SEQ ID NO: 1780188 - RNA, 14 nt, Salmonella enterica enterica serovar Typhi Ty2
cuucgucaaaaugg

SEQ ID NO: 1780189 - RNA, 16 nt, Salmonella enterica enterica serovar Typhi Ty2
cuucguaccaaacgaa

SEQ ID NO: 1780190 - RNA, 15 nt, Salmonella enterica enterica serovar Typhi Ty2
cuucguuaagcgguu

SEQ ID NO: 1780191 - RNA, 23 nt, Salmonella enterica enterica serovar Typhi Ty2
cuucguggaacugcagcgcgucg

SEQ ID NO: 1780192 - RNA, 19 nt, Salmonella enterica enterica serovar Typhi Ty2
cuucguggaacugcagcgc

SEQ ID NO: 1780193 - RNA, 21 nt, Salmonella enterica enterica serovar Typhi Ty2
cuucuacacgacgcauugcca

SEQ ID NO: 1780194 - RNA, 13 nt, Salmonella enterica enterica serovar Typhi Ty2
cuucuaauuuuuc

SEQ ID NO: 1780195 - RNA, 15 nt, Salmonella enterica enterica serovar Typhi Ty2
cuucuaccuggaacc

SEQ ID NO: 1780196 - RNA, 19 nt, Salmonella enterica enterica serovar Typhi Ty2
cuucuauuaccgcagcgcg

SEQ ID NO: 1780197 - RNA, 18 nt, Salmonella enterica enterica serovar Typhi Ty2
cuucgacaaucagcacca

SEQ ID NO: 1780198 - RNA, 18 nt, Salmonella enterica enterica serovar Typhi Ty2
cuucgaccgucagcagca

SEQ ID NO: 1780199 - RNA, 21 nt, Salmonella enterica enterica serovar Typhi Ty2
cuucgauaguccauuuuccua

SEQ ID NO: 1780200 - RNA, 15 nt, Salmonella enterica enterica serovar Typhi Ty2
cuucgcuuagcuucc

SEQ ID NO: 1780201 - RNA, 14 nt, Salmonella enterica enterica serovar Typhi Ty2
cuucgcuuaucugg

SEQ ID NO: 1780202 - RNA, 22 nt, Salmonella enterica enterica serovar Typhi Ty2
cuucggcaaaauauucagcgaa

SEQ ID NO: 1780203 - RNA, 18 nt, Salmonella enterica enterica serovar Typhi Ty2
cuucggccugaaucagca

SEQ ID NO: 1780204 - RNA, 21 nt, Salmonella enterica enterica serovar Typhi Ty2
cuucggcgggaucuccagaag

SEQ ID NO: 1780205 - RNA, 19 nt, Salmonella enterica enterica serovar Typhi Ty2
cuucggcgucgugcugggc

SEQ ID NO: 1780206 - RNA, 19 nt, Salmonella enterica enterica serovar Typhi Ty2
cuucaacgcaggcgaaauc

SEQ ID NO: 1780207 - RNA, 15 nt, Salmonella enterica enterica serovar Typhi Ty2
cuucaacgccgcgcu

SEQ ID NO: 1780208 - RNA, 13 nt, Salmonella enterica enterica serovar Typhi Ty2
cuucaacgcgccg

SEQ ID NO: 1780209 - RNA, 19 nt, Salmonella enterica enterica serovar Typhi Ty2
cuucaaccguuucuuuuuc

SEQ ID NO: 1780210 - RNA, 21 nt, Salmonella enterica enterica serovar Typhi Ty2
cuucaaccguuucuuuuucga

SEQ ID NO: 1780211 - RNA, 17 nt, Salmonella enterica enterica serovar Typhi Ty2
cuucaagcguuuccaga

SEQ ID NO: 1780212 - RNA, 21 nt, Salmonella enterica enterica serovar Typhi Ty2
cuucaagguucgacucgagca

SEQ ID NO: 1780213 - RNA, 15 nt, Salmonella enterica enterica serovar Typhi Ty2
cuucaagaaguucca

SEQ ID NO: 1780214 - RNA, 19 nt, Salmonella enterica enterica serovar Typhi Ty2
cuucaccucagccaaccca

SEQ ID NO: 1780215 - RNA, 17 nt, Salmonella enterica enterica serovar Typhi Ty2
cuucaccucagucgcuu

SEQ ID NO: 1780216 - RNA, 15 nt, Salmonella enterica enterica serovar Typhi Ty2
cuucaccggcgugcg

SEQ ID NO: 1780217 - RNA, 16 nt, Salmonella enterica enterica serovar Typhi Ty2
cuucaauaucaacgac

SEQ ID NO: 1780218 - RNA, 21 nt, Salmonella enterica enterica serovar Typhi Ty2
cuuauuuuucagcgccaguga

SEQ ID NO: 1780219 - RNA, 19 nt, Salmonella enterica enterica serovar Typhi Ty2
cuuauuuuccguuagccaa

SEQ ID NO: 1780220 - RNA, 16 nt, Salmonella enterica enterica serovar Typhi Ty2
cuuauugucgccgccg

SEQ ID NO: 1780221 - RNA, 15 nt, Salmonella enterica enterica serovar Typhi Ty2
cuuauuucuccugcg

SEQ ID NO: 1780222 - RNA, 23 nt, Salmonella enterica enterica serovar Typhi Ty2
cuucaaauauauugaaaagggac

SEQ ID NO: 1780223 - RNA, 12 nt, Salmonella enterica enterica serovar Typhi Ty2
cuuauucaggcg

SEQ ID NO: 1780224 - RNA, 13 nt, Salmonella enterica enterica serovar Typhi Ty2
cuuauucaaucaa

SEQ ID NO: 1780225 - RNA, 21 nt, Salmonella enterica enterica serovar Typhi Ty2
cuuaugaucgcccagccacuc

SEQ ID NO: 1780226 - RNA, 23 nt, Salmonella enterica enterica serovar Typhi Ty2
cuuaugaccgagucuacaucaag

SEQ ID NO: 1780227 - RNA, 22 nt, Salmonella enterica enterica serovar Typhi Ty2
cuuaaauuaaugauuaaaauaa

SEQ ID NO: 1780228 - RNA, 18 nt, Salmonella enterica enterica serovar Typhi Ty2
cuuaaauuaaugauuaaa

SEQ ID NO: 1780229 - RNA, 16 nt, Salmonella enterica enterica serovar Typhi Ty2
cuuaacgauaacguca

SEQ ID NO: 1780230 - RNA, 21 nt, Salmonella enterica enterica serovar Typhi Ty2
cuuaaccgggaucgggacaug

SEQ ID NO: 1780231 - RNA, 15 nt, Salmonella enterica enterica serovar Typhi Ty2
cuuaacagaauugcg

SEQ ID NO: 1780232 - RNA, 14 nt, Salmonella enterica enterica serovar Typhi Ty2
cuguucgccggaug

SEQ ID NO: 1780233 - RNA, 21 nt, Salmonella enterica enterica serovar Typhi Ty2
cuguuccugcgggaacagaua

SEQ ID NO: 1780234 - RNA, 12 nt, Salmonella enterica enterica serovar Typhi Ty2
cuguuccucuuu

SEQ ID NO: 1780235 - RNA, 19 nt, Salmonella enterica enterica serovar Typhi Ty2
cuguuccgaaauaaaucga

SEQ ID NO: 1780236 - RNA, 11 nt, Salmonella enterica enterica serovar Typhi Ty2
cuguuccagcg

SEQ ID NO: 1780237 - RNA, 15 nt, Salmonella enterica enterica serovar Typhi Ty2
cuguuccagcugcga

SEQ ID NO: 1780238 - RNA, 18 nt, Salmonella enterica enterica serovar Typhi Ty2
cuguuccagguucaagcu

SEQ ID NO: 1780239 - RNA, 21 nt, Salmonella enterica enterica serovar Typhi Ty2
cuuaauacccauuucuucuuc

SEQ ID NO: 1780240 - RNA, 23 nt, Salmonella enterica enterica serovar Typhi Ty2
cuuaauacccauuucuucuucaa

SEQ ID NO: 1780241 - RNA, 18 nt, Salmonella enterica enterica serovar Typhi Ty2
cuuaauacccauuucuuc

SEQ ID NO: 1780242 - RNA, 18 nt, Salmonella enterica enterica serovar Typhi Ty2
cuuaauacucgccccguu

SEQ ID NO: 1780243 - RNA, 17 nt, Salmonella enterica enterica serovar Typhi Ty2
cuuaauacgcagaucuu

SEQ ID NO: 1780244 - RNA, 21 nt, Salmonella enterica enterica serovar Typhi Ty2
cuuaaugaguacggguauucc

SEQ ID NO: 1780245 - RNA, 18 nt, Salmonella enterica enterica serovar Typhi Ty2
cuuaccaggucuuaccua

SEQ ID NO: 1780246 - RNA, 14 nt, Salmonella enterica enterica serovar Typhi Ty2
cuuaccgggcagga

SEQ ID NO: 1780247 - RNA, 14 nt, Salmonella enterica enterica serovar Typhi Ty2
cuuacuuguaggcc

SEQ ID NO: 1780248 - RNA, 18 nt, Salmonella enterica enterica serovar Typhi Ty2
cuuacuuuccaaaaucca

SEQ ID NO: 1780249 - RNA, 22 nt, Salmonella enterica enterica serovar Typhi Ty2
cuuacuuuccaaaauccaggga

SEQ ID NO: 1780250 - RNA, 20 nt, Salmonella enterica enterica serovar Typhi Ty2
cuuacuuucuugccacuggc

SEQ ID NO: 1780251 - RNA, 14 nt, Salmonella enterica enterica serovar Typhi Ty2
cuuacuuugcgccc

SEQ ID NO: 1780252 - RNA, 20 nt, Salmonella enterica enterica serovar Typhi Ty2
cuuaggcaggggauuagacu

SEQ ID NO: 1780253 - RNA, 19 nt, Salmonella enterica enterica serovar Typhi Ty2
cuuagcgcccgguuuuuuu

SEQ ID NO: 1780254 - RNA, 16 nt, Salmonella enterica enterica serovar Typhi Ty2
cuuaggauaauucccc

SEQ ID NO: 1780255 - RNA, 15 nt, Salmonella enterica enterica serovar Typhi Ty2
cuuucugcugccgca

SEQ ID NO: 1780256 - RNA, 12 nt, Salmonella enterica enterica serovar Typhi Ty2
cuuucguuggua

SEQ ID NO: 1780257 - RNA, 12 nt, Salmonella enterica enterica serovar Typhi Ty2
cuuucuacaaau

SEQ ID NO: 1780258 - RNA, 13 nt, Salmonella enterica enterica serovar Typhi Ty2
cuuuccaaccugu

SEQ ID NO: 1780259 - RNA, 15 nt, Salmonella enterica enterica serovar Typhi Ty2
cuuuccaaagcgaag

SEQ ID NO: 1780260 - RNA, 23 nt, Salmonella enterica enterica serovar Typhi Ty2
cuuuccacaaucccggcaacugc

SEQ ID NO: 1780261 - RNA, 18 nt, Salmonella enterica enterica serovar Typhi Ty2
cuuuccaaaauccaggga

SEQ ID NO: 1780262 - RNA, 18 nt, Salmonella enterica enterica serovar Typhi Ty2
cuuucgguagccacagau

SEQ ID NO: 1780263 - RNA, 22 nt, Salmonella enterica enterica serovar Typhi Ty2
cuuucggucguuugccgugcau

SEQ ID NO: 1780264 - RNA, 22 nt, Salmonella enterica enterica serovar Typhi Ty2
cuuucgucguccacucuuccgg

SEQ ID NO: 1780265 - RNA, 14 nt, Salmonella enterica enterica serovar Typhi Ty2
cuuuccagcuccag

SEQ ID NO: 1780266 - RNA, 14 nt, Salmonella enterica enterica serovar Typhi Ty2
cuuuccagcagcca

SEQ ID NO: 1780267 - RNA, 15 nt, Salmonella enterica enterica serovar Typhi Ty2
cuuugaccagcgacg

SEQ ID NO: 1780268 - RNA, 18 nt, Salmonella enterica enterica serovar Typhi Ty2
cuuugaccagcaucgccg

SEQ ID NO: 1780269 - RNA, 14 nt, Salmonella enterica enterica serovar Typhi Ty2
cuuugaacagccag

SEQ ID NO: 1780270 - RNA, 11 nt, Salmonella enterica enterica serovar Typhi Ty2
cuuugaacagc

SEQ ID NO: 1780271 - RNA, 14 nt, Salmonella enterica enterica serovar Typhi Ty2
cuuucuucaauggc

SEQ ID NO: 1780272 - RNA, 18 nt, Salmonella enterica enterica serovar Typhi Ty2
cuuuggcuguccagccgc

SEQ ID NO: 1780273 - RNA, 20 nt, Salmonella enterica enterica serovar Typhi Ty2
cuuuggcgcgcgguuuaucc

SEQ ID NO: 1780274 - RNA, 21 nt, Salmonella enterica enterica serovar Typhi Ty2
cuuuggcgcgcgguuuauccc

SEQ ID NO: 1780275 - RNA, 14 nt, Salmonella enterica enterica serovar Typhi Ty2
cuuuggcgcccauu

SEQ ID NO: 1780276 - RNA, 23 nt, Salmonella enterica enterica serovar Typhi Ty2
cuuuggccuggagaucagcaugg

SEQ ID NO: 1780277 - RNA, 22 nt, Salmonella enterica enterica serovar Typhi Ty2
cuuuggcaggccucuaucuucu

SEQ ID NO: 1780278 - RNA, 19 nt, Salmonella enterica enterica serovar Typhi Ty2
cuuuggacggcaucaggaa

SEQ ID NO: 1780279 - RNA, 19 nt, Salmonella enterica enterica serovar Typhi Ty2
cuuugcguuuacuuacaaa

SEQ ID NO: 1780280 - RNA, 20 nt, Salmonella enterica enterica serovar Typhi Ty2
cuuugcguaaaaaacaucau

SEQ ID NO: 1780281 - RNA, 16 nt, Salmonella enterica enterica serovar Typhi Ty2
cuuugcgcuccugcuc

SEQ ID NO: 1780282 - RNA, 21 nt, Salmonella enterica enterica serovar Typhi Ty2
cuuugcgcucaugcgccuggc

SEQ ID NO: 1780283 - RNA, 14 nt, Salmonella enterica enterica serovar Typhi Ty2
cuuugcuuuguagc

SEQ ID NO: 1780284 - RNA, 18 nt, Salmonella enterica enterica serovar Typhi Ty2
cuuugcgauagcccggca

SEQ ID NO: 1780285 - RNA, 21 nt, Salmonella enterica enterica serovar Typhi Ty2
cuuugccuuuuucccacugcg

SEQ ID NO: 1780286 - RNA, 20 nt, Salmonella enterica enterica serovar Typhi Ty2
cuuugcgccggcaguuuaag

SEQ ID NO: 1780287 - RNA, 19 nt, Salmonella enterica enterica serovar Typhi Ty2
cuuugcgauagcccggcau

SEQ ID NO: 1780288 - RNA, 15 nt, Salmonella enterica enterica serovar Typhi Ty2
cuuugcgauuugucc

SEQ ID NO: 1780289 - RNA, 19 nt, Salmonella enterica enterica serovar Typhi Ty2
cuuugccuucuguuuuuug

SEQ ID NO: 1780290 - RNA, 15 nt, Salmonella enterica enterica serovar Typhi Ty2
cuuugcccucaaaga

SEQ ID NO: 1780291 - RNA, 18 nt, Salmonella enterica enterica serovar Typhi Ty2
cuuugcacguucugcugg

SEQ ID NO: 1780292 - RNA, 13 nt, Salmonella enterica enterica serovar Typhi Ty2
cuuugcaaucgac

SEQ ID NO: 1780293 - RNA, 20 nt, Salmonella enterica enterica serovar Typhi Ty2
cuuuaaugcccgguauuuuu

SEQ ID NO: 1780294 - RNA, 19 nt, Salmonella enterica enterica serovar Typhi Ty2
cuuuacugcgccagccugc

SEQ ID NO: 1780295 - RNA, 16 nt, Salmonella enterica enterica serovar Typhi Ty2
cuuuacugaaucucag

SEQ ID NO: 1780296 - RNA, 18 nt, Salmonella enterica enterica serovar Typhi Ty2
cuuuacgcuuguuguaaa

SEQ ID NO: 1780297 - RNA, 15 nt, Salmonella enterica enterica serovar Typhi Ty2
cuuuacgcagcaaga

SEQ ID NO: 1780298 - RNA, 23 nt, Salmonella enterica enterica serovar Typhi Ty2
cuuuaucgcgcagcagauuaaca

SEQ ID NO: 1780299 - RNA, 11 nt, Salmonella enterica enterica serovar Typhi Ty2
cuuuauugaug

SEQ ID NO: 1780300 - RNA, 15 nt, Salmonella enterica enterica serovar Typhi Ty2
cuuuauccggucugc

SEQ ID NO: 1780301 - RNA, 18 nt, Salmonella enterica enterica serovar Typhi Ty2
cuuuaggguaucauuucc

SEQ ID NO: 1780302 - RNA, 14 nt, Salmonella enterica enterica serovar Typhi Ty2
cuuuaggcaggaaa

SEQ ID NO: 1780303 - RNA, 20 nt, Salmonella enterica enterica serovar Typhi Ty2
cuuuaggcggcgccgcgccg

SEQ ID NO: 1780304 - RNA, 19 nt, Salmonella enterica enterica serovar Typhi Ty2
cuuuauuuuacaacuacuc

SEQ ID NO: 1780305 - RNA, 18 nt, Salmonella enterica enterica serovar Typhi Ty2
cuuucaauccuucuucug

SEQ ID NO: 1780306 - RNA, 22 nt, Salmonella enterica enterica serovar Typhi Ty2
cuuucacugucaugguuauuuu

SEQ ID NO: 1780307 - RNA, 13 nt, Salmonella enterica enterica serovar Typhi Ty2
cuuucagauuuuu

SEQ ID NO: 1780308 - RNA, 18 nt, Salmonella enterica enterica serovar Typhi Ty2
cuuucagagcccgggaga

SEQ ID NO: 1780309 - RNA, 18 nt, Salmonella enterica enterica serovar Typhi Ty2
cuugccgcuuccagucca

SEQ ID NO: 1780310 - RNA, 20 nt, Salmonella enterica enterica serovar Typhi Ty2
cuugcgaccacuccggcaua

SEQ ID NO: 1780311 - RNA, 13 nt, Salmonella enterica enterica serovar Typhi Ty2
cuugccgcgccag

SEQ ID NO: 1780312 - RNA, 18 nt, Salmonella enterica enterica serovar Typhi Ty2
cuugccgaguggaaucag

SEQ ID NO: 1780313 - RNA, 21 nt, Salmonella enterica enterica serovar Typhi Ty2
cuugccgcaucuucgcccggc

SEQ ID NO: 1780314 - RNA, 15 nt, Salmonella enterica enterica serovar Typhi Ty2
cuugcugcugcugau

SEQ ID NO: 1780315 - RNA, 20 nt, Salmonella enterica enterica serovar Typhi Ty2
cuugcuggccuguucaagug

SEQ ID NO: 1780316 - RNA, 23 nt, Salmonella enterica enterica serovar Typhi Ty2
cuugcuuaacagaauugcgccac

SEQ ID NO: 1780317 - RNA, 11 nt, Salmonella enterica enterica serovar Typhi Ty2
cuugcuuuauu

SEQ ID NO: 1780318 - RNA, 22 nt, Salmonella enterica enterica serovar Typhi Ty2
cuuggcagccccugaaauaaca

SEQ ID NO: 1780319 - RNA, 20 nt, Salmonella enterica enterica serovar Typhi Ty2
cuuguaggccugauagcaca

SEQ ID NO: 1780320 - RNA, 19 nt, Salmonella enterica enterica serovar Typhi Ty2
cuuggcguauagccgcccc

SEQ ID NO: 1780321 - RNA, 22 nt, Salmonella enterica enterica serovar Typhi Ty2
cuugguauggcgcuaacaccgc

SEQ ID NO: 1780322 - RNA, 23 nt, Salmonella enterica enterica serovar Typhi Ty2
cuugcauuuuacguagccgcaga

SEQ ID NO: 1780323 - RNA, 14 nt, Salmonella enterica enterica serovar Typhi Ty2
cuugccacuggccu

SEQ ID NO: 1780324 - RNA, 15 nt, Salmonella enterica enterica serovar Typhi Ty2
cuugcaauuuaucca

SEQ ID NO: 1780325 - RNA, 18 nt, Salmonella enterica enterica serovar Typhi Ty2
cuugccaugugccgcgaa

SEQ ID NO: 1780326 - RNA, 14 nt, Salmonella enterica enterica serovar Typhi Ty2
cuugcccagcgccu

SEQ ID NO: 1780327 - RNA, 18 nt, Salmonella enterica enterica serovar Typhi Ty2
cuugcccgcgccagaggc

SEQ ID NO: 1780328 - RNA, 17 nt, Salmonella enterica enterica serovar Typhi Ty2
cuugacuuugcucuccu

SEQ ID NO: 1780329 - RNA, 19 nt, Salmonella enterica enterica serovar Typhi Ty2
cuugaucggguuuuccuga

SEQ ID NO: 1780330 - RNA, 16 nt, Salmonella enterica enterica serovar Typhi Ty2
cuugaucgcgcagcaa

SEQ ID NO: 1780331 - RNA, 19 nt, Salmonella enterica enterica serovar Typhi Ty2
cuucuuuggugcgacgcca

SEQ ID NO: 1780332 - RNA, 15 nt, Salmonella enterica enterica serovar Typhi Ty2
cuucuuugcgauuug

SEQ ID NO: 1780333 - RNA, 19 nt, Salmonella enterica enterica serovar Typhi Ty2
cuucucaggcgagcccugu

SEQ ID NO: 1780334 - RNA, 18 nt, Salmonella enterica enterica serovar Typhi Ty2
cuugacgcuuugcauuau

SEQ ID NO: 1780335 - RNA, 22 nt, Salmonella enterica enterica serovar Typhi Ty2
cuugaagccuuucuguucuuug

SEQ ID NO: 1780336 - RNA, 19 nt, Salmonella enterica enterica serovar Typhi Ty2
cgcgaauaguggcgcgcca

SEQ ID NO: 1780337 - RNA, 20 nt, Salmonella enterica enterica serovar Typhi Ty2
cgcgaaucgacaauccgcca

SEQ ID NO: 1780338 - RNA, 15 nt, Salmonella enterica enterica serovar Typhi Ty2
cgcgaauaauuauuu

SEQ ID NO: 1780339 - RNA, 20 nt, Salmonella enterica enterica serovar Typhi Ty2
cgcgaauagccagacagccc

SEQ ID NO: 1780340 - RNA, 14 nt, Salmonella enterica enterica serovar Typhi Ty2
cgcgaagcggcgcu

SEQ ID NO: 1780341 - RNA, 19 nt, Salmonella enterica enterica serovar Typhi Ty2
cgcgaacauuacauccuca

SEQ ID NO: 1780342 - RNA, 18 nt, Salmonella enterica enterica serovar Typhi Ty2
cgcgaaaacagcuggcga

SEQ ID NO: 1780343 - RNA, 14 nt, Salmonella enterica enterica serovar Typhi Ty2
cgccuucuucaucu

SEQ ID NO: 1780344 - RNA, 22 nt, Salmonella enterica enterica serovar Typhi Ty2
cgccuucggcgucgugcugggc

SEQ ID NO: 1780345 - RNA, 15 nt, Salmonella enterica enterica serovar Typhi Ty2
cgccuuccacuuuca

SEQ ID NO: 1780346 - RNA, 12 nt, Salmonella enterica enterica serovar Typhi Ty2
cgccuuccaguu

SEQ ID NO: 1780347 - RNA, 21 nt, Salmonella enterica enterica serovar Typhi Ty2
cgccuucgauuaguccgucgg

SEQ ID NO: 1780348 - RNA, 20 nt, Salmonella enterica enterica serovar Typhi Ty2
cgccuucgcggugaucccag

SEQ ID NO: 1780349 - RNA, 15 nt, Salmonella enterica enterica serovar Typhi Ty2
cgccuuuucccccag

SEQ ID NO: 1780350 - RNA, 23 nt, Salmonella enterica enterica serovar Typhi Ty2
cgccuuuuuuaaauuugaccucg

SEQ ID NO: 1780351 - RNA, 15 nt, Salmonella enterica enterica serovar Typhi Ty2
cgccuugcggcggcg

SEQ ID NO: 1780352 - RNA, 14 nt, Salmonella enterica enterica serovar Typhi Ty2
cgccuugcccgcgc

SEQ ID NO: 1780353 - RNA, 15 nt, Salmonella enterica enterica serovar Typhi Ty2
cgccuuguccggccu

SEQ ID NO: 1780354 - RNA, 23 nt, Salmonella enterica enterica serovar Typhi Ty2
cgccuguaaugucuggugcagca

SEQ ID NO: 1780355 - RNA, 16 nt, Salmonella enterica enterica serovar Typhi Ty2
cgccuggcgguaugaa

SEQ ID NO: 1780356 - RNA, 14 nt, Salmonella enterica enterica serovar Typhi Ty2
cgccuuauucaggc

SEQ ID NO: 1780357 - RNA, 16 nt, Salmonella enterica enterica serovar Typhi Ty2
cgccuucagcgcgccc

SEQ ID NO: 1780358 - RNA, 14 nt, Salmonella enterica enterica serovar Typhi Ty2
cgccuguuaauggu

SEQ ID NO: 1780359 - RNA, 21 nt, Salmonella enterica enterica serovar Typhi Ty2
cgccugugguuuaaaacggug

SEQ ID NO: 1780360 - RNA, 15 nt, Salmonella enterica enterica serovar Typhi Ty2
cgccugucuccagcg

SEQ ID NO: 1780361 - RNA, 18 nt, Salmonella enterica enterica serovar Typhi Ty2
cgccuguuuacugacgcc

SEQ ID NO: 1780362 - RNA, 20 nt, Salmonella enterica enterica serovar Typhi Ty2
cgccugccauagcaucacca

SEQ ID NO: 1780363 - RNA, 20 nt, Salmonella enterica enterica serovar Typhi Ty2
cgccugccaacauggggagc

SEQ ID NO: 1780364 - RNA, 20 nt, Salmonella enterica enterica serovar Typhi Ty2
cgccugccgcgccgccgccu

SEQ ID NO: 1780365 - RNA, 16 nt, Salmonella enterica enterica serovar Typhi Ty2
cgccugcgccagcgcc

SEQ ID NO: 1780366 - RNA, 20 nt, Salmonella enterica enterica serovar Typhi Ty2
cgccugcugccagccgccgc

SEQ ID NO: 1780367 - RNA, 11 nt, Salmonella enterica enterica serovar Typhi Ty2
cgccugcugca

SEQ ID NO: 1780368 - RNA, 11 nt, Salmonella enterica enterica serovar Typhi Ty2
cgccugcugcg

SEQ ID NO: 1780369 - RNA, 17 nt, Salmonella enterica enterica serovar Typhi Ty2
cgccugcuguugggcag

SEQ ID NO: 1780370 - RNA, 21 nt, Salmonella enterica enterica serovar Typhi Ty2
cgccugcggaaucuccggcga

SEQ ID NO: 1780371 - RNA, 14 nt, Salmonella enterica enterica serovar Typhi Ty2
cgccugcgcgccug

SEQ ID NO: 1780372 - RNA, 22 nt, Salmonella enterica enterica serovar Typhi Ty2
cgccugcgcucauauacccugc

SEQ ID NO: 1780373 - RNA, 22 nt, Salmonella enterica enterica serovar Typhi Ty2
cgccguuuguuuauugccgcuu

SEQ ID NO: 1780374 - RNA, 23 nt, Salmonella enterica enterica serovar Typhi Ty2
cgccguuggcguaaaucaggcca

SEQ ID NO: 1780375 - RNA, 21 nt, Salmonella enterica enterica serovar Typhi Ty2
cgccuaucgccagcaggguca

SEQ ID NO: 1780376 - RNA, 14 nt, Salmonella enterica enterica serovar Typhi Ty2
cgccuaccgcuucc

SEQ ID NO: 1780377 - RNA, 21 nt, Salmonella enterica enterica serovar Typhi Ty2
cgccuaacagcgccgcgccga

SEQ ID NO: 1780378 - RNA, 22 nt, Salmonella enterica enterica serovar Typhi Ty2
cgccgucuucuucuucgcgcau

SEQ ID NO: 1780379 - RNA, 13 nt, Salmonella enterica enterica serovar Typhi Ty2
cgccgucgcgcuu

SEQ ID NO: 1780380 - RNA, 16 nt, Salmonella enterica enterica serovar Typhi Ty2
cgccgucggcaauaaa

SEQ ID NO: 1780381 - RNA, 16 nt, Salmonella enterica enterica serovar Typhi Ty2
cgccguuaccagcauc

SEQ ID NO: 1780382 - RNA, 16 nt, Salmonella enterica enterica serovar Typhi Ty2
cgccguuaaaccguua

SEQ ID NO: 1780383 - RNA, 17 nt, Salmonella enterica enterica serovar Typhi Ty2
cgccguguucuuaccca

SEQ ID NO: 1780384 - RNA, 21 nt, Salmonella enterica enterica serovar Typhi Ty2
cgccguguugugugccgcgcu

SEQ ID NO: 1780385 - RNA, 20 nt, Salmonella enterica enterica serovar Typhi Ty2
cgccguggcggugacuuccu

SEQ ID NO: 1780386 - RNA, 18 nt, Salmonella enterica enterica serovar Typhi Ty2
cgccgugucuggcgaacg

SEQ ID NO: 1780387 - RNA, 20 nt, Salmonella enterica enterica serovar Typhi Ty2
cgccucguaucugucccagc

SEQ ID NO: 1780388 - RNA, 21 nt, Salmonella enterica enterica serovar Typhi Ty2
cgccucguaucugucccagcc

SEQ ID NO: 1780389 - RNA, 21 nt, Salmonella enterica enterica serovar Typhi Ty2
cgccugaaaggcacgcuccug

SEQ ID NO: 1780390 - RNA, 24 nt, Salmonella enterica enterica serovar Typhi Ty2
cgccugacgcggacgccaccacag

SEQ ID NO: 1780391 - RNA, 17 nt, Salmonella enterica enterica serovar Typhi Ty2
cgccugaagauacgcca

SEQ ID NO: 1780392 - RNA, 20 nt, Salmonella enterica enterica serovar Typhi Ty2
cgccugaucguuacccgugc

SEQ ID NO: 1780393 - RNA, 14 nt, Salmonella enterica enterica serovar Typhi Ty2
cgccucccugccua

SEQ ID NO: 1780394 - RNA, 20 nt, Salmonella enterica enterica serovar Typhi Ty2
cgccuccguaugaccgccgc

SEQ ID NO: 1780395 - RNA, 16 nt, Salmonella enterica enterica serovar Typhi Ty2
cgccuccgacaacaag

SEQ ID NO: 1780396 - RNA, 18 nt, Salmonella enterica enterica serovar Typhi Ty2
cgccuccccugccggcgg

SEQ ID NO: 1780397 - RNA, 20 nt, Salmonella enterica enterica serovar Typhi Ty2
cgccucaucggcguugccca

SEQ ID NO: 1780398 - RNA, 19 nt, Salmonella enterica enterica serovar Typhi Ty2
cgccucgcgauccgccagc

SEQ ID NO: 1780399 - RNA, 18 nt, Salmonella enterica enterica serovar Typhi Ty2
cgccucgcgauccgccag

SEQ ID NO: 1780400 - RNA, 22 nt, Salmonella enterica enterica serovar Typhi Ty2
cgcgccaggucucauagcgccc

SEQ ID NO: 1780401 - RNA, 17 nt, Salmonella enterica enterica serovar Typhi Ty2
cgcgccauuugccagau

SEQ ID NO: 1780402 - RNA, 20 nt, Salmonella enterica enterica serovar Typhi Ty2
cgcgcccgccaccagcacag

SEQ ID NO: 1780403 - RNA, 14 nt, Salmonella enterica enterica serovar Typhi Ty2
cgcgcccgccgcca

SEQ ID NO: 1780404 - RNA, 14 nt, Salmonella enterica enterica serovar Typhi Ty2
cgcgcccgacgcgc

SEQ ID NO: 1780405 - RNA, 14 nt, Salmonella enterica enterica serovar Typhi Ty2
cgcgcccagcgccg

SEQ ID NO: 1780406 - RNA, 14 nt, Salmonella enterica enterica serovar Typhi Ty2
cgcgcccagcagca

SEQ ID NO: 1780407 - RNA, 16 nt, Salmonella enterica enterica serovar Typhi Ty2
cgcgcccuccuccagc

SEQ ID NO: 1780408 - RNA, 14 nt, Salmonella enterica enterica serovar Typhi Ty2
cgcgccgcaucuuc

SEQ ID NO: 1780409 - RNA, 15 nt, Salmonella enterica enterica serovar Typhi Ty2
cgcgccgccaacgau

SEQ ID NO: 1780410 - RNA, 22 nt, Salmonella enterica enterica serovar Typhi Ty2
cgcgccgccaacgccaacauag

SEQ ID NO: 1780411 - RNA, 13 nt, Salmonella enterica enterica serovar Typhi Ty2
cgcgccgccgccu

SEQ ID NO: 1780412 - RNA, 12 nt, Salmonella enterica enterica serovar Typhi Ty2
cgcgccgccucu

SEQ ID NO: 1780413 - RNA, 15 nt, Salmonella enterica enterica serovar Typhi Ty2
cgcgcagcugggccu

SEQ ID NO: 1780414 - RNA, 22 nt, Salmonella enterica enterica serovar Typhi Ty2
cgcgcagcaacaguugcuggag

SEQ ID NO: 1780415 - RNA, 13 nt, Salmonella enterica enterica serovar Typhi Ty2
cgcgcagcaggcc

SEQ ID NO: 1780416 - RNA, 21 nt, Salmonella enterica enterica serovar Typhi Ty2
cgcgcagagauagccagcgau

SEQ ID NO: 1780417 - RNA, 13 nt, Salmonella enterica enterica serovar Typhi Ty2
cgcgcacgcgcgc

SEQ ID NO: 1780418 - RNA, 14 nt, Salmonella enterica enterica serovar Typhi Ty2
cgcgcacgcgcgcg

SEQ ID NO: 1780419 - RNA, 19 nt, Salmonella enterica enterica serovar Typhi Ty2
cgcgccaauggccgccccc

SEQ ID NO: 1780420 - RNA, 18 nt, Salmonella enterica enterica serovar Typhi Ty2
cgcgccaauggccgcccc

SEQ ID NO: 1780421 - RNA, 20 nt, Salmonella enterica enterica serovar Typhi Ty2
cgcgccaaaagaggcagcaa

SEQ ID NO: 1780422 - RNA, 13 nt, Salmonella enterica enterica serovar Typhi Ty2
cgcgccacuucca

SEQ ID NO: 1780423 - RNA, 13 nt, Salmonella enterica enterica serovar Typhi Ty2
cgcgccacgccau

SEQ ID NO: 1780424 - RNA, 23 nt, Salmonella enterica enterica serovar Typhi Ty2
cgcgcaggucuucgucagcgcau

SEQ ID NO: 1780425 - RNA, 13 nt, Salmonella enterica enterica serovar Typhi Ty2
cgcgcagugcagc

SEQ ID NO: 1780426 - RNA, 18 nt, Salmonella enterica enterica serovar Typhi Ty2
cgcgcaguucaauauuca

SEQ ID NO: 1780427 - RNA, 18 nt, Salmonella enterica enterica serovar Typhi Ty2
cgcgcaguucauccacgc

SEQ ID NO: 1780428 - RNA, 11 nt, Salmonella enterica enterica serovar Typhi Ty2
cgcgcauggca

SEQ ID NO: 1780429 - RNA, 16 nt, Salmonella enterica enterica serovar Typhi Ty2
cgcgcauugaccagga

SEQ ID NO: 1780430 - RNA, 16 nt, Salmonella enterica enterica serovar Typhi Ty2
cgcgacgaugcgcauu

SEQ ID NO: 1780431 - RNA, 15 nt, Salmonella enterica enterica serovar Typhi Ty2
cgcgacgacgccagc

SEQ ID NO: 1780432 - RNA, 21 nt, Salmonella enterica enterica serovar Typhi Ty2
cgcgaccggaucaauaaacag

SEQ ID NO: 1780433 - RNA, 14 nt, Salmonella enterica enterica serovar Typhi Ty2
cgcgaccaguucac

SEQ ID NO: 1780434 - RNA, 19 nt, Salmonella enterica enterica serovar Typhi Ty2
cgcgacaaaaagcgcgccg

SEQ ID NO: 1780435 - RNA, 13 nt, Salmonella enterica enterica serovar Typhi Ty2
cgcgacagcgcgc

SEQ ID NO: 1780436 - RNA, 13 nt, Salmonella enterica enterica serovar Typhi Ty2
cgcgaccagcgcg

SEQ ID NO: 1780437 - RNA, 15 nt, Salmonella enterica enterica serovar Typhi Ty2
cgcgacauccgcuuu

SEQ ID NO: 1780438 - RNA, 20 nt, Salmonella enterica enterica serovar Typhi Ty2
cgcgacucccaggcgcgcag

SEQ ID NO: 1780439 - RNA, 19 nt, Salmonella enterica enterica serovar Typhi Ty2
cgcgagaaaauagaggaaa

SEQ ID NO: 1780440 - RNA, 19 nt, Salmonella enterica enterica serovar Typhi Ty2
cgcgacuuuggcuuuaucc

SEQ ID NO: 1780441 - RNA, 21 nt, Salmonella enterica enterica serovar Typhi Ty2
cgcgacggcagccucuuucag

SEQ ID NO: 1780442 - RNA, 21 nt, Salmonella enterica enterica serovar Typhi Ty2
cgcgacgggcggcgacagaga

SEQ ID NO: 1780443 - RNA, 14 nt, Salmonella enterica enterica serovar Typhi Ty2
cgcgagaacugcug

SEQ ID NO: 1780444 - RNA, 16 nt, Salmonella enterica enterica serovar Typhi Ty2
cgcgagaacugcugca

SEQ ID NO: 1780445 - RNA, 20 nt, Salmonella enterica enterica serovar Typhi Ty2
cgcgagaagaagaauuauua

SEQ ID NO: 1780446 - RNA, 24 nt, Salmonella enterica enterica serovar Typhi Ty2
cgcgagagucgccaggaucgccgc

SEQ ID NO: 1780447 - RNA, 23 nt, Salmonella enterica enterica serovar Typhi Ty2
cgcgaggcuuauaacccugucug

SEQ ID NO: 1780448 - RNA, 14 nt, Salmonella enterica enterica serovar Typhi Ty2
cgcgauccgccagc

SEQ ID NO: 1780449 - RNA, 17 nt, Salmonella enterica enterica serovar Typhi Ty2
cgcgaucgccccgacca

SEQ ID NO: 1780450 - RNA, 14 nt, Salmonella enterica enterica serovar Typhi Ty2
cgcgaugacggcgc

SEQ ID NO: 1780451 - RNA, 17 nt, Salmonella enterica enterica serovar Typhi Ty2
cgcgaucaaucacgccg

SEQ ID NO: 1780452 - RNA, 21 nt, Salmonella enterica enterica serovar Typhi Ty2
cgcgauaccgccguagaaaau

SEQ ID NO: 1780453 - RNA, 15 nt, Salmonella enterica enterica serovar Typhi Ty2
cgcgauacgcagcac

SEQ ID NO: 1780454 - RNA, 18 nt, Salmonella enterica enterica serovar Typhi Ty2
cgcgauacgcagcaccgc

SEQ ID NO: 1780455 - RNA, 21 nt, Salmonella enterica enterica serovar Typhi Ty2
cgcgauacacuccggcgcgcg

SEQ ID NO: 1780456 - RNA, 22 nt, Salmonella enterica enterica serovar Typhi Ty2
cgcgauacacuccggcgcgcgc

SEQ ID NO: 1780457 - RNA, 22 nt, Salmonella enterica enterica serovar Typhi Ty2
cgcgaguguaaagauuaauaau

SEQ ID NO: 1780458 - RNA, 23 nt, Salmonella enterica enterica serovar Typhi Ty2
cgcgauaauaauuaccacgcagc

SEQ ID NO: 1780459 - RNA, 22 nt, Salmonella enterica enterica serovar Typhi Ty2
cgcgcaccauaauauaaggauc

SEQ ID NO: 1780460 - RNA, 18 nt, Salmonella enterica enterica serovar Typhi Ty2
cgcgcacagggugaaauc

SEQ ID NO: 1780461 - RNA, 19 nt, Salmonella enterica enterica serovar Typhi Ty2
cgcgcaaucauuaccggac

SEQ ID NO: 1780462 - RNA, 23 nt, Salmonella enterica enterica serovar Typhi Ty2
cgcgcaaccgcaucacgcgaagc

SEQ ID NO: 1780463 - RNA, 15 nt, Salmonella enterica enterica serovar Typhi Ty2
cgcgauucgggccgc

SEQ ID NO: 1780464 - RNA, 11 nt, Salmonella enterica enterica serovar Typhi Ty2
cgcgaugcugc

SEQ ID NO: 1780465 - RNA, 23 nt, Salmonella enterica enterica serovar Typhi Ty2
cgcgauuuuuuuccgcccgccuu

SEQ ID NO: 1780466 - RNA, 18 nt, Salmonella enterica enterica serovar Typhi Ty2
cgcgauguuugcucgcca

SEQ ID NO: 1780467 - RNA, 14 nt, Salmonella enterica enterica serovar Typhi Ty2
cgccgggcggcgca

SEQ ID NO: 1780468 - RNA, 18 nt, Salmonella enterica enterica serovar Typhi Ty2
cgccggcugcgcugccag

SEQ ID NO: 1780469 - RNA, 14 nt, Salmonella enterica enterica serovar Typhi Ty2
cgccggccccgcuu

SEQ ID NO: 1780470 - RNA, 14 nt, Salmonella enterica enterica serovar Typhi Ty2
cgccgucauaaaac

SEQ ID NO: 1780471 - RNA, 17 nt, Salmonella enterica enterica serovar Typhi Ty2
cgccgucauaccgccca

SEQ ID NO: 1780472 - RNA, 19 nt, Salmonella enterica enterica serovar Typhi Ty2
cgccguccauuucaaugca

SEQ ID NO: 1780473 - RNA, 18 nt, Salmonella enterica enterica serovar Typhi Ty2
cgccgucacguucgguac

SEQ ID NO: 1780474 - RNA, 22 nt, Salmonella enterica enterica serovar Typhi Ty2
cgccguacuugacacaggcgug

SEQ ID NO: 1780475 - RNA, 17 nt, Salmonella enterica enterica serovar Typhi Ty2
cgccguacuccagccca

SEQ ID NO: 1780476 - RNA, 19 nt, Salmonella enterica enterica serovar Typhi Ty2
cgccguagcugcgcgccgc

SEQ ID NO: 1780477 - RNA, 22 nt, Salmonella enterica enterica serovar Typhi Ty2
cgccgguguuuccgucacuucc

SEQ ID NO: 1780478 - RNA, 16 nt, Salmonella enterica enterica serovar Typhi Ty2
cgccgguuccaacagc

SEQ ID NO: 1780479 - RNA, 23 nt, Salmonella enterica enterica serovar Typhi Ty2
cgccguacacguauaaacgccgc

SEQ ID NO: 1780480 - RNA, 14 nt, Salmonella enterica enterica serovar Typhi Ty2
cgccguaaggcgcc

SEQ ID NO: 1780481 - RNA, 19 nt, Salmonella enterica enterica serovar Typhi Ty2
cgccguaaggcguaccgcc

SEQ ID NO: 1780482 - RNA, 15 nt, Salmonella enterica enterica serovar Typhi Ty2
cgccggucgccagca

SEQ ID NO: 1780483 - RNA, 15 nt, Salmonella enterica enterica serovar Typhi Ty2
cgccggucaugccau

SEQ ID NO: 1780484 - RNA, 14 nt, Salmonella enterica enterica serovar Typhi Ty2
cgccggggcagcaa

SEQ ID NO: 1780485 - RNA, 16 nt, Salmonella enterica enterica serovar Typhi Ty2
cgccgguacgcagcag

SEQ ID NO: 1780486 - RNA, 16 nt, Salmonella enterica enterica serovar Typhi Ty2
cgccggagccgccugg

SEQ ID NO: 1780487 - RNA, 19 nt, Salmonella enterica enterica serovar Typhi Ty2
cgccggaucgggcuuccag

SEQ ID NO: 1780488 - RNA, 18 nt, Salmonella enterica enterica serovar Typhi Ty2
cgccggauuuaccagcgc

SEQ ID NO: 1780489 - RNA, 20 nt, Salmonella enterica enterica serovar Typhi Ty2
cgccggauuuaccagcgcuu

SEQ ID NO: 1780490 - RNA, 16 nt, Salmonella enterica enterica serovar Typhi Ty2
cgccgcuacugccgcc

SEQ ID NO: 1780491 - RNA, 17 nt, Salmonella enterica enterica serovar Typhi Ty2
cgccgcuauuaccccgc

SEQ ID NO: 1780492 - RNA, 15 nt, Salmonella enterica enterica serovar Typhi Ty2
cgccggaaauuugca

SEQ ID NO: 1780493 - RNA, 19 nt, Salmonella enterica enterica serovar Typhi Ty2
cgccggaaggcgaaaacau

SEQ ID NO: 1780494 - RNA, 17 nt, Salmonella enterica enterica serovar Typhi Ty2
cgccgcuuuuuccgccg

SEQ ID NO: 1780495 - RNA, 22 nt, Salmonella enterica enterica serovar Typhi Ty2
cgccgcuuuuuucagcggcagc

SEQ ID NO: 1780496 - RNA, 21 nt, Salmonella enterica enterica serovar Typhi Ty2
cgccgcguaaucuucgcggcu

SEQ ID NO: 1780497 - RNA, 16 nt, Salmonella enterica enterica serovar Typhi Ty2
cgccgcgcggccccau

SEQ ID NO: 1780498 - RNA, 17 nt, Salmonella enterica enterica serovar Typhi Ty2
cgccgcgaugcaucuug

SEQ ID NO: 1780499 - RNA, 20 nt, Salmonella enterica enterica serovar Typhi Ty2
cgccgcgaagcguuccgcca

SEQ ID NO: 1780500 - RNA, 13 nt, Salmonella enterica enterica serovar Typhi Ty2
cgccgccucuuca

SEQ ID NO: 1780501 - RNA, 21 nt, Salmonella enterica enterica serovar Typhi Ty2
cgccgccucgcgauccgccag

SEQ ID NO: 1780502 - RNA, 17 nt, Salmonella enterica enterica serovar Typhi Ty2
cgccgccuaucgccagc

SEQ ID NO: 1780503 - RNA, 15 nt, Salmonella enterica enterica serovar Typhi Ty2
cgccgccucccccuc

SEQ ID NO: 1780504 - RNA, 21 nt, Salmonella enterica enterica serovar Typhi Ty2
cgcccugcgucgcgcuuucaa

SEQ ID NO: 1780505 - RNA, 14 nt, Salmonella enterica enterica serovar Typhi Ty2
cgcccugcgguagc

SEQ ID NO: 1780506 - RNA, 14 nt, Salmonella enterica enterica serovar Typhi Ty2
cgcccugcgcgccu

SEQ ID NO: 1780507 - RNA, 15 nt, Salmonella enterica enterica serovar Typhi Ty2
cgcccugcggacagg

SEQ ID NO: 1780508 - RNA, 23 nt, Salmonella enterica enterica serovar Typhi Ty2
cgcccugaggaguauuauccauu

SEQ ID NO: 1780509 - RNA, 15 nt, Salmonella enterica enterica serovar Typhi Ty2
cgcccuuccgucagc

SEQ ID NO: 1780510 - RNA, 16 nt, Salmonella enterica enterica serovar Typhi Ty2
cgcccuucgucaggag

SEQ ID NO: 1780511 - RNA, 23 nt, Salmonella enterica enterica serovar Typhi Ty2
cgcccuguggaaacuccagcggc

SEQ ID NO: 1780512 - RNA, 21 nt, Salmonella enterica enterica serovar Typhi Ty2
cgcccuguauacaggcauggc

SEQ ID NO: 1780513 - RNA, 15 nt, Salmonella enterica enterica serovar Typhi Ty2
cgcccugucauuaag

SEQ ID NO: 1780514 - RNA, 15 nt, Salmonella enterica enterica serovar Typhi Ty2
cgcccuguaagaggc

SEQ ID NO: 1780515 - RNA, 14 nt, Salmonella enterica enterica serovar Typhi Ty2
cgcccugacgccgc

SEQ ID NO: 1780516 - RNA, 15 nt, Salmonella enterica enterica serovar Typhi Ty2
cgcccugacgccgcu

SEQ ID NO: 1780517 - RNA, 22 nt, Salmonella enterica enterica serovar Typhi Ty2
cgcccucaagacgguuauuuuu

SEQ ID NO: 1780518 - RNA, 18 nt, Salmonella enterica enterica serovar Typhi Ty2
cgcccguaccgcggcgcu

SEQ ID NO: 1780519 - RNA, 22 nt, Salmonella enterica enterica serovar Typhi Ty2
cgcccgguugcaauuccgccau

SEQ ID NO: 1780520 - RNA, 21 nt, Salmonella enterica enterica serovar Typhi Ty2
cgccgacauaagugcaggcug

SEQ ID NO: 1780521 - RNA, 15 nt, Salmonella enterica enterica serovar Typhi Ty2
cgccgacaccggccu

SEQ ID NO: 1780522 - RNA, 17 nt, Salmonella enterica enterica serovar Typhi Ty2
cgccgacauucccugcg

SEQ ID NO: 1780523 - RNA, 20 nt, Salmonella enterica enterica serovar Typhi Ty2
cgccgacauucccugcgcau

SEQ ID NO: 1780524 - RNA, 18 nt, Salmonella enterica enterica serovar Typhi Ty2
cgccgacaucgccaccgc

SEQ ID NO: 1780525 - RNA, 23 nt, Salmonella enterica enterica serovar Typhi Ty2
cgccgaccauuggcaccaccagg

SEQ ID NO: 1780526 - RNA, 15 nt, Salmonella enterica enterica serovar Typhi Ty2
cgccgaagccagcgc

SEQ ID NO: 1780527 - RNA, 22 nt, Salmonella enterica enterica serovar Typhi Ty2
cgccgaaggcaacgccgccagc

SEQ ID NO: 1780528 - RNA, 15 nt, Salmonella enterica enterica serovar Typhi Ty2
cgccgaagcggcagu

SEQ ID NO: 1780529 - RNA, 19 nt, Salmonella enterica enterica serovar Typhi Ty2
cgccgaacaacacggcggc

SEQ ID NO: 1780530 - RNA, 13 nt, Salmonella enterica enterica serovar Typhi Ty2
cgccgaacacgca

SEQ ID NO: 1780531 - RNA, 13 nt, Salmonella enterica enterica serovar Typhi Ty2
cgccgagccgccc

SEQ ID NO: 1780532 - RNA, 15 nt, Salmonella enterica enterica serovar Typhi Ty2
cgccgagccgcccuu

SEQ ID NO: 1780533 - RNA, 13 nt, Salmonella enterica enterica serovar Typhi Ty2
cgccgagcgccgu

SEQ ID NO: 1780534 - RNA, 16 nt, Salmonella enterica enterica serovar Typhi Ty2
cgccgacucacgcagc

SEQ ID NO: 1780535 - RNA, 14 nt, Salmonella enterica enterica serovar Typhi Ty2
cgccgacucacgca

SEQ ID NO: 1780536 - RNA, 22 nt, Salmonella enterica enterica serovar Typhi Ty2
cgccgccagaaucaccucuuuc

SEQ ID NO: 1780537 - RNA, 20 nt, Salmonella enterica enterica serovar Typhi Ty2
cgccgccagauagccgcgcu

SEQ ID NO: 1780538 - RNA, 21 nt, Salmonella enterica enterica serovar Typhi Ty2
cgccgccaccauguugcgcag

SEQ ID NO: 1780539 - RNA, 14 nt, Salmonella enterica enterica serovar Typhi Ty2
cgccgccaucggcg

SEQ ID NO: 1780540 - RNA, 13 nt, Salmonella enterica enterica serovar Typhi Ty2
cgccgccaggucu

SEQ ID NO: 1780541 - RNA, 14 nt, Salmonella enterica enterica serovar Typhi Ty2
cgccgccaggucuu

SEQ ID NO: 1780542 - RNA, 15 nt, Salmonella enterica enterica serovar Typhi Ty2
cgccgccgaacagac

SEQ ID NO: 1780543 - RNA, 13 nt, Salmonella enterica enterica serovar Typhi Ty2
cgccgccgggccg

SEQ ID NO: 1780544 - RNA, 13 nt, Salmonella enterica enterica serovar Typhi Ty2
cgccgccggcgag

SEQ ID NO: 1780545 - RNA, 13 nt, Salmonella enterica enterica serovar Typhi Ty2
cgccgccgccaga

SEQ ID NO: 1780546 - RNA, 15 nt, Salmonella enterica enterica serovar Typhi Ty2
cgccgccgccaacgc

SEQ ID NO: 1780547 - RNA, 14 nt, Salmonella enterica enterica serovar Typhi Ty2
cgccgccgcguccu

SEQ ID NO: 1780548 - RNA, 16 nt, Salmonella enterica enterica serovar Typhi Ty2
cgccgcagcuccaugu

SEQ ID NO: 1780549 - RNA, 17 nt, Salmonella enterica enterica serovar Typhi Ty2
cgccgcaaugccgccug

SEQ ID NO: 1780550 - RNA, 15 nt, Salmonella enterica enterica serovar Typhi Ty2
cgccgcaacgcgcac

SEQ ID NO: 1780551 - RNA, 22 nt, Salmonella enterica enterica serovar Typhi Ty2
cgccgcaauuccugacugcgcg

SEQ ID NO: 1780552 - RNA, 17 nt, Salmonella enterica enterica serovar Typhi Ty2
cgccgcacacagcagaa

SEQ ID NO: 1780553 - RNA, 22 nt, Salmonella enterica enterica serovar Typhi Ty2
cgccgauugagggggaggcggc

SEQ ID NO: 1780554 - RNA, 21 nt, Salmonella enterica enterica serovar Typhi Ty2
cgccgauuaaugcuccaauaa

SEQ ID NO: 1780555 - RNA, 15 nt, Salmonella enterica enterica serovar Typhi Ty2
cgccgcaggguauau

SEQ ID NO: 1780556 - RNA, 20 nt, Salmonella enterica enterica serovar Typhi Ty2
cgccgcaucuuuugccgcgg

SEQ ID NO: 1780557 - RNA, 21 nt, Salmonella enterica enterica serovar Typhi Ty2
cgccgccaaacugcgcgccgc

SEQ ID NO: 1780558 - RNA, 18 nt, Salmonella enterica enterica serovar Typhi Ty2
cgccgaggcuaagccaga

SEQ ID NO: 1780559 - RNA, 19 nt, Salmonella enterica enterica serovar Typhi Ty2
cgccgaggcuaagccagaa

SEQ ID NO: 1780560 - RNA, 19 nt, Salmonella enterica enterica serovar Typhi Ty2
cgccgagugcuugcauuuu

SEQ ID NO: 1780561 - RNA, 21 nt, Salmonella enterica enterica serovar Typhi Ty2
cgccgauaaccagcgcgccgc

SEQ ID NO: 1780562 - RNA, 16 nt, Salmonella enterica enterica serovar Typhi Ty2
cgccgaguaauuugaa

SEQ ID NO: 1780563 - RNA, 15 nt, Salmonella enterica enterica serovar Typhi Ty2
cgccgaucagcacca

SEQ ID NO: 1780564 - RNA, 23 nt, Salmonella enterica enterica serovar Typhi Ty2
cgccgaucaucccgcccagcaac

SEQ ID NO: 1780565 - RNA, 13 nt, Salmonella enterica enterica serovar Typhi Ty2
cgccagcgccgga

SEQ ID NO: 1780566 - RNA, 16 nt, Salmonella enterica enterica serovar Typhi Ty2
cgccagcgccagcagc

SEQ ID NO: 1780567 - RNA, 15 nt, Salmonella enterica enterica serovar Typhi Ty2
cgccagcgagaugaa

SEQ ID NO: 1780568 - RNA, 14 nt, Salmonella enterica enterica serovar Typhi Ty2
cgccagcgccaccu

SEQ ID NO: 1780569 - RNA, 16 nt, Salmonella enterica enterica serovar Typhi Ty2
cgccagcgccaccugc

SEQ ID NO: 1780570 - RNA, 15 nt, Salmonella enterica enterica serovar Typhi Ty2
cgccagcgccucuuc

SEQ ID NO: 1780571 - RNA, 15 nt, Salmonella enterica enterica serovar Typhi Ty2
cgccagcgcgguggc

SEQ ID NO: 1780572 - RNA, 21 nt, Salmonella enterica enterica serovar Typhi Ty2
cgccagcggcgccaucaccau

SEQ ID NO: 1780573 - RNA, 19 nt, Salmonella enterica enterica serovar Typhi Ty2
cgccagcggcgacaguaac

SEQ ID NO: 1780574 - RNA, 20 nt, Salmonella enterica enterica serovar Typhi Ty2
cgccagcgcuacccgcugac

SEQ ID NO: 1780575 - RNA, 14 nt, Salmonella enterica enterica serovar Typhi Ty2
cgccagcggcugcu

SEQ ID NO: 1780576 - RNA, 18 nt, Salmonella enterica enterica serovar Typhi Ty2
cgccagcgugcuuaaucc

SEQ ID NO: 1780577 - RNA, 21 nt, Salmonella enterica enterica serovar Typhi Ty2
cgccaggaaccgcggucggca

SEQ ID NO: 1780578 - RNA, 20 nt, Salmonella enterica enterica serovar Typhi Ty2
cgccaggaucgccgccgcga

SEQ ID NO: 1780579 - RNA, 12 nt, Salmonella enterica enterica serovar Typhi Ty2
cgccagcucugc

SEQ ID NO: 1780580 - RNA, 13 nt, Salmonella enterica enterica serovar Typhi Ty2
cgccagcucaugc

SEQ ID NO: 1780581 - RNA, 21 nt, Salmonella enterica enterica serovar Typhi Ty2
cgccagcucaugcgcggcggg

SEQ ID NO: 1780582 - RNA, 15 nt, Salmonella enterica enterica serovar Typhi Ty2
cgccaggccauugcu

SEQ ID NO: 1780583 - RNA, 11 nt, Salmonella enterica enterica serovar Typhi Ty2
cgccaggccau

SEQ ID NO: 1780584 - RNA, 16 nt, Salmonella enterica enterica serovar Typhi Ty2
cgccaguuauucgacu

SEQ ID NO: 1780585 - RNA, 22 nt, Salmonella enterica enterica serovar Typhi Ty2
cgccaguucauucgccaccagg

SEQ ID NO: 1780586 - RNA, 14 nt, Salmonella enterica enterica serovar Typhi Ty2
cgccagugcgcaua

SEQ ID NO: 1780587 - RNA, 17 nt, Salmonella enterica enterica serovar Typhi Ty2
cgccaguuucuuuuucc

SEQ ID NO: 1780588 - RNA, 22 nt, Salmonella enterica enterica serovar Typhi Ty2
cgccauaaaaagcguacaaaaa

SEQ ID NO: 1780589 - RNA, 19 nt, Salmonella enterica enterica serovar Typhi Ty2
cgccaguuugguuaauucc

SEQ ID NO: 1780590 - RNA, 17 nt, Salmonella enterica enterica serovar Typhi Ty2
cgccaucaccaggucaa

SEQ ID NO: 1780591 - RNA, 15 nt, Salmonella enterica enterica serovar Typhi Ty2
cgccauauccgcaga

SEQ ID NO: 1780592 - RNA, 13 nt, Salmonella enterica enterica serovar Typhi Ty2
cgccauaucggca

SEQ ID NO: 1780593 - RNA, 18 nt, Salmonella enterica enterica serovar Typhi Ty2
cgccaucaacuccuccgg

SEQ ID NO: 1780594 - RNA, 23 nt, Salmonella enterica enterica serovar Typhi Ty2
cgccauauauuuacugaauaaau

SEQ ID NO: 1780595 - RNA, 15 nt, Salmonella enterica enterica serovar Typhi Ty2
cgccauauccaagcc

SEQ ID NO: 1780596 - RNA, 14 nt, Salmonella enterica enterica serovar Typhi Ty2
cgccauauacgcca

SEQ ID NO: 1780597 - RNA, 23 nt, Salmonella enterica enterica serovar Typhi Ty2
cgccauaauacuuaauucauaac

SEQ ID NO: 1780598 - RNA, 14 nt, Salmonella enterica enterica serovar Typhi Ty2
cgccauaacacaaa

SEQ ID NO: 1780599 - RNA, 16 nt, Salmonella enterica enterica serovar Typhi Ty2
cgccagggcuucugcu

SEQ ID NO: 1780600 - RNA, 22 nt, Salmonella enterica enterica serovar Typhi Ty2
cgccagggcgggauccccugcu

SEQ ID NO: 1780601 - RNA, 16 nt, Salmonella enterica enterica serovar Typhi Ty2
cgccagugaauccacc

SEQ ID NO: 1780602 - RNA, 11 nt, Salmonella enterica enterica serovar Typhi Ty2
cgccagugaca

SEQ ID NO: 1780603 - RNA, 17 nt, Salmonella enterica enterica serovar Typhi Ty2
cgccagugaugccaaac

SEQ ID NO: 1780604 - RNA, 15 nt, Salmonella enterica enterica serovar Typhi Ty2
cgccagucccagcac

SEQ ID NO: 1780605 - RNA, 23 nt, Salmonella enterica enterica serovar Typhi Ty2
cgccaguaauuuuucucccagca

SEQ ID NO: 1780606 - RNA, 19 nt, Salmonella enterica enterica serovar Typhi Ty2
cgccaguaggaauauacca

SEQ ID NO: 1780607 - RNA, 22 nt, Salmonella enterica enterica serovar Typhi Ty2
cgccaccacagucaucgcgcca

SEQ ID NO: 1780608 - RNA, 21 nt, Salmonella enterica enterica serovar Typhi Ty2
cgccaccaucgucgccagacc

SEQ ID NO: 1780609 - RNA, 22 nt, Salmonella enterica enterica serovar Typhi Ty2
cgccaccgggcaacacacgcuu

SEQ ID NO: 1780610 - RNA, 19 nt, Salmonella enterica enterica serovar Typhi Ty2
cgccaccgggcaacacacg

SEQ ID NO: 1780611 - RNA, 14 nt, Salmonella enterica enterica serovar Typhi Ty2
cgccacccaacauc

SEQ ID NO: 1780612 - RNA, 14 nt, Salmonella enterica enterica serovar Typhi Ty2
cgccaccgcgcgcu

SEQ ID NO: 1780613 - RNA, 22 nt, Salmonella enterica enterica serovar Typhi Ty2
cgccaccugaauaacccgcagc

SEQ ID NO: 1780614 - RNA, 22 nt, Salmonella enterica enterica serovar Typhi Ty2
cgccaccgggccgucagggucu

SEQ ID NO: 1780615 - RNA, 20 nt, Salmonella enterica enterica serovar Typhi Ty2
cgccaccggguuaaagcccu

SEQ ID NO: 1780616 - RNA, 12 nt, Salmonella enterica enterica serovar Typhi Ty2
cgccaccaaaaa

SEQ ID NO: 1780617 - RNA, 14 nt, Salmonella enterica enterica serovar Typhi Ty2
cgccacauucaauu

SEQ ID NO: 1780618 - RNA, 12 nt, Salmonella enterica enterica serovar Typhi Ty2
cgccaccacaaa

SEQ ID NO: 1780619 - RNA, 22 nt, Salmonella enterica enterica serovar Typhi Ty2
cgccacagcggaauagacggcc

SEQ ID NO: 1780620 - RNA, 17 nt, Salmonella enterica enterica serovar Typhi Ty2
cgccacaccgagacaga

SEQ ID NO: 1780621 - RNA, 18 nt, Salmonella enterica enterica serovar Typhi Ty2
cgccacaauauccgcccc

SEQ ID NO: 1780622 - RNA, 22 nt, Salmonella enterica enterica serovar Typhi Ty2
cgcauacaucgcagacauggca

SEQ ID NO: 1780623 - RNA, 16 nt, Salmonella enterica enterica serovar Typhi Ty2
cgccaauuaaauaucc

SEQ ID NO: 1780624 - RNA, 15 nt, Salmonella enterica enterica serovar Typhi Ty2
cgccaauugaugaac

SEQ ID NO: 1780625 - RNA, 15 nt, Salmonella enterica enterica serovar Typhi Ty2
cgccaaucuguaauu

SEQ ID NO: 1780626 - RNA, 20 nt, Salmonella enterica enterica serovar Typhi Ty2
cgccacaauauccgccccgc

SEQ ID NO: 1780627 - RNA, 22 nt, Salmonella enterica enterica serovar Typhi Ty2
cgccacaauauccgccccgcug

SEQ ID NO: 1780628 - RNA, 14 nt, Salmonella enterica enterica serovar Typhi Ty2
cgccacaauauccg

SEQ ID NO: 1780629 - RNA, 15 nt, Salmonella enterica enterica serovar Typhi Ty2
cgccagcaccagcag

SEQ ID NO: 1780630 - RNA, 21 nt, Salmonella enterica enterica serovar Typhi Ty2
cgccacgauagacagcaccau

SEQ ID NO: 1780631 - RNA, 14 nt, Salmonella enterica enterica serovar Typhi Ty2
cgccagccgcgcca

SEQ ID NO: 1780632 - RNA, 15 nt, Salmonella enterica enterica serovar Typhi Ty2
cgccagccgcgccau

SEQ ID NO: 1780633 - RNA, 21 nt, Salmonella enterica enterica serovar Typhi Ty2
cgccagccacaagagcagcaa

SEQ ID NO: 1780634 - RNA, 19 nt, Salmonella enterica enterica serovar Typhi Ty2
cgccagccgcgccaucucc

SEQ ID NO: 1780635 - RNA, 17 nt, Salmonella enterica enterica serovar Typhi Ty2
cgccagcauaccgccca

SEQ ID NO: 1780636 - RNA, 14 nt, Salmonella enterica enterica serovar Typhi Ty2
cgccagcauuucaa

SEQ ID NO: 1780637 - RNA, 20 nt, Salmonella enterica enterica serovar Typhi Ty2
cgccagcaucggcagcgcca

SEQ ID NO: 1780638 - RNA, 15 nt, Salmonella enterica enterica serovar Typhi Ty2
cgccagccacugacu

SEQ ID NO: 1780639 - RNA, 21 nt, Salmonella enterica enterica serovar Typhi Ty2
cgccagccagcgccaccaaag

SEQ ID NO: 1780640 - RNA, 17 nt, Salmonella enterica enterica serovar Typhi Ty2
cgccagccagucgccag

SEQ ID NO: 1780641 - RNA, 15 nt, Salmonella enterica enterica serovar Typhi Ty2
cgcccaucccgaugg

SEQ ID NO: 1780642 - RNA, 13 nt, Salmonella enterica enterica serovar Typhi Ty2
cgcccauccagag

SEQ ID NO: 1780643 - RNA, 14 nt, Salmonella enterica enterica serovar Typhi Ty2
cgcccaucgccaca

SEQ ID NO: 1780644 - RNA, 14 nt, Salmonella enterica enterica serovar Typhi Ty2
cgcccaucgccuga

SEQ ID NO: 1780645 - RNA, 15 nt, Salmonella enterica enterica serovar Typhi Ty2
cgcccaugcggcuga

SEQ ID NO: 1780646 - RNA, 20 nt, Salmonella enterica enterica serovar Typhi Ty2
cgcccauggaugcgccgccc

SEQ ID NO: 1780647 - RNA, 19 nt, Salmonella enterica enterica serovar Typhi Ty2
cgcccagucaucauaauuc

SEQ ID NO: 1780648 - RNA, 16 nt, Salmonella enterica enterica serovar Typhi Ty2
cgcccaucaacaccag

SEQ ID NO: 1780649 - RNA, 13 nt, Salmonella enterica enterica serovar Typhi Ty2
cgcccaggccuga

SEQ ID NO: 1780650 - RNA, 14 nt, Salmonella enterica enterica serovar Typhi Ty2
cgcccaggcgggua

SEQ ID NO: 1780651 - RNA, 12 nt, Salmonella enterica enterica serovar Typhi Ty2
cgcccagcgccg

SEQ ID NO: 1780652 - RNA, 16 nt, Salmonella enterica enterica serovar Typhi Ty2
cgcccacgcggcgugc

SEQ ID NO: 1780653 - RNA, 14 nt, Salmonella enterica enterica serovar Typhi Ty2
cgcccacgcggcgu

SEQ ID NO: 1780654 - RNA, 22 nt, Salmonella enterica enterica serovar Typhi Ty2
cgcccacaucuguuugagaaaa

SEQ ID NO: 1780655 - RNA, 21 nt, Salmonella enterica enterica serovar Typhi Ty2
cgcccaccgccaaccgcccgu

SEQ ID NO: 1780656 - RNA, 16 nt, Salmonella enterica enterica serovar Typhi Ty2
cgcccagaucgaccuc

SEQ ID NO: 1780657 - RNA, 17 nt, Salmonella enterica enterica serovar Typhi Ty2
cgcccagcacuaacagc

SEQ ID NO: 1780658 - RNA, 11 nt, Salmonella enterica enterica serovar Typhi Ty2
cgcccagcagc

SEQ ID NO: 1780659 - RNA, 14 nt, Salmonella enterica enterica serovar Typhi Ty2
cgcccagccaaagc

SEQ ID NO: 1780660 - RNA, 15 nt, Salmonella enterica enterica serovar Typhi Ty2
cgccauggccgcagc

SEQ ID NO: 1780661 - RNA, 18 nt, Salmonella enterica enterica serovar Typhi Ty2
cgccauuccugccgccgc

SEQ ID NO: 1780662 - RNA, 18 nt, Salmonella enterica enterica serovar Typhi Ty2
cgccauucucuucuacca

SEQ ID NO: 1780663 - RNA, 22 nt, Salmonella enterica enterica serovar Typhi Ty2
cgcccacaggcugcggcacgcu

SEQ ID NO: 1780664 - RNA, 17 nt, Salmonella enterica enterica serovar Typhi Ty2
cgcccacaaugacagaa

SEQ ID NO: 1780665 - RNA, 18 nt, Salmonella enterica enterica serovar Typhi Ty2
cgcccaaccagcccaggu

SEQ ID NO: 1780666 - RNA, 13 nt, Salmonella enterica enterica serovar Typhi Ty2
cgccauuuccagc

SEQ ID NO: 1780667 - RNA, 16 nt, Salmonella enterica enterica serovar Typhi Ty2
cgccaucuucacgcag

SEQ ID NO: 1780668 - RNA, 16 nt, Salmonella enterica enterica serovar Typhi Ty2
cgccaucuuucaccca

SEQ ID NO: 1780669 - RNA, 18 nt, Salmonella enterica enterica serovar Typhi Ty2
cgccaugauucaucccgc

SEQ ID NO: 1780670 - RNA, 19 nt, Salmonella enterica enterica serovar Typhi Ty2
cgccaucgccgccucgcgu

SEQ ID NO: 1780671 - RNA, 17 nt, Salmonella enterica enterica serovar Typhi Ty2
cgccaucggcgagcggc

SEQ ID NO: 1780672 - RNA, 14 nt, Salmonella enterica enterica serovar Typhi Ty2
cgccaucgcggcgc

SEQ ID NO: 1780673 - RNA, 14 nt, Salmonella enterica enterica serovar Typhi Ty2
cgccaucgccgccu

SEQ ID NO: 1780674 - RNA, 17 nt, Salmonella enterica enterica serovar Typhi Ty2
cgccaucgccgccucgc

SEQ ID NO: 1780675 - RNA, 23 nt, Salmonella enterica enterica serovar Typhi Ty2
cgccaucaguucggcgcgccagc

SEQ ID NO: 1780676 - RNA, 18 nt, Salmonella enterica enterica serovar Typhi Ty2
cgccaucaggcauggcag

SEQ ID NO: 1780677 - RNA, 22 nt, Salmonella enterica enterica serovar Typhi Ty2
cgccaucaggcaauucggcccu

SEQ ID NO: 1780678 - RNA, 12 nt, Salmonella enterica enterica serovar Typhi Ty2
cgccauccacgg

SEQ ID NO: 1780679 - RNA, 21 nt, Salmonella enterica enterica serovar Typhi Ty2
cgccaucaugcccacaggcag

SEQ ID NO: 1780680 - RNA, 15 nt, Salmonella enterica enterica serovar Typhi Ty2
cgccaucaggcaugc

SEQ ID NO: 1780681 - RNA, 20 nt, Salmonella enterica enterica serovar Typhi Ty2
cgccaucaggcaugccaaac

SEQ ID NO: 1780682 - RNA, 17 nt, Salmonella enterica enterica serovar Typhi Ty2
cgccaucaggcauaaac

SEQ ID NO: 1780683 - RNA, 14 nt, Salmonella enterica enterica serovar Typhi Ty2
cgccaucaggcaug

SEQ ID NO: 1780684 - RNA, 22 nt, Salmonella enterica enterica serovar Typhi Ty2
cgccauccgguaaacgugcugg

SEQ ID NO: 1780685 - RNA, 23 nt, Salmonella enterica enterica serovar Typhi Ty2
cgccauccggccuguaaggucuc

SEQ ID NO: 1780686 - RNA, 13 nt, Salmonella enterica enterica serovar Typhi Ty2
cgccauccggccu

SEQ ID NO: 1780687 - RNA, 15 nt, Salmonella enterica enterica serovar Typhi Ty2
cgccauccugcaccg

SEQ ID NO: 1780688 - RNA, 23 nt, Salmonella enterica enterica serovar Typhi Ty2
cgccauccuuaauugccgcacgc

SEQ ID NO: 1780689 - RNA, 19 nt, Salmonella enterica enterica serovar Typhi Ty2
cgccauccggcacggucaa

SEQ ID NO: 1780690 - RNA, 11 nt, Salmonella enterica enterica serovar Typhi Ty2
cgcccgccaga

SEQ ID NO: 1780691 - RNA, 14 nt, Salmonella enterica enterica serovar Typhi Ty2
cgcccgcaaaagcg

SEQ ID NO: 1780692 - RNA, 13 nt, Salmonella enterica enterica serovar Typhi Ty2
cgcccgccgcgaa

SEQ ID NO: 1780693 - RNA, 13 nt, Salmonella enterica enterica serovar Typhi Ty2
cgcccgccgccug

SEQ ID NO: 1780694 - RNA, 14 nt, Salmonella enterica enterica serovar Typhi Ty2
cgcccgccgccagc

SEQ ID NO: 1780695 - RNA, 12 nt, Salmonella enterica enterica serovar Typhi Ty2
cgcccgcggcga

SEQ ID NO: 1780696 - RNA, 16 nt, Salmonella enterica enterica serovar Typhi Ty2
cgcccgccucgcugau

SEQ ID NO: 1780697 - RNA, 23 nt, Salmonella enterica enterica serovar Typhi Ty2
cgcccgcgauaaaaauccugcuc

SEQ ID NO: 1780698 - RNA, 17 nt, Salmonella enterica enterica serovar Typhi Ty2
cgcccggaucacggccu

SEQ ID NO: 1780699 - RNA, 23 nt, Salmonella enterica enterica serovar Typhi Ty2
cgcccggagggguuuucgccagc

SEQ ID NO: 1780700 - RNA, 15 nt, Salmonella enterica enterica serovar Typhi Ty2
cgcccgcucagggag

SEQ ID NO: 1780701 - RNA, 11 nt, Salmonella enterica enterica serovar Typhi Ty2
cgcccgcuuca

SEQ ID NO: 1780702 - RNA, 21 nt, Salmonella enterica enterica serovar Typhi Ty2
cgccccggcgagugccugcug

SEQ ID NO: 1780703 - RNA, 22 nt, Salmonella enterica enterica serovar Typhi Ty2
cgcccgauaauaucacucccgc

SEQ ID NO: 1780704 - RNA, 15 nt, Salmonella enterica enterica serovar Typhi Ty2
cgcccgaccacgccc

SEQ ID NO: 1780705 - RNA, 13 nt, Salmonella enterica enterica serovar Typhi Ty2
cgcccccugccag

SEQ ID NO: 1780706 - RNA, 13 nt, Salmonella enterica enterica serovar Typhi Ty2
cgcccccuccagu

SEQ ID NO: 1780707 - RNA, 12 nt, Salmonella enterica enterica serovar Typhi Ty2
cgcccccugcca

SEQ ID NO: 1780708 - RNA, 22 nt, Salmonella enterica enterica serovar Typhi Ty2
cgccccaguaacgugccccaga

SEQ ID NO: 1780709 - RNA, 22 nt, Salmonella enterica enterica serovar Typhi Ty2
cgcccccaugccgccugccgcg

SEQ ID NO: 1780710 - RNA, 12 nt, Salmonella enterica enterica serovar Typhi Ty2
cgccccaaagcg

SEQ ID NO: 1780711 - RNA, 16 nt, Salmonella enterica enterica serovar Typhi Ty2
cgccccaaucgccagu

SEQ ID NO: 1780712 - RNA, 16 nt, Salmonella enterica enterica serovar Typhi Ty2
cgcccauuccgccugc

SEQ ID NO: 1780713 - RNA, 17 nt, Salmonella enterica enterica serovar Typhi Ty2
cgcccauuccgccugcc

SEQ ID NO: 1780714 - RNA, 21 nt, Salmonella enterica enterica serovar Typhi Ty2
cgcccauuagcauuccgcccg

SEQ ID NO: 1780715 - RNA, 20 nt, Salmonella enterica enterica serovar Typhi Ty2
cgcccauuaauaucagcccc

SEQ ID NO: 1780716 - RNA, 22 nt, Salmonella enterica enterica serovar Typhi Ty2
cgccccagaagagcgagucuuu

SEQ ID NO: 1780717 - RNA, 21 nt, Salmonella enterica enterica serovar Typhi Ty2
cgccccagcaugagccagccc

SEQ ID NO: 1780718 - RNA, 12 nt, Salmonella enterica enterica serovar Typhi Ty2
cgccccacuggc

SEQ ID NO: 1780719 - RNA, 21 nt, Salmonella enterica enterica serovar Typhi Ty2
cgauacuaaaacuuuaacacu

SEQ ID NO: 1780720 - RNA, 22 nt, Salmonella enterica enterica serovar Typhi Ty2
cgauacuccauugucggcagcg

SEQ ID NO: 1780721 - RNA, 13 nt, Salmonella enterica enterica serovar Typhi Ty2
cgauacuaaaacu

SEQ ID NO: 1780722 - RNA, 18 nt, Salmonella enterica enterica serovar Typhi Ty2
cgauagacguugagcuca

SEQ ID NO: 1780723 - RNA, 20 nt, Salmonella enterica enterica serovar Typhi Ty2
cgauauaccacccgcuauga

SEQ ID NO: 1780724 - RNA, 23 nt, Salmonella enterica enterica serovar Typhi Ty2
cgauauaccacccgcuaugaaga

SEQ ID NO: 1780725 - RNA, 19 nt, Salmonella enterica enterica serovar Typhi Ty2
cgauauaucgcgucaucaa

SEQ ID NO: 1780726 - RNA, 17 nt, Salmonella enterica enterica serovar Typhi Ty2
cgauauagcgcugaagu

SEQ ID NO: 1780727 - RNA, 19 nt, Salmonella enterica enterica serovar Typhi Ty2
cgauauaauuuuauuauau

SEQ ID NO: 1780728 - RNA, 16 nt, Salmonella enterica enterica serovar Typhi Ty2
cgauagagaguuccuc

SEQ ID NO: 1780729 - RNA, 19 nt, Salmonella enterica enterica serovar Typhi Ty2
cgauaaccuguaaauaaua

SEQ ID NO: 1780730 - RNA, 18 nt, Salmonella enterica enterica serovar Typhi Ty2
cgauaaccucucaccgcc

SEQ ID NO: 1780731 - RNA, 14 nt, Salmonella enterica enterica serovar Typhi Ty2
cgauaaccuguaaa

SEQ ID NO: 1780732 - RNA, 14 nt, Salmonella enterica enterica serovar Typhi Ty2
cgauaaccaccagc

SEQ ID NO: 1780733 - RNA, 22 nt, Salmonella enterica enterica serovar Typhi Ty2
cgauaaccggacgauuuaagcu

SEQ ID NO: 1780734 - RNA, 17 nt, Salmonella enterica enterica serovar Typhi Ty2
cgauaaccucucaccgc

SEQ ID NO: 1780735 - RNA, 13 nt, Salmonella enterica enterica serovar Typhi Ty2
cgauaaauccucc

SEQ ID NO: 1780736 - RNA, 14 nt, Salmonella enterica enterica serovar Typhi Ty2
cgauaacgcagcgc

SEQ ID NO: 1780737 - RNA, 17 nt, Salmonella enterica enterica serovar Typhi Ty2
cgauacgccccugcugg

SEQ ID NO: 1780738 - RNA, 14 nt, Salmonella enterica enterica serovar Typhi Ty2
cgauaaauaagaag

SEQ ID NO: 1780739 - RNA, 23 nt, Salmonella enterica enterica serovar Typhi Ty2
cgauaaagaacgcgccgaccauu

SEQ ID NO: 1780740 - RNA, 14 nt, Salmonella enterica enterica serovar Typhi Ty2
cgauaaacagauau

SEQ ID NO: 1780741 - RNA, 18 nt, Salmonella enterica enterica serovar Typhi Ty2
cgauaaaaacccaccagc

SEQ ID NO: 1780742 - RNA, 19 nt, Salmonella enterica enterica serovar Typhi Ty2
cgauaaaaacccaccagcg

SEQ ID NO: 1780743 - RNA, 12 nt, Salmonella enterica enterica serovar Typhi Ty2
ccuucauaaaua

SEQ ID NO: 1780744 - RNA, 23 nt, Salmonella enterica enterica serovar Typhi Ty2
ccuucauaaugaauacgcuccag

SEQ ID NO: 1780745 - RNA, 14 nt, Salmonella enterica enterica serovar Typhi Ty2
cgaucccuaauaaa

SEQ ID NO: 1780746 - RNA, 16 nt, Salmonella enterica enterica serovar Typhi Ty2
cgauccgaagaacaga

SEQ ID NO: 1780747 - RNA, 19 nt, Salmonella enterica enterica serovar Typhi Ty2
cgaucccgggcgauaaacc

SEQ ID NO: 1780748 - RNA, 21 nt, Salmonella enterica enterica serovar Typhi Ty2
cgauccggcauccaaccgaac

SEQ ID NO: 1780749 - RNA, 22 nt, Salmonella enterica enterica serovar Typhi Ty2
cgaucccaguugaucggccagc

SEQ ID NO: 1780750 - RNA, 19 nt, Salmonella enterica enterica serovar Typhi Ty2
cgaucaucccgcccagcaa

SEQ ID NO: 1780751 - RNA, 22 nt, Salmonella enterica enterica serovar Typhi Ty2
cgaucaucauuccgagggugga

SEQ ID NO: 1780752 - RNA, 15 nt, Salmonella enterica enterica serovar Typhi Ty2
cgaucagcgccacca

SEQ ID NO: 1780753 - RNA, 12 nt, Salmonella enterica enterica serovar Typhi Ty2
cgaucagcgcca

SEQ ID NO: 1780754 - RNA, 22 nt, Salmonella enterica enterica serovar Typhi Ty2
cgauauauuuuccguccaccug

SEQ ID NO: 1780755 - RNA, 14 nt, Salmonella enterica enterica serovar Typhi Ty2
cgauauauuuuccg

SEQ ID NO: 1780756 - RNA, 22 nt, Salmonella enterica enterica serovar Typhi Ty2
cgaugaaagagcgcgcgcgccu

SEQ ID NO: 1780757 - RNA, 14 nt, Salmonella enterica enterica serovar Typhi Ty2
cgaugacucccagu

SEQ ID NO: 1780758 - RNA, 17 nt, Salmonella enterica enterica serovar Typhi Ty2
cgaugagauaauaaaug

SEQ ID NO: 1780759 - RNA, 14 nt, Salmonella enterica enterica serovar Typhi Ty2
cgaugacgacuuuu

SEQ ID NO: 1780760 - RNA, 19 nt, Salmonella enterica enterica serovar Typhi Ty2
cgaucucauaaacgccugg

SEQ ID NO: 1780761 - RNA, 12 nt, Salmonella enterica enterica serovar Typhi Ty2
cgaucuauuuca

SEQ ID NO: 1780762 - RNA, 14 nt, Salmonella enterica enterica serovar Typhi Ty2
cgaucucccagccg

SEQ ID NO: 1780763 - RNA, 16 nt, Salmonella enterica enterica serovar Typhi Ty2
cgaucuccgccgucgu

SEQ ID NO: 1780764 - RNA, 18 nt, Salmonella enterica enterica serovar Typhi Ty2
cgaucguagcaucucuuc

SEQ ID NO: 1780765 - RNA, 15 nt, Salmonella enterica enterica serovar Typhi Ty2
cgaucguccgccucc

SEQ ID NO: 1780766 - RNA, 22 nt, Salmonella enterica enterica serovar Typhi Ty2
cgaucgcgccaucgauagucau

SEQ ID NO: 1780767 - RNA, 16 nt, Salmonella enterica enterica serovar Typhi Ty2
cgaucgcuaaucagga

SEQ ID NO: 1780768 - RNA, 18 nt, Salmonella enterica enterica serovar Typhi Ty2
cgaucgcucaacuccugc

SEQ ID NO: 1780769 - RNA, 23 nt, Salmonella enterica enterica serovar Typhi Ty2
cgaucgcuggacgucgucaccac

SEQ ID NO: 1780770 - RNA, 15 nt, Salmonella enterica enterica serovar Typhi Ty2
cgaugcgcuuuucca

SEQ ID NO: 1780771 - RNA, 21 nt, Salmonella enterica enterica serovar Typhi Ty2
cgaugauuauuguuaaaaaga

SEQ ID NO: 1780772 - RNA, 13 nt, Salmonella enterica enterica serovar Typhi Ty2
cgaugaucgauga

SEQ ID NO: 1780773 - RNA, 19 nt, Salmonella enterica enterica serovar Typhi Ty2
cgaugauaacgcgccgcgc

SEQ ID NO: 1780774 - RNA, 22 nt, Salmonella enterica enterica serovar Typhi Ty2
cgaugagcucguuauaagcuuu

SEQ ID NO: 1780775 - RNA, 19 nt, Salmonella enterica enterica serovar Typhi Ty2
cgaugagcgccagcaacag

SEQ ID NO: 1780776 - RNA, 20 nt, Salmonella enterica enterica serovar Typhi Ty2
cgauggccuguuuaagcuuu

SEQ ID NO: 1780777 - RNA, 16 nt, Salmonella enterica enterica serovar Typhi Ty2
cgauggcagugaugga

SEQ ID NO: 1780778 - RNA, 23 nt, Salmonella enterica enterica serovar Typhi Ty2
cgaugcucaaccaguaccgggcc

SEQ ID NO: 1780779 - RNA, 18 nt, Salmonella enterica enterica serovar Typhi Ty2
cgaugcuaugauggccga

SEQ ID NO: 1780780 - RNA, 23 nt, Salmonella enterica enterica serovar Typhi Ty2
cgaugcgguucaacgcgcugcag

SEQ ID NO: 1780781 - RNA, 19 nt, Salmonella enterica enterica serovar Typhi Ty2
cgaugcguucaaaaagcug

SEQ ID NO: 1780782 - RNA, 15 nt, Salmonella enterica enterica serovar Typhi Ty2
cgauggcgcuccuga

SEQ ID NO: 1780783 - RNA, 20 nt, Salmonella enterica enterica serovar Typhi Ty2
cgauggcgauuuucaccggc

SEQ ID NO: 1780784 - RNA, 18 nt, Salmonella enterica enterica serovar Typhi Ty2
cgauguauuuauccacgc

SEQ ID NO: 1780785 - RNA, 12 nt, Salmonella enterica enterica serovar Typhi Ty2
cgcaaaccgcuu

SEQ ID NO: 1780786 - RNA, 21 nt, Salmonella enterica enterica serovar Typhi Ty2
cgcaaacgccgugaacgccaa

SEQ ID NO: 1780787 - RNA, 18 nt, Salmonella enterica enterica serovar Typhi Ty2
cgcaaacgccugcuccgu

SEQ ID NO: 1780788 - RNA, 17 nt, Salmonella enterica enterica serovar Typhi Ty2
cgcaaacuggccacagc

SEQ ID NO: 1780789 - RNA, 22 nt, Salmonella enterica enterica serovar Typhi Ty2
cgcaaacuuugcgccauuucaa

SEQ ID NO: 1780790 - RNA, 19 nt, Salmonella enterica enterica serovar Typhi Ty2
cgcaaacugccaggcaauc

SEQ ID NO: 1780791 - RNA, 22 nt, Salmonella enterica enterica serovar Typhi Ty2
cgcaaaguuuucuuccgugccg

SEQ ID NO: 1780792 - RNA, 19 nt, Salmonella enterica enterica serovar Typhi Ty2
cgcaaagcaauguaaaacu

SEQ ID NO: 1780793 - RNA, 16 nt, Salmonella enterica enterica serovar Typhi Ty2
cgcaaaggaccaacac

SEQ ID NO: 1780794 - RNA, 17 nt, Salmonella enterica enterica serovar Typhi Ty2
cgcaaacagcacgcccu

SEQ ID NO: 1780795 - RNA, 16 nt, Salmonella enterica enterica serovar Typhi Ty2
cgauucaaucugguga

SEQ ID NO: 1780796 - RNA, 21 nt, Salmonella enterica enterica serovar Typhi Ty2
cgauuaaugcuccaauaaaua

SEQ ID NO: 1780797 - RNA, 17 nt, Salmonella enterica enterica serovar Typhi Ty2
cgauuaaugcuccaaua

SEQ ID NO: 1780798 - RNA, 16 nt, Salmonella enterica enterica serovar Typhi Ty2
cgcaacguuucuuuca

SEQ ID NO: 1780799 - RNA, 21 nt, Salmonella enterica enterica serovar Typhi Ty2
cgcaacguuucuuucaucaga

SEQ ID NO: 1780800 - RNA, 23 nt, Salmonella enterica enterica serovar Typhi Ty2
cgcaacguuucuuucaucagauc

SEQ ID NO: 1780801 - RNA, 16 nt, Salmonella enterica enterica serovar Typhi Ty2
cgcaacgucagcgauc

SEQ ID NO: 1780802 - RNA, 23 nt, Salmonella enterica enterica serovar Typhi Ty2
cgcaacgcuuaucaguccccaca

SEQ ID NO: 1780803 - RNA, 19 nt, Salmonella enterica enterica serovar Typhi Ty2
cgcaaauucaucgccgccg

SEQ ID NO: 1780804 - RNA, 21 nt, Salmonella enterica enterica serovar Typhi Ty2
cgcaauaaguucaaacucauu

SEQ ID NO: 1780805 - RNA, 19 nt, Salmonella enterica enterica serovar Typhi Ty2
cgcaauacagcccgccagc

SEQ ID NO: 1780806 - RNA, 22 nt, Salmonella enterica enterica serovar Typhi Ty2
cgcaaggcggcguuuuuuuauc

SEQ ID NO: 1780807 - RNA, 16 nt, Salmonella enterica enterica serovar Typhi Ty2
cgcacgccugcggccc

SEQ ID NO: 1780808 - RNA, 13 nt, Salmonella enterica enterica serovar Typhi Ty2
cgcacgcgcgccc

SEQ ID NO: 1780809 - RNA, 21 nt, Salmonella enterica enterica serovar Typhi Ty2
cgcacgcgucaucggcgcgcu

SEQ ID NO: 1780810 - RNA, 20 nt, Salmonella enterica enterica serovar Typhi Ty2
cgcacgccggccccgcuucc

SEQ ID NO: 1780811 - RNA, 18 nt, Salmonella enterica enterica serovar Typhi Ty2
cgcacagggugaaaucac

SEQ ID NO: 1780812 - RNA, 20 nt, Salmonella enterica enterica serovar Typhi Ty2
cgcacagggugaaaucacgc

SEQ ID NO: 1780813 - RNA, 15 nt, Salmonella enterica enterica serovar Typhi Ty2
cgcaccacgccgaag

SEQ ID NO: 1780814 - RNA, 12 nt, Salmonella enterica enterica serovar Typhi Ty2
cgcacagcgcca

SEQ ID NO: 1780815 - RNA, 23 nt, Salmonella enterica enterica serovar Typhi Ty2
cgcacagaaucgcuguggcauua

SEQ ID NO: 1780816 - RNA, 22 nt, Salmonella enterica enterica serovar Typhi Ty2
cgcacuggucgggcaggcuucc

SEQ ID NO: 1780817 - RNA, 19 nt, Salmonella enterica enterica serovar Typhi Ty2
cgcacugauagccgccagu

SEQ ID NO: 1780818 - RNA, 12 nt, Salmonella enterica enterica serovar Typhi Ty2
cgcacugccuga

SEQ ID NO: 1780819 - RNA, 20 nt, Salmonella enterica enterica serovar Typhi Ty2
cgcagcagauguggcggccc

SEQ ID NO: 1780820 - RNA, 14 nt, Salmonella enterica enterica serovar Typhi Ty2
cgcagccaacaaca

SEQ ID NO: 1780821 - RNA, 11 nt, Salmonella enterica enterica serovar Typhi Ty2
cgcagccagaa

SEQ ID NO: 1780822 - RNA, 14 nt, Salmonella enterica enterica serovar Typhi Ty2
cgcagccagcgccc

SEQ ID NO: 1780823 - RNA, 12 nt, Salmonella enterica enterica serovar Typhi Ty2
cgcagccccagc

SEQ ID NO: 1780824 - RNA, 22 nt, Salmonella enterica enterica serovar Typhi Ty2
cgcagcgaaaauccaguaauuu

SEQ ID NO: 1780825 - RNA, 13 nt, Salmonella enterica enterica serovar Typhi Ty2
cgcagcgcggcgc

SEQ ID NO: 1780826 - RNA, 14 nt, Salmonella enterica enterica serovar Typhi Ty2
cgcagcgccuucgc

SEQ ID NO: 1780827 - RNA, 15 nt, Salmonella enterica enterica serovar Typhi Ty2
cgcagcgauauuucu

SEQ ID NO: 1780828 - RNA, 21 nt, Salmonella enterica enterica serovar Typhi Ty2
cgcagcgaacucccgggcgcu

SEQ ID NO: 1780829 - RNA, 14 nt, Salmonella enterica enterica serovar Typhi Ty2
cgcaggagagccag

SEQ ID NO: 1780830 - RNA, 13 nt, Salmonella enterica enterica serovar Typhi Ty2
cgcaggagggagg

SEQ ID NO: 1780831 - RNA, 17 nt, Salmonella enterica enterica serovar Typhi Ty2
cgcaguugggcgcgcga

SEQ ID NO: 1780832 - RNA, 18 nt, Salmonella enterica enterica serovar Typhi Ty2
cgcagucagcacuggcga

SEQ ID NO: 1780833 - RNA, 15 nt, Salmonella enterica enterica serovar Typhi Ty2
cgcaguaaucaccgu

SEQ ID NO: 1780834 - RNA, 18 nt, Salmonella enterica enterica serovar Typhi Ty2
cgcaguaauacgccgccg

SEQ ID NO: 1780835 - RNA, 13 nt, Salmonella enterica enterica serovar Typhi Ty2
cggauaaccgacg

SEQ ID NO: 1780836 - RNA, 23 nt, Salmonella enterica enterica serovar Typhi Ty2
cggauaaacgcgucuucaucagc

SEQ ID NO: 1780837 - RNA, 22 nt, Salmonella enterica enterica serovar Typhi Ty2
cggauaaggccacgccgccauc

SEQ ID NO: 1780838 - RNA, 16 nt, Salmonella enterica enterica serovar Typhi Ty2
cggauaagcggcagcg

SEQ ID NO: 1780839 - RNA, 14 nt, Salmonella enterica enterica serovar Typhi Ty2
cggauaaguaaguu

SEQ ID NO: 1780840 - RNA, 22 nt, Salmonella enterica enterica serovar Typhi Ty2
cggauaaggcgcagccgccauc

SEQ ID NO: 1780841 - RNA, 18 nt, Salmonella enterica enterica serovar Typhi Ty2
cggauaaggcgcagccgc

SEQ ID NO: 1780842 - RNA, 23 nt, Salmonella enterica enterica serovar Typhi Ty2
cggauaagguguuuacgccgcca

SEQ ID NO: 1780843 - RNA, 18 nt, Salmonella enterica enterica serovar Typhi Ty2
cggaucgaucccggcaaa

SEQ ID NO: 1780844 - RNA, 19 nt, Salmonella enterica enterica serovar Typhi Ty2
cggaucgccgauaaagugg

SEQ ID NO: 1780845 - RNA, 22 nt, Salmonella enterica enterica serovar Typhi Ty2
cggaggauauuuauuauuucca

SEQ ID NO: 1780846 - RNA, 15 nt, Salmonella enterica enterica serovar Typhi Ty2
cggagcgucauuuuc

SEQ ID NO: 1780847 - RNA, 23 nt, Salmonella enterica enterica serovar Typhi Ty2
cggagcgcuuuuuuuaugcguua

SEQ ID NO: 1780848 - RNA, 18 nt, Salmonella enterica enterica serovar Typhi Ty2
cggaacuaacccgcagcc

SEQ ID NO: 1780849 - RNA, 19 nt, Salmonella enterica enterica serovar Typhi Ty2
cggaacuuuaucaccagcg

SEQ ID NO: 1780850 - RNA, 23 nt, Salmonella enterica enterica serovar Typhi Ty2
cggagaugaucguuuccagcauc

SEQ ID NO: 1780851 - RNA, 15 nt, Salmonella enterica enterica serovar Typhi Ty2
cggagaucuccagau

SEQ ID NO: 1780852 - RNA, 23 nt, Salmonella enterica enterica serovar Typhi Ty2
cggagauuaacagcgcgaccagc

SEQ ID NO: 1780853 - RNA, 22 nt, Salmonella enterica enterica serovar Typhi Ty2
cggagcaaaaaaugagaacacc

SEQ ID NO: 1780854 - RNA, 18 nt, Salmonella enterica enterica serovar Typhi Ty2
cggaaaugaaaaagauag

SEQ ID NO: 1780855 - RNA, 18 nt, Salmonella enterica enterica serovar Typhi Ty2
cggaaagggugcccgccu

SEQ ID NO: 1780856 - RNA, 16 nt, Salmonella enterica enterica serovar Typhi Ty2
cggaaagcuguuguug

SEQ ID NO: 1780857 - RNA, 23 nt, Salmonella enterica enterica serovar Typhi Ty2
cggaaaucacaaacaccaccagu

SEQ ID NO: 1780858 - RNA, 15 nt, Salmonella enterica enterica serovar Typhi Ty2
cggaaaucgcggcga

SEQ ID NO: 1780859 - RNA, 15 nt, Salmonella enterica enterica serovar Typhi Ty2
cggaugaucuucaua

SEQ ID NO: 1780860 - RNA, 15 nt, Salmonella enterica enterica serovar Typhi Ty2
cggaugacgccgcuu

SEQ ID NO: 1780861 - RNA, 16 nt, Salmonella enterica enterica serovar Typhi Ty2
cggaugaaacaguccg

SEQ ID NO: 1780862 - RNA, 17 nt, Salmonella enterica enterica serovar Typhi Ty2
cggaucggccauaucca

SEQ ID NO: 1780863 - RNA, 12 nt, Salmonella enterica enterica serovar Typhi Ty2
cggaugggcaga

SEQ ID NO: 1780864 - RNA, 23 nt, Salmonella enterica enterica serovar Typhi Ty2
cggauggcguuuagcuggcgggg

SEQ ID NO: 1780865 - RNA, 17 nt, Salmonella enterica enterica serovar Typhi Ty2
cggauggccugcucaau

SEQ ID NO: 1780866 - RNA, 16 nt, Salmonella enterica enterica serovar Typhi Ty2
cggauggaauuuugca

SEQ ID NO: 1780867 - RNA, 17 nt, Salmonella enterica enterica serovar Typhi Ty2
cggaugcgccaucccau

SEQ ID NO: 1780868 - RNA, 18 nt, Salmonella enterica enterica serovar Typhi Ty2
cggauugccgcgcucaau

SEQ ID NO: 1780869 - RNA, 14 nt, Salmonella enterica enterica serovar Typhi Ty2
cggauucuuccucu

SEQ ID NO: 1780870 - RNA, 16 nt, Salmonella enterica enterica serovar Typhi Ty2
cggauuauuggucagu

SEQ ID NO: 1780871 - RNA, 14 nt, Salmonella enterica enterica serovar Typhi Ty2
cggaugugcauuga

SEQ ID NO: 1780872 - RNA, 19 nt, Salmonella enterica enterica serovar Typhi Ty2
cggcaaaaaucagcccgga

SEQ ID NO: 1780873 - RNA, 18 nt, Salmonella enterica enterica serovar Typhi Ty2
cggcaaaaagaaucgcca

SEQ ID NO: 1780874 - RNA, 13 nt, Salmonella enterica enterica serovar Typhi Ty2
cggcaaaagaggc

SEQ ID NO: 1780875 - RNA, 24 nt, Salmonella enterica enterica serovar Typhi Ty2
cggauugccuucucugucgagcau

SEQ ID NO: 1780876 - RNA, 17 nt, Salmonella enterica enterica serovar Typhi Ty2
cggauuggucugauuca

SEQ ID NO: 1780877 - RNA, 19 nt, Salmonella enterica enterica serovar Typhi Ty2
cggauuuaccagcgcuucu

SEQ ID NO: 1780878 - RNA, 18 nt, Salmonella enterica enterica serovar Typhi Ty2
cggcacugcuuccugccg

SEQ ID NO: 1780879 - RNA, 15 nt, Salmonella enterica enterica serovar Typhi Ty2
cggcacgccagcgcc

SEQ ID NO: 1780880 - RNA, 17 nt, Salmonella enterica enterica serovar Typhi Ty2
cggcacgaaaaauaaaa

SEQ ID NO: 1780881 - RNA, 17 nt, Salmonella enterica enterica serovar Typhi Ty2
cggcaaagguugccgca

SEQ ID NO: 1780882 - RNA, 14 nt, Salmonella enterica enterica serovar Typhi Ty2
cggcaaagucuuca

SEQ ID NO: 1780883 - RNA, 14 nt, Salmonella enterica enterica serovar Typhi Ty2
cggcaaauucuuuu

SEQ ID NO: 1780884 - RNA, 20 nt, Salmonella enterica enterica serovar Typhi Ty2
cggcaaauucuuuucacgca

SEQ ID NO: 1780885 - RNA, 13 nt, Salmonella enterica enterica serovar Typhi Ty2
cggcaaacucagc

SEQ ID NO: 1780886 - RNA, 21 nt, Salmonella enterica enterica serovar Typhi Ty2
cggcaaacgggcgaccgucgg

SEQ ID NO: 1780887 - RNA, 13 nt, Salmonella enterica enterica serovar Typhi Ty2
cggcaaagaaaaa

SEQ ID NO: 1780888 - RNA, 17 nt, Salmonella enterica enterica serovar Typhi Ty2
cggcaaagaccaauaaa

SEQ ID NO: 1780889 - RNA, 17 nt, Salmonella enterica enterica serovar Typhi Ty2
cggcacauccagcgccu

SEQ ID NO: 1780890 - RNA, 17 nt, Salmonella enterica enterica serovar Typhi Ty2
cggcacauucaccacgc

SEQ ID NO: 1780891 - RNA, 20 nt, Salmonella enterica enterica serovar Typhi Ty2
cggcacauucaccacgcagc

SEQ ID NO: 1780892 - RNA, 15 nt, Salmonella enterica enterica serovar Typhi Ty2
cggcaccacauuaaa

SEQ ID NO: 1780893 - RNA, 21 nt, Salmonella enterica enterica serovar Typhi Ty2
cggcaccagcgaugcgcgcgc

SEQ ID NO: 1780894 - RNA, 20 nt, Salmonella enterica enterica serovar Typhi Ty2
cggcaccauguggcgcggcc

SEQ ID NO: 1780895 - RNA, 20 nt, Salmonella enterica enterica serovar Typhi Ty2
cggcaguccuugcagccaga

SEQ ID NO: 1780896 - RNA, 23 nt, Salmonella enterica enterica serovar Typhi Ty2
cggcaggugauggcggcuuggcu

SEQ ID NO: 1780897 - RNA, 16 nt, Salmonella enterica enterica serovar Typhi Ty2
cggcauacugucgcgc

SEQ ID NO: 1780898 - RNA, 19 nt, Salmonella enterica enterica serovar Typhi Ty2
cggcauacugucgcgcggc

SEQ ID NO: 1780899 - RNA, 18 nt, Salmonella enterica enterica serovar Typhi Ty2
cggcauauucccugacug

SEQ ID NO: 1780900 - RNA, 16 nt, Salmonella enterica enterica serovar Typhi Ty2
cggcaucacaggcuua

SEQ ID NO: 1780901 - RNA, 14 nt, Salmonella enterica enterica serovar Typhi Ty2
cggcaucagauggc

SEQ ID NO: 1780902 - RNA, 17 nt, Salmonella enterica enterica serovar Typhi Ty2
cggcagugcggugguau

SEQ ID NO: 1780903 - RNA, 20 nt, Salmonella enterica enterica serovar Typhi Ty2
cggcaguguuucccaacaau

SEQ ID NO: 1780904 - RNA, 15 nt, Salmonella enterica enterica serovar Typhi Ty2
cggcaggcagcgcca

SEQ ID NO: 1780905 - RNA, 20 nt, Salmonella enterica enterica serovar Typhi Ty2
cggcaggccggagcugauac

SEQ ID NO: 1780906 - RNA, 17 nt, Salmonella enterica enterica serovar Typhi Ty2
cggcagccgccaccaca

SEQ ID NO: 1780907 - RNA, 17 nt, Salmonella enterica enterica serovar Typhi Ty2
cggcagaccggcagccu

SEQ ID NO: 1780908 - RNA, 19 nt, Salmonella enterica enterica serovar Typhi Ty2
cggcagacgauagcgggug

SEQ ID NO: 1780909 - RNA, 13 nt, Salmonella enterica enterica serovar Typhi Ty2
cggcagcgcgccg

SEQ ID NO: 1780910 - RNA, 13 nt, Salmonella enterica enterica serovar Typhi Ty2
cggcagcgcgcac

SEQ ID NO: 1780911 - RNA, 19 nt, Salmonella enterica enterica serovar Typhi Ty2
cggcagcgcgacauagagc

SEQ ID NO: 1780912 - RNA, 18 nt, Salmonella enterica enterica serovar Typhi Ty2
cggccuccgcuuccugcg

SEQ ID NO: 1780913 - RNA, 13 nt, Salmonella enterica enterica serovar Typhi Ty2
cggccuccgguga

SEQ ID NO: 1780914 - RNA, 15 nt, Salmonella enterica enterica serovar Typhi Ty2
cggccuacaacucag

SEQ ID NO: 1780915 - RNA, 19 nt, Salmonella enterica enterica serovar Typhi Ty2
cggccugaaucagcaucuu

SEQ ID NO: 1780916 - RNA, 18 nt, Salmonella enterica enterica serovar Typhi Ty2
cggccugcaaaccgccuc

SEQ ID NO: 1780917 - RNA, 20 nt, Salmonella enterica enterica serovar Typhi Ty2
cggccugcaaaccgccucgc

SEQ ID NO: 1780918 - RNA, 16 nt, Salmonella enterica enterica serovar Typhi Ty2
cggccuggcucuuccg

SEQ ID NO: 1780919 - RNA, 14 nt, Salmonella enterica enterica serovar Typhi Ty2
cggccuggcgcagc

SEQ ID NO: 1780920 - RNA, 12 nt, Salmonella enterica enterica serovar Typhi Ty2
cggccuggcccg

SEQ ID NO: 1780921 - RNA, 14 nt, Salmonella enterica enterica serovar Typhi Ty2
cggccuggcccggc

SEQ ID NO: 1780922 - RNA, 16 nt, Salmonella enterica enterica serovar Typhi Ty2
cggccugcgguguaga

SEQ ID NO: 1780923 - RNA, 23 nt, Salmonella enterica enterica serovar Typhi Ty2
cggccucuucacgcagcgccuua

SEQ ID NO: 1780924 - RNA, 18 nt, Salmonella enterica enterica serovar Typhi Ty2
cggcccgugccagcuauc

SEQ ID NO: 1780925 - RNA, 23 nt, Salmonella enterica enterica serovar Typhi Ty2
cggcccgcuucauuggcgucugc

SEQ ID NO: 1780926 - RNA, 19 nt, Salmonella enterica enterica serovar Typhi Ty2
cggcccgcuaucaccgccc

SEQ ID NO: 1780927 - RNA, 14 nt, Salmonella enterica enterica serovar Typhi Ty2
cggcccgcauugaa

SEQ ID NO: 1780928 - RNA, 18 nt, Salmonella enterica enterica serovar Typhi Ty2
cggcccccggccauagcg

SEQ ID NO: 1780929 - RNA, 13 nt, Salmonella enterica enterica serovar Typhi Ty2
cggcccccggcca

SEQ ID NO: 1780930 - RNA, 14 nt, Salmonella enterica enterica serovar Typhi Ty2
cggccagcgcaggc

SEQ ID NO: 1780931 - RNA, 22 nt, Salmonella enterica enterica serovar Typhi Ty2
cggcaucaucuaccuucacgca

SEQ ID NO: 1780932 - RNA, 22 nt, Salmonella enterica enterica serovar Typhi Ty2
cggcaucaagcauaaaccggcg

SEQ ID NO: 1780933 - RNA, 14 nt, Salmonella enterica enterica serovar Typhi Ty2
cggcaucaggaaaa

SEQ ID NO: 1780934 - RNA, 18 nt, Salmonella enterica enterica serovar Typhi Ty2
cggccaguagcgggggcc

SEQ ID NO: 1780935 - RNA, 19 nt, Salmonella enterica enterica serovar Typhi Ty2
cggccagcgccagcguaga

SEQ ID NO: 1780936 - RNA, 19 nt, Salmonella enterica enterica serovar Typhi Ty2
cggccaguguacauagcuu

SEQ ID NO: 1780937 - RNA, 16 nt, Salmonella enterica enterica serovar Typhi Ty2
cggccauuaacacaca

SEQ ID NO: 1780938 - RNA, 15 nt, Salmonella enterica enterica serovar Typhi Ty2
cggcccacgcgcaga

SEQ ID NO: 1780939 - RNA, 15 nt, Salmonella enterica enterica serovar Typhi Ty2
cgcguccauuacucu

SEQ ID NO: 1780940 - RNA, 13 nt, Salmonella enterica enterica serovar Typhi Ty2
cgcgucccucucc

SEQ ID NO: 1780941 - RNA, 15 nt, Salmonella enterica enterica serovar Typhi Ty2
cgcgguugucggcgc

SEQ ID NO: 1780942 - RNA, 12 nt, Salmonella enterica enterica serovar Typhi Ty2
cgcgguuuaucc

SEQ ID NO: 1780943 - RNA, 17 nt, Salmonella enterica enterica serovar Typhi Ty2
cgcgucagggcaaggcg

SEQ ID NO: 1780944 - RNA, 19 nt, Salmonella enterica enterica serovar Typhi Ty2
cgcguaaacuuccgccagc

SEQ ID NO: 1780945 - RNA, 20 nt, Salmonella enterica enterica serovar Typhi Ty2
cgcguaaauccacauuccag

SEQ ID NO: 1780946 - RNA, 15 nt, Salmonella enterica enterica serovar Typhi Ty2
cgcguccagcccgcu

SEQ ID NO: 1780947 - RNA, 23 nt, Salmonella enterica enterica serovar Typhi Ty2
cgcggugacuuuggccggcuucu

SEQ ID NO: 1780948 - RNA, 15 nt, Salmonella enterica enterica serovar Typhi Ty2
cgcggucgccugccg

SEQ ID NO: 1780949 - RNA, 22 nt, Salmonella enterica enterica serovar Typhi Ty2
cgcggucgggauauaugcaaaa

SEQ ID NO: 1780950 - RNA, 12 nt, Salmonella enterica enterica serovar Typhi Ty2
cgcggucagcgg

SEQ ID NO: 1780951 - RNA, 14 nt, Salmonella enterica enterica serovar Typhi Ty2
cgcggucagcggcg

SEQ ID NO: 1780952 - RNA, 23 nt, Salmonella enterica enterica serovar Typhi Ty2
cgcggucagggugaaucccgcca

SEQ ID NO: 1780953 - RNA, 19 nt, Salmonella enterica enterica serovar Typhi Ty2
cgcgguauuucgccgccgc

SEQ ID NO: 1780954 - RNA, 22 nt, Salmonella enterica enterica serovar Typhi Ty2
cgcuauguaagguucccugcgc

SEQ ID NO: 1780955 - RNA, 13 nt, Salmonella enterica enterica serovar Typhi Ty2
cgcucacgauaac

SEQ ID NO: 1780956 - RNA, 16 nt, Salmonella enterica enterica serovar Typhi Ty2
cgcucagccagaaacg

SEQ ID NO: 1780957 - RNA, 13 nt, Salmonella enterica enterica serovar Typhi Ty2
cgcucagcgccgu

SEQ ID NO: 1780958 - RNA, 21 nt, Salmonella enterica enterica serovar Typhi Ty2
cgcucagcgccguagcggcag

SEQ ID NO: 1780959 - RNA, 19 nt, Salmonella enterica enterica serovar Typhi Ty2
cgcuaucugcuccgccagc

SEQ ID NO: 1780960 - RNA, 18 nt, Salmonella enterica enterica serovar Typhi Ty2
cgcuaugcccaccgcgcg

SEQ ID NO: 1780961 - RNA, 16 nt, Salmonella enterica enterica serovar Typhi Ty2
cgcuaugcuuaccauc

SEQ ID NO: 1780962 - RNA, 15 nt, Salmonella enterica enterica serovar Typhi Ty2
cgcuauccggcgcgc

SEQ ID NO: 1780963 - RNA, 14 nt, Salmonella enterica enterica serovar Typhi Ty2
cgcuacuucagggg

SEQ ID NO: 1780964 - RNA, 18 nt, Salmonella enterica enterica serovar Typhi Ty2
cgcuauccaggccgucgg

SEQ ID NO: 1780965 - RNA, 16 nt, Salmonella enterica enterica serovar Typhi Ty2
cgcuacugccgccauc

SEQ ID NO: 1780966 - RNA, 16 nt, Salmonella enterica enterica serovar Typhi Ty2
cgcuacguuuaucugg

SEQ ID NO: 1780967 - RNA, 20 nt, Salmonella enterica enterica serovar Typhi Ty2
cgcuacgcuuaucaggccua

SEQ ID NO: 1780968 - RNA, 23 nt, Salmonella enterica enterica serovar Typhi Ty2
cgcuaaaccacaugaccagcgcc

SEQ ID NO: 1780969 - RNA, 14 nt, Salmonella enterica enterica serovar Typhi Ty2
cgcuaaccaucagc

SEQ ID NO: 1780970 - RNA, 13 nt, Salmonella enterica enterica serovar Typhi Ty2
cgcguuuuccauu

SEQ ID NO: 1780971 - RNA, 15 nt, Salmonella enterica enterica serovar Typhi Ty2
cgcguuuaucaccaa

SEQ ID NO: 1780972 - RNA, 12 nt, Salmonella enterica enterica serovar Typhi Ty2
cgcgucgcuguu

SEQ ID NO: 1780973 - RNA, 17 nt, Salmonella enterica enterica serovar Typhi Ty2
cgcggcuuauccggcuu

SEQ ID NO: 1780974 - RNA, 23 nt, Salmonella enterica enterica serovar Typhi Ty2
cgcggcucaccagcugacgcagc

SEQ ID NO: 1780975 - RNA, 14 nt, Salmonella enterica enterica serovar Typhi Ty2
cgcggcucaccagc

SEQ ID NO: 1780976 - RNA, 14 nt, Salmonella enterica enterica serovar Typhi Ty2
cgcggcgcucgcca

SEQ ID NO: 1780977 - RNA, 22 nt, Salmonella enterica enterica serovar Typhi Ty2
cgcggcgcugaguuucucccgc

SEQ ID NO: 1780978 - RNA, 21 nt, Salmonella enterica enterica serovar Typhi Ty2
cgcgccgcuggcgaccagccu

SEQ ID NO: 1780979 - RNA, 18 nt, Salmonella enterica enterica serovar Typhi Ty2
cgcgccgcugcuuagcag

SEQ ID NO: 1780980 - RNA, 14 nt, Salmonella enterica enterica serovar Typhi Ty2
cgcggaucggcaca

SEQ ID NO: 1780981 - RNA, 14 nt, Salmonella enterica enterica serovar Typhi Ty2
cgcggcaucaagca

SEQ ID NO: 1780982 - RNA, 20 nt, Salmonella enterica enterica serovar Typhi Ty2
cgcggcaucguagucaggca

SEQ ID NO: 1780983 - RNA, 19 nt, Salmonella enterica enterica serovar Typhi Ty2
cgcggcaaccagcccauga

SEQ ID NO: 1780984 - RNA, 15 nt, Salmonella enterica enterica serovar Typhi Ty2
cgcggauugccgccc

SEQ ID NO: 1780985 - RNA, 13 nt, Salmonella enterica enterica serovar Typhi Ty2
cgcggccaaaacc

SEQ ID NO: 1780986 - RNA, 20 nt, Salmonella enterica enterica serovar Typhi Ty2
cgcggccaaaacccaccagc

SEQ ID NO: 1780987 - RNA, 16 nt, Salmonella enterica enterica serovar Typhi Ty2
cgcggccaaaacccac

SEQ ID NO: 1780988 - RNA, 15 nt, Salmonella enterica enterica serovar Typhi Ty2
cgcugucggcgccca

SEQ ID NO: 1780989 - RNA, 23 nt, Salmonella enterica enterica serovar Typhi Ty2
cgcuguccagauagggccaggcg

SEQ ID NO: 1780990 - RNA, 23 nt, Salmonella enterica enterica serovar Typhi Ty2
cgcuuaaucaguugcaggaaggu

SEQ ID NO: 1780991 - RNA, 20 nt, Salmonella enterica enterica serovar Typhi Ty2
cgcuuaauggcgucaaucaa

SEQ ID NO: 1780992 - RNA, 20 nt, Salmonella enterica enterica serovar Typhi Ty2
cgcuguuaugcacgcgcggc

SEQ ID NO: 1780993 - RNA, 15 nt, Salmonella enterica enterica serovar Typhi Ty2
cgcuguucuugcugc

SEQ ID NO: 1780994 - RNA, 19 nt, Salmonella enterica enterica serovar Typhi Ty2
cgcuggcggcccgcauuga

SEQ ID NO: 1780995 - RNA, 14 nt, Salmonella enterica enterica serovar Typhi Ty2
cgcuguaacccgcc

SEQ ID NO: 1780996 - RNA, 15 nt, Salmonella enterica enterica serovar Typhi Ty2
cgcuguaacccgccg

SEQ ID NO: 1780997 - RNA, 14 nt, Salmonella enterica enterica serovar Typhi Ty2
cgcugguuccccgu

SEQ ID NO: 1780998 - RNA, 15 nt, Salmonella enterica enterica serovar Typhi Ty2
cgcugguuggcgcgc

SEQ ID NO: 1780999 - RNA, 12 nt, Salmonella enterica enterica serovar Typhi Ty2
cgcuuucaaucg

SEQ ID NO: 1781000 - RNA, 21 nt, Salmonella enterica enterica serovar Typhi Ty2
cgcuuuaggguaucauuucca

SEQ ID NO: 1781001 - RNA, 15 nt, Salmonella enterica enterica serovar Typhi Ty2
cgcuuuaccgccuuc

SEQ ID NO: 1781002 - RNA, 17 nt, Salmonella enterica enterica serovar Typhi Ty2
cgcuuuaccgccuuccu

SEQ ID NO: 1781003 - RNA, 16 nt, Salmonella enterica enterica serovar Typhi Ty2
cgcuugugccugcugc

SEQ ID NO: 1781004 - RNA, 18 nt, Salmonella enterica enterica serovar Typhi Ty2
cgcuuacaauuuaucugc

SEQ ID NO: 1781005 - RNA, 16 nt, Salmonella enterica enterica serovar Typhi Ty2
cgcuuacaauuuaucu

SEQ ID NO: 1781006 - RNA, 17 nt, Salmonella enterica enterica serovar Typhi Ty2
cgcuuacaauuuaucug

SEQ ID NO: 1781007 - RNA, 21 nt, Salmonella enterica enterica serovar Typhi Ty2
cgcuuaccacuuugcgcuccu

SEQ ID NO: 1781008 - RNA, 14 nt, Salmonella enterica enterica serovar Typhi Ty2
cgcuuaccgggccu

SEQ ID NO: 1781009 - RNA, 18 nt, Salmonella enterica enterica serovar Typhi Ty2
cgcuuacucagccagaua

SEQ ID NO: 1781010 - RNA, 19 nt, Salmonella enterica enterica serovar Typhi Ty2
cgcuuacucagccagauac

SEQ ID NO: 1781011 - RNA, 18 nt, Salmonella enterica enterica serovar Typhi Ty2
cgcuuacgcggcgcgcuc

SEQ ID NO: 1781012 - RNA, 16 nt, Salmonella enterica enterica serovar Typhi Ty2
cgcuuacgcuccugcg

SEQ ID NO: 1781013 - RNA, 20 nt, Salmonella enterica enterica serovar Typhi Ty2
cgcuuacgcuuacccggccu

SEQ ID NO: 1781014 - RNA, 14 nt, Salmonella enterica enterica serovar Typhi Ty2
cgcuuaucaggccu

SEQ ID NO: 1781015 - RNA, 17 nt, Salmonella enterica enterica serovar Typhi Ty2
cgcuugauacgccaucu

SEQ ID NO: 1781016 - RNA, 17 nt, Salmonella enterica enterica serovar Typhi Ty2
cgcuugauccagcucgc

SEQ ID NO: 1781017 - RNA, 14 nt, Salmonella enterica enterica serovar Typhi Ty2
cgcuugauacgcca

SEQ ID NO: 1781018 - RNA, 14 nt, Salmonella enterica enterica serovar Typhi Ty2
cgcuuauccggccu

SEQ ID NO: 1781019 - RNA, 13 nt, Salmonella enterica enterica serovar Typhi Ty2
cgcuugcauggca

SEQ ID NO: 1781020 - RNA, 14 nt, Salmonella enterica enterica serovar Typhi Ty2
cgcuuuuuucucug

SEQ ID NO: 1781021 - RNA, 14 nt, Salmonella enterica enterica serovar Typhi Ty2
cggaaaccccaggu

SEQ ID NO: 1781022 - RNA, 17 nt, Salmonella enterica enterica serovar Typhi Ty2
cggaaacuauccuggcc

SEQ ID NO: 1781023 - RNA, 20 nt, Salmonella enterica enterica serovar Typhi Ty2
cggaaacgucauuuuuucaa

SEQ ID NO: 1781024 - RNA, 16 nt, Salmonella enterica enterica serovar Typhi Ty2
cgcuuucaguaauaau

SEQ ID NO: 1781025 - RNA, 23 nt, Salmonella enterica enterica serovar Typhi Ty2
cgcuuuccggggugaauuuuuug

SEQ ID NO: 1781026 - RNA, 20 nt, Salmonella enterica enterica serovar Typhi Ty2
cgcuuuugccgcgacuuccg

SEQ ID NO: 1781027 - RNA, 13 nt, Salmonella enterica enterica serovar Typhi Ty2
cgcuuuuccccgc

SEQ ID NO: 1781028 - RNA, 23 nt, Salmonella enterica enterica serovar Typhi Ty2
cgcuuuuuuaacgauuuccccug
